United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 31

SEQ ID NO: 1121052 - RNA, 18 nt, Mycobacterium bovis subsp bovis AF2122/97
ccacgcucggugcugcgc

SEQ ID NO: 1121053 - RNA, 13 nt, Mycobacterium bovis subsp bovis AF2122/97
ccaccggugccgc

SEQ ID NO: 1121054 - RNA, 15 nt, Mycobacterium bovis subsp bovis AF2122/97
ccaccggugccgccc

SEQ ID NO: 1121055 - RNA, 20 nt, Mycobacterium bovis subsp bovis AF2122/97
ccaccggugccgcccgcgcc

SEQ ID NO: 1121056 - RNA, 14 nt, Mycobacterium bovis subsp bovis AF2122/97
ccaccggugccggc

SEQ ID NO: 1121057 - RNA, 15 nt, Mycobacterium bovis subsp bovis AF2122/97
ccaccggugccggcg

SEQ ID NO: 1121058 - RNA, 17 nt, Mycobacterium bovis subsp bovis AF2122/97
ccaccgguccagcgccg

SEQ ID NO: 1121059 - RNA, 14 nt, Mycobacterium bovis subsp bovis AF2122/97
ccaccggucgccgc

SEQ ID NO: 1121060 - RNA, 18 nt, Mycobacterium bovis subsp bovis AF2122/97
ccaccgucaccgccguca

SEQ ID NO: 1121061 - RNA, 20 nt, Mycobacterium bovis subsp bovis AF2122/97
ccaccguaaacagcgcgccg

SEQ ID NO: 1121062 - RNA, 21 nt, Mycobacterium bovis subsp bovis AF2122/97
ccaccguaaacagcgcgccgg

SEQ ID NO: 1121063 - RNA, 15 nt, Mycobacterium bovis subsp bovis AF2122/97
ccaccguagacgaca

SEQ ID NO: 1121064 - RNA, 20 nt, Mycobacterium bovis subsp bovis AF2122/97
ccaccguagacgacaucguc

SEQ ID NO: 1121065 - RNA, 16 nt, Mycobacterium bovis subsp bovis AF2122/97
ccacgcuggccucguc

SEQ ID NO: 1121066 - RNA, 22 nt, Mycobacterium bovis subsp bovis AF2122/97
ccacgcugucccgcgggccagc

SEQ ID NO: 1121067 - RNA, 18 nt, Mycobacterium bovis subsp bovis AF2122/97
ccacgcuuaacagcgggu

SEQ ID NO: 1121068 - RNA, 20 nt, Mycobacterium bovis subsp bovis AF2122/97
ccacgcuuaacagcgggucc

SEQ ID NO: 1121069 - RNA, 21 nt, Mycobacterium bovis subsp bovis AF2122/97
ccacggaaguaucgccggccg

SEQ ID NO: 1121070 - RNA, 22 nt, Mycobacterium bovis subsp bovis AF2122/97
ccacggaaguaucgccggccgc

SEQ ID NO: 1121071 - RNA, 18 nt, Mycobacterium bovis subsp bovis AF2122/97
ccacgcuucuuccgcgcg

SEQ ID NO: 1121072 - RNA, 20 nt, Mycobacterium bovis subsp bovis AF2122/97
ccacgcuucuuccgcgcgcc

SEQ ID NO: 1121073 - RNA, 21 nt, Mycobacterium bovis subsp bovis AF2122/97
ccacggacgugacgucguggc

SEQ ID NO: 1121074 - RNA, 13 nt, Mycobacterium bovis subsp bovis AF2122/97
ccacggaccagcg

SEQ ID NO: 1121075 - RNA, 14 nt, Mycobacterium bovis subsp bovis AF2122/97
ccacggaccagcgc

SEQ ID NO: 1121076 - RNA, 17 nt, Mycobacterium bovis subsp bovis AF2122/97
ccacggacgugacgucg

SEQ ID NO: 1121077 - RNA, 16 nt, Mycobacterium bovis subsp bovis AF2122/97
ccacggcagccaaccg

SEQ ID NO: 1121078 - RNA, 18 nt, Mycobacterium bovis subsp bovis AF2122/97
ccacggcagccaaccggc

SEQ ID NO: 1121079 - RNA, 20 nt, Mycobacterium bovis subsp bovis AF2122/97
ccacggcagccaaccggcgc

SEQ ID NO: 1121080 - RNA, 21 nt, Mycobacterium bovis subsp bovis AF2122/97
ccacggcagccaaccggcgca

SEQ ID NO: 1121081 - RNA, 14 nt, Mycobacterium bovis subsp bovis AF2122/97
ccacggcagcgccc

SEQ ID NO: 1121082 - RNA, 18 nt, Mycobacterium bovis subsp bovis AF2122/97
ccacggcagcgccggucg

SEQ ID NO: 1121083 - RNA, 23 nt, Mycobacterium bovis subsp bovis AF2122/97
ccacggcaggcagggcagcccgg

SEQ ID NO: 1121084 - RNA, 20 nt, Mycobacterium bovis subsp bovis AF2122/97
ccacggcaagccaaccagcc

SEQ ID NO: 1121085 - RNA, 15 nt, Mycobacterium bovis subsp bovis AF2122/97
ccacggagggcagga

SEQ ID NO: 1121086 - RNA, 22 nt, Mycobacterium bovis subsp bovis AF2122/97
ccacggaggguugccgccgacu

SEQ ID NO: 1121087 - RNA, 20 nt, Mycobacterium bovis subsp bovis AF2122/97
ccagaaguaggcgaccgcca

SEQ ID NO: 1121088 - RNA, 15 nt, Mycobacterium bovis subsp bovis AF2122/97
ccagaagccggccac

SEQ ID NO: 1121089 - RNA, 13 nt, Mycobacterium bovis subsp bovis AF2122/97
ccagaaggccgca

SEQ ID NO: 1121090 - RNA, 19 nt, Mycobacterium bovis subsp bovis AF2122/97
ccagaaggccgcaccgcca

SEQ ID NO: 1121091 - RNA, 20 nt, Mycobacterium bovis subsp bovis AF2122/97
ccagaaggccggggcggaac

SEQ ID NO: 1121092 - RNA, 20 nt, Mycobacterium bovis subsp bovis AF2122/97
ccagaaccuggagccgugcg

SEQ ID NO: 1121093 - RNA, 14 nt, Mycobacterium bovis subsp bovis AF2122/97
ccagaacggcgauc

SEQ ID NO: 1121094 - RNA, 15 nt, Mycobacterium bovis subsp bovis AF2122/97
ccagaacccggacag

SEQ ID NO: 1121095 - RNA, 16 nt, Mycobacterium bovis subsp bovis AF2122/97
ccagaaacccggcgac

SEQ ID NO: 1121096 - RNA, 23 nt, Mycobacterium bovis subsp bovis AF2122/97
ccagacggugcagcuccccgccg

SEQ ID NO: 1121097 - RNA, 19 nt, Mycobacterium bovis subsp bovis AF2122/97
ccagacguuccaucacgga

SEQ ID NO: 1121098 - RNA, 21 nt, Mycobacterium bovis subsp bovis AF2122/97
ccagagacaugucgcugccgc

SEQ ID NO: 1121099 - RNA, 23 nt, Mycobacterium bovis subsp bovis AF2122/97
ccagagacaugucgcugccgccg

SEQ ID NO: 1121100 - RNA, 22 nt, Mycobacterium bovis subsp bovis AF2122/97
ccagaauuccggcggagcgggc

SEQ ID NO: 1121101 - RNA, 12 nt, Mycobacterium bovis subsp bovis AF2122/97
ccagaaugucgc

SEQ ID NO: 1121102 - RNA, 16 nt, Mycobacterium bovis subsp bovis AF2122/97
ccacugaucaggccga

SEQ ID NO: 1121103 - RNA, 19 nt, Mycobacterium bovis subsp bovis AF2122/97
ccacugaucaggccgauga

SEQ ID NO: 1121104 - RNA, 15 nt, Mycobacterium bovis subsp bovis AF2122/97
ccacuguuacggcca

SEQ ID NO: 1121105 - RNA, 20 nt, Mycobacterium bovis subsp bovis AF2122/97
ccacugcaugaacugcucgc

SEQ ID NO: 1121106 - RNA, 17 nt, Mycobacterium bovis subsp bovis AF2122/97
ccacuguuacggccaca

SEQ ID NO: 1121107 - RNA, 14 nt, Mycobacterium bovis subsp bovis AF2122/97
ccacucgccgagcu

SEQ ID NO: 1121108 - RNA, 20 nt, Mycobacterium bovis subsp bovis AF2122/97
ccacucgucgaacaccgucc

SEQ ID NO: 1121109 - RNA, 16 nt, Mycobacterium bovis subsp bovis AF2122/97
ccacucuucgggcggc

SEQ ID NO: 1121110 - RNA, 17 nt, Mycobacterium bovis subsp bovis AF2122/97
ccacucucgccacgccg

SEQ ID NO: 1121111 - RNA, 21 nt, Mycobacterium bovis subsp bovis AF2122/97
ccacugacgucucaucaaacc

SEQ ID NO: 1121112 - RNA, 17 nt, Mycobacterium bovis subsp bovis AF2122/97
ccacucgaucaccggca

SEQ ID NO: 1121113 - RNA, 21 nt, Mycobacterium bovis subsp bovis AF2122/97
ccacgucgaccgaacccgacg

SEQ ID NO: 1121114 - RNA, 22 nt, Mycobacterium bovis subsp bovis AF2122/97
ccacgucgaucagugcaagacc

SEQ ID NO: 1121115 - RNA, 21 nt, Mycobacterium bovis subsp bovis AF2122/97
ccacguccaucaccggcggcc

SEQ ID NO: 1121116 - RNA, 14 nt, Mycobacterium bovis subsp bovis AF2122/97
ccacguccucagcc

SEQ ID NO: 1121117 - RNA, 13 nt, Mycobacterium bovis subsp bovis AF2122/97
ccacguccugccc

SEQ ID NO: 1121118 - RNA, 17 nt, Mycobacterium bovis subsp bovis AF2122/97
ccacguccugcccgucg

SEQ ID NO: 1121119 - RNA, 16 nt, Mycobacterium bovis subsp bovis AF2122/97
ccacucgagcgcucac

SEQ ID NO: 1121120 - RNA, 17 nt, Mycobacterium bovis subsp bovis AF2122/97
ccacuucagaucggcga

SEQ ID NO: 1121121 - RNA, 19 nt, Mycobacterium bovis subsp bovis AF2122/97
ccacuuccacggcgugguc

SEQ ID NO: 1121122 - RNA, 23 nt, Mycobacterium bovis subsp bovis AF2122/97
ccacuucgcuuucccgucggcgg

SEQ ID NO: 1121123 - RNA, 13 nt, Mycobacterium bovis subsp bovis AF2122/97
ccacuucggcguc

SEQ ID NO: 1121124 - RNA, 15 nt, Mycobacterium bovis subsp bovis AF2122/97
ccagaaaaccgccgc

SEQ ID NO: 1121125 - RNA, 17 nt, Mycobacterium bovis subsp bovis AF2122/97
ccacuuuucgguggcgg

SEQ ID NO: 1121126 - RNA, 17 nt, Mycobacterium bovis subsp bovis AF2122/97
ccagccgucaccgcgac

SEQ ID NO: 1121127 - RNA, 16 nt, Mycobacterium bovis subsp bovis AF2122/97
ccagccgucaccgcga

SEQ ID NO: 1121128 - RNA, 20 nt, Mycobacterium bovis subsp bovis AF2122/97
ccagccggugagcgagcgcg

SEQ ID NO: 1121129 - RNA, 21 nt, Mycobacterium bovis subsp bovis AF2122/97
ccagccggugagcgagcgcgc

SEQ ID NO: 1121130 - RNA, 11 nt, Mycobacterium bovis subsp bovis AF2122/97
ccagccgguga

SEQ ID NO: 1121131 - RNA, 24 nt, Mycobacterium bovis subsp bovis AF2122/97
ccagccgguccagacccagcucgu

SEQ ID NO: 1121132 - RNA, 20 nt, Mycobacterium bovis subsp bovis AF2122/97
ccagccggucuuggacagca

SEQ ID NO: 1121133 - RNA, 15 nt, Mycobacterium bovis subsp bovis AF2122/97
ccagccggcgcacuc

SEQ ID NO: 1121134 - RNA, 13 nt, Mycobacterium bovis subsp bovis AF2122/97
ccagccggcagca

SEQ ID NO: 1121135 - RNA, 16 nt, Mycobacterium bovis subsp bovis AF2122/97
ccagccggcgcacucc

SEQ ID NO: 1121136 - RNA, 15 nt, Mycobacterium bovis subsp bovis AF2122/97
ccagccgggagucgu

SEQ ID NO: 1121137 - RNA, 18 nt, Mycobacterium bovis subsp bovis AF2122/97
ccagccgguagccgggca

SEQ ID NO: 1121138 - RNA, 22 nt, Mycobacterium bovis subsp bovis AF2122/97
ccagccggcgaaugcgguccuc

SEQ ID NO: 1121139 - RNA, 20 nt, Mycobacterium bovis subsp bovis AF2122/97
ccagccggaccgcgacggcg

SEQ ID NO: 1121140 - RNA, 21 nt, Mycobacterium bovis subsp bovis AF2122/97
ccagccggaccgcgacggcgc

SEQ ID NO: 1121141 - RNA, 17 nt, Mycobacterium bovis subsp bovis AF2122/97
ccagccggcagcagcgg

SEQ ID NO: 1121142 - RNA, 17 nt, Mycobacterium bovis subsp bovis AF2122/97
ccagcaugacaccggcc

SEQ ID NO: 1121143 - RNA, 18 nt, Mycobacterium bovis subsp bovis AF2122/97
ccagcaugacaccggcca

SEQ ID NO: 1121144 - RNA, 19 nt, Mycobacterium bovis subsp bovis AF2122/97
ccagcaugaagucccggau

SEQ ID NO: 1121145 - RNA, 14 nt, Mycobacterium bovis subsp bovis AF2122/97
ccagcaucggugcg

SEQ ID NO: 1121146 - RNA, 19 nt, Mycobacterium bovis subsp bovis AF2122/97
ccagcaucggugcgggcgc

SEQ ID NO: 1121147 - RNA, 19 nt, Mycobacterium bovis subsp bovis AF2122/97
ccagcaucuuuggcggccg

SEQ ID NO: 1121148 - RNA, 20 nt, Mycobacterium bovis subsp bovis AF2122/97
ccagcaucuuuggcggccgc

SEQ ID NO: 1121149 - RNA, 18 nt, Mycobacterium bovis subsp bovis AF2122/97
ccagcgaaaugcccauca

SEQ ID NO: 1121150 - RNA, 18 nt, Mycobacterium bovis subsp bovis AF2122/97
ccagccuuuuucgacaag

SEQ ID NO: 1121151 - RNA, 19 nt, Mycobacterium bovis subsp bovis AF2122/97
ccagccuaccggcuacggc

SEQ ID NO: 1121152 - RNA, 22 nt, Mycobacterium bovis subsp bovis AF2122/97
ccagccucaucugaggcuucca

SEQ ID NO: 1121153 - RNA, 22 nt, Mycobacterium bovis subsp bovis AF2122/97
ccagccguggugguugaucagc

SEQ ID NO: 1121154 - RNA, 14 nt, Mycobacterium bovis subsp bovis AF2122/97
ccagccguggcggc

SEQ ID NO: 1121155 - RNA, 19 nt, Mycobacterium bovis subsp bovis AF2122/97
ccagccguggcggcgggcc

SEQ ID NO: 1121156 - RNA, 20 nt, Mycobacterium bovis subsp bovis AF2122/97
ccagccguggcggcgggccu

SEQ ID NO: 1121157 - RNA, 16 nt, Mycobacterium bovis subsp bovis AF2122/97
ccagccgugcggcggc

SEQ ID NO: 1121158 - RNA, 17 nt, Mycobacterium bovis subsp bovis AF2122/97
ccagccgucgucaggug

SEQ ID NO: 1121159 - RNA, 20 nt, Mycobacterium bovis subsp bovis AF2122/97
ccagcgacgaccacaccacg

SEQ ID NO: 1121160 - RNA, 23 nt, Mycobacterium bovis subsp bovis AF2122/97
ccagcgaccaggucgccagcucg

SEQ ID NO: 1121161 - RNA, 16 nt, Mycobacterium bovis subsp bovis AF2122/97
ccagcgauaucggcgg

SEQ ID NO: 1121162 - RNA, 18 nt, Mycobacterium bovis subsp bovis AF2122/97
ccagcgaucccggugagg

SEQ ID NO: 1121163 - RNA, 18 nt, Mycobacterium bovis subsp bovis AF2122/97
ccagcgaaucgcugguga

SEQ ID NO: 1121164 - RNA, 18 nt, Mycobacterium bovis subsp bovis AF2122/97
ccagcgaauccagccgcg

SEQ ID NO: 1121165 - RNA, 19 nt, Mycobacterium bovis subsp bovis AF2122/97
ccagcgaauccagccgcgc

SEQ ID NO: 1121166 - RNA, 22 nt, Mycobacterium bovis subsp bovis AF2122/97
ccagcgaaccgacccggccgcu

SEQ ID NO: 1121167 - RNA, 23 nt, Mycobacterium bovis subsp bovis AF2122/97
ccagcgaaucacccgcgagaucg

SEQ ID NO: 1121168 - RNA, 17 nt, Mycobacterium bovis subsp bovis AF2122/97
ccagcgacaacaccacg

SEQ ID NO: 1121169 - RNA, 21 nt, Mycobacterium bovis subsp bovis AF2122/97
ccagcgacaacaccacggugc

SEQ ID NO: 1121170 - RNA, 20 nt, Mycobacterium bovis subsp bovis AF2122/97
ccagcgacaugucgaacgcc

SEQ ID NO: 1121171 - RNA, 14 nt, Mycobacterium bovis subsp bovis AF2122/97
ccagcgauucagcc

SEQ ID NO: 1121172 - RNA, 15 nt, Mycobacterium bovis subsp bovis AF2122/97
ccagcgcaagguugc

SEQ ID NO: 1121173 - RNA, 19 nt, Mycobacterium bovis subsp bovis AF2122/97
ccagcgcaagguugccaac

SEQ ID NO: 1121174 - RNA, 14 nt, Mycobacterium bovis subsp bovis AF2122/97
ccagcgcgagcccg

SEQ ID NO: 1121175 - RNA, 17 nt, Mycobacterium bovis subsp bovis AF2122/97
ccagcgcgcugcgcgac

SEQ ID NO: 1121176 - RNA, 14 nt, Mycobacterium bovis subsp bovis AF2122/97
ccagcgcgcuggga

SEQ ID NO: 1121177 - RNA, 16 nt, Mycobacterium bovis subsp bovis AF2122/97
ccagcgcccgccggca

SEQ ID NO: 1121178 - RNA, 19 nt, Mycobacterium bovis subsp bovis AF2122/97
ccagcgcccgcgcggccac

SEQ ID NO: 1121179 - RNA, 13 nt, Mycobacterium bovis subsp bovis AF2122/97
ccagcgcccgccg

SEQ ID NO: 1121180 - RNA, 15 nt, Mycobacterium bovis subsp bovis AF2122/97
ccagcgccuugacgc

SEQ ID NO: 1121181 - RNA, 13 nt, Mycobacterium bovis subsp bovis AF2122/97
ccagcgcggcgag

SEQ ID NO: 1121182 - RNA, 22 nt, Mycobacterium bovis subsp bovis AF2122/97
ccagcgcgguguagagcgcacc

SEQ ID NO: 1121183 - RNA, 18 nt, Mycobacterium bovis subsp bovis AF2122/97
ccagcgcuuugaugccga

SEQ ID NO: 1121184 - RNA, 15 nt, Mycobacterium bovis subsp bovis AF2122/97
ccagcggagcgcccu

SEQ ID NO: 1121185 - RNA, 16 nt, Mycobacterium bovis subsp bovis AF2122/97
ccagcggaaucaccga

SEQ ID NO: 1121186 - RNA, 22 nt, Mycobacterium bovis subsp bovis AF2122/97
ccagcgcugucguaccgcggau

SEQ ID NO: 1121187 - RNA, 21 nt, Mycobacterium bovis subsp bovis AF2122/97
ccagcgcuagccgggcgcgcc

SEQ ID NO: 1121188 - RNA, 16 nt, Mycobacterium bovis subsp bovis AF2122/97
ccagcgcuccagcacc

SEQ ID NO: 1121189 - RNA, 17 nt, Mycobacterium bovis subsp bovis AF2122/97
ccaggacccaucgccag

SEQ ID NO: 1121190 - RNA, 15 nt, Mycobacterium bovis subsp bovis AF2122/97
ccaggaccgcgccga

SEQ ID NO: 1121191 - RNA, 18 nt, Mycobacterium bovis subsp bovis AF2122/97
ccaggaccgcgccgauca

SEQ ID NO: 1121192 - RNA, 20 nt, Mycobacterium bovis subsp bovis AF2122/97
ccaggacggaucgucgugca

SEQ ID NO: 1121193 - RNA, 17 nt, Mycobacterium bovis subsp bovis AF2122/97
ccaggaccggcugcagg

SEQ ID NO: 1121194 - RNA, 13 nt, Mycobacterium bovis subsp bovis AF2122/97
ccaggacgacgcc

SEQ ID NO: 1121195 - RNA, 13 nt, Mycobacterium bovis subsp bovis AF2122/97
ccaggacuccggc

SEQ ID NO: 1121196 - RNA, 17 nt, Mycobacterium bovis subsp bovis AF2122/97
ccaggacuccggccgca

SEQ ID NO: 1121197 - RNA, 17 nt, Mycobacterium bovis subsp bovis AF2122/97
ccaggacuggcaccgcc

SEQ ID NO: 1121198 - RNA, 22 nt, Mycobacterium bovis subsp bovis AF2122/97
ccaggacuggcaccgccagcca

SEQ ID NO: 1121199 - RNA, 18 nt, Mycobacterium bovis subsp bovis AF2122/97
ccaggagcauuuggccga

SEQ ID NO: 1121200 - RNA, 16 nt, Mycobacterium bovis subsp bovis AF2122/97
ccaggagccgaggaau

SEQ ID NO: 1121201 - RNA, 23 nt, Mycobacterium bovis subsp bovis AF2122/97
ccaggaaucccucggccgcaggc

SEQ ID NO: 1121202 - RNA, 23 nt, Mycobacterium bovis subsp bovis AF2122/97
ccaggacaccuugcguccguagc

SEQ ID NO: 1121203 - RNA, 17 nt, Mycobacterium bovis subsp bovis AF2122/97
ccaggaacggcucggcc

SEQ ID NO: 1121204 - RNA, 15 nt, Mycobacterium bovis subsp bovis AF2122/97
ccaggaacgggacgc

SEQ ID NO: 1121205 - RNA, 19 nt, Mycobacterium bovis subsp bovis AF2122/97
ccaggaacgggacgccgug

SEQ ID NO: 1121206 - RNA, 20 nt, Mycobacterium bovis subsp bovis AF2122/97
ccagcuuggcgucgaugcgg

SEQ ID NO: 1121207 - RNA, 14 nt, Mycobacterium bovis subsp bovis AF2122/97
ccagcuugucgggc

SEQ ID NO: 1121208 - RNA, 13 nt, Mycobacterium bovis subsp bovis AF2122/97
ccaggaacccgug

SEQ ID NO: 1121209 - RNA, 16 nt, Mycobacterium bovis subsp bovis AF2122/97
ccagcuugcgcaacgu

SEQ ID NO: 1121210 - RNA, 17 nt, Mycobacterium bovis subsp bovis AF2122/97
ccagcuugcgccgcagc

SEQ ID NO: 1121211 - RNA, 17 nt, Mycobacterium bovis subsp bovis AF2122/97
ccagcugggcagccaga

SEQ ID NO: 1121212 - RNA, 22 nt, Mycobacterium bovis subsp bovis AF2122/97
ccagcuggcgauacagcgacag

SEQ ID NO: 1121213 - RNA, 19 nt, Mycobacterium bovis subsp bovis AF2122/97
ccagcugugaacaggccga

SEQ ID NO: 1121214 - RNA, 21 nt, Mycobacterium bovis subsp bovis AF2122/97
ccagcugcucgucgucgaucc

SEQ ID NO: 1121215 - RNA, 18 nt, Mycobacterium bovis subsp bovis AF2122/97
ccagcugcgcagcgcaac

SEQ ID NO: 1121216 - RNA, 18 nt, Mycobacterium bovis subsp bovis AF2122/97
ccagcugcagcagacccg

SEQ ID NO: 1121217 - RNA, 17 nt, Mycobacterium bovis subsp bovis AF2122/97
ccagcugacggcgcaac

SEQ ID NO: 1121218 - RNA, 18 nt, Mycobacterium bovis subsp bovis AF2122/97
ccagcugagcggccggca

SEQ ID NO: 1121219 - RNA, 15 nt, Mycobacterium bovis subsp bovis AF2122/97
ccagcugagcuggca

SEQ ID NO: 1121220 - RNA, 17 nt, Mycobacterium bovis subsp bovis AF2122/97
ccagcugagccgucggc

SEQ ID NO: 1121221 - RNA, 20 nt, Mycobacterium bovis subsp bovis AF2122/97
ccagcugagccgucggcgcc

SEQ ID NO: 1121222 - RNA, 12 nt, Mycobacterium bovis subsp bovis AF2122/97
ccagcucgucgc

SEQ ID NO: 1121223 - RNA, 20 nt, Mycobacterium bovis subsp bovis AF2122/97
ccagcucgcugcgcgcccac

SEQ ID NO: 1121224 - RNA, 18 nt, Mycobacterium bovis subsp bovis AF2122/97
ccagcucggcacccgccg

SEQ ID NO: 1121225 - RNA, 19 nt, Mycobacterium bovis subsp bovis AF2122/97
ccagcucggcacccgccgg

SEQ ID NO: 1121226 - RNA, 16 nt, Mycobacterium bovis subsp bovis AF2122/97
ccagcucggccagcug

SEQ ID NO: 1121227 - RNA, 14 nt, Mycobacterium bovis subsp bovis AF2122/97
ccagcucggccagu

SEQ ID NO: 1121228 - RNA, 15 nt, Mycobacterium bovis subsp bovis AF2122/97
ccagcucggccagug

SEQ ID NO: 1121229 - RNA, 14 nt, Mycobacterium bovis subsp bovis AF2122/97
ccagcucgcgcacc

SEQ ID NO: 1121230 - RNA, 14 nt, Mycobacterium bovis subsp bovis AF2122/97
ccagcucgcugcgc

SEQ ID NO: 1121231 - RNA, 14 nt, Mycobacterium bovis subsp bovis AF2122/97
ccagcucgcgggcc

SEQ ID NO: 1121232 - RNA, 16 nt, Mycobacterium bovis subsp bovis AF2122/97
ccagcucgcgggccgc

SEQ ID NO: 1121233 - RNA, 19 nt, Mycobacterium bovis subsp bovis AF2122/97
ccagcucgcgcacccagcc

SEQ ID NO: 1121234 - RNA, 20 nt, Mycobacterium bovis subsp bovis AF2122/97
ccagcucggugcuguugcgc

SEQ ID NO: 1121235 - RNA, 22 nt, Mycobacterium bovis subsp bovis AF2122/97
ccagcucgggggcgccggcgcc

SEQ ID NO: 1121236 - RNA, 21 nt, Mycobacterium bovis subsp bovis AF2122/97
ccagcucggugaucaccauga

SEQ ID NO: 1121237 - RNA, 16 nt, Mycobacterium bovis subsp bovis AF2122/97
ccagcucgucgacguc

SEQ ID NO: 1121238 - RNA, 17 nt, Mycobacterium bovis subsp bovis AF2122/97
ccagcucgucgacgucg

SEQ ID NO: 1121239 - RNA, 13 nt, Mycobacterium bovis subsp bovis AF2122/97
ccagcuccggcgc

SEQ ID NO: 1121240 - RNA, 16 nt, Mycobacterium bovis subsp bovis AF2122/97
ccagcucccgggcggc

SEQ ID NO: 1121241 - RNA, 23 nt, Mycobacterium bovis subsp bovis AF2122/97
ccagcuccucgugcucggccaga

SEQ ID NO: 1121242 - RNA, 19 nt, Mycobacterium bovis subsp bovis AF2122/97
ccagcuccucagccaccgc

SEQ ID NO: 1121243 - RNA, 21 nt, Mycobacterium bovis subsp bovis AF2122/97
ccagcuccucagccaccgcgg

SEQ ID NO: 1121244 - RNA, 22 nt, Mycobacterium bovis subsp bovis AF2122/97
ccagcuccgggucgacgacguc

SEQ ID NO: 1121245 - RNA, 14 nt, Mycobacterium bovis subsp bovis AF2122/97
ccagcuccucagcc

SEQ ID NO: 1121246 - RNA, 16 nt, Mycobacterium bovis subsp bovis AF2122/97
ccagcuccucagccac

SEQ ID NO: 1121247 - RNA, 13 nt, Mycobacterium bovis subsp bovis AF2122/97
ccagcggcggccc

SEQ ID NO: 1121248 - RNA, 22 nt, Mycobacterium bovis subsp bovis AF2122/97
ccagcggcgggggcgucgccgc

SEQ ID NO: 1121249 - RNA, 15 nt, Mycobacterium bovis subsp bovis AF2122/97
ccagcguggggccgc

SEQ ID NO: 1121250 - RNA, 17 nt, Mycobacterium bovis subsp bovis AF2122/97
ccagcguggggccgcca

SEQ ID NO: 1121251 - RNA, 21 nt, Mycobacterium bovis subsp bovis AF2122/97
ccagcggcaauggccagcacc

SEQ ID NO: 1121252 - RNA, 15 nt, Mycobacterium bovis subsp bovis AF2122/97
ccagcggcgagucca

SEQ ID NO: 1121253 - RNA, 13 nt, Mycobacterium bovis subsp bovis AF2122/97
ccagcggccgcga

SEQ ID NO: 1121254 - RNA, 18 nt, Mycobacterium bovis subsp bovis AF2122/97
ccagcggcaauggccagc

SEQ ID NO: 1121255 - RNA, 22 nt, Mycobacterium bovis subsp bovis AF2122/97
ccagcgugucuugucgcgcagc

SEQ ID NO: 1121256 - RNA, 23 nt, Mycobacterium bovis subsp bovis AF2122/97
ccagcguguggagcucgcggcgc

SEQ ID NO: 1121257 - RNA, 23 nt, Mycobacterium bovis subsp bovis AF2122/97
ccagcguggugaagucggugccg

SEQ ID NO: 1121258 - RNA, 21 nt, Mycobacterium bovis subsp bovis AF2122/97
ccagcguggugauccggucuc

SEQ ID NO: 1121259 - RNA, 14 nt, Mycobacterium bovis subsp bovis AF2122/97
ccagcguguccgcc

SEQ ID NO: 1121260 - RNA, 19 nt, Mycobacterium bovis subsp bovis AF2122/97
ccagcguuaggucgccggc

SEQ ID NO: 1121261 - RNA, 20 nt, Mycobacterium bovis subsp bovis AF2122/97
ccagcguuggcggcgaucca

SEQ ID NO: 1121262 - RNA, 16 nt, Mycobacterium bovis subsp bovis AF2122/97
ccagcguucccgccgg

SEQ ID NO: 1121263 - RNA, 17 nt, Mycobacterium bovis subsp bovis AF2122/97
ccagcguuugcuggcgg

SEQ ID NO: 1121264 - RNA, 21 nt, Mycobacterium bovis subsp bovis AF2122/97
ccagcguuugaacgcaugcga

SEQ ID NO: 1121265 - RNA, 16 nt, Mycobacterium bovis subsp bovis AF2122/97
ccagcucagcugcgga

SEQ ID NO: 1121266 - RNA, 21 nt, Mycobacterium bovis subsp bovis AF2122/97
caugcguuggggcacgacgcc

SEQ ID NO: 1121267 - RNA, 23 nt, Mycobacterium bovis subsp bovis AF2122/97
caugcguuggggcacgacgccgg

SEQ ID NO: 1121268 - RNA, 23 nt, Mycobacterium bovis subsp bovis AF2122/97
caugcgguuuggaucacccgccg

SEQ ID NO: 1121269 - RNA, 16 nt, Mycobacterium bovis subsp bovis AF2122/97
caugcuaggaccacca

SEQ ID NO: 1121270 - RNA, 13 nt, Mycobacterium bovis subsp bovis AF2122/97
caugcuaggccac

SEQ ID NO: 1121271 - RNA, 16 nt, Mycobacterium bovis subsp bovis AF2122/97
caugcucagcaucguc

SEQ ID NO: 1121272 - RNA, 15 nt, Mycobacterium bovis subsp bovis AF2122/97
caugcuaggaccacc

SEQ ID NO: 1121273 - RNA, 22 nt, Mycobacterium bovis subsp bovis AF2122/97
caugcgguuagcagccgcugau

SEQ ID NO: 1121274 - RNA, 21 nt, Mycobacterium bovis subsp bovis AF2122/97
caugcggguaaaccagguggc

SEQ ID NO: 1121275 - RNA, 19 nt, Mycobacterium bovis subsp bovis AF2122/97
caugcgcuccggcgcgacg

SEQ ID NO: 1121276 - RNA, 19 nt, Mycobacterium bovis subsp bovis AF2122/97
caugcggaucggcggaccg

SEQ ID NO: 1121277 - RNA, 18 nt, Mycobacterium bovis subsp bovis AF2122/97
caugccgcccgcgccgcc

SEQ ID NO: 1121278 - RNA, 12 nt, Mycobacterium bovis subsp bovis AF2122/97
caugccgcccgc

SEQ ID NO: 1121279 - RNA, 12 nt, Mycobacterium bovis subsp bovis AF2122/97
caugccgcggcg

SEQ ID NO: 1121280 - RNA, 12 nt, Mycobacterium bovis subsp bovis AF2122/97
caugcccggcgg

SEQ ID NO: 1121281 - RNA, 23 nt, Mycobacterium bovis subsp bovis AF2122/97
caugcccgggaugacugggcaaa

SEQ ID NO: 1121282 - RNA, 12 nt, Mycobacterium bovis subsp bovis AF2122/97
caugccggcgug

SEQ ID NO: 1121283 - RNA, 19 nt, Mycobacterium bovis subsp bovis AF2122/97
caugccggcuagcucggcg

SEQ ID NO: 1121284 - RNA, 21 nt, Mycobacterium bovis subsp bovis AF2122/97
caugccggcuagcucggcggc

SEQ ID NO: 1121285 - RNA, 20 nt, Mycobacterium bovis subsp bovis AF2122/97
caugccggauaggucgggca

SEQ ID NO: 1121286 - RNA, 15 nt, Mycobacterium bovis subsp bovis AF2122/97
caugccgcucggcaa

SEQ ID NO: 1121287 - RNA, 11 nt, Mycobacterium bovis subsp bovis AF2122/97
caugccggcga

SEQ ID NO: 1121288 - RNA, 20 nt, Mycobacterium bovis subsp bovis AF2122/97
caugccggcgaagccggccg

SEQ ID NO: 1121289 - RNA, 17 nt, Mycobacterium bovis subsp bovis AF2122/97
caugccccgaccgcgua

SEQ ID NO: 1121290 - RNA, 16 nt, Mycobacterium bovis subsp bovis AF2122/97
caugcccagcgcacgg

SEQ ID NO: 1121291 - RNA, 21 nt, Mycobacterium bovis subsp bovis AF2122/97
caugcccagaaaaccgccgca

SEQ ID NO: 1121292 - RNA, 20 nt, Mycobacterium bovis subsp bovis AF2122/97
caugcccaggugcguccagg

SEQ ID NO: 1121293 - RNA, 15 nt, Mycobacterium bovis subsp bovis AF2122/97
caugcccaugauggc

SEQ ID NO: 1121294 - RNA, 15 nt, Mycobacterium bovis subsp bovis AF2122/97
caugcaccgaugccg

SEQ ID NO: 1121295 - RNA, 14 nt, Mycobacterium bovis subsp bovis AF2122/97
caugcacgucaucg

SEQ ID NO: 1121296 - RNA, 22 nt, Mycobacterium bovis subsp bovis AF2122/97
caugcacguugccgaacgucgc

SEQ ID NO: 1121297 - RNA, 20 nt, Mycobacterium bovis subsp bovis AF2122/97
caugauugccaggaccgcgc

SEQ ID NO: 1121298 - RNA, 16 nt, Mycobacterium bovis subsp bovis AF2122/97
caugcaaaagccgcga

SEQ ID NO: 1121299 - RNA, 17 nt, Mycobacterium bovis subsp bovis AF2122/97
caugcaagccgacaucg

SEQ ID NO: 1121300 - RNA, 19 nt, Mycobacterium bovis subsp bovis AF2122/97
caugcaagccgacaucggc

SEQ ID NO: 1121301 - RNA, 20 nt, Mycobacterium bovis subsp bovis AF2122/97
caugcaagucaaacgccguc

SEQ ID NO: 1121302 - RNA, 22 nt, Mycobacterium bovis subsp bovis AF2122/97
caucggcgaggccucggcggcc

SEQ ID NO: 1121303 - RNA, 20 nt, Mycobacterium bovis subsp bovis AF2122/97
caucggccuguucgccgucg

SEQ ID NO: 1121304 - RNA, 21 nt, Mycobacterium bovis subsp bovis AF2122/97
caucggcgccagaucgacgcc

SEQ ID NO: 1121305 - RNA, 18 nt, Mycobacterium bovis subsp bovis AF2122/97
caucggcggcaacggcgg

SEQ ID NO: 1121306 - RNA, 23 nt, Mycobacterium bovis subsp bovis AF2122/97
caucggcggcaaggguggugacg

SEQ ID NO: 1121307 - RNA, 13 nt, Mycobacterium bovis subsp bovis AF2122/97
caucggcggcccu

SEQ ID NO: 1121308 - RNA, 15 nt, Mycobacterium bovis subsp bovis AF2122/97
caucggcggcgucga

SEQ ID NO: 1121309 - RNA, 22 nt, Mycobacterium bovis subsp bovis AF2122/97
caucggcgggucugggucaggc

SEQ ID NO: 1121310 - RNA, 18 nt, Mycobacterium bovis subsp bovis AF2122/97
caucggcuaggccggccg

SEQ ID NO: 1121311 - RNA, 13 nt, Mycobacterium bovis subsp bovis AF2122/97
caugucggugagg

SEQ ID NO: 1121312 - RNA, 17 nt, Mycobacterium bovis subsp bovis AF2122/97
caugucgcugccgccgc

SEQ ID NO: 1121313 - RNA, 17 nt, Mycobacterium bovis subsp bovis AF2122/97
caugucgggccgcucga

SEQ ID NO: 1121314 - RNA, 18 nt, Mycobacterium bovis subsp bovis AF2122/97
caugucucgggcgcgggu

SEQ ID NO: 1121315 - RNA, 14 nt, Mycobacterium bovis subsp bovis AF2122/97
cauguggccgccgu

SEQ ID NO: 1121316 - RNA, 16 nt, Mycobacterium bovis subsp bovis AF2122/97
cauguggccgccgucg

SEQ ID NO: 1121317 - RNA, 18 nt, Mycobacterium bovis subsp bovis AF2122/97
cauguggccgccgucgac

SEQ ID NO: 1121318 - RNA, 21 nt, Mycobacterium bovis subsp bovis AF2122/97
caugugacaucgggccgccga

SEQ ID NO: 1121319 - RNA, 17 nt, Mycobacterium bovis subsp bovis AF2122/97
caugugaccggcgaucg

SEQ ID NO: 1121320 - RNA, 22 nt, Mycobacterium bovis subsp bovis AF2122/97
cauguuccccgucgccagggcc

SEQ ID NO: 1121321 - RNA, 18 nt, Mycobacterium bovis subsp bovis AF2122/97
cauguuccuugcggccgc

SEQ ID NO: 1121322 - RNA, 23 nt, Mycobacterium bovis subsp bovis AF2122/97
cauguuccuugcggccgcugauc

SEQ ID NO: 1121323 - RNA, 15 nt, Mycobacterium bovis subsp bovis AF2122/97
caugugggugaacac

SEQ ID NO: 1121324 - RNA, 16 nt, Mycobacterium bovis subsp bovis AF2122/97
cauguggucaacggcc

SEQ ID NO: 1121325 - RNA, 16 nt, Mycobacterium bovis subsp bovis AF2122/97
caugugguggcgccgg

SEQ ID NO: 1121326 - RNA, 21 nt, Mycobacterium bovis subsp bovis AF2122/97
caugugguggcgccggccggu

SEQ ID NO: 1121327 - RNA, 15 nt, Mycobacterium bovis subsp bovis AF2122/97
cauguagaguaucga

SEQ ID NO: 1121328 - RNA, 16 nt, Mycobacterium bovis subsp bovis AF2122/97
cauguagcggucguag

SEQ ID NO: 1121329 - RNA, 17 nt, Mycobacterium bovis subsp bovis AF2122/97
caugucgggccaggcga

SEQ ID NO: 1121330 - RNA, 17 nt, Mycobacterium bovis subsp bovis AF2122/97
caugucggccaccggcg

SEQ ID NO: 1121331 - RNA, 14 nt, Mycobacterium bovis subsp bovis AF2122/97
caugucggccgggg

SEQ ID NO: 1121332 - RNA, 14 nt, Mycobacterium bovis subsp bovis AF2122/97
caugucggcgcgcc

SEQ ID NO: 1121333 - RNA, 17 nt, Mycobacterium bovis subsp bovis AF2122/97
caugucggcgcgccgca

SEQ ID NO: 1121334 - RNA, 13 nt, Mycobacterium bovis subsp bovis AF2122/97
caugucggccacc

SEQ ID NO: 1121335 - RNA, 14 nt, Mycobacterium bovis subsp bovis AF2122/97
caugucggccaccg

SEQ ID NO: 1121336 - RNA, 16 nt, Mycobacterium bovis subsp bovis AF2122/97
cauggugggucgacga

SEQ ID NO: 1121337 - RNA, 16 nt, Mycobacterium bovis subsp bovis AF2122/97
caugguggcgccgacc

SEQ ID NO: 1121338 - RNA, 20 nt, Mycobacterium bovis subsp bovis AF2122/97
caugguggcgccgaccugga

SEQ ID NO: 1121339 - RNA, 20 nt, Mycobacterium bovis subsp bovis AF2122/97
caugggggcguuggcgggcu

SEQ ID NO: 1121340 - RNA, 16 nt, Mycobacterium bovis subsp bovis AF2122/97
cauggugggugccggc

SEQ ID NO: 1121341 - RNA, 19 nt, Mycobacterium bovis subsp bovis AF2122/97
cauggugucuccuuguugu

SEQ ID NO: 1121342 - RNA, 15 nt, Mycobacterium bovis subsp bovis AF2122/97
cauguaccgaccgcg

SEQ ID NO: 1121343 - RNA, 18 nt, Mycobacterium bovis subsp bovis AF2122/97
cauggcgaaccgucagcg

SEQ ID NO: 1121344 - RNA, 23 nt, Mycobacterium bovis subsp bovis AF2122/97
cauggcgaaccgucagcgcgccg

SEQ ID NO: 1121345 - RNA, 18 nt, Mycobacterium bovis subsp bovis AF2122/97
cauggcgaacacgucggc

SEQ ID NO: 1121346 - RNA, 19 nt, Mycobacterium bovis subsp bovis AF2122/97
cauggcgaacacgucggcc

SEQ ID NO: 1121347 - RNA, 23 nt, Mycobacterium bovis subsp bovis AF2122/97
cauggccugauuccacugggccu

SEQ ID NO: 1121348 - RNA, 23 nt, Mycobacterium bovis subsp bovis AF2122/97
caugcuggaaguugugcgcacuc

SEQ ID NO: 1121349 - RNA, 23 nt, Mycobacterium bovis subsp bovis AF2122/97
caugcucaccgaaacgaugcggc

SEQ ID NO: 1121350 - RNA, 18 nt, Mycobacterium bovis subsp bovis AF2122/97
caugcucgacgcccgcca

SEQ ID NO: 1121351 - RNA, 22 nt, Mycobacterium bovis subsp bovis AF2122/97
caugcucgacgcccgccaccgg

SEQ ID NO: 1121352 - RNA, 14 nt, Mycobacterium bovis subsp bovis AF2122/97
caugcucgaucgcg

SEQ ID NO: 1121353 - RNA, 22 nt, Mycobacterium bovis subsp bovis AF2122/97
cauggggcuauggcgcagcugg

SEQ ID NO: 1121354 - RNA, 16 nt, Mycobacterium bovis subsp bovis AF2122/97
cauggguagccgccca

SEQ ID NO: 1121355 - RNA, 20 nt, Mycobacterium bovis subsp bovis AF2122/97
caugggcgcguagcucagcg

SEQ ID NO: 1121356 - RNA, 20 nt, Mycobacterium bovis subsp bovis AF2122/97
cauggcgagcguuuggacgg

SEQ ID NO: 1121357 - RNA, 21 nt, Mycobacterium bovis subsp bovis AF2122/97
cauggcgaguacggccugccg

SEQ ID NO: 1121358 - RNA, 22 nt, Mycobacterium bovis subsp bovis AF2122/97
cauggcgaguacggccugccgc

SEQ ID NO: 1121359 - RNA, 19 nt, Mycobacterium bovis subsp bovis AF2122/97
cauggcuagggcgaugagg

SEQ ID NO: 1121360 - RNA, 19 nt, Mycobacterium bovis subsp bovis AF2122/97
cauggcuuuugcgccgaau

SEQ ID NO: 1121361 - RNA, 19 nt, Mycobacterium bovis subsp bovis AF2122/97
cauucggcgagccgcgccc

SEQ ID NO: 1121362 - RNA, 19 nt, Mycobacterium bovis subsp bovis AF2122/97
cauucggucagccagccca

SEQ ID NO: 1121363 - RNA, 13 nt, Mycobacterium bovis subsp bovis AF2122/97
cauucggcggcgg

SEQ ID NO: 1121364 - RNA, 14 nt, Mycobacterium bovis subsp bovis AF2122/97
cauucgggcgcccu

SEQ ID NO: 1121365 - RNA, 18 nt, Mycobacterium bovis subsp bovis AF2122/97
cauucgggcgugcucgcc

SEQ ID NO: 1121366 - RNA, 20 nt, Mycobacterium bovis subsp bovis AF2122/97
cauucgcaccaccugggcgg

SEQ ID NO: 1121367 - RNA, 13 nt, Mycobacterium bovis subsp bovis AF2122/97
cauucgcgggccg

SEQ ID NO: 1121368 - RNA, 16 nt, Mycobacterium bovis subsp bovis AF2122/97
cauuccguaggccaca

SEQ ID NO: 1121369 - RNA, 21 nt, Mycobacterium bovis subsp bovis AF2122/97
cauuccuugauaacgacccuc

SEQ ID NO: 1121370 - RNA, 14 nt, Mycobacterium bovis subsp bovis AF2122/97
cauucgagcacguc

SEQ ID NO: 1121371 - RNA, 14 nt, Mycobacterium bovis subsp bovis AF2122/97
cauucgauaccgca

SEQ ID NO: 1121372 - RNA, 21 nt, Mycobacterium bovis subsp bovis AF2122/97
cauuauucgcgcaacgggucg

SEQ ID NO: 1121373 - RNA, 18 nt, Mycobacterium bovis subsp bovis AF2122/97
cauguuccacccgguggc

SEQ ID NO: 1121374 - RNA, 16 nt, Mycobacterium bovis subsp bovis AF2122/97
cauguugcggaccagu

SEQ ID NO: 1121375 - RNA, 18 nt, Mycobacterium bovis subsp bovis AF2122/97
cauguucggggcgcacca

SEQ ID NO: 1121376 - RNA, 20 nt, Mycobacterium bovis subsp bovis AF2122/97
cauguucggggcgcaccacg

SEQ ID NO: 1121377 - RNA, 20 nt, Mycobacterium bovis subsp bovis AF2122/97
cauguugaccucgcgcaccg

SEQ ID NO: 1121378 - RNA, 23 nt, Mycobacterium bovis subsp bovis AF2122/97
cauguugcaggcgcagcugggug

SEQ ID NO: 1121379 - RNA, 22 nt, Mycobacterium bovis subsp bovis AF2122/97
cauguuuugcugcaugccgacc

SEQ ID NO: 1121380 - RNA, 17 nt, Mycobacterium bovis subsp bovis AF2122/97
cauuaccaacgcgguga

SEQ ID NO: 1121381 - RNA, 17 nt, Mycobacterium bovis subsp bovis AF2122/97
ccaaaaacccggugacc

SEQ ID NO: 1121382 - RNA, 17 nt, Mycobacterium bovis subsp bovis AF2122/97
ccaaaaaguagcugcgg

SEQ ID NO: 1121383 - RNA, 13 nt, Mycobacterium bovis subsp bovis AF2122/97
ccaaaagcccggu

SEQ ID NO: 1121384 - RNA, 19 nt, Mycobacterium bovis subsp bovis AF2122/97
ccaaaaaggaucccgccgc

SEQ ID NO: 1121385 - RNA, 12 nt, Mycobacterium bovis subsp bovis AF2122/97
ccaaaagcgcgg

SEQ ID NO: 1121386 - RNA, 14 nt, Mycobacterium bovis subsp bovis AF2122/97
cauuucggaacgcc

SEQ ID NO: 1121387 - RNA, 19 nt, Mycobacterium bovis subsp bovis AF2122/97
cauuucuuugggcggccca

SEQ ID NO: 1121388 - RNA, 16 nt, Mycobacterium bovis subsp bovis AF2122/97
ccaacaggaacaggca

SEQ ID NO: 1121389 - RNA, 21 nt, Mycobacterium bovis subsp bovis AF2122/97
ccaacaggauggugcggccgc

SEQ ID NO: 1121390 - RNA, 12 nt, Mycobacterium bovis subsp bovis AF2122/97
ccaacaccgccc

SEQ ID NO: 1121391 - RNA, 14 nt, Mycobacterium bovis subsp bovis AF2122/97
ccaacaccgcccgc

SEQ ID NO: 1121392 - RNA, 14 nt, Mycobacterium bovis subsp bovis AF2122/97
ccaacaccgcgccg

SEQ ID NO: 1121393 - RNA, 15 nt, Mycobacterium bovis subsp bovis AF2122/97
ccaacaccgcgccga

SEQ ID NO: 1121394 - RNA, 12 nt, Mycobacterium bovis subsp bovis AF2122/97
ccaacaccgcgg

SEQ ID NO: 1121395 - RNA, 14 nt, Mycobacterium bovis subsp bovis AF2122/97
ccaacaccgguggc

SEQ ID NO: 1121396 - RNA, 18 nt, Mycobacterium bovis subsp bovis AF2122/97
ccaacacgucgagcagcc

SEQ ID NO: 1121397 - RNA, 13 nt, Mycobacterium bovis subsp bovis AF2122/97
ccaacaccagcgc

SEQ ID NO: 1121398 - RNA, 13 nt, Mycobacterium bovis subsp bovis AF2122/97
ccaacaccgccag

SEQ ID NO: 1121399 - RNA, 15 nt, Mycobacterium bovis subsp bovis AF2122/97
ccaacaccgccagca

SEQ ID NO: 1121400 - RNA, 13 nt, Mycobacterium bovis subsp bovis AF2122/97
ccaacacagccgu

SEQ ID NO: 1121401 - RNA, 17 nt, Mycobacterium bovis subsp bovis AF2122/97
ccaacacagccgucgca

SEQ ID NO: 1121402 - RNA, 19 nt, Mycobacterium bovis subsp bovis AF2122/97
ccaacacauugccggccac

SEQ ID NO: 1121403 - RNA, 16 nt, Mycobacterium bovis subsp bovis AF2122/97
ccaacaaaaggccauc

SEQ ID NO: 1121404 - RNA, 15 nt, Mycobacterium bovis subsp bovis AF2122/97
ccaacaacaucagcg

SEQ ID NO: 1121405 - RNA, 18 nt, Mycobacterium bovis subsp bovis AF2122/97
ccaacaacgcuucggcgu

SEQ ID NO: 1121406 - RNA, 22 nt, Mycobacterium bovis subsp bovis AF2122/97
cauugacgaggcgagcggccag

SEQ ID NO: 1121407 - RNA, 18 nt, Mycobacterium bovis subsp bovis AF2122/97
cauugacgaugucggucg

SEQ ID NO: 1121408 - RNA, 13 nt, Mycobacterium bovis subsp bovis AF2122/97
cauugaccaggug

SEQ ID NO: 1121409 - RNA, 20 nt, Mycobacterium bovis subsp bovis AF2122/97
cauugaccaggugcccgccc

SEQ ID NO: 1121410 - RNA, 21 nt, Mycobacterium bovis subsp bovis AF2122/97
cauugacccgacgaugccggc

SEQ ID NO: 1121411 - RNA, 16 nt, Mycobacterium bovis subsp bovis AF2122/97
cauugaguucggccac

SEQ ID NO: 1121412 - RNA, 16 nt, Mycobacterium bovis subsp bovis AF2122/97
cauugagcucccgcaa

SEQ ID NO: 1121413 - RNA, 21 nt, Mycobacterium bovis subsp bovis AF2122/97
cauuuccacauccaacgaccu

SEQ ID NO: 1121414 - RNA, 23 nt, Mycobacterium bovis subsp bovis AF2122/97
ccaccgaaauacccagcgcagca

SEQ ID NO: 1121415 - RNA, 12 nt, Mycobacterium bovis subsp bovis AF2122/97
ccaccgacagca

SEQ ID NO: 1121416 - RNA, 21 nt, Mycobacterium bovis subsp bovis AF2122/97
ccaccgaacgcggccaccgac

SEQ ID NO: 1121417 - RNA, 22 nt, Mycobacterium bovis subsp bovis AF2122/97
ccaccgaacgcggccaccgacc

SEQ ID NO: 1121418 - RNA, 15 nt, Mycobacterium bovis subsp bovis AF2122/97
ccaccgaagccccuc

SEQ ID NO: 1121419 - RNA, 21 nt, Mycobacterium bovis subsp bovis AF2122/97
ccaccgacaagaauggccgcc

SEQ ID NO: 1121420 - RNA, 20 nt, Mycobacterium bovis subsp bovis AF2122/97
ccaccgagaucaugccggcg

SEQ ID NO: 1121421 - RNA, 16 nt, Mycobacterium bovis subsp bovis AF2122/97
ccaccgagaucaugcc

SEQ ID NO: 1121422 - RNA, 17 nt, Mycobacterium bovis subsp bovis AF2122/97
ccaccgauucggcgacg

SEQ ID NO: 1121423 - RNA, 21 nt, Mycobacterium bovis subsp bovis AF2122/97
ccaccgauaccgucagcgccg

SEQ ID NO: 1121424 - RNA, 21 nt, Mycobacterium bovis subsp bovis AF2122/97
ccaccgagaucaugccggcga

SEQ ID NO: 1121425 - RNA, 15 nt, Mycobacterium bovis subsp bovis AF2122/97
ccacccgcggcgccg

SEQ ID NO: 1121426 - RNA, 20 nt, Mycobacterium bovis subsp bovis AF2122/97
ccacccgcggcgccguugcc

SEQ ID NO: 1121427 - RNA, 14 nt, Mycobacterium bovis subsp bovis AF2122/97
ccacccgccaacgc

SEQ ID NO: 1121428 - RNA, 12 nt, Mycobacterium bovis subsp bovis AF2122/97
ccacccgcgccg

SEQ ID NO: 1121429 - RNA, 13 nt, Mycobacterium bovis subsp bovis AF2122/97
ccacccgcgccgc

SEQ ID NO: 1121430 - RNA, 19 nt, Mycobacterium bovis subsp bovis AF2122/97
ccacccgcgcgaugcuggc

SEQ ID NO: 1121431 - RNA, 12 nt, Mycobacterium bovis subsp bovis AF2122/97
ccacccggccgc

SEQ ID NO: 1121432 - RNA, 16 nt, Mycobacterium bovis subsp bovis AF2122/97
ccacccggccgcgcgg

SEQ ID NO: 1121433 - RNA, 13 nt, Mycobacterium bovis subsp bovis AF2122/97
ccacccggccgcg

SEQ ID NO: 1121434 - RNA, 14 nt, Mycobacterium bovis subsp bovis AF2122/97
ccacccggcgcagc

SEQ ID NO: 1121435 - RNA, 16 nt, Mycobacterium bovis subsp bovis AF2122/97
ccacccgcgaagccgc

SEQ ID NO: 1121436 - RNA, 20 nt, Mycobacterium bovis subsp bovis AF2122/97
ccacccgggccucggcgccg

SEQ ID NO: 1121437 - RNA, 13 nt, Mycobacterium bovis subsp bovis AF2122/97
ccacccggugccg

SEQ ID NO: 1121438 - RNA, 12 nt, Mycobacterium bovis subsp bovis AF2122/97
ccacccgggcgu

SEQ ID NO: 1121439 - RNA, 13 nt, Mycobacterium bovis subsp bovis AF2122/97
ccacccuugccga

SEQ ID NO: 1121440 - RNA, 17 nt, Mycobacterium bovis subsp bovis AF2122/97
ccacccuugccgaugac

SEQ ID NO: 1121441 - RNA, 15 nt, Mycobacterium bovis subsp bovis AF2122/97
ccacccuugccgccg

SEQ ID NO: 1121442 - RNA, 16 nt, Mycobacterium bovis subsp bovis AF2122/97
ccacccuugccgccgg

SEQ ID NO: 1121443 - RNA, 19 nt, Mycobacterium bovis subsp bovis AF2122/97
ccacccgauuggccaaccc

SEQ ID NO: 1121444 - RNA, 13 nt, Mycobacterium bovis subsp bovis AF2122/97
ccacccgagcucu

SEQ ID NO: 1121445 - RNA, 19 nt, Mycobacterium bovis subsp bovis AF2122/97
ccacccgauauucggccau

SEQ ID NO: 1121446 - RNA, 16 nt, Mycobacterium bovis subsp bovis AF2122/97
ccacccgaucgggcgu

SEQ ID NO: 1121447 - RNA, 16 nt, Mycobacterium bovis subsp bovis AF2122/97
ccacccgcaccucacc

SEQ ID NO: 1121448 - RNA, 23 nt, Mycobacterium bovis subsp bovis AF2122/97
ccaccccgcuuggaccguugccg

SEQ ID NO: 1121449 - RNA, 24 nt, Mycobacterium bovis subsp bovis AF2122/97
ccaccccgcuuggaccguugccga

SEQ ID NO: 1121450 - RNA, 13 nt, Mycobacterium bovis subsp bovis AF2122/97
ccaccccgcgcgc

SEQ ID NO: 1121451 - RNA, 12 nt, Mycobacterium bovis subsp bovis AF2122/97
ccacccgacaug

SEQ ID NO: 1121452 - RNA, 17 nt, Mycobacterium bovis subsp bovis AF2122/97
ccacccgacaugcgccg

SEQ ID NO: 1121453 - RNA, 14 nt, Mycobacterium bovis subsp bovis AF2122/97
ccaccccggccgca

SEQ ID NO: 1121454 - RNA, 13 nt, Mycobacterium bovis subsp bovis AF2122/97
ccaccccugagcu

SEQ ID NO: 1121455 - RNA, 14 nt, Mycobacterium bovis subsp bovis AF2122/97
ccaccccgaggccg

SEQ ID NO: 1121456 - RNA, 14 nt, Mycobacterium bovis subsp bovis AF2122/97
ccaccccgauccgc

SEQ ID NO: 1121457 - RNA, 17 nt, Mycobacterium bovis subsp bovis AF2122/97
ccaccccgauccgccac

SEQ ID NO: 1121458 - RNA, 17 nt, Mycobacterium bovis subsp bovis AF2122/97
ccaccccgaccucccgg

SEQ ID NO: 1121459 - RNA, 15 nt, Mycobacterium bovis subsp bovis AF2122/97
ccaccccgagcucac

SEQ ID NO: 1121460 - RNA, 17 nt, Mycobacterium bovis subsp bovis AF2122/97
ccaccccagcggccacc

SEQ ID NO: 1121461 - RNA, 19 nt, Mycobacterium bovis subsp bovis AF2122/97
ccaccccagcggccaccga

SEQ ID NO: 1121462 - RNA, 14 nt, Mycobacterium bovis subsp bovis AF2122/97
ccacccacgccgac

SEQ ID NO: 1121463 - RNA, 13 nt, Mycobacterium bovis subsp bovis AF2122/97
ccacccagcgacu

SEQ ID NO: 1121464 - RNA, 12 nt, Mycobacterium bovis subsp bovis AF2122/97
ccacccacccgc

SEQ ID NO: 1121465 - RNA, 13 nt, Mycobacterium bovis subsp bovis AF2122/97
ccacccaccgaca

SEQ ID NO: 1121466 - RNA, 13 nt, Mycobacterium bovis subsp bovis AF2122/97
ccacccaccggcc

SEQ ID NO: 1121467 - RNA, 15 nt, Mycobacterium bovis subsp bovis AF2122/97
ccacccaccggccac

SEQ ID NO: 1121468 - RNA, 16 nt, Mycobacterium bovis subsp bovis AF2122/97
ccacccacgaucagca

SEQ ID NO: 1121469 - RNA, 22 nt, Mycobacterium bovis subsp bovis AF2122/97
ccaccagcguguagcgaugccg

SEQ ID NO: 1121470 - RNA, 19 nt, Mycobacterium bovis subsp bovis AF2122/97
ccaccagcgcuccagcacc

SEQ ID NO: 1121471 - RNA, 15 nt, Mycobacterium bovis subsp bovis AF2122/97
ccaccagcgcccggc

SEQ ID NO: 1121472 - RNA, 22 nt, Mycobacterium bovis subsp bovis AF2122/97
ccaccagcgcccggcccgccac

SEQ ID NO: 1121473 - RNA, 14 nt, Mycobacterium bovis subsp bovis AF2122/97
ccaccagcgcccgu

SEQ ID NO: 1121474 - RNA, 14 nt, Mycobacterium bovis subsp bovis AF2122/97
ccaccagcggcggc

SEQ ID NO: 1121475 - RNA, 12 nt, Mycobacterium bovis subsp bovis AF2122/97
ccaccgccggca

SEQ ID NO: 1121476 - RNA, 13 nt, Mycobacterium bovis subsp bovis AF2122/97
ccaccgccgcgcg

SEQ ID NO: 1121477 - RNA, 15 nt, Mycobacterium bovis subsp bovis AF2122/97
ccaccgccgcugccg

SEQ ID NO: 1121478 - RNA, 21 nt, Mycobacterium bovis subsp bovis AF2122/97
ccaccgccgccgccgacgccg

SEQ ID NO: 1121479 - RNA, 13 nt, Mycobacterium bovis subsp bovis AF2122/97
ccaccgccgccgg

SEQ ID NO: 1121480 - RNA, 13 nt, Mycobacterium bovis subsp bovis AF2122/97
ccaccgagucgau

SEQ ID NO: 1121481 - RNA, 23 nt, Mycobacterium bovis subsp bovis AF2122/97
ccaccgccggugccgccaucgcc

SEQ ID NO: 1121482 - RNA, 11 nt, Mycobacterium bovis subsp bovis AF2122/97
ccaccgccguu

SEQ ID NO: 1121483 - RNA, 24 nt, Mycobacterium bovis subsp bovis AF2122/97
ccaccgcaaccaaagcgacgagca

SEQ ID NO: 1121484 - RNA, 19 nt, Mycobacterium bovis subsp bovis AF2122/97
ccaccgcacgcuggcgggc

SEQ ID NO: 1121485 - RNA, 20 nt, Mycobacterium bovis subsp bovis AF2122/97
ccaccgcacggaugucgccc

SEQ ID NO: 1121486 - RNA, 17 nt, Mycobacterium bovis subsp bovis AF2122/97
ccaccgcagacgccguc

SEQ ID NO: 1121487 - RNA, 18 nt, Mycobacterium bovis subsp bovis AF2122/97
ccaccgcagauccccgcc

SEQ ID NO: 1121488 - RNA, 14 nt, Mycobacterium bovis subsp bovis AF2122/97
ccaccgccgacaug

SEQ ID NO: 1121489 - RNA, 14 nt, Mycobacterium bovis subsp bovis AF2122/97
ccaccgccgagaug

SEQ ID NO: 1121490 - RNA, 13 nt, Mycobacterium bovis subsp bovis AF2122/97
ccaccgcccgcac

SEQ ID NO: 1121491 - RNA, 21 nt, Mycobacterium bovis subsp bovis AF2122/97
ccaccgcccacagcaacgaca

SEQ ID NO: 1121492 - RNA, 15 nt, Mycobacterium bovis subsp bovis AF2122/97
ccaccgccccgcgcc

SEQ ID NO: 1121493 - RNA, 12 nt, Mycobacterium bovis subsp bovis AF2122/97
ccaccgcgccgg

SEQ ID NO: 1121494 - RNA, 17 nt, Mycobacterium bovis subsp bovis AF2122/97
ccaccgcgccgagcaga

SEQ ID NO: 1121495 - RNA, 13 nt, Mycobacterium bovis subsp bovis AF2122/97
ccaccgcgcaggu

SEQ ID NO: 1121496 - RNA, 15 nt, Mycobacterium bovis subsp bovis AF2122/97
ccaccgcgccgagca

SEQ ID NO: 1121497 - RNA, 14 nt, Mycobacterium bovis subsp bovis AF2122/97
ccaccgcgaugccc

SEQ ID NO: 1121498 - RNA, 15 nt, Mycobacterium bovis subsp bovis AF2122/97
ccaccgcgcaacccg

SEQ ID NO: 1121499 - RNA, 21 nt, Mycobacterium bovis subsp bovis AF2122/97
ccaccgcgacggcaggcucgg

SEQ ID NO: 1121500 - RNA, 13 nt, Mycobacterium bovis subsp bovis AF2122/97
ccaccgcgagacc

SEQ ID NO: 1121501 - RNA, 17 nt, Mycobacterium bovis subsp bovis AF2122/97
ccaccgcgacaccccgg

SEQ ID NO: 1121502 - RNA, 18 nt, Mycobacterium bovis subsp bovis AF2122/97
ccaccgcggucaccgacg

SEQ ID NO: 1121503 - RNA, 19 nt, Mycobacterium bovis subsp bovis AF2122/97
ccaccgcggucaccgacgc

SEQ ID NO: 1121504 - RNA, 14 nt, Mycobacterium bovis subsp bovis AF2122/97
ccaccgcggucagc

SEQ ID NO: 1121505 - RNA, 24 nt, Mycobacterium bovis subsp bovis AF2122/97
ccaccgcggcugcuccgucgccga

SEQ ID NO: 1121506 - RNA, 20 nt, Mycobacterium bovis subsp bovis AF2122/97
ccaccgcggcggcggccaua

SEQ ID NO: 1121507 - RNA, 15 nt, Mycobacterium bovis subsp bovis AF2122/97
ccaccgcgacgagcg

SEQ ID NO: 1121508 - RNA, 15 nt, Mycobacterium bovis subsp bovis AF2122/97
ccaccgcgcggcgca

SEQ ID NO: 1121509 - RNA, 12 nt, Mycobacterium bovis subsp bovis AF2122/97
ccaccgcggcga

SEQ ID NO: 1121510 - RNA, 13 nt, Mycobacterium bovis subsp bovis AF2122/97
ccaccgcggccgc

SEQ ID NO: 1121511 - RNA, 20 nt, Mycobacterium bovis subsp bovis AF2122/97
ccaccgcggccgcggucgau

SEQ ID NO: 1121512 - RNA, 13 nt, Mycobacterium bovis subsp bovis AF2122/97
ccaccggccagug

SEQ ID NO: 1121513 - RNA, 20 nt, Mycobacterium bovis subsp bovis AF2122/97
ccaccggcacccgcuggcgg

SEQ ID NO: 1121514 - RNA, 12 nt, Mycobacterium bovis subsp bovis AF2122/97
ccaccggcaccg

SEQ ID NO: 1121515 - RNA, 14 nt, Mycobacterium bovis subsp bovis AF2122/97
ccaccggccguccc

SEQ ID NO: 1121516 - RNA, 15 nt, Mycobacterium bovis subsp bovis AF2122/97
ccaccggccgcggcg

SEQ ID NO: 1121517 - RNA, 13 nt, Mycobacterium bovis subsp bovis AF2122/97
ccaccggccggcg

SEQ ID NO: 1121518 - RNA, 18 nt, Mycobacterium bovis subsp bovis AF2122/97
ccaccggccccaccgaca

SEQ ID NO: 1121519 - RNA, 19 nt, Mycobacterium bovis subsp bovis AF2122/97
ccaccggccccaccggcac

SEQ ID NO: 1121520 - RNA, 15 nt, Mycobacterium bovis subsp bovis AF2122/97
ccaccggcggugccg

SEQ ID NO: 1121521 - RNA, 16 nt, Mycobacterium bovis subsp bovis AF2122/97
ccaccggcggugccgg

SEQ ID NO: 1121522 - RNA, 18 nt, Mycobacterium bovis subsp bovis AF2122/97
ccaccggcggugccggug

SEQ ID NO: 1121523 - RNA, 18 nt, Mycobacterium bovis subsp bovis AF2122/97
ccaccggcgccaccggcg

SEQ ID NO: 1121524 - RNA, 13 nt, Mycobacterium bovis subsp bovis AF2122/97
ccaccggcgccgc

SEQ ID NO: 1121525 - RNA, 20 nt, Mycobacterium bovis subsp bovis AF2122/97
ccaccggcgccgcccgcgcc

SEQ ID NO: 1121526 - RNA, 16 nt, Mycobacterium bovis subsp bovis AF2122/97
ccaccggcgccgccgg

SEQ ID NO: 1121527 - RNA, 19 nt, Mycobacterium bovis subsp bovis AF2122/97
ccaccggcgucgacgucgg

SEQ ID NO: 1121528 - RNA, 23 nt, Mycobacterium bovis subsp bovis AF2122/97
ccaccggcgucugcccgcccagc

SEQ ID NO: 1121529 - RNA, 17 nt, Mycobacterium bovis subsp bovis AF2122/97
ccaccggcuaugcuggc

SEQ ID NO: 1121530 - RNA, 18 nt, Mycobacterium bovis subsp bovis AF2122/97
ccaccggcuaugcuggcg

SEQ ID NO: 1121531 - RNA, 19 nt, Mycobacterium bovis subsp bovis AF2122/97
ccaccggcuaugcuggcgc

SEQ ID NO: 1121532 - RNA, 20 nt, Mycobacterium bovis subsp bovis AF2122/97
ccaccggcugauucgagcca

SEQ ID NO: 1121533 - RNA, 20 nt, Mycobacterium bovis subsp bovis AF2122/97
ccaccgggauagccgcgacc

SEQ ID NO: 1121534 - RNA, 21 nt, Mycobacterium bovis subsp bovis AF2122/97
ccaccgggauagccgcgacca

SEQ ID NO: 1121535 - RNA, 15 nt, Mycobacterium bovis subsp bovis AF2122/97
ccaccgggcgcugcu

SEQ ID NO: 1121536 - RNA, 21 nt, Mycobacterium bovis subsp bovis AF2122/97
ccaccgggauggcucacccag

SEQ ID NO: 1121537 - RNA, 16 nt, Mycobacterium bovis subsp bovis AF2122/97
ccaccgggcccgccgg

SEQ ID NO: 1121538 - RNA, 18 nt, Mycobacterium bovis subsp bovis AF2122/97
ccaccgcuggcccggcgc

SEQ ID NO: 1121539 - RNA, 17 nt, Mycobacterium bovis subsp bovis AF2122/97
ccaccggcaacaucagc

SEQ ID NO: 1121540 - RNA, 17 nt, Mycobacterium bovis subsp bovis AF2122/97
ccaccggaucgcucccg

SEQ ID NO: 1121541 - RNA, 22 nt, Mycobacterium bovis subsp bovis AF2122/97
ccaccgcuugaccccuggccgc

SEQ ID NO: 1121542 - RNA, 21 nt, Mycobacterium bovis subsp bovis AF2122/97
ccaccggaccgaccaccgcga

SEQ ID NO: 1121543 - RNA, 17 nt, Mycobacterium bovis subsp bovis AF2122/97
ccaccggcacccccguc

SEQ ID NO: 1121544 - RNA, 19 nt, Mycobacterium bovis subsp bovis AF2122/97
ccaccggcaccgccugcgc

SEQ ID NO: 1121545 - RNA, 14 nt, Mycobacterium bovis subsp bovis AF2122/97
ccaccggcaccgcu

SEQ ID NO: 1121546 - RNA, 15 nt, Mycobacterium bovis subsp bovis AF2122/97
ccaccggcaccgcug

SEQ ID NO: 1121547 - RNA, 19 nt, Mycobacterium bovis subsp bovis AF2122/97
ccaccggcaccgcugccgc

SEQ ID NO: 1121548 - RNA, 14 nt, Mycobacterium bovis subsp bovis AF2122/97
ccaccggcaccggc

SEQ ID NO: 1121549 - RNA, 22 nt, Mycobacterium bovis subsp bovis AF2122/97
ccaccggcaccggccgugccgc

SEQ ID NO: 1121550 - RNA, 17 nt, Mycobacterium bovis subsp bovis AF2122/97
ccaccgcguuggccaca

SEQ ID NO: 1121551 - RNA, 14 nt, Mycobacterium bovis subsp bovis AF2122/97
ccaccgcgguggcg

SEQ ID NO: 1121552 - RNA, 17 nt, Mycobacterium bovis subsp bovis AF2122/97
ccaccggaauacgcgcc

SEQ ID NO: 1121553 - RNA, 18 nt, Mycobacterium bovis subsp bovis AF2122/97
ccaccggaauacgcgccg

SEQ ID NO: 1121554 - RNA, 22 nt, Mycobacterium bovis subsp bovis AF2122/97
ccaccggaauacgcgccgccgg

SEQ ID NO: 1121555 - RNA, 19 nt, Mycobacterium bovis subsp bovis AF2122/97
ccaccggaauccuggccgc

SEQ ID NO: 1121556 - RNA, 16 nt, Mycobacterium bovis subsp bovis AF2122/97
ccaccggaccaccgcc

SEQ ID NO: 1121557 - RNA, 17 nt, Mycobacterium bovis subsp bovis AF2122/97
ccaccggaccaccgccg

SEQ ID NO: 1121558 - RNA, 16 nt, Mycobacterium bovis subsp bovis AF2122/97
ccaccggaccgaccac

SEQ ID NO: 1121559 - RNA, 15 nt, Mycobacterium bovis subsp bovis AF2122/97
ccaccgcugccggca

SEQ ID NO: 1121560 - RNA, 12 nt, Mycobacterium bovis subsp bovis AF2122/97
ccaccgcugcga

SEQ ID NO: 1121561 - RNA, 22 nt, Mycobacterium bovis subsp bovis AF2122/97
ccacagcugacgagccgguggc

SEQ ID NO: 1121562 - RNA, 20 nt, Mycobacterium bovis subsp bovis AF2122/97
ccacagcuugcccgagccca

SEQ ID NO: 1121563 - RNA, 23 nt, Mycobacterium bovis subsp bovis AF2122/97
ccacagcucgccgugaccaggug

SEQ ID NO: 1121564 - RNA, 13 nt, Mycobacterium bovis subsp bovis AF2122/97
ccacaggaagcga

SEQ ID NO: 1121565 - RNA, 19 nt, Mycobacterium bovis subsp bovis AF2122/97
ccacaggcugaagacgaau

SEQ ID NO: 1121566 - RNA, 13 nt, Mycobacterium bovis subsp bovis AF2122/97
ccacagcggagac

SEQ ID NO: 1121567 - RNA, 13 nt, Mycobacterium bovis subsp bovis AF2122/97
ccacagcggcgau

SEQ ID NO: 1121568 - RNA, 14 nt, Mycobacterium bovis subsp bovis AF2122/97
ccacagcgacagcg

SEQ ID NO: 1121569 - RNA, 13 nt, Mycobacterium bovis subsp bovis AF2122/97
ccacagccgcgcc

SEQ ID NO: 1121570 - RNA, 20 nt, Mycobacterium bovis subsp bovis AF2122/97
ccacagcauaaagaucagca

SEQ ID NO: 1121571 - RNA, 23 nt, Mycobacterium bovis subsp bovis AF2122/97
ccacacuggggauaaacugccgc

SEQ ID NO: 1121572 - RNA, 13 nt, Mycobacterium bovis subsp bovis AF2122/97
ccacacggggccg

SEQ ID NO: 1121573 - RNA, 14 nt, Mycobacterium bovis subsp bovis AF2122/97
ccacacggggccgc

SEQ ID NO: 1121574 - RNA, 13 nt, Mycobacterium bovis subsp bovis AF2122/97
ccacacggugcga

SEQ ID NO: 1121575 - RNA, 17 nt, Mycobacterium bovis subsp bovis AF2122/97
ccacagaccgaacagca

SEQ ID NO: 1121576 - RNA, 15 nt, Mycobacterium bovis subsp bovis AF2122/97
ccacagcaacgacau

SEQ ID NO: 1121577 - RNA, 17 nt, Mycobacterium bovis subsp bovis AF2122/97
ccacagcacccacgccg

SEQ ID NO: 1121578 - RNA, 15 nt, Mycobacterium bovis subsp bovis AF2122/97
ccacacucccgcgcc

SEQ ID NO: 1121579 - RNA, 16 nt, Mycobacterium bovis subsp bovis AF2122/97
ccacacgggaagccgc

SEQ ID NO: 1121580 - RNA, 15 nt, Mycobacterium bovis subsp bovis AF2122/97
ccacacagccgcgcu

SEQ ID NO: 1121581 - RNA, 20 nt, Mycobacterium bovis subsp bovis AF2122/97
ccacaccacgauggcggcca

SEQ ID NO: 1121582 - RNA, 14 nt, Mycobacterium bovis subsp bovis AF2122/97
ccacaccaggccga

SEQ ID NO: 1121583 - RNA, 22 nt, Mycobacterium bovis subsp bovis AF2122/97
ccacaccaggccgagccgcccg

SEQ ID NO: 1121584 - RNA, 19 nt, Mycobacterium bovis subsp bovis AF2122/97
ccacacagucacggaccgc

SEQ ID NO: 1121585 - RNA, 14 nt, Mycobacterium bovis subsp bovis AF2122/97
ccacacacagccgg

SEQ ID NO: 1121586 - RNA, 18 nt, Mycobacterium bovis subsp bovis AF2122/97
ccacacaccgagcacggg

SEQ ID NO: 1121587 - RNA, 17 nt, Mycobacterium bovis subsp bovis AF2122/97
ccacaccacgguggccg

SEQ ID NO: 1121588 - RNA, 12 nt, Mycobacterium bovis subsp bovis AF2122/97
ccacaccagcgc

SEQ ID NO: 1121589 - RNA, 14 nt, Mycobacterium bovis subsp bovis AF2122/97
ccacaccagcgcag

SEQ ID NO: 1121590 - RNA, 16 nt, Mycobacterium bovis subsp bovis AF2122/97
ccacaccagcgcagca

SEQ ID NO: 1121591 - RNA, 13 nt, Mycobacterium bovis subsp bovis AF2122/97
ccaccacccggcg

SEQ ID NO: 1121592 - RNA, 14 nt, Mycobacterium bovis subsp bovis AF2122/97
ccaccacccggcgc

SEQ ID NO: 1121593 - RNA, 15 nt, Mycobacterium bovis subsp bovis AF2122/97
ccaccaccgacgagg

SEQ ID NO: 1121594 - RNA, 14 nt, Mycobacterium bovis subsp bovis AF2122/97
ccaccaccgccggu

SEQ ID NO: 1121595 - RNA, 15 nt, Mycobacterium bovis subsp bovis AF2122/97
ccaccaccgccggug

SEQ ID NO: 1121596 - RNA, 12 nt, Mycobacterium bovis subsp bovis AF2122/97
ccaccaccgcgc

SEQ ID NO: 1121597 - RNA, 12 nt, Mycobacterium bovis subsp bovis AF2122/97
ccaccaccgccg

SEQ ID NO: 1121598 - RNA, 14 nt, Mycobacterium bovis subsp bovis AF2122/97
ccaccaccgccgac

SEQ ID NO: 1121599 - RNA, 13 nt, Mycobacterium bovis subsp bovis AF2122/97
ccaccaccgccgc

SEQ ID NO: 1121600 - RNA, 15 nt, Mycobacterium bovis subsp bovis AF2122/97
ccaccaccgccgccg

SEQ ID NO: 1121601 - RNA, 14 nt, Mycobacterium bovis subsp bovis AF2122/97
ccaccaccgcgccg

SEQ ID NO: 1121602 - RNA, 13 nt, Mycobacterium bovis subsp bovis AF2122/97
ccaccaccggcgc

SEQ ID NO: 1121603 - RNA, 13 nt, Mycobacterium bovis subsp bovis AF2122/97
ccaccaccgguga

SEQ ID NO: 1121604 - RNA, 14 nt, Mycobacterium bovis subsp bovis AF2122/97
ccaccacgcgccgc

SEQ ID NO: 1121605 - RNA, 11 nt, Mycobacterium bovis subsp bovis AF2122/97
ccaccacgcau

SEQ ID NO: 1121606 - RNA, 13 nt, Mycobacterium bovis subsp bovis AF2122/97
ccaccacgccguc

SEQ ID NO: 1121607 - RNA, 14 nt, Mycobacterium bovis subsp bovis AF2122/97
ccaccaccaccgcc

SEQ ID NO: 1121608 - RNA, 15 nt, Mycobacterium bovis subsp bovis AF2122/97
ccaccacaccugcgg

SEQ ID NO: 1121609 - RNA, 16 nt, Mycobacterium bovis subsp bovis AF2122/97
ccaccacaccugcggc

SEQ ID NO: 1121610 - RNA, 20 nt, Mycobacterium bovis subsp bovis AF2122/97
ccaccacaccugcggcugcu

SEQ ID NO: 1121611 - RNA, 18 nt, Mycobacterium bovis subsp bovis AF2122/97
ccaccacaccggagccga

SEQ ID NO: 1121612 - RNA, 22 nt, Mycobacterium bovis subsp bovis AF2122/97
ccacagugaaauccgagccgcg

SEQ ID NO: 1121613 - RNA, 20 nt, Mycobacterium bovis subsp bovis AF2122/97
ccacaguuaucagccgcgcg

SEQ ID NO: 1121614 - RNA, 21 nt, Mycobacterium bovis subsp bovis AF2122/97
ccacaguuaucagccgcgcgc

SEQ ID NO: 1121615 - RNA, 14 nt, Mycobacterium bovis subsp bovis AF2122/97
ccacagucgccggc

SEQ ID NO: 1121616 - RNA, 16 nt, Mycobacterium bovis subsp bovis AF2122/97
ccacagucgccggccg

SEQ ID NO: 1121617 - RNA, 18 nt, Mycobacterium bovis subsp bovis AF2122/97
ccacagucgccggccggc

SEQ ID NO: 1121618 - RNA, 17 nt, Mycobacterium bovis subsp bovis AF2122/97
ccacagguuugcgccgc

SEQ ID NO: 1121619 - RNA, 16 nt, Mycobacterium bovis subsp bovis AF2122/97
ccacaggggcagcgcg

SEQ ID NO: 1121620 - RNA, 22 nt, Mycobacterium bovis subsp bovis AF2122/97
ccacaggggcagcgcggccacc

SEQ ID NO: 1121621 - RNA, 17 nt, Mycobacterium bovis subsp bovis AF2122/97
ccacaggggccagcgcg

SEQ ID NO: 1121622 - RNA, 16 nt, Mycobacterium bovis subsp bovis AF2122/97
ccacagguagaccguc

SEQ ID NO: 1121623 - RNA, 17 nt, Mycobacterium bovis subsp bovis AF2122/97
ccaacaucccggaccga

SEQ ID NO: 1121624 - RNA, 15 nt, Mycobacterium bovis subsp bovis AF2122/97
ccaacaggccggugu

SEQ ID NO: 1121625 - RNA, 22 nt, Mycobacterium bovis subsp bovis AF2122/97
ccaaccaaggacgaacgcgccg

SEQ ID NO: 1121626 - RNA, 19 nt, Mycobacterium bovis subsp bovis AF2122/97
ccaaccagucgcacgacgu

SEQ ID NO: 1121627 - RNA, 15 nt, Mycobacterium bovis subsp bovis AF2122/97
ccaaccaugcugucg

SEQ ID NO: 1121628 - RNA, 13 nt, Mycobacterium bovis subsp bovis AF2122/97
ccaaccaggccgc

SEQ ID NO: 1121629 - RNA, 16 nt, Mycobacterium bovis subsp bovis AF2122/97
ccaaccacgagcauca

SEQ ID NO: 1121630 - RNA, 22 nt, Mycobacterium bovis subsp bovis AF2122/97
ccaacccaccccccagcgccgc

SEQ ID NO: 1121631 - RNA, 21 nt, Mycobacterium bovis subsp bovis AF2122/97
ccaagcuaccccgacggcgac

SEQ ID NO: 1121632 - RNA, 14 nt, Mycobacterium bovis subsp bovis AF2122/97
ccaagcucgacaac

SEQ ID NO: 1121633 - RNA, 14 nt, Mycobacterium bovis subsp bovis AF2122/97
ccaagcucggccac

SEQ ID NO: 1121634 - RNA, 15 nt, Mycobacterium bovis subsp bovis AF2122/97
ccaagcucggccacc

SEQ ID NO: 1121635 - RNA, 16 nt, Mycobacterium bovis subsp bovis AF2122/97
ccaagcucggccagca

SEQ ID NO: 1121636 - RNA, 22 nt, Mycobacterium bovis subsp bovis AF2122/97
ccaagcucggccagcacgccgc

SEQ ID NO: 1121637 - RNA, 15 nt, Mycobacterium bovis subsp bovis AF2122/97
ccaagcucggcccag

SEQ ID NO: 1121638 - RNA, 17 nt, Mycobacterium bovis subsp bovis AF2122/97
ccaaccccauggccagc

SEQ ID NO: 1121639 - RNA, 16 nt, Mycobacterium bovis subsp bovis AF2122/97
ccaagcucggcccagc

SEQ ID NO: 1121640 - RNA, 23 nt, Mycobacterium bovis subsp bovis AF2122/97
ccaagcucggcccagcgcgccag

SEQ ID NO: 1121641 - RNA, 17 nt, Mycobacterium bovis subsp bovis AF2122/97
ccaaggcucagcagcgc

SEQ ID NO: 1121642 - RNA, 21 nt, Mycobacterium bovis subsp bovis AF2122/97
ccaaggcgacgaaucggcaac

SEQ ID NO: 1121643 - RNA, 13 nt, Mycobacterium bovis subsp bovis AF2122/97
ccaaggucggcga

SEQ ID NO: 1121644 - RNA, 15 nt, Mycobacterium bovis subsp bovis AF2122/97
ccaagguccgcacga

SEQ ID NO: 1121645 - RNA, 19 nt, Mycobacterium bovis subsp bovis AF2122/97
ccaaggucuucaggccgcg

SEQ ID NO: 1121646 - RNA, 22 nt, Mycobacterium bovis subsp bovis AF2122/97
ccaaggcucagcagcgccgcgc

SEQ ID NO: 1121647 - RNA, 20 nt, Mycobacterium bovis subsp bovis AF2122/97
ccaaggugagcagcaagacc

SEQ ID NO: 1121648 - RNA, 23 nt, Mycobacterium bovis subsp bovis AF2122/97
ccaaggugagcagcaagaccgcg

SEQ ID NO: 1121649 - RNA, 21 nt, Mycobacterium bovis subsp bovis AF2122/97
ccaaggucuucaggccgcgca

SEQ ID NO: 1121650 - RNA, 19 nt, Mycobacterium bovis subsp bovis AF2122/97
ccaauccgcaacagcucgg

SEQ ID NO: 1121651 - RNA, 15 nt, Mycobacterium bovis subsp bovis AF2122/97
ccaaucaugugccag

SEQ ID NO: 1121652 - RNA, 21 nt, Mycobacterium bovis subsp bovis AF2122/97
ccaaucagugcagcgugggca

SEQ ID NO: 1121653 - RNA, 17 nt, Mycobacterium bovis subsp bovis AF2122/97
ccaaugucggacagcga

SEQ ID NO: 1121654 - RNA, 16 nt, Mycobacterium bovis subsp bovis AF2122/97
ccaaugugccggucac

SEQ ID NO: 1121655 - RNA, 23 nt, Mycobacterium bovis subsp bovis AF2122/97
ccaauuacagcuugcgcagccgc

SEQ ID NO: 1121656 - RNA, 18 nt, Mycobacterium bovis subsp bovis AF2122/97
ccaauggagccgcgacca

SEQ ID NO: 1121657 - RNA, 16 nt, Mycobacterium bovis subsp bovis AF2122/97
ccaauucccgcgcggc

SEQ ID NO: 1121658 - RNA, 17 nt, Mycobacterium bovis subsp bovis AF2122/97
ccaauucgaccgcgcgg

SEQ ID NO: 1121659 - RNA, 17 nt, Mycobacterium bovis subsp bovis AF2122/97
ccaaugcccuuggccag

SEQ ID NO: 1121660 - RNA, 18 nt, Mycobacterium bovis subsp bovis AF2122/97
ccaaugcccuuggccagc

SEQ ID NO: 1121661 - RNA, 19 nt, Mycobacterium bovis subsp bovis AF2122/97
ccaaugcccuuggccagca

SEQ ID NO: 1121662 - RNA, 18 nt, Mycobacterium bovis subsp bovis AF2122/97
ccaaugacuuggccagca

SEQ ID NO: 1121663 - RNA, 16 nt, Mycobacterium bovis subsp bovis AF2122/97
ccaaucgcacgccagc

SEQ ID NO: 1121664 - RNA, 21 nt, Mycobacterium bovis subsp bovis AF2122/97
ccaaucgccgggugcaggcga

SEQ ID NO: 1121665 - RNA, 20 nt, Mycobacterium bovis subsp bovis AF2122/97
ccaaucugcgcgaggggccg

SEQ ID NO: 1121666 - RNA, 15 nt, Mycobacterium bovis subsp bovis AF2122/97
ccacaacggcggcgc

SEQ ID NO: 1121667 - RNA, 14 nt, Mycobacterium bovis subsp bovis AF2122/97
ccacaacgucggca

SEQ ID NO: 1121668 - RNA, 22 nt, Mycobacterium bovis subsp bovis AF2122/97
ccacaacgucggcaccgguuuu

SEQ ID NO: 1121669 - RNA, 23 nt, Mycobacterium bovis subsp bovis AF2122/97
ccacaacucggcauucaccgcgg

SEQ ID NO: 1121670 - RNA, 18 nt, Mycobacterium bovis subsp bovis AF2122/97
ccacaaugacucggccgc

SEQ ID NO: 1121671 - RNA, 21 nt, Mycobacterium bovis subsp bovis AF2122/97
ccacaaugacucggccgcacc

SEQ ID NO: 1121672 - RNA, 17 nt, Mycobacterium bovis subsp bovis AF2122/97
ccacaaggguuggccga

SEQ ID NO: 1121673 - RNA, 19 nt, Mycobacterium bovis subsp bovis AF2122/97
ccacaaucagcccgacacc

SEQ ID NO: 1121674 - RNA, 13 nt, Mycobacterium bovis subsp bovis AF2122/97
ccacaauccgcuc

SEQ ID NO: 1121675 - RNA, 22 nt, Mycobacterium bovis subsp bovis AF2122/97
ccaauuggcgucgucggcggcg

SEQ ID NO: 1121676 - RNA, 21 nt, Mycobacterium bovis subsp bovis AF2122/97
ccaauugggcgaugcggcguc

SEQ ID NO: 1121677 - RNA, 20 nt, Mycobacterium bovis subsp bovis AF2122/97
ccaauugugcugaccggucc

SEQ ID NO: 1121678 - RNA, 12 nt, Mycobacterium bovis subsp bovis AF2122/97
agcucgaaguug

SEQ ID NO: 1121679 - RNA, 17 nt, Mycobacterium bovis subsp bovis AF2122/97
agcucgaagcccggaca

SEQ ID NO: 1121680 - RNA, 22 nt, Mycobacterium bovis subsp bovis AF2122/97
agcucgaacagguuggccccgg

SEQ ID NO: 1121681 - RNA, 20 nt, Mycobacterium bovis subsp bovis AF2122/97
agcucgaacagcucgaucag

SEQ ID NO: 1121682 - RNA, 22 nt, Mycobacterium bovis subsp bovis AF2122/97
agcucgaucagccgggugcgca

SEQ ID NO: 1121683 - RNA, 14 nt, Mycobacterium bovis subsp bovis AF2122/97
agcucgauccgcag

SEQ ID NO: 1121684 - RNA, 14 nt, Mycobacterium bovis subsp bovis AF2122/97
agcucgauacccag

SEQ ID NO: 1121685 - RNA, 22 nt, Mycobacterium bovis subsp bovis AF2122/97
agcucgaggaccaccuggucgc

SEQ ID NO: 1121686 - RNA, 12 nt, Mycobacterium bovis subsp bovis AF2122/97
agcucgccggcg

SEQ ID NO: 1121687 - RNA, 13 nt, Mycobacterium bovis subsp bovis AF2122/97
agcucgaugccgu

SEQ ID NO: 1121688 - RNA, 13 nt, Mycobacterium bovis subsp bovis AF2122/97
agcucgccggcga

SEQ ID NO: 1121689 - RNA, 18 nt, Mycobacterium bovis subsp bovis AF2122/97
agcucgcgcacgucgacg

SEQ ID NO: 1121690 - RNA, 16 nt, Mycobacterium bovis subsp bovis AF2122/97
agcucggccaccagcg

SEQ ID NO: 1121691 - RNA, 18 nt, Mycobacterium bovis subsp bovis AF2122/97
agcucgcacucguugccg

SEQ ID NO: 1121692 - RNA, 21 nt, Mycobacterium bovis subsp bovis AF2122/97
agcucggcccagcgcgccagc

SEQ ID NO: 1121693 - RNA, 15 nt, Mycobacterium bovis subsp bovis AF2122/97
agcucggccgaggcg

SEQ ID NO: 1121694 - RNA, 17 nt, Mycobacterium bovis subsp bovis AF2122/97
agcucggccccgccgcc

SEQ ID NO: 1121695 - RNA, 24 nt, Mycobacterium bovis subsp bovis AF2122/97
agcucgggcagggaccgcaucggu

SEQ ID NO: 1121696 - RNA, 16 nt, Mycobacterium bovis subsp bovis AF2122/97
agcucggggcgaugag

SEQ ID NO: 1121697 - RNA, 14 nt, Mycobacterium bovis subsp bovis AF2122/97
agcucggcggcagc

SEQ ID NO: 1121698 - RNA, 17 nt, Mycobacterium bovis subsp bovis AF2122/97
agcucggcggcagcggc

SEQ ID NO: 1121699 - RNA, 18 nt, Mycobacterium bovis subsp bovis AF2122/97
agcucggcggcagcggcg

SEQ ID NO: 1121700 - RNA, 23 nt, Mycobacterium bovis subsp bovis AF2122/97
agcucggcgaugcugagccgguc

SEQ ID NO: 1121701 - RNA, 20 nt, Mycobacterium bovis subsp bovis AF2122/97
agcucggcgcccagcucguc

SEQ ID NO: 1121702 - RNA, 19 nt, Mycobacterium bovis subsp bovis AF2122/97
agcucgcgggccgcgucga

SEQ ID NO: 1121703 - RNA, 23 nt, Mycobacterium bovis subsp bovis AF2122/97
agcucgcgguagucguugccgau

SEQ ID NO: 1121704 - RNA, 23 nt, Mycobacterium bovis subsp bovis AF2122/97
agcucgcgguuuuggucgcgaug

SEQ ID NO: 1121705 - RNA, 20 nt, Mycobacterium bovis subsp bovis AF2122/97
agcucggccaccagcgcccg

SEQ ID NO: 1121706 - RNA, 24 nt, Mycobacterium bovis subsp bovis AF2122/97
agcucggccagcacgccgccggcc

SEQ ID NO: 1121707 - RNA, 12 nt, Mycobacterium bovis subsp bovis AF2122/97
agcucggccagg

SEQ ID NO: 1121708 - RNA, 15 nt, Mycobacterium bovis subsp bovis AF2122/97
agcucgcugacggca

SEQ ID NO: 1121709 - RNA, 15 nt, Mycobacterium bovis subsp bovis AF2122/97
agcucgguaggccgg

SEQ ID NO: 1121710 - RNA, 18 nt, Mycobacterium bovis subsp bovis AF2122/97
agcucgguaggccggcaa

SEQ ID NO: 1121711 - RNA, 22 nt, Mycobacterium bovis subsp bovis AF2122/97
agcucggugacaagcggcccgc

SEQ ID NO: 1121712 - RNA, 17 nt, Mycobacterium bovis subsp bovis AF2122/97
agcucggucagcgucag

SEQ ID NO: 1121713 - RNA, 20 nt, Mycobacterium bovis subsp bovis AF2122/97
agcucgucggcgauggccag

SEQ ID NO: 1121714 - RNA, 20 nt, Mycobacterium bovis subsp bovis AF2122/97
agcucgucgagcgcgucggu

SEQ ID NO: 1121715 - RNA, 21 nt, Mycobacterium bovis subsp bovis AF2122/97
agcucguugcuggcggccagc

SEQ ID NO: 1121716 - RNA, 13 nt, Mycobacterium bovis subsp bovis AF2122/97
agcucuucggaca

SEQ ID NO: 1121717 - RNA, 21 nt, Mycobacterium bovis subsp bovis AF2122/97
agcugacacccgcagcugugg

SEQ ID NO: 1121718 - RNA, 12 nt, Mycobacterium bovis subsp bovis AF2122/97
agcugaccgcca

SEQ ID NO: 1121719 - RNA, 22 nt, Mycobacterium bovis subsp bovis AF2122/97
agcugaacuacugcgaucgcga

SEQ ID NO: 1121720 - RNA, 17 nt, Mycobacterium bovis subsp bovis AF2122/97
agcugacgucaccacga

SEQ ID NO: 1121721 - RNA, 22 nt, Mycobacterium bovis subsp bovis AF2122/97
agcucuugcgggcagccgcccg

SEQ ID NO: 1121722 - RNA, 19 nt, Mycobacterium bovis subsp bovis AF2122/97
agcugaccgccagcggccg

SEQ ID NO: 1121723 - RNA, 16 nt, Mycobacterium bovis subsp bovis AF2122/97
agcugacgagccggug

SEQ ID NO: 1121724 - RNA, 19 nt, Mycobacterium bovis subsp bovis AF2122/97
agcugacgagccgguggcg

SEQ ID NO: 1121725 - RNA, 19 nt, Mycobacterium bovis subsp bovis AF2122/97
agcugaugccuggucgcgg

SEQ ID NO: 1121726 - RNA, 20 nt, Mycobacterium bovis subsp bovis AF2122/97
agcugaugccuggucgcggg

SEQ ID NO: 1121727 - RNA, 23 nt, Mycobacterium bovis subsp bovis AF2122/97
agcugauccggguggcgucaccg

SEQ ID NO: 1121728 - RNA, 16 nt, Mycobacterium bovis subsp bovis AF2122/97
agcugagccgucggcg

SEQ ID NO: 1121729 - RNA, 17 nt, Mycobacterium bovis subsp bovis AF2122/97
agcugauacgcaugcga

SEQ ID NO: 1121730 - RNA, 18 nt, Mycobacterium bovis subsp bovis AF2122/97
agcuagcccucagcuagc

SEQ ID NO: 1121731 - RNA, 13 nt, Mycobacterium bovis subsp bovis AF2122/97
agcuauacagcgg

SEQ ID NO: 1121732 - RNA, 16 nt, Mycobacterium bovis subsp bovis AF2122/97
agcucaaccaccucgc

SEQ ID NO: 1121733 - RNA, 21 nt, Mycobacterium bovis subsp bovis AF2122/97
agcucaaccaccucgccaaca

SEQ ID NO: 1121734 - RNA, 21 nt, Mycobacterium bovis subsp bovis AF2122/97
agcuaugucaccugggccagc

SEQ ID NO: 1121735 - RNA, 19 nt, Mycobacterium bovis subsp bovis AF2122/97
agcucacccggagcacccg

SEQ ID NO: 1121736 - RNA, 16 nt, Mycobacterium bovis subsp bovis AF2122/97
agcucaccacaucggu

SEQ ID NO: 1121737 - RNA, 15 nt, Mycobacterium bovis subsp bovis AF2122/97
agcucaccacccgca

SEQ ID NO: 1121738 - RNA, 22 nt, Mycobacterium bovis subsp bovis AF2122/97
agcucaauggcuucgaagcgau

SEQ ID NO: 1121739 - RNA, 20 nt, Mycobacterium bovis subsp bovis AF2122/97
agcuauugcuauuccgcggc

SEQ ID NO: 1121740 - RNA, 15 nt, Mycobacterium bovis subsp bovis AF2122/97
agcuaacccgccacg

SEQ ID NO: 1121741 - RNA, 16 nt, Mycobacterium bovis subsp bovis AF2122/97
agcuacucacggugau

SEQ ID NO: 1121742 - RNA, 21 nt, Mycobacterium bovis subsp bovis AF2122/97
agcuagacccgucaccgccga

SEQ ID NO: 1121743 - RNA, 16 nt, Mycobacterium bovis subsp bovis AF2122/97
agcguugccaggugcu

SEQ ID NO: 1121744 - RNA, 14 nt, Mycobacterium bovis subsp bovis AF2122/97
agcguugaccgcgg

SEQ ID NO: 1121745 - RNA, 20 nt, Mycobacterium bovis subsp bovis AF2122/97
agcguuggcuucuucgguca

SEQ ID NO: 1121746 - RNA, 14 nt, Mycobacterium bovis subsp bovis AF2122/97
agcguugucgccca

SEQ ID NO: 1121747 - RNA, 22 nt, Mycobacterium bovis subsp bovis AF2122/97
agcuccguggugcuagcgccgc

SEQ ID NO: 1121748 - RNA, 14 nt, Mycobacterium bovis subsp bovis AF2122/97
agcuccucgcccag

SEQ ID NO: 1121749 - RNA, 16 nt, Mycobacterium bovis subsp bovis AF2122/97
agcuccugcaugccgg

SEQ ID NO: 1121750 - RNA, 15 nt, Mycobacterium bovis subsp bovis AF2122/97
agcuccuugagcaau

SEQ ID NO: 1121751 - RNA, 21 nt, Mycobacterium bovis subsp bovis AF2122/97
agcuccgggucgacgacgucg

SEQ ID NO: 1121752 - RNA, 22 nt, Mycobacterium bovis subsp bovis AF2122/97
agcuccuauggcaagcggccgc

SEQ ID NO: 1121753 - RNA, 19 nt, Mycobacterium bovis subsp bovis AF2122/97
agcuccgggugcagaucgc

SEQ ID NO: 1121754 - RNA, 24 nt, Mycobacterium bovis subsp bovis AF2122/97
agcuccgggugcagaucgccccag

SEQ ID NO: 1121755 - RNA, 12 nt, Mycobacterium bovis subsp bovis AF2122/97
agcuccgucgcg

SEQ ID NO: 1121756 - RNA, 19 nt, Mycobacterium bovis subsp bovis AF2122/97
agcuccgucgcggccgaga

SEQ ID NO: 1121757 - RNA, 15 nt, Mycobacterium bovis subsp bovis AF2122/97
agcuccgccgccgac

SEQ ID NO: 1121758 - RNA, 22 nt, Mycobacterium bovis subsp bovis AF2122/97
agcuccgccgccgacggaucgc

SEQ ID NO: 1121759 - RNA, 16 nt, Mycobacterium bovis subsp bovis AF2122/97
agcuccgccugccgcu

SEQ ID NO: 1121760 - RNA, 17 nt, Mycobacterium bovis subsp bovis AF2122/97
agcucccugggcgucga

SEQ ID NO: 1121761 - RNA, 20 nt, Mycobacterium bovis subsp bovis AF2122/97
agcucccugggcgucgacca

SEQ ID NO: 1121762 - RNA, 12 nt, Mycobacterium bovis subsp bovis AF2122/97
agcuccccgacc

SEQ ID NO: 1121763 - RNA, 16 nt, Mycobacterium bovis subsp bovis AF2122/97
agcuccccgaccgaac

SEQ ID NO: 1121764 - RNA, 20 nt, Mycobacterium bovis subsp bovis AF2122/97
agcuccaccgugacggccau

SEQ ID NO: 1121765 - RNA, 19 nt, Mycobacterium bovis subsp bovis AF2122/97
agcuccaaccaugcgguua

SEQ ID NO: 1121766 - RNA, 20 nt, Mycobacterium bovis subsp bovis AF2122/97
agcuccagcaaaacccgcuc

SEQ ID NO: 1121767 - RNA, 17 nt, Mycobacterium bovis subsp bovis AF2122/97
agcucaccgacggagau

SEQ ID NO: 1121768 - RNA, 21 nt, Mycobacterium bovis subsp bovis AF2122/97
agcuacgucggcucgucgcuc

SEQ ID NO: 1121769 - RNA, 17 nt, Mycobacterium bovis subsp bovis AF2122/97
agcucagaccggcgccg

SEQ ID NO: 1121770 - RNA, 13 nt, Mycobacterium bovis subsp bovis AF2122/97
agcucaucgccgc

SEQ ID NO: 1121771 - RNA, 17 nt, Mycobacterium bovis subsp bovis AF2122/97
agcucaucgccgcuacc

SEQ ID NO: 1121772 - RNA, 17 nt, Mycobacterium bovis subsp bovis AF2122/97
agcggaucgcggucagc

SEQ ID NO: 1121773 - RNA, 23 nt, Mycobacterium bovis subsp bovis AF2122/97
agcggauccaggccucgcaccgg

SEQ ID NO: 1121774 - RNA, 22 nt, Mycobacterium bovis subsp bovis AF2122/97
agcggaucccgccggugugccc

SEQ ID NO: 1121775 - RNA, 18 nt, Mycobacterium bovis subsp bovis AF2122/97
agcggaauggaggccgcc

SEQ ID NO: 1121776 - RNA, 20 nt, Mycobacterium bovis subsp bovis AF2122/97
agcggaauggaggccgccga

SEQ ID NO: 1121777 - RNA, 22 nt, Mycobacterium bovis subsp bovis AF2122/97
agcggaucaggucuggcgcgga

SEQ ID NO: 1121778 - RNA, 17 nt, Mycobacterium bovis subsp bovis AF2122/97
agcggauguccccgacg

SEQ ID NO: 1121779 - RNA, 22 nt, Mycobacterium bovis subsp bovis AF2122/97
agcggaucgcggucagcggguc

SEQ ID NO: 1121780 - RNA, 21 nt, Mycobacterium bovis subsp bovis AF2122/97
agcggcaacaugucaccugca

SEQ ID NO: 1121781 - RNA, 21 nt, Mycobacterium bovis subsp bovis AF2122/97
agcggcgaguuggccguggcg

SEQ ID NO: 1121782 - RNA, 12 nt, Mycobacterium bovis subsp bovis AF2122/97
agcggcgaucag

SEQ ID NO: 1121783 - RNA, 21 nt, Mycobacterium bovis subsp bovis AF2122/97
agcggcgauugauccgguggc

SEQ ID NO: 1121784 - RNA, 18 nt, Mycobacterium bovis subsp bovis AF2122/97
agcggauucacgcaccgg

SEQ ID NO: 1121785 - RNA, 17 nt, Mycobacterium bovis subsp bovis AF2122/97
agcggauucagcgucgc

SEQ ID NO: 1121786 - RNA, 15 nt, Mycobacterium bovis subsp bovis AF2122/97
agcggcaauggccag

SEQ ID NO: 1121787 - RNA, 16 nt, Mycobacterium bovis subsp bovis AF2122/97
agcggcaauggccagc

SEQ ID NO: 1121788 - RNA, 18 nt, Mycobacterium bovis subsp bovis AF2122/97
agcggcaauggccagcac

SEQ ID NO: 1121789 - RNA, 21 nt, Mycobacterium bovis subsp bovis AF2122/97
agcggcaauggccagcaccac

SEQ ID NO: 1121790 - RNA, 19 nt, Mycobacterium bovis subsp bovis AF2122/97
agcggcgcccgccaccgga

SEQ ID NO: 1121791 - RNA, 14 nt, Mycobacterium bovis subsp bovis AF2122/97
agcggcgccgcaca

SEQ ID NO: 1121792 - RNA, 14 nt, Mycobacterium bovis subsp bovis AF2122/97
agcggcgccgcccu

SEQ ID NO: 1121793 - RNA, 22 nt, Mycobacterium bovis subsp bovis AF2122/97
agcggcgccgccuggacgccgc

SEQ ID NO: 1121794 - RNA, 17 nt, Mycobacterium bovis subsp bovis AF2122/97
agcggcgucgucgucga

SEQ ID NO: 1121795 - RNA, 22 nt, Mycobacterium bovis subsp bovis AF2122/97
agcggcgcgaggaacgccgggg

SEQ ID NO: 1121796 - RNA, 23 nt, Mycobacterium bovis subsp bovis AF2122/97
agcggcguuccgggccgaucacc

SEQ ID NO: 1121797 - RNA, 14 nt, Mycobacterium bovis subsp bovis AF2122/97
agcggcugcccgag

SEQ ID NO: 1121798 - RNA, 21 nt, Mycobacterium bovis subsp bovis AF2122/97
agcggcugcccgagaucgcgu

SEQ ID NO: 1121799 - RNA, 20 nt, Mycobacterium bovis subsp bovis AF2122/97
agcggcugcugcgcggugcc

SEQ ID NO: 1121800 - RNA, 14 nt, Mycobacterium bovis subsp bovis AF2122/97
agcggcucaccgcg

SEQ ID NO: 1121801 - RNA, 23 nt, Mycobacterium bovis subsp bovis AF2122/97
agcggcgugucguugccagggcg

SEQ ID NO: 1121802 - RNA, 17 nt, Mycobacterium bovis subsp bovis AF2122/97
agcggcguucgaugcca

SEQ ID NO: 1121803 - RNA, 21 nt, Mycobacterium bovis subsp bovis AF2122/97
agcgggaaggguggaccgggg

SEQ ID NO: 1121804 - RNA, 18 nt, Mycobacterium bovis subsp bovis AF2122/97
agcggcugcggcaacgag

SEQ ID NO: 1121805 - RNA, 20 nt, Mycobacterium bovis subsp bovis AF2122/97
agcgggugaaucgacaccgc

SEQ ID NO: 1121806 - RNA, 15 nt, Mycobacterium bovis subsp bovis AF2122/97
agcgggucgccgggc

SEQ ID NO: 1121807 - RNA, 13 nt, Mycobacterium bovis subsp bovis AF2122/97
agcgggucgcggg

SEQ ID NO: 1121808 - RNA, 18 nt, Mycobacterium bovis subsp bovis AF2122/97
agcggguccccggucagg

SEQ ID NO: 1121809 - RNA, 15 nt, Mycobacterium bovis subsp bovis AF2122/97
agcgggucagcucga

SEQ ID NO: 1121810 - RNA, 18 nt, Mycobacterium bovis subsp bovis AF2122/97
agcgggucagcucgaccu

SEQ ID NO: 1121811 - RNA, 13 nt, Mycobacterium bovis subsp bovis AF2122/97
agcgggcccgcag

SEQ ID NO: 1121812 - RNA, 18 nt, Mycobacterium bovis subsp bovis AF2122/97
agcgggccagcacccgcu

SEQ ID NO: 1121813 - RNA, 17 nt, Mycobacterium bovis subsp bovis AF2122/97
agcgggcaagucgccca

SEQ ID NO: 1121814 - RNA, 16 nt, Mycobacterium bovis subsp bovis AF2122/97
agcgggaugagcucgu

SEQ ID NO: 1121815 - RNA, 16 nt, Mycobacterium bovis subsp bovis AF2122/97
agcgggacugcagcgc

SEQ ID NO: 1121816 - RNA, 23 nt, Mycobacterium bovis subsp bovis AF2122/97
agcggcuugggauuugggcgagu

SEQ ID NO: 1121817 - RNA, 14 nt, Mycobacterium bovis subsp bovis AF2122/97
agcgggauugccga

SEQ ID NO: 1121818 - RNA, 19 nt, Mycobacterium bovis subsp bovis AF2122/97
agcggcuuggccgggagug

SEQ ID NO: 1121819 - RNA, 17 nt, Mycobacterium bovis subsp bovis AF2122/97
agcgggcacgccgccga

SEQ ID NO: 1121820 - RNA, 21 nt, Mycobacterium bovis subsp bovis AF2122/97
agcgggcauaacccgcaccgg

SEQ ID NO: 1121821 - RNA, 12 nt, Mycobacterium bovis subsp bovis AF2122/97
agcgggcaucgc

SEQ ID NO: 1121822 - RNA, 13 nt, Mycobacterium bovis subsp bovis AF2122/97
agcgggccagcac

SEQ ID NO: 1121823 - RNA, 18 nt, Mycobacterium bovis subsp bovis AF2122/97
agcgggcaagaugaucgc

SEQ ID NO: 1121824 - RNA, 15 nt, Mycobacterium bovis subsp bovis AF2122/97
agcgggcaagucgcc

SEQ ID NO: 1121825 - RNA, 18 nt, Mycobacterium bovis subsp bovis AF2122/97
agcgggugccagcccguu

SEQ ID NO: 1121826 - RNA, 22 nt, Mycobacterium bovis subsp bovis AF2122/97
agcgggugccaucggugguggc

SEQ ID NO: 1121827 - RNA, 23 nt, Mycobacterium bovis subsp bovis AF2122/97
agcggguucgacguugaucgcca

SEQ ID NO: 1121828 - RNA, 21 nt, Mycobacterium bovis subsp bovis AF2122/97
agcggguucgacguugaucgc

SEQ ID NO: 1121829 - RNA, 21 nt, Mycobacterium bovis subsp bovis AF2122/97
agcggguugggaccgaacacg

SEQ ID NO: 1121830 - RNA, 22 nt, Mycobacterium bovis subsp bovis AF2122/97
agcgguggccucccacggcgcg

SEQ ID NO: 1121831 - RNA, 17 nt, Mycobacterium bovis subsp bovis AF2122/97
agcggugaauucggcga

SEQ ID NO: 1121832 - RNA, 20 nt, Mycobacterium bovis subsp bovis AF2122/97
agcgguggucggcgcgccgu

SEQ ID NO: 1121833 - RNA, 15 nt, Mycobacterium bovis subsp bovis AF2122/97
agcgguguagccggc

SEQ ID NO: 1121834 - RNA, 16 nt, Mycobacterium bovis subsp bovis AF2122/97
agcggucggcgaccac

SEQ ID NO: 1121835 - RNA, 14 nt, Mycobacterium bovis subsp bovis AF2122/97
agcggugcagcccg

SEQ ID NO: 1121836 - RNA, 21 nt, Mycobacterium bovis subsp bovis AF2122/97
agcggucuccccagagcuggu

SEQ ID NO: 1121837 - RNA, 15 nt, Mycobacterium bovis subsp bovis AF2122/97
agcgucgcggccacg

SEQ ID NO: 1121838 - RNA, 17 nt, Mycobacterium bovis subsp bovis AF2122/97
agcgucgcugcccgcgg

SEQ ID NO: 1121839 - RNA, 16 nt, Mycobacterium bovis subsp bovis AF2122/97
agcgugaacugagggc

SEQ ID NO: 1121840 - RNA, 11 nt, Mycobacterium bovis subsp bovis AF2122/97
agcguccuggu

SEQ ID NO: 1121841 - RNA, 12 nt, Mycobacterium bovis subsp bovis AF2122/97
agcguccgcugc

SEQ ID NO: 1121842 - RNA, 20 nt, Mycobacterium bovis subsp bovis AF2122/97
agcgguuagaucacccgcag

SEQ ID NO: 1121843 - RNA, 22 nt, Mycobacterium bovis subsp bovis AF2122/97
agcgguuagaucacccgcagcc

SEQ ID NO: 1121844 - RNA, 12 nt, Mycobacterium bovis subsp bovis AF2122/97
agcgucgcaccc

SEQ ID NO: 1121845 - RNA, 17 nt, Mycobacterium bovis subsp bovis AF2122/97
agcguccgucgucggcg

SEQ ID NO: 1121846 - RNA, 23 nt, Mycobacterium bovis subsp bovis AF2122/97
agcgucgccuucguaaccacgac

SEQ ID NO: 1121847 - RNA, 23 nt, Mycobacterium bovis subsp bovis AF2122/97
agcguggacaucgggcggcaccg

SEQ ID NO: 1121848 - RNA, 15 nt, Mycobacterium bovis subsp bovis AF2122/97
agcguggagaucacg

SEQ ID NO: 1121849 - RNA, 17 nt, Mycobacterium bovis subsp bovis AF2122/97
agcgugcgaugcagcgc

SEQ ID NO: 1121850 - RNA, 23 nt, Mycobacterium bovis subsp bovis AF2122/97
agcgugccgaacagggaggucgc

SEQ ID NO: 1121851 - RNA, 20 nt, Mycobacterium bovis subsp bovis AF2122/97
agcgugccgcagcggcggca

SEQ ID NO: 1121852 - RNA, 22 nt, Mycobacterium bovis subsp bovis AF2122/97
agcgugccgcagcggcggcaac

SEQ ID NO: 1121853 - RNA, 22 nt, Mycobacterium bovis subsp bovis AF2122/97
agcgugccugcaguucggcgua

SEQ ID NO: 1121854 - RNA, 18 nt, Mycobacterium bovis subsp bovis AF2122/97
agcgugagcgccgcggcg

SEQ ID NO: 1121855 - RNA, 14 nt, Mycobacterium bovis subsp bovis AF2122/97
agcgugaccaccgc

SEQ ID NO: 1121856 - RNA, 19 nt, Mycobacterium bovis subsp bovis AF2122/97
agcgugaccaccgccgaca

SEQ ID NO: 1121857 - RNA, 18 nt, Mycobacterium bovis subsp bovis AF2122/97
agcgugacccgccggcga

SEQ ID NO: 1121858 - RNA, 15 nt, Mycobacterium bovis subsp bovis AF2122/97
agcgugcccgccacc

SEQ ID NO: 1121859 - RNA, 14 nt, Mycobacterium bovis subsp bovis AF2122/97
agcgugcagcggcg

SEQ ID NO: 1121860 - RNA, 15 nt, Mycobacterium bovis subsp bovis AF2122/97
agcguggugaagucg

SEQ ID NO: 1121861 - RNA, 20 nt, Mycobacterium bovis subsp bovis AF2122/97
agcgugucgcccuguucggc

SEQ ID NO: 1121862 - RNA, 13 nt, Mycobacterium bovis subsp bovis AF2122/97
agcgugucgccga

SEQ ID NO: 1121863 - RNA, 23 nt, Mycobacterium bovis subsp bovis AF2122/97
agcgugugcucgugggcgacgag

SEQ ID NO: 1121864 - RNA, 20 nt, Mycobacterium bovis subsp bovis AF2122/97
agcguguggagcucgcggcg

SEQ ID NO: 1121865 - RNA, 17 nt, Mycobacterium bovis subsp bovis AF2122/97
agcguggcgcccgugcc

SEQ ID NO: 1121866 - RNA, 17 nt, Mycobacterium bovis subsp bovis AF2122/97
agcguggggccgccacc

SEQ ID NO: 1121867 - RNA, 15 nt, Mycobacterium bovis subsp bovis AF2122/97
agcgugggcagcgcg

SEQ ID NO: 1121868 - RNA, 16 nt, Mycobacterium bovis subsp bovis AF2122/97
agcgugggcagcgcga

SEQ ID NO: 1121869 - RNA, 20 nt, Mycobacterium bovis subsp bovis AF2122/97
agcgugggcagcgcgaucac

SEQ ID NO: 1121870 - RNA, 14 nt, Mycobacterium bovis subsp bovis AF2122/97
agcguucaaggucu

SEQ ID NO: 1121871 - RNA, 16 nt, Mycobacterium bovis subsp bovis AF2122/97
agcguuaggucgccgg

SEQ ID NO: 1121872 - RNA, 12 nt, Mycobacterium bovis subsp bovis AF2122/97
agcgccagcagc

SEQ ID NO: 1121873 - RNA, 21 nt, Mycobacterium bovis subsp bovis AF2122/97
agcgccagcagccacccgaca

SEQ ID NO: 1121874 - RNA, 14 nt, Mycobacterium bovis subsp bovis AF2122/97
agcgccagcgagca

SEQ ID NO: 1121875 - RNA, 22 nt, Mycobacterium bovis subsp bovis AF2122/97
agcgccagcgagcauaccgccg

SEQ ID NO: 1121876 - RNA, 14 nt, Mycobacterium bovis subsp bovis AF2122/97
agcgcccccagcag

SEQ ID NO: 1121877 - RNA, 19 nt, Mycobacterium bovis subsp bovis AF2122/97
agcgcccagaucgccgaga

SEQ ID NO: 1121878 - RNA, 19 nt, Mycobacterium bovis subsp bovis AF2122/97
agcgcccccagcagcugcg

SEQ ID NO: 1121879 - RNA, 14 nt, Mycobacterium bovis subsp bovis AF2122/97
agcgcccccgcugc

SEQ ID NO: 1121880 - RNA, 19 nt, Mycobacterium bovis subsp bovis AF2122/97
agcgccccgcgguccuggu

SEQ ID NO: 1121881 - RNA, 18 nt, Mycobacterium bovis subsp bovis AF2122/97
agcgcccggcccgccacc

SEQ ID NO: 1121882 - RNA, 16 nt, Mycobacterium bovis subsp bovis AF2122/97
agcgcccgcgcggcca

SEQ ID NO: 1121883 - RNA, 13 nt, Mycobacterium bovis subsp bovis AF2122/97
agcgccacccgcg

SEQ ID NO: 1121884 - RNA, 21 nt, Mycobacterium bovis subsp bovis AF2122/97
agcgccacccgguccggcccg

SEQ ID NO: 1121885 - RNA, 13 nt, Mycobacterium bovis subsp bovis AF2122/97
agcgccaccguua

SEQ ID NO: 1121886 - RNA, 15 nt, Mycobacterium bovis subsp bovis AF2122/97
agcgcauuuguugcu

SEQ ID NO: 1121887 - RNA, 16 nt, Mycobacterium bovis subsp bovis AF2122/97
agcgccacauacaccg

SEQ ID NO: 1121888 - RNA, 22 nt, Mycobacterium bovis subsp bovis AF2122/97
agcgccaaacccggcgggcccg

SEQ ID NO: 1121889 - RNA, 12 nt, Mycobacterium bovis subsp bovis AF2122/97
agcgccgcggcg

SEQ ID NO: 1121890 - RNA, 23 nt, Mycobacterium bovis subsp bovis AF2122/97
agcgccgcgcuugcgaucggcac

SEQ ID NO: 1121891 - RNA, 16 nt, Mycobacterium bovis subsp bovis AF2122/97
agcgccgcuuggcgau

SEQ ID NO: 1121892 - RNA, 18 nt, Mycobacterium bovis subsp bovis AF2122/97
agcgccgcuuggcgaucc

SEQ ID NO: 1121893 - RNA, 19 nt, Mycobacterium bovis subsp bovis AF2122/97
agcgccgcuuggcgauccg

SEQ ID NO: 1121894 - RNA, 14 nt, Mycobacterium bovis subsp bovis AF2122/97
agcgccggcaucgc

SEQ ID NO: 1121895 - RNA, 17 nt, Mycobacterium bovis subsp bovis AF2122/97
agcgccggccaggcuau

SEQ ID NO: 1121896 - RNA, 23 nt, Mycobacterium bovis subsp bovis AF2122/97
agcgccggauggguggccagcaa

SEQ ID NO: 1121897 - RNA, 11 nt, Mycobacterium bovis subsp bovis AF2122/97
agcgccggccc

SEQ ID NO: 1121898 - RNA, 12 nt, Mycobacterium bovis subsp bovis AF2122/97
agcgccucgaug

SEQ ID NO: 1121899 - RNA, 23 nt, Mycobacterium bovis subsp bovis AF2122/97
agcgcgacguccaccagccgguu

SEQ ID NO: 1121900 - RNA, 18 nt, Mycobacterium bovis subsp bovis AF2122/97
agcgccucgccggccacc

SEQ ID NO: 1121901 - RNA, 19 nt, Mycobacterium bovis subsp bovis AF2122/97
agcgccucgccggccaccc

SEQ ID NO: 1121902 - RNA, 18 nt, Mycobacterium bovis subsp bovis AF2122/97
agcgccugagcggccucg

SEQ ID NO: 1121903 - RNA, 21 nt, Mycobacterium bovis subsp bovis AF2122/97
agcgccugcgcccagccguuc

SEQ ID NO: 1121904 - RNA, 13 nt, Mycobacterium bovis subsp bovis AF2122/97
agcgcucguuccg

SEQ ID NO: 1121905 - RNA, 24 nt, Mycobacterium bovis subsp bovis AF2122/97
agcgcuccagcacccgcgcgacgc

SEQ ID NO: 1121906 - RNA, 21 nt, Mycobacterium bovis subsp bovis AF2122/97
agcgcucguagaaucggcuca

SEQ ID NO: 1121907 - RNA, 22 nt, Mycobacterium bovis subsp bovis AF2122/97
agcgcuucggcggucgccgcgc

SEQ ID NO: 1121908 - RNA, 14 nt, Mycobacterium bovis subsp bovis AF2122/97
agcgcuugacccgc

SEQ ID NO: 1121909 - RNA, 20 nt, Mycobacterium bovis subsp bovis AF2122/97
agcgcuucgucggccggcac

SEQ ID NO: 1121910 - RNA, 21 nt, Mycobacterium bovis subsp bovis AF2122/97
agcgcuucgucggccggcacc

SEQ ID NO: 1121911 - RNA, 23 nt, Mycobacterium bovis subsp bovis AF2122/97
agcgcuucgucggccggcacccc

SEQ ID NO: 1121912 - RNA, 14 nt, Mycobacterium bovis subsp bovis AF2122/97
agcggaaaaucacc

SEQ ID NO: 1121913 - RNA, 13 nt, Mycobacterium bovis subsp bovis AF2122/97
agcgcuaucaccg

SEQ ID NO: 1121914 - RNA, 17 nt, Mycobacterium bovis subsp bovis AF2122/97
agcgcuaucaccgccuc

SEQ ID NO: 1121915 - RNA, 12 nt, Mycobacterium bovis subsp bovis AF2122/97
agcgcgucgccg

SEQ ID NO: 1121916 - RNA, 15 nt, Mycobacterium bovis subsp bovis AF2122/97
agcgcgucgccgaaa

SEQ ID NO: 1121917 - RNA, 22 nt, Mycobacterium bovis subsp bovis AF2122/97
agcgcguauggcucaccccggu

SEQ ID NO: 1121918 - RNA, 15 nt, Mycobacterium bovis subsp bovis AF2122/97
agcgcggcgucgccu

SEQ ID NO: 1121919 - RNA, 17 nt, Mycobacterium bovis subsp bovis AF2122/97
agcgcggugucggggcc

SEQ ID NO: 1121920 - RNA, 21 nt, Mycobacterium bovis subsp bovis AF2122/97
agcgcggugucggggcccccg

SEQ ID NO: 1121921 - RNA, 19 nt, Mycobacterium bovis subsp bovis AF2122/97
agcgcgguuggcugaugac

SEQ ID NO: 1121922 - RNA, 20 nt, Mycobacterium bovis subsp bovis AF2122/97
agcgcguacuuggugguggu

SEQ ID NO: 1121923 - RNA, 17 nt, Mycobacterium bovis subsp bovis AF2122/97
agcgcgcggguggcggc

SEQ ID NO: 1121924 - RNA, 18 nt, Mycobacterium bovis subsp bovis AF2122/97
agcgcgcggguggcggcg

SEQ ID NO: 1121925 - RNA, 16 nt, Mycobacterium bovis subsp bovis AF2122/97
agcgcgcguagcgggg

SEQ ID NO: 1121926 - RNA, 22 nt, Mycobacterium bovis subsp bovis AF2122/97
agcgcgcagcaguuggucgcgg

SEQ ID NO: 1121927 - RNA, 22 nt, Mycobacterium bovis subsp bovis AF2122/97
agcgcgcuacagcaucaaccgu

SEQ ID NO: 1121928 - RNA, 14 nt, Mycobacterium bovis subsp bovis AF2122/97
agcgcggccgggcg

SEQ ID NO: 1121929 - RNA, 17 nt, Mycobacterium bovis subsp bovis AF2122/97
agcgcggccuugguggg

SEQ ID NO: 1121930 - RNA, 20 nt, Mycobacterium bovis subsp bovis AF2122/97
agcgcggcgaccuguccggu

SEQ ID NO: 1121931 - RNA, 17 nt, Mycobacterium bovis subsp bovis AF2122/97
agcgcggcgaagccggg

SEQ ID NO: 1121932 - RNA, 14 nt, Mycobacterium bovis subsp bovis AF2122/97
agcgcggcgaucga

SEQ ID NO: 1121933 - RNA, 23 nt, Mycobacterium bovis subsp bovis AF2122/97
agcgcggcgcacaacccgucgag

SEQ ID NO: 1121934 - RNA, 13 nt, Mycobacterium bovis subsp bovis AF2122/97
agcgcggcggcgg

SEQ ID NO: 1121935 - RNA, 22 nt, Mycobacterium bovis subsp bovis AF2122/97
agcgcggcgcgcggggccucgc

SEQ ID NO: 1121936 - RNA, 13 nt, Mycobacterium bovis subsp bovis AF2122/97
agcgcggcgcgca

SEQ ID NO: 1121937 - RNA, 22 nt, Mycobacterium bovis subsp bovis AF2122/97
agcgcgguggucgcgaccgacc

SEQ ID NO: 1121938 - RNA, 21 nt, Mycobacterium bovis subsp bovis AF2122/97
agcgcggcggucgagcgaacc

SEQ ID NO: 1121939 - RNA, 16 nt, Mycobacterium bovis subsp bovis AF2122/97
agcgcgagcccgaacc

SEQ ID NO: 1121940 - RNA, 14 nt, Mycobacterium bovis subsp bovis AF2122/97
agcgcgaucgcggu

SEQ ID NO: 1121941 - RNA, 23 nt, Mycobacterium bovis subsp bovis AF2122/97
agcgcgaugcagugcgacccggg

SEQ ID NO: 1121942 - RNA, 16 nt, Mycobacterium bovis subsp bovis AF2122/97
agcgcgaugucgccgg

SEQ ID NO: 1121943 - RNA, 18 nt, Mycobacterium bovis subsp bovis AF2122/97
agcgcgcgcaacccugcc

SEQ ID NO: 1121944 - RNA, 22 nt, Mycobacterium bovis subsp bovis AF2122/97
agcgcgcgcaacccugccgcga

SEQ ID NO: 1121945 - RNA, 19 nt, Mycobacterium bovis subsp bovis AF2122/97
agcgcgccguugccgccca

SEQ ID NO: 1121946 - RNA, 13 nt, Mycobacterium bovis subsp bovis AF2122/97
agcgcgccggcca

SEQ ID NO: 1121947 - RNA, 15 nt, Mycobacterium bovis subsp bovis AF2122/97
agcgcgcgccgagcc

SEQ ID NO: 1121948 - RNA, 14 nt, Mycobacterium bovis subsp bovis AF2122/97
agcgcgcgccgcag

SEQ ID NO: 1121949 - RNA, 20 nt, Mycobacterium bovis subsp bovis AF2122/97
agccgcgaguccaggcugau

SEQ ID NO: 1121950 - RNA, 13 nt, Mycobacterium bovis subsp bovis AF2122/97
agccgcgagcacg

SEQ ID NO: 1121951 - RNA, 21 nt, Mycobacterium bovis subsp bovis AF2122/97
agccgcgagcacgucggggug

SEQ ID NO: 1121952 - RNA, 14 nt, Mycobacterium bovis subsp bovis AF2122/97
agccgcgagccggu

SEQ ID NO: 1121953 - RNA, 12 nt, Mycobacterium bovis subsp bovis AF2122/97
agccgcgaucgg

SEQ ID NO: 1121954 - RNA, 15 nt, Mycobacterium bovis subsp bovis AF2122/97
agccgccugucgggc

SEQ ID NO: 1121955 - RNA, 23 nt, Mycobacterium bovis subsp bovis AF2122/97
agccgcgacgcggcgucggucgg

SEQ ID NO: 1121956 - RNA, 16 nt, Mycobacterium bovis subsp bovis AF2122/97
agccgucgagcagccg

SEQ ID NO: 1121957 - RNA, 21 nt, Mycobacterium bovis subsp bovis AF2122/97
agccgucgagcagccgagcuc

SEQ ID NO: 1121958 - RNA, 14 nt, Mycobacterium bovis subsp bovis AF2122/97
agccgucgaucccg

SEQ ID NO: 1121959 - RNA, 17 nt, Mycobacterium bovis subsp bovis AF2122/97
agccgcgccgcggcccg

SEQ ID NO: 1121960 - RNA, 18 nt, Mycobacterium bovis subsp bovis AF2122/97
agccgucguccgcugacc

SEQ ID NO: 1121961 - RNA, 20 nt, Mycobacterium bovis subsp bovis AF2122/97
agccgucguccgcugacccg

SEQ ID NO: 1121962 - RNA, 23 nt, Mycobacterium bovis subsp bovis AF2122/97
agccgucguccgcugacccgcca

SEQ ID NO: 1121963 - RNA, 16 nt, Mycobacterium bovis subsp bovis AF2122/97
agccgucgcgacgucg

SEQ ID NO: 1121964 - RNA, 20 nt, Mycobacterium bovis subsp bovis AF2122/97
agccgucgaucccggucggu

SEQ ID NO: 1121965 - RNA, 18 nt, Mycobacterium bovis subsp bovis AF2122/97
agccgucgcgacgucggc

SEQ ID NO: 1121966 - RNA, 14 nt, Mycobacterium bovis subsp bovis AF2122/97
agccgugauauccg

SEQ ID NO: 1121967 - RNA, 20 nt, Mycobacterium bovis subsp bovis AF2122/97
agccgugauauccguacagu

SEQ ID NO: 1121968 - RNA, 15 nt, Mycobacterium bovis subsp bovis AF2122/97
agccgugcaccagcg

SEQ ID NO: 1121969 - RNA, 15 nt, Mycobacterium bovis subsp bovis AF2122/97
agccgugcaccucgu

SEQ ID NO: 1121970 - RNA, 16 nt, Mycobacterium bovis subsp bovis AF2122/97
agccgugcaccucgug

SEQ ID NO: 1121971 - RNA, 20 nt, Mycobacterium bovis subsp bovis AF2122/97
agccgugucaaccggucggu

SEQ ID NO: 1121972 - RNA, 22 nt, Mycobacterium bovis subsp bovis AF2122/97
agccgugcuuguugcgcgacgc

SEQ ID NO: 1121973 - RNA, 14 nt, Mycobacterium bovis subsp bovis AF2122/97
agccgugcggucgc

SEQ ID NO: 1121974 - RNA, 15 nt, Mycobacterium bovis subsp bovis AF2122/97
agccgugcggucgcg

SEQ ID NO: 1121975 - RNA, 16 nt, Mycobacterium bovis subsp bovis AF2122/97
agccgugcggucgcgc

SEQ ID NO: 1121976 - RNA, 23 nt, Mycobacterium bovis subsp bovis AF2122/97
agccgugauauccguacagucca

SEQ ID NO: 1121977 - RNA, 15 nt, Mycobacterium bovis subsp bovis AF2122/97
agccgugccgccagc

SEQ ID NO: 1121978 - RNA, 14 nt, Mycobacterium bovis subsp bovis AF2122/97
agccgugcggcggc

SEQ ID NO: 1121979 - RNA, 18 nt, Mycobacterium bovis subsp bovis AF2122/97
agccgugcggcggcugcc

SEQ ID NO: 1121980 - RNA, 22 nt, Mycobacterium bovis subsp bovis AF2122/97
agccguugccgccacgggcggc

SEQ ID NO: 1121981 - RNA, 15 nt, Mycobacterium bovis subsp bovis AF2122/97
agccguugaugcgua

SEQ ID NO: 1121982 - RNA, 12 nt, Mycobacterium bovis subsp bovis AF2122/97
agccguucgucg

SEQ ID NO: 1121983 - RNA, 17 nt, Mycobacterium bovis subsp bovis AF2122/97
agccguucccggugacc

SEQ ID NO: 1121984 - RNA, 15 nt, Mycobacterium bovis subsp bovis AF2122/97
agccguucggcaucu

SEQ ID NO: 1121985 - RNA, 13 nt, Mycobacterium bovis subsp bovis AF2122/97
agccguucggcua

SEQ ID NO: 1121986 - RNA, 15 nt, Mycobacterium bovis subsp bovis AF2122/97
agccguucgucgcgg

SEQ ID NO: 1121987 - RNA, 21 nt, Mycobacterium bovis subsp bovis AF2122/97
agccguucucgcccacccgcu

SEQ ID NO: 1121988 - RNA, 18 nt, Mycobacterium bovis subsp bovis AF2122/97
agccguucgcgucgccga

SEQ ID NO: 1121989 - RNA, 17 nt, Mycobacterium bovis subsp bovis AF2122/97
agccgugggccacgaug

SEQ ID NO: 1121990 - RNA, 15 nt, Mycobacterium bovis subsp bovis AF2122/97
agccgugcugcccau

SEQ ID NO: 1121991 - RNA, 23 nt, Mycobacterium bovis subsp bovis AF2122/97
agccgugcugcccaucccggccg

SEQ ID NO: 1121992 - RNA, 16 nt, Mycobacterium bovis subsp bovis AF2122/97
agccguggccggaccc

SEQ ID NO: 1121993 - RNA, 21 nt, Mycobacterium bovis subsp bovis AF2122/97
agccuucggugucgccgaaca

SEQ ID NO: 1121994 - RNA, 21 nt, Mycobacterium bovis subsp bovis AF2122/97
agccuaccggcuacggcgaca

SEQ ID NO: 1121995 - RNA, 20 nt, Mycobacterium bovis subsp bovis AF2122/97
agccguuuuccugaucgcgc

SEQ ID NO: 1121996 - RNA, 16 nt, Mycobacterium bovis subsp bovis AF2122/97
agccuuggacgugcgc

SEQ ID NO: 1121997 - RNA, 16 nt, Mycobacterium bovis subsp bovis AF2122/97
agccuugguagccggc

SEQ ID NO: 1121998 - RNA, 20 nt, Mycobacterium bovis subsp bovis AF2122/97
agccuugguagccggccgcu

SEQ ID NO: 1121999 - RNA, 15 nt, Mycobacterium bovis subsp bovis AF2122/97
agccuuuccggccgc

SEQ ID NO: 1122000 - RNA, 21 nt, Mycobacterium bovis subsp bovis AF2122/97
agccuuucgugcaccgcgacc

SEQ ID NO: 1122001 - RNA, 15 nt, Mycobacterium bovis subsp bovis AF2122/97
agcgaaucacccgcg

SEQ ID NO: 1122002 - RNA, 14 nt, Mycobacterium bovis subsp bovis AF2122/97
agcgaagugucgcu

SEQ ID NO: 1122003 - RNA, 16 nt, Mycobacterium bovis subsp bovis AF2122/97
agcgaagugucgcugc

SEQ ID NO: 1122004 - RNA, 12 nt, Mycobacterium bovis subsp bovis AF2122/97
agcgagcgcaca

SEQ ID NO: 1122005 - RNA, 20 nt, Mycobacterium bovis subsp bovis AF2122/97
agcgagcgcgcguagcgggg

SEQ ID NO: 1122006 - RNA, 12 nt, Mycobacterium bovis subsp bovis AF2122/97
agcgagcagcuc

SEQ ID NO: 1122007 - RNA, 21 nt, Mycobacterium bovis subsp bovis AF2122/97
agcgagcauaccgccgcugcc

SEQ ID NO: 1122008 - RNA, 15 nt, Mycobacterium bovis subsp bovis AF2122/97
agcgaggagcagggc

SEQ ID NO: 1122009 - RNA, 14 nt, Mycobacterium bovis subsp bovis AF2122/97
agcgaggagcccgg

SEQ ID NO: 1122010 - RNA, 20 nt, Mycobacterium bovis subsp bovis AF2122/97
agcgagcccagcugcgccga

SEQ ID NO: 1122011 - RNA, 19 nt, Mycobacterium bovis subsp bovis AF2122/97
agcgacagcagcgccaccc

SEQ ID NO: 1122012 - RNA, 15 nt, Mycobacterium bovis subsp bovis AF2122/97
agcgacagcgugccg

SEQ ID NO: 1122013 - RNA, 23 nt, Mycobacterium bovis subsp bovis AF2122/97
agcgaguccucgagugccgccgu

SEQ ID NO: 1122014 - RNA, 14 nt, Mycobacterium bovis subsp bovis AF2122/97
agcgagucgacgaa

SEQ ID NO: 1122015 - RNA, 15 nt, Mycobacterium bovis subsp bovis AF2122/97
agcgaucgccggccg

SEQ ID NO: 1122016 - RNA, 14 nt, Mycobacterium bovis subsp bovis AF2122/97
agcgaucgggugca

SEQ ID NO: 1122017 - RNA, 15 nt, Mycobacterium bovis subsp bovis AF2122/97
agcgaucgggugcac

SEQ ID NO: 1122018 - RNA, 21 nt, Mycobacterium bovis subsp bovis AF2122/97
agcgaucuccgugagccggac

SEQ ID NO: 1122019 - RNA, 15 nt, Mycobacterium bovis subsp bovis AF2122/97
agcgcaaugcaucgc

SEQ ID NO: 1122020 - RNA, 14 nt, Mycobacterium bovis subsp bovis AF2122/97
agcgcaaucgacca

SEQ ID NO: 1122021 - RNA, 16 nt, Mycobacterium bovis subsp bovis AF2122/97
agcgauccggcugcgg

SEQ ID NO: 1122022 - RNA, 12 nt, Mycobacterium bovis subsp bovis AF2122/97
agcgaucgccgg

SEQ ID NO: 1122023 - RNA, 22 nt, Mycobacterium bovis subsp bovis AF2122/97
agcgcaccgcugaccgcaacgc

SEQ ID NO: 1122024 - RNA, 22 nt, Mycobacterium bovis subsp bovis AF2122/97
agcgcacgauagccaccgacga

SEQ ID NO: 1122025 - RNA, 13 nt, Mycobacterium bovis subsp bovis AF2122/97
agcgcacgcucgg

SEQ ID NO: 1122026 - RNA, 20 nt, Mycobacterium bovis subsp bovis AF2122/97
agcgcaccacggcggucaac

SEQ ID NO: 1122027 - RNA, 19 nt, Mycobacterium bovis subsp bovis AF2122/97
agcgcagcaucgucgccac

SEQ ID NO: 1122028 - RNA, 13 nt, Mycobacterium bovis subsp bovis AF2122/97
agcgcacugggga

SEQ ID NO: 1122029 - RNA, 20 nt, Mycobacterium bovis subsp bovis AF2122/97
agcgcacggaccaucgccag

SEQ ID NO: 1122030 - RNA, 22 nt, Mycobacterium bovis subsp bovis AF2122/97
agcgcagcaacugggcggccug

SEQ ID NO: 1122031 - RNA, 16 nt, Mycobacterium bovis subsp bovis AF2122/97
agcgcaucgagcccgg

SEQ ID NO: 1122032 - RNA, 19 nt, Mycobacterium bovis subsp bovis AF2122/97
agcgcaucagggugggcga

SEQ ID NO: 1122033 - RNA, 14 nt, Mycobacterium bovis subsp bovis AF2122/97
agcgcaucgccaau

SEQ ID NO: 1122034 - RNA, 23 nt, Mycobacterium bovis subsp bovis AF2122/97
agcgcaucgccgcuggccagcac

SEQ ID NO: 1122035 - RNA, 13 nt, Mycobacterium bovis subsp bovis AF2122/97
agcgcaucggcca

SEQ ID NO: 1122036 - RNA, 19 nt, Mycobacterium bovis subsp bovis AF2122/97
agcccgccggacccgcccu

SEQ ID NO: 1122037 - RNA, 22 nt, Mycobacterium bovis subsp bovis AF2122/97
agcccgccggauccgccagacc

SEQ ID NO: 1122038 - RNA, 12 nt, Mycobacterium bovis subsp bovis AF2122/97
agcccgcgcagc

SEQ ID NO: 1122039 - RNA, 13 nt, Mycobacterium bovis subsp bovis AF2122/97
agcccgcgaucuc

SEQ ID NO: 1122040 - RNA, 23 nt, Mycobacterium bovis subsp bovis AF2122/97
agcccgcuggccguauaggcccg

SEQ ID NO: 1122041 - RNA, 22 nt, Mycobacterium bovis subsp bovis AF2122/97
agcccggaccgcccgugccguc

SEQ ID NO: 1122042 - RNA, 17 nt, Mycobacterium bovis subsp bovis AF2122/97
agcccggagcggucagc

SEQ ID NO: 1122043 - RNA, 16 nt, Mycobacterium bovis subsp bovis AF2122/97
agcccggccagccgca

SEQ ID NO: 1122044 - RNA, 18 nt, Mycobacterium bovis subsp bovis AF2122/97
agcccggcacugaccgcg

SEQ ID NO: 1122045 - RNA, 18 nt, Mycobacterium bovis subsp bovis AF2122/97
agcccggcauuaggccgg

SEQ ID NO: 1122046 - RNA, 21 nt, Mycobacterium bovis subsp bovis AF2122/97
agcccggccucggcgagcacg

SEQ ID NO: 1122047 - RNA, 21 nt, Mycobacterium bovis subsp bovis AF2122/97
agcccguuguccagaacggcg

SEQ ID NO: 1122048 - RNA, 17 nt, Mycobacterium bovis subsp bovis AF2122/97
agcccggccgccgagga

SEQ ID NO: 1122049 - RNA, 14 nt, Mycobacterium bovis subsp bovis AF2122/97
agcccggccgccga

SEQ ID NO: 1122050 - RNA, 13 nt, Mycobacterium bovis subsp bovis AF2122/97
agcccuggccagc

SEQ ID NO: 1122051 - RNA, 17 nt, Mycobacterium bovis subsp bovis AF2122/97
agcccuguuugacugcg

SEQ ID NO: 1122052 - RNA, 19 nt, Mycobacterium bovis subsp bovis AF2122/97
agcccuucagcgaagccgg

SEQ ID NO: 1122053 - RNA, 22 nt, Mycobacterium bovis subsp bovis AF2122/97
agcccuucagcgaagccggguc

SEQ ID NO: 1122054 - RNA, 18 nt, Mycobacterium bovis subsp bovis AF2122/97
agcccuucagcguccugg

SEQ ID NO: 1122055 - RNA, 18 nt, Mycobacterium bovis subsp bovis AF2122/97
agccgaccaggaccaccg

SEQ ID NO: 1122056 - RNA, 19 nt, Mycobacterium bovis subsp bovis AF2122/97
agccgaccaggaccaccgc

SEQ ID NO: 1122057 - RNA, 15 nt, Mycobacterium bovis subsp bovis AF2122/97
agccgaccaccgccg

SEQ ID NO: 1122058 - RNA, 16 nt, Mycobacterium bovis subsp bovis AF2122/97
agccgaccaccgccgg

SEQ ID NO: 1122059 - RNA, 22 nt, Mycobacterium bovis subsp bovis AF2122/97
agccgaccaccgccgggcugug

SEQ ID NO: 1122060 - RNA, 19 nt, Mycobacterium bovis subsp bovis AF2122/97
agccgacagauggucgguc

SEQ ID NO: 1122061 - RNA, 13 nt, Mycobacterium bovis subsp bovis AF2122/97
agccgacaucggc

SEQ ID NO: 1122062 - RNA, 17 nt, Mycobacterium bovis subsp bovis AF2122/97
agccgacaucggcggcc

SEQ ID NO: 1122063 - RNA, 13 nt, Mycobacterium bovis subsp bovis AF2122/97
agcccugcgcagc

SEQ ID NO: 1122064 - RNA, 21 nt, Mycobacterium bovis subsp bovis AF2122/97
agcccuaucagccgagacacc

SEQ ID NO: 1122065 - RNA, 15 nt, Mycobacterium bovis subsp bovis AF2122/97
agcccuccucgauga

SEQ ID NO: 1122066 - RNA, 23 nt, Mycobacterium bovis subsp bovis AF2122/97
agccgcccgcccaccucgaucgc

SEQ ID NO: 1122067 - RNA, 14 nt, Mycobacterium bovis subsp bovis AF2122/97
agccgcccgcccgg

SEQ ID NO: 1122068 - RNA, 14 nt, Mycobacterium bovis subsp bovis AF2122/97
agccgccgccggca

SEQ ID NO: 1122069 - RNA, 15 nt, Mycobacterium bovis subsp bovis AF2122/97
agccgccgccggcaa

SEQ ID NO: 1122070 - RNA, 22 nt, Mycobacterium bovis subsp bovis AF2122/97
agccgcgacauccgcggcaugc

SEQ ID NO: 1122071 - RNA, 17 nt, Mycobacterium bovis subsp bovis AF2122/97
agccgcgaccagaggcg

SEQ ID NO: 1122072 - RNA, 16 nt, Mycobacterium bovis subsp bovis AF2122/97
agccgaucaucaccgg

SEQ ID NO: 1122073 - RNA, 19 nt, Mycobacterium bovis subsp bovis AF2122/97
agccgaucaucaccggcau

SEQ ID NO: 1122074 - RNA, 18 nt, Mycobacterium bovis subsp bovis AF2122/97
agccgaucgcccgcugag

SEQ ID NO: 1122075 - RNA, 15 nt, Mycobacterium bovis subsp bovis AF2122/97
agccgaucaccgccg

SEQ ID NO: 1122076 - RNA, 18 nt, Mycobacterium bovis subsp bovis AF2122/97
agccgauccagcaggccg

SEQ ID NO: 1122077 - RNA, 21 nt, Mycobacterium bovis subsp bovis AF2122/97
agccgccauguacaggcccca

SEQ ID NO: 1122078 - RNA, 19 nt, Mycobacterium bovis subsp bovis AF2122/97
agccgccauugagcucccg

SEQ ID NO: 1122079 - RNA, 21 nt, Mycobacterium bovis subsp bovis AF2122/97
agccgccauugagcucccgca

SEQ ID NO: 1122080 - RNA, 21 nt, Mycobacterium bovis subsp bovis AF2122/97
agccgcccaagccgccggcgc

SEQ ID NO: 1122081 - RNA, 20 nt, Mycobacterium bovis subsp bovis AF2122/97
agccgagguucaaagcagcg

SEQ ID NO: 1122082 - RNA, 23 nt, Mycobacterium bovis subsp bovis AF2122/97
agccgaggaaguccagcuggccg

SEQ ID NO: 1122083 - RNA, 22 nt, Mycobacterium bovis subsp bovis AF2122/97
agccgaggacuggaaagcagca

SEQ ID NO: 1122084 - RNA, 12 nt, Mycobacterium bovis subsp bovis AF2122/97
agccgaccgaau

SEQ ID NO: 1122085 - RNA, 12 nt, Mycobacterium bovis subsp bovis AF2122/97
agccgaccgacc

SEQ ID NO: 1122086 - RNA, 15 nt, Mycobacterium bovis subsp bovis AF2122/97
agccgaccgaccgca

SEQ ID NO: 1122087 - RNA, 23 nt, Mycobacterium bovis subsp bovis AF2122/97
agccgaccgaccuggucggugac

SEQ ID NO: 1122088 - RNA, 14 nt, Mycobacterium bovis subsp bovis AF2122/97
agccgaccgauggc

SEQ ID NO: 1122089 - RNA, 12 nt, Mycobacterium bovis subsp bovis AF2122/97
agccgaccgcgg

SEQ ID NO: 1122090 - RNA, 21 nt, Mycobacterium bovis subsp bovis AF2122/97
agccgaccaugguagcgcccc

SEQ ID NO: 1122091 - RNA, 18 nt, Mycobacterium bovis subsp bovis AF2122/97
agccgaccgcgggucgug

SEQ ID NO: 1122092 - RNA, 12 nt, Mycobacterium bovis subsp bovis AF2122/97
agccgaccggca

SEQ ID NO: 1122093 - RNA, 22 nt, Mycobacterium bovis subsp bovis AF2122/97
agccgaccggcagcgaugcggu

SEQ ID NO: 1122094 - RNA, 14 nt, Mycobacterium bovis subsp bovis AF2122/97
agccgaccggcggc

SEQ ID NO: 1122095 - RNA, 14 nt, Mycobacterium bovis subsp bovis AF2122/97
agccgaccggguug

SEQ ID NO: 1122096 - RNA, 17 nt, Mycobacterium bovis subsp bovis AF2122/97
agccgacgauccacggc

SEQ ID NO: 1122097 - RNA, 12 nt, Mycobacterium bovis subsp bovis AF2122/97
agccgagcucgu

SEQ ID NO: 1122098 - RNA, 22 nt, Mycobacterium bovis subsp bovis AF2122/97
agccgacgauccacggcgaugc

SEQ ID NO: 1122099 - RNA, 18 nt, Mycobacterium bovis subsp bovis AF2122/97
agccccauugccgucgcg

SEQ ID NO: 1122100 - RNA, 14 nt, Mycobacterium bovis subsp bovis AF2122/97
agccccgucgaccu

SEQ ID NO: 1122101 - RNA, 17 nt, Mycobacterium bovis subsp bovis AF2122/97
agccccucaccucggcu

SEQ ID NO: 1122102 - RNA, 14 nt, Mycobacterium bovis subsp bovis AF2122/97
agcccgaccggucc

SEQ ID NO: 1122103 - RNA, 17 nt, Mycobacterium bovis subsp bovis AF2122/97
agcccgacgcccgacug

SEQ ID NO: 1122104 - RNA, 14 nt, Mycobacterium bovis subsp bovis AF2122/97
agcccgaaggcggc

SEQ ID NO: 1122105 - RNA, 17 nt, Mycobacterium bovis subsp bovis AF2122/97
agcccgacaccguccag

SEQ ID NO: 1122106 - RNA, 16 nt, Mycobacterium bovis subsp bovis AF2122/97
agcccgacagcagguu

SEQ ID NO: 1122107 - RNA, 18 nt, Mycobacterium bovis subsp bovis AF2122/97
agccccgaagccggugcc

SEQ ID NO: 1122108 - RNA, 13 nt, Mycobacterium bovis subsp bovis AF2122/97
agccccgaccagc

SEQ ID NO: 1122109 - RNA, 17 nt, Mycobacterium bovis subsp bovis AF2122/97
agcccccgcacgcucgg

SEQ ID NO: 1122110 - RNA, 17 nt, Mycobacterium bovis subsp bovis AF2122/97
agccccgcggccagcag

SEQ ID NO: 1122111 - RNA, 15 nt, Mycobacterium bovis subsp bovis AF2122/97
agccccgcuccgcgc

SEQ ID NO: 1122112 - RNA, 15 nt, Mycobacterium bovis subsp bovis AF2122/97
agcccccggauccgu

SEQ ID NO: 1122113 - RNA, 13 nt, Mycobacterium bovis subsp bovis AF2122/97
agccccccggcga

SEQ ID NO: 1122114 - RNA, 18 nt, Mycobacterium bovis subsp bovis AF2122/97
agcccccgacacgccgug

SEQ ID NO: 1122115 - RNA, 13 nt, Mycobacterium bovis subsp bovis AF2122/97
agcccgccgggcu

SEQ ID NO: 1122116 - RNA, 21 nt, Mycobacterium bovis subsp bovis AF2122/97
agcccgcccgguguguucggc

SEQ ID NO: 1122117 - RNA, 15 nt, Mycobacterium bovis subsp bovis AF2122/97
agcccgccgcgacca

SEQ ID NO: 1122118 - RNA, 15 nt, Mycobacterium bovis subsp bovis AF2122/97
agcccgcaucgcacc

SEQ ID NO: 1122119 - RNA, 16 nt, Mycobacterium bovis subsp bovis AF2122/97
agcccgcaucgcacca

SEQ ID NO: 1122120 - RNA, 16 nt, Mycobacterium bovis subsp bovis AF2122/97
agcccgaugccgugcc

SEQ ID NO: 1122121 - RNA, 21 nt, Mycobacterium bovis subsp bovis AF2122/97
agcccgaugccgugcccggug

SEQ ID NO: 1122122 - RNA, 19 nt, Mycobacterium bovis subsp bovis AF2122/97
agcccgauggugccgaccc

SEQ ID NO: 1122123 - RNA, 18 nt, Mycobacterium bovis subsp bovis AF2122/97
agcccgauucagcgcccc

SEQ ID NO: 1122124 - RNA, 19 nt, Mycobacterium bovis subsp bovis AF2122/97
agcccgauucagcgcccca

SEQ ID NO: 1122125 - RNA, 17 nt, Mycobacterium bovis subsp bovis AF2122/97
agcccgaugaucccgcc

SEQ ID NO: 1122126 - RNA, 20 nt, Mycobacterium bovis subsp bovis AF2122/97
agcccgaugaucccgccacc

SEQ ID NO: 1122127 - RNA, 19 nt, Mycobacterium bovis subsp bovis AF2122/97
agcccgacaguggucccgg

SEQ ID NO: 1122128 - RNA, 20 nt, Mycobacterium bovis subsp bovis AF2122/97
agcccgaguuguucgugccg

SEQ ID NO: 1122129 - RNA, 21 nt, Mycobacterium bovis subsp bovis AF2122/97
agcccgaguuguucgugccgg

SEQ ID NO: 1122130 - RNA, 21 nt, Mycobacterium bovis subsp bovis AF2122/97
agcccgaguuguuggugcccg

SEQ ID NO: 1122131 - RNA, 13 nt, Mycobacterium bovis subsp bovis AF2122/97
agccccacccgcc

SEQ ID NO: 1122132 - RNA, 17 nt, Mycobacterium bovis subsp bovis AF2122/97
agccccacccgccgccg

SEQ ID NO: 1122133 - RNA, 16 nt, Mycobacterium bovis subsp bovis AF2122/97
agccccagcgacgucg

SEQ ID NO: 1122134 - RNA, 17 nt, Mycobacterium bovis subsp bovis AF2122/97
agcccaucuaccagcuc

SEQ ID NO: 1122135 - RNA, 20 nt, Mycobacterium bovis subsp bovis AF2122/97
agcccagcagguuccacggc

SEQ ID NO: 1122136 - RNA, 14 nt, Mycobacterium bovis subsp bovis AF2122/97
agcccacgaucgcg

SEQ ID NO: 1122137 - RNA, 14 nt, Mycobacterium bovis subsp bovis AF2122/97
agcccacccgggug

SEQ ID NO: 1122138 - RNA, 18 nt, Mycobacterium bovis subsp bovis AF2122/97
agcccaccggcgccgccg

SEQ ID NO: 1122139 - RNA, 20 nt, Mycobacterium bovis subsp bovis AF2122/97
agcccaccggcgccgccggc

SEQ ID NO: 1122140 - RNA, 21 nt, Mycobacterium bovis subsp bovis AF2122/97
agcccaccggugccgcccgcg

SEQ ID NO: 1122141 - RNA, 20 nt, Mycobacterium bovis subsp bovis AF2122/97
agcccaauccgcaacagcuc

SEQ ID NO: 1122142 - RNA, 15 nt, Mycobacterium bovis subsp bovis AF2122/97
agcccacaggcggcg

SEQ ID NO: 1122143 - RNA, 16 nt, Mycobacterium bovis subsp bovis AF2122/97
agcccacaggcggcgc

SEQ ID NO: 1122144 - RNA, 18 nt, Mycobacterium bovis subsp bovis AF2122/97
agcccaaagcgccagcag

SEQ ID NO: 1122145 - RNA, 14 nt, Mycobacterium bovis subsp bovis AF2122/97
agccauucggugug

SEQ ID NO: 1122146 - RNA, 20 nt, Mycobacterium bovis subsp bovis AF2122/97
agcagucgcaaaagccccca

SEQ ID NO: 1122147 - RNA, 22 nt, Mycobacterium bovis subsp bovis AF2122/97
agcaguacuaacaacaccacca

SEQ ID NO: 1122148 - RNA, 13 nt, Mycobacterium bovis subsp bovis AF2122/97
agcauccggccgu

SEQ ID NO: 1122149 - RNA, 19 nt, Mycobacterium bovis subsp bovis AF2122/97
agcauccccgcagcgucca

SEQ ID NO: 1122150 - RNA, 20 nt, Mycobacterium bovis subsp bovis AF2122/97
agcauccacccauagacccg

SEQ ID NO: 1122151 - RNA, 13 nt, Mycobacterium bovis subsp bovis AF2122/97
agcaucagcgcca

SEQ ID NO: 1122152 - RNA, 16 nt, Mycobacterium bovis subsp bovis AF2122/97
agcaucagcccggcgc

SEQ ID NO: 1122153 - RNA, 18 nt, Mycobacterium bovis subsp bovis AF2122/97
agcaucuuuggcggccgc

SEQ ID NO: 1122154 - RNA, 17 nt, Mycobacterium bovis subsp bovis AF2122/97
agcaugccgcccgcgcc

SEQ ID NO: 1122155 - RNA, 14 nt, Mycobacterium bovis subsp bovis AF2122/97
agcaugccgcggcg

SEQ ID NO: 1122156 - RNA, 14 nt, Mycobacterium bovis subsp bovis AF2122/97
agcaugacaccggc

SEQ ID NO: 1122157 - RNA, 15 nt, Mycobacterium bovis subsp bovis AF2122/97
agcagccagcgucca

SEQ ID NO: 1122158 - RNA, 14 nt, Mycobacterium bovis subsp bovis AF2122/97
agcagccacccgac

SEQ ID NO: 1122159 - RNA, 18 nt, Mycobacterium bovis subsp bovis AF2122/97
agcagccagcguccaugg

SEQ ID NO: 1122160 - RNA, 15 nt, Mycobacterium bovis subsp bovis AF2122/97
agcagccagccaccg

SEQ ID NO: 1122161 - RNA, 21 nt, Mycobacterium bovis subsp bovis AF2122/97
agcagccagcccagccgccag

SEQ ID NO: 1122162 - RNA, 14 nt, Mycobacterium bovis subsp bovis AF2122/97
agcagcaugucgua

SEQ ID NO: 1122163 - RNA, 16 nt, Mycobacterium bovis subsp bovis AF2122/97
agcagcagugccaccg

SEQ ID NO: 1122164 - RNA, 14 nt, Mycobacterium bovis subsp bovis AF2122/97
agcagccgagcuca

SEQ ID NO: 1122165 - RNA, 16 nt, Mycobacterium bovis subsp bovis AF2122/97
agcagggcggcgaacu

SEQ ID NO: 1122166 - RNA, 14 nt, Mycobacterium bovis subsp bovis AF2122/97
agcagggccggcac

SEQ ID NO: 1122167 - RNA, 18 nt, Mycobacterium bovis subsp bovis AF2122/97
agcagggccggcaccgca

SEQ ID NO: 1122168 - RNA, 13 nt, Mycobacterium bovis subsp bovis AF2122/97
agcagggcgcgca

SEQ ID NO: 1122169 - RNA, 14 nt, Mycobacterium bovis subsp bovis AF2122/97
agcaggcggcugaa

SEQ ID NO: 1122170 - RNA, 21 nt, Mycobacterium bovis subsp bovis AF2122/97
agcaggcggcugaacggcagc

SEQ ID NO: 1122171 - RNA, 13 nt, Mycobacterium bovis subsp bovis AF2122/97
agccaggccgcaa

SEQ ID NO: 1122172 - RNA, 18 nt, Mycobacterium bovis subsp bovis AF2122/97
agccagcuugcgcaacgu

SEQ ID NO: 1122173 - RNA, 15 nt, Mycobacterium bovis subsp bovis AF2122/97
agccaggcccggcuu

SEQ ID NO: 1122174 - RNA, 21 nt, Mycobacterium bovis subsp bovis AF2122/97
agccagggaucagccgugcgg

SEQ ID NO: 1122175 - RNA, 23 nt, Mycobacterium bovis subsp bovis AF2122/97
agccagggauuuccagcagugcg

SEQ ID NO: 1122176 - RNA, 14 nt, Mycobacterium bovis subsp bovis AF2122/97
agccagcggcgaag

SEQ ID NO: 1122177 - RNA, 13 nt, Mycobacterium bovis subsp bovis AF2122/97
agccaucaccgca

SEQ ID NO: 1122178 - RNA, 17 nt, Mycobacterium bovis subsp bovis AF2122/97
agccauagugcggcagc

SEQ ID NO: 1122179 - RNA, 18 nt, Mycobacterium bovis subsp bovis AF2122/97
agccauagugcggcagcg

SEQ ID NO: 1122180 - RNA, 14 nt, Mycobacterium bovis subsp bovis AF2122/97
agccaggcgauugc

SEQ ID NO: 1122181 - RNA, 20 nt, Mycobacterium bovis subsp bovis AF2122/97
agccaggugucgucgaucgc

SEQ ID NO: 1122182 - RNA, 20 nt, Mycobacterium bovis subsp bovis AF2122/97
agccagcacugccaucgcgg

SEQ ID NO: 1122183 - RNA, 13 nt, Mycobacterium bovis subsp bovis AF2122/97
agccagcagcaca

SEQ ID NO: 1122184 - RNA, 16 nt, Mycobacterium bovis subsp bovis AF2122/97
agccagcaucggcagc

SEQ ID NO: 1122185 - RNA, 14 nt, Mycobacterium bovis subsp bovis AF2122/97
agccagaugccggu

SEQ ID NO: 1122186 - RNA, 22 nt, Mycobacterium bovis subsp bovis AF2122/97
agccagcaacaccagaugcacc

SEQ ID NO: 1122187 - RNA, 23 nt, Mycobacterium bovis subsp bovis AF2122/97
agccagcaccuagucgcggccgu

SEQ ID NO: 1122188 - RNA, 17 nt, Mycobacterium bovis subsp bovis AF2122/97
agccagaucagccgccg

SEQ ID NO: 1122189 - RNA, 17 nt, Mycobacterium bovis subsp bovis AF2122/97
agccacguuacgcucgc

SEQ ID NO: 1122190 - RNA, 17 nt, Mycobacterium bovis subsp bovis AF2122/97
agccacaaaggcgccgg

SEQ ID NO: 1122191 - RNA, 14 nt, Mycobacterium bovis subsp bovis AF2122/97
agccacaaucgcag

SEQ ID NO: 1122192 - RNA, 17 nt, Mycobacterium bovis subsp bovis AF2122/97
agccacgccggucgcgg

SEQ ID NO: 1122193 - RNA, 20 nt, Mycobacterium bovis subsp bovis AF2122/97
agccaaugcccuuggccagc

SEQ ID NO: 1122194 - RNA, 22 nt, Mycobacterium bovis subsp bovis AF2122/97
agccaaugcccuuggccagcag

SEQ ID NO: 1122195 - RNA, 16 nt, Mycobacterium bovis subsp bovis AF2122/97
agccaacuggucgcca

SEQ ID NO: 1122196 - RNA, 18 nt, Mycobacterium bovis subsp bovis AF2122/97
agccaagugagcgaucgg

SEQ ID NO: 1122197 - RNA, 23 nt, Mycobacterium bovis subsp bovis AF2122/97
agccaaaaacgcugccgccguuc

SEQ ID NO: 1122198 - RNA, 19 nt, Mycobacterium bovis subsp bovis AF2122/97
agccaaaugcgcugucgcc

SEQ ID NO: 1122199 - RNA, 17 nt, Mycobacterium bovis subsp bovis AF2122/97
agccaaccagcccggcc

SEQ ID NO: 1122200 - RNA, 14 nt, Mycobacterium bovis subsp bovis AF2122/97
agccaaccguccgg

SEQ ID NO: 1122201 - RNA, 19 nt, Mycobacterium bovis subsp bovis AF2122/97
agccaaccugaagccagcg

SEQ ID NO: 1122202 - RNA, 14 nt, Mycobacterium bovis subsp bovis AF2122/97
agccaacgagcgcg

SEQ ID NO: 1122203 - RNA, 19 nt, Mycobacterium bovis subsp bovis AF2122/97
agccaacgagcgcgcugcg

SEQ ID NO: 1122204 - RNA, 23 nt, Mycobacterium bovis subsp bovis AF2122/97
agaaaaucugcuagcuuggcggc

SEQ ID NO: 1122205 - RNA, 21 nt, Mycobacterium bovis subsp bovis AF2122/97
agacgucgaccgugucaccgc

SEQ ID NO: 1122206 - RNA, 16 nt, Mycobacterium bovis subsp bovis AF2122/97
agaaacgucugccacg

SEQ ID NO: 1122207 - RNA, 19 nt, Mycobacterium bovis subsp bovis AF2122/97
agacguuggucaucaacgc

SEQ ID NO: 1122208 - RNA, 12 nt, Mycobacterium bovis subsp bovis AF2122/97
agacgucgccgc

SEQ ID NO: 1122209 - RNA, 13 nt, Mycobacterium bovis subsp bovis AF2122/97
agacgucgccgca

SEQ ID NO: 1122210 - RNA, 20 nt, Mycobacterium bovis subsp bovis AF2122/97
agacgugccaaugauucggc

SEQ ID NO: 1122211 - RNA, 21 nt, Mycobacterium bovis subsp bovis AF2122/97
agacgugggcgcuggugcgcc

SEQ ID NO: 1122212 - RNA, 21 nt, Mycobacterium bovis subsp bovis AF2122/97
agacguuucccaggcccgaca

SEQ ID NO: 1122213 - RNA, 14 nt, Mycobacterium bovis subsp bovis AF2122/97
agacguuuugcggc

SEQ ID NO: 1122214 - RNA, 16 nt, Mycobacterium bovis subsp bovis AF2122/97
agagacaugccggcga

SEQ ID NO: 1122215 - RNA, 13 nt, Mycobacterium bovis subsp bovis AF2122/97
agagacuugccga

SEQ ID NO: 1122216 - RNA, 20 nt, Mycobacterium bovis subsp bovis AF2122/97
agagaucagcacccaagaau

SEQ ID NO: 1122217 - RNA, 16 nt, Mycobacterium bovis subsp bovis AF2122/97
agagaucgucgaccca

SEQ ID NO: 1122218 - RNA, 16 nt, Mycobacterium bovis subsp bovis AF2122/97
agagcuccgucgcggc

SEQ ID NO: 1122219 - RNA, 12 nt, Mycobacterium bovis subsp bovis AF2122/97
agagcaggccca

SEQ ID NO: 1122220 - RNA, 14 nt, Mycobacterium bovis subsp bovis AF2122/97
agaggucgagcgcc

SEQ ID NO: 1122221 - RNA, 22 nt, Mycobacterium bovis subsp bovis AF2122/97
agaggcgcaagaaugccgccga

SEQ ID NO: 1122222 - RNA, 17 nt, Mycobacterium bovis subsp bovis AF2122/97
agaggauaucgccgaga

SEQ ID NO: 1122223 - RNA, 12 nt, Mycobacterium bovis subsp bovis AF2122/97
agaggcccgaaa

SEQ ID NO: 1122224 - RNA, 23 nt, Mycobacterium bovis subsp bovis AF2122/97
agauggugaaguugccggucagg

SEQ ID NO: 1122225 - RNA, 21 nt, Mycobacterium bovis subsp bovis AF2122/97
agauguaccucaucgcagacg

SEQ ID NO: 1122226 - RNA, 20 nt, Mycobacterium bovis subsp bovis AF2122/97
agauggucgggcggcgucga

SEQ ID NO: 1122227 - RNA, 18 nt, Mycobacterium bovis subsp bovis AF2122/97
agaugcggaacgccgagc

SEQ ID NO: 1122228 - RNA, 12 nt, Mycobacterium bovis subsp bovis AF2122/97
agaugccggcga

SEQ ID NO: 1122229 - RNA, 19 nt, Mycobacterium bovis subsp bovis AF2122/97
agaugccauuucgucgucg

SEQ ID NO: 1122230 - RNA, 15 nt, Mycobacterium bovis subsp bovis AF2122/97
agaugauuucgccga

SEQ ID NO: 1122231 - RNA, 17 nt, Mycobacterium bovis subsp bovis AF2122/97
agaugauuucgccgagc

SEQ ID NO: 1122232 - RNA, 17 nt, Mycobacterium bovis subsp bovis AF2122/97
agaucgucacucccgac

SEQ ID NO: 1122233 - RNA, 23 nt, Mycobacterium bovis subsp bovis AF2122/97
agaucuccccgaccgcgcccgcg

SEQ ID NO: 1122234 - RNA, 13 nt, Mycobacterium bovis subsp bovis AF2122/97
agaucucgcgggc

SEQ ID NO: 1122235 - RNA, 22 nt, Mycobacterium bovis subsp bovis AF2122/97
agaucguugaugacguugcagc

SEQ ID NO: 1122236 - RNA, 15 nt, Mycobacterium bovis subsp bovis AF2122/97
agaucguagugcgcg

SEQ ID NO: 1122237 - RNA, 19 nt, Mycobacterium bovis subsp bovis AF2122/97
agaucggguggcgggucag

SEQ ID NO: 1122238 - RNA, 20 nt, Mycobacterium bovis subsp bovis AF2122/97
agaucggcagcguggacauc

SEQ ID NO: 1122239 - RNA, 18 nt, Mycobacterium bovis subsp bovis AF2122/97
agaucgcgguccgagcgg

SEQ ID NO: 1122240 - RNA, 19 nt, Mycobacterium bovis subsp bovis AF2122/97
agauccugguaaggccggc

SEQ ID NO: 1122241 - RNA, 22 nt, Mycobacterium bovis subsp bovis AF2122/97
agaucgaacgcagccagcgcca

SEQ ID NO: 1122242 - RNA, 23 nt, Mycobacterium bovis subsp bovis AF2122/97
agaucagcaugccuucggccaac

SEQ ID NO: 1122243 - RNA, 19 nt, Mycobacterium bovis subsp bovis AF2122/97
agaucagcagcggcgaccg

SEQ ID NO: 1122244 - RNA, 18 nt, Mycobacterium bovis subsp bovis AF2122/97
agaucaccucccgcggca

SEQ ID NO: 1122245 - RNA, 19 nt, Mycobacterium bovis subsp bovis AF2122/97
agaucaccucggugccggc

SEQ ID NO: 1122246 - RNA, 23 nt, Mycobacterium bovis subsp bovis AF2122/97
agaucaccucggugccggccgca

SEQ ID NO: 1122247 - RNA, 15 nt, Mycobacterium bovis subsp bovis AF2122/97
agaucacgccgacga

SEQ ID NO: 1122248 - RNA, 15 nt, Mycobacterium bovis subsp bovis AF2122/97
agaucacgccgggcg

SEQ ID NO: 1122249 - RNA, 16 nt, Mycobacterium bovis subsp bovis AF2122/97
agaucacgccgggcga

SEQ ID NO: 1122250 - RNA, 15 nt, Mycobacterium bovis subsp bovis AF2122/97
agaucacgugccggc

SEQ ID NO: 1122251 - RNA, 19 nt, Mycobacterium bovis subsp bovis AF2122/97
agaucagcaacggcagcga

SEQ ID NO: 1122252 - RNA, 15 nt, Mycobacterium bovis subsp bovis AF2122/97
agaucacccgcagcc

SEQ ID NO: 1122253 - RNA, 14 nt, Mycobacterium bovis subsp bovis AF2122/97
agaucaccgccacc

SEQ ID NO: 1122254 - RNA, 19 nt, Mycobacterium bovis subsp bovis AF2122/97
agagucgcacugcgccggc

SEQ ID NO: 1122255 - RNA, 16 nt, Mycobacterium bovis subsp bovis AF2122/97
agauauggaccgccgc

SEQ ID NO: 1122256 - RNA, 15 nt, Mycobacterium bovis subsp bovis AF2122/97
agcagcaccugcacc

SEQ ID NO: 1122257 - RNA, 24 nt, Mycobacterium bovis subsp bovis AF2122/97
agcagcaccgcgaccaucgcgacg

SEQ ID NO: 1122258 - RNA, 21 nt, Mycobacterium bovis subsp bovis AF2122/97
agcagagccccggcaagcgca

SEQ ID NO: 1122259 - RNA, 15 nt, Mycobacterium bovis subsp bovis AF2122/97
agcagacugcccucg

SEQ ID NO: 1122260 - RNA, 14 nt, Mycobacterium bovis subsp bovis AF2122/97
agcagacugccgau

SEQ ID NO: 1122261 - RNA, 20 nt, Mycobacterium bovis subsp bovis AF2122/97
agcagacgcggaaucgcacc

SEQ ID NO: 1122262 - RNA, 13 nt, Mycobacterium bovis subsp bovis AF2122/97
agcagacgccgua

SEQ ID NO: 1122263 - RNA, 18 nt, Mycobacterium bovis subsp bovis AF2122/97
agcagacgcagagucgca

SEQ ID NO: 1122264 - RNA, 18 nt, Mycobacterium bovis subsp bovis AF2122/97
agcagacgccguagccgg

SEQ ID NO: 1122265 - RNA, 21 nt, Mycobacterium bovis subsp bovis AF2122/97
agcagacgcgaaagcacccca

SEQ ID NO: 1122266 - RNA, 19 nt, Mycobacterium bovis subsp bovis AF2122/97
agcagacgcgaaauccccc

SEQ ID NO: 1122267 - RNA, 20 nt, Mycobacterium bovis subsp bovis AF2122/97
agcagacgcgaaaucccccg

SEQ ID NO: 1122268 - RNA, 18 nt, Mycobacterium bovis subsp bovis AF2122/97
agcagacgcggaaucgca

SEQ ID NO: 1122269 - RNA, 16 nt, Mycobacterium bovis subsp bovis AF2122/97
agcagcacgucgaacu

SEQ ID NO: 1122270 - RNA, 13 nt, Mycobacterium bovis subsp bovis AF2122/97
agcagcagcggcg

SEQ ID NO: 1122271 - RNA, 18 nt, Mycobacterium bovis subsp bovis AF2122/97
agcagcagaaacggcgac

SEQ ID NO: 1122272 - RNA, 20 nt, Mycobacterium bovis subsp bovis AF2122/97
agcagacgcaaaagccaccg

SEQ ID NO: 1122273 - RNA, 15 nt, Mycobacterium bovis subsp bovis AF2122/97
agcagacccgugccg

SEQ ID NO: 1122274 - RNA, 19 nt, Mycobacterium bovis subsp bovis AF2122/97
agcacgguggcuucgacgg

SEQ ID NO: 1122275 - RNA, 20 nt, Mycobacterium bovis subsp bovis AF2122/97
agcagacgcaaaauccccuc

SEQ ID NO: 1122276 - RNA, 17 nt, Mycobacterium bovis subsp bovis AF2122/97
agcagacgcaaaaucgc

SEQ ID NO: 1122277 - RNA, 19 nt, Mycobacterium bovis subsp bovis AF2122/97
agcagacgcaaaaucgcac

SEQ ID NO: 1122278 - RNA, 20 nt, Mycobacterium bovis subsp bovis AF2122/97
agcagacgcaaaaucgccca

SEQ ID NO: 1122279 - RNA, 19 nt, Mycobacterium bovis subsp bovis AF2122/97
agcagacgcaaaaucgccc

SEQ ID NO: 1122280 - RNA, 20 nt, Mycobacterium bovis subsp bovis AF2122/97
agcagacgcagaagccccca

SEQ ID NO: 1122281 - RNA, 19 nt, Mycobacterium bovis subsp bovis AF2122/97
agcagacgcagaaucgccc

SEQ ID NO: 1122282 - RNA, 20 nt, Mycobacterium bovis subsp bovis AF2122/97
agcacguucaccgcgcgcuc

SEQ ID NO: 1122283 - RNA, 15 nt, Mycobacterium bovis subsp bovis AF2122/97
agcacguugacgucc

SEQ ID NO: 1122284 - RNA, 21 nt, Mycobacterium bovis subsp bovis AF2122/97
agcacgucggggugccggcug

SEQ ID NO: 1122285 - RNA, 15 nt, Mycobacterium bovis subsp bovis AF2122/97
agcacgucgucgcgg

SEQ ID NO: 1122286 - RNA, 16 nt, Mycobacterium bovis subsp bovis AF2122/97
agcacguugcacagcu

SEQ ID NO: 1122287 - RNA, 12 nt, Mycobacterium bovis subsp bovis AF2122/97
agcacuccaccg

SEQ ID NO: 1122288 - RNA, 18 nt, Mycobacterium bovis subsp bovis AF2122/97
agcacccaaugccaccgc

SEQ ID NO: 1122289 - RNA, 13 nt, Mycobacterium bovis subsp bovis AF2122/97
agcacccgcgcga

SEQ ID NO: 1122290 - RNA, 18 nt, Mycobacterium bovis subsp bovis AF2122/97
agcacccgcgcgacgccg

SEQ ID NO: 1122291 - RNA, 18 nt, Mycobacterium bovis subsp bovis AF2122/97
agcacccgagcgaugcga

SEQ ID NO: 1122292 - RNA, 13 nt, Mycobacterium bovis subsp bovis AF2122/97
agcacccggucga

SEQ ID NO: 1122293 - RNA, 16 nt, Mycobacterium bovis subsp bovis AF2122/97
agcacccugcgggccg

SEQ ID NO: 1122294 - RNA, 20 nt, Mycobacterium bovis subsp bovis AF2122/97
agcaccgacagcccgaacga

SEQ ID NO: 1122295 - RNA, 14 nt, Mycobacterium bovis subsp bovis AF2122/97
agcacgggcacgau

SEQ ID NO: 1122296 - RNA, 13 nt, Mycobacterium bovis subsp bovis AF2122/97
agcacggcuucgc

SEQ ID NO: 1122297 - RNA, 15 nt, Mycobacterium bovis subsp bovis AF2122/97
agcacggggaccggg

SEQ ID NO: 1122298 - RNA, 18 nt, Mycobacterium bovis subsp bovis AF2122/97
agcacggggaccgggcug

SEQ ID NO: 1122299 - RNA, 16 nt, Mycobacterium bovis subsp bovis AF2122/97
agcacggucugggucu

SEQ ID NO: 1122300 - RNA, 22 nt, Mycobacterium bovis subsp bovis AF2122/97
agcacggugaacaaaugccggu

SEQ ID NO: 1122301 - RNA, 14 nt, Mycobacterium bovis subsp bovis AF2122/97
agcacggcgaucgg

SEQ ID NO: 1122302 - RNA, 16 nt, Mycobacterium bovis subsp bovis AF2122/97
agcacggugaucagca

SEQ ID NO: 1122303 - RNA, 14 nt, Mycobacterium bovis subsp bovis AF2122/97
agcacguccgcgga

SEQ ID NO: 1122304 - RNA, 15 nt, Mycobacterium bovis subsp bovis AF2122/97
agcacggcgcggcgg

SEQ ID NO: 1122305 - RNA, 19 nt, Mycobacterium bovis subsp bovis AF2122/97
agcaacgucacgucgacgg

SEQ ID NO: 1122306 - RNA, 20 nt, Mycobacterium bovis subsp bovis AF2122/97
agcaacgucacgucgacggc

SEQ ID NO: 1122307 - RNA, 21 nt, Mycobacterium bovis subsp bovis AF2122/97
agcaacucauuacgguagacg

SEQ ID NO: 1122308 - RNA, 21 nt, Mycobacterium bovis subsp bovis AF2122/97
agcaacgcccaacgucgccag

SEQ ID NO: 1122309 - RNA, 17 nt, Mycobacterium bovis subsp bovis AF2122/97
agcaacgccacgccgau

SEQ ID NO: 1122310 - RNA, 17 nt, Mycobacterium bovis subsp bovis AF2122/97
agcaacgaagccggcgc

SEQ ID NO: 1122311 - RNA, 15 nt, Mycobacterium bovis subsp bovis AF2122/97
agcaacgcggugccg

SEQ ID NO: 1122312 - RNA, 16 nt, Mycobacterium bovis subsp bovis AF2122/97
agcaacgcggugccgg

SEQ ID NO: 1122313 - RNA, 15 nt, Mycobacterium bovis subsp bovis AF2122/97
agcaacgcugcggca

SEQ ID NO: 1122314 - RNA, 17 nt, Mycobacterium bovis subsp bovis AF2122/97
agcaacggacgaagcac

SEQ ID NO: 1122315 - RNA, 13 nt, Mycobacterium bovis subsp bovis AF2122/97
agcaacggcaucc

SEQ ID NO: 1122316 - RNA, 15 nt, Mycobacterium bovis subsp bovis AF2122/97
agcaacggcggcagg

SEQ ID NO: 1122317 - RNA, 21 nt, Mycobacterium bovis subsp bovis AF2122/97
agcaacccgccguugccaccg

SEQ ID NO: 1122318 - RNA, 18 nt, Mycobacterium bovis subsp bovis AF2122/97
agcaacaccucgucaccc

SEQ ID NO: 1122319 - RNA, 20 nt, Mycobacterium bovis subsp bovis AF2122/97
agcaacaccgucggcagcag

SEQ ID NO: 1122320 - RNA, 13 nt, Mycobacterium bovis subsp bovis AF2122/97
agcaacaggccca

SEQ ID NO: 1122321 - RNA, 15 nt, Mycobacterium bovis subsp bovis AF2122/97
agauguucacgccgc

SEQ ID NO: 1122322 - RNA, 18 nt, Mycobacterium bovis subsp bovis AF2122/97
agauguucacgccgccgg

SEQ ID NO: 1122323 - RNA, 23 nt, Mycobacterium bovis subsp bovis AF2122/97
agauggcaccgcccccgucggcc

SEQ ID NO: 1122324 - RNA, 22 nt, Mycobacterium bovis subsp bovis AF2122/97
agauguccgguccgccagcgcg

SEQ ID NO: 1122325 - RNA, 15 nt, Mycobacterium bovis subsp bovis AF2122/97
agauguugccgccgg

SEQ ID NO: 1122326 - RNA, 16 nt, Mycobacterium bovis subsp bovis AF2122/97
agcaacaacgucugca

SEQ ID NO: 1122327 - RNA, 13 nt, Mycobacterium bovis subsp bovis AF2122/97
agcaauggugcgg

SEQ ID NO: 1122328 - RNA, 17 nt, Mycobacterium bovis subsp bovis AF2122/97
agcaaugacccgcgggu

SEQ ID NO: 1122329 - RNA, 17 nt, Mycobacterium bovis subsp bovis AF2122/97
agcaaugcccgcaccgc

SEQ ID NO: 1122330 - RNA, 15 nt, Mycobacterium bovis subsp bovis AF2122/97
agcaacugccgcacc

SEQ ID NO: 1122331 - RNA, 16 nt, Mycobacterium bovis subsp bovis AF2122/97
agcaauccgcacagcg

SEQ ID NO: 1122332 - RNA, 18 nt, Mycobacterium bovis subsp bovis AF2122/97
agcaauccaaggcucagc

SEQ ID NO: 1122333 - RNA, 19 nt, Mycobacterium bovis subsp bovis AF2122/97
agcacccaacccggcggca

SEQ ID NO: 1122334 - RNA, 17 nt, Mycobacterium bovis subsp bovis AF2122/97
agcacccaaugccaccg

SEQ ID NO: 1122335 - RNA, 20 nt, Mycobacterium bovis subsp bovis AF2122/97
agcacccagacgauggccag

SEQ ID NO: 1122336 - RNA, 12 nt, Mycobacterium bovis subsp bovis AF2122/97
agcacccauacg

SEQ ID NO: 1122337 - RNA, 19 nt, Mycobacterium bovis subsp bovis AF2122/97
agcaccccaaaaccgccgg

SEQ ID NO: 1122338 - RNA, 22 nt, Mycobacterium bovis subsp bovis AF2122/97
agcaccccagggguugcggagc

SEQ ID NO: 1122339 - RNA, 18 nt, Mycobacterium bovis subsp bovis AF2122/97
agcaccccauggccaccg

SEQ ID NO: 1122340 - RNA, 14 nt, Mycobacterium bovis subsp bovis AF2122/97
agcaccagccaaau

SEQ ID NO: 1122341 - RNA, 20 nt, Mycobacterium bovis subsp bovis AF2122/97
agcaccagccagccugcugg

SEQ ID NO: 1122342 - RNA, 14 nt, Mycobacterium bovis subsp bovis AF2122/97
agcaccagcgucgc

SEQ ID NO: 1122343 - RNA, 15 nt, Mycobacterium bovis subsp bovis AF2122/97
agcaccagcgucgcg

SEQ ID NO: 1122344 - RNA, 16 nt, Mycobacterium bovis subsp bovis AF2122/97
agcaccagcgucgcgg

SEQ ID NO: 1122345 - RNA, 14 nt, Mycobacterium bovis subsp bovis AF2122/97
agcaccagcagcac

SEQ ID NO: 1122346 - RNA, 23 nt, Mycobacterium bovis subsp bovis AF2122/97
aggcgauugcagcuucggccagc

SEQ ID NO: 1122347 - RNA, 16 nt, Mycobacterium bovis subsp bovis AF2122/97
aggcgccacugcuucc

SEQ ID NO: 1122348 - RNA, 16 nt, Mycobacterium bovis subsp bovis AF2122/97
aggcgauggucuccuc

SEQ ID NO: 1122349 - RNA, 17 nt, Mycobacterium bovis subsp bovis AF2122/97
aggcgaugcgccaggcu

SEQ ID NO: 1122350 - RNA, 22 nt, Mycobacterium bovis subsp bovis AF2122/97
aggccuccaaaaucgcggccac

SEQ ID NO: 1122351 - RNA, 20 nt, Mycobacterium bovis subsp bovis AF2122/97
aggcgaugagcgugccgcag

SEQ ID NO: 1122352 - RNA, 13 nt, Mycobacterium bovis subsp bovis AF2122/97
aggcgaucgcauc

SEQ ID NO: 1122353 - RNA, 15 nt, Mycobacterium bovis subsp bovis AF2122/97
aggcgaucgucuccu

SEQ ID NO: 1122354 - RNA, 19 nt, Mycobacterium bovis subsp bovis AF2122/97
aggcgaucuggccgaacga

SEQ ID NO: 1122355 - RNA, 15 nt, Mycobacterium bovis subsp bovis AF2122/97
aggcgaucaccgcgc

SEQ ID NO: 1122356 - RNA, 16 nt, Mycobacterium bovis subsp bovis AF2122/97
aggcgaucaccgcgcc

SEQ ID NO: 1122357 - RNA, 22 nt, Mycobacterium bovis subsp bovis AF2122/97
aggcgaucaccgcgccggagau

SEQ ID NO: 1122358 - RNA, 22 nt, Mycobacterium bovis subsp bovis AF2122/97
aggccuaguccggcacugcggc

SEQ ID NO: 1122359 - RNA, 21 nt, Mycobacterium bovis subsp bovis AF2122/97
aggccgucgaguuccggccgg

SEQ ID NO: 1122360 - RNA, 13 nt, Mycobacterium bovis subsp bovis AF2122/97
aggccguggcgga

SEQ ID NO: 1122361 - RNA, 23 nt, Mycobacterium bovis subsp bovis AF2122/97
aggccgucgaacgguagcacggu

SEQ ID NO: 1122362 - RNA, 16 nt, Mycobacterium bovis subsp bovis AF2122/97
aggccguacgacggca

SEQ ID NO: 1122363 - RNA, 18 nt, Mycobacterium bovis subsp bovis AF2122/97
aggccguacgacggcaau

SEQ ID NO: 1122364 - RNA, 15 nt, Mycobacterium bovis subsp bovis AF2122/97
aggccguacucgaug

SEQ ID NO: 1122365 - RNA, 16 nt, Mycobacterium bovis subsp bovis AF2122/97
aggccguacucgauga

SEQ ID NO: 1122366 - RNA, 21 nt, Mycobacterium bovis subsp bovis AF2122/97
aggccgguuugcacgcaccac

SEQ ID NO: 1122367 - RNA, 18 nt, Mycobacterium bovis subsp bovis AF2122/97
aggccggugaacggcagc

SEQ ID NO: 1122368 - RNA, 12 nt, Mycobacterium bovis subsp bovis AF2122/97
aggcgcggccca

SEQ ID NO: 1122369 - RNA, 17 nt, Mycobacterium bovis subsp bovis AF2122/97
aggcgcggucaccgcgu

SEQ ID NO: 1122370 - RNA, 13 nt, Mycobacterium bovis subsp bovis AF2122/97
aggcgcggucacc

SEQ ID NO: 1122371 - RNA, 16 nt, Mycobacterium bovis subsp bovis AF2122/97
aggcgccgcagggccg

SEQ ID NO: 1122372 - RNA, 19 nt, Mycobacterium bovis subsp bovis AF2122/97
aggcgauugcgccgcacac

SEQ ID NO: 1122373 - RNA, 22 nt, Mycobacterium bovis subsp bovis AF2122/97
aggcgcccagcgacaacaccac

SEQ ID NO: 1122374 - RNA, 17 nt, Mycobacterium bovis subsp bovis AF2122/97
aggcgcccaacaggcgg

SEQ ID NO: 1122375 - RNA, 18 nt, Mycobacterium bovis subsp bovis AF2122/97
aggcgcccaacaggcggg

SEQ ID NO: 1122376 - RNA, 13 nt, Mycobacterium bovis subsp bovis AF2122/97
aggcgcuucgcca

SEQ ID NO: 1122377 - RNA, 22 nt, Mycobacterium bovis subsp bovis AF2122/97
aggcgcugaagaucaacaggcg

SEQ ID NO: 1122378 - RNA, 20 nt, Mycobacterium bovis subsp bovis AF2122/97
aggcgguacgggucgccgga

SEQ ID NO: 1122379 - RNA, 17 nt, Mycobacterium bovis subsp bovis AF2122/97
aggcggguacaccacgg

SEQ ID NO: 1122380 - RNA, 23 nt, Mycobacterium bovis subsp bovis AF2122/97
aggcgggagcggaauggcgccgg

SEQ ID NO: 1122381 - RNA, 17 nt, Mycobacterium bovis subsp bovis AF2122/97
aggcggacgccgcgccg

SEQ ID NO: 1122382 - RNA, 21 nt, Mycobacterium bovis subsp bovis AF2122/97
aggcgggaaaauauaugcgca

SEQ ID NO: 1122383 - RNA, 15 nt, Mycobacterium bovis subsp bovis AF2122/97
aggcggugacccguu

SEQ ID NO: 1122384 - RNA, 19 nt, Mycobacterium bovis subsp bovis AF2122/97
aggcggugacccguucagc

SEQ ID NO: 1122385 - RNA, 13 nt, Mycobacterium bovis subsp bovis AF2122/97
aggcggucgccga

SEQ ID NO: 1122386 - RNA, 22 nt, Mycobacterium bovis subsp bovis AF2122/97
aggcgggugcggcaauaccgaa

SEQ ID NO: 1122387 - RNA, 16 nt, Mycobacterium bovis subsp bovis AF2122/97
aggcggucaccaccgu

SEQ ID NO: 1122388 - RNA, 16 nt, Mycobacterium bovis subsp bovis AF2122/97
aggcgugcacagguca

SEQ ID NO: 1122389 - RNA, 18 nt, Mycobacterium bovis subsp bovis AF2122/97
aggcgugcacaggucagc

SEQ ID NO: 1122390 - RNA, 21 nt, Mycobacterium bovis subsp bovis AF2122/97
aggcguucgacucgaccgcga

SEQ ID NO: 1122391 - RNA, 21 nt, Mycobacterium bovis subsp bovis AF2122/97
aggcguuguagcgguccagcg

SEQ ID NO: 1122392 - RNA, 23 nt, Mycobacterium bovis subsp bovis AF2122/97
aggcguucgacucgaccgcgacg

SEQ ID NO: 1122393 - RNA, 22 nt, Mycobacterium bovis subsp bovis AF2122/97
aggcguugaacugugcggcagc

SEQ ID NO: 1122394 - RNA, 14 nt, Mycobacterium bovis subsp bovis AF2122/97
aggcugcagugccg

SEQ ID NO: 1122395 - RNA, 18 nt, Mycobacterium bovis subsp bovis AF2122/97
aggcuggaggugaacucg

SEQ ID NO: 1122396 - RNA, 20 nt, Mycobacterium bovis subsp bovis AF2122/97
aggcucagcagcgccgcgcg

SEQ ID NO: 1122397 - RNA, 21 nt, Mycobacterium bovis subsp bovis AF2122/97
aggcugaccguggcgccgguc

SEQ ID NO: 1122398 - RNA, 22 nt, Mycobacterium bovis subsp bovis AF2122/97
aggcugaccguggcgccggucg

SEQ ID NO: 1122399 - RNA, 21 nt, Mycobacterium bovis subsp bovis AF2122/97
aggcucaccaggcgagccggc

SEQ ID NO: 1122400 - RNA, 21 nt, Mycobacterium bovis subsp bovis AF2122/97
agggacugugggggcgcaccg

SEQ ID NO: 1122401 - RNA, 21 nt, Mycobacterium bovis subsp bovis AF2122/97
agggaccacccgguccugcuc

SEQ ID NO: 1122402 - RNA, 14 nt, Mycobacterium bovis subsp bovis AF2122/97
agggaccgcaucgg

SEQ ID NO: 1122403 - RNA, 15 nt, Mycobacterium bovis subsp bovis AF2122/97
agggaaggacgcgca

SEQ ID NO: 1122404 - RNA, 17 nt, Mycobacterium bovis subsp bovis AF2122/97
agggaauagcggcgccc

SEQ ID NO: 1122405 - RNA, 20 nt, Mycobacterium bovis subsp bovis AF2122/97
aggcuuucgauauagccgcc

SEQ ID NO: 1122406 - RNA, 13 nt, Mycobacterium bovis subsp bovis AF2122/97
aggccgacgucga

SEQ ID NO: 1122407 - RNA, 23 nt, Mycobacterium bovis subsp bovis AF2122/97
aggccgacgacauugggcgcggu

SEQ ID NO: 1122408 - RNA, 19 nt, Mycobacterium bovis subsp bovis AF2122/97
aggccgaccuguaugccgc

SEQ ID NO: 1122409 - RNA, 21 nt, Mycobacterium bovis subsp bovis AF2122/97
aggccgaccuguaugccgcgg

SEQ ID NO: 1122410 - RNA, 20 nt, Mycobacterium bovis subsp bovis AF2122/97
aggccgccacaaacccgaug

SEQ ID NO: 1122411 - RNA, 17 nt, Mycobacterium bovis subsp bovis AF2122/97
aggccgccaucgccgcc

SEQ ID NO: 1122412 - RNA, 19 nt, Mycobacterium bovis subsp bovis AF2122/97
aggccgccaucgccgccaa

SEQ ID NO: 1122413 - RNA, 20 nt, Mycobacterium bovis subsp bovis AF2122/97
aggccgccaucgccgccaac

SEQ ID NO: 1122414 - RNA, 14 nt, Mycobacterium bovis subsp bovis AF2122/97
aggccgccgccagu

SEQ ID NO: 1122415 - RNA, 12 nt, Mycobacterium bovis subsp bovis AF2122/97
aggccgccgcca

SEQ ID NO: 1122416 - RNA, 16 nt, Mycobacterium bovis subsp bovis AF2122/97
aggccgccaucgccgc

SEQ ID NO: 1122417 - RNA, 20 nt, Mycobacterium bovis subsp bovis AF2122/97
aggccgccagccggcgcacu

SEQ ID NO: 1122418 - RNA, 14 nt, Mycobacterium bovis subsp bovis AF2122/97
aggccgccguugcc

SEQ ID NO: 1122419 - RNA, 16 nt, Mycobacterium bovis subsp bovis AF2122/97
aggccgccggacccgu

SEQ ID NO: 1122420 - RNA, 19 nt, Mycobacterium bovis subsp bovis AF2122/97
aggccgccggacccgucga

SEQ ID NO: 1122421 - RNA, 20 nt, Mycobacterium bovis subsp bovis AF2122/97
aggccgccggacccgucgag

SEQ ID NO: 1122422 - RNA, 20 nt, Mycobacterium bovis subsp bovis AF2122/97
aggccccaccauucgcgggc

SEQ ID NO: 1122423 - RNA, 17 nt, Mycobacterium bovis subsp bovis AF2122/97
aggccgacaaugucggc

SEQ ID NO: 1122424 - RNA, 22 nt, Mycobacterium bovis subsp bovis AF2122/97
aggccgacaaugucggcgaugc

SEQ ID NO: 1122425 - RNA, 20 nt, Mycobacterium bovis subsp bovis AF2122/97
aggccgaagacgugccggcu

SEQ ID NO: 1122426 - RNA, 15 nt, Mycobacterium bovis subsp bovis AF2122/97
aggcccugccgacgc

SEQ ID NO: 1122427 - RNA, 14 nt, Mycobacterium bovis subsp bovis AF2122/97
aggcccuggccagc

SEQ ID NO: 1122428 - RNA, 16 nt, Mycobacterium bovis subsp bovis AF2122/97
aggccccgccagcgcc

SEQ ID NO: 1122429 - RNA, 20 nt, Mycobacterium bovis subsp bovis AF2122/97
aggccccgccagcgccgguc

SEQ ID NO: 1122430 - RNA, 21 nt, Mycobacterium bovis subsp bovis AF2122/97
aggccggcgggcucgcccgcu

SEQ ID NO: 1122431 - RNA, 17 nt, Mycobacterium bovis subsp bovis AF2122/97
aggccggcuaccgcgcu

SEQ ID NO: 1122432 - RNA, 21 nt, Mycobacterium bovis subsp bovis AF2122/97
aggccggggcggaaccuguca

SEQ ID NO: 1122433 - RNA, 15 nt, Mycobacterium bovis subsp bovis AF2122/97
aggccggggcgucgc

SEQ ID NO: 1122434 - RNA, 17 nt, Mycobacterium bovis subsp bovis AF2122/97
aggccggcaagaccgaa

SEQ ID NO: 1122435 - RNA, 16 nt, Mycobacterium bovis subsp bovis AF2122/97
aggccggcgaccgggc

SEQ ID NO: 1122436 - RNA, 22 nt, Mycobacterium bovis subsp bovis AF2122/97
aggccggacuuuaaaccgaacc

SEQ ID NO: 1122437 - RNA, 18 nt, Mycobacterium bovis subsp bovis AF2122/97
aggccggaagauccgggc

SEQ ID NO: 1122438 - RNA, 16 nt, Mycobacterium bovis subsp bovis AF2122/97
aggccggagucgacga

SEQ ID NO: 1122439 - RNA, 12 nt, Mycobacterium bovis subsp bovis AF2122/97
aggccggcaccc

SEQ ID NO: 1122440 - RNA, 16 nt, Mycobacterium bovis subsp bovis AF2122/97
aggccgcgcgcagggc

SEQ ID NO: 1122441 - RNA, 16 nt, Mycobacterium bovis subsp bovis AF2122/97
aggccgcgcggcggcg

SEQ ID NO: 1122442 - RNA, 12 nt, Mycobacterium bovis subsp bovis AF2122/97
aggccgcggugu

SEQ ID NO: 1122443 - RNA, 16 nt, Mycobacterium bovis subsp bovis AF2122/97
aggccgcugccagcau

SEQ ID NO: 1122444 - RNA, 13 nt, Mycobacterium bovis subsp bovis AF2122/97
aggccagggcggu

SEQ ID NO: 1122445 - RNA, 14 nt, Mycobacterium bovis subsp bovis AF2122/97
aggcccacccgggc

SEQ ID NO: 1122446 - RNA, 14 nt, Mycobacterium bovis subsp bovis AF2122/97
aggcccaacgcgau

SEQ ID NO: 1122447 - RNA, 16 nt, Mycobacterium bovis subsp bovis AF2122/97
aggcccaccauggcug

SEQ ID NO: 1122448 - RNA, 18 nt, Mycobacterium bovis subsp bovis AF2122/97
aggcccacggcagcgccg

SEQ ID NO: 1122449 - RNA, 21 nt, Mycobacterium bovis subsp bovis AF2122/97
aggcccacggcagcgccgguc

SEQ ID NO: 1122450 - RNA, 22 nt, Mycobacterium bovis subsp bovis AF2122/97
aggcccagcaaccgcucggcga

SEQ ID NO: 1122451 - RNA, 17 nt, Mycobacterium bovis subsp bovis AF2122/97
aggcccagcaaccgcuc

SEQ ID NO: 1122452 - RNA, 16 nt, Mycobacterium bovis subsp bovis AF2122/97
aggccaacccugcggc

SEQ ID NO: 1122453 - RNA, 21 nt, Mycobacterium bovis subsp bovis AF2122/97
aggccaacuuggcggccagcc

SEQ ID NO: 1122454 - RNA, 17 nt, Mycobacterium bovis subsp bovis AF2122/97
aggccaagauggcgcgc

SEQ ID NO: 1122455 - RNA, 20 nt, Mycobacterium bovis subsp bovis AF2122/97
aggccaaccacagccucgua

SEQ ID NO: 1122456 - RNA, 17 nt, Mycobacterium bovis subsp bovis AF2122/97
aggcauucccgcggcaa

SEQ ID NO: 1122457 - RNA, 23 nt, Mycobacterium bovis subsp bovis AF2122/97
aggcaugccacacacugccggac

SEQ ID NO: 1122458 - RNA, 14 nt, Mycobacterium bovis subsp bovis AF2122/97
aggcaucguccacg

SEQ ID NO: 1122459 - RNA, 14 nt, Mycobacterium bovis subsp bovis AF2122/97
aggcaugccacaca

SEQ ID NO: 1122460 - RNA, 19 nt, Mycobacterium bovis subsp bovis AF2122/97
aggaugucgagcccgucga

SEQ ID NO: 1122461 - RNA, 12 nt, Mycobacterium bovis subsp bovis AF2122/97
aggaugucgaug

SEQ ID NO: 1122462 - RNA, 23 nt, Mycobacterium bovis subsp bovis AF2122/97
aggauucccucgacagugcugcc

SEQ ID NO: 1122463 - RNA, 13 nt, Mycobacterium bovis subsp bovis AF2122/97
aggauugccgagc

SEQ ID NO: 1122464 - RNA, 13 nt, Mycobacterium bovis subsp bovis AF2122/97
agcugccgucgcu

SEQ ID NO: 1122465 - RNA, 13 nt, Mycobacterium bovis subsp bovis AF2122/97
agcugccgucggu

SEQ ID NO: 1122466 - RNA, 15 nt, Mycobacterium bovis subsp bovis AF2122/97
agcugccgucggugc

SEQ ID NO: 1122467 - RNA, 14 nt, Mycobacterium bovis subsp bovis AF2122/97
agcugccgcggccg

SEQ ID NO: 1122468 - RNA, 16 nt, Mycobacterium bovis subsp bovis AF2122/97
agcugcccgccagcgc

SEQ ID NO: 1122469 - RNA, 22 nt, Mycobacterium bovis subsp bovis AF2122/97
agcugccgcacccccuccgcga

SEQ ID NO: 1122470 - RNA, 16 nt, Mycobacterium bovis subsp bovis AF2122/97
agcugcagcagacccg

SEQ ID NO: 1122471 - RNA, 20 nt, Mycobacterium bovis subsp bovis AF2122/97
agcugcaccuccgacggccg

SEQ ID NO: 1122472 - RNA, 21 nt, Mycobacterium bovis subsp bovis AF2122/97
agcugcaccuccgacggccgc

SEQ ID NO: 1122473 - RNA, 20 nt, Mycobacterium bovis subsp bovis AF2122/97
agcugcgacgaugccgccug

SEQ ID NO: 1122474 - RNA, 21 nt, Mycobacterium bovis subsp bovis AF2122/97
agcugcgacgaugccgccugg

SEQ ID NO: 1122475 - RNA, 18 nt, Mycobacterium bovis subsp bovis AF2122/97
agcugcgagucgucgcca

SEQ ID NO: 1122476 - RNA, 17 nt, Mycobacterium bovis subsp bovis AF2122/97
agcugcgcaucgccacc

SEQ ID NO: 1122477 - RNA, 13 nt, Mycobacterium bovis subsp bovis AF2122/97
agcugcggcggcc

SEQ ID NO: 1122478 - RNA, 23 nt, Mycobacterium bovis subsp bovis AF2122/97
agcugcggauuaagucggcggcc

SEQ ID NO: 1122479 - RNA, 12 nt, Mycobacterium bovis subsp bovis AF2122/97
aggaugcugagc

SEQ ID NO: 1122480 - RNA, 21 nt, Mycobacterium bovis subsp bovis AF2122/97
aggaugcugagcgccaggccg

SEQ ID NO: 1122481 - RNA, 23 nt, Mycobacterium bovis subsp bovis AF2122/97
aggucguuucccuggccgccgcc

SEQ ID NO: 1122482 - RNA, 20 nt, Mycobacterium bovis subsp bovis AF2122/97
aggucugacagaccgggcac

SEQ ID NO: 1122483 - RNA, 22 nt, Mycobacterium bovis subsp bovis AF2122/97
aggucucgaaagccgcggccga

SEQ ID NO: 1122484 - RNA, 21 nt, Mycobacterium bovis subsp bovis AF2122/97
aggugacauguugccgcugac

SEQ ID NO: 1122485 - RNA, 20 nt, Mycobacterium bovis subsp bovis AF2122/97
aggugacgaucaggucgccg

SEQ ID NO: 1122486 - RNA, 21 nt, Mycobacterium bovis subsp bovis AF2122/97
aggugacgaucgacagccccg

SEQ ID NO: 1122487 - RNA, 15 nt, Mycobacterium bovis subsp bovis AF2122/97
aggugacgccgccag

SEQ ID NO: 1122488 - RNA, 16 nt, Mycobacterium bovis subsp bovis AF2122/97
aggugacgccgccagc

SEQ ID NO: 1122489 - RNA, 15 nt, Mycobacterium bovis subsp bovis AF2122/97
aggugacggugacga

SEQ ID NO: 1122490 - RNA, 22 nt, Mycobacterium bovis subsp bovis AF2122/97
aggugaacgcugucccagcccg

SEQ ID NO: 1122491 - RNA, 14 nt, Mycobacterium bovis subsp bovis AF2122/97
aggucugcggccga

SEQ ID NO: 1122492 - RNA, 16 nt, Mycobacterium bovis subsp bovis AF2122/97
aggugaaucgcgucga

SEQ ID NO: 1122493 - RNA, 15 nt, Mycobacterium bovis subsp bovis AF2122/97
aggugacaaaucggc

SEQ ID NO: 1122494 - RNA, 23 nt, Mycobacterium bovis subsp bovis AF2122/97
aggugcccaucgggugguacagg

SEQ ID NO: 1122495 - RNA, 13 nt, Mycobacterium bovis subsp bovis AF2122/97
aggugcaugucga

SEQ ID NO: 1122496 - RNA, 21 nt, Mycobacterium bovis subsp bovis AF2122/97
aggugccaaacgccgcccgcc

SEQ ID NO: 1122497 - RNA, 11 nt, Mycobacterium bovis subsp bovis AF2122/97
aggugccggcg

SEQ ID NO: 1122498 - RNA, 12 nt, Mycobacterium bovis subsp bovis AF2122/97
aggugccgaccg

SEQ ID NO: 1122499 - RNA, 14 nt, Mycobacterium bovis subsp bovis AF2122/97
aggugcgauccggc

SEQ ID NO: 1122500 - RNA, 22 nt, Mycobacterium bovis subsp bovis AF2122/97
aggugcaccauuguuccguccc

SEQ ID NO: 1122501 - RNA, 16 nt, Mycobacterium bovis subsp bovis AF2122/97
aggugcacugccgggu

SEQ ID NO: 1122502 - RNA, 16 nt, Mycobacterium bovis subsp bovis AF2122/97
aggugcagcaccagcc

SEQ ID NO: 1122503 - RNA, 18 nt, Mycobacterium bovis subsp bovis AF2122/97
aggugauguucagcgcca

SEQ ID NO: 1122504 - RNA, 17 nt, Mycobacterium bovis subsp bovis AF2122/97
aggucggugcggucauc

SEQ ID NO: 1122505 - RNA, 19 nt, Mycobacterium bovis subsp bovis AF2122/97
aggucggucaggucgaggu

SEQ ID NO: 1122506 - RNA, 13 nt, Mycobacterium bovis subsp bovis AF2122/97
aggucgggcauga

SEQ ID NO: 1122507 - RNA, 17 nt, Mycobacterium bovis subsp bovis AF2122/97
aggucgucggcgucgcg

SEQ ID NO: 1122508 - RNA, 17 nt, Mycobacterium bovis subsp bovis AF2122/97
aggucggugggcggcga

SEQ ID NO: 1122509 - RNA, 17 nt, Mycobacterium bovis subsp bovis AF2122/97
aggucggugugcaucgc

SEQ ID NO: 1122510 - RNA, 21 nt, Mycobacterium bovis subsp bovis AF2122/97
aggucgguguuuggccgccga

SEQ ID NO: 1122511 - RNA, 16 nt, Mycobacterium bovis subsp bovis AF2122/97
aggucgguucggccgg

SEQ ID NO: 1122512 - RNA, 23 nt, Mycobacterium bovis subsp bovis AF2122/97
aggucgccagcucggcacccgcc

SEQ ID NO: 1122513 - RNA, 21 nt, Mycobacterium bovis subsp bovis AF2122/97
aggucgaucaggggcccaccc

SEQ ID NO: 1122514 - RNA, 14 nt, Mycobacterium bovis subsp bovis AF2122/97
aggucgagcgccuu

SEQ ID NO: 1122515 - RNA, 23 nt, Mycobacterium bovis subsp bovis AF2122/97
aggucgaggcaggccucggcgcc

SEQ ID NO: 1122516 - RNA, 14 nt, Mycobacterium bovis subsp bovis AF2122/97
aggucgacgggcac

SEQ ID NO: 1122517 - RNA, 18 nt, Mycobacterium bovis subsp bovis AF2122/97
aggucgacgccgaccacc

SEQ ID NO: 1122518 - RNA, 22 nt, Mycobacterium bovis subsp bovis AF2122/97
aggucgacccaacgcagaucag

SEQ ID NO: 1122519 - RNA, 23 nt, Mycobacterium bovis subsp bovis AF2122/97
aggucgaugcugccagccauggc

SEQ ID NO: 1122520 - RNA, 17 nt, Mycobacterium bovis subsp bovis AF2122/97
aggucgaugcgggcgac

SEQ ID NO: 1122521 - RNA, 15 nt, Mycobacterium bovis subsp bovis AF2122/97
aggucgaugccggcu

SEQ ID NO: 1122522 - RNA, 16 nt, Mycobacterium bovis subsp bovis AF2122/97
agguccaccccgccga

SEQ ID NO: 1122523 - RNA, 17 nt, Mycobacterium bovis subsp bovis AF2122/97
aggucauagccguugcg

SEQ ID NO: 1122524 - RNA, 19 nt, Mycobacterium bovis subsp bovis AF2122/97
agggccagcagccgcgacg

SEQ ID NO: 1122525 - RNA, 22 nt, Mycobacterium bovis subsp bovis AF2122/97
agggccacguagcagcagacga

SEQ ID NO: 1122526 - RNA, 14 nt, Mycobacterium bovis subsp bovis AF2122/97
agggccagaccgaa

SEQ ID NO: 1122527 - RNA, 18 nt, Mycobacterium bovis subsp bovis AF2122/97
agggccacguagcagcag

SEQ ID NO: 1122528 - RNA, 23 nt, Mycobacterium bovis subsp bovis AF2122/97
agggccagcgccucggcaucgcc

SEQ ID NO: 1122529 - RNA, 23 nt, Mycobacterium bovis subsp bovis AF2122/97
aggggcgucgcaacgcgaucacc

SEQ ID NO: 1122530 - RNA, 21 nt, Mycobacterium bovis subsp bovis AF2122/97
aggggugugugcugccgcaca

SEQ ID NO: 1122531 - RNA, 16 nt, Mycobacterium bovis subsp bovis AF2122/97
aggggugcccggcggc

SEQ ID NO: 1122532 - RNA, 17 nt, Mycobacterium bovis subsp bovis AF2122/97
aggguaagaguucgcgc

SEQ ID NO: 1122533 - RNA, 17 nt, Mycobacterium bovis subsp bovis AF2122/97
aggggcuuuugcgucug

SEQ ID NO: 1122534 - RNA, 15 nt, Mycobacterium bovis subsp bovis AF2122/97
agggggucgagcgcu

SEQ ID NO: 1122535 - RNA, 14 nt, Mycobacterium bovis subsp bovis AF2122/97
agggcagcagcccg

SEQ ID NO: 1122536 - RNA, 20 nt, Mycobacterium bovis subsp bovis AF2122/97
agggcagcagcccgggcagc

SEQ ID NO: 1122537 - RNA, 24 nt, Mycobacterium bovis subsp bovis AF2122/97
agggcaacggacgggaucgcccag

SEQ ID NO: 1122538 - RNA, 13 nt, Mycobacterium bovis subsp bovis AF2122/97
agggcaacggcac

SEQ ID NO: 1122539 - RNA, 20 nt, Mycobacterium bovis subsp bovis AF2122/97
agggauccgaagagccagca

SEQ ID NO: 1122540 - RNA, 16 nt, Mycobacterium bovis subsp bovis AF2122/97
agggcagcgccaggcc

SEQ ID NO: 1122541 - RNA, 16 nt, Mycobacterium bovis subsp bovis AF2122/97
agggcaucgucgccga

SEQ ID NO: 1122542 - RNA, 14 nt, Mycobacterium bovis subsp bovis AF2122/97
agggccaccaccac

SEQ ID NO: 1122543 - RNA, 16 nt, Mycobacterium bovis subsp bovis AF2122/97
agggcauugcggcccg

SEQ ID NO: 1122544 - RNA, 21 nt, Mycobacterium bovis subsp bovis AF2122/97
agggguggcgcgggccggcga

SEQ ID NO: 1122545 - RNA, 15 nt, Mycobacterium bovis subsp bovis AF2122/97
agggugccggcgccg

SEQ ID NO: 1122546 - RNA, 15 nt, Mycobacterium bovis subsp bovis AF2122/97
agggugccggucacg

SEQ ID NO: 1122547 - RNA, 16 nt, Mycobacterium bovis subsp bovis AF2122/97
aggguggaccggucga

SEQ ID NO: 1122548 - RNA, 16 nt, Mycobacterium bovis subsp bovis AF2122/97
agggugcgcuugcggc

SEQ ID NO: 1122549 - RNA, 17 nt, Mycobacterium bovis subsp bovis AF2122/97
agggugcguuggaugaa

SEQ ID NO: 1122550 - RNA, 12 nt, Mycobacterium bovis subsp bovis AF2122/97
aggguggccggu

SEQ ID NO: 1122551 - RNA, 16 nt, Mycobacterium bovis subsp bovis AF2122/97
aggguggggccggcgg

SEQ ID NO: 1122552 - RNA, 22 nt, Mycobacterium bovis subsp bovis AF2122/97
agggugggcgacgucaucgccg

SEQ ID NO: 1122553 - RNA, 19 nt, Mycobacterium bovis subsp bovis AF2122/97
aggucaacgccacgccgau

SEQ ID NO: 1122554 - RNA, 12 nt, Mycobacterium bovis subsp bovis AF2122/97
agguaggcgcga

SEQ ID NO: 1122555 - RNA, 17 nt, Mycobacterium bovis subsp bovis AF2122/97
aggucaccggccgccga

SEQ ID NO: 1122556 - RNA, 10 nt, Mycobacterium bovis subsp bovis AF2122/97
aggucaccgg

SEQ ID NO: 1122557 - RNA, 18 nt, Mycobacterium bovis subsp bovis AF2122/97
aggucaccggccgccgac

SEQ ID NO: 1122558 - RNA, 15 nt, Mycobacterium bovis subsp bovis AF2122/97
aggucaccggucacc

SEQ ID NO: 1122559 - RNA, 22 nt, Mycobacterium bovis subsp bovis AF2122/97
aggucacuacuccggucccgca

SEQ ID NO: 1122560 - RNA, 14 nt, Mycobacterium bovis subsp bovis AF2122/97
aggucagccgcgcg

SEQ ID NO: 1122561 - RNA, 17 nt, Mycobacterium bovis subsp bovis AF2122/97
agguaccgcgugcgccg

SEQ ID NO: 1122562 - RNA, 20 nt, Mycobacterium bovis subsp bovis AF2122/97
agguaccgcgugcgccgggg

SEQ ID NO: 1122563 - RNA, 14 nt, Mycobacterium bovis subsp bovis AF2122/97
agguagcgcgcaac

SEQ ID NO: 1122564 - RNA, 16 nt, Mycobacterium bovis subsp bovis AF2122/97
aguaccaccggcaccg

SEQ ID NO: 1122565 - RNA, 23 nt, Mycobacterium bovis subsp bovis AF2122/97
aguaccgcgcguugaagucgccg

SEQ ID NO: 1122566 - RNA, 17 nt, Mycobacterium bovis subsp bovis AF2122/97
aguaucgaggccgacga

SEQ ID NO: 1122567 - RNA, 20 nt, Mycobacterium bovis subsp bovis AF2122/97
aguaauggaacggcuugcga

SEQ ID NO: 1122568 - RNA, 16 nt, Mycobacterium bovis subsp bovis AF2122/97
aguacacggcggcccg

SEQ ID NO: 1122569 - RNA, 22 nt, Mycobacterium bovis subsp bovis AF2122/97
aguaagcgaacagcggcacgau

SEQ ID NO: 1122570 - RNA, 15 nt, Mycobacterium bovis subsp bovis AF2122/97
aguaacgucgucgcg

SEQ ID NO: 1122571 - RNA, 14 nt, Mycobacterium bovis subsp bovis AF2122/97
aguccgcgccgacg

SEQ ID NO: 1122572 - RNA, 15 nt, Mycobacterium bovis subsp bovis AF2122/97
aguccgcgccgacgg

SEQ ID NO: 1122573 - RNA, 20 nt, Mycobacterium bovis subsp bovis AF2122/97
aguccgcgccgacggccagc

SEQ ID NO: 1122574 - RNA, 17 nt, Mycobacterium bovis subsp bovis AF2122/97
aguccgaucgccgaggc

SEQ ID NO: 1122575 - RNA, 15 nt, Mycobacterium bovis subsp bovis AF2122/97
aguccgagacgucgg

SEQ ID NO: 1122576 - RNA, 20 nt, Mycobacterium bovis subsp bovis AF2122/97
aguccgagggcgucgccgcc

SEQ ID NO: 1122577 - RNA, 19 nt, Mycobacterium bovis subsp bovis AF2122/97
agucccgugacgaacuucg

SEQ ID NO: 1122578 - RNA, 17 nt, Mycobacterium bovis subsp bovis AF2122/97
aguccgaaagccgccga

SEQ ID NO: 1122579 - RNA, 14 nt, Mycobacterium bovis subsp bovis AF2122/97
aguccgacaccggc

SEQ ID NO: 1122580 - RNA, 16 nt, Mycobacterium bovis subsp bovis AF2122/97
aguccgacaccggcgg

SEQ ID NO: 1122581 - RNA, 20 nt, Mycobacterium bovis subsp bovis AF2122/97
aguccgacaccggcggcauc

SEQ ID NO: 1122582 - RNA, 20 nt, Mycobacterium bovis subsp bovis AF2122/97
aguccgacaguccgcgccgg

SEQ ID NO: 1122583 - RNA, 13 nt, Mycobacterium bovis subsp bovis AF2122/97
aguccgcgccggc

SEQ ID NO: 1122584 - RNA, 22 nt, Mycobacterium bovis subsp bovis AF2122/97
aguccgcggaucaccaucgccg

SEQ ID NO: 1122585 - RNA, 23 nt, Mycobacterium bovis subsp bovis AF2122/97
aguccgcggaucaccaucgccgc

SEQ ID NO: 1122586 - RNA, 20 nt, Mycobacterium bovis subsp bovis AF2122/97
aguccgcgcucagcuccggc

SEQ ID NO: 1122587 - RNA, 18 nt, Mycobacterium bovis subsp bovis AF2122/97
aguccgcuacugcgacca

SEQ ID NO: 1122588 - RNA, 14 nt, Mycobacterium bovis subsp bovis AF2122/97
aguccuggcucggc

SEQ ID NO: 1122589 - RNA, 19 nt, Mycobacterium bovis subsp bovis AF2122/97
aguauggccgccaccgcga

SEQ ID NO: 1122590 - RNA, 23 nt, Mycobacterium bovis subsp bovis AF2122/97
agucaggccuagcgcggcgacga

SEQ ID NO: 1122591 - RNA, 18 nt, Mycobacterium bovis subsp bovis AF2122/97
agucauguccauagccgg

SEQ ID NO: 1122592 - RNA, 22 nt, Mycobacterium bovis subsp bovis AF2122/97
agucccgaacaauucacgcacc

SEQ ID NO: 1122593 - RNA, 22 nt, Mycobacterium bovis subsp bovis AF2122/97
aguccaccgcgcggcgcagcac

SEQ ID NO: 1122594 - RNA, 17 nt, Mycobacterium bovis subsp bovis AF2122/97
aguccaacucggccaac

SEQ ID NO: 1122595 - RNA, 21 nt, Mycobacterium bovis subsp bovis AF2122/97
aguccaagcugucaagcgggc

SEQ ID NO: 1122596 - RNA, 13 nt, Mycobacterium bovis subsp bovis AF2122/97
aggugugugacga

SEQ ID NO: 1122597 - RNA, 21 nt, Mycobacterium bovis subsp bovis AF2122/97
aggugugcgacgacggcgccg

SEQ ID NO: 1122598 - RNA, 14 nt, Mycobacterium bovis subsp bovis AF2122/97
agguguugacgauc

SEQ ID NO: 1122599 - RNA, 18 nt, Mycobacterium bovis subsp bovis AF2122/97
agguguugcgguggguga

SEQ ID NO: 1122600 - RNA, 21 nt, Mycobacterium bovis subsp bovis AF2122/97
agguggcguaauugucgaugu

SEQ ID NO: 1122601 - RNA, 23 nt, Mycobacterium bovis subsp bovis AF2122/97
agguggucacgcagucgggcagc

SEQ ID NO: 1122602 - RNA, 15 nt, Mycobacterium bovis subsp bovis AF2122/97
aggugcgcgugacga

SEQ ID NO: 1122603 - RNA, 15 nt, Mycobacterium bovis subsp bovis AF2122/97
aggugcugggcgagg

SEQ ID NO: 1122604 - RNA, 19 nt, Mycobacterium bovis subsp bovis AF2122/97
aggugcugguauagccggc

SEQ ID NO: 1122605 - RNA, 22 nt, Mycobacterium bovis subsp bovis AF2122/97
aggugcuggugaucugcugggc

SEQ ID NO: 1122606 - RNA, 14 nt, Mycobacterium bovis subsp bovis AF2122/97
agguggccagcgcg

SEQ ID NO: 1122607 - RNA, 14 nt, Mycobacterium bovis subsp bovis AF2122/97
agguggcgagcgcc

SEQ ID NO: 1122608 - RNA, 16 nt, Mycobacterium bovis subsp bovis AF2122/97
agguggcgagcgccuu

SEQ ID NO: 1122609 - RNA, 23 nt, Mycobacterium bovis subsp bovis AF2122/97
agguggccgcgcaggggcggcgu

SEQ ID NO: 1122610 - RNA, 15 nt, Mycobacterium bovis subsp bovis AF2122/97
agguggccgucgccg

SEQ ID NO: 1122611 - RNA, 14 nt, Mycobacterium bovis subsp bovis AF2122/97
agguggcccgcgcg

SEQ ID NO: 1122612 - RNA, 19 nt, Mycobacterium bovis subsp bovis AF2122/97
aggugggcguuggcgacga

SEQ ID NO: 1122613 - RNA, 21 nt, Mycobacterium bovis subsp bovis AF2122/97
agguugauuggggccagguug

SEQ ID NO: 1122614 - RNA, 15 nt, Mycobacterium bovis subsp bovis AF2122/97
agguugccgaaguuu

SEQ ID NO: 1122615 - RNA, 14 nt, Mycobacterium bovis subsp bovis AF2122/97
agguugcggacggu

SEQ ID NO: 1122616 - RNA, 18 nt, Mycobacterium bovis subsp bovis AF2122/97
agguugccuuggcggcca

SEQ ID NO: 1122617 - RNA, 15 nt, Mycobacterium bovis subsp bovis AF2122/97
agguugcguugcagg

SEQ ID NO: 1122618 - RNA, 19 nt, Mycobacterium bovis subsp bovis AF2122/97
agguuggcaagcacggcgu

SEQ ID NO: 1122619 - RNA, 17 nt, Mycobacterium bovis subsp bovis AF2122/97
agguuggccaccgccca

SEQ ID NO: 1122620 - RNA, 23 nt, Mycobacterium bovis subsp bovis AF2122/97
agguuccaccgggcgucgucggu

SEQ ID NO: 1122621 - RNA, 15 nt, Mycobacterium bovis subsp bovis AF2122/97
agguucgaucgcggu

SEQ ID NO: 1122622 - RNA, 22 nt, Mycobacterium bovis subsp bovis AF2122/97
agguucgcaccggagucggcgu

SEQ ID NO: 1122623 - RNA, 13 nt, Mycobacterium bovis subsp bovis AF2122/97
agguucgugcguu

SEQ ID NO: 1122624 - RNA, 18 nt, Mycobacterium bovis subsp bovis AF2122/97
agguucgguagucgaugc

SEQ ID NO: 1122625 - RNA, 22 nt, Mycobacterium bovis subsp bovis AF2122/97
agguuguacaggaagucgcgga

SEQ ID NO: 1122626 - RNA, 14 nt, Mycobacterium bovis subsp bovis AF2122/97
agguugucgucggu

SEQ ID NO: 1122627 - RNA, 16 nt, Mycobacterium bovis subsp bovis AF2122/97
agguugucgcuacgag

SEQ ID NO: 1122628 - RNA, 14 nt, Mycobacterium bovis subsp bovis AF2122/97
aguguccccggcug

SEQ ID NO: 1122629 - RNA, 20 nt, Mycobacterium bovis subsp bovis AF2122/97
agugucgauagcccgccacc

SEQ ID NO: 1122630 - RNA, 19 nt, Mycobacterium bovis subsp bovis AF2122/97
agugugaaucgcacgacgc

SEQ ID NO: 1122631 - RNA, 15 nt, Mycobacterium bovis subsp bovis AF2122/97
agugugacggcggcc

SEQ ID NO: 1122632 - RNA, 17 nt, Mycobacterium bovis subsp bovis AF2122/97
agugugagaucguaggg

SEQ ID NO: 1122633 - RNA, 18 nt, Mycobacterium bovis subsp bovis AF2122/97
aguggugauccagccguc

SEQ ID NO: 1122634 - RNA, 23 nt, Mycobacterium bovis subsp bovis AF2122/97
agucgcacucauagaacucgccg

SEQ ID NO: 1122635 - RNA, 12 nt, Mycobacterium bovis subsp bovis AF2122/97
aguggucgauga

SEQ ID NO: 1122636 - RNA, 18 nt, Mycobacterium bovis subsp bovis AF2122/97
aguggucccggugaugac

SEQ ID NO: 1122637 - RNA, 22 nt, Mycobacterium bovis subsp bovis AF2122/97
aguggucggcccgcucaccuug

SEQ ID NO: 1122638 - RNA, 13 nt, Mycobacterium bovis subsp bovis AF2122/97
agugucagcagau

SEQ ID NO: 1122639 - RNA, 12 nt, Mycobacterium bovis subsp bovis AF2122/97
agucgaucgccg

SEQ ID NO: 1122640 - RNA, 14 nt, Mycobacterium bovis subsp bovis AF2122/97
agucgaucgcggcc

SEQ ID NO: 1122641 - RNA, 20 nt, Mycobacterium bovis subsp bovis AF2122/97
agucgaucacguacgccgcc

SEQ ID NO: 1122642 - RNA, 22 nt, Mycobacterium bovis subsp bovis AF2122/97
agucgaucacguggugcggccg

SEQ ID NO: 1122643 - RNA, 16 nt, Mycobacterium bovis subsp bovis AF2122/97
agucgauguacaccgg

SEQ ID NO: 1122644 - RNA, 19 nt, Mycobacterium bovis subsp bovis AF2122/97
agucgauguacaccgugcg

SEQ ID NO: 1122645 - RNA, 20 nt, Mycobacterium bovis subsp bovis AF2122/97
agucgauguacaccgugcgc

SEQ ID NO: 1122646 - RNA, 19 nt, Mycobacterium bovis subsp bovis AF2122/97
agucgcagccaggcacguc

SEQ ID NO: 1122647 - RNA, 16 nt, Mycobacterium bovis subsp bovis AF2122/97
agucgacgaacucgcc

SEQ ID NO: 1122648 - RNA, 18 nt, Mycobacterium bovis subsp bovis AF2122/97
agucgacgaacucgccca

SEQ ID NO: 1122649 - RNA, 16 nt, Mycobacterium bovis subsp bovis AF2122/97
agucgacgacguccuc

SEQ ID NO: 1122650 - RNA, 15 nt, Mycobacterium bovis subsp bovis AF2122/97
agucgacgacguggc

SEQ ID NO: 1122651 - RNA, 13 nt, Mycobacterium bovis subsp bovis AF2122/97
agucgacccugcc

SEQ ID NO: 1122652 - RNA, 14 nt, Mycobacterium bovis subsp bovis AF2122/97
agucgacggccagu

SEQ ID NO: 1122653 - RNA, 14 nt, Mycobacterium bovis subsp bovis AF2122/97
agucgacggucacg

SEQ ID NO: 1122654 - RNA, 18 nt, Mycobacterium bovis subsp bovis AF2122/97
agucgacggugccgucgg

SEQ ID NO: 1122655 - RNA, 21 nt, Mycobacterium bovis subsp bovis AF2122/97
agucgacgguggcgccgucgg

SEQ ID NO: 1122656 - RNA, 19 nt, Mycobacterium bovis subsp bovis AF2122/97
agucgagcagauacagcgg

SEQ ID NO: 1122657 - RNA, 22 nt, Mycobacterium bovis subsp bovis AF2122/97
agucgaccauauuggcgcggcc

SEQ ID NO: 1122658 - RNA, 20 nt, Mycobacterium bovis subsp bovis AF2122/97
agucgaagaaccugagcacc

SEQ ID NO: 1122659 - RNA, 22 nt, Mycobacterium bovis subsp bovis AF2122/97
agucgaauggcaacacaccgaa

SEQ ID NO: 1122660 - RNA, 15 nt, Mycobacterium bovis subsp bovis AF2122/97
agucgaaugucccgg

SEQ ID NO: 1122661 - RNA, 23 nt, Mycobacterium bovis subsp bovis AF2122/97
aguugccaacacauugccggcca

SEQ ID NO: 1122662 - RNA, 15 nt, Mycobacterium bovis subsp bovis AF2122/97
aguugcccgacgccg

SEQ ID NO: 1122663 - RNA, 15 nt, Mycobacterium bovis subsp bovis AF2122/97
aguugcacaccggca

SEQ ID NO: 1122664 - RNA, 20 nt, Mycobacterium bovis subsp bovis AF2122/97
aguugcacaccggcacugcc

SEQ ID NO: 1122665 - RNA, 14 nt, Mycobacterium bovis subsp bovis AF2122/97
aguugaucaggccg

SEQ ID NO: 1122666 - RNA, 23 nt, Mycobacterium bovis subsp bovis AF2122/97
aguucucgcgcuugcgccgccca

SEQ ID NO: 1122667 - RNA, 20 nt, Mycobacterium bovis subsp bovis AF2122/97
aguucuggaauccggccaga

SEQ ID NO: 1122668 - RNA, 19 nt, Mycobacterium bovis subsp bovis AF2122/97
aguucugcgcucccguacg

SEQ ID NO: 1122669 - RNA, 17 nt, Mycobacterium bovis subsp bovis AF2122/97
aguugaaggugccggcg

SEQ ID NO: 1122670 - RNA, 16 nt, Mycobacterium bovis subsp bovis AF2122/97
aguucgucaccacgag

SEQ ID NO: 1122671 - RNA, 15 nt, Mycobacterium bovis subsp bovis AF2122/97
aguucgucagcggcc

SEQ ID NO: 1122672 - RNA, 20 nt, Mycobacterium bovis subsp bovis AF2122/97
aguucggcgucguccgcgcc

SEQ ID NO: 1122673 - RNA, 18 nt, Mycobacterium bovis subsp bovis AF2122/97
aguucgggcugcggcagu

SEQ ID NO: 1122674 - RNA, 17 nt, Mycobacterium bovis subsp bovis AF2122/97
aguucgguagcgaucgu

SEQ ID NO: 1122675 - RNA, 17 nt, Mycobacterium bovis subsp bovis AF2122/97
aguucggugagccgggc

SEQ ID NO: 1122676 - RNA, 20 nt, Mycobacterium bovis subsp bovis AF2122/97
aguucgguguagaucagcaa

SEQ ID NO: 1122677 - RNA, 18 nt, Mycobacterium bovis subsp bovis AF2122/97
aguuccuugaugcggccg

SEQ ID NO: 1122678 - RNA, 12 nt, Mycobacterium bovis subsp bovis AF2122/97
aguucggcggcc

SEQ ID NO: 1122679 - RNA, 22 nt, Mycobacterium bovis subsp bovis AF2122/97
aguucccuacacccauuacuga

SEQ ID NO: 1122680 - RNA, 23 nt, Mycobacterium bovis subsp bovis AF2122/97
auaaacccgaggcucgugcgugu

SEQ ID NO: 1122681 - RNA, 15 nt, Mycobacterium bovis subsp bovis AF2122/97
aguuguagacgucga

SEQ ID NO: 1122682 - RNA, 23 nt, Mycobacterium bovis subsp bovis AF2122/97
aguugguguuauugaugcccgac

SEQ ID NO: 1122683 - RNA, 16 nt, Mycobacterium bovis subsp bovis AF2122/97
aguugguucaccgcga

SEQ ID NO: 1122684 - RNA, 22 nt, Mycobacterium bovis subsp bovis AF2122/97
aguugcaguacuagcagcgggc

SEQ ID NO: 1122685 - RNA, 13 nt, Mycobacterium bovis subsp bovis AF2122/97
aguuggucgcggu

SEQ ID NO: 1122686 - RNA, 12 nt, Mycobacterium bovis subsp bovis AF2122/97
aguuguugcagg

SEQ ID NO: 1122687 - RNA, 17 nt, Mycobacterium bovis subsp bovis AF2122/97
auacagcaggccgcgcu

SEQ ID NO: 1122688 - RNA, 21 nt, Mycobacterium bovis subsp bovis AF2122/97
auaccauguucugcacguuga

SEQ ID NO: 1122689 - RNA, 16 nt, Mycobacterium bovis subsp bovis AF2122/97
auacccagcgcccggc

SEQ ID NO: 1122690 - RNA, 19 nt, Mycobacterium bovis subsp bovis AF2122/97
auaccgaaaucaccucacc

SEQ ID NO: 1122691 - RNA, 15 nt, Mycobacterium bovis subsp bovis AF2122/97
auaccgaacagcacc

SEQ ID NO: 1122692 - RNA, 23 nt, Mycobacterium bovis subsp bovis AF2122/97
auaccgaaccgguguagcagcgc

SEQ ID NO: 1122693 - RNA, 14 nt, Mycobacterium bovis subsp bovis AF2122/97
auaccgcuggggcu

SEQ ID NO: 1122694 - RNA, 18 nt, Mycobacterium bovis subsp bovis AF2122/97
auaccgccgcgcagccgc

SEQ ID NO: 1122695 - RNA, 15 nt, Mycobacterium bovis subsp bovis AF2122/97
auaccgccggcccca

SEQ ID NO: 1122696 - RNA, 23 nt, Mycobacterium bovis subsp bovis AF2122/97
auaccgcgaugauggcgguaccg

SEQ ID NO: 1122697 - RNA, 19 nt, Mycobacterium bovis subsp bovis AF2122/97
auaccgcucagggugcgcc

SEQ ID NO: 1122698 - RNA, 22 nt, Mycobacterium bovis subsp bovis AF2122/97
auaccgcucagggugcgccgca

SEQ ID NO: 1122699 - RNA, 15 nt, Mycobacterium bovis subsp bovis AF2122/97
auacuccgcgagccc

SEQ ID NO: 1122700 - RNA, 21 nt, Mycobacterium bovis subsp bovis AF2122/97
auagcaccaguuugugccgcc

SEQ ID NO: 1122701 - RNA, 17 nt, Mycobacterium bovis subsp bovis AF2122/97
aucaccacccgaccgcc

SEQ ID NO: 1122702 - RNA, 13 nt, Mycobacterium bovis subsp bovis AF2122/97
aucaccaccgacc

SEQ ID NO: 1122703 - RNA, 23 nt, Mycobacterium bovis subsp bovis AF2122/97
aucaccaccgaccuggacgcggc

SEQ ID NO: 1122704 - RNA, 13 nt, Mycobacterium bovis subsp bovis AF2122/97
aucaccaccgcac

SEQ ID NO: 1122705 - RNA, 14 nt, Mycobacterium bovis subsp bovis AF2122/97
aucacaucgcccgg

SEQ ID NO: 1122706 - RNA, 13 nt, Mycobacterium bovis subsp bovis AF2122/97
aucacaucgcccg

SEQ ID NO: 1122707 - RNA, 15 nt, Mycobacterium bovis subsp bovis AF2122/97
aucaccacaccggca

SEQ ID NO: 1122708 - RNA, 17 nt, Mycobacterium bovis subsp bovis AF2122/97
aucaccacaccggcagc

SEQ ID NO: 1122709 - RNA, 15 nt, Mycobacterium bovis subsp bovis AF2122/97
aucacaccccaggca

SEQ ID NO: 1122710 - RNA, 20 nt, Mycobacterium bovis subsp bovis AF2122/97
aucacaccgagcgcaaucga

SEQ ID NO: 1122711 - RNA, 16 nt, Mycobacterium bovis subsp bovis AF2122/97
aucacacguccgcgca

SEQ ID NO: 1122712 - RNA, 21 nt, Mycobacterium bovis subsp bovis AF2122/97
aucacacguccgcgcaccgca

SEQ ID NO: 1122713 - RNA, 17 nt, Mycobacterium bovis subsp bovis AF2122/97
aucaccccgccaugcgg

SEQ ID NO: 1122714 - RNA, 21 nt, Mycobacterium bovis subsp bovis AF2122/97
aucacccacucgacgucgucg

SEQ ID NO: 1122715 - RNA, 15 nt, Mycobacterium bovis subsp bovis AF2122/97
aucacccacucgccg

SEQ ID NO: 1122716 - RNA, 21 nt, Mycobacterium bovis subsp bovis AF2122/97
aucaccauccagcccaucccg

SEQ ID NO: 1122717 - RNA, 19 nt, Mycobacterium bovis subsp bovis AF2122/97
aucaccaucgccgccgcgc

SEQ ID NO: 1122718 - RNA, 23 nt, Mycobacterium bovis subsp bovis AF2122/97
aucaccaggguuggcaccgucag

SEQ ID NO: 1122719 - RNA, 18 nt, Mycobacterium bovis subsp bovis AF2122/97
aucaccgaccaacgcggu

SEQ ID NO: 1122720 - RNA, 16 nt, Mycobacterium bovis subsp bovis AF2122/97
aucaccgacgcgucgg

SEQ ID NO: 1122721 - RNA, 21 nt, Mycobacterium bovis subsp bovis AF2122/97
aucaccgaauaccgccgcgca

SEQ ID NO: 1122722 - RNA, 21 nt, Mycobacterium bovis subsp bovis AF2122/97
aucaccgaaugcacgacggug

SEQ ID NO: 1122723 - RNA, 14 nt, Mycobacterium bovis subsp bovis AF2122/97
aucaccgcgccagc

SEQ ID NO: 1122724 - RNA, 21 nt, Mycobacterium bovis subsp bovis AF2122/97
aucaccgcgcccgccgcggca

SEQ ID NO: 1122725 - RNA, 23 nt, Mycobacterium bovis subsp bovis AF2122/97
aucaccgcgcccgccgcggcagc

SEQ ID NO: 1122726 - RNA, 15 nt, Mycobacterium bovis subsp bovis AF2122/97
aucaccgccgcggcc

SEQ ID NO: 1122727 - RNA, 14 nt, Mycobacterium bovis subsp bovis AF2122/97
aucacguugcgcug

SEQ ID NO: 1122728 - RNA, 22 nt, Mycobacterium bovis subsp bovis AF2122/97
aucacgucgucagccaccgcau

SEQ ID NO: 1122729 - RNA, 15 nt, Mycobacterium bovis subsp bovis AF2122/97
aucacguggaccacg

SEQ ID NO: 1122730 - RNA, 17 nt, Mycobacterium bovis subsp bovis AF2122/97
aucacguggaccacggc

SEQ ID NO: 1122731 - RNA, 19 nt, Mycobacterium bovis subsp bovis AF2122/97
aucacgugguccaaccggg

SEQ ID NO: 1122732 - RNA, 22 nt, Mycobacterium bovis subsp bovis AF2122/97
aucacguggugcggccgggucg

SEQ ID NO: 1122733 - RNA, 20 nt, Mycobacterium bovis subsp bovis AF2122/97
aucacgguugccgcgaucgg

SEQ ID NO: 1122734 - RNA, 13 nt, Mycobacterium bovis subsp bovis AF2122/97
aucacggcggccc

SEQ ID NO: 1122735 - RNA, 14 nt, Mycobacterium bovis subsp bovis AF2122/97
aucacggcggcccc

SEQ ID NO: 1122736 - RNA, 17 nt, Mycobacterium bovis subsp bovis AF2122/97
aucacggcggccccggc

SEQ ID NO: 1122737 - RNA, 16 nt, Mycobacterium bovis subsp bovis AF2122/97
aucacgaucacaccac

SEQ ID NO: 1122738 - RNA, 14 nt, Mycobacterium bovis subsp bovis AF2122/97
aucacggaccaggc

SEQ ID NO: 1122739 - RNA, 22 nt, Mycobacterium bovis subsp bovis AF2122/97
aucacgccggccucgccgaagc

SEQ ID NO: 1122740 - RNA, 19 nt, Mycobacterium bovis subsp bovis AF2122/97
aucaccuggcgugucgccg

SEQ ID NO: 1122741 - RNA, 23 nt, Mycobacterium bovis subsp bovis AF2122/97
aucaccuucggccgaccgggcuc

SEQ ID NO: 1122742 - RNA, 20 nt, Mycobacterium bovis subsp bovis AF2122/97
aucacgacguugccucgcga

SEQ ID NO: 1122743 - RNA, 14 nt, Mycobacterium bovis subsp bovis AF2122/97
aucacgaccgcgca

SEQ ID NO: 1122744 - RNA, 11 nt, Mycobacterium bovis subsp bovis AF2122/97
aucacgacgcc

SEQ ID NO: 1122745 - RNA, 12 nt, Mycobacterium bovis subsp bovis AF2122/97
aucacgaucaca

SEQ ID NO: 1122746 - RNA, 13 nt, Mycobacterium bovis subsp bovis AF2122/97
aucacgaccgcgc

SEQ ID NO: 1122747 - RNA, 21 nt, Mycobacterium bovis subsp bovis AF2122/97
aucaccuugccuagccgcagc

SEQ ID NO: 1122748 - RNA, 18 nt, Mycobacterium bovis subsp bovis AF2122/97
aucaccggagcgccgagc

SEQ ID NO: 1122749 - RNA, 22 nt, Mycobacterium bovis subsp bovis AF2122/97
aucaccgcuguguucagcgcau

SEQ ID NO: 1122750 - RNA, 19 nt, Mycobacterium bovis subsp bovis AF2122/97
aucaccggcgcaccgucgc

SEQ ID NO: 1122751 - RNA, 22 nt, Mycobacterium bovis subsp bovis AF2122/97
aucaccggcaugcgugccggca

SEQ ID NO: 1122752 - RNA, 16 nt, Mycobacterium bovis subsp bovis AF2122/97
aucaccucccgcggca

SEQ ID NO: 1122753 - RNA, 15 nt, Mycobacterium bovis subsp bovis AF2122/97
aucaccucggcgacg

SEQ ID NO: 1122754 - RNA, 21 nt, Mycobacterium bovis subsp bovis AF2122/97
aucaccucggcgacgucggcg

SEQ ID NO: 1122755 - RNA, 18 nt, Mycobacterium bovis subsp bovis AF2122/97
aucaccgguucggugagc

SEQ ID NO: 1122756 - RNA, 19 nt, Mycobacterium bovis subsp bovis AF2122/97
aucaccgguucggugagcg

SEQ ID NO: 1122757 - RNA, 13 nt, Mycobacterium bovis subsp bovis AF2122/97
aucagcacgucgc

SEQ ID NO: 1122758 - RNA, 16 nt, Mycobacterium bovis subsp bovis AF2122/97
aucagcacgucgcggc

SEQ ID NO: 1122759 - RNA, 14 nt, Mycobacterium bovis subsp bovis AF2122/97
aucagcaccgacgg

SEQ ID NO: 1122760 - RNA, 21 nt, Mycobacterium bovis subsp bovis AF2122/97
aucagcacguaacgccgcuca

SEQ ID NO: 1122761 - RNA, 14 nt, Mycobacterium bovis subsp bovis AF2122/97
aucagcaccgacag

SEQ ID NO: 1122762 - RNA, 15 nt, Mycobacterium bovis subsp bovis AF2122/97
aucagcgcggcgccc

SEQ ID NO: 1122763 - RNA, 18 nt, Mycobacterium bovis subsp bovis AF2122/97
aucagcgccagcgagcau

SEQ ID NO: 1122764 - RNA, 18 nt, Mycobacterium bovis subsp bovis AF2122/97
aucagcgacuccacccca

SEQ ID NO: 1122765 - RNA, 19 nt, Mycobacterium bovis subsp bovis AF2122/97
aucagcccgccggacccgc

SEQ ID NO: 1122766 - RNA, 19 nt, Mycobacterium bovis subsp bovis AF2122/97
aucagccguggcagucgca

SEQ ID NO: 1122767 - RNA, 17 nt, Mycobacterium bovis subsp bovis AF2122/97
aucagccgcaucuuguc

SEQ ID NO: 1122768 - RNA, 17 nt, Mycobacterium bovis subsp bovis AF2122/97
aucagccgccaaccgca

SEQ ID NO: 1122769 - RNA, 12 nt, Mycobacterium bovis subsp bovis AF2122/97
aucagaucgccg

SEQ ID NO: 1122770 - RNA, 13 nt, Mycobacterium bovis subsp bovis AF2122/97
aucagaucgccga

SEQ ID NO: 1122771 - RNA, 13 nt, Mycobacterium bovis subsp bovis AF2122/97
aucagaucccgcc

SEQ ID NO: 1122772 - RNA, 22 nt, Mycobacterium bovis subsp bovis AF2122/97
aucagaaucaggcucgccgaug

SEQ ID NO: 1122773 - RNA, 20 nt, Mycobacterium bovis subsp bovis AF2122/97
aucagacccagcgcggcaac

SEQ ID NO: 1122774 - RNA, 14 nt, Mycobacterium bovis subsp bovis AF2122/97
aucagacgauucgg

SEQ ID NO: 1122775 - RNA, 16 nt, Mycobacterium bovis subsp bovis AF2122/97
aucagcaacacgucgg

SEQ ID NO: 1122776 - RNA, 22 nt, Mycobacterium bovis subsp bovis AF2122/97
aucacuaaccuggcguagauca

SEQ ID NO: 1122777 - RNA, 22 nt, Mycobacterium bovis subsp bovis AF2122/97
aucacucccccacacacccgac

SEQ ID NO: 1122778 - RNA, 20 nt, Mycobacterium bovis subsp bovis AF2122/97
aucaacccgguccagccggu

SEQ ID NO: 1122779 - RNA, 14 nt, Mycobacterium bovis subsp bovis AF2122/97
aucaacaucggccc

SEQ ID NO: 1122780 - RNA, 22 nt, Mycobacterium bovis subsp bovis AF2122/97
aucaaccccggugcagaugcgg

SEQ ID NO: 1122781 - RNA, 18 nt, Mycobacterium bovis subsp bovis AF2122/97
aucaacaugccggucauc

SEQ ID NO: 1122782 - RNA, 15 nt, Mycobacterium bovis subsp bovis AF2122/97
aucaacaggccggcu

SEQ ID NO: 1122783 - RNA, 15 nt, Mycobacterium bovis subsp bovis AF2122/97
aucaacaccaacgac

SEQ ID NO: 1122784 - RNA, 22 nt, Mycobacterium bovis subsp bovis AF2122/97
aucaacaaggggcagcacguca

SEQ ID NO: 1122785 - RNA, 20 nt, Mycobacterium bovis subsp bovis AF2122/97
aucaaaaacgaacccaggca

SEQ ID NO: 1122786 - RNA, 15 nt, Mycobacterium bovis subsp bovis AF2122/97
aucaaacccccgggg

SEQ ID NO: 1122787 - RNA, 15 nt, Mycobacterium bovis subsp bovis AF2122/97
aucaaaccggcggcg

SEQ ID NO: 1122788 - RNA, 14 nt, Mycobacterium bovis subsp bovis AF2122/97
aucaacucgugcgg

SEQ ID NO: 1122789 - RNA, 19 nt, Mycobacterium bovis subsp bovis AF2122/97
aucaagaaguacagcuggc

SEQ ID NO: 1122790 - RNA, 22 nt, Mycobacterium bovis subsp bovis AF2122/97
aucaacggaacaucgucaucga

SEQ ID NO: 1122791 - RNA, 16 nt, Mycobacterium bovis subsp bovis AF2122/97
aucaacgcgucgcccg

SEQ ID NO: 1122792 - RNA, 19 nt, Mycobacterium bovis subsp bovis AF2122/97
aucaagccuucgucgaugc

SEQ ID NO: 1122793 - RNA, 13 nt, Mycobacterium bovis subsp bovis AF2122/97
aucaagccgugau

SEQ ID NO: 1122794 - RNA, 15 nt, Mycobacterium bovis subsp bovis AF2122/97
aucaagcuggcccgc

SEQ ID NO: 1122795 - RNA, 14 nt, Mycobacterium bovis subsp bovis AF2122/97
aucaaugcgaugcg

SEQ ID NO: 1122796 - RNA, 20 nt, Mycobacterium bovis subsp bovis AF2122/97
auagccgaaaaagaccgaca

SEQ ID NO: 1122797 - RNA, 14 nt, Mycobacterium bovis subsp bovis AF2122/97
auagccaccgacga

SEQ ID NO: 1122798 - RNA, 17 nt, Mycobacterium bovis subsp bovis AF2122/97
auagccaccgacgacau

SEQ ID NO: 1122799 - RNA, 16 nt, Mycobacterium bovis subsp bovis AF2122/97
auagccguucggcauc

SEQ ID NO: 1122800 - RNA, 16 nt, Mycobacterium bovis subsp bovis AF2122/97
auagccgccgcgguca

SEQ ID NO: 1122801 - RNA, 15 nt, Mycobacterium bovis subsp bovis AF2122/97
auagccgcgacccgc

SEQ ID NO: 1122802 - RNA, 11 nt, Mycobacterium bovis subsp bovis AF2122/97
auagccggcgc

SEQ ID NO: 1122803 - RNA, 16 nt, Mycobacterium bovis subsp bovis AF2122/97
auagcgacagcagcgc

SEQ ID NO: 1122804 - RNA, 19 nt, Mycobacterium bovis subsp bovis AF2122/97
auagccugcgccgacccgc

SEQ ID NO: 1122805 - RNA, 19 nt, Mycobacterium bovis subsp bovis AF2122/97
auagccgguggucgcgccc

SEQ ID NO: 1122806 - RNA, 23 nt, Mycobacterium bovis subsp bovis AF2122/97
auagccggucaguauggcgacga

SEQ ID NO: 1122807 - RNA, 13 nt, Mycobacterium bovis subsp bovis AF2122/97
caccgaaccgccg

SEQ ID NO: 1122808 - RNA, 20 nt, Mycobacterium bovis subsp bovis AF2122/97
caccgaaccgccgcugccgc

SEQ ID NO: 1122809 - RNA, 19 nt, Mycobacterium bovis subsp bovis AF2122/97
caccgaacccgccaccgcg

SEQ ID NO: 1122810 - RNA, 15 nt, Mycobacterium bovis subsp bovis AF2122/97
caccgaaacgccgac

SEQ ID NO: 1122811 - RNA, 22 nt, Mycobacterium bovis subsp bovis AF2122/97
caccgaaauugcccuagcagca

SEQ ID NO: 1122812 - RNA, 23 nt, Mycobacterium bovis subsp bovis AF2122/97
caccgaaauugcccuagcagcaa

SEQ ID NO: 1122813 - RNA, 16 nt, Mycobacterium bovis subsp bovis AF2122/97
caccgaacagucgcag

SEQ ID NO: 1122814 - RNA, 20 nt, Mycobacterium bovis subsp bovis AF2122/97
caccgaaaaguccgccgccu

SEQ ID NO: 1122815 - RNA, 19 nt, Mycobacterium bovis subsp bovis AF2122/97
caccgaaaccaugccgccg

SEQ ID NO: 1122816 - RNA, 22 nt, Mycobacterium bovis subsp bovis AF2122/97
caccgaaaccaugccgccgaag

SEQ ID NO: 1122817 - RNA, 14 nt, Mycobacterium bovis subsp bovis AF2122/97
caccgaaauaccca

SEQ ID NO: 1122818 - RNA, 21 nt, Mycobacterium bovis subsp bovis AF2122/97
cacccguucgugagcggccag

SEQ ID NO: 1122819 - RNA, 23 nt, Mycobacterium bovis subsp bovis AF2122/97
cacccguugagcauaugacgucg

SEQ ID NO: 1122820 - RNA, 20 nt, Mycobacterium bovis subsp bovis AF2122/97
cacccguugaucgcggacac

SEQ ID NO: 1122821 - RNA, 18 nt, Mycobacterium bovis subsp bovis AF2122/97
cacccgugaguucgcaau

SEQ ID NO: 1122822 - RNA, 16 nt, Mycobacterium bovis subsp bovis AF2122/97
cacccuaaucguuccg

SEQ ID NO: 1122823 - RNA, 14 nt, Mycobacterium bovis subsp bovis AF2122/97
cacccgguccaccg

SEQ ID NO: 1122824 - RNA, 13 nt, Mycobacterium bovis subsp bovis AF2122/97
cacccguccggcc

SEQ ID NO: 1122825 - RNA, 13 nt, Mycobacterium bovis subsp bovis AF2122/97
cacccgcggcgaa

SEQ ID NO: 1122826 - RNA, 15 nt, Mycobacterium bovis subsp bovis AF2122/97
cacccgcggcgaacc

SEQ ID NO: 1122827 - RNA, 19 nt, Mycobacterium bovis subsp bovis AF2122/97
cacccgcggugacgccagc

SEQ ID NO: 1122828 - RNA, 13 nt, Mycobacterium bovis subsp bovis AF2122/97
cacccgcggcgcc

SEQ ID NO: 1122829 - RNA, 14 nt, Mycobacterium bovis subsp bovis AF2122/97
cacccgcucggcgc

SEQ ID NO: 1122830 - RNA, 14 nt, Mycobacterium bovis subsp bovis AF2122/97
cacccgcucggccg

SEQ ID NO: 1122831 - RNA, 12 nt, Mycobacterium bovis subsp bovis AF2122/97
cacccgcucgcc

SEQ ID NO: 1122832 - RNA, 16 nt, Mycobacterium bovis subsp bovis AF2122/97
cacccgcucgcccgcc

SEQ ID NO: 1122833 - RNA, 23 nt, Mycobacterium bovis subsp bovis AF2122/97
cacccgcuccauaucgucgggcg

SEQ ID NO: 1122834 - RNA, 14 nt, Mycobacterium bovis subsp bovis AF2122/97
cacccgguccugcu

SEQ ID NO: 1122835 - RNA, 17 nt, Mycobacterium bovis subsp bovis AF2122/97
cacccgguuggccccca

SEQ ID NO: 1122836 - RNA, 21 nt, Mycobacterium bovis subsp bovis AF2122/97
cacccgguugugcgcgcgccc

SEQ ID NO: 1122837 - RNA, 24 nt, Mycobacterium bovis subsp bovis AF2122/97
cacccgguugugcgcgcgcccgaa

SEQ ID NO: 1122838 - RNA, 17 nt, Mycobacterium bovis subsp bovis AF2122/97
cacccggugccgcagca

SEQ ID NO: 1122839 - RNA, 14 nt, Mycobacterium bovis subsp bovis AF2122/97
cacccgcuggcggu

SEQ ID NO: 1122840 - RNA, 16 nt, Mycobacterium bovis subsp bovis AF2122/97
cacccgcuggucgagc

SEQ ID NO: 1122841 - RNA, 20 nt, Mycobacterium bovis subsp bovis AF2122/97
cacccgcugcgagaucgcgg

SEQ ID NO: 1122842 - RNA, 14 nt, Mycobacterium bovis subsp bovis AF2122/97
caccgacgcgucgg

SEQ ID NO: 1122843 - RNA, 13 nt, Mycobacterium bovis subsp bovis AF2122/97
caccgacgcgaac

SEQ ID NO: 1122844 - RNA, 22 nt, Mycobacterium bovis subsp bovis AF2122/97
caccgacgcgaacgcggccacc

SEQ ID NO: 1122845 - RNA, 15 nt, Mycobacterium bovis subsp bovis AF2122/97
caccgacgcgcccgc

SEQ ID NO: 1122846 - RNA, 18 nt, Mycobacterium bovis subsp bovis AF2122/97
caccgacgcgucggcgac

SEQ ID NO: 1122847 - RNA, 19 nt, Mycobacterium bovis subsp bovis AF2122/97
caccgacgcgucggcgacg

SEQ ID NO: 1122848 - RNA, 13 nt, Mycobacterium bovis subsp bovis AF2122/97
caccgacgcgguc

SEQ ID NO: 1122849 - RNA, 14 nt, Mycobacterium bovis subsp bovis AF2122/97
caccgacgcggucg

SEQ ID NO: 1122850 - RNA, 23 nt, Mycobacterium bovis subsp bovis AF2122/97
caccgacgcggucggcggccgcc

SEQ ID NO: 1122851 - RNA, 17 nt, Mycobacterium bovis subsp bovis AF2122/97
caccgacgaggacguca

SEQ ID NO: 1122852 - RNA, 18 nt, Mycobacterium bovis subsp bovis AF2122/97
caccgacgcacaggcgac

SEQ ID NO: 1122853 - RNA, 14 nt, Mycobacterium bovis subsp bovis AF2122/97
caccgacgccgcca

SEQ ID NO: 1122854 - RNA, 16 nt, Mycobacterium bovis subsp bovis AF2122/97
caccgacgccgccagg

SEQ ID NO: 1122855 - RNA, 18 nt, Mycobacterium bovis subsp bovis AF2122/97
caccgacggaugaucagc

SEQ ID NO: 1122856 - RNA, 21 nt, Mycobacterium bovis subsp bovis AF2122/97
caccgacgggauauccggucg

SEQ ID NO: 1122857 - RNA, 14 nt, Mycobacterium bovis subsp bovis AF2122/97
caccgacggcgcau

SEQ ID NO: 1122858 - RNA, 15 nt, Mycobacterium bovis subsp bovis AF2122/97
caccgacugcuguca

SEQ ID NO: 1122859 - RNA, 21 nt, Mycobacterium bovis subsp bovis AF2122/97
caccgacgucaggcucacguc

SEQ ID NO: 1122860 - RNA, 21 nt, Mycobacterium bovis subsp bovis AF2122/97
caccgacugcugucaccgcaa

SEQ ID NO: 1122861 - RNA, 14 nt, Mycobacterium bovis subsp bovis AF2122/97
caccgacgacacca

SEQ ID NO: 1122862 - RNA, 13 nt, Mycobacterium bovis subsp bovis AF2122/97
caccgaccgcaug

SEQ ID NO: 1122863 - RNA, 17 nt, Mycobacterium bovis subsp bovis AF2122/97
caccgaccgcaugaucg

SEQ ID NO: 1122864 - RNA, 18 nt, Mycobacterium bovis subsp bovis AF2122/97
caccgaccuaccgucgac

SEQ ID NO: 1122865 - RNA, 21 nt, Mycobacterium bovis subsp bovis AF2122/97
caccgaccuggacgcggccaa

SEQ ID NO: 1122866 - RNA, 13 nt, Mycobacterium bovis subsp bovis AF2122/97
caccgaccgcacc

SEQ ID NO: 1122867 - RNA, 14 nt, Mycobacterium bovis subsp bovis AF2122/97
caccgaccgggucg

SEQ ID NO: 1122868 - RNA, 22 nt, Mycobacterium bovis subsp bovis AF2122/97
caccgaccgggucgcaaccgcc

SEQ ID NO: 1122869 - RNA, 16 nt, Mycobacterium bovis subsp bovis AF2122/97
caccgaccuaccgucg

SEQ ID NO: 1122870 - RNA, 17 nt, Mycobacterium bovis subsp bovis AF2122/97
caccgaccagggccgcc

SEQ ID NO: 1122871 - RNA, 17 nt, Mycobacterium bovis subsp bovis AF2122/97
caccgacaugacgcggc

SEQ ID NO: 1122872 - RNA, 18 nt, Mycobacterium bovis subsp bovis AF2122/97
caccgacauuggugugga

SEQ ID NO: 1122873 - RNA, 15 nt, Mycobacterium bovis subsp bovis AF2122/97
caccgacaccggccg

SEQ ID NO: 1122874 - RNA, 20 nt, Mycobacterium bovis subsp bovis AF2122/97
caccgacaagaauggccgcc

SEQ ID NO: 1122875 - RNA, 16 nt, Mycobacterium bovis subsp bovis AF2122/97
caccgacaccggccgc

SEQ ID NO: 1122876 - RNA, 17 nt, Mycobacterium bovis subsp bovis AF2122/97
caccgacaccggccgcg

SEQ ID NO: 1122877 - RNA, 20 nt, Mycobacterium bovis subsp bovis AF2122/97
caccgacaccggccgcgacg

SEQ ID NO: 1122878 - RNA, 17 nt, Mycobacterium bovis subsp bovis AF2122/97
caccgacaccgugccgc

SEQ ID NO: 1122879 - RNA, 17 nt, Mycobacterium bovis subsp bovis AF2122/97
caccgacaccguguugc

SEQ ID NO: 1122880 - RNA, 19 nt, Mycobacterium bovis subsp bovis AF2122/97
caccgacauguguggcagc

SEQ ID NO: 1122881 - RNA, 23 nt, Mycobacterium bovis subsp bovis AF2122/97
caccgacagccccaucaccaccg

SEQ ID NO: 1122882 - RNA, 21 nt, Mycobacterium bovis subsp bovis AF2122/97
caccgacagcacccggccacc

SEQ ID NO: 1122883 - RNA, 17 nt, Mycobacterium bovis subsp bovis AF2122/97
caccgaagauggccagc

SEQ ID NO: 1122884 - RNA, 21 nt, Mycobacterium bovis subsp bovis AF2122/97
caccgaagauggccagcgcgg

SEQ ID NO: 1122885 - RNA, 22 nt, Mycobacterium bovis subsp bovis AF2122/97
caccgaacgcggccaccgaccg

SEQ ID NO: 1122886 - RNA, 15 nt, Mycobacterium bovis subsp bovis AF2122/97
caccgaacggcgagg

SEQ ID NO: 1122887 - RNA, 14 nt, Mycobacterium bovis subsp bovis AF2122/97
caccgaacgcgaug

SEQ ID NO: 1122888 - RNA, 16 nt, Mycobacterium bovis subsp bovis AF2122/97
caccgaacgcggccac

SEQ ID NO: 1122889 - RNA, 15 nt, Mycobacterium bovis subsp bovis AF2122/97
caccgaacgcaccga

SEQ ID NO: 1122890 - RNA, 17 nt, Mycobacterium bovis subsp bovis AF2122/97
caccgaaaaacaccagc

SEQ ID NO: 1122891 - RNA, 22 nt, Mycobacterium bovis subsp bovis AF2122/97
caccgaacccgccaccgcgaca

SEQ ID NO: 1122892 - RNA, 14 nt, Mycobacterium bovis subsp bovis AF2122/97
caccgaagccgccg

SEQ ID NO: 1122893 - RNA, 23 nt, Mycobacterium bovis subsp bovis AF2122/97
caccgaaggugcgcgugacgauc

SEQ ID NO: 1122894 - RNA, 15 nt, Mycobacterium bovis subsp bovis AF2122/97
caccgaagucgauga

SEQ ID NO: 1122895 - RNA, 16 nt, Mycobacterium bovis subsp bovis AF2122/97
caccgaauuacgcacc

SEQ ID NO: 1122896 - RNA, 17 nt, Mycobacterium bovis subsp bovis AF2122/97
caccgaauaccgccgcg

SEQ ID NO: 1122897 - RNA, 20 nt, Mycobacterium bovis subsp bovis AF2122/97
cacccagauugccugggcgg

SEQ ID NO: 1122898 - RNA, 23 nt, Mycobacterium bovis subsp bovis AF2122/97
cacccagauugccugggcggccg

SEQ ID NO: 1122899 - RNA, 17 nt, Mycobacterium bovis subsp bovis AF2122/97
cacccagcaccagggcg

SEQ ID NO: 1122900 - RNA, 14 nt, Mycobacterium bovis subsp bovis AF2122/97
cacccagcacgcgc

SEQ ID NO: 1122901 - RNA, 14 nt, Mycobacterium bovis subsp bovis AF2122/97
cacccagccgcagc

SEQ ID NO: 1122902 - RNA, 20 nt, Mycobacterium bovis subsp bovis AF2122/97
cacccagaugcagcggucca

SEQ ID NO: 1122903 - RNA, 15 nt, Mycobacterium bovis subsp bovis AF2122/97
cacccagccgcagcc

SEQ ID NO: 1122904 - RNA, 14 nt, Mycobacterium bovis subsp bovis AF2122/97
cacccagaugcagc

SEQ ID NO: 1122905 - RNA, 22 nt, Mycobacterium bovis subsp bovis AF2122/97
cacccagaaugacaucgucgcc

SEQ ID NO: 1122906 - RNA, 15 nt, Mycobacterium bovis subsp bovis AF2122/97
cacccagacaccggc

SEQ ID NO: 1122907 - RNA, 17 nt, Mycobacterium bovis subsp bovis AF2122/97
cacccacuccgccgaua

SEQ ID NO: 1122908 - RNA, 16 nt, Mycobacterium bovis subsp bovis AF2122/97
cacccacucgacgucg

SEQ ID NO: 1122909 - RNA, 21 nt, Mycobacterium bovis subsp bovis AF2122/97
cacccaaugccaccgcggccg

SEQ ID NO: 1122910 - RNA, 23 nt, Mycobacterium bovis subsp bovis AF2122/97
cacccaaugccaccgcggccgcg

SEQ ID NO: 1122911 - RNA, 23 nt, Mycobacterium bovis subsp bovis AF2122/97
cacccaauggagccgcgaccaug

SEQ ID NO: 1122912 - RNA, 19 nt, Mycobacterium bovis subsp bovis AF2122/97
cacccacaugacgaucgcg

SEQ ID NO: 1122913 - RNA, 17 nt, Mycobacterium bovis subsp bovis AF2122/97
cacccacauggcggccc

SEQ ID NO: 1122914 - RNA, 18 nt, Mycobacterium bovis subsp bovis AF2122/97
cacccacauggcggcccg

SEQ ID NO: 1122915 - RNA, 16 nt, Mycobacterium bovis subsp bovis AF2122/97
cacccacgaucagcag

SEQ ID NO: 1122916 - RNA, 14 nt, Mycobacterium bovis subsp bovis AF2122/97
cacccacgccgacu

SEQ ID NO: 1122917 - RNA, 14 nt, Mycobacterium bovis subsp bovis AF2122/97
cacccacgccggug

SEQ ID NO: 1122918 - RNA, 16 nt, Mycobacterium bovis subsp bovis AF2122/97
cacccacccgcaccgc

SEQ ID NO: 1122919 - RNA, 14 nt, Mycobacterium bovis subsp bovis AF2122/97
cacccacgucgagc

SEQ ID NO: 1122920 - RNA, 15 nt, Mycobacterium bovis subsp bovis AF2122/97
cacccaccggccacc

SEQ ID NO: 1122921 - RNA, 20 nt, Mycobacterium bovis subsp bovis AF2122/97
cacccacguugaugaugccg

SEQ ID NO: 1122922 - RNA, 17 nt, Mycobacterium bovis subsp bovis AF2122/97
caccaggccgagccgcc

SEQ ID NO: 1122923 - RNA, 19 nt, Mycobacterium bovis subsp bovis AF2122/97
caccaggccgagccgcccg

SEQ ID NO: 1122924 - RNA, 19 nt, Mycobacterium bovis subsp bovis AF2122/97
caccagguacgcgaucagc

SEQ ID NO: 1122925 - RNA, 22 nt, Mycobacterium bovis subsp bovis AF2122/97
caccaggucauugccggcgacg

SEQ ID NO: 1122926 - RNA, 14 nt, Mycobacterium bovis subsp bovis AF2122/97
caccagguccaccc

SEQ ID NO: 1122927 - RNA, 16 nt, Mycobacterium bovis subsp bovis AF2122/97
caccagguccaccccg

SEQ ID NO: 1122928 - RNA, 16 nt, Mycobacterium bovis subsp bovis AF2122/97
caccaggggaccgcgg

SEQ ID NO: 1122929 - RNA, 17 nt, Mycobacterium bovis subsp bovis AF2122/97
caccaggggaccgcggc

SEQ ID NO: 1122930 - RNA, 15 nt, Mycobacterium bovis subsp bovis AF2122/97
caccaggcccgguuc

SEQ ID NO: 1122931 - RNA, 13 nt, Mycobacterium bovis subsp bovis AF2122/97
caccaggagcgga

SEQ ID NO: 1122932 - RNA, 16 nt, Mycobacterium bovis subsp bovis AF2122/97
caccccccguccaccg

SEQ ID NO: 1122933 - RNA, 14 nt, Mycobacterium bovis subsp bovis AF2122/97
cacccccgauagcg

SEQ ID NO: 1122934 - RNA, 13 nt, Mycobacterium bovis subsp bovis AF2122/97
caccccgaagaug

SEQ ID NO: 1122935 - RNA, 22 nt, Mycobacterium bovis subsp bovis AF2122/97
caccccgaagcucaucaccggc

SEQ ID NO: 1122936 - RNA, 17 nt, Mycobacterium bovis subsp bovis AF2122/97
cacccccgucgaucagc

SEQ ID NO: 1122937 - RNA, 22 nt, Mycobacterium bovis subsp bovis AF2122/97
cacccccgucugcgugggccug

SEQ ID NO: 1122938 - RNA, 16 nt, Mycobacterium bovis subsp bovis AF2122/97
caccccauggccaccg

SEQ ID NO: 1122939 - RNA, 15 nt, Mycobacterium bovis subsp bovis AF2122/97
cacccccaaccgccg

SEQ ID NO: 1122940 - RNA, 19 nt, Mycobacterium bovis subsp bovis AF2122/97
cacccagucggcgccgccg

SEQ ID NO: 1122941 - RNA, 12 nt, Mycobacterium bovis subsp bovis AF2122/97
cacccaggccga

SEQ ID NO: 1122942 - RNA, 18 nt, Mycobacterium bovis subsp bovis AF2122/97
cacccaggugucgcugcu

SEQ ID NO: 1122943 - RNA, 18 nt, Mycobacterium bovis subsp bovis AF2122/97
cacccagcgugcccgcca

SEQ ID NO: 1122944 - RNA, 17 nt, Mycobacterium bovis subsp bovis AF2122/97
cacccagcgugcccgcc

SEQ ID NO: 1122945 - RNA, 19 nt, Mycobacterium bovis subsp bovis AF2122/97
cacccagcgacucggccag

SEQ ID NO: 1122946 - RNA, 16 nt, Mycobacterium bovis subsp bovis AF2122/97
cacccagcggaaccga

SEQ ID NO: 1122947 - RNA, 13 nt, Mycobacterium bovis subsp bovis AF2122/97
cacccgccgcagc

SEQ ID NO: 1122948 - RNA, 18 nt, Mycobacterium bovis subsp bovis AF2122/97
cacccgcauggcagcggc

SEQ ID NO: 1122949 - RNA, 21 nt, Mycobacterium bovis subsp bovis AF2122/97
cacccgcauggcagcggcggu

SEQ ID NO: 1122950 - RNA, 17 nt, Mycobacterium bovis subsp bovis AF2122/97
cacccgccaggccgcgc

SEQ ID NO: 1122951 - RNA, 18 nt, Mycobacterium bovis subsp bovis AF2122/97
caccccccagcgccgccg

SEQ ID NO: 1122952 - RNA, 22 nt, Mycobacterium bovis subsp bovis AF2122/97
caccccgccaugcggcgcgucg

SEQ ID NO: 1122953 - RNA, 18 nt, Mycobacterium bovis subsp bovis AF2122/97
caccccgccaugcggcgc

SEQ ID NO: 1122954 - RNA, 19 nt, Mycobacterium bovis subsp bovis AF2122/97
caccccgauucgugucggu

SEQ ID NO: 1122955 - RNA, 13 nt, Mycobacterium bovis subsp bovis AF2122/97
caccccgauccgc

SEQ ID NO: 1122956 - RNA, 18 nt, Mycobacterium bovis subsp bovis AF2122/97
caccccgaugccgugccg

SEQ ID NO: 1122957 - RNA, 14 nt, Mycobacterium bovis subsp bovis AF2122/97
caccccgacguucg

SEQ ID NO: 1122958 - RNA, 17 nt, Mycobacterium bovis subsp bovis AF2122/97
caccccgagccgcagcu

SEQ ID NO: 1122959 - RNA, 15 nt, Mycobacterium bovis subsp bovis AF2122/97
cacccgcgccgcccg

SEQ ID NO: 1122960 - RNA, 15 nt, Mycobacterium bovis subsp bovis AF2122/97
cacccgcgcgacgcc

SEQ ID NO: 1122961 - RNA, 22 nt, Mycobacterium bovis subsp bovis AF2122/97
cacccgcgcgaugcuggcgaac

SEQ ID NO: 1122962 - RNA, 13 nt, Mycobacterium bovis subsp bovis AF2122/97
cacccgcgccgcc

SEQ ID NO: 1122963 - RNA, 11 nt, Mycobacterium bovis subsp bovis AF2122/97
cacccgccgug

SEQ ID NO: 1122964 - RNA, 12 nt, Mycobacterium bovis subsp bovis AF2122/97
cacccgcgacga

SEQ ID NO: 1122965 - RNA, 17 nt, Mycobacterium bovis subsp bovis AF2122/97
cacccgcgagaucgggc

SEQ ID NO: 1122966 - RNA, 20 nt, Mycobacterium bovis subsp bovis AF2122/97
cacccgcgagaucgggccgg

SEQ ID NO: 1122967 - RNA, 17 nt, Mycobacterium bovis subsp bovis AF2122/97
cacccgcgaacgcgaca

SEQ ID NO: 1122968 - RNA, 22 nt, Mycobacterium bovis subsp bovis AF2122/97
cacccgcgaacgcgacagccac

SEQ ID NO: 1122969 - RNA, 16 nt, Mycobacterium bovis subsp bovis AF2122/97
cacccgcgaagccgcc

SEQ ID NO: 1122970 - RNA, 13 nt, Mycobacterium bovis subsp bovis AF2122/97
cacccgccggccg

SEQ ID NO: 1122971 - RNA, 15 nt, Mycobacterium bovis subsp bovis AF2122/97
cacccgccgccgccc

SEQ ID NO: 1122972 - RNA, 16 nt, Mycobacterium bovis subsp bovis AF2122/97
cacccgccgccgcccg

SEQ ID NO: 1122973 - RNA, 13 nt, Mycobacterium bovis subsp bovis AF2122/97
caccagcuggaag

SEQ ID NO: 1122974 - RNA, 15 nt, Mycobacterium bovis subsp bovis AF2122/97
caccagcugcgcgau

SEQ ID NO: 1122975 - RNA, 17 nt, Mycobacterium bovis subsp bovis AF2122/97
caccagcugcgcgaugu

SEQ ID NO: 1122976 - RNA, 14 nt, Mycobacterium bovis subsp bovis AF2122/97
caccagcugucggg

SEQ ID NO: 1122977 - RNA, 15 nt, Mycobacterium bovis subsp bovis AF2122/97
caccagcucgagguc

SEQ ID NO: 1122978 - RNA, 20 nt, Mycobacterium bovis subsp bovis AF2122/97
caccagcggucagccggcca

SEQ ID NO: 1122979 - RNA, 11 nt, Mycobacterium bovis subsp bovis AF2122/97
caccagcggcu

SEQ ID NO: 1122980 - RNA, 20 nt, Mycobacterium bovis subsp bovis AF2122/97
caccagcggcugaccgggca

SEQ ID NO: 1122981 - RNA, 17 nt, Mycobacterium bovis subsp bovis AF2122/97
caccagcgucgcggcca

SEQ ID NO: 1122982 - RNA, 15 nt, Mycobacterium bovis subsp bovis AF2122/97
caccagcucacccgg

SEQ ID NO: 1122983 - RNA, 16 nt, Mycobacterium bovis subsp bovis AF2122/97
caccagcucacccgga

SEQ ID NO: 1122984 - RNA, 16 nt, Mycobacterium bovis subsp bovis AF2122/97
caccagcgugcugccg

SEQ ID NO: 1122985 - RNA, 19 nt, Mycobacterium bovis subsp bovis AF2122/97
caccagcgucgcggccacg

SEQ ID NO: 1122986 - RNA, 22 nt, Mycobacterium bovis subsp bovis AF2122/97
caccagcgucgcggccacgguc

SEQ ID NO: 1122987 - RNA, 18 nt, Mycobacterium bovis subsp bovis AF2122/97
caccagcgucgcggccac

SEQ ID NO: 1122988 - RNA, 15 nt, Mycobacterium bovis subsp bovis AF2122/97
caccagcgcgagccc

SEQ ID NO: 1122989 - RNA, 17 nt, Mycobacterium bovis subsp bovis AF2122/97
caccagcggcggcaacg

SEQ ID NO: 1122990 - RNA, 16 nt, Mycobacterium bovis subsp bovis AF2122/97
caccagcggcaccgcg

SEQ ID NO: 1122991 - RNA, 16 nt, Mycobacterium bovis subsp bovis AF2122/97
caccagcgaguugagc

SEQ ID NO: 1122992 - RNA, 19 nt, Mycobacterium bovis subsp bovis AF2122/97
caccagcgcacgcucggca

SEQ ID NO: 1122993 - RNA, 12 nt, Mycobacterium bovis subsp bovis AF2122/97
caccagcgcagc

SEQ ID NO: 1122994 - RNA, 15 nt, Mycobacterium bovis subsp bovis AF2122/97
caccagcgcagccga

SEQ ID NO: 1122995 - RNA, 18 nt, Mycobacterium bovis subsp bovis AF2122/97
caccagcgcagccgaucg

SEQ ID NO: 1122996 - RNA, 20 nt, Mycobacterium bovis subsp bovis AF2122/97
caccagcgcagccgaucguc

SEQ ID NO: 1122997 - RNA, 17 nt, Mycobacterium bovis subsp bovis AF2122/97
caccagcgcaucggcca

SEQ ID NO: 1122998 - RNA, 15 nt, Mycobacterium bovis subsp bovis AF2122/97
caccagcgaccaggu

SEQ ID NO: 1122999 - RNA, 16 nt, Mycobacterium bovis subsp bovis AF2122/97
caccagcgaccagguc

SEQ ID NO: 1123000 - RNA, 22 nt, Mycobacterium bovis subsp bovis AF2122/97
caccagcgaccaggucgccagc

SEQ ID NO: 1123001 - RNA, 20 nt, Mycobacterium bovis subsp bovis AF2122/97
caccagccggugagcgagcg

SEQ ID NO: 1123002 - RNA, 12 nt, Mycobacterium bovis subsp bovis AF2122/97
caccagccggug

SEQ ID NO: 1123003 - RNA, 14 nt, Mycobacterium bovis subsp bovis AF2122/97
caccagccggugag

SEQ ID NO: 1123004 - RNA, 13 nt, Mycobacterium bovis subsp bovis AF2122/97
caccagccagaug

SEQ ID NO: 1123005 - RNA, 21 nt, Mycobacterium bovis subsp bovis AF2122/97
caccagccagccugcuggccg

SEQ ID NO: 1123006 - RNA, 17 nt, Mycobacterium bovis subsp bovis AF2122/97
caccagccaaaucagcc

SEQ ID NO: 1123007 - RNA, 15 nt, Mycobacterium bovis subsp bovis AF2122/97
caccagccaccccug

SEQ ID NO: 1123008 - RNA, 14 nt, Mycobacterium bovis subsp bovis AF2122/97
caccagccacgcca

SEQ ID NO: 1123009 - RNA, 17 nt, Mycobacterium bovis subsp bovis AF2122/97
caccagcaguggcgcau

SEQ ID NO: 1123010 - RNA, 16 nt, Mycobacterium bovis subsp bovis AF2122/97
caccagcagccagccc

SEQ ID NO: 1123011 - RNA, 23 nt, Mycobacterium bovis subsp bovis AF2122/97
caccagcagccagcccagccgcc

SEQ ID NO: 1123012 - RNA, 14 nt, Mycobacterium bovis subsp bovis AF2122/97
caccagcaggcggc

SEQ ID NO: 1123013 - RNA, 12 nt, Mycobacterium bovis subsp bovis AF2122/97
caccagcacccc

SEQ ID NO: 1123014 - RNA, 13 nt, Mycobacterium bovis subsp bovis AF2122/97
caccagcaccccg

SEQ ID NO: 1123015 - RNA, 18 nt, Mycobacterium bovis subsp bovis AF2122/97
caccagaugcaccucgcc

SEQ ID NO: 1123016 - RNA, 14 nt, Mycobacterium bovis subsp bovis AF2122/97
caccagaucaggug

SEQ ID NO: 1123017 - RNA, 12 nt, Mycobacterium bovis subsp bovis AF2122/97
caccacggccag

SEQ ID NO: 1123018 - RNA, 16 nt, Mycobacterium bovis subsp bovis AF2122/97
caccacggcggccacc

SEQ ID NO: 1123019 - RNA, 17 nt, Mycobacterium bovis subsp bovis AF2122/97
caccacggucaagccgg

SEQ ID NO: 1123020 - RNA, 20 nt, Mycobacterium bovis subsp bovis AF2122/97
caccacggucaagccggcgc

SEQ ID NO: 1123021 - RNA, 22 nt, Mycobacterium bovis subsp bovis AF2122/97
caccacgguggccgcugccagc

SEQ ID NO: 1123022 - RNA, 14 nt, Mycobacterium bovis subsp bovis AF2122/97
caccacggcggcgg

SEQ ID NO: 1123023 - RNA, 22 nt, Mycobacterium bovis subsp bovis AF2122/97
caccacggcguugccgccggcu

SEQ ID NO: 1123024 - RNA, 16 nt, Mycobacterium bovis subsp bovis AF2122/97
caccagaaccagcgac

SEQ ID NO: 1123025 - RNA, 19 nt, Mycobacterium bovis subsp bovis AF2122/97
caccacuuggguggcgccg

SEQ ID NO: 1123026 - RNA, 21 nt, Mycobacterium bovis subsp bovis AF2122/97
caccagaaaacauugcggccc

SEQ ID NO: 1123027 - RNA, 19 nt, Mycobacterium bovis subsp bovis AF2122/97
caccagacacuggccgucg

SEQ ID NO: 1123028 - RNA, 18 nt, Mycobacterium bovis subsp bovis AF2122/97
caccagacaacgccgucg

SEQ ID NO: 1123029 - RNA, 20 nt, Mycobacterium bovis subsp bovis AF2122/97
caccagauagaucgugaucg

SEQ ID NO: 1123030 - RNA, 21 nt, Mycobacterium bovis subsp bovis AF2122/97
caccagaucuucgagcgcauc

SEQ ID NO: 1123031 - RNA, 17 nt, Mycobacterium bovis subsp bovis AF2122/97
caccagaugcaccucgc

SEQ ID NO: 1123032 - RNA, 19 nt, Mycobacterium bovis subsp bovis AF2122/97
caccaccggaucgcucccg

SEQ ID NO: 1123033 - RNA, 19 nt, Mycobacterium bovis subsp bovis AF2122/97
caccaccggaacgccgucg

SEQ ID NO: 1123034 - RNA, 14 nt, Mycobacterium bovis subsp bovis AF2122/97
caccacccuugccg

SEQ ID NO: 1123035 - RNA, 22 nt, Mycobacterium bovis subsp bovis AF2122/97
caccaccgacagcacccggcca

SEQ ID NO: 1123036 - RNA, 12 nt, Mycobacterium bovis subsp bovis AF2122/97
caccaccgaccu

SEQ ID NO: 1123037 - RNA, 13 nt, Mycobacterium bovis subsp bovis AF2122/97
caccaccggcgcc

SEQ ID NO: 1123038 - RNA, 15 nt, Mycobacterium bovis subsp bovis AF2122/97
caccaccggcgccgc

SEQ ID NO: 1123039 - RNA, 18 nt, Mycobacterium bovis subsp bovis AF2122/97
caccaccggcgccgccgu

SEQ ID NO: 1123040 - RNA, 16 nt, Mycobacterium bovis subsp bovis AF2122/97
caccaccggcacccgc

SEQ ID NO: 1123041 - RNA, 14 nt, Mycobacterium bovis subsp bovis AF2122/97
caccaccggcaccg

SEQ ID NO: 1123042 - RNA, 15 nt, Mycobacterium bovis subsp bovis AF2122/97
caccaccggcaccgc

SEQ ID NO: 1123043 - RNA, 18 nt, Mycobacterium bovis subsp bovis AF2122/97
caccaccggccccaccga

SEQ ID NO: 1123044 - RNA, 19 nt, Mycobacterium bovis subsp bovis AF2122/97
caccaccguggcgcccgcg

SEQ ID NO: 1123045 - RNA, 16 nt, Mycobacterium bovis subsp bovis AF2122/97
caccaccguggccgug

SEQ ID NO: 1123046 - RNA, 20 nt, Mycobacterium bovis subsp bovis AF2122/97
caccaccucggugaccaggc

SEQ ID NO: 1123047 - RNA, 23 nt, Mycobacterium bovis subsp bovis AF2122/97
caccaccucggugaccaggccgg

SEQ ID NO: 1123048 - RNA, 14 nt, Mycobacterium bovis subsp bovis AF2122/97
caccaccaggucgg

SEQ ID NO: 1123049 - RNA, 17 nt, Mycobacterium bovis subsp bovis AF2122/97
caccaccccagcggcca

SEQ ID NO: 1123050 - RNA, 21 nt, Mycobacterium bovis subsp bovis AF2122/97
caccaccccagcggccaccga

SEQ ID NO: 1123051 - RNA, 13 nt, Mycobacterium bovis subsp bovis AF2122/97
caccacccggcga

SEQ ID NO: 1123052 - RNA, 14 nt, Mycobacterium bovis subsp bovis AF2122/97
caccacccggcgca

SEQ ID NO: 1123053 - RNA, 14 nt, Mycobacterium bovis subsp bovis AF2122/97
caccaccccgucga

SEQ ID NO: 1123054 - RNA, 13 nt, Mycobacterium bovis subsp bovis AF2122/97
caccacccgaccg

SEQ ID NO: 1123055 - RNA, 15 nt, Mycobacterium bovis subsp bovis AF2122/97
caccacccgaccgcc

SEQ ID NO: 1123056 - RNA, 16 nt, Mycobacterium bovis subsp bovis AF2122/97
caccacccgaccgcca

SEQ ID NO: 1123057 - RNA, 17 nt, Mycobacterium bovis subsp bovis AF2122/97
caccaccagcacgcucg

SEQ ID NO: 1123058 - RNA, 12 nt, Mycobacterium bovis subsp bovis AF2122/97
caccaccagguc

SEQ ID NO: 1123059 - RNA, 14 nt, Mycobacterium bovis subsp bovis AF2122/97
caccaccacaccgg

SEQ ID NO: 1123060 - RNA, 15 nt, Mycobacterium bovis subsp bovis AF2122/97
caccaccaccgccgg

SEQ ID NO: 1123061 - RNA, 18 nt, Mycobacterium bovis subsp bovis AF2122/97
caccaccaagcucggcca

SEQ ID NO: 1123062 - RNA, 22 nt, Mycobacterium bovis subsp bovis AF2122/97
caccacauuggcgaucagcagc

SEQ ID NO: 1123063 - RNA, 15 nt, Mycobacterium bovis subsp bovis AF2122/97
cacacgcgugcacca

SEQ ID NO: 1123064 - RNA, 21 nt, Mycobacterium bovis subsp bovis AF2122/97
cacacggugcgauuccgcguc

SEQ ID NO: 1123065 - RNA, 14 nt, Mycobacterium bovis subsp bovis AF2122/97
cacacggggccgcc

SEQ ID NO: 1123066 - RNA, 16 nt, Mycobacterium bovis subsp bovis AF2122/97
cacacguuggcagccc

SEQ ID NO: 1123067 - RNA, 16 nt, Mycobacterium bovis subsp bovis AF2122/97
cacacggucaccggca

SEQ ID NO: 1123068 - RNA, 17 nt, Mycobacterium bovis subsp bovis AF2122/97
cacacuaccgccgcgac

SEQ ID NO: 1123069 - RNA, 13 nt, Mycobacterium bovis subsp bovis AF2122/97
cacacucgccagg

SEQ ID NO: 1123070 - RNA, 17 nt, Mycobacterium bovis subsp bovis AF2122/97
caccacaccugcggcug

SEQ ID NO: 1123071 - RNA, 19 nt, Mycobacterium bovis subsp bovis AF2122/97
caccacaugggagccguuc

SEQ ID NO: 1123072 - RNA, 15 nt, Mycobacterium bovis subsp bovis AF2122/97
cacacuggcagugug

SEQ ID NO: 1123073 - RNA, 18 nt, Mycobacterium bovis subsp bovis AF2122/97
cacacuggccugcucaac

SEQ ID NO: 1123074 - RNA, 21 nt, Mycobacterium bovis subsp bovis AF2122/97
caccgcgcaucaucgcccacc

SEQ ID NO: 1123075 - RNA, 13 nt, Mycobacterium bovis subsp bovis AF2122/97
caccgcgccagcc

SEQ ID NO: 1123076 - RNA, 17 nt, Mycobacterium bovis subsp bovis AF2122/97
caccgccugcgccgccc

SEQ ID NO: 1123077 - RNA, 18 nt, Mycobacterium bovis subsp bovis AF2122/97
caccgccugcgccgcccg

SEQ ID NO: 1123078 - RNA, 19 nt, Mycobacterium bovis subsp bovis AF2122/97
caccgccugcgccgcccgc

SEQ ID NO: 1123079 - RNA, 13 nt, Mycobacterium bovis subsp bovis AF2122/97
caccgcgcaggug

SEQ ID NO: 1123080 - RNA, 16 nt, Mycobacterium bovis subsp bovis AF2122/97
caccgcgcaucaucgc

SEQ ID NO: 1123081 - RNA, 13 nt, Mycobacterium bovis subsp bovis AF2122/97
caccgcgcccgcc

SEQ ID NO: 1123082 - RNA, 15 nt, Mycobacterium bovis subsp bovis AF2122/97
caccgcgcccgccga

SEQ ID NO: 1123083 - RNA, 18 nt, Mycobacterium bovis subsp bovis AF2122/97
caccgcgcccgccgaucc

SEQ ID NO: 1123084 - RNA, 11 nt, Mycobacterium bovis subsp bovis AF2122/97
caccgcgccga

SEQ ID NO: 1123085 - RNA, 13 nt, Mycobacterium bovis subsp bovis AF2122/97
caccgcgccggcg

SEQ ID NO: 1123086 - RNA, 15 nt, Mycobacterium bovis subsp bovis AF2122/97
caccgcgccgacgaa

SEQ ID NO: 1123087 - RNA, 12 nt, Mycobacterium bovis subsp bovis AF2122/97
caccgcgccgag

SEQ ID NO: 1123088 - RNA, 15 nt, Mycobacterium bovis subsp bovis AF2122/97
caccgcgccgagcag

SEQ ID NO: 1123089 - RNA, 19 nt, Mycobacterium bovis subsp bovis AF2122/97
caccgccggcuccgccguu

SEQ ID NO: 1123090 - RNA, 20 nt, Mycobacterium bovis subsp bovis AF2122/97
caccgccggcuccgccguug

SEQ ID NO: 1123091 - RNA, 16 nt, Mycobacterium bovis subsp bovis AF2122/97
caccgccggugccgcc

SEQ ID NO: 1123092 - RNA, 17 nt, Mycobacterium bovis subsp bovis AF2122/97
caccgccggugccgcca

SEQ ID NO: 1123093 - RNA, 21 nt, Mycobacterium bovis subsp bovis AF2122/97
caccgccgucaccgucauugc

SEQ ID NO: 1123094 - RNA, 13 nt, Mycobacterium bovis subsp bovis AF2122/97
caccgccgucggg

SEQ ID NO: 1123095 - RNA, 15 nt, Mycobacterium bovis subsp bovis AF2122/97
caccgccugcgccgc

SEQ ID NO: 1123096 - RNA, 21 nt, Mycobacterium bovis subsp bovis AF2122/97
caccgccguugccgccggcgc

SEQ ID NO: 1123097 - RNA, 21 nt, Mycobacterium bovis subsp bovis AF2122/97
caccgccguugggccgcgccc

SEQ ID NO: 1123098 - RNA, 14 nt, Mycobacterium bovis subsp bovis AF2122/97
caccgagugcggug

SEQ ID NO: 1123099 - RNA, 16 nt, Mycobacterium bovis subsp bovis AF2122/97
caccgagugcggugug

SEQ ID NO: 1123100 - RNA, 17 nt, Mycobacterium bovis subsp bovis AF2122/97
caccgagugcggugugu

SEQ ID NO: 1123101 - RNA, 18 nt, Mycobacterium bovis subsp bovis AF2122/97
caccgagucgacggccag

SEQ ID NO: 1123102 - RNA, 13 nt, Mycobacterium bovis subsp bovis AF2122/97
caccgagucgauc

SEQ ID NO: 1123103 - RNA, 16 nt, Mycobacterium bovis subsp bovis AF2122/97
caccgagucgaucacg

SEQ ID NO: 1123104 - RNA, 14 nt, Mycobacterium bovis subsp bovis AF2122/97
caccgauaccguca

SEQ ID NO: 1123105 - RNA, 19 nt, Mycobacterium bovis subsp bovis AF2122/97
caccgaggugccgcgcagc

SEQ ID NO: 1123106 - RNA, 16 nt, Mycobacterium bovis subsp bovis AF2122/97
caccgauauggccggg

SEQ ID NO: 1123107 - RNA, 21 nt, Mycobacterium bovis subsp bovis AF2122/97
caccgauccacuguagggccg

SEQ ID NO: 1123108 - RNA, 16 nt, Mycobacterium bovis subsp bovis AF2122/97
caccgauccggccgcc

SEQ ID NO: 1123109 - RNA, 13 nt, Mycobacterium bovis subsp bovis AF2122/97
caccgccggcgcc

SEQ ID NO: 1123110 - RNA, 14 nt, Mycobacterium bovis subsp bovis AF2122/97
caccgccggcgccc

SEQ ID NO: 1123111 - RNA, 21 nt, Mycobacterium bovis subsp bovis AF2122/97
caccgccggcgcccaggccga

SEQ ID NO: 1123112 - RNA, 19 nt, Mycobacterium bovis subsp bovis AF2122/97
caccgccggcgacgggucg

SEQ ID NO: 1123113 - RNA, 13 nt, Mycobacterium bovis subsp bovis AF2122/97
caccgccggcccg

SEQ ID NO: 1123114 - RNA, 14 nt, Mycobacterium bovis subsp bovis AF2122/97
caccgccggcccgc

SEQ ID NO: 1123115 - RNA, 20 nt, Mycobacterium bovis subsp bovis AF2122/97
caccgaugccuugaccgcgg

SEQ ID NO: 1123116 - RNA, 19 nt, Mycobacterium bovis subsp bovis AF2122/97
caccgaugcgauaacccgc

SEQ ID NO: 1123117 - RNA, 16 nt, Mycobacterium bovis subsp bovis AF2122/97
caccgaugcgccggac

SEQ ID NO: 1123118 - RNA, 13 nt, Mycobacterium bovis subsp bovis AF2122/97
caccgcggccgcg

SEQ ID NO: 1123119 - RNA, 12 nt, Mycobacterium bovis subsp bovis AF2122/97
caccgcggccga

SEQ ID NO: 1123120 - RNA, 13 nt, Mycobacterium bovis subsp bovis AF2122/97
caccgcgccgucg

SEQ ID NO: 1123121 - RNA, 20 nt, Mycobacterium bovis subsp bovis AF2122/97
caccgcgccguggacgauca

SEQ ID NO: 1123122 - RNA, 18 nt, Mycobacterium bovis subsp bovis AF2122/97
caccgcgccgucgucgcg

SEQ ID NO: 1123123 - RNA, 20 nt, Mycobacterium bovis subsp bovis AF2122/97
caccgcgccgucgucgcgca

SEQ ID NO: 1123124 - RNA, 22 nt, Mycobacterium bovis subsp bovis AF2122/97
caccgcgccgcgccgcgccgcc

SEQ ID NO: 1123125 - RNA, 13 nt, Mycobacterium bovis subsp bovis AF2122/97
caccgcgggcggc

SEQ ID NO: 1123126 - RNA, 15 nt, Mycobacterium bovis subsp bovis AF2122/97
caccgcgggaucggu

SEQ ID NO: 1123127 - RNA, 13 nt, Mycobacterium bovis subsp bovis AF2122/97
caccgcgggcagu

SEQ ID NO: 1123128 - RNA, 13 nt, Mycobacterium bovis subsp bovis AF2122/97
caccgcgggcaua

SEQ ID NO: 1123129 - RNA, 21 nt, Mycobacterium bovis subsp bovis AF2122/97
caccgcggcugcuccgucgcc

SEQ ID NO: 1123130 - RNA, 23 nt, Mycobacterium bovis subsp bovis AF2122/97
caccgcggcugcuccgucgccga

SEQ ID NO: 1123131 - RNA, 22 nt, Mycobacterium bovis subsp bovis AF2122/97
caccgcggcgcugaugccgucu

SEQ ID NO: 1123132 - RNA, 16 nt, Mycobacterium bovis subsp bovis AF2122/97
caccgcggcggcggcc

SEQ ID NO: 1123133 - RNA, 12 nt, Mycobacterium bovis subsp bovis AF2122/97
caccgcggcggc

SEQ ID NO: 1123134 - RNA, 16 nt, Mycobacterium bovis subsp bovis AF2122/97
caccgcguuucgcgac

SEQ ID NO: 1123135 - RNA, 22 nt, Mycobacterium bovis subsp bovis AF2122/97
caccgcguuucgcgacgucugc

SEQ ID NO: 1123136 - RNA, 20 nt, Mycobacterium bovis subsp bovis AF2122/97
caccgcguugaugaccaggu

SEQ ID NO: 1123137 - RNA, 20 nt, Mycobacterium bovis subsp bovis AF2122/97
caccgcguugaugaccgccg

SEQ ID NO: 1123138 - RNA, 22 nt, Mycobacterium bovis subsp bovis AF2122/97
caccgcguugaugaccgccgcc

SEQ ID NO: 1123139 - RNA, 19 nt, Mycobacterium bovis subsp bovis AF2122/97
caccgcguguaccgcgacg

SEQ ID NO: 1123140 - RNA, 17 nt, Mycobacterium bovis subsp bovis AF2122/97
caccgcgucgggccgca

SEQ ID NO: 1123141 - RNA, 17 nt, Mycobacterium bovis subsp bovis AF2122/97
caccgcgguacgccggu

SEQ ID NO: 1123142 - RNA, 14 nt, Mycobacterium bovis subsp bovis AF2122/97
caccgcggccagcg

SEQ ID NO: 1123143 - RNA, 19 nt, Mycobacterium bovis subsp bovis AF2122/97
caccgcggucagcucggca

SEQ ID NO: 1123144 - RNA, 20 nt, Mycobacterium bovis subsp bovis AF2122/97
caccgcguaguccaggccgu

SEQ ID NO: 1123145 - RNA, 19 nt, Mycobacterium bovis subsp bovis AF2122/97
caccgcgucaacgcuguug

SEQ ID NO: 1123146 - RNA, 15 nt, Mycobacterium bovis subsp bovis AF2122/97
caccgcgucaccgga

SEQ ID NO: 1123147 - RNA, 22 nt, Mycobacterium bovis subsp bovis AF2122/97
caccgcguaauucgacuucggg

SEQ ID NO: 1123148 - RNA, 19 nt, Mycobacterium bovis subsp bovis AF2122/97
caccgcgguggcggcgagc

SEQ ID NO: 1123149 - RNA, 20 nt, Mycobacterium bovis subsp bovis AF2122/97
caccgcgguggcggcgagca

SEQ ID NO: 1123150 - RNA, 17 nt, Mycobacterium bovis subsp bovis AF2122/97
caccgcgguggcggcga

SEQ ID NO: 1123151 - RNA, 12 nt, Mycobacterium bovis subsp bovis AF2122/97
caccgcggugug

SEQ ID NO: 1123152 - RNA, 22 nt, Mycobacterium bovis subsp bovis AF2122/97
caccgcggugugcgugucaccc

SEQ ID NO: 1123153 - RNA, 13 nt, Mycobacterium bovis subsp bovis AF2122/97
caccggcgcgacc

SEQ ID NO: 1123154 - RNA, 18 nt, Mycobacterium bovis subsp bovis AF2122/97
caccggcgcgaccgcggc

SEQ ID NO: 1123155 - RNA, 13 nt, Mycobacterium bovis subsp bovis AF2122/97
caccggcgccacc

SEQ ID NO: 1123156 - RNA, 14 nt, Mycobacterium bovis subsp bovis AF2122/97
caccggcgccgccg

SEQ ID NO: 1123157 - RNA, 15 nt, Mycobacterium bovis subsp bovis AF2122/97
caccggcgccgccgg

SEQ ID NO: 1123158 - RNA, 16 nt, Mycobacterium bovis subsp bovis AF2122/97
caccggcgccgccguc

SEQ ID NO: 1123159 - RNA, 17 nt, Mycobacterium bovis subsp bovis AF2122/97
caccggcgccgccgucg

SEQ ID NO: 1123160 - RNA, 13 nt, Mycobacterium bovis subsp bovis AF2122/97
caccggcgcaccg

SEQ ID NO: 1123161 - RNA, 16 nt, Mycobacterium bovis subsp bovis AF2122/97
caccggccgugccgcc

SEQ ID NO: 1123162 - RNA, 18 nt, Mycobacterium bovis subsp bovis AF2122/97
caccggcgacgccggccu

SEQ ID NO: 1123163 - RNA, 18 nt, Mycobacterium bovis subsp bovis AF2122/97
caccggcgagugcugucg

SEQ ID NO: 1123164 - RNA, 15 nt, Mycobacterium bovis subsp bovis AF2122/97
caccggcgaucaccg

SEQ ID NO: 1123165 - RNA, 23 nt, Mycobacterium bovis subsp bovis AF2122/97
caccggccgguggguagccagcg

SEQ ID NO: 1123166 - RNA, 14 nt, Mycobacterium bovis subsp bovis AF2122/97
caccggcgaccgac

SEQ ID NO: 1123167 - RNA, 15 nt, Mycobacterium bovis subsp bovis AF2122/97
caccggcgaccgacg

SEQ ID NO: 1123168 - RNA, 12 nt, Mycobacterium bovis subsp bovis AF2122/97
caccggccacca

SEQ ID NO: 1123169 - RNA, 12 nt, Mycobacterium bovis subsp bovis AF2122/97
caccggccagcg

SEQ ID NO: 1123170 - RNA, 14 nt, Mycobacterium bovis subsp bovis AF2122/97
caccggccagcggc

SEQ ID NO: 1123171 - RNA, 14 nt, Mycobacterium bovis subsp bovis AF2122/97
caccggccaggccg

SEQ ID NO: 1123172 - RNA, 19 nt, Mycobacterium bovis subsp bovis AF2122/97
caccggccaggccggcggc

SEQ ID NO: 1123173 - RNA, 16 nt, Mycobacterium bovis subsp bovis AF2122/97
caccggccgguccacg

SEQ ID NO: 1123174 - RNA, 13 nt, Mycobacterium bovis subsp bovis AF2122/97
caccggccgcgca

SEQ ID NO: 1123175 - RNA, 22 nt, Mycobacterium bovis subsp bovis AF2122/97
caccggcacugcccagcagacc

SEQ ID NO: 1123176 - RNA, 15 nt, Mycobacterium bovis subsp bovis AF2122/97
caccggcaccggccg

SEQ ID NO: 1123177 - RNA, 18 nt, Mycobacterium bovis subsp bovis AF2122/97
caccggcagcgcgaucga

SEQ ID NO: 1123178 - RNA, 21 nt, Mycobacterium bovis subsp bovis AF2122/97
caccggcaugcgugccggcag

SEQ ID NO: 1123179 - RNA, 16 nt, Mycobacterium bovis subsp bovis AF2122/97
caccggccaccagggc

SEQ ID NO: 1123180 - RNA, 17 nt, Mycobacterium bovis subsp bovis AF2122/97
caccggcaggcggggga

SEQ ID NO: 1123181 - RNA, 18 nt, Mycobacterium bovis subsp bovis AF2122/97
caccggcauacagccggc

SEQ ID NO: 1123182 - RNA, 14 nt, Mycobacterium bovis subsp bovis AF2122/97
caccggcaugcgug

SEQ ID NO: 1123183 - RNA, 18 nt, Mycobacterium bovis subsp bovis AF2122/97
caccggcacugcccagca

SEQ ID NO: 1123184 - RNA, 13 nt, Mycobacterium bovis subsp bovis AF2122/97
caccggcaccgcu

SEQ ID NO: 1123185 - RNA, 14 nt, Mycobacterium bovis subsp bovis AF2122/97
caccggcaccgcug

SEQ ID NO: 1123186 - RNA, 12 nt, Mycobacterium bovis subsp bovis AF2122/97
caccggaucggc

SEQ ID NO: 1123187 - RNA, 15 nt, Mycobacterium bovis subsp bovis AF2122/97
caccggcaaucggcg

SEQ ID NO: 1123188 - RNA, 17 nt, Mycobacterium bovis subsp bovis AF2122/97
caccggcaaucggcggc

SEQ ID NO: 1123189 - RNA, 21 nt, Mycobacterium bovis subsp bovis AF2122/97
caccggcacccccgucgccac

SEQ ID NO: 1123190 - RNA, 22 nt, Mycobacterium bovis subsp bovis AF2122/97
caccggcacccccgucgccacc

SEQ ID NO: 1123191 - RNA, 17 nt, Mycobacterium bovis subsp bovis AF2122/97
caccggcacccgcacgg

SEQ ID NO: 1123192 - RNA, 16 nt, Mycobacterium bovis subsp bovis AF2122/97
caccggcacccgcugg

SEQ ID NO: 1123193 - RNA, 21 nt, Mycobacterium bovis subsp bovis AF2122/97
caccggaucggcuaccuaacc

SEQ ID NO: 1123194 - RNA, 22 nt, Mycobacterium bovis subsp bovis AF2122/97
caccggaucgucgaacagcacc

SEQ ID NO: 1123195 - RNA, 15 nt, Mycobacterium bovis subsp bovis AF2122/97
caccggaucaccgcg

SEQ ID NO: 1123196 - RNA, 22 nt, Mycobacterium bovis subsp bovis AF2122/97
caccggauccacggagaccggc

SEQ ID NO: 1123197 - RNA, 16 nt, Mycobacterium bovis subsp bovis AF2122/97
caccggaucgccgucg

SEQ ID NO: 1123198 - RNA, 17 nt, Mycobacterium bovis subsp bovis AF2122/97
caccggaucgccgucgc

SEQ ID NO: 1123199 - RNA, 14 nt, Mycobacterium bovis subsp bovis AF2122/97
caccggcaacaucg

SEQ ID NO: 1123200 - RNA, 18 nt, Mycobacterium bovis subsp bovis AF2122/97
caccggcaagccacgccg

SEQ ID NO: 1123201 - RNA, 14 nt, Mycobacterium bovis subsp bovis AF2122/97
caccggcaauaccg

SEQ ID NO: 1123202 - RNA, 16 nt, Mycobacterium bovis subsp bovis AF2122/97
caccggagucggcguc

SEQ ID NO: 1123203 - RNA, 19 nt, Mycobacterium bovis subsp bovis AF2122/97
caccggauacagccacgca

SEQ ID NO: 1123204 - RNA, 13 nt, Mycobacterium bovis subsp bovis AF2122/97
caccggagcgccg

SEQ ID NO: 1123205 - RNA, 16 nt, Mycobacterium bovis subsp bovis AF2122/97
caccggagcgccgagc

SEQ ID NO: 1123206 - RNA, 14 nt, Mycobacterium bovis subsp bovis AF2122/97
caccggaggccgcc

SEQ ID NO: 1123207 - RNA, 22 nt, Mycobacterium bovis subsp bovis AF2122/97
caccggaaccaccaguaccacc

SEQ ID NO: 1123208 - RNA, 14 nt, Mycobacterium bovis subsp bovis AF2122/97
caccgcuugcuggc

SEQ ID NO: 1123209 - RNA, 20 nt, Mycobacterium bovis subsp bovis AF2122/97
caccggaauacgcgccgccg

SEQ ID NO: 1123210 - RNA, 21 nt, Mycobacterium bovis subsp bovis AF2122/97
caccggaauacgcgccgccgg

SEQ ID NO: 1123211 - RNA, 14 nt, Mycobacterium bovis subsp bovis AF2122/97
caccggaauccccc

SEQ ID NO: 1123212 - RNA, 23 nt, Mycobacterium bovis subsp bovis AF2122/97
caccggaauccccccugucgccg

SEQ ID NO: 1123213 - RNA, 19 nt, Mycobacterium bovis subsp bovis AF2122/97
caccggaauccuggccgcc

SEQ ID NO: 1123214 - RNA, 20 nt, Mycobacterium bovis subsp bovis AF2122/97
caccggaauccuggccgccg

SEQ ID NO: 1123215 - RNA, 22 nt, Mycobacterium bovis subsp bovis AF2122/97
caccggaauccuggccgccgcc

SEQ ID NO: 1123216 - RNA, 21 nt, Mycobacterium bovis subsp bovis AF2122/97
caccggaaucgaugaucgagg

SEQ ID NO: 1123217 - RNA, 22 nt, Mycobacterium bovis subsp bovis AF2122/97
caccggacgaaacgaucgcgcc

SEQ ID NO: 1123218 - RNA, 21 nt, Mycobacterium bovis subsp bovis AF2122/97
caccggaacccccagcugcag

SEQ ID NO: 1123219 - RNA, 20 nt, Mycobacterium bovis subsp bovis AF2122/97
caccggaauuugcgucgugg

SEQ ID NO: 1123220 - RNA, 15 nt, Mycobacterium bovis subsp bovis AF2122/97
caccggaccaccgcc

SEQ ID NO: 1123221 - RNA, 16 nt, Mycobacterium bovis subsp bovis AF2122/97
caccggaccaccgccg

SEQ ID NO: 1123222 - RNA, 13 nt, Mycobacterium bovis subsp bovis AF2122/97
caccggaccgacc

SEQ ID NO: 1123223 - RNA, 14 nt, Mycobacterium bovis subsp bovis AF2122/97
caccggaccgacca

SEQ ID NO: 1123224 - RNA, 19 nt, Mycobacterium bovis subsp bovis AF2122/97
caccggaccgaccaccgcg

SEQ ID NO: 1123225 - RNA, 13 nt, Mycobacterium bovis subsp bovis AF2122/97
caccgcugcggca

SEQ ID NO: 1123226 - RNA, 22 nt, Mycobacterium bovis subsp bovis AF2122/97
caccgcugcggcaccacccggc

SEQ ID NO: 1123227 - RNA, 15 nt, Mycobacterium bovis subsp bovis AF2122/97
caccgcugccggcag

SEQ ID NO: 1123228 - RNA, 16 nt, Mycobacterium bovis subsp bovis AF2122/97
caccgcugccggcagc

SEQ ID NO: 1123229 - RNA, 17 nt, Mycobacterium bovis subsp bovis AF2122/97
caccgcugccggcgccg

SEQ ID NO: 1123230 - RNA, 19 nt, Mycobacterium bovis subsp bovis AF2122/97
caccgcugccggcgccgcc

SEQ ID NO: 1123231 - RNA, 20 nt, Mycobacterium bovis subsp bovis AF2122/97
caccgcuguugcaucgccgc

SEQ ID NO: 1123232 - RNA, 14 nt, Mycobacterium bovis subsp bovis AF2122/97
caccgcugucgaug

SEQ ID NO: 1123233 - RNA, 14 nt, Mycobacterium bovis subsp bovis AF2122/97
caccgcuggaucga

SEQ ID NO: 1123234 - RNA, 22 nt, Mycobacterium bovis subsp bovis AF2122/97
caccgcuugaccccuggccgcc

SEQ ID NO: 1123235 - RNA, 21 nt, Mycobacterium bovis subsp bovis AF2122/97
caccgcuucaggcgccacugc

SEQ ID NO: 1123236 - RNA, 18 nt, Mycobacterium bovis subsp bovis AF2122/97
caccgcucgucguccggc

SEQ ID NO: 1123237 - RNA, 21 nt, Mycobacterium bovis subsp bovis AF2122/97
caccgcucgucguccggccac

SEQ ID NO: 1123238 - RNA, 22 nt, Mycobacterium bovis subsp bovis AF2122/97
caccgcucgucguccggccacg

SEQ ID NO: 1123239 - RNA, 23 nt, Mycobacterium bovis subsp bovis AF2122/97
caccgcucgucguccggccacgg

SEQ ID NO: 1123240 - RNA, 19 nt, Mycobacterium bovis subsp bovis AF2122/97
caccgcugaccccggcagc

SEQ ID NO: 1123241 - RNA, 23 nt, Mycobacterium bovis subsp bovis AF2122/97
caccgcugaccccggcagcgccc

SEQ ID NO: 1123242 - RNA, 13 nt, Mycobacterium bovis subsp bovis AF2122/97
caccgcugaccgc

SEQ ID NO: 1123243 - RNA, 14 nt, Mycobacterium bovis subsp bovis AF2122/97
caccgcugaccgca

SEQ ID NO: 1123244 - RNA, 23 nt, Mycobacterium bovis subsp bovis AF2122/97
caccgcugaggaacccuccggac

SEQ ID NO: 1123245 - RNA, 16 nt, Mycobacterium bovis subsp bovis AF2122/97
caccgcugccggcacg

SEQ ID NO: 1123246 - RNA, 21 nt, Mycobacterium bovis subsp bovis AF2122/97
caccgcugccggcacgcaugc

SEQ ID NO: 1123247 - RNA, 14 nt, Mycobacterium bovis subsp bovis AF2122/97
caccgcucggucca

SEQ ID NO: 1123248 - RNA, 16 nt, Mycobacterium bovis subsp bovis AF2122/97
caccgcucgguccagc

SEQ ID NO: 1123249 - RNA, 18 nt, Mycobacterium bovis subsp bovis AF2122/97
caccgcucgguccagccg

SEQ ID NO: 1123250 - RNA, 19 nt, Mycobacterium bovis subsp bovis AF2122/97
caccgcucgguccagccgg

SEQ ID NO: 1123251 - RNA, 13 nt, Mycobacterium bovis subsp bovis AF2122/97
caccggcgucgac

SEQ ID NO: 1123252 - RNA, 22 nt, Mycobacterium bovis subsp bovis AF2122/97
caccggcuuggugaaccgcgcg

SEQ ID NO: 1123253 - RNA, 14 nt, Mycobacterium bovis subsp bovis AF2122/97
caccgggcccgccg

SEQ ID NO: 1123254 - RNA, 15 nt, Mycobacterium bovis subsp bovis AF2122/97
caccgggcccgccgg

SEQ ID NO: 1123255 - RNA, 18 nt, Mycobacterium bovis subsp bovis AF2122/97
caccgggcccgccggccc

SEQ ID NO: 1123256 - RNA, 14 nt, Mycobacterium bovis subsp bovis AF2122/97
caccgggcccgacg

SEQ ID NO: 1123257 - RNA, 19 nt, Mycobacterium bovis subsp bovis AF2122/97
caccgggauggcucaccca

SEQ ID NO: 1123258 - RNA, 23 nt, Mycobacterium bovis subsp bovis AF2122/97
caccggcuuggugaaccgcgcgg

SEQ ID NO: 1123259 - RNA, 13 nt, Mycobacterium bovis subsp bovis AF2122/97
caccgggcgcugc

SEQ ID NO: 1123260 - RNA, 16 nt, Mycobacterium bovis subsp bovis AF2122/97
caccgggcggcggcga

SEQ ID NO: 1123261 - RNA, 12 nt, Mycobacterium bovis subsp bovis AF2122/97
caccggcgucgc

SEQ ID NO: 1123262 - RNA, 17 nt, Mycobacterium bovis subsp bovis AF2122/97
caccggcggugccggug

SEQ ID NO: 1123263 - RNA, 14 nt, Mycobacterium bovis subsp bovis AF2122/97
caccggcggcgacg

SEQ ID NO: 1123264 - RNA, 22 nt, Mycobacterium bovis subsp bovis AF2122/97
caccggcggucugcagugcagc

SEQ ID NO: 1123265 - RNA, 14 nt, Mycobacterium bovis subsp bovis AF2122/97
caccggcgucugcc

SEQ ID NO: 1123266 - RNA, 14 nt, Mycobacterium bovis subsp bovis AF2122/97
caccggcggcaucg

SEQ ID NO: 1123267 - RNA, 15 nt, Mycobacterium bovis subsp bovis AF2122/97
caccggcggcaucga

SEQ ID NO: 1123268 - RNA, 20 nt, Mycobacterium bovis subsp bovis AF2122/97
caccggcgccaccggcgccg

SEQ ID NO: 1123269 - RNA, 14 nt, Mycobacterium bovis subsp bovis AF2122/97
caccggcucgucga

SEQ ID NO: 1123270 - RNA, 18 nt, Mycobacterium bovis subsp bovis AF2122/97
caccggcuaugcuggcgc

SEQ ID NO: 1123271 - RNA, 21 nt, Mycobacterium bovis subsp bovis AF2122/97
caccggcuaugcuggcgcagc

SEQ ID NO: 1123272 - RNA, 17 nt, Mycobacterium bovis subsp bovis AF2122/97
caccggcugaccgaccc

SEQ ID NO: 1123273 - RNA, 21 nt, Mycobacterium bovis subsp bovis AF2122/97
caccggcugauucgagccaca

SEQ ID NO: 1123274 - RNA, 14 nt, Mycobacterium bovis subsp bovis AF2122/97
caccggcugcaacc

SEQ ID NO: 1123275 - RNA, 22 nt, Mycobacterium bovis subsp bovis AF2122/97
caccggcugcaaccagcggcac

SEQ ID NO: 1123276 - RNA, 23 nt, Mycobacterium bovis subsp bovis AF2122/97
caccggcugguucaacaccggua

SEQ ID NO: 1123277 - RNA, 16 nt, Mycobacterium bovis subsp bovis AF2122/97
caccggcuucggccag

SEQ ID NO: 1123278 - RNA, 19 nt, Mycobacterium bovis subsp bovis AF2122/97
caccggcuucggccagcag

SEQ ID NO: 1123279 - RNA, 16 nt, Mycobacterium bovis subsp bovis AF2122/97
caccggcuggugccaa

SEQ ID NO: 1123280 - RNA, 16 nt, Mycobacterium bovis subsp bovis AF2122/97
caccgguuugacgucc

SEQ ID NO: 1123281 - RNA, 22 nt, Mycobacterium bovis subsp bovis AF2122/97
caccguaaacagcgcgccggcg

SEQ ID NO: 1123282 - RNA, 22 nt, Mycobacterium bovis subsp bovis AF2122/97
caccguaauuucuucacggucg

SEQ ID NO: 1123283 - RNA, 17 nt, Mycobacterium bovis subsp bovis AF2122/97
caccguacgacagucgc

SEQ ID NO: 1123284 - RNA, 17 nt, Mycobacterium bovis subsp bovis AF2122/97
caccguaggcgaucuca

SEQ ID NO: 1123285 - RNA, 21 nt, Mycobacterium bovis subsp bovis AF2122/97
caccgguuugacguccagggc

SEQ ID NO: 1123286 - RNA, 20 nt, Mycobacterium bovis subsp bovis AF2122/97
caccgguuuggagcucaucg

SEQ ID NO: 1123287 - RNA, 15 nt, Mycobacterium bovis subsp bovis AF2122/97
caccguacggccacg

SEQ ID NO: 1123288 - RNA, 19 nt, Mycobacterium bovis subsp bovis AF2122/97
caccguagagcaugccgcc

SEQ ID NO: 1123289 - RNA, 20 nt, Mycobacterium bovis subsp bovis AF2122/97
caccguagagcaugccgccc

SEQ ID NO: 1123290 - RNA, 21 nt, Mycobacterium bovis subsp bovis AF2122/97
caccguagagcaugccgcccg

SEQ ID NO: 1123291 - RNA, 21 nt, Mycobacterium bovis subsp bovis AF2122/97
caccggugacgcacagcagca

SEQ ID NO: 1123292 - RNA, 18 nt, Mycobacterium bovis subsp bovis AF2122/97
caccggugcccaccaccg

SEQ ID NO: 1123293 - RNA, 14 nt, Mycobacterium bovis subsp bovis AF2122/97
caccggugccgccc

SEQ ID NO: 1123294 - RNA, 15 nt, Mycobacterium bovis subsp bovis AF2122/97
caccggugccgcccg

SEQ ID NO: 1123295 - RNA, 16 nt, Mycobacterium bovis subsp bovis AF2122/97
caccggugccgcccgc

SEQ ID NO: 1123296 - RNA, 23 nt, Mycobacterium bovis subsp bovis AF2122/97
caccggugccgcccgcgccgccg

SEQ ID NO: 1123297 - RNA, 16 nt, Mycobacterium bovis subsp bovis AF2122/97
caccggugccgccguu

SEQ ID NO: 1123298 - RNA, 14 nt, Mycobacterium bovis subsp bovis AF2122/97
caccggugccggcg

SEQ ID NO: 1123299 - RNA, 14 nt, Mycobacterium bovis subsp bovis AF2122/97
caccgguccagcgc

SEQ ID NO: 1123300 - RNA, 19 nt, Mycobacterium bovis subsp bovis AF2122/97
caccggucccugcgccguc

SEQ ID NO: 1123301 - RNA, 23 nt, Mycobacterium bovis subsp bovis AF2122/97
caccgguauguucggcaaugacg

SEQ ID NO: 1123302 - RNA, 18 nt, Mycobacterium bovis subsp bovis AF2122/97
caccggucaccgcgcagc

SEQ ID NO: 1123303 - RNA, 20 nt, Mycobacterium bovis subsp bovis AF2122/97
caccggucagcgacgcacgc

SEQ ID NO: 1123304 - RNA, 17 nt, Mycobacterium bovis subsp bovis AF2122/97
caccggugccggcgacg

SEQ ID NO: 1123305 - RNA, 16 nt, Mycobacterium bovis subsp bovis AF2122/97
caccggugcgcuggag

SEQ ID NO: 1123306 - RNA, 15 nt, Mycobacterium bovis subsp bovis AF2122/97
caccggugcucgucg

SEQ ID NO: 1123307 - RNA, 16 nt, Mycobacterium bovis subsp bovis AF2122/97
caccgguggacccggc

SEQ ID NO: 1123308 - RNA, 23 nt, Mycobacterium bovis subsp bovis AF2122/97
caccgguucggggggcaggucga

SEQ ID NO: 1123309 - RNA, 14 nt, Mycobacterium bovis subsp bovis AF2122/97
caccgguggcgccc

SEQ ID NO: 1123310 - RNA, 13 nt, Mycobacterium bovis subsp bovis AF2122/97
caccggugucggc

SEQ ID NO: 1123311 - RNA, 20 nt, Mycobacterium bovis subsp bovis AF2122/97
caccggugucuucugccauc

SEQ ID NO: 1123312 - RNA, 13 nt, Mycobacterium bovis subsp bovis AF2122/97
caccgguguuggu

SEQ ID NO: 1123313 - RNA, 19 nt, Mycobacterium bovis subsp bovis AF2122/97
caccggguccaccgcacgg

SEQ ID NO: 1123314 - RNA, 18 nt, Mycobacterium bovis subsp bovis AF2122/97
caccggggugugcgggcg

SEQ ID NO: 1123315 - RNA, 20 nt, Mycobacterium bovis subsp bovis AF2122/97
caccggggugugcgggcggu

SEQ ID NO: 1123316 - RNA, 18 nt, Mycobacterium bovis subsp bovis AF2122/97
caccggggaagaucucgg

SEQ ID NO: 1123317 - RNA, 17 nt, Mycobacterium bovis subsp bovis AF2122/97
caccgggcggcggcgac

SEQ ID NO: 1123318 - RNA, 17 nt, Mycobacterium bovis subsp bovis AF2122/97
caccgggcgggcuggug

SEQ ID NO: 1123319 - RNA, 19 nt, Mycobacterium bovis subsp bovis AF2122/97
caccgggcgugcggcggcc

SEQ ID NO: 1123320 - RNA, 17 nt, Mycobacterium bovis subsp bovis AF2122/97
caccggggacagcccgg

SEQ ID NO: 1123321 - RNA, 19 nt, Mycobacterium bovis subsp bovis AF2122/97
caccggggacagcccggca

SEQ ID NO: 1123322 - RNA, 15 nt, Mycobacterium bovis subsp bovis AF2122/97
caccggggacgucga

SEQ ID NO: 1123323 - RNA, 14 nt, Mycobacterium bovis subsp bovis AF2122/97
caccggucgccgcg

SEQ ID NO: 1123324 - RNA, 17 nt, Mycobacterium bovis subsp bovis AF2122/97
caccgguaccggcgacg

SEQ ID NO: 1123325 - RNA, 16 nt, Mycobacterium bovis subsp bovis AF2122/97
caccgguacgcaacca

SEQ ID NO: 1123326 - RNA, 14 nt, Mycobacterium bovis subsp bovis AF2122/97
caccgguaccgccg

SEQ ID NO: 1123327 - RNA, 14 nt, Mycobacterium bovis subsp bovis AF2122/97
caccggguucaccg

SEQ ID NO: 1123328 - RNA, 15 nt, Mycobacterium bovis subsp bovis AF2122/97
caccggguugagccg

SEQ ID NO: 1123329 - RNA, 18 nt, Mycobacterium bovis subsp bovis AF2122/97
caccggguugagccgccg

SEQ ID NO: 1123330 - RNA, 22 nt, Mycobacterium bovis subsp bovis AF2122/97
caccggguuggaagccgcaccg

SEQ ID NO: 1123331 - RNA, 20 nt, Mycobacterium bovis subsp bovis AF2122/97
caccgguaacgccaacaccg

SEQ ID NO: 1123332 - RNA, 23 nt, Mycobacterium bovis subsp bovis AF2122/97
caccgguaacgccaacaccggca

SEQ ID NO: 1123333 - RNA, 16 nt, Mycobacterium bovis subsp bovis AF2122/97
caccgguaacgcgaca

SEQ ID NO: 1123334 - RNA, 15 nt, Mycobacterium bovis subsp bovis AF2122/97
caccgguaccgccac

SEQ ID NO: 1123335 - RNA, 12 nt, Mycobacterium bovis subsp bovis AF2122/97
caccgugcgccg

SEQ ID NO: 1123336 - RNA, 13 nt, Mycobacterium bovis subsp bovis AF2122/97
caccgugcgccga

SEQ ID NO: 1123337 - RNA, 18 nt, Mycobacterium bovis subsp bovis AF2122/97
caccgugcggaucgcgcu

SEQ ID NO: 1123338 - RNA, 21 nt, Mycobacterium bovis subsp bovis AF2122/97
caccgugcggggggcagcucc

SEQ ID NO: 1123339 - RNA, 14 nt, Mycobacterium bovis subsp bovis AF2122/97
caccgugcaccagc

SEQ ID NO: 1123340 - RNA, 13 nt, Mycobacterium bovis subsp bovis AF2122/97
caccgugccgacg

SEQ ID NO: 1123341 - RNA, 14 nt, Mycobacterium bovis subsp bovis AF2122/97
caccgucggcacca

SEQ ID NO: 1123342 - RNA, 16 nt, Mycobacterium bovis subsp bovis AF2122/97
caccgugaccgccgcg

SEQ ID NO: 1123343 - RNA, 19 nt, Mycobacterium bovis subsp bovis AF2122/97
caccgugaccgccgcgccg

SEQ ID NO: 1123344 - RNA, 15 nt, Mycobacterium bovis subsp bovis AF2122/97
caccgugacagcggc

SEQ ID NO: 1123345 - RNA, 23 nt, Mycobacterium bovis subsp bovis AF2122/97
caccgugacagcggcauugccag

SEQ ID NO: 1123346 - RNA, 13 nt, Mycobacterium bovis subsp bovis AF2122/97
caccgugaccgcc

SEQ ID NO: 1123347 - RNA, 14 nt, Mycobacterium bovis subsp bovis AF2122/97
caccgugaccgccg

SEQ ID NO: 1123348 - RNA, 16 nt, Mycobacterium bovis subsp bovis AF2122/97
caccgucuccggcgcc

SEQ ID NO: 1123349 - RNA, 20 nt, Mycobacterium bovis subsp bovis AF2122/97
caccgucuccggcgccaccg

SEQ ID NO: 1123350 - RNA, 17 nt, Mycobacterium bovis subsp bovis AF2122/97
caccgucucgcaccgcg

SEQ ID NO: 1123351 - RNA, 16 nt, Mycobacterium bovis subsp bovis AF2122/97
caccgugaaccgcccg

SEQ ID NO: 1123352 - RNA, 19 nt, Mycobacterium bovis subsp bovis AF2122/97
caccgugaaccgcccgccc

SEQ ID NO: 1123353 - RNA, 23 nt, Mycobacterium bovis subsp bovis AF2122/97
caccgugaagcccuggccagcga

SEQ ID NO: 1123354 - RNA, 18 nt, Mycobacterium bovis subsp bovis AF2122/97
caccgucgcccggguggc

SEQ ID NO: 1123355 - RNA, 14 nt, Mycobacterium bovis subsp bovis AF2122/97
caccgucgccgccg

SEQ ID NO: 1123356 - RNA, 18 nt, Mycobacterium bovis subsp bovis AF2122/97
caccguccucggucacga

SEQ ID NO: 1123357 - RNA, 15 nt, Mycobacterium bovis subsp bovis AF2122/97
caccgucgagccgga

SEQ ID NO: 1123358 - RNA, 20 nt, Mycobacterium bovis subsp bovis AF2122/97
caccgucgagguacacgccg

SEQ ID NO: 1123359 - RNA, 22 nt, Mycobacterium bovis subsp bovis AF2122/97
caccgucguuaagacggcgacg

SEQ ID NO: 1123360 - RNA, 23 nt, Mycobacterium bovis subsp bovis AF2122/97
caccgucgggcccagccggaccg

SEQ ID NO: 1123361 - RNA, 18 nt, Mycobacterium bovis subsp bovis AF2122/97
caccgucguacucggcgg

SEQ ID NO: 1123362 - RNA, 15 nt, Mycobacterium bovis subsp bovis AF2122/97
caccgucgcggcggc

SEQ ID NO: 1123363 - RNA, 20 nt, Mycobacterium bovis subsp bovis AF2122/97
caccgucgcugcccgcgcgg

SEQ ID NO: 1123364 - RNA, 15 nt, Mycobacterium bovis subsp bovis AF2122/97
caccgucaccgccgg

SEQ ID NO: 1123365 - RNA, 14 nt, Mycobacterium bovis subsp bovis AF2122/97
caccgucacccccg

SEQ ID NO: 1123366 - RNA, 20 nt, Mycobacterium bovis subsp bovis AF2122/97
caccgucacgaucagggcga

SEQ ID NO: 1123367 - RNA, 17 nt, Mycobacterium bovis subsp bovis AF2122/97
caccgucagcgcgaccg

SEQ ID NO: 1123368 - RNA, 20 nt, Mycobacterium bovis subsp bovis AF2122/97
caccgucaguucggugugcg

SEQ ID NO: 1123369 - RNA, 19 nt, Mycobacterium bovis subsp bovis AF2122/97
caccgucaugccgacgaca

SEQ ID NO: 1123370 - RNA, 15 nt, Mycobacterium bovis subsp bovis AF2122/97
caccgucccuguguc

SEQ ID NO: 1123371 - RNA, 16 nt, Mycobacterium bovis subsp bovis AF2122/97
caccguccgucggcgc

SEQ ID NO: 1123372 - RNA, 23 nt, Mycobacterium bovis subsp bovis AF2122/97
caccgucauggcgggugcggcga

SEQ ID NO: 1123373 - RNA, 17 nt, Mycobacterium bovis subsp bovis AF2122/97
caccgucauugccacca

SEQ ID NO: 1123374 - RNA, 19 nt, Mycobacterium bovis subsp bovis AF2122/97
caccguccaauuggcgucg

SEQ ID NO: 1123375 - RNA, 14 nt, Mycobacterium bovis subsp bovis AF2122/97
caccgucgacgaca

SEQ ID NO: 1123376 - RNA, 19 nt, Mycobacterium bovis subsp bovis AF2122/97
caccgugggguaucgccag

SEQ ID NO: 1123377 - RNA, 15 nt, Mycobacterium bovis subsp bovis AF2122/97
caccguggaucggca

SEQ ID NO: 1123378 - RNA, 15 nt, Mycobacterium bovis subsp bovis AF2122/97
caccgugucgacggu

SEQ ID NO: 1123379 - RNA, 14 nt, Mycobacterium bovis subsp bovis AF2122/97
caccgugucgccgg

SEQ ID NO: 1123380 - RNA, 23 nt, Mycobacterium bovis subsp bovis AF2122/97
caccgugguggacgaccgcgcgg

SEQ ID NO: 1123381 - RNA, 14 nt, Mycobacterium bovis subsp bovis AF2122/97
caccgugguggcgu

SEQ ID NO: 1123382 - RNA, 21 nt, Mycobacterium bovis subsp bovis AF2122/97
caccgugguggcguaucgggc

SEQ ID NO: 1123383 - RNA, 20 nt, Mycobacterium bovis subsp bovis AF2122/97
caccgugugcacgcgauggc

SEQ ID NO: 1123384 - RNA, 16 nt, Mycobacterium bovis subsp bovis AF2122/97
caccgugucgccggcg

SEQ ID NO: 1123385 - RNA, 17 nt, Mycobacterium bovis subsp bovis AF2122/97
caccgugucgccggcga

SEQ ID NO: 1123386 - RNA, 18 nt, Mycobacterium bovis subsp bovis AF2122/97
caccgugucgccggcgaa

SEQ ID NO: 1123387 - RNA, 19 nt, Mycobacterium bovis subsp bovis AF2122/97
caccgugugggccccgccg

SEQ ID NO: 1123388 - RNA, 22 nt, Mycobacterium bovis subsp bovis AF2122/97
caccgugugggccccgccgaug

SEQ ID NO: 1123389 - RNA, 14 nt, Mycobacterium bovis subsp bovis AF2122/97
caccguugccgaac

SEQ ID NO: 1123390 - RNA, 17 nt, Mycobacterium bovis subsp bovis AF2122/97
caccguugcguuggcgc

SEQ ID NO: 1123391 - RNA, 22 nt, Mycobacterium bovis subsp bovis AF2122/97
caccguugcguuggcgccacca

SEQ ID NO: 1123392 - RNA, 21 nt, Mycobacterium bovis subsp bovis AF2122/97
caccguugccgaaccacgcgc

SEQ ID NO: 1123393 - RNA, 14 nt, Mycobacterium bovis subsp bovis AF2122/97
caccguugccgccg

SEQ ID NO: 1123394 - RNA, 18 nt, Mycobacterium bovis subsp bovis AF2122/97
caccguguugcacgcggg

SEQ ID NO: 1123395 - RNA, 21 nt, Mycobacterium bovis subsp bovis AF2122/97
caccucagaaaguccccgcaa

SEQ ID NO: 1123396 - RNA, 16 nt, Mycobacterium bovis subsp bovis AF2122/97
caccucaccgcggauc

SEQ ID NO: 1123397 - RNA, 12 nt, Mycobacterium bovis subsp bovis AF2122/97
caccucaccagu

SEQ ID NO: 1123398 - RNA, 19 nt, Mycobacterium bovis subsp bovis AF2122/97
caccuaccgagaucaccgc

SEQ ID NO: 1123399 - RNA, 21 nt, Mycobacterium bovis subsp bovis AF2122/97
caccuaccgagaucaccgcca

SEQ ID NO: 1123400 - RNA, 21 nt, Mycobacterium bovis subsp bovis AF2122/97
caccguugggccgacugggcg

SEQ ID NO: 1123401 - RNA, 17 nt, Mycobacterium bovis subsp bovis AF2122/97
caccguuugagcggcca

SEQ ID NO: 1123402 - RNA, 22 nt, Mycobacterium bovis subsp bovis AF2122/97
caccguuuccggcgcuccgcca

SEQ ID NO: 1123403 - RNA, 19 nt, Mycobacterium bovis subsp bovis AF2122/97
caccguuugagcggccacc

SEQ ID NO: 1123404 - RNA, 21 nt, Mycobacterium bovis subsp bovis AF2122/97
caccguuugggcgccgguguu

SEQ ID NO: 1123405 - RNA, 18 nt, Mycobacterium bovis subsp bovis AF2122/97
caaugugguucgucgucg

SEQ ID NO: 1123406 - RNA, 19 nt, Mycobacterium bovis subsp bovis AF2122/97
caaugugguucgucgucgu

SEQ ID NO: 1123407 - RNA, 22 nt, Mycobacterium bovis subsp bovis AF2122/97
caaugucggcgaugcguccgcc

SEQ ID NO: 1123408 - RNA, 20 nt, Mycobacterium bovis subsp bovis AF2122/97
caauggcggcgccgucgaag

SEQ ID NO: 1123409 - RNA, 18 nt, Mycobacterium bovis subsp bovis AF2122/97
caauggcggcgccgucga

SEQ ID NO: 1123410 - RNA, 15 nt, Mycobacterium bovis subsp bovis AF2122/97
caauggcggcgccgu

SEQ ID NO: 1123411 - RNA, 19 nt, Mycobacterium bovis subsp bovis AF2122/97
caaugccguugaucgcaaa

SEQ ID NO: 1123412 - RNA, 15 nt, Mycobacterium bovis subsp bovis AF2122/97
cacaacccgucgagc

SEQ ID NO: 1123413 - RNA, 20 nt, Mycobacterium bovis subsp bovis AF2122/97
cacaacccgucgagccgugc

SEQ ID NO: 1123414 - RNA, 15 nt, Mycobacterium bovis subsp bovis AF2122/97
cacaaccgcugcugc

SEQ ID NO: 1123415 - RNA, 17 nt, Mycobacterium bovis subsp bovis AF2122/97
cacaaccgugagcacca

SEQ ID NO: 1123416 - RNA, 18 nt, Mycobacterium bovis subsp bovis AF2122/97
caauuggccguuggcggc

SEQ ID NO: 1123417 - RNA, 13 nt, Mycobacterium bovis subsp bovis AF2122/97
caauuggcgucgu

SEQ ID NO: 1123418 - RNA, 14 nt, Mycobacterium bovis subsp bovis AF2122/97
caauuggcgucguc

SEQ ID NO: 1123419 - RNA, 23 nt, Mycobacterium bovis subsp bovis AF2122/97
caauuggcgucgucggcggcgac

SEQ ID NO: 1123420 - RNA, 14 nt, Mycobacterium bovis subsp bovis AF2122/97
caauuggcucggcg

SEQ ID NO: 1123421 - RNA, 14 nt, Mycobacterium bovis subsp bovis AF2122/97
caauugggcgaugc

SEQ ID NO: 1123422 - RNA, 15 nt, Mycobacterium bovis subsp bovis AF2122/97
caauugugcggcccc

SEQ ID NO: 1123423 - RNA, 20 nt, Mycobacterium bovis subsp bovis AF2122/97
cacaccggcuuugcuugccg

SEQ ID NO: 1123424 - RNA, 18 nt, Mycobacterium bovis subsp bovis AF2122/97
cacaccgacgccgccagg

SEQ ID NO: 1123425 - RNA, 13 nt, Mycobacterium bovis subsp bovis AF2122/97
cacaccgaggucg

SEQ ID NO: 1123426 - RNA, 13 nt, Mycobacterium bovis subsp bovis AF2122/97
cacaccgaucggc

SEQ ID NO: 1123427 - RNA, 14 nt, Mycobacterium bovis subsp bovis AF2122/97
cacaccggagccga

SEQ ID NO: 1123428 - RNA, 13 nt, Mycobacterium bovis subsp bovis AF2122/97
cacacccggcaca

SEQ ID NO: 1123429 - RNA, 14 nt, Mycobacterium bovis subsp bovis AF2122/97
cacaccgcggcggc

SEQ ID NO: 1123430 - RNA, 19 nt, Mycobacterium bovis subsp bovis AF2122/97
cacacccgcgaacgcgaca

SEQ ID NO: 1123431 - RNA, 14 nt, Mycobacterium bovis subsp bovis AF2122/97
cacacccgcaccgg

SEQ ID NO: 1123432 - RNA, 14 nt, Mycobacterium bovis subsp bovis AF2122/97
cacacccccgucug

SEQ ID NO: 1123433 - RNA, 21 nt, Mycobacterium bovis subsp bovis AF2122/97
cacacccaucaccgccagccc

SEQ ID NO: 1123434 - RNA, 19 nt, Mycobacterium bovis subsp bovis AF2122/97
cacacaaccgacgggucgc

SEQ ID NO: 1123435 - RNA, 13 nt, Mycobacterium bovis subsp bovis AF2122/97
cacaaugcuucgg

SEQ ID NO: 1123436 - RNA, 17 nt, Mycobacterium bovis subsp bovis AF2122/97
cacaaugcuucggcguc

SEQ ID NO: 1123437 - RNA, 12 nt, Mycobacterium bovis subsp bovis AF2122/97
cacaauuccaca

SEQ ID NO: 1123438 - RNA, 14 nt, Mycobacterium bovis subsp bovis AF2122/97
cacaacgccaugug

SEQ ID NO: 1123439 - RNA, 14 nt, Mycobacterium bovis subsp bovis AF2122/97
cacaacgcccacca

SEQ ID NO: 1123440 - RNA, 15 nt, Mycobacterium bovis subsp bovis AF2122/97
cacaacgcgugacca

SEQ ID NO: 1123441 - RNA, 18 nt, Mycobacterium bovis subsp bovis AF2122/97
cacaacgggugucggcgu

SEQ ID NO: 1123442 - RNA, 22 nt, Mycobacterium bovis subsp bovis AF2122/97
cacaagccccgcgcguucggcg

SEQ ID NO: 1123443 - RNA, 15 nt, Mycobacterium bovis subsp bovis AF2122/97
cacaagcugacacga

SEQ ID NO: 1123444 - RNA, 16 nt, Mycobacterium bovis subsp bovis AF2122/97
cacaaucgcagauugu

SEQ ID NO: 1123445 - RNA, 20 nt, Mycobacterium bovis subsp bovis AF2122/97
cacaaucgguugcacccgcg

SEQ ID NO: 1123446 - RNA, 17 nt, Mycobacterium bovis subsp bovis AF2122/97
cacaauccacgucgcgg

SEQ ID NO: 1123447 - RNA, 21 nt, Mycobacterium bovis subsp bovis AF2122/97
cacaauccgcucggucgccuc

SEQ ID NO: 1123448 - RNA, 17 nt, Mycobacterium bovis subsp bovis AF2122/97
cacaaguaccgcaucga

SEQ ID NO: 1123449 - RNA, 14 nt, Mycobacterium bovis subsp bovis AF2122/97
caaucccuccgcca

SEQ ID NO: 1123450 - RNA, 14 nt, Mycobacterium bovis subsp bovis AF2122/97
caauccgcucgguc

SEQ ID NO: 1123451 - RNA, 18 nt, Mycobacterium bovis subsp bovis AF2122/97
caauccgcacagcgacga

SEQ ID NO: 1123452 - RNA, 19 nt, Mycobacterium bovis subsp bovis AF2122/97
caauccgcacagcgacgag

SEQ ID NO: 1123453 - RNA, 15 nt, Mycobacterium bovis subsp bovis AF2122/97
caaucccacgcccgg

SEQ ID NO: 1123454 - RNA, 20 nt, Mycobacterium bovis subsp bovis AF2122/97
caauccacgguugccggcgg

SEQ ID NO: 1123455 - RNA, 17 nt, Mycobacterium bovis subsp bovis AF2122/97
caauccacgcacucguc

SEQ ID NO: 1123456 - RNA, 17 nt, Mycobacterium bovis subsp bovis AF2122/97
caauccggucagcgcgg

SEQ ID NO: 1123457 - RNA, 18 nt, Mycobacterium bovis subsp bovis AF2122/97
caauccggucagcgcggc

SEQ ID NO: 1123458 - RNA, 19 nt, Mycobacterium bovis subsp bovis AF2122/97
caauccggucagcgcggcg

SEQ ID NO: 1123459 - RNA, 16 nt, Mycobacterium bovis subsp bovis AF2122/97
caaucgaugagcgcga

SEQ ID NO: 1123460 - RNA, 13 nt, Mycobacterium bovis subsp bovis AF2122/97
caaucgaccgccc

SEQ ID NO: 1123461 - RNA, 17 nt, Mycobacterium bovis subsp bovis AF2122/97
caaucagcccgacaccg

SEQ ID NO: 1123462 - RNA, 15 nt, Mycobacterium bovis subsp bovis AF2122/97
caaucaggucgucgg

SEQ ID NO: 1123463 - RNA, 12 nt, Mycobacterium bovis subsp bovis AF2122/97
caaucaccgccg

SEQ ID NO: 1123464 - RNA, 13 nt, Mycobacterium bovis subsp bovis AF2122/97
caaucaccgccgg

SEQ ID NO: 1123465 - RNA, 16 nt, Mycobacterium bovis subsp bovis AF2122/97
caaucgggaucgcugc

SEQ ID NO: 1123466 - RNA, 14 nt, Mycobacterium bovis subsp bovis AF2122/97
caaucggguccacg

SEQ ID NO: 1123467 - RNA, 20 nt, Mycobacterium bovis subsp bovis AF2122/97
caaucggauacccagccggc

SEQ ID NO: 1123468 - RNA, 18 nt, Mycobacterium bovis subsp bovis AF2122/97
caaucggauagccgugcu

SEQ ID NO: 1123469 - RNA, 19 nt, Mycobacterium bovis subsp bovis AF2122/97
caaucgcucugugucgccg

SEQ ID NO: 1123470 - RNA, 17 nt, Mycobacterium bovis subsp bovis AF2122/97
caaucgcgacggggucg

SEQ ID NO: 1123471 - RNA, 12 nt, Mycobacterium bovis subsp bovis AF2122/97
caaucucggccg

SEQ ID NO: 1123472 - RNA, 19 nt, Mycobacterium bovis subsp bovis AF2122/97
caaucucggcguugccgcc

SEQ ID NO: 1123473 - RNA, 23 nt, Mycobacterium bovis subsp bovis AF2122/97
caaucgugguucggcgucgaccc

SEQ ID NO: 1123474 - RNA, 17 nt, Mycobacterium bovis subsp bovis AF2122/97
caaucgucggccagcag

SEQ ID NO: 1123475 - RNA, 14 nt, Mycobacterium bovis subsp bovis AF2122/97
caaugccggccgcg

SEQ ID NO: 1123476 - RNA, 16 nt, Mycobacterium bovis subsp bovis AF2122/97
caaugccgcggccagu

SEQ ID NO: 1123477 - RNA, 17 nt, Mycobacterium bovis subsp bovis AF2122/97
caaugcccuuggccagc

SEQ ID NO: 1123478 - RNA, 17 nt, Mycobacterium bovis subsp bovis AF2122/97
caaugccgacgccaacg

SEQ ID NO: 1123479 - RNA, 19 nt, Mycobacterium bovis subsp bovis AF2122/97
caaugccgacucaggucgg

SEQ ID NO: 1123480 - RNA, 23 nt, Mycobacterium bovis subsp bovis AF2122/97
caaugccauguugaaaaggcgcu

SEQ ID NO: 1123481 - RNA, 18 nt, Mycobacterium bovis subsp bovis AF2122/97
caaucuucucgagccgcc

SEQ ID NO: 1123482 - RNA, 15 nt, Mycobacterium bovis subsp bovis AF2122/97
caaucugcgcgaggg

SEQ ID NO: 1123483 - RNA, 17 nt, Mycobacterium bovis subsp bovis AF2122/97
caauacccgccgcgaug

SEQ ID NO: 1123484 - RNA, 16 nt, Mycobacterium bovis subsp bovis AF2122/97
caauaccgccagcgcc

SEQ ID NO: 1123485 - RNA, 12 nt, Mycobacterium bovis subsp bovis AF2122/97
caauagaccgca

SEQ ID NO: 1123486 - RNA, 20 nt, Mycobacterium bovis subsp bovis AF2122/97
caauagcgacagcagcgcca

SEQ ID NO: 1123487 - RNA, 13 nt, Mycobacterium bovis subsp bovis AF2122/97
caauaggucccca

SEQ ID NO: 1123488 - RNA, 23 nt, Mycobacterium bovis subsp bovis AF2122/97
caaguugagcagcuugguggcgu

SEQ ID NO: 1123489 - RNA, 17 nt, Mycobacterium bovis subsp bovis AF2122/97
caagugucgccgcucgg

SEQ ID NO: 1123490 - RNA, 15 nt, Mycobacterium bovis subsp bovis AF2122/97
caaguucugcgcucc

SEQ ID NO: 1123491 - RNA, 18 nt, Mycobacterium bovis subsp bovis AF2122/97
caaguugguucaccgcga

SEQ ID NO: 1123492 - RNA, 15 nt, Mycobacterium bovis subsp bovis AF2122/97
caagugggccggcgg

SEQ ID NO: 1123493 - RNA, 13 nt, Mycobacterium bovis subsp bovis AF2122/97
caagugucgccgc

SEQ ID NO: 1123494 - RNA, 21 nt, Mycobacterium bovis subsp bovis AF2122/97
caauaagggagaccgcggccg

SEQ ID NO: 1123495 - RNA, 16 nt, Mycobacterium bovis subsp bovis AF2122/97
caagucugugcucacg

SEQ ID NO: 1123496 - RNA, 16 nt, Mycobacterium bovis subsp bovis AF2122/97
caagucgcccagccga

SEQ ID NO: 1123497 - RNA, 16 nt, Mycobacterium bovis subsp bovis AF2122/97
caagucggagcgggga

SEQ ID NO: 1123498 - RNA, 20 nt, Mycobacterium bovis subsp bovis AF2122/97
caagucgaccaugagccggc

SEQ ID NO: 1123499 - RNA, 21 nt, Mycobacterium bovis subsp bovis AF2122/97
caagucgaccaugagccggcg

SEQ ID NO: 1123500 - RNA, 20 nt, Mycobacterium bovis subsp bovis AF2122/97
caagucgacgguggcgccgu

SEQ ID NO: 1123501 - RNA, 23 nt, Mycobacterium bovis subsp bovis AF2122/97
caagucggcgcuggccgucgaag

SEQ ID NO: 1123502 - RNA, 15 nt, Mycobacterium bovis subsp bovis AF2122/97
caagugcgguccggc

SEQ ID NO: 1123503 - RNA, 20 nt, Mycobacterium bovis subsp bovis AF2122/97
caaguagccgucgucgucga

SEQ ID NO: 1123504 - RNA, 16 nt, Mycobacterium bovis subsp bovis AF2122/97
caaguccggucgcggc

SEQ ID NO: 1123505 - RNA, 16 nt, Mycobacterium bovis subsp bovis AF2122/97
caaguccuccacggcg

SEQ ID NO: 1123506 - RNA, 15 nt, Mycobacterium bovis subsp bovis AF2122/97
caagucgacacgccg

SEQ ID NO: 1123507 - RNA, 18 nt, Mycobacterium bovis subsp bovis AF2122/97
caagucgacacgccgaac

SEQ ID NO: 1123508 - RNA, 14 nt, Mycobacterium bovis subsp bovis AF2122/97
caaggccuucagcg

SEQ ID NO: 1123509 - RNA, 17 nt, Mycobacterium bovis subsp bovis AF2122/97
caaggaccugugcggcc

SEQ ID NO: 1123510 - RNA, 18 nt, Mycobacterium bovis subsp bovis AF2122/97
caaggacgaacgcgccgg

SEQ ID NO: 1123511 - RNA, 13 nt, Mycobacterium bovis subsp bovis AF2122/97
caaggacgcaccg

SEQ ID NO: 1123512 - RNA, 14 nt, Mycobacterium bovis subsp bovis AF2122/97
caaggccgccgccg

SEQ ID NO: 1123513 - RNA, 20 nt, Mycobacterium bovis subsp bovis AF2122/97
caaggccgcguugccggucg

SEQ ID NO: 1123514 - RNA, 21 nt, Mycobacterium bovis subsp bovis AF2122/97
caaggcgccgauaccggcggc

SEQ ID NO: 1123515 - RNA, 19 nt, Mycobacterium bovis subsp bovis AF2122/97
caaggcgaagguccgugcc

SEQ ID NO: 1123516 - RNA, 19 nt, Mycobacterium bovis subsp bovis AF2122/97
caaggcgacgaaucggcaa

SEQ ID NO: 1123517 - RNA, 20 nt, Mycobacterium bovis subsp bovis AF2122/97
caaggcucagcagcgccgcg

SEQ ID NO: 1123518 - RNA, 15 nt, Mycobacterium bovis subsp bovis AF2122/97
caaggcucagcagcg

SEQ ID NO: 1123519 - RNA, 23 nt, Mycobacterium bovis subsp bovis AF2122/97
caagguuggucggugcugacccc

SEQ ID NO: 1123520 - RNA, 21 nt, Mycobacterium bovis subsp bovis AF2122/97
caagggccggaugggcgucga

SEQ ID NO: 1123521 - RNA, 17 nt, Mycobacterium bovis subsp bovis AF2122/97
caagguguugcgguggg

SEQ ID NO: 1123522 - RNA, 19 nt, Mycobacterium bovis subsp bovis AF2122/97
caacucggcgaccugccgg

SEQ ID NO: 1123523 - RNA, 16 nt, Mycobacterium bovis subsp bovis AF2122/97
caagccguugcacggc

SEQ ID NO: 1123524 - RNA, 20 nt, Mycobacterium bovis subsp bovis AF2122/97
caagccucguggugagauca

SEQ ID NO: 1123525 - RNA, 16 nt, Mycobacterium bovis subsp bovis AF2122/97
caagcgacucgccggc

SEQ ID NO: 1123526 - RNA, 19 nt, Mycobacterium bovis subsp bovis AF2122/97
caagcgacucgccggcgaa

SEQ ID NO: 1123527 - RNA, 15 nt, Mycobacterium bovis subsp bovis AF2122/97
caagccugcgcuguu

SEQ ID NO: 1123528 - RNA, 17 nt, Mycobacterium bovis subsp bovis AF2122/97
caagccuucgucgaugc

SEQ ID NO: 1123529 - RNA, 20 nt, Mycobacterium bovis subsp bovis AF2122/97
caagccgggugggagcagcc

SEQ ID NO: 1123530 - RNA, 22 nt, Mycobacterium bovis subsp bovis AF2122/97
caagccguagaccaggcccagg

SEQ ID NO: 1123531 - RNA, 21 nt, Mycobacterium bovis subsp bovis AF2122/97
caagccguaguaguggccgcc

SEQ ID NO: 1123532 - RNA, 22 nt, Mycobacterium bovis subsp bovis AF2122/97
caagccguaguaguggccgcca

SEQ ID NO: 1123533 - RNA, 18 nt, Mycobacterium bovis subsp bovis AF2122/97
caacucggcauucaccgc

SEQ ID NO: 1123534 - RNA, 12 nt, Mycobacterium bovis subsp bovis AF2122/97
caacucggccac

SEQ ID NO: 1123535 - RNA, 14 nt, Mycobacterium bovis subsp bovis AF2122/97
caacucggccagcu

SEQ ID NO: 1123536 - RNA, 12 nt, Mycobacterium bovis subsp bovis AF2122/97
caacucggcccg

SEQ ID NO: 1123537 - RNA, 13 nt, Mycobacterium bovis subsp bovis AF2122/97
caacucggcccgg

SEQ ID NO: 1123538 - RNA, 15 nt, Mycobacterium bovis subsp bovis AF2122/97
caacucggcccgggu

SEQ ID NO: 1123539 - RNA, 18 nt, Mycobacterium bovis subsp bovis AF2122/97
caacucgcguggcaccga

SEQ ID NO: 1123540 - RNA, 11 nt, Mycobacterium bovis subsp bovis AF2122/97
caacucggcag

SEQ ID NO: 1123541 - RNA, 16 nt, Mycobacterium bovis subsp bovis AF2122/97
caacucggccacggcg

SEQ ID NO: 1123542 - RNA, 21 nt, Mycobacterium bovis subsp bovis AF2122/97
caacucggccacggcgucggc

SEQ ID NO: 1123543 - RNA, 18 nt, Mycobacterium bovis subsp bovis AF2122/97
caacucgcgaagcaucgc

SEQ ID NO: 1123544 - RNA, 21 nt, Mycobacterium bovis subsp bovis AF2122/97
caacucgaauccggcccacuu

SEQ ID NO: 1123545 - RNA, 22 nt, Mycobacterium bovis subsp bovis AF2122/97
caacucgccacggucgccgacc

SEQ ID NO: 1123546 - RNA, 21 nt, Mycobacterium bovis subsp bovis AF2122/97
caacucgagaguggccucguc

SEQ ID NO: 1123547 - RNA, 16 nt, Mycobacterium bovis subsp bovis AF2122/97
caacucccgcgguacg

SEQ ID NO: 1123548 - RNA, 17 nt, Mycobacterium bovis subsp bovis AF2122/97
caacucgaacgucacca

SEQ ID NO: 1123549 - RNA, 16 nt, Mycobacterium bovis subsp bovis AF2122/97
caacuccucagccgcc

SEQ ID NO: 1123550 - RNA, 11 nt, Mycobacterium bovis subsp bovis AF2122/97
caacuccugca

SEQ ID NO: 1123551 - RNA, 17 nt, Mycobacterium bovis subsp bovis AF2122/97
caacuccugcagcccgg

SEQ ID NO: 1123552 - RNA, 17 nt, Mycobacterium bovis subsp bovis AF2122/97
caacuccagcacccgcu

SEQ ID NO: 1123553 - RNA, 17 nt, Mycobacterium bovis subsp bovis AF2122/97
caacuccaucagcgcga

SEQ ID NO: 1123554 - RNA, 15 nt, Mycobacterium bovis subsp bovis AF2122/97
caacucccagcacgg

SEQ ID NO: 1123555 - RNA, 21 nt, Mycobacterium bovis subsp bovis AF2122/97
caagcgaugucccaucgcguc

SEQ ID NO: 1123556 - RNA, 15 nt, Mycobacterium bovis subsp bovis AF2122/97
caagcgccugagcgg

SEQ ID NO: 1123557 - RNA, 16 nt, Mycobacterium bovis subsp bovis AF2122/97
caagcgccugagcggc

SEQ ID NO: 1123558 - RNA, 21 nt, Mycobacterium bovis subsp bovis AF2122/97
caagcuccaguagucggccga

SEQ ID NO: 1123559 - RNA, 22 nt, Mycobacterium bovis subsp bovis AF2122/97
caagcgauuuggcgucgccgag

SEQ ID NO: 1123560 - RNA, 23 nt, Mycobacterium bovis subsp bovis AF2122/97
caagcgauuuggcgucgccgagg

SEQ ID NO: 1123561 - RNA, 19 nt, Mycobacterium bovis subsp bovis AF2122/97
caagcgccaacaacccaac

SEQ ID NO: 1123562 - RNA, 16 nt, Mycobacterium bovis subsp bovis AF2122/97
caagcgccgcgcuugc

SEQ ID NO: 1123563 - RNA, 17 nt, Mycobacterium bovis subsp bovis AF2122/97
caagcgcagacacgacc

SEQ ID NO: 1123564 - RNA, 22 nt, Mycobacterium bovis subsp bovis AF2122/97
caagcgauccgagaccgcgugc

SEQ ID NO: 1123565 - RNA, 12 nt, Mycobacterium bovis subsp bovis AF2122/97
caagcgauggca

SEQ ID NO: 1123566 - RNA, 23 nt, Mycobacterium bovis subsp bovis AF2122/97
caagcuguuuggggucgcgcugc

SEQ ID NO: 1123567 - RNA, 16 nt, Mycobacterium bovis subsp bovis AF2122/97
caaggaacggcgucgu

SEQ ID NO: 1123568 - RNA, 12 nt, Mycobacterium bovis subsp bovis AF2122/97
caagcucguccg

SEQ ID NO: 1123569 - RNA, 14 nt, Mycobacterium bovis subsp bovis AF2122/97
caagcugaccgcca

SEQ ID NO: 1123570 - RNA, 14 nt, Mycobacterium bovis subsp bovis AF2122/97
caagcucugcgucg

SEQ ID NO: 1123571 - RNA, 15 nt, Mycobacterium bovis subsp bovis AF2122/97
caagcucugcgucgu

SEQ ID NO: 1123572 - RNA, 15 nt, Mycobacterium bovis subsp bovis AF2122/97
caagcucggccagca

SEQ ID NO: 1123573 - RNA, 21 nt, Mycobacterium bovis subsp bovis AF2122/97
caagcuccucgcgagucggcg

SEQ ID NO: 1123574 - RNA, 13 nt, Mycobacterium bovis subsp bovis AF2122/97
caagcucggucaa

SEQ ID NO: 1123575 - RNA, 13 nt, Mycobacterium bovis subsp bovis AF2122/97
caacggcggaucg

SEQ ID NO: 1123576 - RNA, 18 nt, Mycobacterium bovis subsp bovis AF2122/97
caacggcggaucggcggc

SEQ ID NO: 1123577 - RNA, 19 nt, Mycobacterium bovis subsp bovis AF2122/97
caacggcggaucggcggcc

SEQ ID NO: 1123578 - RNA, 20 nt, Mycobacterium bovis subsp bovis AF2122/97
caacggcggaucggcggccg

SEQ ID NO: 1123579 - RNA, 16 nt, Mycobacterium bovis subsp bovis AF2122/97
caacggcggcaacggc

SEQ ID NO: 1123580 - RNA, 19 nt, Mycobacterium bovis subsp bovis AF2122/97
caacgcuucggcgugcgug

SEQ ID NO: 1123581 - RNA, 18 nt, Mycobacterium bovis subsp bovis AF2122/97
caacgcuucugccugcgc

SEQ ID NO: 1123582 - RNA, 13 nt, Mycobacterium bovis subsp bovis AF2122/97
caacgcugggcgg

SEQ ID NO: 1123583 - RNA, 12 nt, Mycobacterium bovis subsp bovis AF2122/97
caacgcugcggc

SEQ ID NO: 1123584 - RNA, 23 nt, Mycobacterium bovis subsp bovis AF2122/97
caacggcgcgccgaccaccgcug

SEQ ID NO: 1123585 - RNA, 15 nt, Mycobacterium bovis subsp bovis AF2122/97
caacgcuucggcacg

SEQ ID NO: 1123586 - RNA, 16 nt, Mycobacterium bovis subsp bovis AF2122/97
caacgcuucggcacgc

SEQ ID NO: 1123587 - RNA, 14 nt, Mycobacterium bovis subsp bovis AF2122/97
caacgcuucggcag

SEQ ID NO: 1123588 - RNA, 18 nt, Mycobacterium bovis subsp bovis AF2122/97
caacgcuucggcagcucc

SEQ ID NO: 1123589 - RNA, 15 nt, Mycobacterium bovis subsp bovis AF2122/97
caacgcgugcgcauc

SEQ ID NO: 1123590 - RNA, 21 nt, Mycobacterium bovis subsp bovis AF2122/97
caacgcguugcacagcagcgg

SEQ ID NO: 1123591 - RNA, 16 nt, Mycobacterium bovis subsp bovis AF2122/97
caacgcgggcgcuugc

SEQ ID NO: 1123592 - RNA, 19 nt, Mycobacterium bovis subsp bovis AF2122/97
caacgcggucugcuccagg

SEQ ID NO: 1123593 - RNA, 20 nt, Mycobacterium bovis subsp bovis AF2122/97
caacgaucgcgcgagcgaug

SEQ ID NO: 1123594 - RNA, 14 nt, Mycobacterium bovis subsp bovis AF2122/97
caacgcgucggucg

SEQ ID NO: 1123595 - RNA, 22 nt, Mycobacterium bovis subsp bovis AF2122/97
caacgcguugcacagcagcggu

SEQ ID NO: 1123596 - RNA, 20 nt, Mycobacterium bovis subsp bovis AF2122/97
caacgcguauucggcaucgc

SEQ ID NO: 1123597 - RNA, 14 nt, Mycobacterium bovis subsp bovis AF2122/97
caacgcgucccgcc

SEQ ID NO: 1123598 - RNA, 12 nt, Mycobacterium bovis subsp bovis AF2122/97
caacgcggugcc

SEQ ID NO: 1123599 - RNA, 14 nt, Mycobacterium bovis subsp bovis AF2122/97
caacgcggugccgg

SEQ ID NO: 1123600 - RNA, 22 nt, Mycobacterium bovis subsp bovis AF2122/97
caacgcggugggcacagccagu

SEQ ID NO: 1123601 - RNA, 21 nt, Mycobacterium bovis subsp bovis AF2122/97
caacgagucagugccaucuac

SEQ ID NO: 1123602 - RNA, 17 nt, Mycobacterium bovis subsp bovis AF2122/97
caacgaggccgacgaca

SEQ ID NO: 1123603 - RNA, 21 nt, Mycobacterium bovis subsp bovis AF2122/97
caacgaggucugcggccgaua

SEQ ID NO: 1123604 - RNA, 21 nt, Mycobacterium bovis subsp bovis AF2122/97
caacgagcaggauaaacccgg

SEQ ID NO: 1123605 - RNA, 22 nt, Mycobacterium bovis subsp bovis AF2122/97
caacgagcaggauaaacccggc

SEQ ID NO: 1123606 - RNA, 17 nt, Mycobacterium bovis subsp bovis AF2122/97
caacgacuguggcgccg

SEQ ID NO: 1123607 - RNA, 20 nt, Mycobacterium bovis subsp bovis AF2122/97
caacgacuguggcgccgccg

SEQ ID NO: 1123608 - RNA, 21 nt, Mycobacterium bovis subsp bovis AF2122/97
caacgacuucgggaacgcucg

SEQ ID NO: 1123609 - RNA, 14 nt, Mycobacterium bovis subsp bovis AF2122/97
caacgaugguggcg

SEQ ID NO: 1123610 - RNA, 18 nt, Mycobacterium bovis subsp bovis AF2122/97
caacgauggaacgggcgg

SEQ ID NO: 1123611 - RNA, 12 nt, Mycobacterium bovis subsp bovis AF2122/97
caacgaucaggu

SEQ ID NO: 1123612 - RNA, 19 nt, Mycobacterium bovis subsp bovis AF2122/97
caacgaucagguuggcggc

SEQ ID NO: 1123613 - RNA, 20 nt, Mycobacterium bovis subsp bovis AF2122/97
caacgaucccggggugccga

SEQ ID NO: 1123614 - RNA, 13 nt, Mycobacterium bovis subsp bovis AF2122/97
caacgaucgcgcc

SEQ ID NO: 1123615 - RNA, 14 nt, Mycobacterium bovis subsp bovis AF2122/97
caacgaucgcgccg

SEQ ID NO: 1123616 - RNA, 15 nt, Mycobacterium bovis subsp bovis AF2122/97
caacgaucgcgccgu

SEQ ID NO: 1123617 - RNA, 21 nt, Mycobacterium bovis subsp bovis AF2122/97
caacgaucgcgccgucgucga

SEQ ID NO: 1123618 - RNA, 16 nt, Mycobacterium bovis subsp bovis AF2122/97
caaccuggggccacca

SEQ ID NO: 1123619 - RNA, 18 nt, Mycobacterium bovis subsp bovis AF2122/97
caaccugcgcggcgaucg

SEQ ID NO: 1123620 - RNA, 22 nt, Mycobacterium bovis subsp bovis AF2122/97
caaccuggacugcagcgccucg

SEQ ID NO: 1123621 - RNA, 23 nt, Mycobacterium bovis subsp bovis AF2122/97
caaccuggacugggucgccuccu

SEQ ID NO: 1123622 - RNA, 20 nt, Mycobacterium bovis subsp bovis AF2122/97
caacgacgucgucgccgccg

SEQ ID NO: 1123623 - RNA, 19 nt, Mycobacterium bovis subsp bovis AF2122/97
caaccugggaaugacggag

SEQ ID NO: 1123624 - RNA, 18 nt, Mycobacterium bovis subsp bovis AF2122/97
caaccugaaccggccgcg

SEQ ID NO: 1123625 - RNA, 15 nt, Mycobacterium bovis subsp bovis AF2122/97
caaccugccgggcca

SEQ ID NO: 1123626 - RNA, 18 nt, Mycobacterium bovis subsp bovis AF2122/97
caaccugccgggccacgg

SEQ ID NO: 1123627 - RNA, 16 nt, Mycobacterium bovis subsp bovis AF2122/97
caaccugcgcggcgau

SEQ ID NO: 1123628 - RNA, 17 nt, Mycobacterium bovis subsp bovis AF2122/97
caacggcuccgggcgcu

SEQ ID NO: 1123629 - RNA, 17 nt, Mycobacterium bovis subsp bovis AF2122/97
caacggcguuggcgccg

SEQ ID NO: 1123630 - RNA, 15 nt, Mycobacterium bovis subsp bovis AF2122/97
caacggcggcgucgc

SEQ ID NO: 1123631 - RNA, 18 nt, Mycobacterium bovis subsp bovis AF2122/97
caacggcggcaggccggc

SEQ ID NO: 1123632 - RNA, 22 nt, Mycobacterium bovis subsp bovis AF2122/97
caacggcggcaggccggccacc

SEQ ID NO: 1123633 - RNA, 17 nt, Mycobacterium bovis subsp bovis AF2122/97
caacggcggcaucggcg

SEQ ID NO: 1123634 - RNA, 17 nt, Mycobacterium bovis subsp bovis AF2122/97
caacggcggcgacggcg

SEQ ID NO: 1123635 - RNA, 19 nt, Mycobacterium bovis subsp bovis AF2122/97
caacggcggcgacggcgga

SEQ ID NO: 1123636 - RNA, 13 nt, Mycobacterium bovis subsp bovis AF2122/97
caacggcggcgca

SEQ ID NO: 1123637 - RNA, 17 nt, Mycobacterium bovis subsp bovis AF2122/97
caacggcggggccggcg

SEQ ID NO: 1123638 - RNA, 19 nt, Mycobacterium bovis subsp bovis AF2122/97
caacggcggggccggcggc

SEQ ID NO: 1123639 - RNA, 18 nt, Mycobacterium bovis subsp bovis AF2122/97
caacggcgguaacggcgg

SEQ ID NO: 1123640 - RNA, 17 nt, Mycobacterium bovis subsp bovis AF2122/97
caacggcggcgucgcgg

SEQ ID NO: 1123641 - RNA, 20 nt, Mycobacterium bovis subsp bovis AF2122/97
caacggcggcgucgcgguug

SEQ ID NO: 1123642 - RNA, 15 nt, Mycobacterium bovis subsp bovis AF2122/97
caacggcggcguggg

SEQ ID NO: 1123643 - RNA, 23 nt, Mycobacterium bovis subsp bovis AF2122/97
caacgucuucacucacgacgccg

SEQ ID NO: 1123644 - RNA, 23 nt, Mycobacterium bovis subsp bovis AF2122/97
caacgucgacuucagcggccggu

SEQ ID NO: 1123645 - RNA, 14 nt, Mycobacterium bovis subsp bovis AF2122/97
caacgucgccgcgg

SEQ ID NO: 1123646 - RNA, 18 nt, Mycobacterium bovis subsp bovis AF2122/97
caacgucgccgcggcggc

SEQ ID NO: 1123647 - RNA, 22 nt, Mycobacterium bovis subsp bovis AF2122/97
caacgucgccgcggcggcagcg

SEQ ID NO: 1123648 - RNA, 23 nt, Mycobacterium bovis subsp bovis AF2122/97
caacgucgcguucuccggcaccg

SEQ ID NO: 1123649 - RNA, 13 nt, Mycobacterium bovis subsp bovis AF2122/97
caacgucgcuccg

SEQ ID NO: 1123650 - RNA, 16 nt, Mycobacterium bovis subsp bovis AF2122/97
caacgggauccgcgcg

SEQ ID NO: 1123651 - RNA, 21 nt, Mycobacterium bovis subsp bovis AF2122/97
caacgggauccgcgcgcugga

SEQ ID NO: 1123652 - RNA, 20 nt, Mycobacterium bovis subsp bovis AF2122/97
caacgugcgcaacgcgucgu

SEQ ID NO: 1123653 - RNA, 17 nt, Mycobacterium bovis subsp bovis AF2122/97
caacgugugcaccauca

SEQ ID NO: 1123654 - RNA, 20 nt, Mycobacterium bovis subsp bovis AF2122/97
caacgugguauugacguggc

SEQ ID NO: 1123655 - RNA, 21 nt, Mycobacterium bovis subsp bovis AF2122/97
caacgugucccaagccugccg

SEQ ID NO: 1123656 - RNA, 19 nt, Mycobacterium bovis subsp bovis AF2122/97
caacguucaacgacggcaa

SEQ ID NO: 1123657 - RNA, 22 nt, Mycobacterium bovis subsp bovis AF2122/97
caacguucggcacaaccaacga

SEQ ID NO: 1123658 - RNA, 16 nt, Mycobacterium bovis subsp bovis AF2122/97
caacguugcgccagcg

SEQ ID NO: 1123659 - RNA, 21 nt, Mycobacterium bovis subsp bovis AF2122/97
caacguugcgccagcggugga

SEQ ID NO: 1123660 - RNA, 16 nt, Mycobacterium bovis subsp bovis AF2122/97
caacucauagaccagu

SEQ ID NO: 1123661 - RNA, 23 nt, Mycobacterium bovis subsp bovis AF2122/97
caacucaggccgguaccgggacg

SEQ ID NO: 1123662 - RNA, 13 nt, Mycobacterium bovis subsp bovis AF2122/97
caacucaggccgg

SEQ ID NO: 1123663 - RNA, 19 nt, Mycobacterium bovis subsp bovis AF2122/97
caacuaucgucgugucgcc

SEQ ID NO: 1123664 - RNA, 14 nt, Mycobacterium bovis subsp bovis AF2122/97
caacuccacgcgga

SEQ ID NO: 1123665 - RNA, 19 nt, Mycobacterium bovis subsp bovis AF2122/97
caacuccaagaugccgccc

SEQ ID NO: 1123666 - RNA, 16 nt, Mycobacterium bovis subsp bovis AF2122/97
caacuacgccagccgc

SEQ ID NO: 1123667 - RNA, 23 nt, Mycobacterium bovis subsp bovis AF2122/97
caacuacggcguccccgacaacg

SEQ ID NO: 1123668 - RNA, 23 nt, Mycobacterium bovis subsp bovis AF2122/97
caacuacucauccagaagccggc

SEQ ID NO: 1123669 - RNA, 20 nt, Mycobacterium bovis subsp bovis AF2122/97
caacguuuugggcgccggag

SEQ ID NO: 1123670 - RNA, 14 nt, Mycobacterium bovis subsp bovis AF2122/97
caaccaccggccgc

SEQ ID NO: 1123671 - RNA, 15 nt, Mycobacterium bovis subsp bovis AF2122/97
caaccaccggccgcg

SEQ ID NO: 1123672 - RNA, 15 nt, Mycobacterium bovis subsp bovis AF2122/97
caaccaccgguccag

SEQ ID NO: 1123673 - RNA, 21 nt, Mycobacterium bovis subsp bovis AF2122/97
caaccaccgguccagcgccgg

SEQ ID NO: 1123674 - RNA, 23 nt, Mycobacterium bovis subsp bovis AF2122/97
caaccacgaaagcguaaggccgg

SEQ ID NO: 1123675 - RNA, 19 nt, Mycobacterium bovis subsp bovis AF2122/97
caaccacgcacgguggcuc

SEQ ID NO: 1123676 - RNA, 16 nt, Mycobacterium bovis subsp bovis AF2122/97
caaccaagcgugccug

SEQ ID NO: 1123677 - RNA, 20 nt, Mycobacterium bovis subsp bovis AF2122/97
caaccaauaggugucgacgc

SEQ ID NO: 1123678 - RNA, 16 nt, Mycobacterium bovis subsp bovis AF2122/97
caacauuggugaggug

SEQ ID NO: 1123679 - RNA, 16 nt, Mycobacterium bovis subsp bovis AF2122/97
caaccaaccggucacg

SEQ ID NO: 1123680 - RNA, 18 nt, Mycobacterium bovis subsp bovis AF2122/97
caacccgaucucugcggc

SEQ ID NO: 1123681 - RNA, 21 nt, Mycobacterium bovis subsp bovis AF2122/97
caacccgaucucugcggcggu

SEQ ID NO: 1123682 - RNA, 18 nt, Mycobacterium bovis subsp bovis AF2122/97
caacccgcaccccggccg

SEQ ID NO: 1123683 - RNA, 16 nt, Mycobacterium bovis subsp bovis AF2122/97
caaccccgccggccgg

SEQ ID NO: 1123684 - RNA, 12 nt, Mycobacterium bovis subsp bovis AF2122/97
caacacgucgag

SEQ ID NO: 1123685 - RNA, 19 nt, Mycobacterium bovis subsp bovis AF2122/97
caacacgucgagcagccgc

SEQ ID NO: 1123686 - RNA, 22 nt, Mycobacterium bovis subsp bovis AF2122/97
caacauguugucgucgccgccg

SEQ ID NO: 1123687 - RNA, 19 nt, Mycobacterium bovis subsp bovis AF2122/97
caacaccucgucacccggu

SEQ ID NO: 1123688 - RNA, 15 nt, Mycobacterium bovis subsp bovis AF2122/97
caacaccucgucggc

SEQ ID NO: 1123689 - RNA, 13 nt, Mycobacterium bovis subsp bovis AF2122/97
caacaccgguguc

SEQ ID NO: 1123690 - RNA, 19 nt, Mycobacterium bovis subsp bovis AF2122/97
caacaccgucggcagcagc

SEQ ID NO: 1123691 - RNA, 21 nt, Mycobacterium bovis subsp bovis AF2122/97
caacaccgucggcagcagcgg

SEQ ID NO: 1123692 - RNA, 13 nt, Mycobacterium bovis subsp bovis AF2122/97
caacacgccgucg

SEQ ID NO: 1123693 - RNA, 17 nt, Mycobacterium bovis subsp bovis AF2122/97
caacacgccgucgaccg

SEQ ID NO: 1123694 - RNA, 24 nt, Mycobacterium bovis subsp bovis AF2122/97
caacacggcgaaccggcccaccga

SEQ ID NO: 1123695 - RNA, 20 nt, Mycobacterium bovis subsp bovis AF2122/97
caacaccucaccgcggaucg

SEQ ID NO: 1123696 - RNA, 17 nt, Mycobacterium bovis subsp bovis AF2122/97
caaccgguagccaggcg

SEQ ID NO: 1123697 - RNA, 19 nt, Mycobacterium bovis subsp bovis AF2122/97
caaccgguagccaggcgcg

SEQ ID NO: 1123698 - RNA, 16 nt, Mycobacterium bovis subsp bovis AF2122/97
caaccggucacgucga

SEQ ID NO: 1123699 - RNA, 18 nt, Mycobacterium bovis subsp bovis AF2122/97
caaccggucacgucgaug

SEQ ID NO: 1123700 - RNA, 18 nt, Mycobacterium bovis subsp bovis AF2122/97
caaccggucagccugcca

SEQ ID NO: 1123701 - RNA, 19 nt, Mycobacterium bovis subsp bovis AF2122/97
caaccgggucagcccagcc

SEQ ID NO: 1123702 - RNA, 20 nt, Mycobacterium bovis subsp bovis AF2122/97
caaccgggugugcgucgagg

SEQ ID NO: 1123703 - RNA, 19 nt, Mycobacterium bovis subsp bovis AF2122/97
caaccggguguggucggug

SEQ ID NO: 1123704 - RNA, 19 nt, Mycobacterium bovis subsp bovis AF2122/97
caaccgggaucugcuccgc

SEQ ID NO: 1123705 - RNA, 19 nt, Mycobacterium bovis subsp bovis AF2122/97
caaccggacgaccggaacg

SEQ ID NO: 1123706 - RNA, 15 nt, Mycobacterium bovis subsp bovis AF2122/97
caaccggcgaucggu

SEQ ID NO: 1123707 - RNA, 22 nt, Mycobacterium bovis subsp bovis AF2122/97
caaccggcgcaguagccgacca

SEQ ID NO: 1123708 - RNA, 15 nt, Mycobacterium bovis subsp bovis AF2122/97
caaccggcggacacc

SEQ ID NO: 1123709 - RNA, 14 nt, Mycobacterium bovis subsp bovis AF2122/97
caaccgggacaacc

SEQ ID NO: 1123710 - RNA, 15 nt, Mycobacterium bovis subsp bovis AF2122/97
caaccgggacaaccc

SEQ ID NO: 1123711 - RNA, 15 nt, Mycobacterium bovis subsp bovis AF2122/97
caaccguccggggcc

SEQ ID NO: 1123712 - RNA, 22 nt, Mycobacterium bovis subsp bovis AF2122/97
caaccggucgucugucucggug

SEQ ID NO: 1123713 - RNA, 15 nt, Mycobacterium bovis subsp bovis AF2122/97
caaccggucgugguc

SEQ ID NO: 1123714 - RNA, 21 nt, Mycobacterium bovis subsp bovis AF2122/97
caaccgguguaauugccgacg

SEQ ID NO: 1123715 - RNA, 22 nt, Mycobacterium bovis subsp bovis AF2122/97
caaccgguguaauugccgacgc

SEQ ID NO: 1123716 - RNA, 15 nt, Mycobacterium bovis subsp bovis AF2122/97
caaccgugagcacca

SEQ ID NO: 1123717 - RNA, 17 nt, Mycobacterium bovis subsp bovis AF2122/97
caaccgugagcaccagc

SEQ ID NO: 1123718 - RNA, 17 nt, Mycobacterium bovis subsp bovis AF2122/97
caaccucaucgcggucg

SEQ ID NO: 1123719 - RNA, 17 nt, Mycobacterium bovis subsp bovis AF2122/97
caaccucaugcacgccg

SEQ ID NO: 1123720 - RNA, 22 nt, Mycobacterium bovis subsp bovis AF2122/97
caaccgccgugugccacggggc

SEQ ID NO: 1123721 - RNA, 19 nt, Mycobacterium bovis subsp bovis AF2122/97
caaccgcggccccgacugc

SEQ ID NO: 1123722 - RNA, 23 nt, Mycobacterium bovis subsp bovis AF2122/97
caaccgcuuugaauugcgcgccc

SEQ ID NO: 1123723 - RNA, 16 nt, Mycobacterium bovis subsp bovis AF2122/97
caaccgcugucaccgu

SEQ ID NO: 1123724 - RNA, 19 nt, Mycobacterium bovis subsp bovis AF2122/97
caaccgcugucaccguacg

SEQ ID NO: 1123725 - RNA, 19 nt, Mycobacterium bovis subsp bovis AF2122/97
caaccgcucaucgaucaca

SEQ ID NO: 1123726 - RNA, 12 nt, Mycobacterium bovis subsp bovis AF2122/97
caacccgcucgg

SEQ ID NO: 1123727 - RNA, 18 nt, Mycobacterium bovis subsp bovis AF2122/97
caacccggauaggacgaa

SEQ ID NO: 1123728 - RNA, 22 nt, Mycobacterium bovis subsp bovis AF2122/97
caacccgccguugccaccggug

SEQ ID NO: 1123729 - RNA, 14 nt, Mycobacterium bovis subsp bovis AF2122/97
caaccgcaggccga

SEQ ID NO: 1123730 - RNA, 19 nt, Mycobacterium bovis subsp bovis AF2122/97
caaccgcaggccgaagacg

SEQ ID NO: 1123731 - RNA, 15 nt, Mycobacterium bovis subsp bovis AF2122/97
caaccgagcggucga

SEQ ID NO: 1123732 - RNA, 15 nt, Mycobacterium bovis subsp bovis AF2122/97
caacaccggcaucgc

SEQ ID NO: 1123733 - RNA, 17 nt, Mycobacterium bovis subsp bovis AF2122/97
caacaccgcgucaacgc

SEQ ID NO: 1123734 - RNA, 14 nt, Mycobacterium bovis subsp bovis AF2122/97
caacaccgcggccg

SEQ ID NO: 1123735 - RNA, 15 nt, Mycobacterium bovis subsp bovis AF2122/97
caacaccgcggccga

SEQ ID NO: 1123736 - RNA, 13 nt, Mycobacterium bovis subsp bovis AF2122/97
caacaccgcggcg

SEQ ID NO: 1123737 - RNA, 14 nt, Mycobacterium bovis subsp bovis AF2122/97
caacaccgcgccga

SEQ ID NO: 1123738 - RNA, 17 nt, Mycobacterium bovis subsp bovis AF2122/97
caacaccgcgccgacga

SEQ ID NO: 1123739 - RNA, 14 nt, Mycobacterium bovis subsp bovis AF2122/97
caacaccgcaccgg

SEQ ID NO: 1123740 - RNA, 14 nt, Mycobacterium bovis subsp bovis AF2122/97
caacaccgccaacu

SEQ ID NO: 1123741 - RNA, 13 nt, Mycobacterium bovis subsp bovis AF2122/97
caacaccgccagc

SEQ ID NO: 1123742 - RNA, 14 nt, Mycobacterium bovis subsp bovis AF2122/97
caacaccagcagca

SEQ ID NO: 1123743 - RNA, 16 nt, Mycobacterium bovis subsp bovis AF2122/97
caacaccagccggucg

SEQ ID NO: 1123744 - RNA, 16 nt, Mycobacterium bovis subsp bovis AF2122/97
caacaccacuagcggc

SEQ ID NO: 1123745 - RNA, 19 nt, Mycobacterium bovis subsp bovis AF2122/97
caacaccccccguccaccg

SEQ ID NO: 1123746 - RNA, 13 nt, Mycobacterium bovis subsp bovis AF2122/97
caacacccgcccg

SEQ ID NO: 1123747 - RNA, 14 nt, Mycobacterium bovis subsp bovis AF2122/97
caacacccgcccgg

SEQ ID NO: 1123748 - RNA, 18 nt, Mycobacterium bovis subsp bovis AF2122/97
caacacccgcccgggcgu

SEQ ID NO: 1123749 - RNA, 13 nt, Mycobacterium bovis subsp bovis AF2122/97
caacacccgccgg

SEQ ID NO: 1123750 - RNA, 18 nt, Mycobacterium bovis subsp bovis AF2122/97
caacaccaccucgacgag

SEQ ID NO: 1123751 - RNA, 14 nt, Mycobacterium bovis subsp bovis AF2122/97
caacacccgggcga

SEQ ID NO: 1123752 - RNA, 22 nt, Mycobacterium bovis subsp bovis AF2122/97
caacacacugaagaucgcgccc

SEQ ID NO: 1123753 - RNA, 14 nt, Mycobacterium bovis subsp bovis AF2122/97
caacaaacccggcc

SEQ ID NO: 1123754 - RNA, 16 nt, Mycobacterium bovis subsp bovis AF2122/97
caacaacgucugcagc

SEQ ID NO: 1123755 - RNA, 21 nt, Mycobacterium bovis subsp bovis AF2122/97
caacaacgauguggccguggg

SEQ ID NO: 1123756 - RNA, 17 nt, Mycobacterium bovis subsp bovis AF2122/97
caacaaggggcagcacg

SEQ ID NO: 1123757 - RNA, 14 nt, Mycobacterium bovis subsp bovis AF2122/97
caaaucggcaucgg

SEQ ID NO: 1123758 - RNA, 17 nt, Mycobacterium bovis subsp bovis AF2122/97
caaaucggcaucggcga

SEQ ID NO: 1123759 - RNA, 23 nt, Mycobacterium bovis subsp bovis AF2122/97
caaaucgauguccaaugcaccgu

SEQ ID NO: 1123760 - RNA, 15 nt, Mycobacterium bovis subsp bovis AF2122/97
caaaucggucgacga

SEQ ID NO: 1123761 - RNA, 21 nt, Mycobacterium bovis subsp bovis AF2122/97
caaaucggucgacgaucucgc

SEQ ID NO: 1123762 - RNA, 22 nt, Mycobacterium bovis subsp bovis AF2122/97
caaaucguaggggucugcgucg

SEQ ID NO: 1123763 - RNA, 20 nt, Mycobacterium bovis subsp bovis AF2122/97
caaaugccccgaaccgcgcu

SEQ ID NO: 1123764 - RNA, 15 nt, Mycobacterium bovis subsp bovis AF2122/97
caaaucgucgauggu

SEQ ID NO: 1123765 - RNA, 14 nt, Mycobacterium bovis subsp bovis AF2122/97
caaaugcgcugucg

SEQ ID NO: 1123766 - RNA, 16 nt, Mycobacterium bovis subsp bovis AF2122/97
caaauccuucggcgug

SEQ ID NO: 1123767 - RNA, 16 nt, Mycobacterium bovis subsp bovis AF2122/97
caaaucaacggcgucg

SEQ ID NO: 1123768 - RNA, 19 nt, Mycobacterium bovis subsp bovis AF2122/97
caaaucaagcacagcccgg

SEQ ID NO: 1123769 - RNA, 21 nt, Mycobacterium bovis subsp bovis AF2122/97
caaaucaagcacagcccggcg

SEQ ID NO: 1123770 - RNA, 22 nt, Mycobacterium bovis subsp bovis AF2122/97
caaaucaagcacagcccggcga

SEQ ID NO: 1123771 - RNA, 15 nt, Mycobacterium bovis subsp bovis AF2122/97
caaauaggacugcgc

SEQ ID NO: 1123772 - RNA, 13 nt, Mycobacterium bovis subsp bovis AF2122/97
auugugcucgccg

SEQ ID NO: 1123773 - RNA, 15 nt, Mycobacterium bovis subsp bovis AF2122/97
auugugggacgcgau

SEQ ID NO: 1123774 - RNA, 14 nt, Mycobacterium bovis subsp bovis AF2122/97
caaacccagcgacg

SEQ ID NO: 1123775 - RNA, 15 nt, Mycobacterium bovis subsp bovis AF2122/97
caaacaccagcccgg

SEQ ID NO: 1123776 - RNA, 22 nt, Mycobacterium bovis subsp bovis AF2122/97
caaacacccuugcccacggcga

SEQ ID NO: 1123777 - RNA, 21 nt, Mycobacterium bovis subsp bovis AF2122/97
caaacaagaucagacccagcg

SEQ ID NO: 1123778 - RNA, 15 nt, Mycobacterium bovis subsp bovis AF2122/97
caaaauuuugucggc

SEQ ID NO: 1123779 - RNA, 16 nt, Mycobacterium bovis subsp bovis AF2122/97
caaagaaguggucggc

SEQ ID NO: 1123780 - RNA, 21 nt, Mycobacterium bovis subsp bovis AF2122/97
caaagaaguggucggcccgcu

SEQ ID NO: 1123781 - RNA, 17 nt, Mycobacterium bovis subsp bovis AF2122/97
caaagcgccagcagcca

SEQ ID NO: 1123782 - RNA, 15 nt, Mycobacterium bovis subsp bovis AF2122/97
caaagcugcucgucg

SEQ ID NO: 1123783 - RNA, 14 nt, Mycobacterium bovis subsp bovis AF2122/97
caaaggcgccguca

SEQ ID NO: 1123784 - RNA, 22 nt, Mycobacterium bovis subsp bovis AF2122/97
caaaggcuguaacacccggccg

SEQ ID NO: 1123785 - RNA, 23 nt, Mycobacterium bovis subsp bovis AF2122/97
caaaggcuguaacacccggccgc

SEQ ID NO: 1123786 - RNA, 14 nt, Mycobacterium bovis subsp bovis AF2122/97
caaacccgccgaca

SEQ ID NO: 1123787 - RNA, 19 nt, Mycobacterium bovis subsp bovis AF2122/97
caaaccgaucaauccgccc

SEQ ID NO: 1123788 - RNA, 19 nt, Mycobacterium bovis subsp bovis AF2122/97
caaacugggaugugccgcg

SEQ ID NO: 1123789 - RNA, 18 nt, Mycobacterium bovis subsp bovis AF2122/97
caaacugggcaccggcgg

SEQ ID NO: 1123790 - RNA, 18 nt, Mycobacterium bovis subsp bovis AF2122/97
augucggggccgucgucg

SEQ ID NO: 1123791 - RNA, 20 nt, Mycobacterium bovis subsp bovis AF2122/97
augucgggguuucaggcggc

SEQ ID NO: 1123792 - RNA, 16 nt, Mycobacterium bovis subsp bovis AF2122/97
augucggucggaucgg

SEQ ID NO: 1123793 - RNA, 16 nt, Mycobacterium bovis subsp bovis AF2122/97
augucggcgaugcguc

SEQ ID NO: 1123794 - RNA, 23 nt, Mycobacterium bovis subsp bovis AF2122/97
augucggcgaugcguccgcccag

SEQ ID NO: 1123795 - RNA, 17 nt, Mycobacterium bovis subsp bovis AF2122/97
augucggccaggucggc

SEQ ID NO: 1123796 - RNA, 22 nt, Mycobacterium bovis subsp bovis AF2122/97
augucggccgcgggucccggcc

SEQ ID NO: 1123797 - RNA, 23 nt, Mycobacterium bovis subsp bovis AF2122/97
augucggugacaccaacaccggu

SEQ ID NO: 1123798 - RNA, 20 nt, Mycobacterium bovis subsp bovis AF2122/97
augucggccaccggcgucug

SEQ ID NO: 1123799 - RNA, 13 nt, Mycobacterium bovis subsp bovis AF2122/97
augucggcaggua

SEQ ID NO: 1123800 - RNA, 17 nt, Mycobacterium bovis subsp bovis AF2122/97
augucaccccgcccagc

SEQ ID NO: 1123801 - RNA, 17 nt, Mycobacterium bovis subsp bovis AF2122/97
augucauagcgcaccac

SEQ ID NO: 1123802 - RNA, 17 nt, Mycobacterium bovis subsp bovis AF2122/97
augucagcggccugcuc

SEQ ID NO: 1123803 - RNA, 15 nt, Mycobacterium bovis subsp bovis AF2122/97
augucagggaugauc

SEQ ID NO: 1123804 - RNA, 20 nt, Mycobacterium bovis subsp bovis AF2122/97
augucggugaggaagcggcc

SEQ ID NO: 1123805 - RNA, 13 nt, Mycobacterium bovis subsp bovis AF2122/97
augucgucgacca

SEQ ID NO: 1123806 - RNA, 13 nt, Mycobacterium bovis subsp bovis AF2122/97
augucgucgacga

SEQ ID NO: 1123807 - RNA, 23 nt, Mycobacterium bovis subsp bovis AF2122/97
augucgucgacgaggucagcggu

SEQ ID NO: 1123808 - RNA, 22 nt, Mycobacterium bovis subsp bovis AF2122/97
augucgucuuuggucagccgau

SEQ ID NO: 1123809 - RNA, 17 nt, Mycobacterium bovis subsp bovis AF2122/97
augucggcgcgccgcac

SEQ ID NO: 1123810 - RNA, 18 nt, Mycobacterium bovis subsp bovis AF2122/97
augucuaccaacaccgcc

SEQ ID NO: 1123811 - RNA, 16 nt, Mycobacterium bovis subsp bovis AF2122/97
augucguuggccaccu

SEQ ID NO: 1123812 - RNA, 15 nt, Mycobacterium bovis subsp bovis AF2122/97
augucguugucugcc

SEQ ID NO: 1123813 - RNA, 19 nt, Mycobacterium bovis subsp bovis AF2122/97
augucuccaguagccggug

SEQ ID NO: 1123814 - RNA, 16 nt, Mycobacterium bovis subsp bovis AF2122/97
augucuccgacauugg

SEQ ID NO: 1123815 - RNA, 23 nt, Mycobacterium bovis subsp bovis AF2122/97
augucuccgacauuggccgucau

SEQ ID NO: 1123816 - RNA, 18 nt, Mycobacterium bovis subsp bovis AF2122/97
auguugaaaaggcgcugg

SEQ ID NO: 1123817 - RNA, 21 nt, Mycobacterium bovis subsp bovis AF2122/97
auguucggggcgcaccacgau

SEQ ID NO: 1123818 - RNA, 13 nt, Mycobacterium bovis subsp bovis AF2122/97
auguugaccggcu

SEQ ID NO: 1123819 - RNA, 18 nt, Mycobacterium bovis subsp bovis AF2122/97
auguucagguugcugauc

SEQ ID NO: 1123820 - RNA, 14 nt, Mycobacterium bovis subsp bovis AF2122/97
auguucauccgcag

SEQ ID NO: 1123821 - RNA, 18 nt, Mycobacterium bovis subsp bovis AF2122/97
augugaguccagccggcg

SEQ ID NO: 1123822 - RNA, 21 nt, Mycobacterium bovis subsp bovis AF2122/97
augugacaucgggccgccgag

SEQ ID NO: 1123823 - RNA, 16 nt, Mycobacterium bovis subsp bovis AF2122/97
augugugagucccacg

SEQ ID NO: 1123824 - RNA, 16 nt, Mycobacterium bovis subsp bovis AF2122/97
auguggccggcgaugg

SEQ ID NO: 1123825 - RNA, 19 nt, Mycobacterium bovis subsp bovis AF2122/97
auguggccgccgucgacgu

SEQ ID NO: 1123826 - RNA, 20 nt, Mycobacterium bovis subsp bovis AF2122/97
auguggugugccugcgucuc

SEQ ID NO: 1123827 - RNA, 22 nt, Mycobacterium bovis subsp bovis AF2122/97
auguggcgucgcucgucgucac

SEQ ID NO: 1123828 - RNA, 17 nt, Mycobacterium bovis subsp bovis AF2122/97
augggccggcgccgcac

SEQ ID NO: 1123829 - RNA, 16 nt, Mycobacterium bovis subsp bovis AF2122/97
augggauggcaccacc

SEQ ID NO: 1123830 - RNA, 21 nt, Mycobacterium bovis subsp bovis AF2122/97
augggacacaauccacgucgc

SEQ ID NO: 1123831 - RNA, 22 nt, Mycobacterium bovis subsp bovis AF2122/97
augggacacaauccacgucgcg

SEQ ID NO: 1123832 - RNA, 18 nt, Mycobacterium bovis subsp bovis AF2122/97
augggcgagaaguccggg

SEQ ID NO: 1123833 - RNA, 20 nt, Mycobacterium bovis subsp bovis AF2122/97
augggcgauaaggaccgcgc

SEQ ID NO: 1123834 - RNA, 22 nt, Mycobacterium bovis subsp bovis AF2122/97
augggcgauaaggaccgcgccc

SEQ ID NO: 1123835 - RNA, 13 nt, Mycobacterium bovis subsp bovis AF2122/97
auggggaacgggu

SEQ ID NO: 1123836 - RNA, 14 nt, Mycobacterium bovis subsp bovis AF2122/97
augggggagccggu

SEQ ID NO: 1123837 - RNA, 15 nt, Mycobacterium bovis subsp bovis AF2122/97
augggggagccggug

SEQ ID NO: 1123838 - RNA, 20 nt, Mycobacterium bovis subsp bovis AF2122/97
augggcugaggaacgccggc

SEQ ID NO: 1123839 - RNA, 19 nt, Mycobacterium bovis subsp bovis AF2122/97
augggcugcgcgucgagca

SEQ ID NO: 1123840 - RNA, 16 nt, Mycobacterium bovis subsp bovis AF2122/97
auggcgaaccgucagc

SEQ ID NO: 1123841 - RNA, 19 nt, Mycobacterium bovis subsp bovis AF2122/97
auggcgaacacgucggcca

SEQ ID NO: 1123842 - RNA, 15 nt, Mycobacterium bovis subsp bovis AF2122/97
auggcgagcgcgcca

SEQ ID NO: 1123843 - RNA, 20 nt, Mycobacterium bovis subsp bovis AF2122/97
auggcgaguacggccugccg

SEQ ID NO: 1123844 - RNA, 20 nt, Mycobacterium bovis subsp bovis AF2122/97
auggcgaugagguggccgcg

SEQ ID NO: 1123845 - RNA, 14 nt, Mycobacterium bovis subsp bovis AF2122/97
auggcgaugcgcgc

SEQ ID NO: 1123846 - RNA, 13 nt, Mycobacterium bovis subsp bovis AF2122/97
auggcuugcucug

SEQ ID NO: 1123847 - RNA, 17 nt, Mycobacterium bovis subsp bovis AF2122/97
augggagucgucguguu

SEQ ID NO: 1123848 - RNA, 15 nt, Mycobacterium bovis subsp bovis AF2122/97
auggggugacgcacc

SEQ ID NO: 1123849 - RNA, 21 nt, Mycobacterium bovis subsp bovis AF2122/97
augggguuaggaguggccggg

SEQ ID NO: 1123850 - RNA, 13 nt, Mycobacterium bovis subsp bovis AF2122/97
auggguagccgcc

SEQ ID NO: 1123851 - RNA, 17 nt, Mycobacterium bovis subsp bovis AF2122/97
augggucuuugcccgcc

SEQ ID NO: 1123852 - RNA, 20 nt, Mycobacterium bovis subsp bovis AF2122/97
augggugaaucgacagguca

SEQ ID NO: 1123853 - RNA, 16 nt, Mycobacterium bovis subsp bovis AF2122/97
auggguagccgcccag

SEQ ID NO: 1123854 - RNA, 16 nt, Mycobacterium bovis subsp bovis AF2122/97
augggugacgguggcc

SEQ ID NO: 1123855 - RNA, 19 nt, Mycobacterium bovis subsp bovis AF2122/97
auggguguugcuggccgcg

SEQ ID NO: 1123856 - RNA, 14 nt, Mycobacterium bovis subsp bovis AF2122/97
auggucaaccgcgc

SEQ ID NO: 1123857 - RNA, 14 nt, Mycobacterium bovis subsp bovis AF2122/97
auggguggccagca

SEQ ID NO: 1123858 - RNA, 21 nt, Mycobacterium bovis subsp bovis AF2122/97
auggguugacguaggcggcgg

SEQ ID NO: 1123859 - RNA, 15 nt, Mycobacterium bovis subsp bovis AF2122/97
auggguugccagcga

SEQ ID NO: 1123860 - RNA, 13 nt, Mycobacterium bovis subsp bovis AF2122/97
augguacccgcgc

SEQ ID NO: 1123861 - RNA, 18 nt, Mycobacterium bovis subsp bovis AF2122/97
augguacccgcgccgcgc

SEQ ID NO: 1123862 - RNA, 13 nt, Mycobacterium bovis subsp bovis AF2122/97
augguaccgccac

SEQ ID NO: 1123863 - RNA, 15 nt, Mycobacterium bovis subsp bovis AF2122/97
auggugggucgacga

SEQ ID NO: 1123864 - RNA, 16 nt, Mycobacterium bovis subsp bovis AF2122/97
augguggugccaaccu

SEQ ID NO: 1123865 - RNA, 17 nt, Mycobacterium bovis subsp bovis AF2122/97
augguggugaugccauc

SEQ ID NO: 1123866 - RNA, 19 nt, Mycobacterium bovis subsp bovis AF2122/97
augguguccucgucgaggu

SEQ ID NO: 1123867 - RNA, 21 nt, Mycobacterium bovis subsp bovis AF2122/97
auguaaguuguagacgucgac

SEQ ID NO: 1123868 - RNA, 22 nt, Mycobacterium bovis subsp bovis AF2122/97
augcggucgucacggaccgcca

SEQ ID NO: 1123869 - RNA, 23 nt, Mycobacterium bovis subsp bovis AF2122/97
augcggucgucacggaccgccac

SEQ ID NO: 1123870 - RNA, 18 nt, Mycobacterium bovis subsp bovis AF2122/97
augcgguuagcagccgcu

SEQ ID NO: 1123871 - RNA, 18 nt, Mycobacterium bovis subsp bovis AF2122/97
augcgguuccgauagccg

SEQ ID NO: 1123872 - RNA, 22 nt, Mycobacterium bovis subsp bovis AF2122/97
augcggugguaggacgccagca

SEQ ID NO: 1123873 - RNA, 14 nt, Mycobacterium bovis subsp bovis AF2122/97
augcggugacaacc

SEQ ID NO: 1123874 - RNA, 15 nt, Mycobacterium bovis subsp bovis AF2122/97
augcggucggccaca

SEQ ID NO: 1123875 - RNA, 15 nt, Mycobacterium bovis subsp bovis AF2122/97
augcgguccucgauc

SEQ ID NO: 1123876 - RNA, 16 nt, Mycobacterium bovis subsp bovis AF2122/97
augcgggucucgaccu

SEQ ID NO: 1123877 - RNA, 21 nt, Mycobacterium bovis subsp bovis AF2122/97
augcgggucugcggucaucgc

SEQ ID NO: 1123878 - RNA, 19 nt, Mycobacterium bovis subsp bovis AF2122/97
augcgggccaucaagcgau

SEQ ID NO: 1123879 - RNA, 17 nt, Mycobacterium bovis subsp bovis AF2122/97
augcggcggcgcucguc

SEQ ID NO: 1123880 - RNA, 21 nt, Mycobacterium bovis subsp bovis AF2122/97
augcgguuuggaucacccgcc

SEQ ID NO: 1123881 - RNA, 15 nt, Mycobacterium bovis subsp bovis AF2122/97
augcugagccgguca

SEQ ID NO: 1123882 - RNA, 12 nt, Mycobacterium bovis subsp bovis AF2122/97
augcugccgccg

SEQ ID NO: 1123883 - RNA, 21 nt, Mycobacterium bovis subsp bovis AF2122/97
augcugccgccgccgccggcg

SEQ ID NO: 1123884 - RNA, 22 nt, Mycobacterium bovis subsp bovis AF2122/97
augcugccgccgccgccggcgc

SEQ ID NO: 1123885 - RNA, 21 nt, Mycobacterium bovis subsp bovis AF2122/97
augcugccagccauggccgcc

SEQ ID NO: 1123886 - RNA, 22 nt, Mycobacterium bovis subsp bovis AF2122/97
augcugccagaucggucggcca

SEQ ID NO: 1123887 - RNA, 16 nt, Mycobacterium bovis subsp bovis AF2122/97
augcgauugccgucgu

SEQ ID NO: 1123888 - RNA, 14 nt, Mycobacterium bovis subsp bovis AF2122/97
augcgcaccagcac

SEQ ID NO: 1123889 - RNA, 19 nt, Mycobacterium bovis subsp bovis AF2122/97
augcgcaauagaccgcagu

SEQ ID NO: 1123890 - RNA, 16 nt, Mycobacterium bovis subsp bovis AF2122/97
augcgcaaccgcggcc

SEQ ID NO: 1123891 - RNA, 20 nt, Mycobacterium bovis subsp bovis AF2122/97
augcgauucugcgucugcuc

SEQ ID NO: 1123892 - RNA, 15 nt, Mycobacterium bovis subsp bovis AF2122/97
augcgauugccgucg

SEQ ID NO: 1123893 - RNA, 22 nt, Mycobacterium bovis subsp bovis AF2122/97
augcaugucaaguucgccagca

SEQ ID NO: 1123894 - RNA, 20 nt, Mycobacterium bovis subsp bovis AF2122/97
augcgauuccgcgucugcuc

SEQ ID NO: 1123895 - RNA, 15 nt, Mycobacterium bovis subsp bovis AF2122/97
augcgccaacccggc

SEQ ID NO: 1123896 - RNA, 16 nt, Mycobacterium bovis subsp bovis AF2122/97
augcgccgcacggcga

SEQ ID NO: 1123897 - RNA, 21 nt, Mycobacterium bovis subsp bovis AF2122/97
augcgccauuucgagggcaac

SEQ ID NO: 1123898 - RNA, 16 nt, Mycobacterium bovis subsp bovis AF2122/97
augcgccagcgagcgc

SEQ ID NO: 1123899 - RNA, 13 nt, Mycobacterium bovis subsp bovis AF2122/97
augcggcaggugc

SEQ ID NO: 1123900 - RNA, 22 nt, Mycobacterium bovis subsp bovis AF2122/97
augcggcaggugcccaucgggu

SEQ ID NO: 1123901 - RNA, 23 nt, Mycobacterium bovis subsp bovis AF2122/97
augcggccgcggaugcucagguc

SEQ ID NO: 1123902 - RNA, 23 nt, Mycobacterium bovis subsp bovis AF2122/97
augcggcccggguggcccggaac

SEQ ID NO: 1123903 - RNA, 22 nt, Mycobacterium bovis subsp bovis AF2122/97
auggccaggcuggcgucaccgc

SEQ ID NO: 1123904 - RNA, 15 nt, Mycobacterium bovis subsp bovis AF2122/97
auggccccgccaaac

SEQ ID NO: 1123905 - RNA, 12 nt, Mycobacterium bovis subsp bovis AF2122/97
auggccccgggc

SEQ ID NO: 1123906 - RNA, 15 nt, Mycobacterium bovis subsp bovis AF2122/97
auggccaccggcggu

SEQ ID NO: 1123907 - RNA, 19 nt, Mycobacterium bovis subsp bovis AF2122/97
auggccaccgaacgcggcc

SEQ ID NO: 1123908 - RNA, 16 nt, Mycobacterium bovis subsp bovis AF2122/97
auggccagcaccacgg

SEQ ID NO: 1123909 - RNA, 19 nt, Mycobacterium bovis subsp bovis AF2122/97
auggcagugucguggucgu

SEQ ID NO: 1123910 - RNA, 18 nt, Mycobacterium bovis subsp bovis AF2122/97
auggcaccaccccgaggc

SEQ ID NO: 1123911 - RNA, 14 nt, Mycobacterium bovis subsp bovis AF2122/97
auggcacugccggc

SEQ ID NO: 1123912 - RNA, 15 nt, Mycobacterium bovis subsp bovis AF2122/97
auggcacugccggca

SEQ ID NO: 1123913 - RNA, 16 nt, Mycobacterium bovis subsp bovis AF2122/97
auggcacugccggcac

SEQ ID NO: 1123914 - RNA, 21 nt, Mycobacterium bovis subsp bovis AF2122/97
auggcacugccggcacgccga

SEQ ID NO: 1123915 - RNA, 20 nt, Mycobacterium bovis subsp bovis AF2122/97
auggcaagucaacaccgcgg

SEQ ID NO: 1123916 - RNA, 16 nt, Mycobacterium bovis subsp bovis AF2122/97
auggauugcggcacgg

SEQ ID NO: 1123917 - RNA, 23 nt, Mycobacterium bovis subsp bovis AF2122/97
auggauguaggcuucgccgaguu

SEQ ID NO: 1123918 - RNA, 21 nt, Mycobacterium bovis subsp bovis AF2122/97
augcuggcggccucgccggcg

SEQ ID NO: 1123919 - RNA, 17 nt, Mycobacterium bovis subsp bovis AF2122/97
augcuggcgcagcgcca

SEQ ID NO: 1123920 - RNA, 19 nt, Mycobacterium bovis subsp bovis AF2122/97
augcuggcaaaguaucgca

SEQ ID NO: 1123921 - RNA, 20 nt, Mycobacterium bovis subsp bovis AF2122/97
augcugucagacggcgucug

SEQ ID NO: 1123922 - RNA, 19 nt, Mycobacterium bovis subsp bovis AF2122/97
augcugucggugccgucga

SEQ ID NO: 1123923 - RNA, 21 nt, Mycobacterium bovis subsp bovis AF2122/97
augcuuucguauucggccgcg

SEQ ID NO: 1123924 - RNA, 21 nt, Mycobacterium bovis subsp bovis AF2122/97
auggacggccaggugcagggu

SEQ ID NO: 1123925 - RNA, 14 nt, Mycobacterium bovis subsp bovis AF2122/97
auggaccgccgccg

SEQ ID NO: 1123926 - RNA, 15 nt, Mycobacterium bovis subsp bovis AF2122/97
auggaccgccgccga

SEQ ID NO: 1123927 - RNA, 16 nt, Mycobacterium bovis subsp bovis AF2122/97
auggaccgccgccgac

SEQ ID NO: 1123928 - RNA, 20 nt, Mycobacterium bovis subsp bovis AF2122/97
auggaaggcggccaggugca

SEQ ID NO: 1123929 - RNA, 20 nt, Mycobacterium bovis subsp bovis AF2122/97
auggaguggcuguacccgac

SEQ ID NO: 1123930 - RNA, 13 nt, Mycobacterium bovis subsp bovis AF2122/97
auggagccgcgac

SEQ ID NO: 1123931 - RNA, 12 nt, Mycobacterium bovis subsp bovis AF2122/97
auggagccggug

SEQ ID NO: 1123932 - RNA, 20 nt, Mycobacterium bovis subsp bovis AF2122/97
auggaucccacgaguuggcc

SEQ ID NO: 1123933 - RNA, 12 nt, Mycobacterium bovis subsp bovis AF2122/97
auuccggcgcca

SEQ ID NO: 1123934 - RNA, 16 nt, Mycobacterium bovis subsp bovis AF2122/97
auuccgcuaccgcaca

SEQ ID NO: 1123935 - RNA, 20 nt, Mycobacterium bovis subsp bovis AF2122/97
auuccggcucaccgaucccg

SEQ ID NO: 1123936 - RNA, 17 nt, Mycobacterium bovis subsp bovis AF2122/97
auuccgggugcgaucgc

SEQ ID NO: 1123937 - RNA, 15 nt, Mycobacterium bovis subsp bovis AF2122/97
auuccgguggcaucc

SEQ ID NO: 1123938 - RNA, 22 nt, Mycobacterium bovis subsp bovis AF2122/97
auuccgggccuggccugcccag

SEQ ID NO: 1123939 - RNA, 18 nt, Mycobacterium bovis subsp bovis AF2122/97
auuccguagccggcggug

SEQ ID NO: 1123940 - RNA, 22 nt, Mycobacterium bovis subsp bovis AF2122/97
auuccgcccacaugcgcucgcg

SEQ ID NO: 1123941 - RNA, 18 nt, Mycobacterium bovis subsp bovis AF2122/97
auuccgcgcguccgucgg

SEQ ID NO: 1123942 - RNA, 17 nt, Mycobacterium bovis subsp bovis AF2122/97
auuccgaccccgccgag

SEQ ID NO: 1123943 - RNA, 16 nt, Mycobacterium bovis subsp bovis AF2122/97
auucccuacgccgcca

SEQ ID NO: 1123944 - RNA, 15 nt, Mycobacterium bovis subsp bovis AF2122/97
auguuggccgccaca

SEQ ID NO: 1123945 - RNA, 23 nt, Mycobacterium bovis subsp bovis AF2122/97
auguuggugucaaugacaccggg

SEQ ID NO: 1123946 - RNA, 14 nt, Mycobacterium bovis subsp bovis AF2122/97
auucacgagccgcu

SEQ ID NO: 1123947 - RNA, 11 nt, Mycobacterium bovis subsp bovis AF2122/97
auucaccgcgu

SEQ ID NO: 1123948 - RNA, 16 nt, Mycobacterium bovis subsp bovis AF2122/97
auucacgaugcucgcc

SEQ ID NO: 1123949 - RNA, 18 nt, Mycobacterium bovis subsp bovis AF2122/97
auucggucucgaccgcgc

SEQ ID NO: 1123950 - RNA, 14 nt, Mycobacterium bovis subsp bovis AF2122/97
auucgucgcgucgg

SEQ ID NO: 1123951 - RNA, 16 nt, Mycobacterium bovis subsp bovis AF2122/97
auucgugcccgggcgg

SEQ ID NO: 1123952 - RNA, 18 nt, Mycobacterium bovis subsp bovis AF2122/97
auucucggccggcggcgc

SEQ ID NO: 1123953 - RNA, 20 nt, Mycobacterium bovis subsp bovis AF2122/97
auucucggccggcggcgccc

SEQ ID NO: 1123954 - RNA, 12 nt, Mycobacterium bovis subsp bovis AF2122/97
auucugcgucug

SEQ ID NO: 1123955 - RNA, 17 nt, Mycobacterium bovis subsp bovis AF2122/97
auucgcgacaacucgcg

SEQ ID NO: 1123956 - RNA, 23 nt, Mycobacterium bovis subsp bovis AF2122/97
auucgccgaacgguugcucgucc

SEQ ID NO: 1123957 - RNA, 22 nt, Mycobacterium bovis subsp bovis AF2122/97
auucgcgcagcauggugcggcg

SEQ ID NO: 1123958 - RNA, 13 nt, Mycobacterium bovis subsp bovis AF2122/97
auucggccggcgc

SEQ ID NO: 1123959 - RNA, 13 nt, Mycobacterium bovis subsp bovis AF2122/97
auucggcgagccg

SEQ ID NO: 1123960 - RNA, 18 nt, Mycobacterium bovis subsp bovis AF2122/97
auucggcgagccgcgccc

SEQ ID NO: 1123961 - RNA, 19 nt, Mycobacterium bovis subsp bovis AF2122/97
auucggcgagcgcccuggc

SEQ ID NO: 1123962 - RNA, 18 nt, Mycobacterium bovis subsp bovis AF2122/97
auucggcugccaccgcag

SEQ ID NO: 1123963 - RNA, 14 nt, Mycobacterium bovis subsp bovis AF2122/97
auucggccaucgcg

SEQ ID NO: 1123964 - RNA, 17 nt, Mycobacterium bovis subsp bovis AF2122/97
auucggccgccgacguu

SEQ ID NO: 1123965 - RNA, 14 nt, Mycobacterium bovis subsp bovis AF2122/97
auucgcaaucggcg

SEQ ID NO: 1123966 - RNA, 18 nt, Mycobacterium bovis subsp bovis AF2122/97
auucgccauagcgggcgg

SEQ ID NO: 1123967 - RNA, 16 nt, Mycobacterium bovis subsp bovis AF2122/97
auuccucuguacccca

SEQ ID NO: 1123968 - RNA, 16 nt, Mycobacterium bovis subsp bovis AF2122/97
auuccuugauaacgac

SEQ ID NO: 1123969 - RNA, 21 nt, Mycobacterium bovis subsp bovis AF2122/97
auugcggaacaccaccaggcu

SEQ ID NO: 1123970 - RNA, 18 nt, Mycobacterium bovis subsp bovis AF2122/97
auugcggcccgcgaucgg

SEQ ID NO: 1123971 - RNA, 12 nt, Mycobacterium bovis subsp bovis AF2122/97
auugcggccgcc

SEQ ID NO: 1123972 - RNA, 18 nt, Mycobacterium bovis subsp bovis AF2122/97
auugcggcgcgggugcgg

SEQ ID NO: 1123973 - RNA, 16 nt, Mycobacterium bovis subsp bovis AF2122/97
auugcgggagccucgc

SEQ ID NO: 1123974 - RNA, 19 nt, Mycobacterium bovis subsp bovis AF2122/97
auugcuauuccgcggcacg

SEQ ID NO: 1123975 - RNA, 13 nt, Mycobacterium bovis subsp bovis AF2122/97
auugcucgaucug

SEQ ID NO: 1123976 - RNA, 20 nt, Mycobacterium bovis subsp bovis AF2122/97
auugcgaaccggccgucgac

SEQ ID NO: 1123977 - RNA, 18 nt, Mycobacterium bovis subsp bovis AF2122/97
auugcgaagggcaccggc

SEQ ID NO: 1123978 - RNA, 17 nt, Mycobacterium bovis subsp bovis AF2122/97
auugccugccacccggc

SEQ ID NO: 1123979 - RNA, 18 nt, Mycobacterium bovis subsp bovis AF2122/97
auugccugggcgaccggc

SEQ ID NO: 1123980 - RNA, 19 nt, Mycobacterium bovis subsp bovis AF2122/97
auugccugggcggccgggc

SEQ ID NO: 1123981 - RNA, 16 nt, Mycobacterium bovis subsp bovis AF2122/97
auugcgcccggccaug

SEQ ID NO: 1123982 - RNA, 13 nt, Mycobacterium bovis subsp bovis AF2122/97
auugccgccgccg

SEQ ID NO: 1123983 - RNA, 18 nt, Mycobacterium bovis subsp bovis AF2122/97
auugccgccggcgccgcc

SEQ ID NO: 1123984 - RNA, 19 nt, Mycobacterium bovis subsp bovis AF2122/97
auugccgccggcgccgccg

SEQ ID NO: 1123985 - RNA, 21 nt, Mycobacterium bovis subsp bovis AF2122/97
auugccgccggcgccgccggc

SEQ ID NO: 1123986 - RNA, 17 nt, Mycobacterium bovis subsp bovis AF2122/97
auugccgggcgcacgcc

SEQ ID NO: 1123987 - RNA, 17 nt, Mycobacterium bovis subsp bovis AF2122/97
auugccggcgacgauau

SEQ ID NO: 1123988 - RNA, 14 nt, Mycobacterium bovis subsp bovis AF2122/97
auugccgucgcggu

SEQ ID NO: 1123989 - RNA, 16 nt, Mycobacterium bovis subsp bovis AF2122/97
auuggcgcugcccgcc

SEQ ID NO: 1123990 - RNA, 14 nt, Mycobacterium bovis subsp bovis AF2122/97
auuggcgccgucac

SEQ ID NO: 1123991 - RNA, 15 nt, Mycobacterium bovis subsp bovis AF2122/97
auuggcucgccgaac

SEQ ID NO: 1123992 - RNA, 19 nt, Mycobacterium bovis subsp bovis AF2122/97
auuggcugugaucgagucg

SEQ ID NO: 1123993 - RNA, 15 nt, Mycobacterium bovis subsp bovis AF2122/97
auuggcuuagcggcu

SEQ ID NO: 1123994 - RNA, 12 nt, Mycobacterium bovis subsp bovis AF2122/97
auuggcaucgug

SEQ ID NO: 1123995 - RNA, 21 nt, Mycobacterium bovis subsp bovis AF2122/97
auuggaccgagacuugcuggc

SEQ ID NO: 1123996 - RNA, 14 nt, Mycobacterium bovis subsp bovis AF2122/97
auuggacagcgcga

SEQ ID NO: 1123997 - RNA, 13 nt, Mycobacterium bovis subsp bovis AF2122/97
auuguccggccgg

SEQ ID NO: 1123998 - RNA, 14 nt, Mycobacterium bovis subsp bovis AF2122/97
auugucgacgguca

SEQ ID NO: 1123999 - RNA, 23 nt, Mycobacterium bovis subsp bovis AF2122/97
auuggucgaacagcgaaccggcu

SEQ ID NO: 1124000 - RNA, 17 nt, Mycobacterium bovis subsp bovis AF2122/97
auuggucgagucgauga

SEQ ID NO: 1124001 - RNA, 20 nt, Mycobacterium bovis subsp bovis AF2122/97
auugggcgauucugcgucug

SEQ ID NO: 1124002 - RNA, 13 nt, Mycobacterium bovis subsp bovis AF2122/97
auugguaccggcu

SEQ ID NO: 1124003 - RNA, 14 nt, Mycobacterium bovis subsp bovis AF2122/97
auuggguccagcga

SEQ ID NO: 1124004 - RNA, 20 nt, Mycobacterium bovis subsp bovis AF2122/97
auugggugccguugcgucug

SEQ ID NO: 1124005 - RNA, 12 nt, Mycobacterium bovis subsp bovis AF2122/97
auugagccggcc

SEQ ID NO: 1124006 - RNA, 13 nt, Mycobacterium bovis subsp bovis AF2122/97
auugagccggccc

SEQ ID NO: 1124007 - RNA, 22 nt, Mycobacterium bovis subsp bovis AF2122/97
auugagccggcccugcucgccg

SEQ ID NO: 1124008 - RNA, 22 nt, Mycobacterium bovis subsp bovis AF2122/97
auugacccgacgaugccggccc

SEQ ID NO: 1124009 - RNA, 19 nt, Mycobacterium bovis subsp bovis AF2122/97
auugaccugcuggcgcacg

SEQ ID NO: 1124010 - RNA, 14 nt, Mycobacterium bovis subsp bovis AF2122/97
auugaccgcggccg

SEQ ID NO: 1124011 - RNA, 14 nt, Mycobacterium bovis subsp bovis AF2122/97
auugaacagcggau

SEQ ID NO: 1124012 - RNA, 20 nt, Mycobacterium bovis subsp bovis AF2122/97
auugaacgaguagccggucg

SEQ ID NO: 1124013 - RNA, 16 nt, Mycobacterium bovis subsp bovis AF2122/97
auugccaggaccgcgc

SEQ ID NO: 1124014 - RNA, 22 nt, Mycobacterium bovis subsp bovis AF2122/97
auugcaugguuucguuccucga

SEQ ID NO: 1124015 - RNA, 14 nt, Mycobacterium bovis subsp bovis AF2122/97
auugccgaugguca

SEQ ID NO: 1124016 - RNA, 12 nt, Mycobacterium bovis subsp bovis AF2122/97
auugccgccacc

SEQ ID NO: 1124017 - RNA, 15 nt, Mycobacterium bovis subsp bovis AF2122/97
auugccgagaacacc

SEQ ID NO: 1124018 - RNA, 18 nt, Mycobacterium bovis subsp bovis AF2122/97
auugauaggccccgaggc

SEQ ID NO: 1124019 - RNA, 15 nt, Mycobacterium bovis subsp bovis AF2122/97
auugaugaucugcag

SEQ ID NO: 1124020 - RNA, 14 nt, Mycobacterium bovis subsp bovis AF2122/97
auugaucggugccc

SEQ ID NO: 1124021 - RNA, 17 nt, Mycobacterium bovis subsp bovis AF2122/97
auugauuccgaccccgc

SEQ ID NO: 1124022 - RNA, 22 nt, Mycobacterium bovis subsp bovis AF2122/97
auugcagaaccgccaacauugg

SEQ ID NO: 1124023 - RNA, 13 nt, Mycobacterium bovis subsp bovis AF2122/97
auugcagcgcgau

SEQ ID NO: 1124024 - RNA, 16 nt, Mycobacterium bovis subsp bovis AF2122/97
aucggcagaauccggu

SEQ ID NO: 1124025 - RNA, 14 nt, Mycobacterium bovis subsp bovis AF2122/97
aucggcagcagcgc

SEQ ID NO: 1124026 - RNA, 21 nt, Mycobacterium bovis subsp bovis AF2122/97
aucggcaccgucucgcaccgc

SEQ ID NO: 1124027 - RNA, 14 nt, Mycobacterium bovis subsp bovis AF2122/97
aucggcaccgugcg

SEQ ID NO: 1124028 - RNA, 15 nt, Mycobacterium bovis subsp bovis AF2122/97
aucggcaccgugcgg

SEQ ID NO: 1124029 - RNA, 22 nt, Mycobacterium bovis subsp bovis AF2122/97
aucggcaccgugucgacgguca

SEQ ID NO: 1124030 - RNA, 12 nt, Mycobacterium bovis subsp bovis AF2122/97
aucggcacccca

SEQ ID NO: 1124031 - RNA, 23 nt, Mycobacterium bovis subsp bovis AF2122/97
aucggcaccccacgccugccgaa

SEQ ID NO: 1124032 - RNA, 12 nt, Mycobacterium bovis subsp bovis AF2122/97
aucggcaccccg

SEQ ID NO: 1124033 - RNA, 13 nt, Mycobacterium bovis subsp bovis AF2122/97
aucggcaccccgg

SEQ ID NO: 1124034 - RNA, 14 nt, Mycobacterium bovis subsp bovis AF2122/97
aucggcaacccgca

SEQ ID NO: 1124035 - RNA, 22 nt, Mycobacterium bovis subsp bovis AF2122/97
aucggcccgugccacagcucgc

SEQ ID NO: 1124036 - RNA, 14 nt, Mycobacterium bovis subsp bovis AF2122/97
aucggccggcagau

SEQ ID NO: 1124037 - RNA, 19 nt, Mycobacterium bovis subsp bovis AF2122/97
aucggcacaggcggccagc

SEQ ID NO: 1124038 - RNA, 17 nt, Mycobacterium bovis subsp bovis AF2122/97
aucggccaucucgucga

SEQ ID NO: 1124039 - RNA, 22 nt, Mycobacterium bovis subsp bovis AF2122/97
aucggcgccaauucagcggcaa

SEQ ID NO: 1124040 - RNA, 14 nt, Mycobacterium bovis subsp bovis AF2122/97
aucggcgccgcaua

SEQ ID NO: 1124041 - RNA, 13 nt, Mycobacterium bovis subsp bovis AF2122/97
aucggcgcgucga

SEQ ID NO: 1124042 - RNA, 15 nt, Mycobacterium bovis subsp bovis AF2122/97
aucggcggcccuguu

SEQ ID NO: 1124043 - RNA, 16 nt, Mycobacterium bovis subsp bovis AF2122/97
aucggcggccggcacg

SEQ ID NO: 1124044 - RNA, 15 nt, Mycobacterium bovis subsp bovis AF2122/97
aucggcggcaaccgc

SEQ ID NO: 1124045 - RNA, 16 nt, Mycobacterium bovis subsp bovis AF2122/97
aucggcggcaaccgcc

SEQ ID NO: 1124046 - RNA, 20 nt, Mycobacterium bovis subsp bovis AF2122/97
aucggcggcaaccgccgcca

SEQ ID NO: 1124047 - RNA, 22 nt, Mycobacterium bovis subsp bovis AF2122/97
aucggccgugaauucgccgaac

SEQ ID NO: 1124048 - RNA, 15 nt, Mycobacterium bovis subsp bovis AF2122/97
aucggccugccggca

SEQ ID NO: 1124049 - RNA, 17 nt, Mycobacterium bovis subsp bovis AF2122/97
aucggccugccggcagc

SEQ ID NO: 1124050 - RNA, 22 nt, Mycobacterium bovis subsp bovis AF2122/97
aucggcgaacaaccacgcacgg

SEQ ID NO: 1124051 - RNA, 16 nt, Mycobacterium bovis subsp bovis AF2122/97
aucggccuguucgccg

SEQ ID NO: 1124052 - RNA, 13 nt, Mycobacterium bovis subsp bovis AF2122/97
aucggcgacgccg

SEQ ID NO: 1124053 - RNA, 18 nt, Mycobacterium bovis subsp bovis AF2122/97
aucggcgaggucccggcc

SEQ ID NO: 1124054 - RNA, 19 nt, Mycobacterium bovis subsp bovis AF2122/97
aucggcgaggucccggccg

SEQ ID NO: 1124055 - RNA, 16 nt, Mycobacterium bovis subsp bovis AF2122/97
aucgcgccgucgucga

SEQ ID NO: 1124056 - RNA, 12 nt, Mycobacterium bovis subsp bovis AF2122/97
aucgcgcgccga

SEQ ID NO: 1124057 - RNA, 22 nt, Mycobacterium bovis subsp bovis AF2122/97
aucgcgccgucgucgaccacga

SEQ ID NO: 1124058 - RNA, 23 nt, Mycobacterium bovis subsp bovis AF2122/97
aucgcgccgucgucgaccacgac

SEQ ID NO: 1124059 - RNA, 21 nt, Mycobacterium bovis subsp bovis AF2122/97
aucgcgccuuugagcccgcga

SEQ ID NO: 1124060 - RNA, 16 nt, Mycobacterium bovis subsp bovis AF2122/97
aucgcgcgcggcuccg

SEQ ID NO: 1124061 - RNA, 19 nt, Mycobacterium bovis subsp bovis AF2122/97
aucgcgcccaccgaugcga

SEQ ID NO: 1124062 - RNA, 23 nt, Mycobacterium bovis subsp bovis AF2122/97
aucgcgcggcugugcccgaucag

SEQ ID NO: 1124063 - RNA, 15 nt, Mycobacterium bovis subsp bovis AF2122/97
aucgccuaccggccu

SEQ ID NO: 1124064 - RNA, 18 nt, Mycobacterium bovis subsp bovis AF2122/97
aucgcgccaucgucgcgc

SEQ ID NO: 1124065 - RNA, 16 nt, Mycobacterium bovis subsp bovis AF2122/97
aucgcggaagcgggcg

SEQ ID NO: 1124066 - RNA, 18 nt, Mycobacterium bovis subsp bovis AF2122/97
aucgcggaagcgggcgau

SEQ ID NO: 1124067 - RNA, 22 nt, Mycobacterium bovis subsp bovis AF2122/97
aucgcggcccggcccuccgggc

SEQ ID NO: 1124068 - RNA, 23 nt, Mycobacterium bovis subsp bovis AF2122/97
aucgcggccgaaacuucgcccgg

SEQ ID NO: 1124069 - RNA, 17 nt, Mycobacterium bovis subsp bovis AF2122/97
aucgcggcaucgacgcg

SEQ ID NO: 1124070 - RNA, 23 nt, Mycobacterium bovis subsp bovis AF2122/97
aucgcggcaucgacgcggccaac

SEQ ID NO: 1124071 - RNA, 23 nt, Mycobacterium bovis subsp bovis AF2122/97
aucggagucuucaacgucgagau

SEQ ID NO: 1124072 - RNA, 17 nt, Mycobacterium bovis subsp bovis AF2122/97
aucggauggcggccaca

SEQ ID NO: 1124073 - RNA, 18 nt, Mycobacterium bovis subsp bovis AF2122/97
aucggauacccagccggc

SEQ ID NO: 1124074 - RNA, 19 nt, Mycobacterium bovis subsp bovis AF2122/97
aucggauacccagccggcc

SEQ ID NO: 1124075 - RNA, 20 nt, Mycobacterium bovis subsp bovis AF2122/97
aucggauacccagccggccu

SEQ ID NO: 1124076 - RNA, 16 nt, Mycobacterium bovis subsp bovis AF2122/97
aucggaucggcacccc

SEQ ID NO: 1124077 - RNA, 22 nt, Mycobacterium bovis subsp bovis AF2122/97
aucgcugggcacucggcccggc

SEQ ID NO: 1124078 - RNA, 12 nt, Mycobacterium bovis subsp bovis AF2122/97
aucgcuggccgc

SEQ ID NO: 1124079 - RNA, 15 nt, Mycobacterium bovis subsp bovis AF2122/97
aucgcuggccgcgag

SEQ ID NO: 1124080 - RNA, 13 nt, Mycobacterium bovis subsp bovis AF2122/97
aucgcuggcgacc

SEQ ID NO: 1124081 - RNA, 14 nt, Mycobacterium bovis subsp bovis AF2122/97
aucgcucucgguca

SEQ ID NO: 1124082 - RNA, 16 nt, Mycobacterium bovis subsp bovis AF2122/97
aucgcucucggucagu

SEQ ID NO: 1124083 - RNA, 18 nt, Mycobacterium bovis subsp bovis AF2122/97
aucgcucugugucgccga

SEQ ID NO: 1124084 - RNA, 14 nt, Mycobacterium bovis subsp bovis AF2122/97
aucgcuccgcggcg

SEQ ID NO: 1124085 - RNA, 19 nt, Mycobacterium bovis subsp bovis AF2122/97
aucgcuccgcggcgcagca

SEQ ID NO: 1124086 - RNA, 19 nt, Mycobacterium bovis subsp bovis AF2122/97
aucgcuccggcccugccgc

SEQ ID NO: 1124087 - RNA, 23 nt, Mycobacterium bovis subsp bovis AF2122/97
aucgccgcgcuggucggagacca

SEQ ID NO: 1124088 - RNA, 14 nt, Mycobacterium bovis subsp bovis AF2122/97
aucgccgcgggcga

SEQ ID NO: 1124089 - RNA, 23 nt, Mycobacterium bovis subsp bovis AF2122/97
aucgccgcgggugaucugggcgg

SEQ ID NO: 1124090 - RNA, 17 nt, Mycobacterium bovis subsp bovis AF2122/97
aucgccgcuaacgcacc

SEQ ID NO: 1124091 - RNA, 16 nt, Mycobacterium bovis subsp bovis AF2122/97
aucgccgcuacgccgg

SEQ ID NO: 1124092 - RNA, 20 nt, Mycobacterium bovis subsp bovis AF2122/97
aucgccgcuggccagcacac

SEQ ID NO: 1124093 - RNA, 20 nt, Mycobacterium bovis subsp bovis AF2122/97
aucgccgcuugacgcagcuc

SEQ ID NO: 1124094 - RNA, 20 nt, Mycobacterium bovis subsp bovis AF2122/97
aucgccggagucgacccugc

SEQ ID NO: 1124095 - RNA, 18 nt, Mycobacterium bovis subsp bovis AF2122/97
aucgccggcuucgcccag

SEQ ID NO: 1124096 - RNA, 19 nt, Mycobacterium bovis subsp bovis AF2122/97
aucgccggcgcgccgauga

SEQ ID NO: 1124097 - RNA, 12 nt, Mycobacterium bovis subsp bovis AF2122/97
aucgccggccgc

SEQ ID NO: 1124098 - RNA, 13 nt, Mycobacterium bovis subsp bovis AF2122/97
aucgccggccgcg

SEQ ID NO: 1124099 - RNA, 19 nt, Mycobacterium bovis subsp bovis AF2122/97
aucgccggccgcgggcgcg

SEQ ID NO: 1124100 - RNA, 19 nt, Mycobacterium bovis subsp bovis AF2122/97
aucgccggccugcucggcg

SEQ ID NO: 1124101 - RNA, 15 nt, Mycobacterium bovis subsp bovis AF2122/97
aucgccgccggugcc

SEQ ID NO: 1124102 - RNA, 17 nt, Mycobacterium bovis subsp bovis AF2122/97
aucgccgcgaagcgcuc

SEQ ID NO: 1124103 - RNA, 23 nt, Mycobacterium bovis subsp bovis AF2122/97
aucgccgcgaagcgcucggcagc

SEQ ID NO: 1124104 - RNA, 15 nt, Mycobacterium bovis subsp bovis AF2122/97
aucgcccggccccgc

SEQ ID NO: 1124105 - RNA, 24 nt, Mycobacterium bovis subsp bovis AF2122/97
aucgcgaucggggcgacgauccgc

SEQ ID NO: 1124106 - RNA, 14 nt, Mycobacterium bovis subsp bovis AF2122/97
aucgcgauuccggc

SEQ ID NO: 1124107 - RNA, 15 nt, Mycobacterium bovis subsp bovis AF2122/97
aucgcgcagcgccgc

SEQ ID NO: 1124108 - RNA, 14 nt, Mycobacterium bovis subsp bovis AF2122/97
aucgcgcaccgcau

SEQ ID NO: 1124109 - RNA, 14 nt, Mycobacterium bovis subsp bovis AF2122/97
aucgccgugcgccg

SEQ ID NO: 1124110 - RNA, 18 nt, Mycobacterium bovis subsp bovis AF2122/97
aucgccgucagcaccgcu

SEQ ID NO: 1124111 - RNA, 13 nt, Mycobacterium bovis subsp bovis AF2122/97
aucgccgggugca

SEQ ID NO: 1124112 - RNA, 15 nt, Mycobacterium bovis subsp bovis AF2122/97
aucgccgggcuuggc

SEQ ID NO: 1124113 - RNA, 20 nt, Mycobacterium bovis subsp bovis AF2122/97
aucgccgggcuuggccgcgc

SEQ ID NO: 1124114 - RNA, 21 nt, Mycobacterium bovis subsp bovis AF2122/97
aucgccgggcuuggccgcgcc

SEQ ID NO: 1124115 - RNA, 17 nt, Mycobacterium bovis subsp bovis AF2122/97
aucgccgucagcaccgc

SEQ ID NO: 1124116 - RNA, 13 nt, Mycobacterium bovis subsp bovis AF2122/97
aucgagacgcacg

SEQ ID NO: 1124117 - RNA, 21 nt, Mycobacterium bovis subsp bovis AF2122/97
aucgagacuucuucgacgcgc

SEQ ID NO: 1124118 - RNA, 19 nt, Mycobacterium bovis subsp bovis AF2122/97
aucgagauauugcgcgccu

SEQ ID NO: 1124119 - RNA, 13 nt, Mycobacterium bovis subsp bovis AF2122/97
aucgagaucgccg

SEQ ID NO: 1124120 - RNA, 13 nt, Mycobacterium bovis subsp bovis AF2122/97
aucgagcaccgca

SEQ ID NO: 1124121 - RNA, 20 nt, Mycobacterium bovis subsp bovis AF2122/97
aucgagcaguuccagcucgc

SEQ ID NO: 1124122 - RNA, 22 nt, Mycobacterium bovis subsp bovis AF2122/97
aucgagcaguuccagcucgcgg

SEQ ID NO: 1124123 - RNA, 16 nt, Mycobacterium bovis subsp bovis AF2122/97
aucgagcccggacgag

SEQ ID NO: 1124124 - RNA, 15 nt, Mycobacterium bovis subsp bovis AF2122/97
aucgagcccggagcg

SEQ ID NO: 1124125 - RNA, 13 nt, Mycobacterium bovis subsp bovis AF2122/97
aucgacggcggcc

SEQ ID NO: 1124126 - RNA, 17 nt, Mycobacterium bovis subsp bovis AF2122/97
aucgacugcagcccguu

SEQ ID NO: 1124127 - RNA, 21 nt, Mycobacterium bovis subsp bovis AF2122/97
aucgacucacggaucugagcu

SEQ ID NO: 1124128 - RNA, 21 nt, Mycobacterium bovis subsp bovis AF2122/97
aucgacugaucgccacccggu

SEQ ID NO: 1124129 - RNA, 17 nt, Mycobacterium bovis subsp bovis AF2122/97
aucgcccgaugcgccag

SEQ ID NO: 1124130 - RNA, 20 nt, Mycobacterium bovis subsp bovis AF2122/97
aucgagcugacgauggccag

SEQ ID NO: 1124131 - RNA, 22 nt, Mycobacterium bovis subsp bovis AF2122/97
aucgagcugacgauggccaggc

SEQ ID NO: 1124132 - RNA, 15 nt, Mycobacterium bovis subsp bovis AF2122/97
aucgagcggcacauc

SEQ ID NO: 1124133 - RNA, 18 nt, Mycobacterium bovis subsp bovis AF2122/97
aucgagcgggaucgggcc

SEQ ID NO: 1124134 - RNA, 19 nt, Mycobacterium bovis subsp bovis AF2122/97
aucgcccaauuucgugccg

SEQ ID NO: 1124135 - RNA, 16 nt, Mycobacterium bovis subsp bovis AF2122/97
aucgaggagaugccga

SEQ ID NO: 1124136 - RNA, 16 nt, Mycobacterium bovis subsp bovis AF2122/97
auccgcucguggucgg

SEQ ID NO: 1124137 - RNA, 15 nt, Mycobacterium bovis subsp bovis AF2122/97
auccggcgggugccg

SEQ ID NO: 1124138 - RNA, 23 nt, Mycobacterium bovis subsp bovis AF2122/97
auccggcgggugccgagcuggcg

SEQ ID NO: 1124139 - RNA, 19 nt, Mycobacterium bovis subsp bovis AF2122/97
auccgggcaaccgaugacg

SEQ ID NO: 1124140 - RNA, 22 nt, Mycobacterium bovis subsp bovis AF2122/97
auccggcaaccaccggccgcgc

SEQ ID NO: 1124141 - RNA, 19 nt, Mycobacterium bovis subsp bovis AF2122/97
auccgggccuugcgcgcgc

SEQ ID NO: 1124142 - RNA, 13 nt, Mycobacterium bovis subsp bovis AF2122/97
auccgugucgaga

SEQ ID NO: 1124143 - RNA, 22 nt, Mycobacterium bovis subsp bovis AF2122/97
auccgguauucgguggagcgcg

SEQ ID NO: 1124144 - RNA, 19 nt, Mycobacterium bovis subsp bovis AF2122/97
auccggguggcgucaccgc

SEQ ID NO: 1124145 - RNA, 22 nt, Mycobacterium bovis subsp bovis AF2122/97
auccuaggguggcgauccacag

SEQ ID NO: 1124146 - RNA, 19 nt, Mycobacterium bovis subsp bovis AF2122/97
auccuccggguuggcgacg

SEQ ID NO: 1124147 - RNA, 18 nt, Mycobacterium bovis subsp bovis AF2122/97
auccgccagaccgcggcg

SEQ ID NO: 1124148 - RNA, 23 nt, Mycobacterium bovis subsp bovis AF2122/97
auccgccauuucucguacccggc

SEQ ID NO: 1124149 - RNA, 16 nt, Mycobacterium bovis subsp bovis AF2122/97
auccgcaacagcucgg

SEQ ID NO: 1124150 - RNA, 19 nt, Mycobacterium bovis subsp bovis AF2122/97
auccgcaaggaccugugcg

SEQ ID NO: 1124151 - RNA, 16 nt, Mycobacterium bovis subsp bovis AF2122/97
auccgaguugucgccg

SEQ ID NO: 1124152 - RNA, 20 nt, Mycobacterium bovis subsp bovis AF2122/97
auccgaguugucgccggagu

SEQ ID NO: 1124153 - RNA, 23 nt, Mycobacterium bovis subsp bovis AF2122/97
aucagcgguacguaaucgagcgc

SEQ ID NO: 1124154 - RNA, 14 nt, Mycobacterium bovis subsp bovis AF2122/97
aucagcguggcgcc

SEQ ID NO: 1124155 - RNA, 14 nt, Mycobacterium bovis subsp bovis AF2122/97
aucagcgugggcau

SEQ ID NO: 1124156 - RNA, 16 nt, Mycobacterium bovis subsp bovis AF2122/97
aucagcgugucgccga

SEQ ID NO: 1124157 - RNA, 22 nt, Mycobacterium bovis subsp bovis AF2122/97
aucagcggcaguuccugacgcc

SEQ ID NO: 1124158 - RNA, 21 nt, Mycobacterium bovis subsp bovis AF2122/97
aucagcggcagcaccgcacgg

SEQ ID NO: 1124159 - RNA, 19 nt, Mycobacterium bovis subsp bovis AF2122/97
auccgaccugcucgauacg

SEQ ID NO: 1124160 - RNA, 15 nt, Mycobacterium bovis subsp bovis AF2122/97
auccgacgaccgcau

SEQ ID NO: 1124161 - RNA, 14 nt, Mycobacterium bovis subsp bovis AF2122/97
auccgagccgcgau

SEQ ID NO: 1124162 - RNA, 15 nt, Mycobacterium bovis subsp bovis AF2122/97
auccgagccgcgauu

SEQ ID NO: 1124163 - RNA, 21 nt, Mycobacterium bovis subsp bovis AF2122/97
auccgaggauguugugccgau

SEQ ID NO: 1124164 - RNA, 15 nt, Mycobacterium bovis subsp bovis AF2122/97
auccgacgucgacga

SEQ ID NO: 1124165 - RNA, 21 nt, Mycobacterium bovis subsp bovis AF2122/97
auccgacagcagccggugccg

SEQ ID NO: 1124166 - RNA, 19 nt, Mycobacterium bovis subsp bovis AF2122/97
auccgacaagcugucggcg

SEQ ID NO: 1124167 - RNA, 21 nt, Mycobacterium bovis subsp bovis AF2122/97
auccgaacucgcgggcgacca

SEQ ID NO: 1124168 - RNA, 23 nt, Mycobacterium bovis subsp bovis AF2122/97
auccgaacucgcgggcgaccacc

SEQ ID NO: 1124169 - RNA, 17 nt, Mycobacterium bovis subsp bovis AF2122/97
aucgacccggucgacgg

SEQ ID NO: 1124170 - RNA, 15 nt, Mycobacterium bovis subsp bovis AF2122/97
aucgacccuccagca

SEQ ID NO: 1124171 - RNA, 14 nt, Mycobacterium bovis subsp bovis AF2122/97
aucgaccgcggccg

SEQ ID NO: 1124172 - RNA, 17 nt, Mycobacterium bovis subsp bovis AF2122/97
aucgaccgcggccgggu

SEQ ID NO: 1124173 - RNA, 16 nt, Mycobacterium bovis subsp bovis AF2122/97
aucgaccggacaaaca

SEQ ID NO: 1124174 - RNA, 14 nt, Mycobacterium bovis subsp bovis AF2122/97
aucgaccgcccgcc

SEQ ID NO: 1124175 - RNA, 17 nt, Mycobacterium bovis subsp bovis AF2122/97
aucgaccgccgcgagca

SEQ ID NO: 1124176 - RNA, 11 nt, Mycobacterium bovis subsp bovis AF2122/97
aucgaccgcgg

SEQ ID NO: 1124177 - RNA, 17 nt, Mycobacterium bovis subsp bovis AF2122/97
aucgaccaauucgaccg

SEQ ID NO: 1124178 - RNA, 22 nt, Mycobacterium bovis subsp bovis AF2122/97
aucgaccaccggguagccggcg

SEQ ID NO: 1124179 - RNA, 14 nt, Mycobacterium bovis subsp bovis AF2122/97
aucgacagcagcgc

SEQ ID NO: 1124180 - RNA, 13 nt, Mycobacterium bovis subsp bovis AF2122/97
aucgacagccccg

SEQ ID NO: 1124181 - RNA, 20 nt, Mycobacterium bovis subsp bovis AF2122/97
aucgacauaguuggcgcccg

SEQ ID NO: 1124182 - RNA, 16 nt, Mycobacterium bovis subsp bovis AF2122/97
aucgacaucaccaccg

SEQ ID NO: 1124183 - RNA, 23 nt, Mycobacterium bovis subsp bovis AF2122/97
aucgacaucaccaccgccggggu

SEQ ID NO: 1124184 - RNA, 18 nt, Mycobacterium bovis subsp bovis AF2122/97
aucgacagccccgcggcc

SEQ ID NO: 1124185 - RNA, 21 nt, Mycobacterium bovis subsp bovis AF2122/97
aucgacaucguuggccgggca

SEQ ID NO: 1124186 - RNA, 16 nt, Mycobacterium bovis subsp bovis AF2122/97
aucgacgagccgcggu

SEQ ID NO: 1124187 - RNA, 22 nt, Mycobacterium bovis subsp bovis AF2122/97
aucgacgagcgauacgucguca

SEQ ID NO: 1124188 - RNA, 18 nt, Mycobacterium bovis subsp bovis AF2122/97
aucgacgccgccacccgg

SEQ ID NO: 1124189 - RNA, 15 nt, Mycobacterium bovis subsp bovis AF2122/97
aucgacgcggccaac

SEQ ID NO: 1124190 - RNA, 18 nt, Mycobacterium bovis subsp bovis AF2122/97
aucgacgcggccaacgaa

SEQ ID NO: 1124191 - RNA, 18 nt, Mycobacterium bovis subsp bovis AF2122/97
aucgacgcauuccucgac

SEQ ID NO: 1124192 - RNA, 19 nt, Mycobacterium bovis subsp bovis AF2122/97
aucgacgagcgauacgucg

SEQ ID NO: 1124193 - RNA, 15 nt, Mycobacterium bovis subsp bovis AF2122/97
aucgaccuggccacg

SEQ ID NO: 1124194 - RNA, 17 nt, Mycobacterium bovis subsp bovis AF2122/97
aucgaccgaggcacguc

SEQ ID NO: 1124195 - RNA, 16 nt, Mycobacterium bovis subsp bovis AF2122/97
aucgacgacacguuga

SEQ ID NO: 1124196 - RNA, 12 nt, Mycobacterium bovis subsp bovis AF2122/97
aucgaccguccg

SEQ ID NO: 1124197 - RNA, 17 nt, Mycobacterium bovis subsp bovis AF2122/97
aucgaccguccggguca

SEQ ID NO: 1124198 - RNA, 15 nt, Mycobacterium bovis subsp bovis AF2122/97
aucgacaccgcccga

SEQ ID NO: 1124199 - RNA, 13 nt, Mycobacterium bovis subsp bovis AF2122/97
aucgacacccgcu

SEQ ID NO: 1124200 - RNA, 13 nt, Mycobacterium bovis subsp bovis AF2122/97
aucgacaaucgca

SEQ ID NO: 1124201 - RNA, 19 nt, Mycobacterium bovis subsp bovis AF2122/97
aucgacaccgagccacgac

SEQ ID NO: 1124202 - RNA, 14 nt, Mycobacterium bovis subsp bovis AF2122/97
aucgacaccaccau

SEQ ID NO: 1124203 - RNA, 20 nt, Mycobacterium bovis subsp bovis AF2122/97
aucgacaguugcgccagcgu

SEQ ID NO: 1124204 - RNA, 14 nt, Mycobacterium bovis subsp bovis AF2122/97
aucgaagcccggcg

SEQ ID NO: 1124205 - RNA, 17 nt, Mycobacterium bovis subsp bovis AF2122/97
aucgaagcccggcggca

SEQ ID NO: 1124206 - RNA, 23 nt, Mycobacterium bovis subsp bovis AF2122/97
aucgaacuucgauucuggccgga

SEQ ID NO: 1124207 - RNA, 21 nt, Mycobacterium bovis subsp bovis AF2122/97
aucgaaggugacaaaucggcc

SEQ ID NO: 1124208 - RNA, 19 nt, Mycobacterium bovis subsp bovis AF2122/97
aucgaauuaaagccaccag

SEQ ID NO: 1124209 - RNA, 19 nt, Mycobacterium bovis subsp bovis AF2122/97
aucgaaagccaacucgacc

SEQ ID NO: 1124210 - RNA, 15 nt, Mycobacterium bovis subsp bovis AF2122/97
auccuuugccgccga

SEQ ID NO: 1124211 - RNA, 15 nt, Mycobacterium bovis subsp bovis AF2122/97
aucgaaaaaccucga

SEQ ID NO: 1124212 - RNA, 15 nt, Mycobacterium bovis subsp bovis AF2122/97
auccuggcggcugca

SEQ ID NO: 1124213 - RNA, 18 nt, Mycobacterium bovis subsp bovis AF2122/97
auccuggcggcugcagcc

SEQ ID NO: 1124214 - RNA, 21 nt, Mycobacterium bovis subsp bovis AF2122/97
auccuggcggcugcagccgac

SEQ ID NO: 1124215 - RNA, 14 nt, Mycobacterium bovis subsp bovis AF2122/97
auccuucgccggcg

SEQ ID NO: 1124216 - RNA, 15 nt, Mycobacterium bovis subsp bovis AF2122/97
auccuucgccggcgc

SEQ ID NO: 1124217 - RNA, 16 nt, Mycobacterium bovis subsp bovis AF2122/97
auccuucggggugaau

SEQ ID NO: 1124218 - RNA, 13 nt, Mycobacterium bovis subsp bovis AF2122/97
auccucucgauca

SEQ ID NO: 1124219 - RNA, 15 nt, Mycobacterium bovis subsp bovis AF2122/97
augaacguggcgaca

SEQ ID NO: 1124220 - RNA, 23 nt, Mycobacterium bovis subsp bovis AF2122/97
augaacgcaagcagcgcgaucug

SEQ ID NO: 1124221 - RNA, 16 nt, Mycobacterium bovis subsp bovis AF2122/97
augaacgcaaccgagg

SEQ ID NO: 1124222 - RNA, 21 nt, Mycobacterium bovis subsp bovis AF2122/97
augaacgcguagucgcgggug

SEQ ID NO: 1124223 - RNA, 15 nt, Mycobacterium bovis subsp bovis AF2122/97
augacgacggugacc

SEQ ID NO: 1124224 - RNA, 18 nt, Mycobacterium bovis subsp bovis AF2122/97
augacgaaugcgggugga

SEQ ID NO: 1124225 - RNA, 13 nt, Mycobacterium bovis subsp bovis AF2122/97
augacgacgccgu

SEQ ID NO: 1124226 - RNA, 17 nt, Mycobacterium bovis subsp bovis AF2122/97
augaccgggaggcggcg

SEQ ID NO: 1124227 - RNA, 17 nt, Mycobacterium bovis subsp bovis AF2122/97
augaccuggccgcccgc

SEQ ID NO: 1124228 - RNA, 15 nt, Mycobacterium bovis subsp bovis AF2122/97
augaccucggcgacg

SEQ ID NO: 1124229 - RNA, 16 nt, Mycobacterium bovis subsp bovis AF2122/97
augaccccgucagcgg

SEQ ID NO: 1124230 - RNA, 15 nt, Mycobacterium bovis subsp bovis AF2122/97
augaccacgccgacg

SEQ ID NO: 1124231 - RNA, 19 nt, Mycobacterium bovis subsp bovis AF2122/97
augaccaugaugaccggca

SEQ ID NO: 1124232 - RNA, 17 nt, Mycobacterium bovis subsp bovis AF2122/97
augaccgcguagagcag

SEQ ID NO: 1124233 - RNA, 21 nt, Mycobacterium bovis subsp bovis AF2122/97
augaccaucgaggcgaucacc

SEQ ID NO: 1124234 - RNA, 13 nt, Mycobacterium bovis subsp bovis AF2122/97
augaccaccgguu

SEQ ID NO: 1124235 - RNA, 15 nt, Mycobacterium bovis subsp bovis AF2122/97
augacaccggccacc

SEQ ID NO: 1124236 - RNA, 17 nt, Mycobacterium bovis subsp bovis AF2122/97
augacgccgucggcgcg

SEQ ID NO: 1124237 - RNA, 20 nt, Mycobacterium bovis subsp bovis AF2122/97
augacgccgucggcgcgcac

SEQ ID NO: 1124238 - RNA, 14 nt, Mycobacterium bovis subsp bovis AF2122/97
augacgaucgcggc

SEQ ID NO: 1124239 - RNA, 19 nt, Mycobacterium bovis subsp bovis AF2122/97
augagguucaucgccggcg

SEQ ID NO: 1124240 - RNA, 13 nt, Mycobacterium bovis subsp bovis AF2122/97
augauccgccggc

SEQ ID NO: 1124241 - RNA, 15 nt, Mycobacterium bovis subsp bovis AF2122/97
augaucacaccgagc

SEQ ID NO: 1124242 - RNA, 22 nt, Mycobacterium bovis subsp bovis AF2122/97
augaucgcaccgagguugcgcg

SEQ ID NO: 1124243 - RNA, 15 nt, Mycobacterium bovis subsp bovis AF2122/97
augaucgaacacggc

SEQ ID NO: 1124244 - RNA, 15 nt, Mycobacterium bovis subsp bovis AF2122/97
augauggccgcggcu

SEQ ID NO: 1124245 - RNA, 21 nt, Mycobacterium bovis subsp bovis AF2122/97
augauggccgcggcuccgagg

SEQ ID NO: 1124246 - RNA, 17 nt, Mycobacterium bovis subsp bovis AF2122/97
augauucacgcucggcg

SEQ ID NO: 1124247 - RNA, 16 nt, Mycobacterium bovis subsp bovis AF2122/97
augauggcgcgaucgg

SEQ ID NO: 1124248 - RNA, 14 nt, Mycobacterium bovis subsp bovis AF2122/97
augaugcugccggc

SEQ ID NO: 1124249 - RNA, 15 nt, Mycobacterium bovis subsp bovis AF2122/97
augauggcgcgaucg

SEQ ID NO: 1124250 - RNA, 21 nt, Mycobacterium bovis subsp bovis AF2122/97
augauguagcggcguuccggg

SEQ ID NO: 1124251 - RNA, 20 nt, Mycobacterium bovis subsp bovis AF2122/97
augauguggugugccugcgu

SEQ ID NO: 1124252 - RNA, 15 nt, Mycobacterium bovis subsp bovis AF2122/97
augcaggacucgcgu

SEQ ID NO: 1124253 - RNA, 20 nt, Mycobacterium bovis subsp bovis AF2122/97
augcaguaucgaggccgacg

SEQ ID NO: 1124254 - RNA, 16 nt, Mycobacterium bovis subsp bovis AF2122/97
augcaucgcggcggcg

SEQ ID NO: 1124255 - RNA, 13 nt, Mycobacterium bovis subsp bovis AF2122/97
augcaugccggcu

SEQ ID NO: 1124256 - RNA, 20 nt, Mycobacterium bovis subsp bovis AF2122/97
aucugcgccgcgcgcggcgu

SEQ ID NO: 1124257 - RNA, 20 nt, Mycobacterium bovis subsp bovis AF2122/97
aucugcgcgaggggccggcu

SEQ ID NO: 1124258 - RNA, 14 nt, Mycobacterium bovis subsp bovis AF2122/97
aucugcgcgaugcc

SEQ ID NO: 1124259 - RNA, 18 nt, Mycobacterium bovis subsp bovis AF2122/97
aucugcgggccggugaac

SEQ ID NO: 1124260 - RNA, 17 nt, Mycobacterium bovis subsp bovis AF2122/97
aucucgggcaggccguc

SEQ ID NO: 1124261 - RNA, 20 nt, Mycobacterium bovis subsp bovis AF2122/97
aucucgggcaggccgucgag

SEQ ID NO: 1124262 - RNA, 20 nt, Mycobacterium bovis subsp bovis AF2122/97
aucucggcgagcaccgugcc

SEQ ID NO: 1124263 - RNA, 12 nt, Mycobacterium bovis subsp bovis AF2122/97
aucucggcggcc

SEQ ID NO: 1124264 - RNA, 17 nt, Mycobacterium bovis subsp bovis AF2122/97
aucucggcggccaacag

SEQ ID NO: 1124265 - RNA, 19 nt, Mycobacterium bovis subsp bovis AF2122/97
aucugcuagcuuggcggcc

SEQ ID NO: 1124266 - RNA, 20 nt, Mycobacterium bovis subsp bovis AF2122/97
aucugcuagcuuggcggcca

SEQ ID NO: 1124267 - RNA, 18 nt, Mycobacterium bovis subsp bovis AF2122/97
aucugcuccgcagcagac

SEQ ID NO: 1124268 - RNA, 19 nt, Mycobacterium bovis subsp bovis AF2122/97
aucugcucguggguaccga

SEQ ID NO: 1124269 - RNA, 16 nt, Mycobacterium bovis subsp bovis AF2122/97
aucugcugcucgauca

SEQ ID NO: 1124270 - RNA, 19 nt, Mycobacterium bovis subsp bovis AF2122/97
aucugguaagucagcucga

SEQ ID NO: 1124271 - RNA, 21 nt, Mycobacterium bovis subsp bovis AF2122/97
aucuggggguagccgccggcg

SEQ ID NO: 1124272 - RNA, 22 nt, Mycobacterium bovis subsp bovis AF2122/97
aucuggguccgucgagucgccg

SEQ ID NO: 1124273 - RNA, 20 nt, Mycobacterium bovis subsp bovis AF2122/97
aucugguauucaugcccguc

SEQ ID NO: 1124274 - RNA, 17 nt, Mycobacterium bovis subsp bovis AF2122/97
aucuggauggcgcucac

SEQ ID NO: 1124275 - RNA, 24 nt, Mycobacterium bovis subsp bovis AF2122/97
aucuggaugucccaugcacggccg

SEQ ID NO: 1124276 - RNA, 16 nt, Mycobacterium bovis subsp bovis AF2122/97
aucuggcggauggccg

SEQ ID NO: 1124277 - RNA, 23 nt, Mycobacterium bovis subsp bovis AF2122/97
aucuggccgaagcccgaucggcg

SEQ ID NO: 1124278 - RNA, 17 nt, Mycobacterium bovis subsp bovis AF2122/97
aucuggugggugcggcc

SEQ ID NO: 1124279 - RNA, 21 nt, Mycobacterium bovis subsp bovis AF2122/97
aucuguguuugcggcuucggc

SEQ ID NO: 1124280 - RNA, 14 nt, Mycobacterium bovis subsp bovis AF2122/97
aucugucgcgccgg

SEQ ID NO: 1124281 - RNA, 13 nt, Mycobacterium bovis subsp bovis AF2122/97
aucuguccgcgaa

SEQ ID NO: 1124282 - RNA, 19 nt, Mycobacterium bovis subsp bovis AF2122/97
aucuugccgucggccggca

SEQ ID NO: 1124283 - RNA, 17 nt, Mycobacterium bovis subsp bovis AF2122/97
aucuuggccaccgccga

SEQ ID NO: 1124284 - RNA, 17 nt, Mycobacterium bovis subsp bovis AF2122/97
aucuuggccagcagcgc

SEQ ID NO: 1124285 - RNA, 13 nt, Mycobacterium bovis subsp bovis AF2122/97
aucuugucgagca

SEQ ID NO: 1124286 - RNA, 19 nt, Mycobacterium bovis subsp bovis AF2122/97
aucuugucgagcaccucga

SEQ ID NO: 1124287 - RNA, 17 nt, Mycobacterium bovis subsp bovis AF2122/97
aucuugucgaucugccc

SEQ ID NO: 1124288 - RNA, 23 nt, Mycobacterium bovis subsp bovis AF2122/97
aucuucuccucgucgguuccggg

SEQ ID NO: 1124289 - RNA, 16 nt, Mycobacterium bovis subsp bovis AF2122/97
aucuucggacgccagc

SEQ ID NO: 1124290 - RNA, 15 nt, Mycobacterium bovis subsp bovis AF2122/97
aucuucaccggccgg

SEQ ID NO: 1124291 - RNA, 19 nt, Mycobacterium bovis subsp bovis AF2122/97
aucggcuaccuaacccgca

SEQ ID NO: 1124292 - RNA, 22 nt, Mycobacterium bovis subsp bovis AF2122/97
aucggcgucaggcacaacgcga

SEQ ID NO: 1124293 - RNA, 16 nt, Mycobacterium bovis subsp bovis AF2122/97
aucggcggcguccagc

SEQ ID NO: 1124294 - RNA, 18 nt, Mycobacterium bovis subsp bovis AF2122/97
aucggcggcgucuucguc

SEQ ID NO: 1124295 - RNA, 19 nt, Mycobacterium bovis subsp bovis AF2122/97
aucgucgugucgccgccgu

SEQ ID NO: 1124296 - RNA, 20 nt, Mycobacterium bovis subsp bovis AF2122/97
aucgucgugucgccgccguu

SEQ ID NO: 1124297 - RNA, 19 nt, Mycobacterium bovis subsp bovis AF2122/97
aucgucguugggugccgga

SEQ ID NO: 1124298 - RNA, 23 nt, Mycobacterium bovis subsp bovis AF2122/97
aucgucguugucagcgaacggcc

SEQ ID NO: 1124299 - RNA, 19 nt, Mycobacterium bovis subsp bovis AF2122/97
aucgucugguggcagcgca

SEQ ID NO: 1124300 - RNA, 13 nt, Mycobacterium bovis subsp bovis AF2122/97
aucgucucggcca

SEQ ID NO: 1124301 - RNA, 18 nt, Mycobacterium bovis subsp bovis AF2122/97
aucgugaucgaccggaca

SEQ ID NO: 1124302 - RNA, 20 nt, Mycobacterium bovis subsp bovis AF2122/97
aucguuggcgaccaccgcgu

SEQ ID NO: 1124303 - RNA, 13 nt, Mycobacterium bovis subsp bovis AF2122/97
aucgugccgaaca

SEQ ID NO: 1124304 - RNA, 16 nt, Mycobacterium bovis subsp bovis AF2122/97
aucgugccgaacacgg

SEQ ID NO: 1124305 - RNA, 14 nt, Mycobacterium bovis subsp bovis AF2122/97
aucgugcagguugc

SEQ ID NO: 1124306 - RNA, 19 nt, Mycobacterium bovis subsp bovis AF2122/97
aucgucuugucgccgagua

SEQ ID NO: 1124307 - RNA, 21 nt, Mycobacterium bovis subsp bovis AF2122/97
aucucgccggcgaagaccgcc

SEQ ID NO: 1124308 - RNA, 22 nt, Mycobacterium bovis subsp bovis AF2122/97
aucucgccguacaucagcgcga

SEQ ID NO: 1124309 - RNA, 17 nt, Mycobacterium bovis subsp bovis AF2122/97
aucucgaucgacccggu

SEQ ID NO: 1124310 - RNA, 16 nt, Mycobacterium bovis subsp bovis AF2122/97
aucucgagccgcggca

SEQ ID NO: 1124311 - RNA, 17 nt, Mycobacterium bovis subsp bovis AF2122/97
aucucgacggccucguc

SEQ ID NO: 1124312 - RNA, 19 nt, Mycobacterium bovis subsp bovis AF2122/97
aucuccucggcgaugccgu

SEQ ID NO: 1124313 - RNA, 17 nt, Mycobacterium bovis subsp bovis AF2122/97
aucucgaccagcgccga

SEQ ID NO: 1124314 - RNA, 15 nt, Mycobacterium bovis subsp bovis AF2122/97
aucucgaaggccgcc

SEQ ID NO: 1124315 - RNA, 21 nt, Mycobacterium bovis subsp bovis AF2122/97
aucucgaaggccgccaaccgu

SEQ ID NO: 1124316 - RNA, 22 nt, Mycobacterium bovis subsp bovis AF2122/97
aucuccccgaccgcgcccgcgg

SEQ ID NO: 1124317 - RNA, 20 nt, Mycobacterium bovis subsp bovis AF2122/97
aucucccgaccgccgagcgg

SEQ ID NO: 1124318 - RNA, 20 nt, Mycobacterium bovis subsp bovis AF2122/97
aucuccgacuuaagcgaacc

SEQ ID NO: 1124319 - RNA, 17 nt, Mycobacterium bovis subsp bovis AF2122/97
aucuccgccaaccgggu

SEQ ID NO: 1124320 - RNA, 13 nt, Mycobacterium bovis subsp bovis AF2122/97
aucuccggcuggc

SEQ ID NO: 1124321 - RNA, 15 nt, Mycobacterium bovis subsp bovis AF2122/97
aucuccgucggccag

SEQ ID NO: 1124322 - RNA, 23 nt, Mycobacterium bovis subsp bovis AF2122/97
aucuccuccuugagccgggcaac

SEQ ID NO: 1124323 - RNA, 15 nt, Mycobacterium bovis subsp bovis AF2122/97
accgcggauuccggc

SEQ ID NO: 1124324 - RNA, 20 nt, Mycobacterium bovis subsp bovis AF2122/97
accgcggcaagaguugccgg

SEQ ID NO: 1124325 - RNA, 13 nt, Mycobacterium bovis subsp bovis AF2122/97
accgccgucccgg

SEQ ID NO: 1124326 - RNA, 23 nt, Mycobacterium bovis subsp bovis AF2122/97
accgccgucccggcucgagcucg

SEQ ID NO: 1124327 - RNA, 18 nt, Mycobacterium bovis subsp bovis AF2122/97
accgcggauaggccgcgc

SEQ ID NO: 1124328 - RNA, 23 nt, Mycobacterium bovis subsp bovis AF2122/97
accgcggauaggccgcgcggcgg

SEQ ID NO: 1124329 - RNA, 14 nt, Mycobacterium bovis subsp bovis AF2122/97
accgcggaucgacc

SEQ ID NO: 1124330 - RNA, 17 nt, Mycobacterium bovis subsp bovis AF2122/97
accgcggagauaccgga

SEQ ID NO: 1124331 - RNA, 20 nt, Mycobacterium bovis subsp bovis AF2122/97
accgcggccccgccguugcc

SEQ ID NO: 1124332 - RNA, 22 nt, Mycobacterium bovis subsp bovis AF2122/97
accgcggccccgccguugccgc

SEQ ID NO: 1124333 - RNA, 18 nt, Mycobacterium bovis subsp bovis AF2122/97
accgcggcccggacgucg

SEQ ID NO: 1124334 - RNA, 14 nt, Mycobacterium bovis subsp bovis AF2122/97
accgcggccgcggu

SEQ ID NO: 1124335 - RNA, 15 nt, Mycobacterium bovis subsp bovis AF2122/97
accgcggccggccgu

SEQ ID NO: 1124336 - RNA, 12 nt, Mycobacterium bovis subsp bovis AF2122/97
accgcggccggg

SEQ ID NO: 1124337 - RNA, 14 nt, Mycobacterium bovis subsp bovis AF2122/97
accgcggccgggug

SEQ ID NO: 1124338 - RNA, 16 nt, Mycobacterium bovis subsp bovis AF2122/97
accgcggccggguggc

SEQ ID NO: 1124339 - RNA, 17 nt, Mycobacterium bovis subsp bovis AF2122/97
accgcggccggguggcc

SEQ ID NO: 1124340 - RNA, 13 nt, Mycobacterium bovis subsp bovis AF2122/97
accgcggacccgc

SEQ ID NO: 1124341 - RNA, 14 nt, Mycobacterium bovis subsp bovis AF2122/97
accgcggacccgca

SEQ ID NO: 1124342 - RNA, 15 nt, Mycobacterium bovis subsp bovis AF2122/97
accgcggacccgcag

SEQ ID NO: 1124343 - RNA, 19 nt, Mycobacterium bovis subsp bovis AF2122/97
accgccgguggcgccgggg

SEQ ID NO: 1124344 - RNA, 13 nt, Mycobacterium bovis subsp bovis AF2122/97
accgccggugcug

SEQ ID NO: 1124345 - RNA, 15 nt, Mycobacterium bovis subsp bovis AF2122/97
accgccggugcugac

SEQ ID NO: 1124346 - RNA, 13 nt, Mycobacterium bovis subsp bovis AF2122/97
accgccggugccg

SEQ ID NO: 1124347 - RNA, 17 nt, Mycobacterium bovis subsp bovis AF2122/97
accgccggugccgauga

SEQ ID NO: 1124348 - RNA, 15 nt, Mycobacterium bovis subsp bovis AF2122/97
accgccggugccgcc

SEQ ID NO: 1124349 - RNA, 20 nt, Mycobacterium bovis subsp bovis AF2122/97
accgccggugccgccaucgc

SEQ ID NO: 1124350 - RNA, 12 nt, Mycobacterium bovis subsp bovis AF2122/97
accgccggugcg

SEQ ID NO: 1124351 - RNA, 20 nt, Mycobacterium bovis subsp bovis AF2122/97
accgccgggcccucgccaug

SEQ ID NO: 1124352 - RNA, 22 nt, Mycobacterium bovis subsp bovis AF2122/97
accgccgggauaucgucgacgc

SEQ ID NO: 1124353 - RNA, 20 nt, Mycobacterium bovis subsp bovis AF2122/97
accgccggcgccggugccgc

SEQ ID NO: 1124354 - RNA, 20 nt, Mycobacterium bovis subsp bovis AF2122/97
accgcggcgauuacggccag

SEQ ID NO: 1124355 - RNA, 15 nt, Mycobacterium bovis subsp bovis AF2122/97
accgcggcgaucugc

SEQ ID NO: 1124356 - RNA, 19 nt, Mycobacterium bovis subsp bovis AF2122/97
accgcggcgaucugcgaca

SEQ ID NO: 1124357 - RNA, 13 nt, Mycobacterium bovis subsp bovis AF2122/97
accgcggcggccg

SEQ ID NO: 1124358 - RNA, 14 nt, Mycobacterium bovis subsp bovis AF2122/97
accgcggcggcgcg

SEQ ID NO: 1124359 - RNA, 15 nt, Mycobacterium bovis subsp bovis AF2122/97
accgcggcggcggcc

SEQ ID NO: 1124360 - RNA, 18 nt, Mycobacterium bovis subsp bovis AF2122/97
accgcgguacgccggucg

SEQ ID NO: 1124361 - RNA, 21 nt, Mycobacterium bovis subsp bovis AF2122/97
accgcgggcggcaucgccgag

SEQ ID NO: 1124362 - RNA, 22 nt, Mycobacterium bovis subsp bovis AF2122/97
accgcggggaugguguggucga

SEQ ID NO: 1124363 - RNA, 21 nt, Mycobacterium bovis subsp bovis AF2122/97
accgcggggcagcgggccgcc

SEQ ID NO: 1124364 - RNA, 16 nt, Mycobacterium bovis subsp bovis AF2122/97
accgcggucgcugcga

SEQ ID NO: 1124365 - RNA, 23 nt, Mycobacterium bovis subsp bovis AF2122/97
accgcggucauggcgacggucgu

SEQ ID NO: 1124366 - RNA, 20 nt, Mycobacterium bovis subsp bovis AF2122/97
accgcgggaucgguggcggc

SEQ ID NO: 1124367 - RNA, 21 nt, Mycobacterium bovis subsp bovis AF2122/97
accgcggcugcuccgucgccg

SEQ ID NO: 1124368 - RNA, 17 nt, Mycobacterium bovis subsp bovis AF2122/97
accgcggcugucacgcc

SEQ ID NO: 1124369 - RNA, 14 nt, Mycobacterium bovis subsp bovis AF2122/97
accgcgggccgacg

SEQ ID NO: 1124370 - RNA, 14 nt, Mycobacterium bovis subsp bovis AF2122/97
accgcgggccgcca

SEQ ID NO: 1124371 - RNA, 20 nt, Mycobacterium bovis subsp bovis AF2122/97
accgcgggccgccaucucgu

SEQ ID NO: 1124372 - RNA, 14 nt, Mycobacterium bovis subsp bovis AF2122/97
accgcugcggcacc

SEQ ID NO: 1124373 - RNA, 19 nt, Mycobacterium bovis subsp bovis AF2122/97
accgcugcgcgaaucgcgu

SEQ ID NO: 1124374 - RNA, 20 nt, Mycobacterium bovis subsp bovis AF2122/97
accgcugcggcaccacccgg

SEQ ID NO: 1124375 - RNA, 18 nt, Mycobacterium bovis subsp bovis AF2122/97
accgcugccggugugcgg

SEQ ID NO: 1124376 - RNA, 23 nt, Mycobacterium bovis subsp bovis AF2122/97
accgcgucaccggaggccgccgc

SEQ ID NO: 1124377 - RNA, 18 nt, Mycobacterium bovis subsp bovis AF2122/97
accgcgucguagccacgc

SEQ ID NO: 1124378 - RNA, 13 nt, Mycobacterium bovis subsp bovis AF2122/97
accgcgucggcgg

SEQ ID NO: 1124379 - RNA, 12 nt, Mycobacterium bovis subsp bovis AF2122/97
accgcgucgcgg

SEQ ID NO: 1124380 - RNA, 13 nt, Mycobacterium bovis subsp bovis AF2122/97
accgcgucgcggg

SEQ ID NO: 1124381 - RNA, 12 nt, Mycobacterium bovis subsp bovis AF2122/97
accgcgucgaag

SEQ ID NO: 1124382 - RNA, 23 nt, Mycobacterium bovis subsp bovis AF2122/97
accgcgguggccagaucgaacgc

SEQ ID NO: 1124383 - RNA, 19 nt, Mycobacterium bovis subsp bovis AF2122/97
accgcggucugcgcgucgc

SEQ ID NO: 1124384 - RNA, 16 nt, Mycobacterium bovis subsp bovis AF2122/97
accgcggucuucuuca

SEQ ID NO: 1124385 - RNA, 23 nt, Mycobacterium bovis subsp bovis AF2122/97
accgcggucuucuucaccgccuu

SEQ ID NO: 1124386 - RNA, 18 nt, Mycobacterium bovis subsp bovis AF2122/97
accgcggugaguucgccg

SEQ ID NO: 1124387 - RNA, 12 nt, Mycobacterium bovis subsp bovis AF2122/97
accgcggugccc

SEQ ID NO: 1124388 - RNA, 17 nt, Mycobacterium bovis subsp bovis AF2122/97
accgcguacaggccggc

SEQ ID NO: 1124389 - RNA, 22 nt, Mycobacterium bovis subsp bovis AF2122/97
accgcguagaccagugaccgca

SEQ ID NO: 1124390 - RNA, 15 nt, Mycobacterium bovis subsp bovis AF2122/97
accgcgucaucaccg

SEQ ID NO: 1124391 - RNA, 17 nt, Mycobacterium bovis subsp bovis AF2122/97
accggaauacgcgccgc

SEQ ID NO: 1124392 - RNA, 20 nt, Mycobacterium bovis subsp bovis AF2122/97
accggaauacgcgccgccgg

SEQ ID NO: 1124393 - RNA, 20 nt, Mycobacterium bovis subsp bovis AF2122/97
accgcugcuagugcgggccg

SEQ ID NO: 1124394 - RNA, 19 nt, Mycobacterium bovis subsp bovis AF2122/97
accgcuguugcaucgccgc

SEQ ID NO: 1124395 - RNA, 22 nt, Mycobacterium bovis subsp bovis AF2122/97
accggacgaaacgaucgcgcca

SEQ ID NO: 1124396 - RNA, 17 nt, Mycobacterium bovis subsp bovis AF2122/97
accggacaaacaucgca

SEQ ID NO: 1124397 - RNA, 17 nt, Mycobacterium bovis subsp bovis AF2122/97
accggacaaagcugcuc

SEQ ID NO: 1124398 - RNA, 16 nt, Mycobacterium bovis subsp bovis AF2122/97
accggaccaccgccga

SEQ ID NO: 1124399 - RNA, 23 nt, Mycobacterium bovis subsp bovis AF2122/97
accggaccgaagaccuccucggu

SEQ ID NO: 1124400 - RNA, 18 nt, Mycobacterium bovis subsp bovis AF2122/97
accgcuggugugucccgg

SEQ ID NO: 1124401 - RNA, 16 nt, Mycobacterium bovis subsp bovis AF2122/97
accgcuguaaccggua

SEQ ID NO: 1124402 - RNA, 19 nt, Mycobacterium bovis subsp bovis AF2122/97
accgcugggggcggucgcc

SEQ ID NO: 1124403 - RNA, 16 nt, Mycobacterium bovis subsp bovis AF2122/97
accgcugggucgccgu

SEQ ID NO: 1124404 - RNA, 23 nt, Mycobacterium bovis subsp bovis AF2122/97
accgcugcuugucgaggcgcagg

SEQ ID NO: 1124405 - RNA, 22 nt, Mycobacterium bovis subsp bovis AF2122/97
accgcuggaaaaucgggucaca

SEQ ID NO: 1124406 - RNA, 15 nt, Mycobacterium bovis subsp bovis AF2122/97
accgcuggaucgcgu

SEQ ID NO: 1124407 - RNA, 17 nt, Mycobacterium bovis subsp bovis AF2122/97
accggcccgcauccgca

SEQ ID NO: 1124408 - RNA, 18 nt, Mycobacterium bovis subsp bovis AF2122/97
accggcccgcauccgcac

SEQ ID NO: 1124409 - RNA, 21 nt, Mycobacterium bovis subsp bovis AF2122/97
accggcccgcauccgcaccga

SEQ ID NO: 1124410 - RNA, 16 nt, Mycobacterium bovis subsp bovis AF2122/97
accggccgacgcuggc

SEQ ID NO: 1124411 - RNA, 19 nt, Mycobacterium bovis subsp bovis AF2122/97
accggcccgcagcagcauc

SEQ ID NO: 1124412 - RNA, 15 nt, Mycobacterium bovis subsp bovis AF2122/97
accggcccgaugacc

SEQ ID NO: 1124413 - RNA, 16 nt, Mycobacterium bovis subsp bovis AF2122/97
accggcccccggucga

SEQ ID NO: 1124414 - RNA, 15 nt, Mycobacterium bovis subsp bovis AF2122/97
accggcccaguggga

SEQ ID NO: 1124415 - RNA, 15 nt, Mycobacterium bovis subsp bovis AF2122/97
accggcccaccgacg

SEQ ID NO: 1124416 - RNA, 19 nt, Mycobacterium bovis subsp bovis AF2122/97
accggccccaccgacagcc

SEQ ID NO: 1124417 - RNA, 17 nt, Mycobacterium bovis subsp bovis AF2122/97
accggccagaugguggc

SEQ ID NO: 1124418 - RNA, 17 nt, Mycobacterium bovis subsp bovis AF2122/97
accggccagccgacgcg

SEQ ID NO: 1124419 - RNA, 20 nt, Mycobacterium bovis subsp bovis AF2122/97
accggccagccgacgcggcg

SEQ ID NO: 1124420 - RNA, 14 nt, Mycobacterium bovis subsp bovis AF2122/97
accggccagcggcc

SEQ ID NO: 1124421 - RNA, 16 nt, Mycobacterium bovis subsp bovis AF2122/97
accggccagcggcccg

SEQ ID NO: 1124422 - RNA, 23 nt, Mycobacterium bovis subsp bovis AF2122/97
accggccagcggcccgucaccgc

SEQ ID NO: 1124423 - RNA, 16 nt, Mycobacterium bovis subsp bovis AF2122/97
accggccaggccggcg

SEQ ID NO: 1124424 - RNA, 19 nt, Mycobacterium bovis subsp bovis AF2122/97
accggccaggccggcggcg

SEQ ID NO: 1124425 - RNA, 17 nt, Mycobacterium bovis subsp bovis AF2122/97
accggccaccagcccga

SEQ ID NO: 1124426 - RNA, 15 nt, Mycobacterium bovis subsp bovis AF2122/97
accggcaggccggcg

SEQ ID NO: 1124427 - RNA, 14 nt, Mycobacterium bovis subsp bovis AF2122/97
accggcagcugcuc

SEQ ID NO: 1124428 - RNA, 15 nt, Mycobacterium bovis subsp bovis AF2122/97
accggaggccgccgc

SEQ ID NO: 1124429 - RNA, 16 nt, Mycobacterium bovis subsp bovis AF2122/97
accggcacgucgcccc

SEQ ID NO: 1124430 - RNA, 19 nt, Mycobacterium bovis subsp bovis AF2122/97
accggcaucgaagugcggc

SEQ ID NO: 1124431 - RNA, 23 nt, Mycobacterium bovis subsp bovis AF2122/97
accggcaucgaagugcggcccgg

SEQ ID NO: 1124432 - RNA, 20 nt, Mycobacterium bovis subsp bovis AF2122/97
accggcaucgaucaacacca

SEQ ID NO: 1124433 - RNA, 20 nt, Mycobacterium bovis subsp bovis AF2122/97
accggcaugccgccaugcgc

SEQ ID NO: 1124434 - RNA, 21 nt, Mycobacterium bovis subsp bovis AF2122/97
accggcaugccgccaugcgca

SEQ ID NO: 1124435 - RNA, 13 nt, Mycobacterium bovis subsp bovis AF2122/97
accggcgcaccgu

SEQ ID NO: 1124436 - RNA, 18 nt, Mycobacterium bovis subsp bovis AF2122/97
accggcgcaccgucgcgg

SEQ ID NO: 1124437 - RNA, 12 nt, Mycobacterium bovis subsp bovis AF2122/97
accggccggcgc

SEQ ID NO: 1124438 - RNA, 12 nt, Mycobacterium bovis subsp bovis AF2122/97
accggccggccg

SEQ ID NO: 1124439 - RNA, 14 nt, Mycobacterium bovis subsp bovis AF2122/97
accggccggccgcg

SEQ ID NO: 1124440 - RNA, 13 nt, Mycobacterium bovis subsp bovis AF2122/97
accggccgcgacg

SEQ ID NO: 1124441 - RNA, 21 nt, Mycobacterium bovis subsp bovis AF2122/97
accggccgcuauggcccgggc

SEQ ID NO: 1124442 - RNA, 19 nt, Mycobacterium bovis subsp bovis AF2122/97
accggcgccaccggcgccg

SEQ ID NO: 1124443 - RNA, 15 nt, Mycobacterium bovis subsp bovis AF2122/97
accggcgccaccgug

SEQ ID NO: 1124444 - RNA, 21 nt, Mycobacterium bovis subsp bovis AF2122/97
accggcgcccagcgccucgau

SEQ ID NO: 1124445 - RNA, 19 nt, Mycobacterium bovis subsp bovis AF2122/97
accggcgcaguagccgacc

SEQ ID NO: 1124446 - RNA, 20 nt, Mycobacterium bovis subsp bovis AF2122/97
accggcgcaguagccgacca

SEQ ID NO: 1124447 - RNA, 19 nt, Mycobacterium bovis subsp bovis AF2122/97
accggcgccgccgucgccg

SEQ ID NO: 1124448 - RNA, 15 nt, Mycobacterium bovis subsp bovis AF2122/97
accggcgccgccguu

SEQ ID NO: 1124449 - RNA, 13 nt, Mycobacterium bovis subsp bovis AF2122/97
accggcgccgccc

SEQ ID NO: 1124450 - RNA, 14 nt, Mycobacterium bovis subsp bovis AF2122/97
accggcgccgcccg

SEQ ID NO: 1124451 - RNA, 18 nt, Mycobacterium bovis subsp bovis AF2122/97
accggcgccgccgucgcc

SEQ ID NO: 1124452 - RNA, 19 nt, Mycobacterium bovis subsp bovis AF2122/97
accggcgccguagccgauc

SEQ ID NO: 1124453 - RNA, 14 nt, Mycobacterium bovis subsp bovis AF2122/97
accggcgccucauc

SEQ ID NO: 1124454 - RNA, 23 nt, Mycobacterium bovis subsp bovis AF2122/97
accggcgccucaucggacagcgc

SEQ ID NO: 1124455 - RNA, 12 nt, Mycobacterium bovis subsp bovis AF2122/97
accggcggugcc

SEQ ID NO: 1124456 - RNA, 15 nt, Mycobacterium bovis subsp bovis AF2122/97
accggcggcuacggc

SEQ ID NO: 1124457 - RNA, 19 nt, Mycobacterium bovis subsp bovis AF2122/97
accggcggcuacggcugcc

SEQ ID NO: 1124458 - RNA, 16 nt, Mycobacterium bovis subsp bovis AF2122/97
accggcgggcgaacgc

SEQ ID NO: 1124459 - RNA, 20 nt, Mycobacterium bovis subsp bovis AF2122/97
accggcgggcgaacgcuuca

SEQ ID NO: 1124460 - RNA, 14 nt, Mycobacterium bovis subsp bovis AF2122/97
accggcgucgcugc

SEQ ID NO: 1124461 - RNA, 15 nt, Mycobacterium bovis subsp bovis AF2122/97
accggcgucgcugcc

SEQ ID NO: 1124462 - RNA, 17 nt, Mycobacterium bovis subsp bovis AF2122/97
accggcgucggcgcggc

SEQ ID NO: 1124463 - RNA, 19 nt, Mycobacterium bovis subsp bovis AF2122/97
accggcgucggcgcggccg

SEQ ID NO: 1124464 - RNA, 20 nt, Mycobacterium bovis subsp bovis AF2122/97
accggcgucggcgcggccgu

SEQ ID NO: 1124465 - RNA, 21 nt, Mycobacterium bovis subsp bovis AF2122/97
accggcgugucacgucgcagu

SEQ ID NO: 1124466 - RNA, 18 nt, Mycobacterium bovis subsp bovis AF2122/97
accggcgugcaguacacc

SEQ ID NO: 1124467 - RNA, 19 nt, Mycobacterium bovis subsp bovis AF2122/97
accggcguugcguagacga

SEQ ID NO: 1124468 - RNA, 22 nt, Mycobacterium bovis subsp bovis AF2122/97
accggcgucugcccgcccagcc

SEQ ID NO: 1124469 - RNA, 16 nt, Mycobacterium bovis subsp bovis AF2122/97
accggcuugccgccgu

SEQ ID NO: 1124470 - RNA, 12 nt, Mycobacterium bovis subsp bovis AF2122/97
accggcuucggc

SEQ ID NO: 1124471 - RNA, 17 nt, Mycobacterium bovis subsp bovis AF2122/97
accggcuucggccagca

SEQ ID NO: 1124472 - RNA, 21 nt, Mycobacterium bovis subsp bovis AF2122/97
accggcugguugaccgaguug

SEQ ID NO: 1124473 - RNA, 16 nt, Mycobacterium bovis subsp bovis AF2122/97
accgucuuuggugccg

SEQ ID NO: 1124474 - RNA, 12 nt, Mycobacterium bovis subsp bovis AF2122/97
accgugaccgcc

SEQ ID NO: 1124475 - RNA, 14 nt, Mycobacterium bovis subsp bovis AF2122/97
accgugaccgccgc

SEQ ID NO: 1124476 - RNA, 17 nt, Mycobacterium bovis subsp bovis AF2122/97
accgugcaccagcucac

SEQ ID NO: 1124477 - RNA, 18 nt, Mycobacterium bovis subsp bovis AF2122/97
accgucgucaccgcgacg

SEQ ID NO: 1124478 - RNA, 20 nt, Mycobacterium bovis subsp bovis AF2122/97
accgucgucguuucgccagc

SEQ ID NO: 1124479 - RNA, 19 nt, Mycobacterium bovis subsp bovis AF2122/97
accgucguggcgguggccg

SEQ ID NO: 1124480 - RNA, 19 nt, Mycobacterium bovis subsp bovis AF2122/97
accgucguacucggcggcc

SEQ ID NO: 1124481 - RNA, 21 nt, Mycobacterium bovis subsp bovis AF2122/97
accgucguacucggcggccac

SEQ ID NO: 1124482 - RNA, 14 nt, Mycobacterium bovis subsp bovis AF2122/97
accgucgucaccgc

SEQ ID NO: 1124483 - RNA, 16 nt, Mycobacterium bovis subsp bovis AF2122/97
accgucgucaccgcga

SEQ ID NO: 1124484 - RNA, 20 nt, Mycobacterium bovis subsp bovis AF2122/97
accgucugcggaccggcgcg

SEQ ID NO: 1124485 - RNA, 18 nt, Mycobacterium bovis subsp bovis AF2122/97
accgucugcuggccgggu

SEQ ID NO: 1124486 - RNA, 22 nt, Mycobacterium bovis subsp bovis AF2122/97
accgucuggaguucgucaccgu

SEQ ID NO: 1124487 - RNA, 14 nt, Mycobacterium bovis subsp bovis AF2122/97
accgucucgcaccg

SEQ ID NO: 1124488 - RNA, 13 nt, Mycobacterium bovis subsp bovis AF2122/97
accgucucgcccc

SEQ ID NO: 1124489 - RNA, 15 nt, Mycobacterium bovis subsp bovis AF2122/97
accgucucgccgcgc

SEQ ID NO: 1124490 - RNA, 23 nt, Mycobacterium bovis subsp bovis AF2122/97
accgucuccggcgccaccgccgc

SEQ ID NO: 1124491 - RNA, 12 nt, Mycobacterium bovis subsp bovis AF2122/97
accguccgcgga

SEQ ID NO: 1124492 - RNA, 18 nt, Mycobacterium bovis subsp bovis AF2122/97
accgucccugugucgccg

SEQ ID NO: 1124493 - RNA, 20 nt, Mycobacterium bovis subsp bovis AF2122/97
accgucgaaaaaucgaucgu

SEQ ID NO: 1124494 - RNA, 23 nt, Mycobacterium bovis subsp bovis AF2122/97
accguccgggucaccagcgcauc

SEQ ID NO: 1124495 - RNA, 14 nt, Mycobacterium bovis subsp bovis AF2122/97
accguccgucggcg

SEQ ID NO: 1124496 - RNA, 13 nt, Mycobacterium bovis subsp bovis AF2122/97
accguccgacggc

SEQ ID NO: 1124497 - RNA, 12 nt, Mycobacterium bovis subsp bovis AF2122/97
accgucgaggua

SEQ ID NO: 1124498 - RNA, 16 nt, Mycobacterium bovis subsp bovis AF2122/97
accgucgccggugacg

SEQ ID NO: 1124499 - RNA, 14 nt, Mycobacterium bovis subsp bovis AF2122/97
accgucgccugccg

SEQ ID NO: 1124500 - RNA, 17 nt, Mycobacterium bovis subsp bovis AF2122/97
accgucgccugccgacg

SEQ ID NO: 1124501 - RNA, 18 nt, Mycobacterium bovis subsp bovis AF2122/97
accgucgggauggacggc

SEQ ID NO: 1124502 - RNA, 22 nt, Mycobacterium bovis subsp bovis AF2122/97
accgucggcaccagcagccagc

SEQ ID NO: 1124503 - RNA, 16 nt, Mycobacterium bovis subsp bovis AF2122/97
accgucgcgggucaca

SEQ ID NO: 1124504 - RNA, 20 nt, Mycobacterium bovis subsp bovis AF2122/97
accgucggaacugaccacgu

SEQ ID NO: 1124505 - RNA, 14 nt, Mycobacterium bovis subsp bovis AF2122/97
accgucgagccgga

SEQ ID NO: 1124506 - RNA, 23 nt, Mycobacterium bovis subsp bovis AF2122/97
accgucgcgggagaaaacggcgg

SEQ ID NO: 1124507 - RNA, 14 nt, Mycobacterium bovis subsp bovis AF2122/97
accgucgcggguca

SEQ ID NO: 1124508 - RNA, 15 nt, Mycobacterium bovis subsp bovis AF2122/97
accgucgcgcugccg

SEQ ID NO: 1124509 - RNA, 18 nt, Mycobacterium bovis subsp bovis AF2122/97
accgucgcgcugccggcc

SEQ ID NO: 1124510 - RNA, 19 nt, Mycobacterium bovis subsp bovis AF2122/97
accgucgcgcugccggccg

SEQ ID NO: 1124511 - RNA, 20 nt, Mycobacterium bovis subsp bovis AF2122/97
accgucgcgcugccggccgc

SEQ ID NO: 1124512 - RNA, 22 nt, Mycobacterium bovis subsp bovis AF2122/97
accgucgcgcugccggccgcgu

SEQ ID NO: 1124513 - RNA, 21 nt, Mycobacterium bovis subsp bovis AF2122/97
accguggccgcgaucccggcc

SEQ ID NO: 1124514 - RNA, 22 nt, Mycobacterium bovis subsp bovis AF2122/97
accguggaagauguugccgccg

SEQ ID NO: 1124515 - RNA, 16 nt, Mycobacterium bovis subsp bovis AF2122/97
accguggcgcccgcgu

SEQ ID NO: 1124516 - RNA, 17 nt, Mycobacterium bovis subsp bovis AF2122/97
accguggcgccggucgc

SEQ ID NO: 1124517 - RNA, 18 nt, Mycobacterium bovis subsp bovis AF2122/97
accguggcgccggucgcc

SEQ ID NO: 1124518 - RNA, 23 nt, Mycobacterium bovis subsp bovis AF2122/97
accgugcgguauuugaacgcccg

SEQ ID NO: 1124519 - RNA, 20 nt, Mycobacterium bovis subsp bovis AF2122/97
accgugcggucgugccccgc

SEQ ID NO: 1124520 - RNA, 20 nt, Mycobacterium bovis subsp bovis AF2122/97
accgugcugggcaucaccga

SEQ ID NO: 1124521 - RNA, 20 nt, Mycobacterium bovis subsp bovis AF2122/97
accguggauaacgacugaca

SEQ ID NO: 1124522 - RNA, 22 nt, Mycobacterium bovis subsp bovis AF2122/97
accguggauaacgacugacaac

SEQ ID NO: 1124523 - RNA, 17 nt, Mycobacterium bovis subsp bovis AF2122/97
accgugcugggcgccgc

SEQ ID NO: 1124524 - RNA, 19 nt, Mycobacterium bovis subsp bovis AF2122/97
accgugcugggcgccgcgc

SEQ ID NO: 1124525 - RNA, 16 nt, Mycobacterium bovis subsp bovis AF2122/97
accgugccgucggcgu

SEQ ID NO: 1124526 - RNA, 15 nt, Mycobacterium bovis subsp bovis AF2122/97
accgugccgucggcg

SEQ ID NO: 1124527 - RNA, 12 nt, Mycobacterium bovis subsp bovis AF2122/97
accgugccgucg

SEQ ID NO: 1124528 - RNA, 16 nt, Mycobacterium bovis subsp bovis AF2122/97
accgugcccuggguga

SEQ ID NO: 1124529 - RNA, 21 nt, Mycobacterium bovis subsp bovis AF2122/97
accgugcgccgaauggcggug

SEQ ID NO: 1124530 - RNA, 16 nt, Mycobacterium bovis subsp bovis AF2122/97
accgugcacgucagcg

SEQ ID NO: 1124531 - RNA, 17 nt, Mycobacterium bovis subsp bovis AF2122/97
accgugccgggcgacgg

SEQ ID NO: 1124532 - RNA, 13 nt, Mycobacterium bovis subsp bovis AF2122/97
accguggcugcgc

SEQ ID NO: 1124533 - RNA, 17 nt, Mycobacterium bovis subsp bovis AF2122/97
accgugggcgacggcgg

SEQ ID NO: 1124534 - RNA, 20 nt, Mycobacterium bovis subsp bovis AF2122/97
accgugggcgacggcggcgu

SEQ ID NO: 1124535 - RNA, 22 nt, Mycobacterium bovis subsp bovis AF2122/97
accguggcggaucgcgagcgcc

SEQ ID NO: 1124536 - RNA, 23 nt, Mycobacterium bovis subsp bovis AF2122/97
accguggcggccuccuccccgac

SEQ ID NO: 1124537 - RNA, 14 nt, Mycobacterium bovis subsp bovis AF2122/97
accgugucaccgcc

SEQ ID NO: 1124538 - RNA, 11 nt, Mycobacterium bovis subsp bovis AF2122/97
accgugguggu

SEQ ID NO: 1124539 - RNA, 17 nt, Mycobacterium bovis subsp bovis AF2122/97
accgugguguacccgcc

SEQ ID NO: 1124540 - RNA, 20 nt, Mycobacterium bovis subsp bovis AF2122/97
accgugugcacgcgauggcc

SEQ ID NO: 1124541 - RNA, 18 nt, Mycobacterium bovis subsp bovis AF2122/97
accguguggccguuggcc

SEQ ID NO: 1124542 - RNA, 20 nt, Mycobacterium bovis subsp bovis AF2122/97
accgugugggccccgccgau

SEQ ID NO: 1124543 - RNA, 16 nt, Mycobacterium bovis subsp bovis AF2122/97
accgugucgccggcga

SEQ ID NO: 1124544 - RNA, 21 nt, Mycobacterium bovis subsp bovis AF2122/97
accgugucgccggcgaaguug

SEQ ID NO: 1124545 - RNA, 14 nt, Mycobacterium bovis subsp bovis AF2122/97
accguucggcgaca

SEQ ID NO: 1124546 - RNA, 18 nt, Mycobacterium bovis subsp bovis AF2122/97
accguucggcgacagcgc

SEQ ID NO: 1124547 - RNA, 23 nt, Mycobacterium bovis subsp bovis AF2122/97
accguguacugguacagcgcuuc

SEQ ID NO: 1124548 - RNA, 14 nt, Mycobacterium bovis subsp bovis AF2122/97
accguugaccucuu

SEQ ID NO: 1124549 - RNA, 14 nt, Mycobacterium bovis subsp bovis AF2122/97
accguugccgaacc

SEQ ID NO: 1124550 - RNA, 20 nt, Mycobacterium bovis subsp bovis AF2122/97
accguugccgaaccacgcgc

SEQ ID NO: 1124551 - RNA, 21 nt, Mycobacterium bovis subsp bovis AF2122/97
accguugccgaaccacgcgcc

SEQ ID NO: 1124552 - RNA, 21 nt, Mycobacterium bovis subsp bovis AF2122/97
accguguugcugucgaaguug

SEQ ID NO: 1124553 - RNA, 14 nt, Mycobacterium bovis subsp bovis AF2122/97
accguucacccagc

SEQ ID NO: 1124554 - RNA, 21 nt, Mycobacterium bovis subsp bovis AF2122/97
accguucgcucagggugucga

SEQ ID NO: 1124555 - RNA, 21 nt, Mycobacterium bovis subsp bovis AF2122/97
accgggcccgccggccccgcc

SEQ ID NO: 1124556 - RNA, 15 nt, Mycobacterium bovis subsp bovis AF2122/97
accgggcccgacgcg

SEQ ID NO: 1124557 - RNA, 20 nt, Mycobacterium bovis subsp bovis AF2122/97
accgggcaacggcggggccg

SEQ ID NO: 1124558 - RNA, 12 nt, Mycobacterium bovis subsp bovis AF2122/97
accgggcacgga

SEQ ID NO: 1124559 - RNA, 16 nt, Mycobacterium bovis subsp bovis AF2122/97
accgggaucugggucu

SEQ ID NO: 1124560 - RNA, 22 nt, Mycobacterium bovis subsp bovis AF2122/97
accgggcaaaucaagcacagcc

SEQ ID NO: 1124561 - RNA, 20 nt, Mycobacterium bovis subsp bovis AF2122/97
accgggaucggcuccgccgc

SEQ ID NO: 1124562 - RNA, 13 nt, Mycobacterium bovis subsp bovis AF2122/97
accgggauagccg

SEQ ID NO: 1124563 - RNA, 19 nt, Mycobacterium bovis subsp bovis AF2122/97
accgggacgauucucgagu

SEQ ID NO: 1124564 - RNA, 21 nt, Mycobacterium bovis subsp bovis AF2122/97
accgggacaaucucggccgca

SEQ ID NO: 1124565 - RNA, 14 nt, Mycobacterium bovis subsp bovis AF2122/97
accgggaaccacgg

SEQ ID NO: 1124566 - RNA, 20 nt, Mycobacterium bovis subsp bovis AF2122/97
accgggaacagggugguggc

SEQ ID NO: 1124567 - RNA, 15 nt, Mycobacterium bovis subsp bovis AF2122/97
accggugacgcacag

SEQ ID NO: 1124568 - RNA, 21 nt, Mycobacterium bovis subsp bovis AF2122/97
accggugacgcacagcagcac

SEQ ID NO: 1124569 - RNA, 19 nt, Mycobacterium bovis subsp bovis AF2122/97
accggucgucugucucggu

SEQ ID NO: 1124570 - RNA, 23 nt, Mycobacterium bovis subsp bovis AF2122/97
accggucgucugucucggugccu

SEQ ID NO: 1124571 - RNA, 19 nt, Mycobacterium bovis subsp bovis AF2122/97
accggugcccaccaccgac

SEQ ID NO: 1124572 - RNA, 12 nt, Mycobacterium bovis subsp bovis AF2122/97
accggugccgcc

SEQ ID NO: 1124573 - RNA, 16 nt, Mycobacterium bovis subsp bovis AF2122/97
accggugccgcccgcg

SEQ ID NO: 1124574 - RNA, 20 nt, Mycobacterium bovis subsp bovis AF2122/97
accggugccgcccgcgccgc

SEQ ID NO: 1124575 - RNA, 14 nt, Mycobacterium bovis subsp bovis AF2122/97
accggugccgccgu

SEQ ID NO: 1124576 - RNA, 14 nt, Mycobacterium bovis subsp bovis AF2122/97
accggugccggcga

SEQ ID NO: 1124577 - RNA, 16 nt, Mycobacterium bovis subsp bovis AF2122/97
accggugccugcaacg

SEQ ID NO: 1124578 - RNA, 16 nt, Mycobacterium bovis subsp bovis AF2122/97
accgguccgucaccac

SEQ ID NO: 1124579 - RNA, 19 nt, Mycobacterium bovis subsp bovis AF2122/97
accgguccgucaccaccgc

SEQ ID NO: 1124580 - RNA, 15 nt, Mycobacterium bovis subsp bovis AF2122/97
accggucggcagcuu

SEQ ID NO: 1124581 - RNA, 19 nt, Mycobacterium bovis subsp bovis AF2122/97
accgguccugggauccggc

SEQ ID NO: 1124582 - RNA, 15 nt, Mycobacterium bovis subsp bovis AF2122/97
accggucgacagcga

SEQ ID NO: 1124583 - RNA, 17 nt, Mycobacterium bovis subsp bovis AF2122/97
accggugcugucgacgu

SEQ ID NO: 1124584 - RNA, 13 nt, Mycobacterium bovis subsp bovis AF2122/97
accgguggaaacc

SEQ ID NO: 1124585 - RNA, 18 nt, Mycobacterium bovis subsp bovis AF2122/97
accgguggacccggcggu

SEQ ID NO: 1124586 - RNA, 19 nt, Mycobacterium bovis subsp bovis AF2122/97
accgguggcaccggcggcg

SEQ ID NO: 1124587 - RNA, 21 nt, Mycobacterium bovis subsp bovis AF2122/97
accgguggcagccugcugcac

SEQ ID NO: 1124588 - RNA, 13 nt, Mycobacterium bovis subsp bovis AF2122/97
accggugcgcauc

SEQ ID NO: 1124589 - RNA, 21 nt, Mycobacterium bovis subsp bovis AF2122/97
accggugcgcauccgucguac

SEQ ID NO: 1124590 - RNA, 15 nt, Mycobacterium bovis subsp bovis AF2122/97
accgguggugcggcc

SEQ ID NO: 1124591 - RNA, 14 nt, Mycobacterium bovis subsp bovis AF2122/97
accgguguagcagc

SEQ ID NO: 1124592 - RNA, 16 nt, Mycobacterium bovis subsp bovis AF2122/97
accggugucggccagc

SEQ ID NO: 1124593 - RNA, 19 nt, Mycobacterium bovis subsp bovis AF2122/97
accggugucggccagcaac

SEQ ID NO: 1124594 - RNA, 16 nt, Mycobacterium bovis subsp bovis AF2122/97
accggugucuucugcc

SEQ ID NO: 1124595 - RNA, 23 nt, Mycobacterium bovis subsp bovis AF2122/97
accggucggcagcuucucgccga

SEQ ID NO: 1124596 - RNA, 16 nt, Mycobacterium bovis subsp bovis AF2122/97
accgguggggacccgc

SEQ ID NO: 1124597 - RNA, 15 nt, Mycobacterium bovis subsp bovis AF2122/97
accgguguagcagcg

SEQ ID NO: 1124598 - RNA, 14 nt, Mycobacterium bovis subsp bovis AF2122/97
accgguucggcgua

SEQ ID NO: 1124599 - RNA, 20 nt, Mycobacterium bovis subsp bovis AF2122/97
accgguguuccgcccagcga

SEQ ID NO: 1124600 - RNA, 22 nt, Mycobacterium bovis subsp bovis AF2122/97
accgguguugguauguaaguug

SEQ ID NO: 1124601 - RNA, 17 nt, Mycobacterium bovis subsp bovis AF2122/97
accgguucccgggcagc

SEQ ID NO: 1124602 - RNA, 22 nt, Mycobacterium bovis subsp bovis AF2122/97
accgguuggcgauccgcggcgu

SEQ ID NO: 1124603 - RNA, 22 nt, Mycobacterium bovis subsp bovis AF2122/97
accgguuggguagcaccgauuu

SEQ ID NO: 1124604 - RNA, 17 nt, Mycobacterium bovis subsp bovis AF2122/97
accgguugacgggcucg

SEQ ID NO: 1124605 - RNA, 16 nt, Mycobacterium bovis subsp bovis AF2122/97
accgguuucuucggcc

SEQ ID NO: 1124606 - RNA, 17 nt, Mycobacterium bovis subsp bovis AF2122/97
accgguuucuucggcca

SEQ ID NO: 1124607 - RNA, 22 nt, Mycobacterium bovis subsp bovis AF2122/97
accguaaacagcgcgccggcgu

SEQ ID NO: 1124608 - RNA, 22 nt, Mycobacterium bovis subsp bovis AF2122/97
accguaauuucuucacggucga

SEQ ID NO: 1124609 - RNA, 13 nt, Mycobacterium bovis subsp bovis AF2122/97
accgucaugccga

SEQ ID NO: 1124610 - RNA, 20 nt, Mycobacterium bovis subsp bovis AF2122/97
accgucaugaagccguugcc

SEQ ID NO: 1124611 - RNA, 21 nt, Mycobacterium bovis subsp bovis AF2122/97
accgucauuggcuuguccggu

SEQ ID NO: 1124612 - RNA, 17 nt, Mycobacterium bovis subsp bovis AF2122/97
accguccaagccggcug

SEQ ID NO: 1124613 - RNA, 23 nt, Mycobacterium bovis subsp bovis AF2122/97
accgucaucgcggugugccgguc

SEQ ID NO: 1124614 - RNA, 18 nt, Mycobacterium bovis subsp bovis AF2122/97
accgucagcgcgccgucg

SEQ ID NO: 1124615 - RNA, 14 nt, Mycobacterium bovis subsp bovis AF2122/97
accgucagcgccgc

SEQ ID NO: 1124616 - RNA, 18 nt, Mycobacterium bovis subsp bovis AF2122/97
accgucagcgccgcugac

SEQ ID NO: 1124617 - RNA, 13 nt, Mycobacterium bovis subsp bovis AF2122/97
accgucacgucgu

SEQ ID NO: 1124618 - RNA, 17 nt, Mycobacterium bovis subsp bovis AF2122/97
accguauuucguccacg

SEQ ID NO: 1124619 - RNA, 13 nt, Mycobacterium bovis subsp bovis AF2122/97
accguauagccga

SEQ ID NO: 1124620 - RNA, 16 nt, Mycobacterium bovis subsp bovis AF2122/97
accgucacgccaccgc

SEQ ID NO: 1124621 - RNA, 18 nt, Mycobacterium bovis subsp bovis AF2122/97
accgucaccgagcccgau

SEQ ID NO: 1124622 - RNA, 20 nt, Mycobacterium bovis subsp bovis AF2122/97
accgucacaagucgacacgc

SEQ ID NO: 1124623 - RNA, 18 nt, Mycobacterium bovis subsp bovis AF2122/97
accgccgcgcagccgcuc

SEQ ID NO: 1124624 - RNA, 15 nt, Mycobacterium bovis subsp bovis AF2122/97
accgccgcgccggcg

SEQ ID NO: 1124625 - RNA, 16 nt, Mycobacterium bovis subsp bovis AF2122/97
accgccgcgccggcgg

SEQ ID NO: 1124626 - RNA, 17 nt, Mycobacterium bovis subsp bovis AF2122/97
accgccgcgccggcggc

SEQ ID NO: 1124627 - RNA, 23 nt, Mycobacterium bovis subsp bovis AF2122/97
accgccgcgccggcggccaccuc

SEQ ID NO: 1124628 - RNA, 14 nt, Mycobacterium bovis subsp bovis AF2122/97
accgccgcgcggau

SEQ ID NO: 1124629 - RNA, 13 nt, Mycobacterium bovis subsp bovis AF2122/97
accgccgccgcca

SEQ ID NO: 1124630 - RNA, 14 nt, Mycobacterium bovis subsp bovis AF2122/97
accgccggcggcgg

SEQ ID NO: 1124631 - RNA, 15 nt, Mycobacterium bovis subsp bovis AF2122/97
accgccggcggcggc

SEQ ID NO: 1124632 - RNA, 16 nt, Mycobacterium bovis subsp bovis AF2122/97
accgccggcggcggcc

SEQ ID NO: 1124633 - RNA, 21 nt, Mycobacterium bovis subsp bovis AF2122/97
accgccggcuccgccguugcc

SEQ ID NO: 1124634 - RNA, 22 nt, Mycobacterium bovis subsp bovis AF2122/97
accgccggcuccgccguugccg

SEQ ID NO: 1124635 - RNA, 13 nt, Mycobacterium bovis subsp bovis AF2122/97
accgccggcgacg

SEQ ID NO: 1124636 - RNA, 21 nt, Mycobacterium bovis subsp bovis AF2122/97
accgccggcgccaccgucgcc

SEQ ID NO: 1124637 - RNA, 13 nt, Mycobacterium bovis subsp bovis AF2122/97
accgccggcgccg

SEQ ID NO: 1124638 - RNA, 19 nt, Mycobacterium bovis subsp bovis AF2122/97
accgccgcccccgccggcc

SEQ ID NO: 1124639 - RNA, 20 nt, Mycobacterium bovis subsp bovis AF2122/97
accgccgcccccgccggccg

SEQ ID NO: 1124640 - RNA, 21 nt, Mycobacterium bovis subsp bovis AF2122/97
accgccgcccccgccggccgc

SEQ ID NO: 1124641 - RNA, 14 nt, Mycobacterium bovis subsp bovis AF2122/97
accgccgccgccac

SEQ ID NO: 1124642 - RNA, 22 nt, Mycobacterium bovis subsp bovis AF2122/97
accgccgccgccaccggcgccg

SEQ ID NO: 1124643 - RNA, 15 nt, Mycobacterium bovis subsp bovis AF2122/97
accgccgccgccgac

SEQ ID NO: 1124644 - RNA, 16 nt, Mycobacterium bovis subsp bovis AF2122/97
accgccgccggaucgc

SEQ ID NO: 1124645 - RNA, 14 nt, Mycobacterium bovis subsp bovis AF2122/97
accgccgccggcac

SEQ ID NO: 1124646 - RNA, 17 nt, Mycobacterium bovis subsp bovis AF2122/97
accgccgccggcaccgc

SEQ ID NO: 1124647 - RNA, 21 nt, Mycobacterium bovis subsp bovis AF2122/97
accgccgccggcaccgccggc

SEQ ID NO: 1124648 - RNA, 22 nt, Mycobacterium bovis subsp bovis AF2122/97
accgccgccggcaccgccggcg

SEQ ID NO: 1124649 - RNA, 23 nt, Mycobacterium bovis subsp bovis AF2122/97
accgccgccggcaccgccggcgc

SEQ ID NO: 1124650 - RNA, 18 nt, Mycobacterium bovis subsp bovis AF2122/97
accgcccuugccgccggc

SEQ ID NO: 1124651 - RNA, 13 nt, Mycobacterium bovis subsp bovis AF2122/97
accgccgccgaca

SEQ ID NO: 1124652 - RNA, 14 nt, Mycobacterium bovis subsp bovis AF2122/97
accgccgccgacaa

SEQ ID NO: 1124653 - RNA, 13 nt, Mycobacterium bovis subsp bovis AF2122/97
accgcccggcccg

SEQ ID NO: 1124654 - RNA, 24 nt, Mycobacterium bovis subsp bovis AF2122/97
accgcccggcccggcucggugcgc

SEQ ID NO: 1124655 - RNA, 21 nt, Mycobacterium bovis subsp bovis AF2122/97
accgcccuagcgagcggcacc

SEQ ID NO: 1124656 - RNA, 13 nt, Mycobacterium bovis subsp bovis AF2122/97
accgcccgccgaa

SEQ ID NO: 1124657 - RNA, 13 nt, Mycobacterium bovis subsp bovis AF2122/97
accgcccgccagc

SEQ ID NO: 1124658 - RNA, 15 nt, Mycobacterium bovis subsp bovis AF2122/97
accgccaugaacucg

SEQ ID NO: 1124659 - RNA, 19 nt, Mycobacterium bovis subsp bovis AF2122/97
accgccauccuucggggug

SEQ ID NO: 1124660 - RNA, 23 nt, Mycobacterium bovis subsp bovis AF2122/97
accgccaugagguaggucgccgc

SEQ ID NO: 1124661 - RNA, 15 nt, Mycobacterium bovis subsp bovis AF2122/97
accgccaucgccaac

SEQ ID NO: 1124662 - RNA, 16 nt, Mycobacterium bovis subsp bovis AF2122/97
accgcccccagcgguu

SEQ ID NO: 1124663 - RNA, 15 nt, Mycobacterium bovis subsp bovis AF2122/97
accgccaccgcggcc

SEQ ID NO: 1124664 - RNA, 22 nt, Mycobacterium bovis subsp bovis AF2122/97
accgccaccccugucgggucga

SEQ ID NO: 1124665 - RNA, 17 nt, Mycobacterium bovis subsp bovis AF2122/97
accgccaccccggucgg

SEQ ID NO: 1124666 - RNA, 16 nt, Mycobacterium bovis subsp bovis AF2122/97
accgccaccacgguca

SEQ ID NO: 1124667 - RNA, 19 nt, Mycobacterium bovis subsp bovis AF2122/97
accgccacacggggccgcc

SEQ ID NO: 1124668 - RNA, 15 nt, Mycobacterium bovis subsp bovis AF2122/97
accgccaccacccag

SEQ ID NO: 1124669 - RNA, 17 nt, Mycobacterium bovis subsp bovis AF2122/97
accgccaccuuggcguu

SEQ ID NO: 1124670 - RNA, 22 nt, Mycobacterium bovis subsp bovis AF2122/97
accgccagcugggcagccagau

SEQ ID NO: 1124671 - RNA, 13 nt, Mycobacterium bovis subsp bovis AF2122/97
accgcaccggccg

SEQ ID NO: 1124672 - RNA, 15 nt, Mycobacterium bovis subsp bovis AF2122/97
accgcaccggccgcu

SEQ ID NO: 1124673 - RNA, 18 nt, Mycobacterium bovis subsp bovis AF2122/97
accgcacgcuggcgggca

SEQ ID NO: 1124674 - RNA, 16 nt, Mycobacterium bovis subsp bovis AF2122/97
accgcacggaugucgc

SEQ ID NO: 1124675 - RNA, 18 nt, Mycobacterium bovis subsp bovis AF2122/97
accgcacccugacagcga

SEQ ID NO: 1124676 - RNA, 15 nt, Mycobacterium bovis subsp bovis AF2122/97
accgcacccugggua

SEQ ID NO: 1124677 - RNA, 23 nt, Mycobacterium bovis subsp bovis AF2122/97
accgcacccuggguauccaccgc

SEQ ID NO: 1124678 - RNA, 17 nt, Mycobacterium bovis subsp bovis AF2122/97
accgcaccgaccugagu

SEQ ID NO: 1124679 - RNA, 22 nt, Mycobacterium bovis subsp bovis AF2122/97
accgcaaucauccgaucgccgc

SEQ ID NO: 1124680 - RNA, 15 nt, Mycobacterium bovis subsp bovis AF2122/97
accgcaaggcccaca

SEQ ID NO: 1124681 - RNA, 18 nt, Mycobacterium bovis subsp bovis AF2122/97
accgcaaucggauaccca

SEQ ID NO: 1124682 - RNA, 18 nt, Mycobacterium bovis subsp bovis AF2122/97
accgcaauuggcguagca

SEQ ID NO: 1124683 - RNA, 19 nt, Mycobacterium bovis subsp bovis AF2122/97
accgauggcgguggugccg

SEQ ID NO: 1124684 - RNA, 18 nt, Mycobacterium bovis subsp bovis AF2122/97
accgauggcgcaccggcg

SEQ ID NO: 1124685 - RNA, 13 nt, Mycobacterium bovis subsp bovis AF2122/97
accgaugcgccgg

SEQ ID NO: 1124686 - RNA, 20 nt, Mycobacterium bovis subsp bovis AF2122/97
accgauggcgcgcucaacgg

SEQ ID NO: 1124687 - RNA, 15 nt, Mycobacterium bovis subsp bovis AF2122/97
accgauuggcccgag

SEQ ID NO: 1124688 - RNA, 14 nt, Mycobacterium bovis subsp bovis AF2122/97
accgcaaacccgcc

SEQ ID NO: 1124689 - RNA, 16 nt, Mycobacterium bovis subsp bovis AF2122/97
accgcaaacccgccga

SEQ ID NO: 1124690 - RNA, 16 nt, Mycobacterium bovis subsp bovis AF2122/97
accgcaacucgccgaa

SEQ ID NO: 1124691 - RNA, 20 nt, Mycobacterium bovis subsp bovis AF2122/97
accgcaaaguagacgugcca

SEQ ID NO: 1124692 - RNA, 16 nt, Mycobacterium bovis subsp bovis AF2122/97
accgcaacgcgugcgc

SEQ ID NO: 1124693 - RNA, 14 nt, Mycobacterium bovis subsp bovis AF2122/97
accgaggucggcca

SEQ ID NO: 1124694 - RNA, 15 nt, Mycobacterium bovis subsp bovis AF2122/97
accgagggucgggca

SEQ ID NO: 1124695 - RNA, 20 nt, Mycobacterium bovis subsp bovis AF2122/97
accgagcugauccggguggc

SEQ ID NO: 1124696 - RNA, 16 nt, Mycobacterium bovis subsp bovis AF2122/97
accgagggccgucaca

SEQ ID NO: 1124697 - RNA, 22 nt, Mycobacterium bovis subsp bovis AF2122/97
accgagggucgggcauuccggu

SEQ ID NO: 1124698 - RNA, 13 nt, Mycobacterium bovis subsp bovis AF2122/97
accgagucgauca

SEQ ID NO: 1124699 - RNA, 15 nt, Mycobacterium bovis subsp bovis AF2122/97
accgagucgaucacg

SEQ ID NO: 1124700 - RNA, 22 nt, Mycobacterium bovis subsp bovis AF2122/97
accgaguagaagauggcaccgc

SEQ ID NO: 1124701 - RNA, 13 nt, Mycobacterium bovis subsp bovis AF2122/97
accgaggccgccg

SEQ ID NO: 1124702 - RNA, 14 nt, Mycobacterium bovis subsp bovis AF2122/97
accgaggccgccga

SEQ ID NO: 1124703 - RNA, 15 nt, Mycobacterium bovis subsp bovis AF2122/97
accgaggccgccgag

SEQ ID NO: 1124704 - RNA, 21 nt, Mycobacterium bovis subsp bovis AF2122/97
accgaggaacuugcauccggc

SEQ ID NO: 1124705 - RNA, 14 nt, Mycobacterium bovis subsp bovis AF2122/97
accgaggaccucgu

SEQ ID NO: 1124706 - RNA, 22 nt, Mycobacterium bovis subsp bovis AF2122/97
accgaggaugugguuggugcug

SEQ ID NO: 1124707 - RNA, 18 nt, Mycobacterium bovis subsp bovis AF2122/97
accgagcgcaaucgacca

SEQ ID NO: 1124708 - RNA, 20 nt, Mycobacterium bovis subsp bovis AF2122/97
accgagcgcaaucgaccacg

SEQ ID NO: 1124709 - RNA, 17 nt, Mycobacterium bovis subsp bovis AF2122/97
accgagcugacgccgag

SEQ ID NO: 1124710 - RNA, 18 nt, Mycobacterium bovis subsp bovis AF2122/97
accgagcugacgccgagc

SEQ ID NO: 1124711 - RNA, 17 nt, Mycobacterium bovis subsp bovis AF2122/97
accgagcggucgaucug

SEQ ID NO: 1124712 - RNA, 17 nt, Mycobacterium bovis subsp bovis AF2122/97
accgaucggucguccgg

SEQ ID NO: 1124713 - RNA, 18 nt, Mycobacterium bovis subsp bovis AF2122/97
accgaucggugccggccu

SEQ ID NO: 1124714 - RNA, 13 nt, Mycobacterium bovis subsp bovis AF2122/97
accgaucggcgcg

SEQ ID NO: 1124715 - RNA, 13 nt, Mycobacterium bovis subsp bovis AF2122/97
accgaucgccaag

SEQ ID NO: 1124716 - RNA, 17 nt, Mycobacterium bovis subsp bovis AF2122/97
accgaucuuggccaccg

SEQ ID NO: 1124717 - RNA, 15 nt, Mycobacterium bovis subsp bovis AF2122/97
accgaucuuggccac

SEQ ID NO: 1124718 - RNA, 18 nt, Mycobacterium bovis subsp bovis AF2122/97
accgaugaucucacccag

SEQ ID NO: 1124719 - RNA, 20 nt, Mycobacterium bovis subsp bovis AF2122/97
accgaucagcagggcggcgu

SEQ ID NO: 1124720 - RNA, 16 nt, Mycobacterium bovis subsp bovis AF2122/97
accgaucccgcggccg

SEQ ID NO: 1124721 - RNA, 19 nt, Mycobacterium bovis subsp bovis AF2122/97
accgaucccgcggccgggc

SEQ ID NO: 1124722 - RNA, 17 nt, Mycobacterium bovis subsp bovis AF2122/97
accgaguuccucugcga

SEQ ID NO: 1124723 - RNA, 20 nt, Mycobacterium bovis subsp bovis AF2122/97
accgauaaguucggcuggcg

SEQ ID NO: 1124724 - RNA, 21 nt, Mycobacterium bovis subsp bovis AF2122/97
accgauaaguucggcuggcgu

SEQ ID NO: 1124725 - RNA, 15 nt, Mycobacterium bovis subsp bovis AF2122/97
accgauacaccgacg

SEQ ID NO: 1124726 - RNA, 17 nt, Mycobacterium bovis subsp bovis AF2122/97
accgauacaccgacggg

SEQ ID NO: 1124727 - RNA, 14 nt, Mycobacterium bovis subsp bovis AF2122/97
accgaagccgccgg

SEQ ID NO: 1124728 - RNA, 23 nt, Mycobacterium bovis subsp bovis AF2122/97
accgaagauggccagcgcggcgu

SEQ ID NO: 1124729 - RNA, 14 nt, Mycobacterium bovis subsp bovis AF2122/97
accgaagucugcag

SEQ ID NO: 1124730 - RNA, 15 nt, Mycobacterium bovis subsp bovis AF2122/97
accgaauaccgccgc

SEQ ID NO: 1124731 - RNA, 15 nt, Mycobacterium bovis subsp bovis AF2122/97
accgaacgcggccac

SEQ ID NO: 1124732 - RNA, 18 nt, Mycobacterium bovis subsp bovis AF2122/97
accgaacgcggccaccga

SEQ ID NO: 1124733 - RNA, 23 nt, Mycobacterium bovis subsp bovis AF2122/97
accgaacgcggccaccgaccgca

SEQ ID NO: 1124734 - RNA, 19 nt, Mycobacterium bovis subsp bovis AF2122/97
accgaagagcgcgcgcaac

SEQ ID NO: 1124735 - RNA, 22 nt, Mycobacterium bovis subsp bovis AF2122/97
accgaagaacaguugcccgacg

SEQ ID NO: 1124736 - RNA, 20 nt, Mycobacterium bovis subsp bovis AF2122/97
accgacgcggucggcggccg

SEQ ID NO: 1124737 - RNA, 15 nt, Mycobacterium bovis subsp bovis AF2122/97
accgacgcguccggu

SEQ ID NO: 1124738 - RNA, 15 nt, Mycobacterium bovis subsp bovis AF2122/97
accgacgcugaaguu

SEQ ID NO: 1124739 - RNA, 14 nt, Mycobacterium bovis subsp bovis AF2122/97
accgacgcgggccg

SEQ ID NO: 1124740 - RNA, 16 nt, Mycobacterium bovis subsp bovis AF2122/97
accgacgccgguggca

SEQ ID NO: 1124741 - RNA, 14 nt, Mycobacterium bovis subsp bovis AF2122/97
accgacgccggugu

SEQ ID NO: 1124742 - RNA, 16 nt, Mycobacterium bovis subsp bovis AF2122/97
accgacgccggugucg

SEQ ID NO: 1124743 - RNA, 19 nt, Mycobacterium bovis subsp bovis AF2122/97
accgacgccgucgagcacg

SEQ ID NO: 1124744 - RNA, 23 nt, Mycobacterium bovis subsp bovis AF2122/97
accgacgccgccagguccgccgg

SEQ ID NO: 1124745 - RNA, 18 nt, Mycobacterium bovis subsp bovis AF2122/97
accgaauggccgccgcag

SEQ ID NO: 1124746 - RNA, 21 nt, Mycobacterium bovis subsp bovis AF2122/97
accgaaugugaaaugcgcgau

SEQ ID NO: 1124747 - RNA, 21 nt, Mycobacterium bovis subsp bovis AF2122/97
accgagcacggguagcgucca

SEQ ID NO: 1124748 - RNA, 18 nt, Mycobacterium bovis subsp bovis AF2122/97
accgagccacgacccagc

SEQ ID NO: 1124749 - RNA, 16 nt, Mycobacterium bovis subsp bovis AF2122/97
accgagcccgaucgcg

SEQ ID NO: 1124750 - RNA, 21 nt, Mycobacterium bovis subsp bovis AF2122/97
accgagcccgaucgcggcccg

SEQ ID NO: 1124751 - RNA, 19 nt, Mycobacterium bovis subsp bovis AF2122/97
accgagccgaccggcggca

SEQ ID NO: 1124752 - RNA, 15 nt, Mycobacterium bovis subsp bovis AF2122/97
accgagccgcgaugc

SEQ ID NO: 1124753 - RNA, 17 nt, Mycobacterium bovis subsp bovis AF2122/97
accgagaucaccgccac

SEQ ID NO: 1124754 - RNA, 18 nt, Mycobacterium bovis subsp bovis AF2122/97
accgagaucaugccggcg

SEQ ID NO: 1124755 - RNA, 17 nt, Mycobacterium bovis subsp bovis AF2122/97
accgagacuugcuggcc

SEQ ID NO: 1124756 - RNA, 15 nt, Mycobacterium bovis subsp bovis AF2122/97
accgagaucaccgcc

SEQ ID NO: 1124757 - RNA, 17 nt, Mycobacterium bovis subsp bovis AF2122/97
accgacuugguugccgc

SEQ ID NO: 1124758 - RNA, 20 nt, Mycobacterium bovis subsp bovis AF2122/97
accgagaacugcucgauccg

SEQ ID NO: 1124759 - RNA, 15 nt, Mycobacterium bovis subsp bovis AF2122/97
accgacggcgcaugc

SEQ ID NO: 1124760 - RNA, 20 nt, Mycobacterium bovis subsp bovis AF2122/97
accgacguggccagcccgcc

SEQ ID NO: 1124761 - RNA, 20 nt, Mycobacterium bovis subsp bovis AF2122/97
accgacguuccccuucagca

SEQ ID NO: 1124762 - RNA, 14 nt, Mycobacterium bovis subsp bovis AF2122/97
accgacggccagca

SEQ ID NO: 1124763 - RNA, 15 nt, Mycobacterium bovis subsp bovis AF2122/97
accgacgggucgcgg

SEQ ID NO: 1124764 - RNA, 15 nt, Mycobacterium bovis subsp bovis AF2122/97
acccgaucgucgagc

SEQ ID NO: 1124765 - RNA, 17 nt, Mycobacterium bovis subsp bovis AF2122/97
acccgaucucugcggcg

SEQ ID NO: 1124766 - RNA, 24 nt, Mycobacterium bovis subsp bovis AF2122/97
acccgaucaccuucggccgaccgg

SEQ ID NO: 1124767 - RNA, 19 nt, Mycobacterium bovis subsp bovis AF2122/97
acccgcaacgacugaucaa

SEQ ID NO: 1124768 - RNA, 13 nt, Mycobacterium bovis subsp bovis AF2122/97
acccgaucgcgcc

SEQ ID NO: 1124769 - RNA, 15 nt, Mycobacterium bovis subsp bovis AF2122/97
acccgaucgcgccag

SEQ ID NO: 1124770 - RNA, 18 nt, Mycobacterium bovis subsp bovis AF2122/97
acccgagggccugacgcg

SEQ ID NO: 1124771 - RNA, 23 nt, Mycobacterium bovis subsp bovis AF2122/97
acccgagggccugacgcgucagc

SEQ ID NO: 1124772 - RNA, 15 nt, Mycobacterium bovis subsp bovis AF2122/97
acccgagaucaccgg

SEQ ID NO: 1124773 - RNA, 16 nt, Mycobacterium bovis subsp bovis AF2122/97
acccgagaucaccggu

SEQ ID NO: 1124774 - RNA, 21 nt, Mycobacterium bovis subsp bovis AF2122/97
acccgauaacaaggccgccgc

SEQ ID NO: 1124775 - RNA, 15 nt, Mycobacterium bovis subsp bovis AF2122/97
acccgagccggcacg

SEQ ID NO: 1124776 - RNA, 18 nt, Mycobacterium bovis subsp bovis AF2122/97
acccgagccggcacgcgc

SEQ ID NO: 1124777 - RNA, 19 nt, Mycobacterium bovis subsp bovis AF2122/97
acccgagcgcucgaucacg

SEQ ID NO: 1124778 - RNA, 19 nt, Mycobacterium bovis subsp bovis AF2122/97
acccgacaugguccgacca

SEQ ID NO: 1124779 - RNA, 17 nt, Mycobacterium bovis subsp bovis AF2122/97
acccgacgccacgcguc

SEQ ID NO: 1124780 - RNA, 12 nt, Mycobacterium bovis subsp bovis AF2122/97
acccgacccgau

SEQ ID NO: 1124781 - RNA, 17 nt, Mycobacterium bovis subsp bovis AF2122/97
acccacccgcaccaccg

SEQ ID NO: 1124782 - RNA, 15 nt, Mycobacterium bovis subsp bovis AF2122/97
acccacccgcaccgc

SEQ ID NO: 1124783 - RNA, 18 nt, Mycobacterium bovis subsp bovis AF2122/97
acccacccgcaccgccgg

SEQ ID NO: 1124784 - RNA, 18 nt, Mycobacterium bovis subsp bovis AF2122/97
acccacauggcggcccgg

SEQ ID NO: 1124785 - RNA, 18 nt, Mycobacterium bovis subsp bovis AF2122/97
acccacagucgccggccg

SEQ ID NO: 1124786 - RNA, 20 nt, Mycobacterium bovis subsp bovis AF2122/97
acccacagucgccggccggc

SEQ ID NO: 1124787 - RNA, 17 nt, Mycobacterium bovis subsp bovis AF2122/97
acccacaugacgaucgc

SEQ ID NO: 1124788 - RNA, 13 nt, Mycobacterium bovis subsp bovis AF2122/97
acccaccggccac

SEQ ID NO: 1124789 - RNA, 21 nt, Mycobacterium bovis subsp bovis AF2122/97
acccaccucccgcagccgggc

SEQ ID NO: 1124790 - RNA, 22 nt, Mycobacterium bovis subsp bovis AF2122/97
acccaccucccgcagccgggca

SEQ ID NO: 1124791 - RNA, 21 nt, Mycobacterium bovis subsp bovis AF2122/97
acccacccgcaccgccggcaa

SEQ ID NO: 1124792 - RNA, 16 nt, Mycobacterium bovis subsp bovis AF2122/97
acccaccgaaccgagg

SEQ ID NO: 1124793 - RNA, 17 nt, Mycobacterium bovis subsp bovis AF2122/97
acccaccgaagcgaacg

SEQ ID NO: 1124794 - RNA, 15 nt, Mycobacterium bovis subsp bovis AF2122/97
acccaagucgccgag

SEQ ID NO: 1124795 - RNA, 14 nt, Mycobacterium bovis subsp bovis AF2122/97
acccaauaggcgaa

SEQ ID NO: 1124796 - RNA, 18 nt, Mycobacterium bovis subsp bovis AF2122/97
acccaaugccaccgcggc

SEQ ID NO: 1124797 - RNA, 22 nt, Mycobacterium bovis subsp bovis AF2122/97
acccaaugccaccgcggccgcg

SEQ ID NO: 1124798 - RNA, 15 nt, Mycobacterium bovis subsp bovis AF2122/97
acccaaccccgccgg

SEQ ID NO: 1124799 - RNA, 19 nt, Mycobacterium bovis subsp bovis AF2122/97
acccaagaauucaccacuc

SEQ ID NO: 1124800 - RNA, 19 nt, Mycobacterium bovis subsp bovis AF2122/97
acccaacucaugggccaac

SEQ ID NO: 1124801 - RNA, 16 nt, Mycobacterium bovis subsp bovis AF2122/97
acccaacgaccaccac

SEQ ID NO: 1124802 - RNA, 22 nt, Mycobacterium bovis subsp bovis AF2122/97
acccaacgcggugggcacagcc

SEQ ID NO: 1124803 - RNA, 18 nt, Mycobacterium bovis subsp bovis AF2122/97
acccgcgagcaucgacga

SEQ ID NO: 1124804 - RNA, 21 nt, Mycobacterium bovis subsp bovis AF2122/97
acccgcgagguugaccaccag

SEQ ID NO: 1124805 - RNA, 13 nt, Mycobacterium bovis subsp bovis AF2122/97
acccgcgccgccc

SEQ ID NO: 1124806 - RNA, 14 nt, Mycobacterium bovis subsp bovis AF2122/97
acccgcgccgcgca

SEQ ID NO: 1124807 - RNA, 13 nt, Mycobacterium bovis subsp bovis AF2122/97
acccgcucgcggc

SEQ ID NO: 1124808 - RNA, 15 nt, Mycobacterium bovis subsp bovis AF2122/97
acccgcucgcggcga

SEQ ID NO: 1124809 - RNA, 15 nt, Mycobacterium bovis subsp bovis AF2122/97
acccgcgcgucgccc

SEQ ID NO: 1124810 - RNA, 16 nt, Mycobacterium bovis subsp bovis AF2122/97
acccgcgcgacgccgu

SEQ ID NO: 1124811 - RNA, 21 nt, Mycobacterium bovis subsp bovis AF2122/97
acccgcgcgagcagcuacagc

SEQ ID NO: 1124812 - RNA, 15 nt, Mycobacterium bovis subsp bovis AF2122/97
acccgcgcgccggcg

SEQ ID NO: 1124813 - RNA, 21 nt, Mycobacterium bovis subsp bovis AF2122/97
acccgcacguagaaguaggcg

SEQ ID NO: 1124814 - RNA, 22 nt, Mycobacterium bovis subsp bovis AF2122/97
acccgcacuccacgaucggccc

SEQ ID NO: 1124815 - RNA, 21 nt, Mycobacterium bovis subsp bovis AF2122/97
acccgcaccgcgguacgccgg

SEQ ID NO: 1124816 - RNA, 13 nt, Mycobacterium bovis subsp bovis AF2122/97
acccgcaccggau

SEQ ID NO: 1124817 - RNA, 17 nt, Mycobacterium bovis subsp bovis AF2122/97
acccgcacuccaaguca

SEQ ID NO: 1124818 - RNA, 21 nt, Mycobacterium bovis subsp bovis AF2122/97
acccgcaggucgaucugcgcc

SEQ ID NO: 1124819 - RNA, 19 nt, Mycobacterium bovis subsp bovis AF2122/97
acccgcaggucgcaccaca

SEQ ID NO: 1124820 - RNA, 18 nt, Mycobacterium bovis subsp bovis AF2122/97
acccgcagccgcgagucc

SEQ ID NO: 1124821 - RNA, 20 nt, Mycobacterium bovis subsp bovis AF2122/97
acccgcaccggggugugcgg

SEQ ID NO: 1124822 - RNA, 20 nt, Mycobacterium bovis subsp bovis AF2122/97
acccgcaccggugacgcaca

SEQ ID NO: 1124823 - RNA, 16 nt, Mycobacterium bovis subsp bovis AF2122/97
acccgcaccucaccgg

SEQ ID NO: 1124824 - RNA, 14 nt, Mycobacterium bovis subsp bovis AF2122/97
acccgcaccaccgg

SEQ ID NO: 1124825 - RNA, 12 nt, Mycobacterium bovis subsp bovis AF2122/97
acccgcaccccg

SEQ ID NO: 1124826 - RNA, 16 nt, Mycobacterium bovis subsp bovis AF2122/97
acccgcaccgccggca

SEQ ID NO: 1124827 - RNA, 13 nt, Mycobacterium bovis subsp bovis AF2122/97
acccgcaccaccg

SEQ ID NO: 1124828 - RNA, 17 nt, Mycobacterium bovis subsp bovis AF2122/97
acccgcaaugaccgcgg

SEQ ID NO: 1124829 - RNA, 21 nt, Mycobacterium bovis subsp bovis AF2122/97
acccgcaaugcgcgcgauggc

SEQ ID NO: 1124830 - RNA, 21 nt, Mycobacterium bovis subsp bovis AF2122/97
acccgcaauuccggugaucgc

SEQ ID NO: 1124831 - RNA, 14 nt, Mycobacterium bovis subsp bovis AF2122/97
acccgggcggcggc

SEQ ID NO: 1124832 - RNA, 15 nt, Mycobacterium bovis subsp bovis AF2122/97
acccgggcggcggcg

SEQ ID NO: 1124833 - RNA, 17 nt, Mycobacterium bovis subsp bovis AF2122/97
acccgggcgaccuccgg

SEQ ID NO: 1124834 - RNA, 14 nt, Mycobacterium bovis subsp bovis AF2122/97
acccgggccaucgc

SEQ ID NO: 1124835 - RNA, 17 nt, Mycobacterium bovis subsp bovis AF2122/97
acccgggccucggcgcc

SEQ ID NO: 1124836 - RNA, 14 nt, Mycobacterium bovis subsp bovis AF2122/97
acccgggccgccag

SEQ ID NO: 1124837 - RNA, 18 nt, Mycobacterium bovis subsp bovis AF2122/97
acccgggccacgucgagc

SEQ ID NO: 1124838 - RNA, 20 nt, Mycobacterium bovis subsp bovis AF2122/97
acccgggaaggaaccgggca

SEQ ID NO: 1124839 - RNA, 23 nt, Mycobacterium bovis subsp bovis AF2122/97
acccgggcagcaucaacaccggc

SEQ ID NO: 1124840 - RNA, 19 nt, Mycobacterium bovis subsp bovis AF2122/97
acccgggcagccugcugca

SEQ ID NO: 1124841 - RNA, 19 nt, Mycobacterium bovis subsp bovis AF2122/97
acccggcuguucucgccga

SEQ ID NO: 1124842 - RNA, 14 nt, Mycobacterium bovis subsp bovis AF2122/97
acccgcucggcgcg

SEQ ID NO: 1124843 - RNA, 17 nt, Mycobacterium bovis subsp bovis AF2122/97
acccgcucggccgccgg

SEQ ID NO: 1124844 - RNA, 19 nt, Mycobacterium bovis subsp bovis AF2122/97
acccgcucggccgccgggu

SEQ ID NO: 1124845 - RNA, 20 nt, Mycobacterium bovis subsp bovis AF2122/97
acccgcuggcucaucgaagc

SEQ ID NO: 1124846 - RNA, 15 nt, Mycobacterium bovis subsp bovis AF2122/97
acccgcuggucgagc

SEQ ID NO: 1124847 - RNA, 14 nt, Mycobacterium bovis subsp bovis AF2122/97
acccgcucggccgc

SEQ ID NO: 1124848 - RNA, 17 nt, Mycobacterium bovis subsp bovis AF2122/97
acccgcucggccgucag

SEQ ID NO: 1124849 - RNA, 19 nt, Mycobacterium bovis subsp bovis AF2122/97
acccgguaccucaacacca

SEQ ID NO: 1124850 - RNA, 22 nt, Mycobacterium bovis subsp bovis AF2122/97
acccggucgacgggucggcgcc

SEQ ID NO: 1124851 - RNA, 23 nt, Mycobacterium bovis subsp bovis AF2122/97
acccggucgacgggucggcgccg

SEQ ID NO: 1124852 - RNA, 15 nt, Mycobacterium bovis subsp bovis AF2122/97
acccggugacccgcu

SEQ ID NO: 1124853 - RNA, 23 nt, Mycobacterium bovis subsp bovis AF2122/97
acccggugaugguggcgguuccg

SEQ ID NO: 1124854 - RNA, 23 nt, Mycobacterium bovis subsp bovis AF2122/97
acccggugauggugugcagcagc

SEQ ID NO: 1124855 - RNA, 12 nt, Mycobacterium bovis subsp bovis AF2122/97
acccggugccgc

SEQ ID NO: 1124856 - RNA, 16 nt, Mycobacterium bovis subsp bovis AF2122/97
acccggugccgcagca

SEQ ID NO: 1124857 - RNA, 16 nt, Mycobacterium bovis subsp bovis AF2122/97
acccggucggcggcau

SEQ ID NO: 1124858 - RNA, 13 nt, Mycobacterium bovis subsp bovis AF2122/97
acccggucggcca

SEQ ID NO: 1124859 - RNA, 23 nt, Mycobacterium bovis subsp bovis AF2122/97
acccggucggccauccaccgcag

SEQ ID NO: 1124860 - RNA, 14 nt, Mycobacterium bovis subsp bovis AF2122/97
acccggggugcccg

SEQ ID NO: 1124861 - RNA, 18 nt, Mycobacterium bovis subsp bovis AF2122/97
acccggggugcccggccg

SEQ ID NO: 1124862 - RNA, 18 nt, Mycobacterium bovis subsp bovis AF2122/97
acccggguagacaccgcg

SEQ ID NO: 1124863 - RNA, 19 nt, Mycobacterium bovis subsp bovis AF2122/97
acccggguagacaccgcga

SEQ ID NO: 1124864 - RNA, 15 nt, Mycobacterium bovis subsp bovis AF2122/97
acccgguccagccgg

SEQ ID NO: 1124865 - RNA, 16 nt, Mycobacterium bovis subsp bovis AF2122/97
acccgguaugcgcguc

SEQ ID NO: 1124866 - RNA, 20 nt, Mycobacterium bovis subsp bovis AF2122/97
acccgguaugcgcgucccca

SEQ ID NO: 1124867 - RNA, 14 nt, Mycobacterium bovis subsp bovis AF2122/97
acccgguaguccgc

SEQ ID NO: 1124868 - RNA, 22 nt, Mycobacterium bovis subsp bovis AF2122/97
acccgggccucggcgccgucgg

SEQ ID NO: 1124869 - RNA, 15 nt, Mycobacterium bovis subsp bovis AF2122/97
acccgggcgagcgcg

SEQ ID NO: 1124870 - RNA, 22 nt, Mycobacterium bovis subsp bovis AF2122/97
acccuucgcggugugcggcagc

SEQ ID NO: 1124871 - RNA, 17 nt, Mycobacterium bovis subsp bovis AF2122/97
accgaacccgccaccgc

SEQ ID NO: 1124872 - RNA, 19 nt, Mycobacterium bovis subsp bovis AF2122/97
acccugucgcgcaccggau

SEQ ID NO: 1124873 - RNA, 22 nt, Mycobacterium bovis subsp bovis AF2122/97
acccuucgccgggcaacgcgaa

SEQ ID NO: 1124874 - RNA, 22 nt, Mycobacterium bovis subsp bovis AF2122/97
acccugggcuggcugaccgaau

SEQ ID NO: 1124875 - RNA, 20 nt, Mycobacterium bovis subsp bovis AF2122/97
acccuggguauccaccgcga

SEQ ID NO: 1124876 - RNA, 19 nt, Mycobacterium bovis subsp bovis AF2122/97
acccugggugccggcagcg

SEQ ID NO: 1124877 - RNA, 16 nt, Mycobacterium bovis subsp bovis AF2122/97
acccuggucgaaacgg

SEQ ID NO: 1124878 - RNA, 13 nt, Mycobacterium bovis subsp bovis AF2122/97
acccugguggugc

SEQ ID NO: 1124879 - RNA, 13 nt, Mycobacterium bovis subsp bovis AF2122/97
acccugucgcgca

SEQ ID NO: 1124880 - RNA, 22 nt, Mycobacterium bovis subsp bovis AF2122/97
acccguagguaguuguccagga

SEQ ID NO: 1124881 - RNA, 23 nt, Mycobacterium bovis subsp bovis AF2122/97
acccguauugccaaagcccgaca

SEQ ID NO: 1124882 - RNA, 22 nt, Mycobacterium bovis subsp bovis AF2122/97
acccguacccacgacgggccga

SEQ ID NO: 1124883 - RNA, 20 nt, Mycobacterium bovis subsp bovis AF2122/97
acccguagcuuggcgaucuc

SEQ ID NO: 1124884 - RNA, 11 nt, Mycobacterium bovis subsp bovis AF2122/97
acccgguggcg

SEQ ID NO: 1124885 - RNA, 11 nt, Mycobacterium bovis subsp bovis AF2122/97
acccgguggcu

SEQ ID NO: 1124886 - RNA, 19 nt, Mycobacterium bovis subsp bovis AF2122/97
acccgguggcugaucaccg

SEQ ID NO: 1124887 - RNA, 13 nt, Mycobacterium bovis subsp bovis AF2122/97
acccgguguugag

SEQ ID NO: 1124888 - RNA, 23 nt, Mycobacterium bovis subsp bovis AF2122/97
acccgguguugagcgaacccgcg

SEQ ID NO: 1124889 - RNA, 17 nt, Mycobacterium bovis subsp bovis AF2122/97
acccgguuauggcaagc

SEQ ID NO: 1124890 - RNA, 21 nt, Mycobacterium bovis subsp bovis AF2122/97
acccgguuauggcaagccguu

SEQ ID NO: 1124891 - RNA, 19 nt, Mycobacterium bovis subsp bovis AF2122/97
acccguaggguggccgacg

SEQ ID NO: 1124892 - RNA, 20 nt, Mycobacterium bovis subsp bovis AF2122/97
acccguucgugagcggccag

SEQ ID NO: 1124893 - RNA, 13 nt, Mycobacterium bovis subsp bovis AF2122/97
acccguucucggu

SEQ ID NO: 1124894 - RNA, 15 nt, Mycobacterium bovis subsp bovis AF2122/97
acccguucggcugcg

SEQ ID NO: 1124895 - RNA, 19 nt, Mycobacterium bovis subsp bovis AF2122/97
acccguucgugagcggcca

SEQ ID NO: 1124896 - RNA, 22 nt, Mycobacterium bovis subsp bovis AF2122/97
acccguuuugggugaucgcaca

SEQ ID NO: 1124897 - RNA, 20 nt, Mycobacterium bovis subsp bovis AF2122/97
acccuagauaugcacccgca

SEQ ID NO: 1124898 - RNA, 21 nt, Mycobacterium bovis subsp bovis AF2122/97
acccguugaagacggccaccg

SEQ ID NO: 1124899 - RNA, 19 nt, Mycobacterium bovis subsp bovis AF2122/97
acccguugcucccacggca

SEQ ID NO: 1124900 - RNA, 21 nt, Mycobacterium bovis subsp bovis AF2122/97
acccguuggauguuuuccggu

SEQ ID NO: 1124901 - RNA, 17 nt, Mycobacterium bovis subsp bovis AF2122/97
acccuccacagcggcca

SEQ ID NO: 1124902 - RNA, 12 nt, Mycobacterium bovis subsp bovis AF2122/97
acccuccgccgg

SEQ ID NO: 1124903 - RNA, 22 nt, Mycobacterium bovis subsp bovis AF2122/97
accagcgccuugaccagcagcu

SEQ ID NO: 1124904 - RNA, 13 nt, Mycobacterium bovis subsp bovis AF2122/97
accagcgcccggc

SEQ ID NO: 1124905 - RNA, 14 nt, Mycobacterium bovis subsp bovis AF2122/97
accagcgcccggcc

SEQ ID NO: 1124906 - RNA, 16 nt, Mycobacterium bovis subsp bovis AF2122/97
accagcgccccggcgc

SEQ ID NO: 1124907 - RNA, 12 nt, Mycobacterium bovis subsp bovis AF2122/97
accagcgccacg

SEQ ID NO: 1124908 - RNA, 18 nt, Mycobacterium bovis subsp bovis AF2122/97
accagcgagcccagcugc

SEQ ID NO: 1124909 - RNA, 19 nt, Mycobacterium bovis subsp bovis AF2122/97
accagccaaaucagccagg

SEQ ID NO: 1124910 - RNA, 17 nt, Mycobacterium bovis subsp bovis AF2122/97
accagcccaccggcgcc

SEQ ID NO: 1124911 - RNA, 19 nt, Mycobacterium bovis subsp bovis AF2122/97
accagcccaccggcgccgc

SEQ ID NO: 1124912 - RNA, 14 nt, Mycobacterium bovis subsp bovis AF2122/97
accagccaccacca

SEQ ID NO: 1124913 - RNA, 19 nt, Mycobacterium bovis subsp bovis AF2122/97
accagccagccugcuggcc

SEQ ID NO: 1124914 - RNA, 18 nt, Mycobacterium bovis subsp bovis AF2122/97
accagaucuucgagcgca

SEQ ID NO: 1124915 - RNA, 14 nt, Mycobacterium bovis subsp bovis AF2122/97
accagaguucggcc

SEQ ID NO: 1124916 - RNA, 18 nt, Mycobacterium bovis subsp bovis AF2122/97
accagagcgucgaacacg

SEQ ID NO: 1124917 - RNA, 20 nt, Mycobacterium bovis subsp bovis AF2122/97
accagagcgucgaacacguc

SEQ ID NO: 1124918 - RNA, 20 nt, Mycobacterium bovis subsp bovis AF2122/97
accagaggcgugucgacucc

SEQ ID NO: 1124919 - RNA, 22 nt, Mycobacterium bovis subsp bovis AF2122/97
accagagcacgggcucgcugca

SEQ ID NO: 1124920 - RNA, 21 nt, Mycobacterium bovis subsp bovis AF2122/97
accagcaacagcccgaggcca

SEQ ID NO: 1124921 - RNA, 17 nt, Mycobacterium bovis subsp bovis AF2122/97
accagcaaccaccccag

SEQ ID NO: 1124922 - RNA, 19 nt, Mycobacterium bovis subsp bovis AF2122/97
accagcaacgacaaaccgg

SEQ ID NO: 1124923 - RNA, 13 nt, Mycobacterium bovis subsp bovis AF2122/97
accagcacccgcu

SEQ ID NO: 1124924 - RNA, 17 nt, Mycobacterium bovis subsp bovis AF2122/97
accacggucaagccggc

SEQ ID NO: 1124925 - RNA, 22 nt, Mycobacterium bovis subsp bovis AF2122/97
accacgcgcguuuagucuccgg

SEQ ID NO: 1124926 - RNA, 16 nt, Mycobacterium bovis subsp bovis AF2122/97
accacgcgcccgcacc

SEQ ID NO: 1124927 - RNA, 19 nt, Mycobacterium bovis subsp bovis AF2122/97
accacgucgagguccacca

SEQ ID NO: 1124928 - RNA, 13 nt, Mycobacterium bovis subsp bovis AF2122/97
accacgucggcga

SEQ ID NO: 1124929 - RNA, 20 nt, Mycobacterium bovis subsp bovis AF2122/97
accagacacuggccgucggc

SEQ ID NO: 1124930 - RNA, 22 nt, Mycobacterium bovis subsp bovis AF2122/97
accagacacuggccgucggcgu

SEQ ID NO: 1124931 - RNA, 19 nt, Mycobacterium bovis subsp bovis AF2122/97
accacgguggucccccgca

SEQ ID NO: 1124932 - RNA, 23 nt, Mycobacterium bovis subsp bovis AF2122/97
accacgguuggccaccagcuggc

SEQ ID NO: 1124933 - RNA, 18 nt, Mycobacterium bovis subsp bovis AF2122/97
accacgaacgcgcgcagc

SEQ ID NO: 1124934 - RNA, 16 nt, Mycobacterium bovis subsp bovis AF2122/97
accaccuuggaugccc

SEQ ID NO: 1124935 - RNA, 16 nt, Mycobacterium bovis subsp bovis AF2122/97
accaccgcaccugcga

SEQ ID NO: 1124936 - RNA, 13 nt, Mycobacterium bovis subsp bovis AF2122/97
accaccgaccucg

SEQ ID NO: 1124937 - RNA, 20 nt, Mycobacterium bovis subsp bovis AF2122/97
accaccgacagcacccggcc

SEQ ID NO: 1124938 - RNA, 13 nt, Mycobacterium bovis subsp bovis AF2122/97
accaccgccgaca

SEQ ID NO: 1124939 - RNA, 15 nt, Mycobacterium bovis subsp bovis AF2122/97
accaccgccgccggc

SEQ ID NO: 1124940 - RNA, 17 nt, Mycobacterium bovis subsp bovis AF2122/97
accaccgccgccggcac

SEQ ID NO: 1124941 - RNA, 15 nt, Mycobacterium bovis subsp bovis AF2122/97
accaccgccgcugcc

SEQ ID NO: 1124942 - RNA, 11 nt, Mycobacterium bovis subsp bovis AF2122/97
accaccgccgg

SEQ ID NO: 1124943 - RNA, 13 nt, Mycobacterium bovis subsp bovis AF2122/97
accaccgacccgc

SEQ ID NO: 1124944 - RNA, 14 nt, Mycobacterium bovis subsp bovis AF2122/97
accacgccguggcc

SEQ ID NO: 1124945 - RNA, 15 nt, Mycobacterium bovis subsp bovis AF2122/97
accacgaccgcgaca

SEQ ID NO: 1124946 - RNA, 12 nt, Mycobacterium bovis subsp bovis AF2122/97
accaccgccggu

SEQ ID NO: 1124947 - RNA, 18 nt, Mycobacterium bovis subsp bovis AF2122/97
accacgacguucgacgac

SEQ ID NO: 1124948 - RNA, 20 nt, Mycobacterium bovis subsp bovis AF2122/97
accacgauggcggccaccgu

SEQ ID NO: 1124949 - RNA, 23 nt, Mycobacterium bovis subsp bovis AF2122/97
accacgaugaucuugccgcggcg

SEQ ID NO: 1124950 - RNA, 14 nt, Mycobacterium bovis subsp bovis AF2122/97
accacgacgacgac

SEQ ID NO: 1124951 - RNA, 14 nt, Mycobacterium bovis subsp bovis AF2122/97
accacgaggcuugc

SEQ ID NO: 1124952 - RNA, 19 nt, Mycobacterium bovis subsp bovis AF2122/97
accacgaggcuugcggcac

SEQ ID NO: 1124953 - RNA, 19 nt, Mycobacterium bovis subsp bovis AF2122/97
accaccacuaggucgccgg

SEQ ID NO: 1124954 - RNA, 11 nt, Mycobacterium bovis subsp bovis AF2122/97
accaccacggc

SEQ ID NO: 1124955 - RNA, 20 nt, Mycobacterium bovis subsp bovis AF2122/97
accaccacuaggucgccggc

SEQ ID NO: 1124956 - RNA, 22 nt, Mycobacterium bovis subsp bovis AF2122/97
accaccacuaggucgccggcca

SEQ ID NO: 1124957 - RNA, 11 nt, Mycobacterium bovis subsp bovis AF2122/97
accaccacgau

SEQ ID NO: 1124958 - RNA, 16 nt, Mycobacterium bovis subsp bovis AF2122/97
accaccacuucggcgc

SEQ ID NO: 1124959 - RNA, 18 nt, Mycobacterium bovis subsp bovis AF2122/97
accaccacuucggcgccg

SEQ ID NO: 1124960 - RNA, 14 nt, Mycobacterium bovis subsp bovis AF2122/97
accaccagcacggc

SEQ ID NO: 1124961 - RNA, 14 nt, Mycobacterium bovis subsp bovis AF2122/97
accaccaccgccgg

SEQ ID NO: 1124962 - RNA, 17 nt, Mycobacterium bovis subsp bovis AF2122/97
accaccaccgccggugc

SEQ ID NO: 1124963 - RNA, 15 nt, Mycobacterium bovis subsp bovis AF2122/97
accacaccggagccg

SEQ ID NO: 1124964 - RNA, 22 nt, Mycobacterium bovis subsp bovis AF2122/97
accacaaccgugagcaccagca

SEQ ID NO: 1124965 - RNA, 23 nt, Mycobacterium bovis subsp bovis AF2122/97
accacaaccgugagcaccagcag

SEQ ID NO: 1124966 - RNA, 18 nt, Mycobacterium bovis subsp bovis AF2122/97
accaaugcgucgaugcgc

SEQ ID NO: 1124967 - RNA, 19 nt, Mycobacterium bovis subsp bovis AF2122/97
accaaugcguugacgucga

SEQ ID NO: 1124968 - RNA, 18 nt, Mycobacterium bovis subsp bovis AF2122/97
accaauucccgcgcggcg

SEQ ID NO: 1124969 - RNA, 21 nt, Mycobacterium bovis subsp bovis AF2122/97
acauguucuccucgucgcggg

SEQ ID NO: 1124970 - RNA, 13 nt, Mycobacterium bovis subsp bovis AF2122/97
accaugccgucgu

SEQ ID NO: 1124971 - RNA, 19 nt, Mycobacterium bovis subsp bovis AF2122/97
accaugcgguuagcagccg

SEQ ID NO: 1124972 - RNA, 23 nt, Mycobacterium bovis subsp bovis AF2122/97
accaugauugccaggaccgcgcc

SEQ ID NO: 1124973 - RNA, 16 nt, Mycobacterium bovis subsp bovis AF2122/97
accaugccgaucggcc

SEQ ID NO: 1124974 - RNA, 11 nt, Mycobacterium bovis subsp bovis AF2122/97
accaugaccac

SEQ ID NO: 1124975 - RNA, 18 nt, Mycobacterium bovis subsp bovis AF2122/97
accaucgguggccaucgc

SEQ ID NO: 1124976 - RNA, 18 nt, Mycobacterium bovis subsp bovis AF2122/97
accaucgcgacggcaagc

SEQ ID NO: 1124977 - RNA, 17 nt, Mycobacterium bovis subsp bovis AF2122/97
accaucuucacgaagug

SEQ ID NO: 1124978 - RNA, 15 nt, Mycobacterium bovis subsp bovis AF2122/97
accaucugaucgggc

SEQ ID NO: 1124979 - RNA, 22 nt, Mycobacterium bovis subsp bovis AF2122/97
accaucugcuguggaucgacac

SEQ ID NO: 1124980 - RNA, 23 nt, Mycobacterium bovis subsp bovis AF2122/97
accaucuccggugugaucggcgg

SEQ ID NO: 1124981 - RNA, 17 nt, Mycobacterium bovis subsp bovis AF2122/97
accaucguugccggugc

SEQ ID NO: 1124982 - RNA, 19 nt, Mycobacterium bovis subsp bovis AF2122/97
accaucguugccggugccg

SEQ ID NO: 1124983 - RNA, 23 nt, Mycobacterium bovis subsp bovis AF2122/97
accaucguugccggugccgccgc

SEQ ID NO: 1124984 - RNA, 16 nt, Mycobacterium bovis subsp bovis AF2122/97
accaucucaccgggcc

SEQ ID NO: 1124985 - RNA, 13 nt, Mycobacterium bovis subsp bovis AF2122/97
accauugcccgac

SEQ ID NO: 1124986 - RNA, 20 nt, Mycobacterium bovis subsp bovis AF2122/97
accauucgcgggccgaggcc

SEQ ID NO: 1124987 - RNA, 12 nt, Mycobacterium bovis subsp bovis AF2122/97
accauucggcga

SEQ ID NO: 1124988 - RNA, 20 nt, Mycobacterium bovis subsp bovis AF2122/97
accauuguuccguccccgac

SEQ ID NO: 1124989 - RNA, 15 nt, Mycobacterium bovis subsp bovis AF2122/97
accaugcgaccggca

SEQ ID NO: 1124990 - RNA, 16 nt, Mycobacterium bovis subsp bovis AF2122/97
accauggcgccgcgcc

SEQ ID NO: 1124991 - RNA, 18 nt, Mycobacterium bovis subsp bovis AF2122/97
accauggcgccgcgccga

SEQ ID NO: 1124992 - RNA, 23 nt, Mycobacterium bovis subsp bovis AF2122/97
accauggcggcuccgcccggcgu

SEQ ID NO: 1124993 - RNA, 20 nt, Mycobacterium bovis subsp bovis AF2122/97
accaugguagcgccccgaug

SEQ ID NO: 1124994 - RNA, 18 nt, Mycobacterium bovis subsp bovis AF2122/97
accaugucggccacccgg

SEQ ID NO: 1124995 - RNA, 20 nt, Mycobacterium bovis subsp bovis AF2122/97
accaugguugaugacggcgu

SEQ ID NO: 1124996 - RNA, 22 nt, Mycobacterium bovis subsp bovis AF2122/97
accaucacgcccuguucuccgu

SEQ ID NO: 1124997 - RNA, 14 nt, Mycobacterium bovis subsp bovis AF2122/97
accaucaccacggc

SEQ ID NO: 1124998 - RNA, 17 nt, Mycobacterium bovis subsp bovis AF2122/97
accaucaccacggccgc

SEQ ID NO: 1124999 - RNA, 12 nt, Mycobacterium bovis subsp bovis AF2122/97
accaucaccgcg

SEQ ID NO: 1125000 - RNA, 14 nt, Mycobacterium bovis subsp bovis AF2122/97
accaucaccggugc

SEQ ID NO: 1125001 - RNA, 21 nt, Mycobacterium bovis subsp bovis AF2122/97
accaucgaggcgaucaccgcg

SEQ ID NO: 1125002 - RNA, 23 nt, Mycobacterium bovis subsp bovis AF2122/97
accaucgaggcgaucaccgcgcc

SEQ ID NO: 1125003 - RNA, 14 nt, Mycobacterium bovis subsp bovis AF2122/97
accaucgccgccgu

SEQ ID NO: 1125004 - RNA, 21 nt, Mycobacterium bovis subsp bovis AF2122/97
accaucgccgccguugccgcc

SEQ ID NO: 1125005 - RNA, 20 nt, Mycobacterium bovis subsp bovis AF2122/97
accauccgaguugucgccgg

SEQ ID NO: 1125006 - RNA, 15 nt, Mycobacterium bovis subsp bovis AF2122/97
accauccggucccgc

SEQ ID NO: 1125007 - RNA, 19 nt, Mycobacterium bovis subsp bovis AF2122/97
accaucgacccgaucacgc

SEQ ID NO: 1125008 - RNA, 22 nt, Mycobacterium bovis subsp bovis AF2122/97
accaguguggcgaugaccacgc

SEQ ID NO: 1125009 - RNA, 24 nt, Mycobacterium bovis subsp bovis AF2122/97
accagugguuuugggcgauuuugc

SEQ ID NO: 1125010 - RNA, 19 nt, Mycobacterium bovis subsp bovis AF2122/97
accagugcgguggcaggug

SEQ ID NO: 1125011 - RNA, 17 nt, Mycobacterium bovis subsp bovis AF2122/97
accagugccccgccgag

SEQ ID NO: 1125012 - RNA, 22 nt, Mycobacterium bovis subsp bovis AF2122/97
accauacuaauggcgccaccgg

SEQ ID NO: 1125013 - RNA, 17 nt, Mycobacterium bovis subsp bovis AF2122/97
accauacucaccgacgc

SEQ ID NO: 1125014 - RNA, 23 nt, Mycobacterium bovis subsp bovis AF2122/97
accauagccugcgccgacccgcg

SEQ ID NO: 1125015 - RNA, 16 nt, Mycobacterium bovis subsp bovis AF2122/97
accaggcggccguaac

SEQ ID NO: 1125016 - RNA, 12 nt, Mycobacterium bovis subsp bovis AF2122/97
accaggcgagcc

SEQ ID NO: 1125017 - RNA, 13 nt, Mycobacterium bovis subsp bovis AF2122/97
accaggcgagccg

SEQ ID NO: 1125018 - RNA, 17 nt, Mycobacterium bovis subsp bovis AF2122/97
accaggcgagccgccac

SEQ ID NO: 1125019 - RNA, 15 nt, Mycobacterium bovis subsp bovis AF2122/97
accaggccggugacg

SEQ ID NO: 1125020 - RNA, 18 nt, Mycobacterium bovis subsp bovis AF2122/97
accagggacgaugcccuc

SEQ ID NO: 1125021 - RNA, 20 nt, Mycobacterium bovis subsp bovis AF2122/97
accagggcacguucggcgca

SEQ ID NO: 1125022 - RNA, 16 nt, Mycobacterium bovis subsp bovis AF2122/97
accaggcggcgcgggu

SEQ ID NO: 1125023 - RNA, 22 nt, Mycobacterium bovis subsp bovis AF2122/97
accaggcggcgcgggucggcga

SEQ ID NO: 1125024 - RNA, 21 nt, Mycobacterium bovis subsp bovis AF2122/97
accaggcuaauagcucgccgg

SEQ ID NO: 1125025 - RNA, 14 nt, Mycobacterium bovis subsp bovis AF2122/97
accaggcuccggcc

SEQ ID NO: 1125026 - RNA, 18 nt, Mycobacterium bovis subsp bovis AF2122/97
accagcggcaccgcggcc

SEQ ID NO: 1125027 - RNA, 14 nt, Mycobacterium bovis subsp bovis AF2122/97
accaggccgagccg

SEQ ID NO: 1125028 - RNA, 15 nt, Mycobacterium bovis subsp bovis AF2122/97
accaggccgagccgc

SEQ ID NO: 1125029 - RNA, 13 nt, Mycobacterium bovis subsp bovis AF2122/97
accaggccgcgac

SEQ ID NO: 1125030 - RNA, 15 nt, Mycobacterium bovis subsp bovis AF2122/97
accagcggcaccgcg

SEQ ID NO: 1125031 - RNA, 22 nt, Mycobacterium bovis subsp bovis AF2122/97
accagcgcuccagcacccgcgc

SEQ ID NO: 1125032 - RNA, 15 nt, Mycobacterium bovis subsp bovis AF2122/97
accagcgcgcgccga

SEQ ID NO: 1125033 - RNA, 13 nt, Mycobacterium bovis subsp bovis AF2122/97
accagcgcgccgu

SEQ ID NO: 1125034 - RNA, 16 nt, Mycobacterium bovis subsp bovis AF2122/97
accagggcagccgggu

SEQ ID NO: 1125035 - RNA, 20 nt, Mycobacterium bovis subsp bovis AF2122/97
accaggcgagccggcgcgca

SEQ ID NO: 1125036 - RNA, 21 nt, Mycobacterium bovis subsp bovis AF2122/97
accaggcugcagucgagcauc

SEQ ID NO: 1125037 - RNA, 18 nt, Mycobacterium bovis subsp bovis AF2122/97
accagggccucgaccgcc

SEQ ID NO: 1125038 - RNA, 18 nt, Mycobacterium bovis subsp bovis AF2122/97
accagggcgcggaucugc

SEQ ID NO: 1125039 - RNA, 17 nt, Mycobacterium bovis subsp bovis AF2122/97
accagguacgcgaucag

SEQ ID NO: 1125040 - RNA, 15 nt, Mycobacterium bovis subsp bovis AF2122/97
accagguccaccccg

SEQ ID NO: 1125041 - RNA, 19 nt, Mycobacterium bovis subsp bovis AF2122/97
accagguccaccccgccga

SEQ ID NO: 1125042 - RNA, 18 nt, Mycobacterium bovis subsp bovis AF2122/97
accaggucgccagcucgg

SEQ ID NO: 1125043 - RNA, 15 nt, Mycobacterium bovis subsp bovis AF2122/97
accagggugccggcg

SEQ ID NO: 1125044 - RNA, 18 nt, Mycobacterium bovis subsp bovis AF2122/97
accagggugccggcggug

SEQ ID NO: 1125045 - RNA, 14 nt, Mycobacterium bovis subsp bovis AF2122/97
accagggucugcuc

SEQ ID NO: 1125046 - RNA, 20 nt, Mycobacterium bovis subsp bovis AF2122/97
accagguacgcgaucagcgc

SEQ ID NO: 1125047 - RNA, 18 nt, Mycobacterium bovis subsp bovis AF2122/97
accaggugcccgccccga

SEQ ID NO: 1125048 - RNA, 12 nt, Mycobacterium bovis subsp bovis AF2122/97
accaggugcgca

SEQ ID NO: 1125049 - RNA, 15 nt, Mycobacterium bovis subsp bovis AF2122/97
accagguggaccggc

SEQ ID NO: 1125050 - RNA, 16 nt, Mycobacterium bovis subsp bovis AF2122/97
accagguggccaggcc

SEQ ID NO: 1125051 - RNA, 21 nt, Mycobacterium bovis subsp bovis AF2122/97
accaggucggugugcaucgcc

SEQ ID NO: 1125052 - RNA, 14 nt, Mycobacterium bovis subsp bovis AF2122/97
accaggucuucgac

SEQ ID NO: 1125053 - RNA, 15 nt, Mycobacterium bovis subsp bovis AF2122/97
accaguaaugcccau

SEQ ID NO: 1125054 - RNA, 19 nt, Mycobacterium bovis subsp bovis AF2122/97
accaguaccgucaucgcgg

SEQ ID NO: 1125055 - RNA, 18 nt, Mycobacterium bovis subsp bovis AF2122/97
accaguaccaccggcacc

SEQ ID NO: 1125056 - RNA, 18 nt, Mycobacterium bovis subsp bovis AF2122/97
acagguuugcgccgcgca

SEQ ID NO: 1125057 - RNA, 16 nt, Mycobacterium bovis subsp bovis AF2122/97
acaucaaagucggcgu

SEQ ID NO: 1125058 - RNA, 20 nt, Mycobacterium bovis subsp bovis AF2122/97
acaucaaagucggcgucacg

SEQ ID NO: 1125059 - RNA, 14 nt, Mycobacterium bovis subsp bovis AF2122/97
acaggucgccgggg

SEQ ID NO: 1125060 - RNA, 21 nt, Mycobacterium bovis subsp bovis AF2122/97
acaggugccagaccagggcag

SEQ ID NO: 1125061 - RNA, 18 nt, Mycobacterium bovis subsp bovis AF2122/97
acaggucgcccaacaccg

SEQ ID NO: 1125062 - RNA, 14 nt, Mycobacterium bovis subsp bovis AF2122/97
acagguagucgccg

SEQ ID NO: 1125063 - RNA, 21 nt, Mycobacterium bovis subsp bovis AF2122/97
acagguaggguucuucgacgc

SEQ ID NO: 1125064 - RNA, 15 nt, Mycobacterium bovis subsp bovis AF2122/97
acaucaccaccgacc

SEQ ID NO: 1125065 - RNA, 17 nt, Mycobacterium bovis subsp bovis AF2122/97
acaucaccgaacggcga

SEQ ID NO: 1125066 - RNA, 18 nt, Mycobacterium bovis subsp bovis AF2122/97
acaucaccaccgccgggg

SEQ ID NO: 1125067 - RNA, 18 nt, Mycobacterium bovis subsp bovis AF2122/97
acaucagugcgccggcga

SEQ ID NO: 1125068 - RNA, 15 nt, Mycobacterium bovis subsp bovis AF2122/97
acaugccgguugcgg

SEQ ID NO: 1125069 - RNA, 20 nt, Mycobacterium bovis subsp bovis AF2122/97
acaugccgguugcggcugcg

SEQ ID NO: 1125070 - RNA, 20 nt, Mycobacterium bovis subsp bovis AF2122/97
acaugcgccgagauccacgc

SEQ ID NO: 1125071 - RNA, 14 nt, Mycobacterium bovis subsp bovis AF2122/97
acaugccggucauc

SEQ ID NO: 1125072 - RNA, 16 nt, Mycobacterium bovis subsp bovis AF2122/97
acaucgggccgccgag

SEQ ID NO: 1125073 - RNA, 18 nt, Mycobacterium bovis subsp bovis AF2122/97
acaucgggcggcaccgcu

SEQ ID NO: 1125074 - RNA, 16 nt, Mycobacterium bovis subsp bovis AF2122/97
acaucgggucgcugcc

SEQ ID NO: 1125075 - RNA, 20 nt, Mycobacterium bovis subsp bovis AF2122/97
acauggcaagucaacaccgc

SEQ ID NO: 1125076 - RNA, 21 nt, Mycobacterium bovis subsp bovis AF2122/97
acaugguccgaccagcggccg

SEQ ID NO: 1125077 - RNA, 19 nt, Mycobacterium bovis subsp bovis AF2122/97
acaucgcaggcaccccgau

SEQ ID NO: 1125078 - RNA, 23 nt, Mycobacterium bovis subsp bovis AF2122/97
acaucgaggccacgccagcucgc

SEQ ID NO: 1125079 - RNA, 20 nt, Mycobacterium bovis subsp bovis AF2122/97
acaucaugccagccgucacc

SEQ ID NO: 1125080 - RNA, 13 nt, Mycobacterium bovis subsp bovis AF2122/97
acauccacaccgc

SEQ ID NO: 1125081 - RNA, 18 nt, Mycobacterium bovis subsp bovis AF2122/97
acaucgcgaaaccggacc

SEQ ID NO: 1125082 - RNA, 21 nt, Mycobacterium bovis subsp bovis AF2122/97
acaucgcgaaaccggaccuga

SEQ ID NO: 1125083 - RNA, 21 nt, Mycobacterium bovis subsp bovis AF2122/97
acaucgccauaccggccgcca

SEQ ID NO: 1125084 - RNA, 19 nt, Mycobacterium bovis subsp bovis AF2122/97
acaucgcccggaaccggcg

SEQ ID NO: 1125085 - RNA, 15 nt, Mycobacterium bovis subsp bovis AF2122/97
acaucgcgggcgugc

SEQ ID NO: 1125086 - RNA, 19 nt, Mycobacterium bovis subsp bovis AF2122/97
acaucggcccgcugaccau

SEQ ID NO: 1125087 - RNA, 12 nt, Mycobacterium bovis subsp bovis AF2122/97
acaucggcggcc

SEQ ID NO: 1125088 - RNA, 14 nt, Mycobacterium bovis subsp bovis AF2122/97
acaggcgaccgggg

SEQ ID NO: 1125089 - RNA, 18 nt, Mycobacterium bovis subsp bovis AF2122/97
acaggccuaggucgacgc

SEQ ID NO: 1125090 - RNA, 19 nt, Mycobacterium bovis subsp bovis AF2122/97
acaggccuaggucgacgcc

SEQ ID NO: 1125091 - RNA, 22 nt, Mycobacterium bovis subsp bovis AF2122/97
acaggcgcagcgucucgugaac

SEQ ID NO: 1125092 - RNA, 13 nt, Mycobacterium bovis subsp bovis AF2122/97
acaggccggccgc

SEQ ID NO: 1125093 - RNA, 15 nt, Mycobacterium bovis subsp bovis AF2122/97
acaggcccggcaccg

SEQ ID NO: 1125094 - RNA, 15 nt, Mycobacterium bovis subsp bovis AF2122/97
acaggcccgguggcg

SEQ ID NO: 1125095 - RNA, 22 nt, Mycobacterium bovis subsp bovis AF2122/97
acaggcccugguagugaacgga

SEQ ID NO: 1125096 - RNA, 20 nt, Mycobacterium bovis subsp bovis AF2122/97
acaggcguccaucgccaccg

SEQ ID NO: 1125097 - RNA, 15 nt, Mycobacterium bovis subsp bovis AF2122/97
acaggcguccaucgc

SEQ ID NO: 1125098 - RNA, 14 nt, Mycobacterium bovis subsp bovis AF2122/97
acaggcggcgcugc

SEQ ID NO: 1125099 - RNA, 17 nt, Mycobacterium bovis subsp bovis AF2122/97
acagggccagaucgccg

SEQ ID NO: 1125100 - RNA, 16 nt, Mycobacterium bovis subsp bovis AF2122/97
acagggugugcgaaca

SEQ ID NO: 1125101 - RNA, 14 nt, Mycobacterium bovis subsp bovis AF2122/97
acagggaggucgcc

SEQ ID NO: 1125102 - RNA, 15 nt, Mycobacterium bovis subsp bovis AF2122/97
acaggcuugacugca

SEQ ID NO: 1125103 - RNA, 23 nt, Mycobacterium bovis subsp bovis AF2122/97
acagcuugcccgagcccagccgg

SEQ ID NO: 1125104 - RNA, 20 nt, Mycobacterium bovis subsp bovis AF2122/97
acagcuugcgcagccgcagc

SEQ ID NO: 1125105 - RNA, 19 nt, Mycobacterium bovis subsp bovis AF2122/97
acagcuucgcgcagccggu

SEQ ID NO: 1125106 - RNA, 14 nt, Mycobacterium bovis subsp bovis AF2122/97
acagcugaucccag

SEQ ID NO: 1125107 - RNA, 15 nt, Mycobacterium bovis subsp bovis AF2122/97
acagcugacgagccg

SEQ ID NO: 1125108 - RNA, 20 nt, Mycobacterium bovis subsp bovis AF2122/97
acagcugaucccagaucggc

SEQ ID NO: 1125109 - RNA, 15 nt, Mycobacterium bovis subsp bovis AF2122/97
acagcugcgcacguc

SEQ ID NO: 1125110 - RNA, 20 nt, Mycobacterium bovis subsp bovis AF2122/97
acaggaagcguugucgccca

SEQ ID NO: 1125111 - RNA, 17 nt, Mycobacterium bovis subsp bovis AF2122/97
acagcuuggagaucgcc

SEQ ID NO: 1125112 - RNA, 22 nt, Mycobacterium bovis subsp bovis AF2122/97
acagcuuggagaucgccgccgg

SEQ ID NO: 1125113 - RNA, 13 nt, Mycobacterium bovis subsp bovis AF2122/97
acaggaccgggau

SEQ ID NO: 1125114 - RNA, 19 nt, Mycobacterium bovis subsp bovis AF2122/97
acaggagacgguacgccag

SEQ ID NO: 1125115 - RNA, 22 nt, Mycobacterium bovis subsp bovis AF2122/97
acagcucgcgcucgcucacgcc

SEQ ID NO: 1125116 - RNA, 23 nt, Mycobacterium bovis subsp bovis AF2122/97
acagcucaucgauccucgcccgc

SEQ ID NO: 1125117 - RNA, 21 nt, Mycobacterium bovis subsp bovis AF2122/97
acagcaggcauucccgcggca

SEQ ID NO: 1125118 - RNA, 14 nt, Mycobacterium bovis subsp bovis AF2122/97
acagcaggccgcgc

SEQ ID NO: 1125119 - RNA, 21 nt, Mycobacterium bovis subsp bovis AF2122/97
acagcaggccgcgcucgucga

SEQ ID NO: 1125120 - RNA, 15 nt, Mycobacterium bovis subsp bovis AF2122/97
acagcagcgucauca

SEQ ID NO: 1125121 - RNA, 21 nt, Mycobacterium bovis subsp bovis AF2122/97
acagcccggcgacgacccggg

SEQ ID NO: 1125122 - RNA, 14 nt, Mycobacterium bovis subsp bovis AF2122/97
acagcccggcggcg

SEQ ID NO: 1125123 - RNA, 17 nt, Mycobacterium bovis subsp bovis AF2122/97
acagcauggcgaagaac

SEQ ID NO: 1125124 - RNA, 13 nt, Mycobacterium bovis subsp bovis AF2122/97
acagcaucacgcc

SEQ ID NO: 1125125 - RNA, 15 nt, Mycobacterium bovis subsp bovis AF2122/97
acagccgaccucgag

SEQ ID NO: 1125126 - RNA, 19 nt, Mycobacterium bovis subsp bovis AF2122/97
acagccgagccagcagcuu

SEQ ID NO: 1125127 - RNA, 16 nt, Mycobacterium bovis subsp bovis AF2122/97
acagccgcagcggccu

SEQ ID NO: 1125128 - RNA, 11 nt, Mycobacterium bovis subsp bovis AF2122/97
acagccgccga

SEQ ID NO: 1125129 - RNA, 18 nt, Mycobacterium bovis subsp bovis AF2122/97
acagacggcucagcgugc

SEQ ID NO: 1125130 - RNA, 22 nt, Mycobacterium bovis subsp bovis AF2122/97
acagaggucggucagccaccug

SEQ ID NO: 1125131 - RNA, 18 nt, Mycobacterium bovis subsp bovis AF2122/97
acagauagacuagccgau

SEQ ID NO: 1125132 - RNA, 18 nt, Mycobacterium bovis subsp bovis AF2122/97
acagcagccgccggccgg

SEQ ID NO: 1125133 - RNA, 13 nt, Mycobacterium bovis subsp bovis AF2122/97
acagcaacgccca

SEQ ID NO: 1125134 - RNA, 15 nt, Mycobacterium bovis subsp bovis AF2122/97
acacgucgacaccga

SEQ ID NO: 1125135 - RNA, 21 nt, Mycobacterium bovis subsp bovis AF2122/97
acacguccaguggcagccagc

SEQ ID NO: 1125136 - RNA, 14 nt, Mycobacterium bovis subsp bovis AF2122/97
acacguaccggucc

SEQ ID NO: 1125137 - RNA, 17 nt, Mycobacterium bovis subsp bovis AF2122/97
acacgggaagccgcgcc

SEQ ID NO: 1125138 - RNA, 20 nt, Mycobacterium bovis subsp bovis AF2122/97
acacgguguauugggguggc

SEQ ID NO: 1125139 - RNA, 19 nt, Mycobacterium bovis subsp bovis AF2122/97
acacggggccgccagcugc

SEQ ID NO: 1125140 - RNA, 17 nt, Mycobacterium bovis subsp bovis AF2122/97
acacggucaccggcacg

SEQ ID NO: 1125141 - RNA, 21 nt, Mycobacterium bovis subsp bovis AF2122/97
acacggucaccggcacgucgc

SEQ ID NO: 1125142 - RNA, 14 nt, Mycobacterium bovis subsp bovis AF2122/97
acacgguccgccac

SEQ ID NO: 1125143 - RNA, 14 nt, Mycobacterium bovis subsp bovis AF2122/97
acaccugcggcugc

SEQ ID NO: 1125144 - RNA, 15 nt, Mycobacterium bovis subsp bovis AF2122/97
acaccuucgacguug

SEQ ID NO: 1125145 - RNA, 16 nt, Mycobacterium bovis subsp bovis AF2122/97
acaccuuggccgccgg

SEQ ID NO: 1125146 - RNA, 20 nt, Mycobacterium bovis subsp bovis AF2122/97
acaccuuggccgccggccgc

SEQ ID NO: 1125147 - RNA, 22 nt, Mycobacterium bovis subsp bovis AF2122/97
acaccugcgcggcgugcgcggu

SEQ ID NO: 1125148 - RNA, 23 nt, Mycobacterium bovis subsp bovis AF2122/97
acaccuuguggacccgccagggc

SEQ ID NO: 1125149 - RNA, 17 nt, Mycobacterium bovis subsp bovis AF2122/97
acagaccgggcccggcg

SEQ ID NO: 1125150 - RNA, 15 nt, Mycobacterium bovis subsp bovis AF2122/97
acagaccuagcaccg

SEQ ID NO: 1125151 - RNA, 23 nt, Mycobacterium bovis subsp bovis AF2122/97
acacgucuaucuggucgggucgc

SEQ ID NO: 1125152 - RNA, 20 nt, Mycobacterium bovis subsp bovis AF2122/97
acacgugauagcuugcgucg

SEQ ID NO: 1125153 - RNA, 16 nt, Mycobacterium bovis subsp bovis AF2122/97
acacguugacucgucg

SEQ ID NO: 1125154 - RNA, 20 nt, Mycobacterium bovis subsp bovis AF2122/97
acacuagcccgguaucgucc

SEQ ID NO: 1125155 - RNA, 21 nt, Mycobacterium bovis subsp bovis AF2122/97
acaccggcgcucaaugcgguc

SEQ ID NO: 1125156 - RNA, 14 nt, Mycobacterium bovis subsp bovis AF2122/97
acaccggcggcauc

SEQ ID NO: 1125157 - RNA, 14 nt, Mycobacterium bovis subsp bovis AF2122/97
acaccggcgaucac

SEQ ID NO: 1125158 - RNA, 16 nt, Mycobacterium bovis subsp bovis AF2122/97
acaccggcgaucaccg

SEQ ID NO: 1125159 - RNA, 18 nt, Mycobacterium bovis subsp bovis AF2122/97
acaccgggcaccagucgc

SEQ ID NO: 1125160 - RNA, 18 nt, Mycobacterium bovis subsp bovis AF2122/97
acacccaucaccgccagc

SEQ ID NO: 1125161 - RNA, 17 nt, Mycobacterium bovis subsp bovis AF2122/97
acacccaucgaccgccc

SEQ ID NO: 1125162 - RNA, 21 nt, Mycobacterium bovis subsp bovis AF2122/97
acacccccccccccacccacc

SEQ ID NO: 1125163 - RNA, 22 nt, Mycobacterium bovis subsp bovis AF2122/97
acacccagcgugcccgccaccg

SEQ ID NO: 1125164 - RNA, 21 nt, Mycobacterium bovis subsp bovis AF2122/97
acaccccggccuugccaccgg

SEQ ID NO: 1125165 - RNA, 22 nt, Mycobacterium bovis subsp bovis AF2122/97
acaccggccugcgcgaccgacc

SEQ ID NO: 1125166 - RNA, 15 nt, Mycobacterium bovis subsp bovis AF2122/97
acaccggccaccagc

SEQ ID NO: 1125167 - RNA, 12 nt, Mycobacterium bovis subsp bovis AF2122/97
acaccggccagc

SEQ ID NO: 1125168 - RNA, 16 nt, Mycobacterium bovis subsp bovis AF2122/97
acaccggccagcggcc

SEQ ID NO: 1125169 - RNA, 13 nt, Mycobacterium bovis subsp bovis AF2122/97
acaccggccaaca

SEQ ID NO: 1125170 - RNA, 18 nt, Mycobacterium bovis subsp bovis AF2122/97
acaccggccaacagucgc

SEQ ID NO: 1125171 - RNA, 13 nt, Mycobacterium bovis subsp bovis AF2122/97
acaccagcagcac

SEQ ID NO: 1125172 - RNA, 20 nt, Mycobacterium bovis subsp bovis AF2122/97
acaccagcagcacuccggcg

SEQ ID NO: 1125173 - RNA, 12 nt, Mycobacterium bovis subsp bovis AF2122/97
acaccagccaga

SEQ ID NO: 1125174 - RNA, 13 nt, Mycobacterium bovis subsp bovis AF2122/97
acaccagcccggc

SEQ ID NO: 1125175 - RNA, 16 nt, Mycobacterium bovis subsp bovis AF2122/97
acaccagcggucggcg

SEQ ID NO: 1125176 - RNA, 12 nt, Mycobacterium bovis subsp bovis AF2122/97
acaccagcgcgu

SEQ ID NO: 1125177 - RNA, 14 nt, Mycobacterium bovis subsp bovis AF2122/97
acaccagcgaggcc

SEQ ID NO: 1125178 - RNA, 21 nt, Mycobacterium bovis subsp bovis AF2122/97
acaccagaucguuccaggccg

SEQ ID NO: 1125179 - RNA, 12 nt, Mycobacterium bovis subsp bovis AF2122/97
acaccagcucga

SEQ ID NO: 1125180 - RNA, 14 nt, Mycobacterium bovis subsp bovis AF2122/97
acaccaggaugccu

SEQ ID NO: 1125181 - RNA, 14 nt, Mycobacterium bovis subsp bovis AF2122/97
acaccagcggucgg

SEQ ID NO: 1125182 - RNA, 22 nt, Mycobacterium bovis subsp bovis AF2122/97
acaccaggccgagccgcccgcc

SEQ ID NO: 1125183 - RNA, 14 nt, Mycobacterium bovis subsp bovis AF2122/97
acacccacgucgag

SEQ ID NO: 1125184 - RNA, 23 nt, Mycobacterium bovis subsp bovis AF2122/97
acacccaaaccggcccgcagcag

SEQ ID NO: 1125185 - RNA, 14 nt, Mycobacterium bovis subsp bovis AF2122/97
acacccaccucgcc

SEQ ID NO: 1125186 - RNA, 21 nt, Mycobacterium bovis subsp bovis AF2122/97
acaccaugguggugaugccau

SEQ ID NO: 1125187 - RNA, 22 nt, Mycobacterium bovis subsp bovis AF2122/97
acaccaucuccgccgucgccac

SEQ ID NO: 1125188 - RNA, 18 nt, Mycobacterium bovis subsp bovis AF2122/97
acaccaucuccgccgucg

SEQ ID NO: 1125189 - RNA, 23 nt, Mycobacterium bovis subsp bovis AF2122/97
acaccaggucauugccggcgacg

SEQ ID NO: 1125190 - RNA, 17 nt, Mycobacterium bovis subsp bovis AF2122/97
acaccauaggccgacgg

SEQ ID NO: 1125191 - RNA, 16 nt, Mycobacterium bovis subsp bovis AF2122/97
acacagucacggaccg

SEQ ID NO: 1125192 - RNA, 22 nt, Mycobacterium bovis subsp bovis AF2122/97
acacauuucuuugggcggccca

SEQ ID NO: 1125193 - RNA, 14 nt, Mycobacterium bovis subsp bovis AF2122/97
acacauugaccagg

SEQ ID NO: 1125194 - RNA, 20 nt, Mycobacterium bovis subsp bovis AF2122/97
acaccacgguuggccaccag

SEQ ID NO: 1125195 - RNA, 21 nt, Mycobacterium bovis subsp bovis AF2122/97
acaccacgagcguagcgaccu

SEQ ID NO: 1125196 - RNA, 15 nt, Mycobacterium bovis subsp bovis AF2122/97
acaccaccgcccgca

SEQ ID NO: 1125197 - RNA, 18 nt, Mycobacterium bovis subsp bovis AF2122/97
acaccaacgacagcgacg

SEQ ID NO: 1125198 - RNA, 14 nt, Mycobacterium bovis subsp bovis AF2122/97
acgccgccguugcc

SEQ ID NO: 1125199 - RNA, 15 nt, Mycobacterium bovis subsp bovis AF2122/97
acgccgccguugccg

SEQ ID NO: 1125200 - RNA, 21 nt, Mycobacterium bovis subsp bovis AF2122/97
acgccgcgagagccggcggcg

SEQ ID NO: 1125201 - RNA, 14 nt, Mycobacterium bovis subsp bovis AF2122/97
acgccgccggcacc

SEQ ID NO: 1125202 - RNA, 18 nt, Mycobacterium bovis subsp bovis AF2122/97
acgccgccggccgccagc

SEQ ID NO: 1125203 - RNA, 18 nt, Mycobacterium bovis subsp bovis AF2122/97
acgccgcgcagccggccc

SEQ ID NO: 1125204 - RNA, 20 nt, Mycobacterium bovis subsp bovis AF2122/97
acgccgccggcgcugaucgc

SEQ ID NO: 1125205 - RNA, 21 nt, Mycobacterium bovis subsp bovis AF2122/97
acgccgaaaaugccgcccagc

SEQ ID NO: 1125206 - RNA, 12 nt, Mycobacterium bovis subsp bovis AF2122/97
acgccgccggca

SEQ ID NO: 1125207 - RNA, 14 nt, Mycobacterium bovis subsp bovis AF2122/97
acgccgccggcccc

SEQ ID NO: 1125208 - RNA, 16 nt, Mycobacterium bovis subsp bovis AF2122/97
acgccgccggccgcca

SEQ ID NO: 1125209 - RNA, 19 nt, Mycobacterium bovis subsp bovis AF2122/97
acgcccucggcgaccuggc

SEQ ID NO: 1125210 - RNA, 15 nt, Mycobacterium bovis subsp bovis AF2122/97
acgcccucgucgauc

SEQ ID NO: 1125211 - RNA, 17 nt, Mycobacterium bovis subsp bovis AF2122/97
acgcccucgucgaucgc

SEQ ID NO: 1125212 - RNA, 17 nt, Mycobacterium bovis subsp bovis AF2122/97
acgcccuggaaugccgc

SEQ ID NO: 1125213 - RNA, 12 nt, Mycobacterium bovis subsp bovis AF2122/97
acgccggcggcg

SEQ ID NO: 1125214 - RNA, 22 nt, Mycobacterium bovis subsp bovis AF2122/97
acgccgggucguacaacacggg

SEQ ID NO: 1125215 - RNA, 22 nt, Mycobacterium bovis subsp bovis AF2122/97
acgccgggcuguucggccaugg

SEQ ID NO: 1125216 - RNA, 16 nt, Mycobacterium bovis subsp bovis AF2122/97
acgccgggugccgcca

SEQ ID NO: 1125217 - RNA, 19 nt, Mycobacterium bovis subsp bovis AF2122/97
acgccgggugccgccacgu

SEQ ID NO: 1125218 - RNA, 14 nt, Mycobacterium bovis subsp bovis AF2122/97
acgccgguccccgc

SEQ ID NO: 1125219 - RNA, 19 nt, Mycobacterium bovis subsp bovis AF2122/97
acgccgguccccgccggcg

SEQ ID NO: 1125220 - RNA, 14 nt, Mycobacterium bovis subsp bovis AF2122/97
acgccggucgcggu

SEQ ID NO: 1125221 - RNA, 17 nt, Mycobacterium bovis subsp bovis AF2122/97
acgccggguucgccgga

SEQ ID NO: 1125222 - RNA, 17 nt, Mycobacterium bovis subsp bovis AF2122/97
acgccguagcaucgggc

SEQ ID NO: 1125223 - RNA, 14 nt, Mycobacterium bovis subsp bovis AF2122/97
acgccguacccgga

SEQ ID NO: 1125224 - RNA, 23 nt, Mycobacterium bovis subsp bovis AF2122/97
acgccgguggcacggccccugcc

SEQ ID NO: 1125225 - RNA, 23 nt, Mycobacterium bovis subsp bovis AF2122/97
acgccguaucggggcaccacgcc

SEQ ID NO: 1125226 - RNA, 15 nt, Mycobacterium bovis subsp bovis AF2122/97
acgccguccacgccg

SEQ ID NO: 1125227 - RNA, 18 nt, Mycobacterium bovis subsp bovis AF2122/97
acgccgucagaacaccgg

SEQ ID NO: 1125228 - RNA, 21 nt, Mycobacterium bovis subsp bovis AF2122/97
acgccgucagaacaccggcca

SEQ ID NO: 1125229 - RNA, 14 nt, Mycobacterium bovis subsp bovis AF2122/97
acgccgucaugccc

SEQ ID NO: 1125230 - RNA, 16 nt, Mycobacterium bovis subsp bovis AF2122/97
acgccgucaugcccau

SEQ ID NO: 1125231 - RNA, 16 nt, Mycobacterium bovis subsp bovis AF2122/97
acgccgucugacagca

SEQ ID NO: 1125232 - RNA, 15 nt, Mycobacterium bovis subsp bovis AF2122/97
acgccgucggcgccg

SEQ ID NO: 1125233 - RNA, 17 nt, Mycobacterium bovis subsp bovis AF2122/97
acgccgucggcgccggc

SEQ ID NO: 1125234 - RNA, 18 nt, Mycobacterium bovis subsp bovis AF2122/97
acgccgucggcgcgcacc

SEQ ID NO: 1125235 - RNA, 13 nt, Mycobacterium bovis subsp bovis AF2122/97
acgccgucggcgc

SEQ ID NO: 1125236 - RNA, 22 nt, Mycobacterium bovis subsp bovis AF2122/97
acgccgucgagcauccacccau

SEQ ID NO: 1125237 - RNA, 14 nt, Mycobacterium bovis subsp bovis AF2122/97
acgccgucgccugc

SEQ ID NO: 1125238 - RNA, 19 nt, Mycobacterium bovis subsp bovis AF2122/97
acgccgucggacaccgcau

SEQ ID NO: 1125239 - RNA, 18 nt, Mycobacterium bovis subsp bovis AF2122/97
acgccgucgaccggcggg

SEQ ID NO: 1125240 - RNA, 19 nt, Mycobacterium bovis subsp bovis AF2122/97
acgccgucgacgcggccgg

SEQ ID NO: 1125241 - RNA, 21 nt, Mycobacterium bovis subsp bovis AF2122/97
acgccgucgagcacggugagc

SEQ ID NO: 1125242 - RNA, 19 nt, Mycobacterium bovis subsp bovis AF2122/97
acgccguccgguguggcgc

SEQ ID NO: 1125243 - RNA, 15 nt, Mycobacterium bovis subsp bovis AF2122/97
acgccguccucgcua

SEQ ID NO: 1125244 - RNA, 18 nt, Mycobacterium bovis subsp bovis AF2122/97
acgccugcgaggaugcgc

SEQ ID NO: 1125245 - RNA, 15 nt, Mycobacterium bovis subsp bovis AF2122/97
acgccugagccacca

SEQ ID NO: 1125246 - RNA, 18 nt, Mycobacterium bovis subsp bovis AF2122/97
acgccugcucgucggcca

SEQ ID NO: 1125247 - RNA, 22 nt, Mycobacterium bovis subsp bovis AF2122/97
acgccugcucgucggccaccgc

SEQ ID NO: 1125248 - RNA, 19 nt, Mycobacterium bovis subsp bovis AF2122/97
acgcgaaaucccccgacac

SEQ ID NO: 1125249 - RNA, 22 nt, Mycobacterium bovis subsp bovis AF2122/97
acgccugcgggaaguugcccag

SEQ ID NO: 1125250 - RNA, 13 nt, Mycobacterium bovis subsp bovis AF2122/97
acgccuugucggc

SEQ ID NO: 1125251 - RNA, 15 nt, Mycobacterium bovis subsp bovis AF2122/97
acgccuuguuggcgc

SEQ ID NO: 1125252 - RNA, 21 nt, Mycobacterium bovis subsp bovis AF2122/97
acgccuuguuggcgcccgggc

SEQ ID NO: 1125253 - RNA, 17 nt, Mycobacterium bovis subsp bovis AF2122/97
acgccguggcccgcucc

SEQ ID NO: 1125254 - RNA, 24 nt, Mycobacterium bovis subsp bovis AF2122/97
acgccguggagaucuccucgaguu

SEQ ID NO: 1125255 - RNA, 17 nt, Mycobacterium bovis subsp bovis AF2122/97
acgccucgccggccacc

SEQ ID NO: 1125256 - RNA, 18 nt, Mycobacterium bovis subsp bovis AF2122/97
acgccugaaacgauugcu

SEQ ID NO: 1125257 - RNA, 19 nt, Mycobacterium bovis subsp bovis AF2122/97
acgccugaacgacccgcug

SEQ ID NO: 1125258 - RNA, 15 nt, Mycobacterium bovis subsp bovis AF2122/97
acgcggggccggccg

SEQ ID NO: 1125259 - RNA, 16 nt, Mycobacterium bovis subsp bovis AF2122/97
acgcgggugccgggca

SEQ ID NO: 1125260 - RNA, 17 nt, Mycobacterium bovis subsp bovis AF2122/97
acgcgggaacgaugccg

SEQ ID NO: 1125261 - RNA, 18 nt, Mycobacterium bovis subsp bovis AF2122/97
acgcgggaacgaugccgc

SEQ ID NO: 1125262 - RNA, 13 nt, Mycobacterium bovis subsp bovis AF2122/97
acgcgggccgacc

SEQ ID NO: 1125263 - RNA, 20 nt, Mycobacterium bovis subsp bovis AF2122/97
acgcgggagguacccccagc

SEQ ID NO: 1125264 - RNA, 22 nt, Mycobacterium bovis subsp bovis AF2122/97
acgcgggcacugguggcgaucc

SEQ ID NO: 1125265 - RNA, 23 nt, Mycobacterium bovis subsp bovis AF2122/97
acgcgggcacugguggcgauccg

SEQ ID NO: 1125266 - RNA, 12 nt, Mycobacterium bovis subsp bovis AF2122/97
acgcggcgcgcu

SEQ ID NO: 1125267 - RNA, 14 nt, Mycobacterium bovis subsp bovis AF2122/97
acgcggacaccgcg

SEQ ID NO: 1125268 - RNA, 21 nt, Mycobacterium bovis subsp bovis AF2122/97
acgcggcggucguugccgacc

SEQ ID NO: 1125269 - RNA, 22 nt, Mycobacterium bovis subsp bovis AF2122/97
acgcggcggacaugcaccucga

SEQ ID NO: 1125270 - RNA, 12 nt, Mycobacterium bovis subsp bovis AF2122/97
acgcgcucgggc

SEQ ID NO: 1125271 - RNA, 22 nt, Mycobacterium bovis subsp bovis AF2122/97
acgcgcuugaagguucgaucgc

SEQ ID NO: 1125272 - RNA, 22 nt, Mycobacterium bovis subsp bovis AF2122/97
acgcggaaaccaucgccagccg

SEQ ID NO: 1125273 - RNA, 15 nt, Mycobacterium bovis subsp bovis AF2122/97
acgcgagcaacacca

SEQ ID NO: 1125274 - RNA, 16 nt, Mycobacterium bovis subsp bovis AF2122/97
acgcgagcaacaccag

SEQ ID NO: 1125275 - RNA, 11 nt, Mycobacterium bovis subsp bovis AF2122/97
acgcgagcgcu

SEQ ID NO: 1125276 - RNA, 11 nt, Mycobacterium bovis subsp bovis AF2122/97
acgcgacgccg

SEQ ID NO: 1125277 - RNA, 18 nt, Mycobacterium bovis subsp bovis AF2122/97
acgcgccguaacagccgg

SEQ ID NO: 1125278 - RNA, 21 nt, Mycobacterium bovis subsp bovis AF2122/97
acgcgccguaacagccggccg

SEQ ID NO: 1125279 - RNA, 22 nt, Mycobacterium bovis subsp bovis AF2122/97
acgcgccguaacagccggccgg

SEQ ID NO: 1125280 - RNA, 17 nt, Mycobacterium bovis subsp bovis AF2122/97
acgcgcgcagccgggca

SEQ ID NO: 1125281 - RNA, 18 nt, Mycobacterium bovis subsp bovis AF2122/97
acgcgcgcagccgggcac

SEQ ID NO: 1125282 - RNA, 15 nt, Mycobacterium bovis subsp bovis AF2122/97
acgcgcgagaacacc

SEQ ID NO: 1125283 - RNA, 18 nt, Mycobacterium bovis subsp bovis AF2122/97
acgcgcgagaacacccgu

SEQ ID NO: 1125284 - RNA, 16 nt, Mycobacterium bovis subsp bovis AF2122/97
acgcgcucgggcgaga

SEQ ID NO: 1125285 - RNA, 16 nt, Mycobacterium bovis subsp bovis AF2122/97
acgcgcgcgaccucgc

SEQ ID NO: 1125286 - RNA, 18 nt, Mycobacterium bovis subsp bovis AF2122/97
acgcgcgcaggccgccgc

SEQ ID NO: 1125287 - RNA, 19 nt, Mycobacterium bovis subsp bovis AF2122/97
acgcgcgcaggccgccgcc

SEQ ID NO: 1125288 - RNA, 20 nt, Mycobacterium bovis subsp bovis AF2122/97
acgcgcgcaggccgccgcca

SEQ ID NO: 1125289 - RNA, 19 nt, Mycobacterium bovis subsp bovis AF2122/97
acgcgcgcagccgggcacc

SEQ ID NO: 1125290 - RNA, 17 nt, Mycobacterium bovis subsp bovis AF2122/97
acgcgacgaagcagacg

SEQ ID NO: 1125291 - RNA, 13 nt, Mycobacterium bovis subsp bovis AF2122/97
acgcgacacgccg

SEQ ID NO: 1125292 - RNA, 16 nt, Mycobacterium bovis subsp bovis AF2122/97
acgcgacagccaccuc

SEQ ID NO: 1125293 - RNA, 15 nt, Mycobacterium bovis subsp bovis AF2122/97
acgcgaaugucgcgc

SEQ ID NO: 1125294 - RNA, 15 nt, Mycobacterium bovis subsp bovis AF2122/97
acgcgacacacgccg

SEQ ID NO: 1125295 - RNA, 18 nt, Mycobacterium bovis subsp bovis AF2122/97
acgcgacacacgccgccg

SEQ ID NO: 1125296 - RNA, 13 nt, Mycobacterium bovis subsp bovis AF2122/97
acgcgaccaccgc

SEQ ID NO: 1125297 - RNA, 18 nt, Mycobacterium bovis subsp bovis AF2122/97
acgcgaccaccgccgagc

SEQ ID NO: 1125298 - RNA, 23 nt, Mycobacterium bovis subsp bovis AF2122/97
acgccugccgaaacgccgaccgc

SEQ ID NO: 1125299 - RNA, 14 nt, Mycobacterium bovis subsp bovis AF2122/97
acgcgaaugacgau

SEQ ID NO: 1125300 - RNA, 14 nt, Mycobacterium bovis subsp bovis AF2122/97
acgcgaaccggcca

SEQ ID NO: 1125301 - RNA, 14 nt, Mycobacterium bovis subsp bovis AF2122/97
acgcgaacgcggcc

SEQ ID NO: 1125302 - RNA, 21 nt, Mycobacterium bovis subsp bovis AF2122/97
acgcgaauaccagaccggccg

SEQ ID NO: 1125303 - RNA, 16 nt, Mycobacterium bovis subsp bovis AF2122/97
acgcgucggcgacgcg

SEQ ID NO: 1125304 - RNA, 14 nt, Mycobacterium bovis subsp bovis AF2122/97
acgcgucgccgacg

SEQ ID NO: 1125305 - RNA, 23 nt, Mycobacterium bovis subsp bovis AF2122/97
acgcgucgguugauugugcccag

SEQ ID NO: 1125306 - RNA, 15 nt, Mycobacterium bovis subsp bovis AF2122/97
acgcguccagcgcgg

SEQ ID NO: 1125307 - RNA, 14 nt, Mycobacterium bovis subsp bovis AF2122/97
acgcgucccgccgc

SEQ ID NO: 1125308 - RNA, 16 nt, Mycobacterium bovis subsp bovis AF2122/97
acgcgucccgccgcac

SEQ ID NO: 1125309 - RNA, 14 nt, Mycobacterium bovis subsp bovis AF2122/97
acgcgucagcggcg

SEQ ID NO: 1125310 - RNA, 18 nt, Mycobacterium bovis subsp bovis AF2122/97
acgcguauucggcaucgc

SEQ ID NO: 1125311 - RNA, 13 nt, Mycobacterium bovis subsp bovis AF2122/97
acgcggugccggg

SEQ ID NO: 1125312 - RNA, 14 nt, Mycobacterium bovis subsp bovis AF2122/97
acgcggucccacuc

SEQ ID NO: 1125313 - RNA, 23 nt, Mycobacterium bovis subsp bovis AF2122/97
acgcggucccacucgucgucggu

SEQ ID NO: 1125314 - RNA, 19 nt, Mycobacterium bovis subsp bovis AF2122/97
acgcggucggcagcgacgc

SEQ ID NO: 1125315 - RNA, 23 nt, Mycobacterium bovis subsp bovis AF2122/97
acgcguagagccgaucaccgccg

SEQ ID NO: 1125316 - RNA, 14 nt, Mycobacterium bovis subsp bovis AF2122/97
acgcguugacgauc

SEQ ID NO: 1125317 - RNA, 16 nt, Mycobacterium bovis subsp bovis AF2122/97
acgcguuccauggccc

SEQ ID NO: 1125318 - RNA, 15 nt, Mycobacterium bovis subsp bovis AF2122/97
acgcguuccuccagc

SEQ ID NO: 1125319 - RNA, 17 nt, Mycobacterium bovis subsp bovis AF2122/97
acgcguucgagugcggu

SEQ ID NO: 1125320 - RNA, 20 nt, Mycobacterium bovis subsp bovis AF2122/97
acgcguggcauccagcagcg

SEQ ID NO: 1125321 - RNA, 20 nt, Mycobacterium bovis subsp bovis AF2122/97
acgcgugucugggaccccgc

SEQ ID NO: 1125322 - RNA, 20 nt, Mycobacterium bovis subsp bovis AF2122/97
acgcgucuggaacgugaugc

SEQ ID NO: 1125323 - RNA, 19 nt, Mycobacterium bovis subsp bovis AF2122/97
acgcgucuucggucgcggc

SEQ ID NO: 1125324 - RNA, 22 nt, Mycobacterium bovis subsp bovis AF2122/97
acgcuccagcucggccagugcc

SEQ ID NO: 1125325 - RNA, 21 nt, Mycobacterium bovis subsp bovis AF2122/97
acgcuccaggccuaguccggc

SEQ ID NO: 1125326 - RNA, 20 nt, Mycobacterium bovis subsp bovis AF2122/97
acgcuccgccggguuggcgc

SEQ ID NO: 1125327 - RNA, 19 nt, Mycobacterium bovis subsp bovis AF2122/97
acgcuccaggguccggacg

SEQ ID NO: 1125328 - RNA, 16 nt, Mycobacterium bovis subsp bovis AF2122/97
acgcucgcugcagcag

SEQ ID NO: 1125329 - RNA, 14 nt, Mycobacterium bovis subsp bovis AF2122/97
acgcucgcugcagc

SEQ ID NO: 1125330 - RNA, 17 nt, Mycobacterium bovis subsp bovis AF2122/97
acgcucgccgagcagac

SEQ ID NO: 1125331 - RNA, 15 nt, Mycobacterium bovis subsp bovis AF2122/97
acgcucacccggcgu

SEQ ID NO: 1125332 - RNA, 13 nt, Mycobacterium bovis subsp bovis AF2122/97
acgcuaaacccgu

SEQ ID NO: 1125333 - RNA, 13 nt, Mycobacterium bovis subsp bovis AF2122/97
acgcguuucgucg

SEQ ID NO: 1125334 - RNA, 14 nt, Mycobacterium bovis subsp bovis AF2122/97
acgcuaacgucgau

SEQ ID NO: 1125335 - RNA, 13 nt, Mycobacterium bovis subsp bovis AF2122/97
acgcuaccgccgg

SEQ ID NO: 1125336 - RNA, 19 nt, Mycobacterium bovis subsp bovis AF2122/97
acgcucaacccgugcgacu

SEQ ID NO: 1125337 - RNA, 16 nt, Mycobacterium bovis subsp bovis AF2122/97
acgcugugcucgacga

SEQ ID NO: 1125338 - RNA, 20 nt, Mycobacterium bovis subsp bovis AF2122/97
acgcuguugucguccaacgg

SEQ ID NO: 1125339 - RNA, 16 nt, Mycobacterium bovis subsp bovis AF2122/97
acgcuguaagcaugcc

SEQ ID NO: 1125340 - RNA, 19 nt, Mycobacterium bovis subsp bovis AF2122/97
acgcugucccagcccggcc

SEQ ID NO: 1125341 - RNA, 13 nt, Mycobacterium bovis subsp bovis AF2122/97
acgcugucccgcg

SEQ ID NO: 1125342 - RNA, 22 nt, Mycobacterium bovis subsp bovis AF2122/97
acgcugucccgcgggccagcac

SEQ ID NO: 1125343 - RNA, 21 nt, Mycobacterium bovis subsp bovis AF2122/97
acgcugggcgguagcuuccgc

SEQ ID NO: 1125344 - RNA, 15 nt, Mycobacterium bovis subsp bovis AF2122/97
acgcugggcgguagc

SEQ ID NO: 1125345 - RNA, 15 nt, Mycobacterium bovis subsp bovis AF2122/97
acggagaccggccgg

SEQ ID NO: 1125346 - RNA, 18 nt, Mycobacterium bovis subsp bovis AF2122/97
acggacucccucgaucac

SEQ ID NO: 1125347 - RNA, 19 nt, Mycobacterium bovis subsp bovis AF2122/97
acggacucccucgaucacg

SEQ ID NO: 1125348 - RNA, 17 nt, Mycobacterium bovis subsp bovis AF2122/97
acggaccuccucgccca

SEQ ID NO: 1125349 - RNA, 13 nt, Mycobacterium bovis subsp bovis AF2122/97
acggaccgucgcc

SEQ ID NO: 1125350 - RNA, 17 nt, Mycobacterium bovis subsp bovis AF2122/97
acggaccaucgccaggc

SEQ ID NO: 1125351 - RNA, 20 nt, Mycobacterium bovis subsp bovis AF2122/97
acggacccuuccgccgccgc

SEQ ID NO: 1125352 - RNA, 17 nt, Mycobacterium bovis subsp bovis AF2122/97
acggaccgcgucgcggg

SEQ ID NO: 1125353 - RNA, 18 nt, Mycobacterium bovis subsp bovis AF2122/97
acggaaugucagccgguu

SEQ ID NO: 1125354 - RNA, 15 nt, Mycobacterium bovis subsp bovis AF2122/97
acggaauguagccga

SEQ ID NO: 1125355 - RNA, 20 nt, Mycobacterium bovis subsp bovis AF2122/97
acggaauguagccgacuucg

SEQ ID NO: 1125356 - RNA, 20 nt, Mycobacterium bovis subsp bovis AF2122/97
acgcugugcgguaucgguca

SEQ ID NO: 1125357 - RNA, 15 nt, Mycobacterium bovis subsp bovis AF2122/97
acggaaggcccggcg

SEQ ID NO: 1125358 - RNA, 20 nt, Mycobacterium bovis subsp bovis AF2122/97
acgcugccgguguaggccuc

SEQ ID NO: 1125359 - RNA, 20 nt, Mycobacterium bovis subsp bovis AF2122/97
acgcugcccacgggccggcc

SEQ ID NO: 1125360 - RNA, 24 nt, Mycobacterium bovis subsp bovis AF2122/97
acgcugcccacgggccggccgagc

SEQ ID NO: 1125361 - RNA, 21 nt, Mycobacterium bovis subsp bovis AF2122/97
acgcugcaggcggccgagcug

SEQ ID NO: 1125362 - RNA, 23 nt, Mycobacterium bovis subsp bovis AF2122/97
acgcugaucuuccccucggccgc

SEQ ID NO: 1125363 - RNA, 20 nt, Mycobacterium bovis subsp bovis AF2122/97
acgcugaggaagcggcggca

SEQ ID NO: 1125364 - RNA, 23 nt, Mycobacterium bovis subsp bovis AF2122/97
acgcugaccggaucugacggcgc

SEQ ID NO: 1125365 - RNA, 15 nt, Mycobacterium bovis subsp bovis AF2122/97
acgcucggucgccac

SEQ ID NO: 1125366 - RNA, 22 nt, Mycobacterium bovis subsp bovis AF2122/97
acgcucgcgggccaaagccguc

SEQ ID NO: 1125367 - RNA, 20 nt, Mycobacterium bovis subsp bovis AF2122/97
acgcucggcggggaccgcgg

SEQ ID NO: 1125368 - RNA, 20 nt, Mycobacterium bovis subsp bovis AF2122/97
acgcucggcguccgcccagc

SEQ ID NO: 1125369 - RNA, 23 nt, Mycobacterium bovis subsp bovis AF2122/97
acgcucggcuauggguucgcggu

SEQ ID NO: 1125370 - RNA, 20 nt, Mycobacterium bovis subsp bovis AF2122/97
acgcucguuugcgagcaggg

SEQ ID NO: 1125371 - RNA, 21 nt, Mycobacterium bovis subsp bovis AF2122/97
acgcccaucucaugcaucugc

SEQ ID NO: 1125372 - RNA, 15 nt, Mycobacterium bovis subsp bovis AF2122/97
acgcccaugaccggc

SEQ ID NO: 1125373 - RNA, 18 nt, Mycobacterium bovis subsp bovis AF2122/97
acgcccaugaccggccgc

SEQ ID NO: 1125374 - RNA, 18 nt, Mycobacterium bovis subsp bovis AF2122/97
acgcccucgacgccgcgc

SEQ ID NO: 1125375 - RNA, 17 nt, Mycobacterium bovis subsp bovis AF2122/97
acgcccgugcggcucgc

SEQ ID NO: 1125376 - RNA, 18 nt, Mycobacterium bovis subsp bovis AF2122/97
acgcccgugcggcucgcc

SEQ ID NO: 1125377 - RNA, 22 nt, Mycobacterium bovis subsp bovis AF2122/97
acgcccgugcggcucgccggcg

SEQ ID NO: 1125378 - RNA, 21 nt, Mycobacterium bovis subsp bovis AF2122/97
acgccaucgaucgagcaggcc

SEQ ID NO: 1125379 - RNA, 16 nt, Mycobacterium bovis subsp bovis AF2122/97
acgcccaggcgaccgc

SEQ ID NO: 1125380 - RNA, 15 nt, Mycobacterium bovis subsp bovis AF2122/97
acgccaucaccccgg

SEQ ID NO: 1125381 - RNA, 18 nt, Mycobacterium bovis subsp bovis AF2122/97
acgccauccacgacaucg

SEQ ID NO: 1125382 - RNA, 16 nt, Mycobacterium bovis subsp bovis AF2122/97
acgccauacgucgccu

SEQ ID NO: 1125383 - RNA, 20 nt, Mycobacterium bovis subsp bovis AF2122/97
acgccagcccguccggcccc

SEQ ID NO: 1125384 - RNA, 14 nt, Mycobacterium bovis subsp bovis AF2122/97
acgccaggugaugc

SEQ ID NO: 1125385 - RNA, 19 nt, Mycobacterium bovis subsp bovis AF2122/97
acgccaggugcagcaccag

SEQ ID NO: 1125386 - RNA, 21 nt, Mycobacterium bovis subsp bovis AF2122/97
acgccaggugcagcaccagcc

SEQ ID NO: 1125387 - RNA, 16 nt, Mycobacterium bovis subsp bovis AF2122/97
acgccagccaggcgaa

SEQ ID NO: 1125388 - RNA, 14 nt, Mycobacterium bovis subsp bovis AF2122/97
acgccagccaggcg

SEQ ID NO: 1125389 - RNA, 21 nt, Mycobacterium bovis subsp bovis AF2122/97
acgccaguguugcgcugcggc

SEQ ID NO: 1125390 - RNA, 20 nt, Mycobacterium bovis subsp bovis AF2122/97
acgccagucccacugggccg

SEQ ID NO: 1125391 - RNA, 17 nt, Mycobacterium bovis subsp bovis AF2122/97
acgccagucccggcgca

SEQ ID NO: 1125392 - RNA, 19 nt, Mycobacterium bovis subsp bovis AF2122/97
acgccagucccggcgcaca

SEQ ID NO: 1125393 - RNA, 21 nt, Mycobacterium bovis subsp bovis AF2122/97
acgccagucgcaggaucggcg

SEQ ID NO: 1125394 - RNA, 19 nt, Mycobacterium bovis subsp bovis AF2122/97
acgcaugucgggccaggcg

SEQ ID NO: 1125395 - RNA, 21 nt, Mycobacterium bovis subsp bovis AF2122/97
acgccaaaauggugccguccg

SEQ ID NO: 1125396 - RNA, 18 nt, Mycobacterium bovis subsp bovis AF2122/97
acgccaaaacggucgacc

SEQ ID NO: 1125397 - RNA, 13 nt, Mycobacterium bovis subsp bovis AF2122/97
acgccaacaccgg

SEQ ID NO: 1125398 - RNA, 13 nt, Mycobacterium bovis subsp bovis AF2122/97
acgccacgacguc

SEQ ID NO: 1125399 - RNA, 14 nt, Mycobacterium bovis subsp bovis AF2122/97
acgccacgacgucg

SEQ ID NO: 1125400 - RNA, 19 nt, Mycobacterium bovis subsp bovis AF2122/97
acgccaagcucggcccagc

SEQ ID NO: 1125401 - RNA, 14 nt, Mycobacterium bovis subsp bovis AF2122/97
acgccacgacgccc

SEQ ID NO: 1125402 - RNA, 12 nt, Mycobacterium bovis subsp bovis AF2122/97
acgccacgacgu

SEQ ID NO: 1125403 - RNA, 22 nt, Mycobacterium bovis subsp bovis AF2122/97
acgccagcaaugcccgcaccgc

SEQ ID NO: 1125404 - RNA, 15 nt, Mycobacterium bovis subsp bovis AF2122/97
acgccagcaccagcg

SEQ ID NO: 1125405 - RNA, 19 nt, Mycobacterium bovis subsp bovis AF2122/97
acgccagcaccagcgucgc

SEQ ID NO: 1125406 - RNA, 22 nt, Mycobacterium bovis subsp bovis AF2122/97
acgccagcaccagcgucgcggc

SEQ ID NO: 1125407 - RNA, 15 nt, Mycobacterium bovis subsp bovis AF2122/97
acgccacugccagcc

SEQ ID NO: 1125408 - RNA, 16 nt, Mycobacterium bovis subsp bovis AF2122/97
acgccacugccagccg

SEQ ID NO: 1125409 - RNA, 14 nt, Mycobacterium bovis subsp bovis AF2122/97
acgccagaccgccg

SEQ ID NO: 1125410 - RNA, 19 nt, Mycobacterium bovis subsp bovis AF2122/97
acgccacggcaucggccac

SEQ ID NO: 1125411 - RNA, 19 nt, Mycobacterium bovis subsp bovis AF2122/97
acgcaugcgagaacgucga

SEQ ID NO: 1125412 - RNA, 20 nt, Mycobacterium bovis subsp bovis AF2122/97
acgcaugcgagaacgucgag

SEQ ID NO: 1125413 - RNA, 12 nt, Mycobacterium bovis subsp bovis AF2122/97
acgcaugcgcgc

SEQ ID NO: 1125414 - RNA, 13 nt, Mycobacterium bovis subsp bovis AF2122/97
acgcaugcgcgcg

SEQ ID NO: 1125415 - RNA, 22 nt, Mycobacterium bovis subsp bovis AF2122/97
acgcaugcgugacccgacaugg

SEQ ID NO: 1125416 - RNA, 15 nt, Mycobacterium bovis subsp bovis AF2122/97
acgcaucgucagcga

SEQ ID NO: 1125417 - RNA, 13 nt, Mycobacterium bovis subsp bovis AF2122/97
acgaucgcguccg

SEQ ID NO: 1125418 - RNA, 15 nt, Mycobacterium bovis subsp bovis AF2122/97
acgaucgcgucgggc

SEQ ID NO: 1125419 - RNA, 21 nt, Mycobacterium bovis subsp bovis AF2122/97
acgaucgcgucgggcucggcg

SEQ ID NO: 1125420 - RNA, 18 nt, Mycobacterium bovis subsp bovis AF2122/97
acgaucgcggcgggcccg

SEQ ID NO: 1125421 - RNA, 19 nt, Mycobacterium bovis subsp bovis AF2122/97
acgaucgcggcgggcccga

SEQ ID NO: 1125422 - RNA, 15 nt, Mycobacterium bovis subsp bovis AF2122/97
acgaucgcgccgucg

SEQ ID NO: 1125423 - RNA, 18 nt, Mycobacterium bovis subsp bovis AF2122/97
acgaucgcgcuggcgccc

SEQ ID NO: 1125424 - RNA, 21 nt, Mycobacterium bovis subsp bovis AF2122/97
acgauccagcccaacucggcc

SEQ ID NO: 1125425 - RNA, 20 nt, Mycobacterium bovis subsp bovis AF2122/97
acgaucgacagccccgcggc

SEQ ID NO: 1125426 - RNA, 21 nt, Mycobacterium bovis subsp bovis AF2122/97
acgaucgacagccccgcggcc

SEQ ID NO: 1125427 - RNA, 14 nt, Mycobacterium bovis subsp bovis AF2122/97
acgaugccggcccg

SEQ ID NO: 1125428 - RNA, 12 nt, Mycobacterium bovis subsp bovis AF2122/97
acgaugccgccg

SEQ ID NO: 1125429 - RNA, 15 nt, Mycobacterium bovis subsp bovis AF2122/97
acgaucgcggugacc

SEQ ID NO: 1125430 - RNA, 20 nt, Mycobacterium bovis subsp bovis AF2122/97
acgaucagcacgucgcggcc

SEQ ID NO: 1125431 - RNA, 11 nt, Mycobacterium bovis subsp bovis AF2122/97
acgaucacgau

SEQ ID NO: 1125432 - RNA, 19 nt, Mycobacterium bovis subsp bovis AF2122/97
acgaucagcgugaucugca

SEQ ID NO: 1125433 - RNA, 18 nt, Mycobacterium bovis subsp bovis AF2122/97
acgaucaggccgucgccg

SEQ ID NO: 1125434 - RNA, 19 nt, Mycobacterium bovis subsp bovis AF2122/97
acgaucaguugccccacuu

SEQ ID NO: 1125435 - RNA, 24 nt, Mycobacterium bovis subsp bovis AF2122/97
acgaucaucgggguggccaccagc

SEQ ID NO: 1125436 - RNA, 12 nt, Mycobacterium bovis subsp bovis AF2122/97
acgaucacccgc

SEQ ID NO: 1125437 - RNA, 13 nt, Mycobacterium bovis subsp bovis AF2122/97
acgaucacccgca

SEQ ID NO: 1125438 - RNA, 17 nt, Mycobacterium bovis subsp bovis AF2122/97
acgaucaacccggucca

SEQ ID NO: 1125439 - RNA, 16 nt, Mycobacterium bovis subsp bovis AF2122/97
acgaucaaccggguca

SEQ ID NO: 1125440 - RNA, 13 nt, Mycobacterium bovis subsp bovis AF2122/97
acgaucacaccac

SEQ ID NO: 1125441 - RNA, 23 nt, Mycobacterium bovis subsp bovis AF2122/97
acgauauagggcuccucgugcac

SEQ ID NO: 1125442 - RNA, 19 nt, Mycobacterium bovis subsp bovis AF2122/97
acgcaccgguaccgacggg

SEQ ID NO: 1125443 - RNA, 23 nt, Mycobacterium bovis subsp bovis AF2122/97
acgcaccuauggucaaccgcgcc

SEQ ID NO: 1125444 - RNA, 22 nt, Mycobacterium bovis subsp bovis AF2122/97
acgcaaaagcccccuaaaccgg

SEQ ID NO: 1125445 - RNA, 16 nt, Mycobacterium bovis subsp bovis AF2122/97
acgcaccgccccgccg

SEQ ID NO: 1125446 - RNA, 14 nt, Mycobacterium bovis subsp bovis AF2122/97
acgcacgccgcgug

SEQ ID NO: 1125447 - RNA, 16 nt, Mycobacterium bovis subsp bovis AF2122/97
acgcacgcgguucacc

SEQ ID NO: 1125448 - RNA, 16 nt, Mycobacterium bovis subsp bovis AF2122/97
acgcacgccgcgugcc

SEQ ID NO: 1125449 - RNA, 23 nt, Mycobacterium bovis subsp bovis AF2122/97
acgcacgcgguucaccacgucgu

SEQ ID NO: 1125450 - RNA, 22 nt, Mycobacterium bovis subsp bovis AF2122/97
acgcacgacugugcgccgcagc

SEQ ID NO: 1125451 - RNA, 23 nt, Mycobacterium bovis subsp bovis AF2122/97
acgcacgauccgcacccggccgc

SEQ ID NO: 1125452 - RNA, 20 nt, Mycobacterium bovis subsp bovis AF2122/97
acgcacgcaguucggucagc

SEQ ID NO: 1125453 - RNA, 16 nt, Mycobacterium bovis subsp bovis AF2122/97
acgcaccugcgcgcgg

SEQ ID NO: 1125454 - RNA, 19 nt, Mycobacterium bovis subsp bovis AF2122/97
acgcagcucgugaccgccg

SEQ ID NO: 1125455 - RNA, 23 nt, Mycobacterium bovis subsp bovis AF2122/97
acgcagaagcccccaaaccggcg

SEQ ID NO: 1125456 - RNA, 18 nt, Mycobacterium bovis subsp bovis AF2122/97
acgcagaaucgcacgcga

SEQ ID NO: 1125457 - RNA, 20 nt, Mycobacterium bovis subsp bovis AF2122/97
acgcagcgcggcuggggccc

SEQ ID NO: 1125458 - RNA, 22 nt, Mycobacterium bovis subsp bovis AF2122/97
acgcagcggcaaggucaacggg

SEQ ID NO: 1125459 - RNA, 23 nt, Mycobacterium bovis subsp bovis AF2122/97
acgcaaaauccccucgcaaccgg

SEQ ID NO: 1125460 - RNA, 16 nt, Mycobacterium bovis subsp bovis AF2122/97
acgcaaaaucgcccaa

SEQ ID NO: 1125461 - RNA, 19 nt, Mycobacterium bovis subsp bovis AF2122/97
acgcaaaaucgcccauuuc

SEQ ID NO: 1125462 - RNA, 13 nt, Mycobacterium bovis subsp bovis AF2122/97
acgauuucggccc

SEQ ID NO: 1125463 - RNA, 12 nt, Mycobacterium bovis subsp bovis AF2122/97
acgcaacaucgg

SEQ ID NO: 1125464 - RNA, 13 nt, Mycobacterium bovis subsp bovis AF2122/97
acgcaaccaaccg

SEQ ID NO: 1125465 - RNA, 14 nt, Mycobacterium bovis subsp bovis AF2122/97
acgcaacaccgcca

SEQ ID NO: 1125466 - RNA, 13 nt, Mycobacterium bovis subsp bovis AF2122/97
acgaugcucagcu

SEQ ID NO: 1125467 - RNA, 16 nt, Mycobacterium bovis subsp bovis AF2122/97
acgaugcucagcuggu

SEQ ID NO: 1125468 - RNA, 17 nt, Mycobacterium bovis subsp bovis AF2122/97
acgaugccucggcggcc

SEQ ID NO: 1125469 - RNA, 20 nt, Mycobacterium bovis subsp bovis AF2122/97
acgaugccucggcggccucg

SEQ ID NO: 1125470 - RNA, 16 nt, Mycobacterium bovis subsp bovis AF2122/97
acgaugcgcacaccga

SEQ ID NO: 1125471 - RNA, 16 nt, Mycobacterium bovis subsp bovis AF2122/97
acgauggccgccgcga

SEQ ID NO: 1125472 - RNA, 14 nt, Mycobacterium bovis subsp bovis AF2122/97
acgaacuucgaugc

SEQ ID NO: 1125473 - RNA, 16 nt, Mycobacterium bovis subsp bovis AF2122/97
acgaacucggccgggc

SEQ ID NO: 1125474 - RNA, 20 nt, Mycobacterium bovis subsp bovis AF2122/97
acgaacggauaccugggaca

SEQ ID NO: 1125475 - RNA, 13 nt, Mycobacterium bovis subsp bovis AF2122/97
acgaagaucgcgu

SEQ ID NO: 1125476 - RNA, 17 nt, Mycobacterium bovis subsp bovis AF2122/97
acgaagagcaccgcgcc

SEQ ID NO: 1125477 - RNA, 21 nt, Mycobacterium bovis subsp bovis AF2122/97
acgaagaucgcgugccacagc

SEQ ID NO: 1125478 - RNA, 16 nt, Mycobacterium bovis subsp bovis AF2122/97
acgaagaucgcugcga

SEQ ID NO: 1125479 - RNA, 18 nt, Mycobacterium bovis subsp bovis AF2122/97
acgaagaucgcugcgaag

SEQ ID NO: 1125480 - RNA, 22 nt, Mycobacterium bovis subsp bovis AF2122/97
acgaagccagaucagccgccgc

SEQ ID NO: 1125481 - RNA, 12 nt, Mycobacterium bovis subsp bovis AF2122/97
acgaagccggcg

SEQ ID NO: 1125482 - RNA, 14 nt, Mycobacterium bovis subsp bovis AF2122/97
acgaagccggcgcc

SEQ ID NO: 1125483 - RNA, 19 nt, Mycobacterium bovis subsp bovis AF2122/97
acgaacaccagcgcgccgu

SEQ ID NO: 1125484 - RNA, 21 nt, Mycobacterium bovis subsp bovis AF2122/97
acgaacccacugcccgccgac

SEQ ID NO: 1125485 - RNA, 17 nt, Mycobacterium bovis subsp bovis AF2122/97
acgaaauccgccgggcg

SEQ ID NO: 1125486 - RNA, 15 nt, Mycobacterium bovis subsp bovis AF2122/97
acgaaaucgucgggu

SEQ ID NO: 1125487 - RNA, 15 nt, Mycobacterium bovis subsp bovis AF2122/97
acgaacgccgucgac

SEQ ID NO: 1125488 - RNA, 23 nt, Mycobacterium bovis subsp bovis AF2122/97
acgaaccggaucaucgccgcggc

SEQ ID NO: 1125489 - RNA, 13 nt, Mycobacterium bovis subsp bovis AF2122/97
acgaaccggccga

SEQ ID NO: 1125490 - RNA, 12 nt, Mycobacterium bovis subsp bovis AF2122/97
acgaaccgccga

SEQ ID NO: 1125491 - RNA, 14 nt, Mycobacterium bovis subsp bovis AF2122/97
acgaaccgccgacg

SEQ ID NO: 1125492 - RNA, 12 nt, Mycobacterium bovis subsp bovis AF2122/97
acgaaccgccgc

SEQ ID NO: 1125493 - RNA, 23 nt, Mycobacterium bovis subsp bovis AF2122/97
acgaaaucggcggcguccagcag

SEQ ID NO: 1125494 - RNA, 18 nt, Mycobacterium bovis subsp bovis AF2122/97
acgaaagucaaucgcguc

SEQ ID NO: 1125495 - RNA, 21 nt, Mycobacterium bovis subsp bovis AF2122/97
accuugcccaccaguuccggg

SEQ ID NO: 1125496 - RNA, 16 nt, Mycobacterium bovis subsp bovis AF2122/97
accuucuuggcgggug

SEQ ID NO: 1125497 - RNA, 17 nt, Mycobacterium bovis subsp bovis AF2122/97
accuugaccgucgcgca

SEQ ID NO: 1125498 - RNA, 23 nt, Mycobacterium bovis subsp bovis AF2122/97
accuugagcacuccgucguaguu

SEQ ID NO: 1125499 - RNA, 17 nt, Mycobacterium bovis subsp bovis AF2122/97
accuguaccgccacggc

SEQ ID NO: 1125500 - RNA, 21 nt, Mycobacterium bovis subsp bovis AF2122/97
accuguaccgccacggcggcu

SEQ ID NO: 1125501 - RNA, 22 nt, Mycobacterium bovis subsp bovis AF2122/97
accuguagaucagcagcggcga

SEQ ID NO: 1125502 - RNA, 14 nt, Mycobacterium bovis subsp bovis AF2122/97
accugguucccgac

SEQ ID NO: 1125503 - RNA, 13 nt, Mycobacterium bovis subsp bovis AF2122/97
accuucgaccucc

SEQ ID NO: 1125504 - RNA, 19 nt, Mycobacterium bovis subsp bovis AF2122/97
accuucggccgaccgggcu

SEQ ID NO: 1125505 - RNA, 18 nt, Mycobacterium bovis subsp bovis AF2122/97
accuucucgaugcugacg

SEQ ID NO: 1125506 - RNA, 19 nt, Mycobacterium bovis subsp bovis AF2122/97
accguuggagucaggcggg

SEQ ID NO: 1125507 - RNA, 14 nt, Mycobacterium bovis subsp bovis AF2122/97
accguuggccgcgc

SEQ ID NO: 1125508 - RNA, 23 nt, Mycobacterium bovis subsp bovis AF2122/97
accguuguucccauagccagccg

SEQ ID NO: 1125509 - RNA, 21 nt, Mycobacterium bovis subsp bovis AF2122/97
accguuguugaggaugccgga

SEQ ID NO: 1125510 - RNA, 17 nt, Mycobacterium bovis subsp bovis AF2122/97
accguuugcgcaccggu

SEQ ID NO: 1125511 - RNA, 14 nt, Mycobacterium bovis subsp bovis AF2122/97
accguuugacgcgc

SEQ ID NO: 1125512 - RNA, 15 nt, Mycobacterium bovis subsp bovis AF2122/97
accuggucggccgca

SEQ ID NO: 1125513 - RNA, 16 nt, Mycobacterium bovis subsp bovis AF2122/97
accguuugguccauca

SEQ ID NO: 1125514 - RNA, 16 nt, Mycobacterium bovis subsp bovis AF2122/97
accguuucgccggcgc

SEQ ID NO: 1125515 - RNA, 19 nt, Mycobacterium bovis subsp bovis AF2122/97
accuaacccgcaccggauc

SEQ ID NO: 1125516 - RNA, 18 nt, Mycobacterium bovis subsp bovis AF2122/97
acgacaucugcccagcgg

SEQ ID NO: 1125517 - RNA, 21 nt, Mycobacterium bovis subsp bovis AF2122/97
acgacaugguuggugucguac

SEQ ID NO: 1125518 - RNA, 13 nt, Mycobacterium bovis subsp bovis AF2122/97
acgaccaauagca

SEQ ID NO: 1125519 - RNA, 21 nt, Mycobacterium bovis subsp bovis AF2122/97
acgacggcaccgaugcacucc

SEQ ID NO: 1125520 - RNA, 16 nt, Mycobacterium bovis subsp bovis AF2122/97
acgacauugccacggc

SEQ ID NO: 1125521 - RNA, 13 nt, Mycobacterium bovis subsp bovis AF2122/97
acgacggcugacc

SEQ ID NO: 1125522 - RNA, 15 nt, Mycobacterium bovis subsp bovis AF2122/97
acgacggcgccgucg

SEQ ID NO: 1125523 - RNA, 21 nt, Mycobacterium bovis subsp bovis AF2122/97
acgacggccgacaacccggcc

SEQ ID NO: 1125524 - RNA, 23 nt, Mycobacterium bovis subsp bovis AF2122/97
acgacggccgacaacccggccgg

SEQ ID NO: 1125525 - RNA, 16 nt, Mycobacterium bovis subsp bovis AF2122/97
acgacggguccgggcc

SEQ ID NO: 1125526 - RNA, 18 nt, Mycobacterium bovis subsp bovis AF2122/97
acgacggguuggcgucgc

SEQ ID NO: 1125527 - RNA, 23 nt, Mycobacterium bovis subsp bovis AF2122/97
acgacuguggcgccgccggcacc

SEQ ID NO: 1125528 - RNA, 18 nt, Mycobacterium bovis subsp bovis AF2122/97
acgacgucaaucucgguc

SEQ ID NO: 1125529 - RNA, 20 nt, Mycobacterium bovis subsp bovis AF2122/97
acgacgucaaucucggucgg

SEQ ID NO: 1125530 - RNA, 19 nt, Mycobacterium bovis subsp bovis AF2122/97
acgaaggcguucgccgggg

SEQ ID NO: 1125531 - RNA, 20 nt, Mycobacterium bovis subsp bovis AF2122/97
acgaagguggcauucgucga

SEQ ID NO: 1125532 - RNA, 18 nt, Mycobacterium bovis subsp bovis AF2122/97
acgaaggauucgaagccg

SEQ ID NO: 1125533 - RNA, 15 nt, Mycobacterium bovis subsp bovis AF2122/97
acgaagcuggcgugc

SEQ ID NO: 1125534 - RNA, 16 nt, Mycobacterium bovis subsp bovis AF2122/97
acgacagcccgccggc

SEQ ID NO: 1125535 - RNA, 18 nt, Mycobacterium bovis subsp bovis AF2122/97
acgacagcgacggucccg

SEQ ID NO: 1125536 - RNA, 16 nt, Mycobacterium bovis subsp bovis AF2122/97
acgacaucgagccaac

SEQ ID NO: 1125537 - RNA, 18 nt, Mycobacterium bovis subsp bovis AF2122/97
acgacaucgagccaacgc

SEQ ID NO: 1125538 - RNA, 20 nt, Mycobacterium bovis subsp bovis AF2122/97
acgacaucguaggccggcau

SEQ ID NO: 1125539 - RNA, 17 nt, Mycobacterium bovis subsp bovis AF2122/97
acgacaucgucgcgacg

SEQ ID NO: 1125540 - RNA, 16 nt, Mycobacterium bovis subsp bovis AF2122/97
acgacaucaccaccgc

SEQ ID NO: 1125541 - RNA, 19 nt, Mycobacterium bovis subsp bovis AF2122/97
acgacaucaccaccgcacg

SEQ ID NO: 1125542 - RNA, 15 nt, Mycobacterium bovis subsp bovis AF2122/97
acgacaggucgcccg

SEQ ID NO: 1125543 - RNA, 21 nt, Mycobacterium bovis subsp bovis AF2122/97
acgacagguguuggacgccuu

SEQ ID NO: 1125544 - RNA, 13 nt, Mycobacterium bovis subsp bovis AF2122/97
acgagggccagca

SEQ ID NO: 1125545 - RNA, 23 nt, Mycobacterium bovis subsp bovis AF2122/97
acgaggcguucaccacgaucgcg

SEQ ID NO: 1125546 - RNA, 13 nt, Mycobacterium bovis subsp bovis AF2122/97
acgaggcgagcgg

SEQ ID NO: 1125547 - RNA, 16 nt, Mycobacterium bovis subsp bovis AF2122/97
acgaggcgagcggcca

SEQ ID NO: 1125548 - RNA, 19 nt, Mycobacterium bovis subsp bovis AF2122/97
acgagcacaugcucgacgc

SEQ ID NO: 1125549 - RNA, 14 nt, Mycobacterium bovis subsp bovis AF2122/97
acgaggccgacgac

SEQ ID NO: 1125550 - RNA, 15 nt, Mycobacterium bovis subsp bovis AF2122/97
acgagagcggcuccg

SEQ ID NO: 1125551 - RNA, 16 nt, Mycobacterium bovis subsp bovis AF2122/97
acgagauacggccacc

SEQ ID NO: 1125552 - RNA, 23 nt, Mycobacterium bovis subsp bovis AF2122/97
acgagaugugagcacaccgacag

SEQ ID NO: 1125553 - RNA, 20 nt, Mycobacterium bovis subsp bovis AF2122/97
acgagauugccgggccgccg

SEQ ID NO: 1125554 - RNA, 23 nt, Mycobacterium bovis subsp bovis AF2122/97
acgagauugccgggccgccgagc

SEQ ID NO: 1125555 - RNA, 14 nt, Mycobacterium bovis subsp bovis AF2122/97
acgagcaacgggcg

SEQ ID NO: 1125556 - RNA, 15 nt, Mycobacterium bovis subsp bovis AF2122/97
acgagcaacgggcga

SEQ ID NO: 1125557 - RNA, 17 nt, Mycobacterium bovis subsp bovis AF2122/97
acgagaagacaccgcgc

SEQ ID NO: 1125558 - RNA, 14 nt, Mycobacterium bovis subsp bovis AF2122/97
acgaggucgccgca

SEQ ID NO: 1125559 - RNA, 16 nt, Mycobacterium bovis subsp bovis AF2122/97
acgagguugccgcacc

SEQ ID NO: 1125560 - RNA, 17 nt, Mycobacterium bovis subsp bovis AF2122/97
acgaguaggcggcuccg

SEQ ID NO: 1125561 - RNA, 24 nt, Mycobacterium bovis subsp bovis AF2122/97
acgagguugccgcaccagucgcgc

SEQ ID NO: 1125562 - RNA, 14 nt, Mycobacterium bovis subsp bovis AF2122/97
acgaguugcgaacc

SEQ ID NO: 1125563 - RNA, 15 nt, Mycobacterium bovis subsp bovis AF2122/97
acgaggucugcggcc

SEQ ID NO: 1125564 - RNA, 12 nt, Mycobacterium bovis subsp bovis AF2122/97
acgagucgccag

SEQ ID NO: 1125565 - RNA, 19 nt, Mycobacterium bovis subsp bovis AF2122/97
acggugcagcuccccgccg

SEQ ID NO: 1125566 - RNA, 20 nt, Mycobacterium bovis subsp bovis AF2122/97
acggugccaccgcgacggca

SEQ ID NO: 1125567 - RNA, 21 nt, Mycobacterium bovis subsp bovis AF2122/97
acggugaugggggagccggug

SEQ ID NO: 1125568 - RNA, 14 nt, Mycobacterium bovis subsp bovis AF2122/97
acggugcccagggc

SEQ ID NO: 1125569 - RNA, 16 nt, Mycobacterium bovis subsp bovis AF2122/97
acggugcccagggcga

SEQ ID NO: 1125570 - RNA, 16 nt, Mycobacterium bovis subsp bovis AF2122/97
acggugccgaccgcgu

SEQ ID NO: 1125571 - RNA, 13 nt, Mycobacterium bovis subsp bovis AF2122/97
acggugccgacga

SEQ ID NO: 1125572 - RNA, 19 nt, Mycobacterium bovis subsp bovis AF2122/97
acggugaugaggaucgcgu

SEQ ID NO: 1125573 - RNA, 19 nt, Mycobacterium bovis subsp bovis AF2122/97
acggugaugggggagccgg

SEQ ID NO: 1125574 - RNA, 19 nt, Mycobacterium bovis subsp bovis AF2122/97
acggucgccgaccacucga

SEQ ID NO: 1125575 - RNA, 15 nt, Mycobacterium bovis subsp bovis AF2122/97
acggucccggcacgu

SEQ ID NO: 1125576 - RNA, 19 nt, Mycobacterium bovis subsp bovis AF2122/97
acggucccggcacgucgac

SEQ ID NO: 1125577 - RNA, 19 nt, Mycobacterium bovis subsp bovis AF2122/97
acgguccacgguggcgccg

SEQ ID NO: 1125578 - RNA, 13 nt, Mycobacterium bovis subsp bovis AF2122/97
acgguccgccacg

SEQ ID NO: 1125579 - RNA, 15 nt, Mycobacterium bovis subsp bovis AF2122/97
acgguccgccacggc

SEQ ID NO: 1125580 - RNA, 16 nt, Mycobacterium bovis subsp bovis AF2122/97
acgguccguucgaugc

SEQ ID NO: 1125581 - RNA, 22 nt, Mycobacterium bovis subsp bovis AF2122/97
acggucaucccuuucgcgccgc

SEQ ID NO: 1125582 - RNA, 15 nt, Mycobacterium bovis subsp bovis AF2122/97
acgguccacgacguc

SEQ ID NO: 1125583 - RNA, 17 nt, Mycobacterium bovis subsp bovis AF2122/97
acgguccacgacgucga

SEQ ID NO: 1125584 - RNA, 18 nt, Mycobacterium bovis subsp bovis AF2122/97
acggucagccgcggggcg

SEQ ID NO: 1125585 - RNA, 19 nt, Mycobacterium bovis subsp bovis AF2122/97
acggucaugccgccgccga

SEQ ID NO: 1125586 - RNA, 17 nt, Mycobacterium bovis subsp bovis AF2122/97
acggucagguccugggu

SEQ ID NO: 1125587 - RNA, 19 nt, Mycobacterium bovis subsp bovis AF2122/97
acggucagguccugggugu

SEQ ID NO: 1125588 - RNA, 23 nt, Mycobacterium bovis subsp bovis AF2122/97
acggguaauucuugacgccgaug

SEQ ID NO: 1125589 - RNA, 14 nt, Mycobacterium bovis subsp bovis AF2122/97
acggguacacccgc

SEQ ID NO: 1125590 - RNA, 15 nt, Mycobacterium bovis subsp bovis AF2122/97
acggguacacccgcu

SEQ ID NO: 1125591 - RNA, 16 nt, Mycobacterium bovis subsp bovis AF2122/97
acggggcugaccgcca

SEQ ID NO: 1125592 - RNA, 22 nt, Mycobacterium bovis subsp bovis AF2122/97
acgggcacccgagccgcacagc

SEQ ID NO: 1125593 - RNA, 12 nt, Mycobacterium bovis subsp bovis AF2122/97
acggggcgacgu

SEQ ID NO: 1125594 - RNA, 15 nt, Mycobacterium bovis subsp bovis AF2122/97
acggggcggucggcc

SEQ ID NO: 1125595 - RNA, 22 nt, Mycobacterium bovis subsp bovis AF2122/97
acggggcugaccgccaccccgc

SEQ ID NO: 1125596 - RNA, 16 nt, Mycobacterium bovis subsp bovis AF2122/97
acgggguugaccgcca

SEQ ID NO: 1125597 - RNA, 16 nt, Mycobacterium bovis subsp bovis AF2122/97
acggguaaucaccgaa

SEQ ID NO: 1125598 - RNA, 21 nt, Mycobacterium bovis subsp bovis AF2122/97
acgggggucgggcgugucggg

SEQ ID NO: 1125599 - RNA, 21 nt, Mycobacterium bovis subsp bovis AF2122/97
acgggguugaccgccaccccg

SEQ ID NO: 1125600 - RNA, 22 nt, Mycobacterium bovis subsp bovis AF2122/97
acgguucauccacuccgccaac

SEQ ID NO: 1125601 - RNA, 12 nt, Mycobacterium bovis subsp bovis AF2122/97
acgguucgaccc

SEQ ID NO: 1125602 - RNA, 18 nt, Mycobacterium bovis subsp bovis AF2122/97
acgguucgacccccgcau

SEQ ID NO: 1125603 - RNA, 21 nt, Mycobacterium bovis subsp bovis AF2122/97
acgguugaugaucuuggugaa

SEQ ID NO: 1125604 - RNA, 16 nt, Mycobacterium bovis subsp bovis AF2122/97
acgguugccgcgaucg

SEQ ID NO: 1125605 - RNA, 13 nt, Mycobacterium bovis subsp bovis AF2122/97
acgguugccggcg

SEQ ID NO: 1125606 - RNA, 15 nt, Mycobacterium bovis subsp bovis AF2122/97
acgguugccggcggc

SEQ ID NO: 1125607 - RNA, 20 nt, Mycobacterium bovis subsp bovis AF2122/97
acgguugguccgccgucgac

SEQ ID NO: 1125608 - RNA, 21 nt, Mycobacterium bovis subsp bovis AF2122/97
acgguuguuguagaucugcgc

SEQ ID NO: 1125609 - RNA, 22 nt, Mycobacterium bovis subsp bovis AF2122/97
acgguugcucguccaagccggc

SEQ ID NO: 1125610 - RNA, 14 nt, Mycobacterium bovis subsp bovis AF2122/97
acgguuggccacca

SEQ ID NO: 1125611 - RNA, 14 nt, Mycobacterium bovis subsp bovis AF2122/97
acgguguagccgcc

SEQ ID NO: 1125612 - RNA, 18 nt, Mycobacterium bovis subsp bovis AF2122/97
acgguguagccgccggca

SEQ ID NO: 1125613 - RNA, 19 nt, Mycobacterium bovis subsp bovis AF2122/97
acgguguagccgccggcag

SEQ ID NO: 1125614 - RNA, 13 nt, Mycobacterium bovis subsp bovis AF2122/97
acgguuaccgcga

SEQ ID NO: 1125615 - RNA, 22 nt, Mycobacterium bovis subsp bovis AF2122/97
acgguguaccagguggaccggc

SEQ ID NO: 1125616 - RNA, 18 nt, Mycobacterium bovis subsp bovis AF2122/97
acggugguaagacgccga

SEQ ID NO: 1125617 - RNA, 19 nt, Mycobacterium bovis subsp bovis AF2122/97
acgguguacaggucgccgg

SEQ ID NO: 1125618 - RNA, 21 nt, Mycobacterium bovis subsp bovis AF2122/97
acggugguaagacgccgaacg

SEQ ID NO: 1125619 - RNA, 18 nt, Mycobacterium bovis subsp bovis AF2122/97
acgguggucccccgcagc

SEQ ID NO: 1125620 - RNA, 19 nt, Mycobacterium bovis subsp bovis AF2122/97
acgguggucccccgcagcc

SEQ ID NO: 1125621 - RNA, 16 nt, Mycobacterium bovis subsp bovis AF2122/97
acgguggugaccgcgg

SEQ ID NO: 1125622 - RNA, 18 nt, Mycobacterium bovis subsp bovis AF2122/97
acgguggugaccgcgggc

SEQ ID NO: 1125623 - RNA, 12 nt, Mycobacterium bovis subsp bovis AF2122/97
acgguggugcgg

SEQ ID NO: 1125624 - RNA, 20 nt, Mycobacterium bovis subsp bovis AF2122/97
acggugggcgccgacaccgg

SEQ ID NO: 1125625 - RNA, 22 nt, Mycobacterium bovis subsp bovis AF2122/97
acggugggcgccgacaccggcu

SEQ ID NO: 1125626 - RNA, 18 nt, Mycobacterium bovis subsp bovis AF2122/97
acgguggggauggcgccc

SEQ ID NO: 1125627 - RNA, 21 nt, Mycobacterium bovis subsp bovis AF2122/97
acgguggcuucgacggcggcc

SEQ ID NO: 1125628 - RNA, 23 nt, Mycobacterium bovis subsp bovis AF2122/97
acgguggccgcaucgacgcucau

SEQ ID NO: 1125629 - RNA, 21 nt, Mycobacterium bovis subsp bovis AF2122/97
acgguggcgcggugccggcgg

SEQ ID NO: 1125630 - RNA, 15 nt, Mycobacterium bovis subsp bovis AF2122/97
acgguggcgcggugc

SEQ ID NO: 1125631 - RNA, 18 nt, Mycobacterium bovis subsp bovis AF2122/97
acgguggccgcugccagc

SEQ ID NO: 1125632 - RNA, 19 nt, Mycobacterium bovis subsp bovis AF2122/97
acgguggccgcugccagcc

SEQ ID NO: 1125633 - RNA, 14 nt, Mycobacterium bovis subsp bovis AF2122/97
acgguggcaacgga

SEQ ID NO: 1125634 - RNA, 18 nt, Mycobacterium bovis subsp bovis AF2122/97
acgguggcaacggaggug

SEQ ID NO: 1125635 - RNA, 20 nt, Mycobacterium bovis subsp bovis AF2122/97
acggugcgggcuaggcggcg

SEQ ID NO: 1125636 - RNA, 17 nt, Mycobacterium bovis subsp bovis AF2122/97
acggugcgguugcaucc

SEQ ID NO: 1125637 - RNA, 17 nt, Mycobacterium bovis subsp bovis AF2122/97
acggcugaaccugcugg

SEQ ID NO: 1125638 - RNA, 19 nt, Mycobacterium bovis subsp bovis AF2122/97
acggcugagacagaccggg

SEQ ID NO: 1125639 - RNA, 20 nt, Mycobacterium bovis subsp bovis AF2122/97
acggcugagacagaccgggc

SEQ ID NO: 1125640 - RNA, 22 nt, Mycobacterium bovis subsp bovis AF2122/97
acggcugagacagaccgggccc

SEQ ID NO: 1125641 - RNA, 14 nt, Mycobacterium bovis subsp bovis AF2122/97
acggcucgucgaac

SEQ ID NO: 1125642 - RNA, 18 nt, Mycobacterium bovis subsp bovis AF2122/97
acggcucgucgaacaugg

SEQ ID NO: 1125643 - RNA, 18 nt, Mycobacterium bovis subsp bovis AF2122/97
acggcugcccaugguggc

SEQ ID NO: 1125644 - RNA, 14 nt, Mycobacterium bovis subsp bovis AF2122/97
acggcugccgucag

SEQ ID NO: 1125645 - RNA, 15 nt, Mycobacterium bovis subsp bovis AF2122/97
acggcucuaccgguc

SEQ ID NO: 1125646 - RNA, 22 nt, Mycobacterium bovis subsp bovis AF2122/97
acggcucuaccgguccgucacc

SEQ ID NO: 1125647 - RNA, 13 nt, Mycobacterium bovis subsp bovis AF2122/97
acggcuccgggcg

SEQ ID NO: 1125648 - RNA, 23 nt, Mycobacterium bovis subsp bovis AF2122/97
acggcuccgggcgcucggucucc

SEQ ID NO: 1125649 - RNA, 23 nt, Mycobacterium bovis subsp bovis AF2122/97
acggcucgggaacuucgccgaag

SEQ ID NO: 1125650 - RNA, 23 nt, Mycobacterium bovis subsp bovis AF2122/97
acgggaugaauucauguggcgcg

SEQ ID NO: 1125651 - RNA, 23 nt, Mycobacterium bovis subsp bovis AF2122/97
acgggcaggagcagcacgucgaa

SEQ ID NO: 1125652 - RNA, 14 nt, Mycobacterium bovis subsp bovis AF2122/97
acgggcaggccgcu

SEQ ID NO: 1125653 - RNA, 20 nt, Mycobacterium bovis subsp bovis AF2122/97
acggggaacguccgcgccga

SEQ ID NO: 1125654 - RNA, 19 nt, Mycobacterium bovis subsp bovis AF2122/97
acgggcacccgagccgcac

SEQ ID NO: 1125655 - RNA, 14 nt, Mycobacterium bovis subsp bovis AF2122/97
acgggaugccggcg

SEQ ID NO: 1125656 - RNA, 17 nt, Mycobacterium bovis subsp bovis AF2122/97
acgggaugccggcgaag

SEQ ID NO: 1125657 - RNA, 19 nt, Mycobacterium bovis subsp bovis AF2122/97
acgggauccgcgcgcugga

SEQ ID NO: 1125658 - RNA, 14 nt, Mycobacterium bovis subsp bovis AF2122/97
acgggaucgacccg

SEQ ID NO: 1125659 - RNA, 12 nt, Mycobacterium bovis subsp bovis AF2122/97
acgggagccggc

SEQ ID NO: 1125660 - RNA, 21 nt, Mycobacterium bovis subsp bovis AF2122/97
acggcuuccaacucggcggcc

SEQ ID NO: 1125661 - RNA, 22 nt, Mycobacterium bovis subsp bovis AF2122/97
acggcuuccaacucggcggcca

SEQ ID NO: 1125662 - RNA, 23 nt, Mycobacterium bovis subsp bovis AF2122/97
acggcuuccaacucggcggccag

SEQ ID NO: 1125663 - RNA, 18 nt, Mycobacterium bovis subsp bovis AF2122/97
acggcugcgccgaacacc

SEQ ID NO: 1125664 - RNA, 16 nt, Mycobacterium bovis subsp bovis AF2122/97
acggcaaugcggggca

SEQ ID NO: 1125665 - RNA, 13 nt, Mycobacterium bovis subsp bovis AF2122/97
acggcaagcacgg

SEQ ID NO: 1125666 - RNA, 17 nt, Mycobacterium bovis subsp bovis AF2122/97
acggcaauacccgccgc

SEQ ID NO: 1125667 - RNA, 19 nt, Mycobacterium bovis subsp bovis AF2122/97
acggcaagcuaccggcccg

SEQ ID NO: 1125668 - RNA, 21 nt, Mycobacterium bovis subsp bovis AF2122/97
acggcaagcuaccggcccgau

SEQ ID NO: 1125669 - RNA, 23 nt, Mycobacterium bovis subsp bovis AF2122/97
acggcaauucgggauaggacacc

SEQ ID NO: 1125670 - RNA, 18 nt, Mycobacterium bovis subsp bovis AF2122/97
acggcacaaucggcgccu

SEQ ID NO: 1125671 - RNA, 16 nt, Mycobacterium bovis subsp bovis AF2122/97
acggcaccagcggguc

SEQ ID NO: 1125672 - RNA, 23 nt, Mycobacterium bovis subsp bovis AF2122/97
acggcaccagcgggucggcggug

SEQ ID NO: 1125673 - RNA, 23 nt, Mycobacterium bovis subsp bovis AF2122/97
acggcaccagaucuucgagcgca

SEQ ID NO: 1125674 - RNA, 13 nt, Mycobacterium bovis subsp bovis AF2122/97
acggagcggccua

SEQ ID NO: 1125675 - RNA, 16 nt, Mycobacterium bovis subsp bovis AF2122/97
acggagccgccggcgg

SEQ ID NO: 1125676 - RNA, 19 nt, Mycobacterium bovis subsp bovis AF2122/97
acggagcccaaaaccgcga

SEQ ID NO: 1125677 - RNA, 18 nt, Mycobacterium bovis subsp bovis AF2122/97
acggaggguugccgccga

SEQ ID NO: 1125678 - RNA, 14 nt, Mycobacterium bovis subsp bovis AF2122/97
acggaggugccggc

SEQ ID NO: 1125679 - RNA, 15 nt, Mycobacterium bovis subsp bovis AF2122/97
acggaggugccggcg

SEQ ID NO: 1125680 - RNA, 13 nt, Mycobacterium bovis subsp bovis AF2122/97
acggcaaccagcg

SEQ ID NO: 1125681 - RNA, 21 nt, Mycobacterium bovis subsp bovis AF2122/97
acggauuuucgcaguccgguu

SEQ ID NO: 1125682 - RNA, 18 nt, Mycobacterium bovis subsp bovis AF2122/97
acggcgucuuccucggcc

SEQ ID NO: 1125683 - RNA, 14 nt, Mycobacterium bovis subsp bovis AF2122/97
acggcgucuucgga

SEQ ID NO: 1125684 - RNA, 18 nt, Mycobacterium bovis subsp bovis AF2122/97
acggcguugauccgcacc

SEQ ID NO: 1125685 - RNA, 18 nt, Mycobacterium bovis subsp bovis AF2122/97
acggcguugccgccggcu

SEQ ID NO: 1125686 - RNA, 23 nt, Mycobacterium bovis subsp bovis AF2122/97
acggcguugcggaaucagcaccc

SEQ ID NO: 1125687 - RNA, 15 nt, Mycobacterium bovis subsp bovis AF2122/97
acggcguuggcgccg

SEQ ID NO: 1125688 - RNA, 13 nt, Mycobacterium bovis subsp bovis AF2122/97
acggcaccagcgg

SEQ ID NO: 1125689 - RNA, 21 nt, Mycobacterium bovis subsp bovis AF2122/97
acggcguacgccggacccggu

SEQ ID NO: 1125690 - RNA, 19 nt, Mycobacterium bovis subsp bovis AF2122/97
acggcgucggcuucucgau

SEQ ID NO: 1125691 - RNA, 14 nt, Mycobacterium bovis subsp bovis AF2122/97
acggcgucugcggu

SEQ ID NO: 1125692 - RNA, 20 nt, Mycobacterium bovis subsp bovis AF2122/97
acggcguccccgacaacgaa

SEQ ID NO: 1125693 - RNA, 23 nt, Mycobacterium bovis subsp bovis AF2122/97
acggcguagacguccgcggucgc

SEQ ID NO: 1125694 - RNA, 14 nt, Mycobacterium bovis subsp bovis AF2122/97
acgucgccgccgcg

SEQ ID NO: 1125695 - RNA, 16 nt, Mycobacterium bovis subsp bovis AF2122/97
acgucgccgcggcggc

SEQ ID NO: 1125696 - RNA, 22 nt, Mycobacterium bovis subsp bovis AF2122/97
acgucgccgcggcggcagcggc

SEQ ID NO: 1125697 - RNA, 18 nt, Mycobacterium bovis subsp bovis AF2122/97
acgucgccgacgguuacc

SEQ ID NO: 1125698 - RNA, 15 nt, Mycobacterium bovis subsp bovis AF2122/97
acgucgcgccaggcg

SEQ ID NO: 1125699 - RNA, 21 nt, Mycobacterium bovis subsp bovis AF2122/97
acgucgcgccaggcgcgaucg

SEQ ID NO: 1125700 - RNA, 18 nt, Mycobacterium bovis subsp bovis AF2122/97
acgucgcggaguagccgc

SEQ ID NO: 1125701 - RNA, 16 nt, Mycobacterium bovis subsp bovis AF2122/97
acgucgcggauugccg

SEQ ID NO: 1125702 - RNA, 14 nt, Mycobacterium bovis subsp bovis AF2122/97
acgucgcggccagc

SEQ ID NO: 1125703 - RNA, 13 nt, Mycobacterium bovis subsp bovis AF2122/97
acgucgaccgaac

SEQ ID NO: 1125704 - RNA, 19 nt, Mycobacterium bovis subsp bovis AF2122/97
acgucgaccgaacccgacg

SEQ ID NO: 1125705 - RNA, 17 nt, Mycobacterium bovis subsp bovis AF2122/97
acgucgacaacgaucgc

SEQ ID NO: 1125706 - RNA, 18 nt, Mycobacterium bovis subsp bovis AF2122/97
acgucgcuguaggccagc

SEQ ID NO: 1125707 - RNA, 19 nt, Mycobacterium bovis subsp bovis AF2122/97
acgucgcuguaggccagcc

SEQ ID NO: 1125708 - RNA, 20 nt, Mycobacterium bovis subsp bovis AF2122/97
acgucugacaauuccuggau

SEQ ID NO: 1125709 - RNA, 21 nt, Mycobacterium bovis subsp bovis AF2122/97
acgucuucgggcucguccagc

SEQ ID NO: 1125710 - RNA, 18 nt, Mycobacterium bovis subsp bovis AF2122/97
acgucuucacucacgacg

SEQ ID NO: 1125711 - RNA, 18 nt, Mycobacterium bovis subsp bovis AF2122/97
acgugaacugagggcgga

SEQ ID NO: 1125712 - RNA, 21 nt, Mycobacterium bovis subsp bovis AF2122/97
acgugaagccaagcgacucgc

SEQ ID NO: 1125713 - RNA, 21 nt, Mycobacterium bovis subsp bovis AF2122/97
acgugaccggcaaugccacgg

SEQ ID NO: 1125714 - RNA, 17 nt, Mycobacterium bovis subsp bovis AF2122/97
acgguuuagcgccgguu

SEQ ID NO: 1125715 - RNA, 13 nt, Mycobacterium bovis subsp bovis AF2122/97
acguaacggucgg

SEQ ID NO: 1125716 - RNA, 19 nt, Mycobacterium bovis subsp bovis AF2122/97
acguagaaguaggcggcga

SEQ ID NO: 1125717 - RNA, 19 nt, Mycobacterium bovis subsp bovis AF2122/97
acguauccacggucgacca

SEQ ID NO: 1125718 - RNA, 15 nt, Mycobacterium bovis subsp bovis AF2122/97
acguacgcggcugcg

SEQ ID NO: 1125719 - RNA, 16 nt, Mycobacterium bovis subsp bovis AF2122/97
acguacggggucgccg

SEQ ID NO: 1125720 - RNA, 11 nt, Mycobacterium bovis subsp bovis AF2122/97
acguccgcgac

SEQ ID NO: 1125721 - RNA, 15 nt, Mycobacterium bovis subsp bovis AF2122/97
acguccgcgcaccgc

SEQ ID NO: 1125722 - RNA, 19 nt, Mycobacterium bovis subsp bovis AF2122/97
acgucacguggucggccac

SEQ ID NO: 1125723 - RNA, 17 nt, Mycobacterium bovis subsp bovis AF2122/97
acgucacguucggcgca

SEQ ID NO: 1125724 - RNA, 17 nt, Mycobacterium bovis subsp bovis AF2122/97
acguccccuguugcaga

SEQ ID NO: 1125725 - RNA, 17 nt, Mycobacterium bovis subsp bovis AF2122/97
acgucaccggguccggu

SEQ ID NO: 1125726 - RNA, 16 nt, Mycobacterium bovis subsp bovis AF2122/97
acguaucgccgcgggc

SEQ ID NO: 1125727 - RNA, 19 nt, Mycobacterium bovis subsp bovis AF2122/97
acgucaaacccagcgacgc

SEQ ID NO: 1125728 - RNA, 23 nt, Mycobacterium bovis subsp bovis AF2122/97
acgucaaacccagcgacgcggcc

SEQ ID NO: 1125729 - RNA, 23 nt, Mycobacterium bovis subsp bovis AF2122/97
acguugacguccaacagcgcucg

SEQ ID NO: 1125730 - RNA, 19 nt, Mycobacterium bovis subsp bovis AF2122/97
acguugauccccagcuccg

SEQ ID NO: 1125731 - RNA, 16 nt, Mycobacterium bovis subsp bovis AF2122/97
acguugccgaacgucg

SEQ ID NO: 1125732 - RNA, 19 nt, Mycobacterium bovis subsp bovis AF2122/97
acguugccggaguugucga

SEQ ID NO: 1125733 - RNA, 16 nt, Mycobacterium bovis subsp bovis AF2122/97
acguugcagccggcau

SEQ ID NO: 1125734 - RNA, 18 nt, Mycobacterium bovis subsp bovis AF2122/97
acguugaugaugccggcg

SEQ ID NO: 1125735 - RNA, 22 nt, Mycobacterium bovis subsp bovis AF2122/97
acguugccaacaccggcgauca

SEQ ID NO: 1125736 - RNA, 23 nt, Mycobacterium bovis subsp bovis AF2122/97
acguugcgaggccgcacgucgac

SEQ ID NO: 1125737 - RNA, 22 nt, Mycobacterium bovis subsp bovis AF2122/97
acguugccggaguugucgacgg

SEQ ID NO: 1125738 - RNA, 19 nt, Mycobacterium bovis subsp bovis AF2122/97
acguugcguagcaggucga

SEQ ID NO: 1125739 - RNA, 20 nt, Mycobacterium bovis subsp bovis AF2122/97
acguugcguagcaggucgac

SEQ ID NO: 1125740 - RNA, 22 nt, Mycobacterium bovis subsp bovis AF2122/97
acguugcguagcaggucgacgg

SEQ ID NO: 1125741 - RNA, 17 nt, Mycobacterium bovis subsp bovis AF2122/97
acuacccagccagccgc

SEQ ID NO: 1125742 - RNA, 15 nt, Mycobacterium bovis subsp bovis AF2122/97
acuaccgccgcgacc

SEQ ID NO: 1125743 - RNA, 18 nt, Mycobacterium bovis subsp bovis AF2122/97
acuaucgucgugucgccg

SEQ ID NO: 1125744 - RNA, 22 nt, Mycobacterium bovis subsp bovis AF2122/97
acuaucgucgugucgccgccgu

SEQ ID NO: 1125745 - RNA, 21 nt, Mycobacterium bovis subsp bovis AF2122/97
acguggucggagcgggugcgg

SEQ ID NO: 1125746 - RNA, 18 nt, Mycobacterium bovis subsp bovis AF2122/97
acgugguccaaccgggcc

SEQ ID NO: 1125747 - RNA, 13 nt, Mycobacterium bovis subsp bovis AF2122/97
acguggugcggcc

SEQ ID NO: 1125748 - RNA, 22 nt, Mycobacterium bovis subsp bovis AF2122/97
acgugguguaucgacggcggcc

SEQ ID NO: 1125749 - RNA, 20 nt, Mycobacterium bovis subsp bovis AF2122/97
acgugucgggugugcaggcc

SEQ ID NO: 1125750 - RNA, 20 nt, Mycobacterium bovis subsp bovis AF2122/97
acguguggugugucaccgga

SEQ ID NO: 1125751 - RNA, 23 nt, Mycobacterium bovis subsp bovis AF2122/97
acgugugcggaagcaucggcugc

SEQ ID NO: 1125752 - RNA, 15 nt, Mycobacterium bovis subsp bovis AF2122/97
acguguugaccgggu

SEQ ID NO: 1125753 - RNA, 14 nt, Mycobacterium bovis subsp bovis AF2122/97
acguuauucaugcc

SEQ ID NO: 1125754 - RNA, 13 nt, Mycobacterium bovis subsp bovis AF2122/97
acguggcucggcg

SEQ ID NO: 1125755 - RNA, 19 nt, Mycobacterium bovis subsp bovis AF2122/97
acguggcugcguucgccgg

SEQ ID NO: 1125756 - RNA, 21 nt, Mycobacterium bovis subsp bovis AF2122/97
acguggcuugaguuucggcgc

SEQ ID NO: 1125757 - RNA, 17 nt, Mycobacterium bovis subsp bovis AF2122/97
acgugggccaacgacgc

SEQ ID NO: 1125758 - RNA, 19 nt, Mycobacterium bovis subsp bovis AF2122/97
acgugggccaacgacgcca

SEQ ID NO: 1125759 - RNA, 17 nt, Mycobacterium bovis subsp bovis AF2122/97
acguggccauccucgag

SEQ ID NO: 1125760 - RNA, 17 nt, Mycobacterium bovis subsp bovis AF2122/97
acguggacugaccucgu

SEQ ID NO: 1125761 - RNA, 18 nt, Mycobacterium bovis subsp bovis AF2122/97
acguggacugaccucguc

SEQ ID NO: 1125762 - RNA, 12 nt, Mycobacterium bovis subsp bovis AF2122/97
acgugacgucgu

SEQ ID NO: 1125763 - RNA, 19 nt, Mycobacterium bovis subsp bovis AF2122/97
acgugcaggaacacccaua

SEQ ID NO: 1125764 - RNA, 17 nt, Mycobacterium bovis subsp bovis AF2122/97
acgugcacgaaaaccgg

SEQ ID NO: 1125765 - RNA, 17 nt, Mycobacterium bovis subsp bovis AF2122/97
acgugcacggucaacga

SEQ ID NO: 1125766 - RNA, 13 nt, Mycobacterium bovis subsp bovis AF2122/97
acgugcacggcga

SEQ ID NO: 1125767 - RNA, 16 nt, Mycobacterium bovis subsp bovis AF2122/97
acuggcgccggugccg

SEQ ID NO: 1125768 - RNA, 18 nt, Mycobacterium bovis subsp bovis AF2122/97
acuggcgccggugccgcc

SEQ ID NO: 1125769 - RNA, 22 nt, Mycobacterium bovis subsp bovis AF2122/97
acuggcgccggugccgccgggu

SEQ ID NO: 1125770 - RNA, 17 nt, Mycobacterium bovis subsp bovis AF2122/97
acuggcgcugaucgccu

SEQ ID NO: 1125771 - RNA, 17 nt, Mycobacterium bovis subsp bovis AF2122/97
acuggcguugccaccgg

SEQ ID NO: 1125772 - RNA, 18 nt, Mycobacterium bovis subsp bovis AF2122/97
acuggcguugccaccgga

SEQ ID NO: 1125773 - RNA, 18 nt, Mycobacterium bovis subsp bovis AF2122/97
acuggcgguccgaugcgc

SEQ ID NO: 1125774 - RNA, 15 nt, Mycobacterium bovis subsp bovis AF2122/97
acuggcuauccaccu

SEQ ID NO: 1125775 - RNA, 18 nt, Mycobacterium bovis subsp bovis AF2122/97
acuggcuguaguccgcua

SEQ ID NO: 1125776 - RNA, 20 nt, Mycobacterium bovis subsp bovis AF2122/97
acugggcgaucgacaccgug

SEQ ID NO: 1125777 - RNA, 13 nt, Mycobacterium bovis subsp bovis AF2122/97
acugggacgacgc

SEQ ID NO: 1125778 - RNA, 15 nt, Mycobacterium bovis subsp bovis AF2122/97
acugggcaaacccgg

SEQ ID NO: 1125779 - RNA, 24 nt, Mycobacterium bovis subsp bovis AF2122/97
acuggucucccagaggucgagcgc

SEQ ID NO: 1125780 - RNA, 13 nt, Mycobacterium bovis subsp bovis AF2122/97
acuggugcagcgc

SEQ ID NO: 1125781 - RNA, 12 nt, Mycobacterium bovis subsp bovis AF2122/97
acuggucgccaa

SEQ ID NO: 1125782 - RNA, 13 nt, Mycobacterium bovis subsp bovis AF2122/97
acuggucgccaac

SEQ ID NO: 1125783 - RNA, 13 nt, Mycobacterium bovis subsp bovis AF2122/97
acugguggcgcca

SEQ ID NO: 1125784 - RNA, 13 nt, Mycobacterium bovis subsp bovis AF2122/97
acuggugggccau

SEQ ID NO: 1125785 - RNA, 17 nt, Mycobacterium bovis subsp bovis AF2122/97
acuggugcagcgccgac

SEQ ID NO: 1125786 - RNA, 21 nt, Mycobacterium bovis subsp bovis AF2122/97
acuggugcccgacccgccgau

SEQ ID NO: 1125787 - RNA, 15 nt, Mycobacterium bovis subsp bovis AF2122/97
acuggugccugccgc

SEQ ID NO: 1125788 - RNA, 21 nt, Mycobacterium bovis subsp bovis AF2122/97
acugguugggcgagaccgcga

SEQ ID NO: 1125789 - RNA, 16 nt, Mycobacterium bovis subsp bovis AF2122/97
acugggcaccggcggu

SEQ ID NO: 1125790 - RNA, 21 nt, Mycobacterium bovis subsp bovis AF2122/97
acugggcggccuggucggcca

SEQ ID NO: 1125791 - RNA, 24 nt, Mycobacterium bovis subsp bovis AF2122/97
acugggcggggcugggcgccaugc

SEQ ID NO: 1125792 - RNA, 19 nt, Mycobacterium bovis subsp bovis AF2122/97
acugggcuuuucaaugccg

SEQ ID NO: 1125793 - RNA, 15 nt, Mycobacterium bovis subsp bovis AF2122/97
acuggggugcugcgc

SEQ ID NO: 1125794 - RNA, 22 nt, Mycobacterium bovis subsp bovis AF2122/97
acugggcuggccagcacgcccg

SEQ ID NO: 1125795 - RNA, 22 nt, Mycobacterium bovis subsp bovis AF2122/97
acugggugucggugucgacguu

SEQ ID NO: 1125796 - RNA, 23 nt, Mycobacterium bovis subsp bovis AF2122/97
acuggucaacgggaugccggcga

SEQ ID NO: 1125797 - RNA, 19 nt, Mycobacterium bovis subsp bovis AF2122/97
acuggucacugcccugauu

SEQ ID NO: 1125798 - RNA, 21 nt, Mycobacterium bovis subsp bovis AF2122/97
acugcacaccaccgccgaaca

SEQ ID NO: 1125799 - RNA, 14 nt, Mycobacterium bovis subsp bovis AF2122/97
acugcacccgaucg

SEQ ID NO: 1125800 - RNA, 17 nt, Mycobacterium bovis subsp bovis AF2122/97
acugcacaccaccgccg

SEQ ID NO: 1125801 - RNA, 13 nt, Mycobacterium bovis subsp bovis AF2122/97
acugcagcgcggu

SEQ ID NO: 1125802 - RNA, 23 nt, Mycobacterium bovis subsp bovis AF2122/97
acugcacuugaaauugagccggc

SEQ ID NO: 1125803 - RNA, 19 nt, Mycobacterium bovis subsp bovis AF2122/97
acugcaguaguagcgcaac

SEQ ID NO: 1125804 - RNA, 13 nt, Mycobacterium bovis subsp bovis AF2122/97
acugcgccggccg

SEQ ID NO: 1125805 - RNA, 18 nt, Mycobacterium bovis subsp bovis AF2122/97
acugcgccguucgcuccc

SEQ ID NO: 1125806 - RNA, 18 nt, Mycobacterium bovis subsp bovis AF2122/97
acugcaugaacugcucgc

SEQ ID NO: 1125807 - RNA, 22 nt, Mycobacterium bovis subsp bovis AF2122/97
acugcagugaucgugaccggca

SEQ ID NO: 1125808 - RNA, 21 nt, Mycobacterium bovis subsp bovis AF2122/97
acugcagugccguguccagca

SEQ ID NO: 1125809 - RNA, 17 nt, Mycobacterium bovis subsp bovis AF2122/97
acugcguuccaucgccg

SEQ ID NO: 1125810 - RNA, 19 nt, Mycobacterium bovis subsp bovis AF2122/97
acugcguuccaucgccgac

SEQ ID NO: 1125811 - RNA, 15 nt, Mycobacterium bovis subsp bovis AF2122/97
acugcgugccgcacc

SEQ ID NO: 1125812 - RNA, 21 nt, Mycobacterium bovis subsp bovis AF2122/97
acugcgugccgcaccgccugc

SEQ ID NO: 1125813 - RNA, 21 nt, Mycobacterium bovis subsp bovis AF2122/97
acugcguuccaucgccgacgc

SEQ ID NO: 1125814 - RNA, 20 nt, Mycobacterium bovis subsp bovis AF2122/97
acugcguuggcgaccaugca

SEQ ID NO: 1125815 - RNA, 19 nt, Mycobacterium bovis subsp bovis AF2122/97
acugcgcgugcucgacgcg

SEQ ID NO: 1125816 - RNA, 17 nt, Mycobacterium bovis subsp bovis AF2122/97
acugcgcuacaucagaa

SEQ ID NO: 1125817 - RNA, 22 nt, Mycobacterium bovis subsp bovis AF2122/97
acugcggcagguucggcgacuc

SEQ ID NO: 1125818 - RNA, 18 nt, Mycobacterium bovis subsp bovis AF2122/97
acugcggcauggcaggcg

SEQ ID NO: 1125819 - RNA, 13 nt, Mycobacterium bovis subsp bovis AF2122/97
acugcggucgccc

SEQ ID NO: 1125820 - RNA, 21 nt, Mycobacterium bovis subsp bovis AF2122/97
acugcggcgcugggacggucg

SEQ ID NO: 1125821 - RNA, 16 nt, Mycobacterium bovis subsp bovis AF2122/97
acuggauggcucgccg

SEQ ID NO: 1125822 - RNA, 16 nt, Mycobacterium bovis subsp bovis AF2122/97
acuggcaccgccagcc

SEQ ID NO: 1125823 - RNA, 18 nt, Mycobacterium bovis subsp bovis AF2122/97
acuggcaggguugccccg

SEQ ID NO: 1125824 - RNA, 20 nt, Mycobacterium bovis subsp bovis AF2122/97
acuggacggggaagcccggc

SEQ ID NO: 1125825 - RNA, 12 nt, Mycobacterium bovis subsp bovis AF2122/97
acugcggugcca

SEQ ID NO: 1125826 - RNA, 15 nt, Mycobacterium bovis subsp bovis AF2122/97
acuggaccggugcca

SEQ ID NO: 1125827 - RNA, 21 nt, Mycobacterium bovis subsp bovis AF2122/97
acuggacucuucggaccggcu

SEQ ID NO: 1125828 - RNA, 22 nt, Mycobacterium bovis subsp bovis AF2122/97
acucaguguuccgccacccgcc

SEQ ID NO: 1125829 - RNA, 16 nt, Mycobacterium bovis subsp bovis AF2122/97
acucacgggugcuggc

SEQ ID NO: 1125830 - RNA, 17 nt, Mycobacterium bovis subsp bovis AF2122/97
acucaccagcaccccga

SEQ ID NO: 1125831 - RNA, 20 nt, Mycobacterium bovis subsp bovis AF2122/97
acucacccgagccaucaccg

SEQ ID NO: 1125832 - RNA, 11 nt, Mycobacterium bovis subsp bovis AF2122/97
acucggcggcu

SEQ ID NO: 1125833 - RNA, 22 nt, Mycobacterium bovis subsp bovis AF2122/97
acucgggcaaugucgacaccgg

SEQ ID NO: 1125834 - RNA, 17 nt, Mycobacterium bovis subsp bovis AF2122/97
acucgggcagcgcggcc

SEQ ID NO: 1125835 - RNA, 19 nt, Mycobacterium bovis subsp bovis AF2122/97
acucgggcagcgcggccag

SEQ ID NO: 1125836 - RNA, 23 nt, Mycobacterium bovis subsp bovis AF2122/97
acucgggcagcuucaacaccggc

SEQ ID NO: 1125837 - RNA, 18 nt, Mycobacterium bovis subsp bovis AF2122/97
acucggucguugccgcgg

SEQ ID NO: 1125838 - RNA, 17 nt, Mycobacterium bovis subsp bovis AF2122/97
acucggugucggccgcg

SEQ ID NO: 1125839 - RNA, 19 nt, Mycobacterium bovis subsp bovis AF2122/97
acucggucguugccgcggu

SEQ ID NO: 1125840 - RNA, 19 nt, Mycobacterium bovis subsp bovis AF2122/97
acucggugaucgcgguggc

SEQ ID NO: 1125841 - RNA, 18 nt, Mycobacterium bovis subsp bovis AF2122/97
acucggcgaccugccgga

SEQ ID NO: 1125842 - RNA, 20 nt, Mycobacterium bovis subsp bovis AF2122/97
acucggcgaccugccggacc

SEQ ID NO: 1125843 - RNA, 13 nt, Mycobacterium bovis subsp bovis AF2122/97
acucggcggccac

SEQ ID NO: 1125844 - RNA, 13 nt, Mycobacterium bovis subsp bovis AF2122/97
acucggcccggcc

SEQ ID NO: 1125845 - RNA, 22 nt, Mycobacterium bovis subsp bovis AF2122/97
acucggcauccaggcugucgcg

SEQ ID NO: 1125846 - RNA, 21 nt, Mycobacterium bovis subsp bovis AF2122/97
acucggccacggcgucggcca

SEQ ID NO: 1125847 - RNA, 16 nt, Mycobacterium bovis subsp bovis AF2122/97
acucggcaccgcggcc

SEQ ID NO: 1125848 - RNA, 16 nt, Mycobacterium bovis subsp bovis AF2122/97
acugaccccgccgcca

SEQ ID NO: 1125849 - RNA, 22 nt, Mycobacterium bovis subsp bovis AF2122/97
acugaccgucugcgacccgggc

SEQ ID NO: 1125850 - RNA, 20 nt, Mycobacterium bovis subsp bovis AF2122/97
acucuguggugucgauuggc

SEQ ID NO: 1125851 - RNA, 21 nt, Mycobacterium bovis subsp bovis AF2122/97
acucguggcgccacggcagcg

SEQ ID NO: 1125852 - RNA, 19 nt, Mycobacterium bovis subsp bovis AF2122/97
acucguugccgaccaugca

SEQ ID NO: 1125853 - RNA, 14 nt, Mycobacterium bovis subsp bovis AF2122/97
acucguugaccggc

SEQ ID NO: 1125854 - RNA, 12 nt, Mycobacterium bovis subsp bovis AF2122/97
acucgucgaugc

SEQ ID NO: 1125855 - RNA, 20 nt, Mycobacterium bovis subsp bovis AF2122/97
acucgguguuucgugccaug

SEQ ID NO: 1125856 - RNA, 23 nt, Mycobacterium bovis subsp bovis AF2122/97
acucgguuugacgagacgacgac

SEQ ID NO: 1125857 - RNA, 14 nt, Mycobacterium bovis subsp bovis AF2122/97
acucugcgacacca

SEQ ID NO: 1125858 - RNA, 19 nt, Mycobacterium bovis subsp bovis AF2122/97
acucugcguccaccacgca

SEQ ID NO: 1125859 - RNA, 15 nt, Mycobacterium bovis subsp bovis AF2122/97
acucguuggcgaacu

SEQ ID NO: 1125860 - RNA, 14 nt, Mycobacterium bovis subsp bovis AF2122/97
acuucauagcgccg

SEQ ID NO: 1125861 - RNA, 13 nt, Mycobacterium bovis subsp bovis AF2122/97
acuuccagcccgg

SEQ ID NO: 1125862 - RNA, 16 nt, Mycobacterium bovis subsp bovis AF2122/97
acuuccaagccgaccu

SEQ ID NO: 1125863 - RNA, 19 nt, Mycobacterium bovis subsp bovis AF2122/97
acuuccauucauggccgcg

SEQ ID NO: 1125864 - RNA, 19 nt, Mycobacterium bovis subsp bovis AF2122/97
acuuccccgguuccgcgau

SEQ ID NO: 1125865 - RNA, 14 nt, Mycobacterium bovis subsp bovis AF2122/97
acuucgcccgggcc

SEQ ID NO: 1125866 - RNA, 22 nt, Mycobacterium bovis subsp bovis AF2122/97
acuucggcgccgcgccgucccg

SEQ ID NO: 1125867 - RNA, 23 nt, Mycobacterium bovis subsp bovis AF2122/97
acuucggcgccgucucgaucgcg

SEQ ID NO: 1125868 - RNA, 19 nt, Mycobacterium bovis subsp bovis AF2122/97
acuucggugagcagggcgg

SEQ ID NO: 1125869 - RNA, 22 nt, Mycobacterium bovis subsp bovis AF2122/97
acuucggugagcagggcggcga

SEQ ID NO: 1125870 - RNA, 23 nt, Mycobacterium bovis subsp bovis AF2122/97
acuucgguggcgggcuugccguc

SEQ ID NO: 1125871 - RNA, 22 nt, Mycobacterium bovis subsp bovis AF2122/97
acuuccggauucggacucgccg

SEQ ID NO: 1125872 - RNA, 19 nt, Mycobacterium bovis subsp bovis AF2122/97
acuucgacagcggcgauug

SEQ ID NO: 1125873 - RNA, 18 nt, Mycobacterium bovis subsp bovis AF2122/97
acugugaaucucacgacg

SEQ ID NO: 1125874 - RNA, 15 nt, Mycobacterium bovis subsp bovis AF2122/97
acuguagggccggug

SEQ ID NO: 1125875 - RNA, 23 nt, Mycobacterium bovis subsp bovis AF2122/97
acugugggggcgcaccgagcgag

SEQ ID NO: 1125876 - RNA, 14 nt, Mycobacterium bovis subsp bovis AF2122/97
acuguucugcuggc

SEQ ID NO: 1125877 - RNA, 14 nt, Mycobacterium bovis subsp bovis AF2122/97
acugugccgcugca

SEQ ID NO: 1125878 - RNA, 21 nt, Mycobacterium bovis subsp bovis AF2122/97
acugugccgcugcauccgcag

SEQ ID NO: 1125879 - RNA, 11 nt, Mycobacterium bovis subsp bovis AF2122/97
acuguggcgcc

SEQ ID NO: 1125880 - RNA, 19 nt, Mycobacterium bovis subsp bovis AF2122/97
acugugaaucucacgacgc

SEQ ID NO: 1125881 - RNA, 17 nt, Mycobacterium bovis subsp bovis AF2122/97
acugugaaucugacgac

SEQ ID NO: 1125882 - RNA, 22 nt, Mycobacterium bovis subsp bovis AF2122/97
acuuagcgcuugacccgcggac

SEQ ID NO: 1125883 - RNA, 18 nt, Mycobacterium bovis subsp bovis AF2122/97
acuuguugacgaacccac

SEQ ID NO: 1125884 - RNA, 18 nt, Mycobacterium bovis subsp bovis AF2122/97
acuuggggucguucgccg

SEQ ID NO: 1125885 - RNA, 17 nt, Mycobacterium bovis subsp bovis AF2122/97
acuuggauggccgaacc

SEQ ID NO: 1125886 - RNA, 14 nt, Mycobacterium bovis subsp bovis AF2122/97
acuuggcggccagc

SEQ ID NO: 1125887 - RNA, 18 nt, Mycobacterium bovis subsp bovis AF2122/97
acuuggcggccagccgcu

SEQ ID NO: 1125888 - RNA, 21 nt, Mycobacterium bovis subsp bovis AF2122/97
acuugcgagguaagcgagucg

SEQ ID NO: 1125889 - RNA, 22 nt, Mycobacterium bovis subsp bovis AF2122/97
acuugauuucgaucgcggcaau

SEQ ID NO: 1125890 - RNA, 14 nt, Mycobacterium bovis subsp bovis AF2122/97
acuugcacgucggc

SEQ ID NO: 1125891 - RNA, 17 nt, Mycobacterium bovis subsp bovis AF2122/97
acuugaucucggcgagc

SEQ ID NO: 1125892 - RNA, 15 nt, Mycobacterium bovis subsp bovis AF2122/97
acuucguuccgugcc

SEQ ID NO: 1125893 - RNA, 13 nt, Mycobacterium bovis subsp bovis AF2122/97
acuucuucgacgc

SEQ ID NO: 1125894 - RNA, 18 nt, Mycobacterium bovis subsp bovis AF2122/97
acuucuucagcagcggcg

SEQ ID NO: 1125895 - RNA, 15 nt, Mycobacterium bovis subsp bovis AF2122/97
acuucugcugcagcc

SEQ ID NO: 1125896 - RNA, 16 nt, Mycobacterium bovis subsp bovis AF2122/97
acuugauaucggcggg

SEQ ID NO: 1125897 - RNA, 18 nt, Mycobacterium bovis subsp bovis AF2122/97
acuugaccguccaccgac

SEQ ID NO: 1125898 - RNA, 16 nt, Mycobacterium bovis subsp bovis AF2122/97
acuuuuccgccggcca

SEQ ID NO: 1125899 - RNA, 14 nt, Mycobacterium bovis subsp bovis AF2122/97
agaaaaccgccgca

SEQ ID NO: 1125900 - RNA, 17 nt, Mycobacterium bovis subsp bovis AF2122/97
uguuugggcaucucggc

SEQ ID NO: 1125901 - RNA, 20 nt, Mycobacterium bovis subsp bovis AF2122/97
uguuuccgaaacccgccgcg

SEQ ID NO: 1125902 - RNA, 13 nt, Mycobacterium bovis subsp bovis AF2122/97
uuaagacgcccga

SEQ ID NO: 1125903 - RNA, 17 nt, Mycobacterium bovis subsp bovis AF2122/97
uuacccgggcggcggcg

SEQ ID NO: 1125904 - RNA, 14 nt, Mycobacterium bovis subsp bovis AF2122/97
ugugguggagcggc

SEQ ID NO: 1125905 - RNA, 16 nt, Mycobacterium bovis subsp bovis AF2122/97
ugugguggagcggcgc

SEQ ID NO: 1125906 - RNA, 13 nt, Mycobacterium bovis subsp bovis AF2122/97
ugucggcgccgaa

SEQ ID NO: 1125907 - RNA, 12 nt, Mycobacterium bovis subsp bovis AF2122/97
ugucggcgcgcc

SEQ ID NO: 1125908 - RNA, 17 nt, Mycobacterium bovis subsp bovis AF2122/97
ugugucugcucgccgag

SEQ ID NO: 1125909 - RNA, 13 nt, Mycobacterium bovis subsp bovis AF2122/97
uguguugcacccg

SEQ ID NO: 1125910 - RNA, 19 nt, Mycobacterium bovis subsp bovis AF2122/97
uguucaccucuuggugccg

SEQ ID NO: 1125911 - RNA, 19 nt, Mycobacterium bovis subsp bovis AF2122/97
uguucagcaacaacgucug

SEQ ID NO: 1125912 - RNA, 15 nt, Mycobacterium bovis subsp bovis AF2122/97
ugucggcgaucaacg

SEQ ID NO: 1125913 - RNA, 19 nt, Mycobacterium bovis subsp bovis AF2122/97
ugucggcgaugcguccgcc

SEQ ID NO: 1125914 - RNA, 20 nt, Mycobacterium bovis subsp bovis AF2122/97
ugucggcgaugucgaagccc

SEQ ID NO: 1125915 - RNA, 22 nt, Mycobacterium bovis subsp bovis AF2122/97
ugucggcgaccgagacggcguc

SEQ ID NO: 1125916 - RNA, 14 nt, Mycobacterium bovis subsp bovis AF2122/97
ugucggccggggcc

SEQ ID NO: 1125917 - RNA, 11 nt, Mycobacterium bovis subsp bovis AF2122/97
ugucggccgcc

SEQ ID NO: 1125918 - RNA, 12 nt, Mycobacterium bovis subsp bovis AF2122/97
ugucggccaccc

SEQ ID NO: 1125919 - RNA, 15 nt, Mycobacterium bovis subsp bovis AF2122/97
ugucggccacccgga

SEQ ID NO: 1125920 - RNA, 15 nt, Mycobacterium bovis subsp bovis AF2122/97
ugucggccaccggcg

SEQ ID NO: 1125921 - RNA, 14 nt, Mycobacterium bovis subsp bovis AF2122/97
ugucgcugccgccg

SEQ ID NO: 1125922 - RNA, 20 nt, Mycobacterium bovis subsp bovis AF2122/97
ugucggauagccucggcggc

SEQ ID NO: 1125923 - RNA, 14 nt, Mycobacterium bovis subsp bovis AF2122/97
uguugcgcugcggc

SEQ ID NO: 1125924 - RNA, 18 nt, Mycobacterium bovis subsp bovis AF2122/97
uguucgaaagcaccgaug

SEQ ID NO: 1125925 - RNA, 19 nt, Mycobacterium bovis subsp bovis AF2122/97
uguuggccagaccgcgcgc

SEQ ID NO: 1125926 - RNA, 20 nt, Mycobacterium bovis subsp bovis AF2122/97
uguuggaagucccgccguug

SEQ ID NO: 1125927 - RNA, 16 nt, Mycobacterium bovis subsp bovis AF2122/97
uguugcuuugcuggcg

SEQ ID NO: 1125928 - RNA, 20 nt, Mycobacterium bovis subsp bovis AF2122/97
uguucaucacgccgccggag

SEQ ID NO: 1125929 - RNA, 15 nt, Mycobacterium bovis subsp bovis AF2122/97
uguugcucgccgucg

SEQ ID NO: 1125930 - RNA, 17 nt, Mycobacterium bovis subsp bovis AF2122/97
uguuccgcccagcgagg

SEQ ID NO: 1125931 - RNA, 15 nt, Mycobacterium bovis subsp bovis AF2122/97
uguuccgccgcgcua

SEQ ID NO: 1125932 - RNA, 17 nt, Mycobacterium bovis subsp bovis AF2122/97
uguuccagcgugccugg

SEQ ID NO: 1125933 - RNA, 14 nt, Mycobacterium bovis subsp bovis AF2122/97
uguuccacccggug

SEQ ID NO: 1125934 - RNA, 19 nt, Mycobacterium bovis subsp bovis AF2122/97
uguucagcuucgccaggug

SEQ ID NO: 1125935 - RNA, 22 nt, Mycobacterium bovis subsp bovis AF2122/97
uguuggccagucccucgccaac

SEQ ID NO: 1125936 - RNA, 18 nt, Mycobacterium bovis subsp bovis AF2122/97
uguuggccauguccacca

SEQ ID NO: 1125937 - RNA, 19 nt, Mycobacterium bovis subsp bovis AF2122/97
uguuggugugcucggccaa

SEQ ID NO: 1125938 - RNA, 21 nt, Mycobacterium bovis subsp bovis AF2122/97
uguugguuugccggcgguggc

SEQ ID NO: 1125939 - RNA, 23 nt, Mycobacterium bovis subsp bovis AF2122/97
uguugguuugccggcgguggccg

SEQ ID NO: 1125940 - RNA, 12 nt, Mycobacterium bovis subsp bovis AF2122/97
uguugucgauca

SEQ ID NO: 1125941 - RNA, 14 nt, Mycobacterium bovis subsp bovis AF2122/97
uguugucgucgccg

SEQ ID NO: 1125942 - RNA, 17 nt, Mycobacterium bovis subsp bovis AF2122/97
uguugugcucggugacg

SEQ ID NO: 1125943 - RNA, 19 nt, Mycobacterium bovis subsp bovis AF2122/97
uucaccgcgcugaaccaga

SEQ ID NO: 1125944 - RNA, 22 nt, Mycobacterium bovis subsp bovis AF2122/97
uucagccacgcagcacggcacc

SEQ ID NO: 1125945 - RNA, 13 nt, Mycobacterium bovis subsp bovis AF2122/97
uucagcgaagccg

SEQ ID NO: 1125946 - RNA, 19 nt, Mycobacterium bovis subsp bovis AF2122/97
uucagcgacggccgccagc

SEQ ID NO: 1125947 - RNA, 21 nt, Mycobacterium bovis subsp bovis AF2122/97
uucaccacucggucguugccg

SEQ ID NO: 1125948 - RNA, 15 nt, Mycobacterium bovis subsp bovis AF2122/97
uucaccaugucggcc

SEQ ID NO: 1125949 - RNA, 14 nt, Mycobacterium bovis subsp bovis AF2122/97
uucacagccaccag

SEQ ID NO: 1125950 - RNA, 16 nt, Mycobacterium bovis subsp bovis AF2122/97
uucaacuuacgcgacg

SEQ ID NO: 1125951 - RNA, 16 nt, Mycobacterium bovis subsp bovis AF2122/97
uucaaagcggccucga

SEQ ID NO: 1125952 - RNA, 19 nt, Mycobacterium bovis subsp bovis AF2122/97
uuaccggcacgccggcggc

SEQ ID NO: 1125953 - RNA, 18 nt, Mycobacterium bovis subsp bovis AF2122/97
uuaccgccggcgccggug

SEQ ID NO: 1125954 - RNA, 11 nt, Mycobacterium bovis subsp bovis AF2122/97
uuaccgccguc

SEQ ID NO: 1125955 - RNA, 14 nt, Mycobacterium bovis subsp bovis AF2122/97
uuaccgccgucgcc

SEQ ID NO: 1125956 - RNA, 11 nt, Mycobacterium bovis subsp bovis AF2122/97
uuaccgccguu

SEQ ID NO: 1125957 - RNA, 17 nt, Mycobacterium bovis subsp bovis AF2122/97
uuaucggucggacggcc

SEQ ID NO: 1125958 - RNA, 20 nt, Mycobacterium bovis subsp bovis AF2122/97
uuaucggcagcaggacaccu

SEQ ID NO: 1125959 - RNA, 20 nt, Mycobacterium bovis subsp bovis AF2122/97
uuaugcgucugcucgccggg

SEQ ID NO: 1125960 - RNA, 15 nt, Mycobacterium bovis subsp bovis AF2122/97
uucgaucagucgugg

SEQ ID NO: 1125961 - RNA, 14 nt, Mycobacterium bovis subsp bovis AF2122/97
uucgauaccgcacc

SEQ ID NO: 1125962 - RNA, 23 nt, Mycobacterium bovis subsp bovis AF2122/97
uucgagugcggucgagagccaaa

SEQ ID NO: 1125963 - RNA, 16 nt, Mycobacterium bovis subsp bovis AF2122/97
uucgagguacagcggg

SEQ ID NO: 1125964 - RNA, 18 nt, Mycobacterium bovis subsp bovis AF2122/97
uucgacggugccgucugc

SEQ ID NO: 1125965 - RNA, 16 nt, Mycobacterium bovis subsp bovis AF2122/97
uucgacucgaccgcga

SEQ ID NO: 1125966 - RNA, 20 nt, Mycobacterium bovis subsp bovis AF2122/97
uucgagagccccgaccagca

SEQ ID NO: 1125967 - RNA, 22 nt, Mycobacterium bovis subsp bovis AF2122/97
uucgagcaccgacaccggccgc

SEQ ID NO: 1125968 - RNA, 21 nt, Mycobacterium bovis subsp bovis AF2122/97
uucgaccuugcaccggccgaa

SEQ ID NO: 1125969 - RNA, 13 nt, Mycobacterium bovis subsp bovis AF2122/97
uucgacgcggcga

SEQ ID NO: 1125970 - RNA, 19 nt, Mycobacterium bovis subsp bovis AF2122/97
uucgacguuggcgugcacc

SEQ ID NO: 1125971 - RNA, 13 nt, Mycobacterium bovis subsp bovis AF2122/97
uucgacggcggcc

SEQ ID NO: 1125972 - RNA, 16 nt, Mycobacterium bovis subsp bovis AF2122/97
uucgacggcggccaag

SEQ ID NO: 1125973 - RNA, 16 nt, Mycobacterium bovis subsp bovis AF2122/97
uucgaccgccguggcc

SEQ ID NO: 1125974 - RNA, 12 nt, Mycobacterium bovis subsp bovis AF2122/97
uucgaugguguc

SEQ ID NO: 1125975 - RNA, 17 nt, Mycobacterium bovis subsp bovis AF2122/97
uucgauugcgcugcacc

SEQ ID NO: 1125976 - RNA, 22 nt, Mycobacterium bovis subsp bovis AF2122/97
uucgccgcgcuugcgaucgccg

SEQ ID NO: 1125977 - RNA, 12 nt, Mycobacterium bovis subsp bovis AF2122/97
uucgccgcccgc

SEQ ID NO: 1125978 - RNA, 13 nt, Mycobacterium bovis subsp bovis AF2122/97
uucgccgcccgca

SEQ ID NO: 1125979 - RNA, 22 nt, Mycobacterium bovis subsp bovis AF2122/97
uucgcagugacguuccgcucgc

SEQ ID NO: 1125980 - RNA, 17 nt, Mycobacterium bovis subsp bovis AF2122/97
uucggcaggaaugccgc

SEQ ID NO: 1125981 - RNA, 12 nt, Mycobacterium bovis subsp bovis AF2122/97
uucggccaccaa

SEQ ID NO: 1125982 - RNA, 13 nt, Mycobacterium bovis subsp bovis AF2122/97
uucggcgccgcgc

SEQ ID NO: 1125983 - RNA, 22 nt, Mycobacterium bovis subsp bovis AF2122/97
uucggccguaucgucgagcacc

SEQ ID NO: 1125984 - RNA, 21 nt, Mycobacterium bovis subsp bovis AF2122/97
uucggccacugauucgcaggc

SEQ ID NO: 1125985 - RNA, 17 nt, Mycobacterium bovis subsp bovis AF2122/97
uucggccagcgcccgca

SEQ ID NO: 1125986 - RNA, 22 nt, Mycobacterium bovis subsp bovis AF2122/97
uucggccagcgcccgcaggugg

SEQ ID NO: 1125987 - RNA, 18 nt, Mycobacterium bovis subsp bovis AF2122/97
uucggccauggcggcgcc

SEQ ID NO: 1125988 - RNA, 22 nt, Mycobacterium bovis subsp bovis AF2122/97
uucggccauguagccguugccg

SEQ ID NO: 1125989 - RNA, 21 nt, Mycobacterium bovis subsp bovis AF2122/97
uucggcgacagcgcggcgguc

SEQ ID NO: 1125990 - RNA, 17 nt, Mycobacterium bovis subsp bovis AF2122/97
uucggcgagccgcgccc

SEQ ID NO: 1125991 - RNA, 15 nt, Mycobacterium bovis subsp bovis AF2122/97
uucgccuggucaccg

SEQ ID NO: 1125992 - RNA, 16 nt, Mycobacterium bovis subsp bovis AF2122/97
uucgccggcaggguuc

SEQ ID NO: 1125993 - RNA, 21 nt, Mycobacterium bovis subsp bovis AF2122/97
uucgcgaagaacgacgccacc

SEQ ID NO: 1125994 - RNA, 19 nt, Mycobacterium bovis subsp bovis AF2122/97
uucgcgguuggcggcgaug

SEQ ID NO: 1125995 - RNA, 13 nt, Mycobacterium bovis subsp bovis AF2122/97
uucgcucccccgc

SEQ ID NO: 1125996 - RNA, 18 nt, Mycobacterium bovis subsp bovis AF2122/97
uucgcucgcaccgcccgc

SEQ ID NO: 1125997 - RNA, 22 nt, Mycobacterium bovis subsp bovis AF2122/97
uucgcugaccgcuaccagcugg

SEQ ID NO: 1125998 - RNA, 19 nt, Mycobacterium bovis subsp bovis AF2122/97
uucaccgcguguaccgcga

SEQ ID NO: 1125999 - RNA, 22 nt, Mycobacterium bovis subsp bovis AF2122/97
uucccgcaggcucaccgagccg

SEQ ID NO: 1126000 - RNA, 11 nt, Mycobacterium bovis subsp bovis AF2122/97
uuccggccgau

SEQ ID NO: 1126001 - RNA, 14 nt, Mycobacterium bovis subsp bovis AF2122/97
uuccggccgaugcg

SEQ ID NO: 1126002 - RNA, 14 nt, Mycobacterium bovis subsp bovis AF2122/97
uucccgcggcaacg

SEQ ID NO: 1126003 - RNA, 18 nt, Mycobacterium bovis subsp bovis AF2122/97
uucccgaaccccgaccgc

SEQ ID NO: 1126004 - RNA, 13 nt, Mycobacterium bovis subsp bovis AF2122/97
uucccgacaucgu

SEQ ID NO: 1126005 - RNA, 22 nt, Mycobacterium bovis subsp bovis AF2122/97
uuccccgguagccccgucgacc

SEQ ID NO: 1126006 - RNA, 17 nt, Mycobacterium bovis subsp bovis AF2122/97
uucccaggaacgggacg

SEQ ID NO: 1126007 - RNA, 18 nt, Mycobacterium bovis subsp bovis AF2122/97
uuccuggguugugccgcc

SEQ ID NO: 1126008 - RNA, 22 nt, Mycobacterium bovis subsp bovis AF2122/97
uuccucggauugcagcgcgaug

SEQ ID NO: 1126009 - RNA, 20 nt, Mycobacterium bovis subsp bovis AF2122/97
uuccucguaggcguacacca

SEQ ID NO: 1126010 - RNA, 16 nt, Mycobacterium bovis subsp bovis AF2122/97
uuccucggccacccgc

SEQ ID NO: 1126011 - RNA, 22 nt, Mycobacterium bovis subsp bovis AF2122/97
uuccgggcgaccaacacgucga

SEQ ID NO: 1126012 - RNA, 13 nt, Mycobacterium bovis subsp bovis AF2122/97
uuccgggcgcgug

SEQ ID NO: 1126013 - RNA, 19 nt, Mycobacterium bovis subsp bovis AF2122/97
uuccggcucaccgaucccg

SEQ ID NO: 1126014 - RNA, 19 nt, Mycobacterium bovis subsp bovis AF2122/97
uuccggugccgggaugccg

SEQ ID NO: 1126015 - RNA, 21 nt, Mycobacterium bovis subsp bovis AF2122/97
uuccgguggugucgguucguc

SEQ ID NO: 1126016 - RNA, 19 nt, Mycobacterium bovis subsp bovis AF2122/97
uuccgggucggcgaacgcc

SEQ ID NO: 1126017 - RNA, 13 nt, Mycobacterium bovis subsp bovis AF2122/97
uuccucgaccgcu

SEQ ID NO: 1126018 - RNA, 15 nt, Mycobacterium bovis subsp bovis AF2122/97
uucuugacgccgaug

SEQ ID NO: 1126019 - RNA, 15 nt, Mycobacterium bovis subsp bovis AF2122/97
uucuugaccgcggug

SEQ ID NO: 1126020 - RNA, 20 nt, Mycobacterium bovis subsp bovis AF2122/97
uucuucuccaccaccgucga

SEQ ID NO: 1126021 - RNA, 14 nt, Mycobacterium bovis subsp bovis AF2122/97
uucugcagcgucuc

SEQ ID NO: 1126022 - RNA, 23 nt, Mycobacterium bovis subsp bovis AF2122/97
uucugacgaccggcuaccggcgu

SEQ ID NO: 1126023 - RNA, 21 nt, Mycobacterium bovis subsp bovis AF2122/97
uucugacuaucucgcucgacg

SEQ ID NO: 1126024 - RNA, 14 nt, Mycobacterium bovis subsp bovis AF2122/97
uucuuuugcgucug

SEQ ID NO: 1126025 - RNA, 16 nt, Mycobacterium bovis subsp bovis AF2122/97
uucuuguuggucccga

SEQ ID NO: 1126026 - RNA, 23 nt, Mycobacterium bovis subsp bovis AF2122/97
uucggggccccgcggcgccgcca

SEQ ID NO: 1126027 - RNA, 15 nt, Mycobacterium bovis subsp bovis AF2122/97
uucggggugguggaa

SEQ ID NO: 1126028 - RNA, 14 nt, Mycobacterium bovis subsp bovis AF2122/97
uucgggggccagcg

SEQ ID NO: 1126029 - RNA, 17 nt, Mycobacterium bovis subsp bovis AF2122/97
uucgggggcggucgcgu

SEQ ID NO: 1126030 - RNA, 21 nt, Mycobacterium bovis subsp bovis AF2122/97
uucggcgccggcgucggcgcc

SEQ ID NO: 1126031 - RNA, 19 nt, Mycobacterium bovis subsp bovis AF2122/97
uucggcgccuggcggcgcc

SEQ ID NO: 1126032 - RNA, 23 nt, Mycobacterium bovis subsp bovis AF2122/97
uucggcgcgacagccguggcgcg

SEQ ID NO: 1126033 - RNA, 17 nt, Mycobacterium bovis subsp bovis AF2122/97
uucgguagucgaugcug

SEQ ID NO: 1126034 - RNA, 21 nt, Mycobacterium bovis subsp bovis AF2122/97
uucggugccgugaucggcgcc

SEQ ID NO: 1126035 - RNA, 16 nt, Mycobacterium bovis subsp bovis AF2122/97
uucggucucgaccgcg

SEQ ID NO: 1126036 - RNA, 13 nt, Mycobacterium bovis subsp bovis AF2122/97
uucggucagcgcc

SEQ ID NO: 1126037 - RNA, 22 nt, Mycobacterium bovis subsp bovis AF2122/97
uucggucagugggacgggcgcg

SEQ ID NO: 1126038 - RNA, 12 nt, Mycobacterium bovis subsp bovis AF2122/97
uucgucaccguu

SEQ ID NO: 1126039 - RNA, 23 nt, Mycobacterium bovis subsp bovis AF2122/97
uucucgcuguugaagccgcccga

SEQ ID NO: 1126040 - RNA, 11 nt, Mycobacterium bovis subsp bovis AF2122/97
uugaggccggu

SEQ ID NO: 1126041 - RNA, 22 nt, Mycobacterium bovis subsp bovis AF2122/97
uugaggccggugaacgguagca

SEQ ID NO: 1126042 - RNA, 16 nt, Mycobacterium bovis subsp bovis AF2122/97
uugagucguuggacgg

SEQ ID NO: 1126043 - RNA, 15 nt, Mycobacterium bovis subsp bovis AF2122/97
uugagguauucgaag

SEQ ID NO: 1126044 - RNA, 22 nt, Mycobacterium bovis subsp bovis AF2122/97
uugaggccgucgaacgguagca

SEQ ID NO: 1126045 - RNA, 20 nt, Mycobacterium bovis subsp bovis AF2122/97
uugagugcccauagccggug

SEQ ID NO: 1126046 - RNA, 18 nt, Mycobacterium bovis subsp bovis AF2122/97
uugagcgugagcgccgcg

SEQ ID NO: 1126047 - RNA, 21 nt, Mycobacterium bovis subsp bovis AF2122/97
uugagcagcaagccgccggug

SEQ ID NO: 1126048 - RNA, 19 nt, Mycobacterium bovis subsp bovis AF2122/97
uugacgguugccccggcga

SEQ ID NO: 1126049 - RNA, 21 nt, Mycobacterium bovis subsp bovis AF2122/97
uugacgguugccccggcgacc

SEQ ID NO: 1126050 - RNA, 21 nt, Mycobacterium bovis subsp bovis AF2122/97
uugacguagaccgucgauccg

SEQ ID NO: 1126051 - RNA, 15 nt, Mycobacterium bovis subsp bovis AF2122/97
uugacguaggcggcg

SEQ ID NO: 1126052 - RNA, 16 nt, Mycobacterium bovis subsp bovis AF2122/97
uugacggucagccgcg

SEQ ID NO: 1126053 - RNA, 19 nt, Mycobacterium bovis subsp bovis AF2122/97
uugacgggcucggcaggcc

SEQ ID NO: 1126054 - RNA, 21 nt, Mycobacterium bovis subsp bovis AF2122/97
uugacgggcucggcaggcccg

SEQ ID NO: 1126055 - RNA, 18 nt, Mycobacterium bovis subsp bovis AF2122/97
uugacucugcguccacca

SEQ ID NO: 1126056 - RNA, 18 nt, Mycobacterium bovis subsp bovis AF2122/97
uugacucugcguccaccg

SEQ ID NO: 1126057 - RNA, 21 nt, Mycobacterium bovis subsp bovis AF2122/97
uugaccuucgacaaguccgcg

SEQ ID NO: 1126058 - RNA, 18 nt, Mycobacterium bovis subsp bovis AF2122/97
uugaccuucucgucggcc

SEQ ID NO: 1126059 - RNA, 22 nt, Mycobacterium bovis subsp bovis AF2122/97
uugacggcgaagucgagugccg

SEQ ID NO: 1126060 - RNA, 15 nt, Mycobacterium bovis subsp bovis AF2122/97
uugacgccguugccg

SEQ ID NO: 1126061 - RNA, 18 nt, Mycobacterium bovis subsp bovis AF2122/97
uugacgaggcgagcggcc

SEQ ID NO: 1126062 - RNA, 22 nt, Mycobacterium bovis subsp bovis AF2122/97
uugaccccuggccgccggcgcc

SEQ ID NO: 1126063 - RNA, 23 nt, Mycobacterium bovis subsp bovis AF2122/97
uugaccccuggccgccggcgccg

SEQ ID NO: 1126064 - RNA, 17 nt, Mycobacterium bovis subsp bovis AF2122/97
uugacccgacgaugccg

SEQ ID NO: 1126065 - RNA, 18 nt, Mycobacterium bovis subsp bovis AF2122/97
uugaccacagcggagacg

SEQ ID NO: 1126066 - RNA, 18 nt, Mycobacterium bovis subsp bovis AF2122/97
uugaccaccaccgagccg

SEQ ID NO: 1126067 - RNA, 20 nt, Mycobacterium bovis subsp bovis AF2122/97
uugaccgaaaacacaugccg

SEQ ID NO: 1126068 - RNA, 14 nt, Mycobacterium bovis subsp bovis AF2122/97
uugacccggggacg

SEQ ID NO: 1126069 - RNA, 18 nt, Mycobacterium bovis subsp bovis AF2122/97
uugaccgggucgaugacg

SEQ ID NO: 1126070 - RNA, 16 nt, Mycobacterium bovis subsp bovis AF2122/97
uugaagccgauguccg

SEQ ID NO: 1126071 - RNA, 17 nt, Mycobacterium bovis subsp bovis AF2122/97
uugaacgaguagccggu

SEQ ID NO: 1126072 - RNA, 14 nt, Mycobacterium bovis subsp bovis AF2122/97
uugaaggcgccggu

SEQ ID NO: 1126073 - RNA, 15 nt, Mycobacterium bovis subsp bovis AF2122/97
uugaaggcgccggug

SEQ ID NO: 1126074 - RNA, 14 nt, Mycobacterium bovis subsp bovis AF2122/97
uugaaggugccggc

SEQ ID NO: 1126075 - RNA, 22 nt, Mycobacterium bovis subsp bovis AF2122/97
uugcuggcggaacuugccggug

SEQ ID NO: 1126076 - RNA, 22 nt, Mycobacterium bovis subsp bovis AF2122/97
uugcucgagcgguggcgucguc

SEQ ID NO: 1126077 - RNA, 20 nt, Mycobacterium bovis subsp bovis AF2122/97
uugcucgacgaucugcagca

SEQ ID NO: 1126078 - RNA, 18 nt, Mycobacterium bovis subsp bovis AF2122/97
uugcgggcucucggcguc

SEQ ID NO: 1126079 - RNA, 18 nt, Mycobacterium bovis subsp bovis AF2122/97
uugcgggcagccgcccgc

SEQ ID NO: 1126080 - RNA, 22 nt, Mycobacterium bovis subsp bovis AF2122/97
uugcggccgccgagucaaacaa

SEQ ID NO: 1126081 - RNA, 14 nt, Mycobacterium bovis subsp bovis AF2122/97
uugcggccgccggg

SEQ ID NO: 1126082 - RNA, 18 nt, Mycobacterium bovis subsp bovis AF2122/97
uugcgucugcucggcgua

SEQ ID NO: 1126083 - RNA, 17 nt, Mycobacterium bovis subsp bovis AF2122/97
uugcggucaucggcgcc

SEQ ID NO: 1126084 - RNA, 22 nt, Mycobacterium bovis subsp bovis AF2122/97
uugcguuccaguccccgccggc

SEQ ID NO: 1126085 - RNA, 13 nt, Mycobacterium bovis subsp bovis AF2122/97
uugcgcacccgcg

SEQ ID NO: 1126086 - RNA, 13 nt, Mycobacterium bovis subsp bovis AF2122/97
uugcgcagcagcg

SEQ ID NO: 1126087 - RNA, 13 nt, Mycobacterium bovis subsp bovis AF2122/97
uugcgcagccgca

SEQ ID NO: 1126088 - RNA, 23 nt, Mycobacterium bovis subsp bovis AF2122/97
uugcgcgcgcagaucguccaccg

SEQ ID NO: 1126089 - RNA, 21 nt, Mycobacterium bovis subsp bovis AF2122/97
uugcgcaaauaggacugcgcc

SEQ ID NO: 1126090 - RNA, 13 nt, Mycobacterium bovis subsp bovis AF2122/97
uugcgcugcggcc

SEQ ID NO: 1126091 - RNA, 21 nt, Mycobacterium bovis subsp bovis AF2122/97
uugcggcccgggaggcguugc

SEQ ID NO: 1126092 - RNA, 13 nt, Mycobacterium bovis subsp bovis AF2122/97
uugcggaucgagc

SEQ ID NO: 1126093 - RNA, 16 nt, Mycobacterium bovis subsp bovis AF2122/97
uugauccagugcugga

SEQ ID NO: 1126094 - RNA, 19 nt, Mycobacterium bovis subsp bovis AF2122/97
uugaucaagaaggccagcg

SEQ ID NO: 1126095 - RNA, 21 nt, Mycobacterium bovis subsp bovis AF2122/97
uugaucaaggugucgacggug

SEQ ID NO: 1126096 - RNA, 18 nt, Mycobacterium bovis subsp bovis AF2122/97
uugaucuccacggcggug

SEQ ID NO: 1126097 - RNA, 14 nt, Mycobacterium bovis subsp bovis AF2122/97
uugccugccgcgca

SEQ ID NO: 1126098 - RNA, 20 nt, Mycobacterium bovis subsp bovis AF2122/97
uugaucgcgcugaaggccgg

SEQ ID NO: 1126099 - RNA, 19 nt, Mycobacterium bovis subsp bovis AF2122/97
uuggccggcuugucgacca

SEQ ID NO: 1126100 - RNA, 21 nt, Mycobacterium bovis subsp bovis AF2122/97
uuggccggaucgaagaccagc

SEQ ID NO: 1126101 - RNA, 15 nt, Mycobacterium bovis subsp bovis AF2122/97
uuggccggccccgcc

SEQ ID NO: 1126102 - RNA, 13 nt, Mycobacterium bovis subsp bovis AF2122/97
uuggcggcgcgca

SEQ ID NO: 1126103 - RNA, 23 nt, Mycobacterium bovis subsp bovis AF2122/97
uuggcggcggcauagugcgacug

SEQ ID NO: 1126104 - RNA, 13 nt, Mycobacterium bovis subsp bovis AF2122/97
uuggccgcgccgg

SEQ ID NO: 1126105 - RNA, 12 nt, Mycobacterium bovis subsp bovis AF2122/97
uuggccgccgug

SEQ ID NO: 1126106 - RNA, 13 nt, Mycobacterium bovis subsp bovis AF2122/97
uuggccgcgaccg

SEQ ID NO: 1126107 - RNA, 19 nt, Mycobacterium bovis subsp bovis AF2122/97
uuggccgccacucgcccgc

SEQ ID NO: 1126108 - RNA, 20 nt, Mycobacterium bovis subsp bovis AF2122/97
uuggccgacagccaccgcga

SEQ ID NO: 1126109 - RNA, 17 nt, Mycobacterium bovis subsp bovis AF2122/97
uuggccagucccucgcc

SEQ ID NO: 1126110 - RNA, 20 nt, Mycobacterium bovis subsp bovis AF2122/97
uuggccagugacucaccgug

SEQ ID NO: 1126111 - RNA, 21 nt, Mycobacterium bovis subsp bovis AF2122/97
uuggaugaagucgucggcacc

SEQ ID NO: 1126112 - RNA, 17 nt, Mycobacterium bovis subsp bovis AF2122/97
uuggaucacccgccgcg

SEQ ID NO: 1126113 - RNA, 21 nt, Mycobacterium bovis subsp bovis AF2122/97
uuggaagucccgccguugccg

SEQ ID NO: 1126114 - RNA, 14 nt, Mycobacterium bovis subsp bovis AF2122/97
uuggaaggcgcgcg

SEQ ID NO: 1126115 - RNA, 20 nt, Mycobacterium bovis subsp bovis AF2122/97
uuggacacucccgggugcga

SEQ ID NO: 1126116 - RNA, 12 nt, Mycobacterium bovis subsp bovis AF2122/97
uuggacagcagc

SEQ ID NO: 1126117 - RNA, 23 nt, Mycobacterium bovis subsp bovis AF2122/97
uuggaacuuguugacgaacccac

SEQ ID NO: 1126118 - RNA, 18 nt, Mycobacterium bovis subsp bovis AF2122/97
uuggcguaguuccgcacc

SEQ ID NO: 1126119 - RNA, 19 nt, Mycobacterium bovis subsp bovis AF2122/97
uuggcguaguuccgcaccg

SEQ ID NO: 1126120 - RNA, 15 nt, Mycobacterium bovis subsp bovis AF2122/97
uuggcgugcaccgca

SEQ ID NO: 1126121 - RNA, 16 nt, Mycobacterium bovis subsp bovis AF2122/97
uuggcgggaccgugac

SEQ ID NO: 1126122 - RNA, 20 nt, Mycobacterium bovis subsp bovis AF2122/97
uuggcugccggcaacagcuc

SEQ ID NO: 1126123 - RNA, 20 nt, Mycobacterium bovis subsp bovis AF2122/97
uuggcugcgagagcaccgac

SEQ ID NO: 1126124 - RNA, 15 nt, Mycobacterium bovis subsp bovis AF2122/97
uuggcuaacaccgca

SEQ ID NO: 1126125 - RNA, 15 nt, Mycobacterium bovis subsp bovis AF2122/97
uuggcugggcccgcc

SEQ ID NO: 1126126 - RNA, 20 nt, Mycobacterium bovis subsp bovis AF2122/97
aauccgugccgaaaaucgca

SEQ ID NO: 1126127 - RNA, 15 nt, Mycobacterium bovis subsp bovis AF2122/97
uugggcaccacccga

SEQ ID NO: 1126128 - RNA, 22 nt, Mycobacterium bovis subsp bovis AF2122/97
uugggccgacugggcgcgaccc

SEQ ID NO: 1126129 - RNA, 17 nt, Mycobacterium bovis subsp bovis AF2122/97
uugggcgacgcggcgcc

SEQ ID NO: 1126130 - RNA, 20 nt, Mycobacterium bovis subsp bovis AF2122/97
uugggcgauucugcgucugc

SEQ ID NO: 1126131 - RNA, 13 nt, Mycobacterium bovis subsp bovis AF2122/97
uugggcgccgacc

SEQ ID NO: 1126132 - RNA, 13 nt, Mycobacterium bovis subsp bovis AF2122/97
uugggcgccggug

SEQ ID NO: 1126133 - RNA, 19 nt, Mycobacterium bovis subsp bovis AF2122/97
uugggcgauuuugcgucuc

SEQ ID NO: 1126134 - RNA, 20 nt, Mycobacterium bovis subsp bovis AF2122/97
uugggcgauuuugcgucugc

SEQ ID NO: 1126135 - RNA, 17 nt, Mycobacterium bovis subsp bovis AF2122/97
aauccugccgcacgggc

SEQ ID NO: 1126136 - RNA, 18 nt, Mycobacterium bovis subsp bovis AF2122/97
aauccugccgcacgggcc

SEQ ID NO: 1126137 - RNA, 14 nt, Mycobacterium bovis subsp bovis AF2122/97
uuguaggagaacgu

SEQ ID NO: 1126138 - RNA, 12 nt, Mycobacterium bovis subsp bovis AF2122/97
uuguuggccagu

SEQ ID NO: 1126139 - RNA, 21 nt, Mycobacterium bovis subsp bovis AF2122/97
uuguugaggaugacgacggug

SEQ ID NO: 1126140 - RNA, 14 nt, Mycobacterium bovis subsp bovis AF2122/97
uuguugccgccggc

SEQ ID NO: 1126141 - RNA, 14 nt, Mycobacterium bovis subsp bovis AF2122/97
uuguucgugccggc

SEQ ID NO: 1126142 - RNA, 19 nt, Mycobacterium bovis subsp bovis AF2122/97
uuuagccgcuugggccugg

SEQ ID NO: 1126143 - RNA, 19 nt, Mycobacterium bovis subsp bovis AF2122/97
uuucgaagaacguucacgc

SEQ ID NO: 1126144 - RNA, 14 nt, Mycobacterium bovis subsp bovis AF2122/97
uuucauucagugcc

SEQ ID NO: 1126145 - RNA, 23 nt, Mycobacterium bovis subsp bovis AF2122/97
uuuugcgucugcucgcgccggug

SEQ ID NO: 1126146 - RNA, 20 nt, Mycobacterium bovis subsp bovis AF2122/97
uuuugcgucugcucggcgca

SEQ ID NO: 1126147 - RNA, 22 nt, Mycobacterium bovis subsp bovis AF2122/97
uuuuccggcauugccgccguug

SEQ ID NO: 1126148 - RNA, 18 nt, Mycobacterium bovis subsp bovis AF2122/97
uuucgucggccauggugu

SEQ ID NO: 1126149 - RNA, 15 nt, Mycobacterium bovis subsp bovis AF2122/97
aaugccaccgcggcc

SEQ ID NO: 1126150 - RNA, 22 nt, Mycobacterium bovis subsp bovis AF2122/97
aaugcccagguguguggcggcg

SEQ ID NO: 1126151 - RNA, 14 nt, Mycobacterium bovis subsp bovis AF2122/97
aaugcaucgcggcg

SEQ ID NO: 1126152 - RNA, 18 nt, Mycobacterium bovis subsp bovis AF2122/97
aaugcaucgcggcggcgc

SEQ ID NO: 1126153 - RNA, 20 nt, Mycobacterium bovis subsp bovis AF2122/97
aaugcaagaccguuacacca

SEQ ID NO: 1126154 - RNA, 17 nt, Mycobacterium bovis subsp bovis AF2122/97
aaugauucggcacgccg

SEQ ID NO: 1126155 - RNA, 17 nt, Mycobacterium bovis subsp bovis AF2122/97
aaucucgguggugcgcu

SEQ ID NO: 1126156 - RNA, 13 nt, Mycobacterium bovis subsp bovis AF2122/97
aaucucgccgggc

SEQ ID NO: 1126157 - RNA, 15 nt, Mycobacterium bovis subsp bovis AF2122/97
aaucucgccgggcug

SEQ ID NO: 1126158 - RNA, 19 nt, Mycobacterium bovis subsp bovis AF2122/97
aaucgccgucagcaccgcu

SEQ ID NO: 1126159 - RNA, 19 nt, Mycobacterium bovis subsp bovis AF2122/97
aaucgcccucgucgcgggc

SEQ ID NO: 1126160 - RNA, 14 nt, Mycobacterium bovis subsp bovis AF2122/97
aaucgcccucgucg

SEQ ID NO: 1126161 - RNA, 21 nt, Mycobacterium bovis subsp bovis AF2122/97
uuuugggaucgugccggcgaa

SEQ ID NO: 1126162 - RNA, 21 nt, Mycobacterium bovis subsp bovis AF2122/97
aauuccggugaucgcgguggc

SEQ ID NO: 1126163 - RNA, 21 nt, Mycobacterium bovis subsp bovis AF2122/97
aauucgaccgcgcggaucuca

SEQ ID NO: 1126164 - RNA, 13 nt, Mycobacterium bovis subsp bovis AF2122/97
aauuccagccccc

SEQ ID NO: 1126165 - RNA, 16 nt, Mycobacterium bovis subsp bovis AF2122/97
aauucaacagcaccgc

SEQ ID NO: 1126166 - RNA, 22 nt, Mycobacterium bovis subsp bovis AF2122/97
aaugcguugacgucgagcagcg

SEQ ID NO: 1126167 - RNA, 12 nt, Mycobacterium bovis subsp bovis AF2122/97
aaugccgguggu

SEQ ID NO: 1126168 - RNA, 12 nt, Mycobacterium bovis subsp bovis AF2122/97
aaugccgccgac

SEQ ID NO: 1126169 - RNA, 20 nt, Mycobacterium bovis subsp bovis AF2122/97
aaugccgcgugggcaugcgg

SEQ ID NO: 1126170 - RNA, 16 nt, Mycobacterium bovis subsp bovis AF2122/97
aaugccgcucucggcg

SEQ ID NO: 1126171 - RNA, 17 nt, Mycobacterium bovis subsp bovis AF2122/97
aaugcuggggccugguc

SEQ ID NO: 1126172 - RNA, 22 nt, Mycobacterium bovis subsp bovis AF2122/97
aaugcuucgcgucgacccgaac

SEQ ID NO: 1126173 - RNA, 15 nt, Mycobacterium bovis subsp bovis AF2122/97
aauugcgccgccaac

SEQ ID NO: 1126174 - RNA, 14 nt, Mycobacterium bovis subsp bovis AF2122/97
aauugcccggcacg

SEQ ID NO: 1126175 - RNA, 17 nt, Mycobacterium bovis subsp bovis AF2122/97
aauugcccuagcagcaa

SEQ ID NO: 1126176 - RNA, 17 nt, Mycobacterium bovis subsp bovis AF2122/97
aauuggccguuggcggc

SEQ ID NO: 1126177 - RNA, 19 nt, Mycobacterium bovis subsp bovis AF2122/97
aauugccaagcgcgcgaac

SEQ ID NO: 1126178 - RNA, 14 nt, Mycobacterium bovis subsp bovis AF2122/97
aauucggcgagcgc

SEQ ID NO: 1126179 - RNA, 15 nt, Mycobacterium bovis subsp bovis AF2122/97
aauucggcgucgugg

SEQ ID NO: 1126180 - RNA, 21 nt, Mycobacterium bovis subsp bovis AF2122/97
aauucggugcgcuggcggcgc

SEQ ID NO: 1126181 - RNA, 21 nt, Mycobacterium bovis subsp bovis AF2122/97
aauugggcgauuuugcgucug

SEQ ID NO: 1126182 - RNA, 17 nt, Mycobacterium bovis subsp bovis AF2122/97
aauuucacugcgagcgc

SEQ ID NO: 1126183 - RNA, 17 nt, Mycobacterium bovis subsp bovis AF2122/97
uggcgacgaacgccguc

SEQ ID NO: 1126184 - RNA, 13 nt, Mycobacterium bovis subsp bovis AF2122/97
uggcgagcagacg

SEQ ID NO: 1126185 - RNA, 17 nt, Mycobacterium bovis subsp bovis AF2122/97
uggcgacgaggcgacgu

SEQ ID NO: 1126186 - RNA, 14 nt, Mycobacterium bovis subsp bovis AF2122/97
uggcgacggugcgc

SEQ ID NO: 1126187 - RNA, 14 nt, Mycobacterium bovis subsp bovis AF2122/97
uggcgcccccgcca

SEQ ID NO: 1126188 - RNA, 19 nt, Mycobacterium bovis subsp bovis AF2122/97
uggcgcccccgacgacggc

SEQ ID NO: 1126189 - RNA, 14 nt, Mycobacterium bovis subsp bovis AF2122/97
uggcgccaccggcg

SEQ ID NO: 1126190 - RNA, 20 nt, Mycobacterium bovis subsp bovis AF2122/97
uggcgccacggcagcgccca

SEQ ID NO: 1126191 - RNA, 19 nt, Mycobacterium bovis subsp bovis AF2122/97
uggcgcccauggccaccag

SEQ ID NO: 1126192 - RNA, 15 nt, Mycobacterium bovis subsp bovis AF2122/97
uggcgccauccccgc

SEQ ID NO: 1126193 - RNA, 23 nt, Mycobacterium bovis subsp bovis AF2122/97
uggcgccauccccgccggcgcca

SEQ ID NO: 1126194 - RNA, 17 nt, Mycobacterium bovis subsp bovis AF2122/97
uggcggaucgcgagcgc

SEQ ID NO: 1126195 - RNA, 14 nt, Mycobacterium bovis subsp bovis AF2122/97
uggcggacggcguc

SEQ ID NO: 1126196 - RNA, 20 nt, Mycobacterium bovis subsp bovis AF2122/97
uggcgcgccugugccaccgc

SEQ ID NO: 1126197 - RNA, 15 nt, Mycobacterium bovis subsp bovis AF2122/97
uggcggacagggcgg

SEQ ID NO: 1126198 - RNA, 16 nt, Mycobacterium bovis subsp bovis AF2122/97
uggcggacagggcggc

SEQ ID NO: 1126199 - RNA, 22 nt, Mycobacterium bovis subsp bovis AF2122/97
uggcggacagggcggcaacggc

SEQ ID NO: 1126200 - RNA, 19 nt, Mycobacterium bovis subsp bovis AF2122/97
uggcgcuuugggcugccgu

SEQ ID NO: 1126201 - RNA, 13 nt, Mycobacterium bovis subsp bovis AF2122/97
uggcggccagcgc

SEQ ID NO: 1126202 - RNA, 18 nt, Mycobacterium bovis subsp bovis AF2122/97
uggcggccagccgcucca

SEQ ID NO: 1126203 - RNA, 20 nt, Mycobacterium bovis subsp bovis AF2122/97
uggcggccaccgucagcgcg

SEQ ID NO: 1126204 - RNA, 21 nt, Mycobacterium bovis subsp bovis AF2122/97
uggcggccacaacagggugac

SEQ ID NO: 1126205 - RNA, 13 nt, Mycobacterium bovis subsp bovis AF2122/97
uggcggccaccag

SEQ ID NO: 1126206 - RNA, 16 nt, Mycobacterium bovis subsp bovis AF2122/97
uggcggccaccagcgc

SEQ ID NO: 1126207 - RNA, 17 nt, Mycobacterium bovis subsp bovis AF2122/97
uggcggcaggugcggcg

SEQ ID NO: 1126208 - RNA, 19 nt, Mycobacterium bovis subsp bovis AF2122/97
uggcggcaggugcggcggc

SEQ ID NO: 1126209 - RNA, 23 nt, Mycobacterium bovis subsp bovis AF2122/97
uggcggcagcgguuuuaggcagc

SEQ ID NO: 1126210 - RNA, 12 nt, Mycobacterium bovis subsp bovis AF2122/97
uggcggcaggug

SEQ ID NO: 1126211 - RNA, 14 nt, Mycobacterium bovis subsp bovis AF2122/97
uggcggcagcagcg

SEQ ID NO: 1126212 - RNA, 19 nt, Mycobacterium bovis subsp bovis AF2122/97
uggcggaugcccgcaacgc

SEQ ID NO: 1126213 - RNA, 18 nt, Mycobacterium bovis subsp bovis AF2122/97
uggcggcaaggguggggc

SEQ ID NO: 1126214 - RNA, 12 nt, Mycobacterium bovis subsp bovis AF2122/97
uggcgccggcca

SEQ ID NO: 1126215 - RNA, 20 nt, Mycobacterium bovis subsp bovis AF2122/97
uggcgccgccggcaccgccg

SEQ ID NO: 1126216 - RNA, 13 nt, Mycobacterium bovis subsp bovis AF2122/97
uggcgccggccgg

SEQ ID NO: 1126217 - RNA, 15 nt, Mycobacterium bovis subsp bovis AF2122/97
uggcgccggccggca

SEQ ID NO: 1126218 - RNA, 13 nt, Mycobacterium bovis subsp bovis AF2122/97
uggcgcgcaaccg

SEQ ID NO: 1126219 - RNA, 21 nt, Mycobacterium bovis subsp bovis AF2122/97
uggcgcgcagguagucgacga

SEQ ID NO: 1126220 - RNA, 23 nt, Mycobacterium bovis subsp bovis AF2122/97
uggcgcgcccacagcccgggcgg

SEQ ID NO: 1126221 - RNA, 20 nt, Mycobacterium bovis subsp bovis AF2122/97
uggcgcgcccacagcccggg

SEQ ID NO: 1126222 - RNA, 21 nt, Mycobacterium bovis subsp bovis AF2122/97
uggcgcgccgcaucggcgaac

SEQ ID NO: 1126223 - RNA, 17 nt, Mycobacterium bovis subsp bovis AF2122/97
uggcgcgcgcaacgcug

SEQ ID NO: 1126224 - RNA, 16 nt, Mycobacterium bovis subsp bovis AF2122/97
uggcgcggcacccggu

SEQ ID NO: 1126225 - RNA, 15 nt, Mycobacterium bovis subsp bovis AF2122/97
uggcgcgcggggugg

SEQ ID NO: 1126226 - RNA, 19 nt, Mycobacterium bovis subsp bovis AF2122/97
uggcgcgcggcgccgcaau

SEQ ID NO: 1126227 - RNA, 13 nt, Mycobacterium bovis subsp bovis AF2122/97
uggccugguuguc

SEQ ID NO: 1126228 - RNA, 18 nt, Mycobacterium bovis subsp bovis AF2122/97
uggcgaaccgucagcgcg

SEQ ID NO: 1126229 - RNA, 15 nt, Mycobacterium bovis subsp bovis AF2122/97
uggcgaccagccgag

SEQ ID NO: 1126230 - RNA, 18 nt, Mycobacterium bovis subsp bovis AF2122/97
uggccguuucggcgccgu

SEQ ID NO: 1126231 - RNA, 22 nt, Mycobacterium bovis subsp bovis AF2122/97
uggccuaggacaccggcaccac

SEQ ID NO: 1126232 - RNA, 20 nt, Mycobacterium bovis subsp bovis AF2122/97
uggccucacccggucaacgu

SEQ ID NO: 1126233 - RNA, 13 nt, Mycobacterium bovis subsp bovis AF2122/97
uggccucagccac

SEQ ID NO: 1126234 - RNA, 15 nt, Mycobacterium bovis subsp bovis AF2122/97
uggccucagcccggc

SEQ ID NO: 1126235 - RNA, 15 nt, Mycobacterium bovis subsp bovis AF2122/97
uggccucauccaccg

SEQ ID NO: 1126236 - RNA, 19 nt, Mycobacterium bovis subsp bovis AF2122/97
uggccucgccauugaggaa

SEQ ID NO: 1126237 - RNA, 17 nt, Mycobacterium bovis subsp bovis AF2122/97
uggccucgaacgccgcc

SEQ ID NO: 1126238 - RNA, 13 nt, Mycobacterium bovis subsp bovis AF2122/97
uggccucgaaggg

SEQ ID NO: 1126239 - RNA, 21 nt, Mycobacterium bovis subsp bovis AF2122/97
uggccugcccagcaccaccgc

SEQ ID NO: 1126240 - RNA, 14 nt, Mycobacterium bovis subsp bovis AF2122/97
uggccugcagcgcg

SEQ ID NO: 1126241 - RNA, 19 nt, Mycobacterium bovis subsp bovis AF2122/97
uggccucguccagcucggu

SEQ ID NO: 1126242 - RNA, 17 nt, Mycobacterium bovis subsp bovis AF2122/97
uggccggaauacccgcu

SEQ ID NO: 1126243 - RNA, 21 nt, Mycobacterium bovis subsp bovis AF2122/97
uggccggacccauuggaccga

SEQ ID NO: 1126244 - RNA, 21 nt, Mycobacterium bovis subsp bovis AF2122/97
uggccgcugucguaccgcucg

SEQ ID NO: 1126245 - RNA, 20 nt, Mycobacterium bovis subsp bovis AF2122/97
uggccggaucgaagaccagc

SEQ ID NO: 1126246 - RNA, 19 nt, Mycobacterium bovis subsp bovis AF2122/97
uggccggcaacggcgcgcc

SEQ ID NO: 1126247 - RNA, 23 nt, Mycobacterium bovis subsp bovis AF2122/97
uggccggccagccauggcagcgc

SEQ ID NO: 1126248 - RNA, 15 nt, Mycobacterium bovis subsp bovis AF2122/97
uggccggccaucgcc

SEQ ID NO: 1126249 - RNA, 15 nt, Mycobacterium bovis subsp bovis AF2122/97
uggccggccccgccc

SEQ ID NO: 1126250 - RNA, 14 nt, Mycobacterium bovis subsp bovis AF2122/97
uggccggcgguguu

SEQ ID NO: 1126251 - RNA, 18 nt, Mycobacterium bovis subsp bovis AF2122/97
uggccguguagauggggu

SEQ ID NO: 1126252 - RNA, 21 nt, Mycobacterium bovis subsp bovis AF2122/97
uggcaggccagcaugucgggc

SEQ ID NO: 1126253 - RNA, 15 nt, Mycobacterium bovis subsp bovis AF2122/97
uggcaguggcgcggc

SEQ ID NO: 1126254 - RNA, 15 nt, Mycobacterium bovis subsp bovis AF2122/97
uggcagugcaggcgg

SEQ ID NO: 1126255 - RNA, 15 nt, Mycobacterium bovis subsp bovis AF2122/97
uggcaguccagccgg

SEQ ID NO: 1126256 - RNA, 17 nt, Mycobacterium bovis subsp bovis AF2122/97
uggcaguccagccgggu

SEQ ID NO: 1126257 - RNA, 21 nt, Mycobacterium bovis subsp bovis AF2122/97
uggcagugaaauugccgccgc

SEQ ID NO: 1126258 - RNA, 19 nt, Mycobacterium bovis subsp bovis AF2122/97
uggcauccaaaaucgccug

SEQ ID NO: 1126259 - RNA, 16 nt, Mycobacterium bovis subsp bovis AF2122/97
uggcauccaaaaucgc

SEQ ID NO: 1126260 - RNA, 17 nt, Mycobacterium bovis subsp bovis AF2122/97
uggcaucgaacgcccug

SEQ ID NO: 1126261 - RNA, 13 nt, Mycobacterium bovis subsp bovis AF2122/97
uggcaugcggauc

SEQ ID NO: 1126262 - RNA, 21 nt, Mycobacterium bovis subsp bovis AF2122/97
uggcaugcggaucggcggacc

SEQ ID NO: 1126263 - RNA, 16 nt, Mycobacterium bovis subsp bovis AF2122/97
uggcauggucaggcgg

SEQ ID NO: 1126264 - RNA, 24 nt, Mycobacterium bovis subsp bovis AF2122/97
uggcucaccagcuccucgugcucg

SEQ ID NO: 1126265 - RNA, 19 nt, Mycobacterium bovis subsp bovis AF2122/97
uggcucacccaggcgccga

SEQ ID NO: 1126266 - RNA, 13 nt, Mycobacterium bovis subsp bovis AF2122/97
uggcucacgcucc

SEQ ID NO: 1126267 - RNA, 18 nt, Mycobacterium bovis subsp bovis AF2122/97
uggcuccgaaguccacgc

SEQ ID NO: 1126268 - RNA, 19 nt, Mycobacterium bovis subsp bovis AF2122/97
uggcuccgaaguccacgca

SEQ ID NO: 1126269 - RNA, 14 nt, Mycobacterium bovis subsp bovis AF2122/97
uggcucgagccgcc

SEQ ID NO: 1126270 - RNA, 17 nt, Mycobacterium bovis subsp bovis AF2122/97
uggcucgagccgcccgu

SEQ ID NO: 1126271 - RNA, 22 nt, Mycobacterium bovis subsp bovis AF2122/97
uggcucgccgaaaagggcgaca

SEQ ID NO: 1126272 - RNA, 22 nt, Mycobacterium bovis subsp bovis AF2122/97
uggcucgcggaugcucguuguu

SEQ ID NO: 1126273 - RNA, 16 nt, Mycobacterium bovis subsp bovis AF2122/97
uggcucgcucugcgcg

SEQ ID NO: 1126274 - RNA, 22 nt, Mycobacterium bovis subsp bovis AF2122/97
uggcugaacaccgcgggcagua

SEQ ID NO: 1126275 - RNA, 15 nt, Mycobacterium bovis subsp bovis AF2122/97
uggcguucagcggcc

SEQ ID NO: 1126276 - RNA, 20 nt, Mycobacterium bovis subsp bovis AF2122/97
uggcguucagcggccagcag

SEQ ID NO: 1126277 - RNA, 17 nt, Mycobacterium bovis subsp bovis AF2122/97
uggcguugccaccggag

SEQ ID NO: 1126278 - RNA, 14 nt, Mycobacterium bovis subsp bovis AF2122/97
uggcguugaccagc

SEQ ID NO: 1126279 - RNA, 13 nt, Mycobacterium bovis subsp bovis AF2122/97
uggcguugaggac

SEQ ID NO: 1126280 - RNA, 14 nt, Mycobacterium bovis subsp bovis AF2122/97
uggcguugaugucg

SEQ ID NO: 1126281 - RNA, 21 nt, Mycobacterium bovis subsp bovis AF2122/97
uggcguucugcgcccguccgc

SEQ ID NO: 1126282 - RNA, 23 nt, Mycobacterium bovis subsp bovis AF2122/97
uggcguucugcgcccguccgcgc

SEQ ID NO: 1126283 - RNA, 15 nt, Mycobacterium bovis subsp bovis AF2122/97
uggcguucggugagg

SEQ ID NO: 1126284 - RNA, 22 nt, Mycobacterium bovis subsp bovis AF2122/97
uggcguugggcgggauggccgc

SEQ ID NO: 1126285 - RNA, 17 nt, Mycobacterium bovis subsp bovis AF2122/97
uggcguugguggucggc

SEQ ID NO: 1126286 - RNA, 16 nt, Mycobacterium bovis subsp bovis AF2122/97
uggcguugguggucug

SEQ ID NO: 1126287 - RNA, 17 nt, Mycobacterium bovis subsp bovis AF2122/97
uggcguugguggucugc

SEQ ID NO: 1126288 - RNA, 17 nt, Mycobacterium bovis subsp bovis AF2122/97
uggcguuugccggccga

SEQ ID NO: 1126289 - RNA, 22 nt, Mycobacterium bovis subsp bovis AF2122/97
uggcuaccuuggacucggcggg

SEQ ID NO: 1126290 - RNA, 20 nt, Mycobacterium bovis subsp bovis AF2122/97
uggcuacgggccgcgguacc

SEQ ID NO: 1126291 - RNA, 16 nt, Mycobacterium bovis subsp bovis AF2122/97
uggcgugucgccgcca

SEQ ID NO: 1126292 - RNA, 13 nt, Mycobacterium bovis subsp bovis AF2122/97
uggcguguggcuu

SEQ ID NO: 1126293 - RNA, 23 nt, Mycobacterium bovis subsp bovis AF2122/97
uggcgugggcacuugcccgucgg

SEQ ID NO: 1126294 - RNA, 19 nt, Mycobacterium bovis subsp bovis AF2122/97
uggcguggcccucggcgau

SEQ ID NO: 1126295 - RNA, 14 nt, Mycobacterium bovis subsp bovis AF2122/97
uggcgugccgucgc

SEQ ID NO: 1126296 - RNA, 21 nt, Mycobacterium bovis subsp bovis AF2122/97
uggcguauagcaugccgcggc

SEQ ID NO: 1126297 - RNA, 19 nt, Mycobacterium bovis subsp bovis AF2122/97
uggcguauccuugcgacgu

SEQ ID NO: 1126298 - RNA, 22 nt, Mycobacterium bovis subsp bovis AF2122/97
uggcgucaagcacacuggccac

SEQ ID NO: 1126299 - RNA, 23 nt, Mycobacterium bovis subsp bovis AF2122/97
uggcguagggcuguccgaccucg

SEQ ID NO: 1126300 - RNA, 12 nt, Mycobacterium bovis subsp bovis AF2122/97
uggcgucgucgg

SEQ ID NO: 1126301 - RNA, 15 nt, Mycobacterium bovis subsp bovis AF2122/97
uggcggcccggguug

SEQ ID NO: 1126302 - RNA, 20 nt, Mycobacterium bovis subsp bovis AF2122/97
uggcggccgggucggugacg

SEQ ID NO: 1126303 - RNA, 14 nt, Mycobacterium bovis subsp bovis AF2122/97
uggcggcccggugg

SEQ ID NO: 1126304 - RNA, 19 nt, Mycobacterium bovis subsp bovis AF2122/97
uggcggccaguucggcggc

SEQ ID NO: 1126305 - RNA, 18 nt, Mycobacterium bovis subsp bovis AF2122/97
uggcgguggugccgcggc

SEQ ID NO: 1126306 - RNA, 19 nt, Mycobacterium bovis subsp bovis AF2122/97
uggcgguggugccgcggcc

SEQ ID NO: 1126307 - RNA, 14 nt, Mycobacterium bovis subsp bovis AF2122/97
uggcggccgcgacc

SEQ ID NO: 1126308 - RNA, 19 nt, Mycobacterium bovis subsp bovis AF2122/97
uggcggccuaacucgccug

SEQ ID NO: 1126309 - RNA, 14 nt, Mycobacterium bovis subsp bovis AF2122/97
uggcgguggccguc

SEQ ID NO: 1126310 - RNA, 20 nt, Mycobacterium bovis subsp bovis AF2122/97
uggcggugggcuuggcgccg

SEQ ID NO: 1126311 - RNA, 18 nt, Mycobacterium bovis subsp bovis AF2122/97
uggcguaggacucuucgg

SEQ ID NO: 1126312 - RNA, 22 nt, Mycobacterium bovis subsp bovis AF2122/97
uggcgguugcaaaccgcugcgc

SEQ ID NO: 1126313 - RNA, 13 nt, Mycobacterium bovis subsp bovis AF2122/97
ugggacggcggca

SEQ ID NO: 1126314 - RNA, 16 nt, Mycobacterium bovis subsp bovis AF2122/97
ugggagcccggcggcc

SEQ ID NO: 1126315 - RNA, 22 nt, Mycobacterium bovis subsp bovis AF2122/97
ugggagccaccggcgucgacgu

SEQ ID NO: 1126316 - RNA, 15 nt, Mycobacterium bovis subsp bovis AF2122/97
ugggagcuacgguac

SEQ ID NO: 1126317 - RNA, 20 nt, Mycobacterium bovis subsp bovis AF2122/97
ugggacaccaucuccgccgu

SEQ ID NO: 1126318 - RNA, 23 nt, Mycobacterium bovis subsp bovis AF2122/97
ugggacaacgugccgaacgccag

SEQ ID NO: 1126319 - RNA, 18 nt, Mycobacterium bovis subsp bovis AF2122/97
ugggaugugccgcgcacg

SEQ ID NO: 1126320 - RNA, 15 nt, Mycobacterium bovis subsp bovis AF2122/97
ugggaucgugccggc

SEQ ID NO: 1126321 - RNA, 20 nt, Mycobacterium bovis subsp bovis AF2122/97
ugggcaaacugggcaccggc

SEQ ID NO: 1126322 - RNA, 21 nt, Mycobacterium bovis subsp bovis AF2122/97
ugggcaaacugggcaccggcg

SEQ ID NO: 1126323 - RNA, 20 nt, Mycobacterium bovis subsp bovis AF2122/97
ugggauucugacgaccggcu

SEQ ID NO: 1126324 - RNA, 15 nt, Mycobacterium bovis subsp bovis AF2122/97
ugggauucugggcga

SEQ ID NO: 1126325 - RNA, 15 nt, Mycobacterium bovis subsp bovis AF2122/97
ugggauccggcggca

SEQ ID NO: 1126326 - RNA, 13 nt, Mycobacterium bovis subsp bovis AF2122/97
ugggagucgucgu

SEQ ID NO: 1126327 - RNA, 14 nt, Mycobacterium bovis subsp bovis AF2122/97
ugggacugcggaca

SEQ ID NO: 1126328 - RNA, 14 nt, Mycobacterium bovis subsp bovis AF2122/97
ugggauacucgucg

SEQ ID NO: 1126329 - RNA, 23 nt, Mycobacterium bovis subsp bovis AF2122/97
ugggcaggaucgaggcgucggca

SEQ ID NO: 1126330 - RNA, 16 nt, Mycobacterium bovis subsp bovis AF2122/97
ugggcaucaccgccgc

SEQ ID NO: 1126331 - RNA, 22 nt, Mycobacterium bovis subsp bovis AF2122/97
ugggcaucacuucauggggcua

SEQ ID NO: 1126332 - RNA, 18 nt, Mycobacterium bovis subsp bovis AF2122/97
ugggcaucaucgacgcgc

SEQ ID NO: 1126333 - RNA, 19 nt, Mycobacterium bovis subsp bovis AF2122/97
ugggcaucaucgacgcgcg

SEQ ID NO: 1126334 - RNA, 12 nt, Mycobacterium bovis subsp bovis AF2122/97
ugggcaucaccg

SEQ ID NO: 1126335 - RNA, 22 nt, Mycobacterium bovis subsp bovis AF2122/97
ugggcagauauugccugccacc

SEQ ID NO: 1126336 - RNA, 15 nt, Mycobacterium bovis subsp bovis AF2122/97
ugggcagcagcgcgc

SEQ ID NO: 1126337 - RNA, 17 nt, Mycobacterium bovis subsp bovis AF2122/97
ugggcaccggcggucug

SEQ ID NO: 1126338 - RNA, 19 nt, Mycobacterium bovis subsp bovis AF2122/97
ugggcaagcugaccgccag

SEQ ID NO: 1126339 - RNA, 15 nt, Mycobacterium bovis subsp bovis AF2122/97
uggcuggcggcgacc

SEQ ID NO: 1126340 - RNA, 15 nt, Mycobacterium bovis subsp bovis AF2122/97
uggcuggccgccacc

SEQ ID NO: 1126341 - RNA, 20 nt, Mycobacterium bovis subsp bovis AF2122/97
uggcugugauguuguucagc

SEQ ID NO: 1126342 - RNA, 18 nt, Mycobacterium bovis subsp bovis AF2122/97
uggcugguuucggggacc

SEQ ID NO: 1126343 - RNA, 20 nt, Mycobacterium bovis subsp bovis AF2122/97
uggcuguaaaaaugcuucgc

SEQ ID NO: 1126344 - RNA, 18 nt, Mycobacterium bovis subsp bovis AF2122/97
uggcuguacccgaccagc

SEQ ID NO: 1126345 - RNA, 16 nt, Mycobacterium bovis subsp bovis AF2122/97
uggcugaucaccguug

SEQ ID NO: 1126346 - RNA, 15 nt, Mycobacterium bovis subsp bovis AF2122/97
uggcugcacuggccc

SEQ ID NO: 1126347 - RNA, 12 nt, Mycobacterium bovis subsp bovis AF2122/97
uggcugagcagc

SEQ ID NO: 1126348 - RNA, 16 nt, Mycobacterium bovis subsp bovis AF2122/97
uggcugagcagcgcgg

SEQ ID NO: 1126349 - RNA, 21 nt, Mycobacterium bovis subsp bovis AF2122/97
uggcugagcagcgcggccaga

SEQ ID NO: 1126350 - RNA, 19 nt, Mycobacterium bovis subsp bovis AF2122/97
uggcugagcccgccgcgac

SEQ ID NO: 1126351 - RNA, 15 nt, Mycobacterium bovis subsp bovis AF2122/97
uggcugccacgaacg

SEQ ID NO: 1126352 - RNA, 20 nt, Mycobacterium bovis subsp bovis AF2122/97
uggcugccuucggcgagcgg

SEQ ID NO: 1126353 - RNA, 16 nt, Mycobacterium bovis subsp bovis AF2122/97
uggcuggcaugccggc

SEQ ID NO: 1126354 - RNA, 16 nt, Mycobacterium bovis subsp bovis AF2122/97
uggcuuuugcgccgaa

SEQ ID NO: 1126355 - RNA, 19 nt, Mycobacterium bovis subsp bovis AF2122/97
uggcuuuugcgucugcucg

SEQ ID NO: 1126356 - RNA, 14 nt, Mycobacterium bovis subsp bovis AF2122/97
uggcuucaacccgg

SEQ ID NO: 1126357 - RNA, 20 nt, Mycobacterium bovis subsp bovis AF2122/97
uggcuucaacccgggcagca

SEQ ID NO: 1126358 - RNA, 22 nt, Mycobacterium bovis subsp bovis AF2122/97
uggcuucacccaaccccgccgg

SEQ ID NO: 1126359 - RNA, 17 nt, Mycobacterium bovis subsp bovis AF2122/97
uggcuucgaagcgaucg

SEQ ID NO: 1126360 - RNA, 18 nt, Mycobacterium bovis subsp bovis AF2122/97
uggcuucgaagcgaucgc

SEQ ID NO: 1126361 - RNA, 19 nt, Mycobacterium bovis subsp bovis AF2122/97
uggcuucuagcccguuguc

SEQ ID NO: 1126362 - RNA, 15 nt, Mycobacterium bovis subsp bovis AF2122/97
uggucgaccgccgag

SEQ ID NO: 1126363 - RNA, 22 nt, Mycobacterium bovis subsp bovis AF2122/97
uggucgacgccgagaccgccgc

SEQ ID NO: 1126364 - RNA, 20 nt, Mycobacterium bovis subsp bovis AF2122/97
uggucgagcacgcugcugcg

SEQ ID NO: 1126365 - RNA, 21 nt, Mycobacterium bovis subsp bovis AF2122/97
uggucgagcacgcugcugcgg

SEQ ID NO: 1126366 - RNA, 14 nt, Mycobacterium bovis subsp bovis AF2122/97
uggucgagcaggcg

SEQ ID NO: 1126367 - RNA, 22 nt, Mycobacterium bovis subsp bovis AF2122/97
uggucgagucgaugaccccggu

SEQ ID NO: 1126368 - RNA, 23 nt, Mycobacterium bovis subsp bovis AF2122/97
uggucgaugaaccaaucgcacgc

SEQ ID NO: 1126369 - RNA, 19 nt, Mycobacterium bovis subsp bovis AF2122/97
uggucgauucgucgaaggg

SEQ ID NO: 1126370 - RNA, 19 nt, Mycobacterium bovis subsp bovis AF2122/97
uggucgauuucggcgcgug

SEQ ID NO: 1126371 - RNA, 16 nt, Mycobacterium bovis subsp bovis AF2122/97
uggucgccacccgaca

SEQ ID NO: 1126372 - RNA, 21 nt, Mycobacterium bovis subsp bovis AF2122/97
uggucgaauaguugaccaggc

SEQ ID NO: 1126373 - RNA, 22 nt, Mycobacterium bovis subsp bovis AF2122/97
ugguccggccgcggaccgcgaa

SEQ ID NO: 1126374 - RNA, 20 nt, Mycobacterium bovis subsp bovis AF2122/97
uggucaguccgacaccggcg

SEQ ID NO: 1126375 - RNA, 23 nt, Mycobacterium bovis subsp bovis AF2122/97
uggucaguccgacaccggcggca

SEQ ID NO: 1126376 - RNA, 21 nt, Mycobacterium bovis subsp bovis AF2122/97
uggucagcuagguauugccgc

SEQ ID NO: 1126377 - RNA, 16 nt, Mycobacterium bovis subsp bovis AF2122/97
uggucagcggcgcgag

SEQ ID NO: 1126378 - RNA, 17 nt, Mycobacterium bovis subsp bovis AF2122/97
uggucagccgcggcggc

SEQ ID NO: 1126379 - RNA, 19 nt, Mycobacterium bovis subsp bovis AF2122/97
uggucaccggacugcgccg

SEQ ID NO: 1126380 - RNA, 15 nt, Mycobacterium bovis subsp bovis AF2122/97
uggucaccgucugca

SEQ ID NO: 1126381 - RNA, 23 nt, Mycobacterium bovis subsp bovis AF2122/97
uggucacgguucgcccgucgcca

SEQ ID NO: 1126382 - RNA, 22 nt, Mycobacterium bovis subsp bovis AF2122/97
uggucacguucaguuccgcggc

SEQ ID NO: 1126383 - RNA, 15 nt, Mycobacterium bovis subsp bovis AF2122/97
ugguacagggugugc

SEQ ID NO: 1126384 - RNA, 17 nt, Mycobacterium bovis subsp bovis AF2122/97
ugguacuuucacgcucg

SEQ ID NO: 1126385 - RNA, 19 nt, Mycobacterium bovis subsp bovis AF2122/97
ugguagccauucggugugg

SEQ ID NO: 1126386 - RNA, 21 nt, Mycobacterium bovis subsp bovis AF2122/97
ugguagcccggaccgcccgug

SEQ ID NO: 1126387 - RNA, 13 nt, Mycobacterium bovis subsp bovis AF2122/97
ugguagccggccg

SEQ ID NO: 1126388 - RNA, 14 nt, Mycobacterium bovis subsp bovis AF2122/97
ugguacccgcgccg

SEQ ID NO: 1126389 - RNA, 13 nt, Mycobacterium bovis subsp bovis AF2122/97
ugguaccgcggug

SEQ ID NO: 1126390 - RNA, 22 nt, Mycobacterium bovis subsp bovis AF2122/97
ugguaccggcgccaccguggug

SEQ ID NO: 1126391 - RNA, 23 nt, Mycobacterium bovis subsp bovis AF2122/97
ugguacgugaauuaaggugacca

SEQ ID NO: 1126392 - RNA, 14 nt, Mycobacterium bovis subsp bovis AF2122/97
ugggccgcugauca

SEQ ID NO: 1126393 - RNA, 13 nt, Mycobacterium bovis subsp bovis AF2122/97
ugggccgcuggga

SEQ ID NO: 1126394 - RNA, 18 nt, Mycobacterium bovis subsp bovis AF2122/97
ugggccugcccggcgccg

SEQ ID NO: 1126395 - RNA, 15 nt, Mycobacterium bovis subsp bovis AF2122/97
ugggccucgaucagc

SEQ ID NO: 1126396 - RNA, 13 nt, Mycobacterium bovis subsp bovis AF2122/97
ugggccggcgccg

SEQ ID NO: 1126397 - RNA, 19 nt, Mycobacterium bovis subsp bovis AF2122/97
ugggccuccaccgcgucca

SEQ ID NO: 1126398 - RNA, 16 nt, Mycobacterium bovis subsp bovis AF2122/97
ugggccugggccgcac

SEQ ID NO: 1126399 - RNA, 17 nt, Mycobacterium bovis subsp bovis AF2122/97
ugggccugggccgcaca

SEQ ID NO: 1126400 - RNA, 15 nt, Mycobacterium bovis subsp bovis AF2122/97
uggguagcaaacccc

SEQ ID NO: 1126401 - RNA, 13 nt, Mycobacterium bovis subsp bovis AF2122/97
uggguagccagcg

SEQ ID NO: 1126402 - RNA, 14 nt, Mycobacterium bovis subsp bovis AF2122/97
uggguauccaccgc

SEQ ID NO: 1126403 - RNA, 20 nt, Mycobacterium bovis subsp bovis AF2122/97
ugggccuuguugccgcgcca

SEQ ID NO: 1126404 - RNA, 21 nt, Mycobacterium bovis subsp bovis AF2122/97
uggguaccgcggggauggugu

SEQ ID NO: 1126405 - RNA, 20 nt, Mycobacterium bovis subsp bovis AF2122/97
uggguacgacaccgcagcgg

SEQ ID NO: 1126406 - RNA, 15 nt, Mycobacterium bovis subsp bovis AF2122/97
ugggucggaccuucc

SEQ ID NO: 1126407 - RNA, 20 nt, Mycobacterium bovis subsp bovis AF2122/97
ugggucggcuuccggugccg

SEQ ID NO: 1126408 - RNA, 14 nt, Mycobacterium bovis subsp bovis AF2122/97
ugggucggggcggc

SEQ ID NO: 1126409 - RNA, 19 nt, Mycobacterium bovis subsp bovis AF2122/97
ugggucgugcaggcgacgg

SEQ ID NO: 1126410 - RNA, 17 nt, Mycobacterium bovis subsp bovis AF2122/97
ugggucgugucgccaca

SEQ ID NO: 1126411 - RNA, 16 nt, Mycobacterium bovis subsp bovis AF2122/97
ugggucguucaccgau

SEQ ID NO: 1126412 - RNA, 18 nt, Mycobacterium bovis subsp bovis AF2122/97
ugggucgauccggugccg

SEQ ID NO: 1126413 - RNA, 22 nt, Mycobacterium bovis subsp bovis AF2122/97
uggguccacgcgcucggugccg

SEQ ID NO: 1126414 - RNA, 14 nt, Mycobacterium bovis subsp bovis AF2122/97
ugggucaggccgac

SEQ ID NO: 1126415 - RNA, 20 nt, Mycobacterium bovis subsp bovis AF2122/97
ugggucaugccguagguugc

SEQ ID NO: 1126416 - RNA, 23 nt, Mycobacterium bovis subsp bovis AF2122/97
ugggucggcuuccggugccggga

SEQ ID NO: 1126417 - RNA, 18 nt, Mycobacterium bovis subsp bovis AF2122/97
uggucggcuaccgccgac

SEQ ID NO: 1126418 - RNA, 16 nt, Mycobacterium bovis subsp bovis AF2122/97
uggucggcuacggcca

SEQ ID NO: 1126419 - RNA, 17 nt, Mycobacterium bovis subsp bovis AF2122/97
uggucggcuacggccag

SEQ ID NO: 1126420 - RNA, 22 nt, Mycobacterium bovis subsp bovis AF2122/97
uggucggucaauucggugcgcu

SEQ ID NO: 1126421 - RNA, 21 nt, Mycobacterium bovis subsp bovis AF2122/97
uggucgguggcuacgccccac

SEQ ID NO: 1126422 - RNA, 24 nt, Mycobacterium bovis subsp bovis AF2122/97
uggucgucggaguaccgcgcguug

SEQ ID NO: 1126423 - RNA, 14 nt, Mycobacterium bovis subsp bovis AF2122/97
uggucguaggugac

SEQ ID NO: 1126424 - RNA, 17 nt, Mycobacterium bovis subsp bovis AF2122/97
uggucgugggccaccac

SEQ ID NO: 1126425 - RNA, 22 nt, Mycobacterium bovis subsp bovis AF2122/97
uggucgugggccaccaccucgg

SEQ ID NO: 1126426 - RNA, 19 nt, Mycobacterium bovis subsp bovis AF2122/97
uggugagguggucagccgg

SEQ ID NO: 1126427 - RNA, 20 nt, Mycobacterium bovis subsp bovis AF2122/97
uggugaguagauugcugacg

SEQ ID NO: 1126428 - RNA, 15 nt, Mycobacterium bovis subsp bovis AF2122/97
uggugagugcgucuc

SEQ ID NO: 1126429 - RNA, 17 nt, Mycobacterium bovis subsp bovis AF2122/97
uggugagugcgucucgg

SEQ ID NO: 1126430 - RNA, 17 nt, Mycobacterium bovis subsp bovis AF2122/97
uggugagccucggcgag

SEQ ID NO: 1126431 - RNA, 23 nt, Mycobacterium bovis subsp bovis AF2122/97
uggugaccccguaggcgccgaac

SEQ ID NO: 1126432 - RNA, 22 nt, Mycobacterium bovis subsp bovis AF2122/97
uggugaggccccccgcgccugc

SEQ ID NO: 1126433 - RNA, 18 nt, Mycobacterium bovis subsp bovis AF2122/97
uggucgcggcugccagaa

SEQ ID NO: 1126434 - RNA, 15 nt, Mycobacterium bovis subsp bovis AF2122/97
uggucggcgaugaug

SEQ ID NO: 1126435 - RNA, 20 nt, Mycobacterium bovis subsp bovis AF2122/97
uggucggcccuccaccggug

SEQ ID NO: 1126436 - RNA, 14 nt, Mycobacterium bovis subsp bovis AF2122/97
uggucggccgcaag

SEQ ID NO: 1126437 - RNA, 22 nt, Mycobacterium bovis subsp bovis AF2122/97
uggucggcgaccccgaacaucc

SEQ ID NO: 1126438 - RNA, 16 nt, Mycobacterium bovis subsp bovis AF2122/97
uggucggccucgagac

SEQ ID NO: 1126439 - RNA, 17 nt, Mycobacterium bovis subsp bovis AF2122/97
uggucggacagcgucuc

SEQ ID NO: 1126440 - RNA, 21 nt, Mycobacterium bovis subsp bovis AF2122/97
uggucggagaccagcgucuuc

SEQ ID NO: 1126441 - RNA, 21 nt, Mycobacterium bovis subsp bovis AF2122/97
uggucggagcgggugcgggcg

SEQ ID NO: 1126442 - RNA, 16 nt, Mycobacterium bovis subsp bovis AF2122/97
uggucggccaggucga

SEQ ID NO: 1126443 - RNA, 18 nt, Mycobacterium bovis subsp bovis AF2122/97
uggucgccccgaugaccg

SEQ ID NO: 1126444 - RNA, 16 nt, Mycobacterium bovis subsp bovis AF2122/97
uggucgccgcggcagc

SEQ ID NO: 1126445 - RNA, 13 nt, Mycobacterium bovis subsp bovis AF2122/97
uggucgccggcgu

SEQ ID NO: 1126446 - RNA, 19 nt, Mycobacterium bovis subsp bovis AF2122/97
uggucgcgaccgaccgcau

SEQ ID NO: 1126447 - RNA, 18 nt, Mycobacterium bovis subsp bovis AF2122/97
uggucgccaugucggcca

SEQ ID NO: 1126448 - RNA, 22 nt, Mycobacterium bovis subsp bovis AF2122/97
uggucgcggcgcuggcugcggu

SEQ ID NO: 1126449 - RNA, 14 nt, Mycobacterium bovis subsp bovis AF2122/97
uggucgcgguggcg

SEQ ID NO: 1126450 - RNA, 16 nt, Mycobacterium bovis subsp bovis AF2122/97
uggucgcgguggcggc

SEQ ID NO: 1126451 - RNA, 19 nt, Mycobacterium bovis subsp bovis AF2122/97
uggucgcgguggcggcggu

SEQ ID NO: 1126452 - RNA, 22 nt, Mycobacterium bovis subsp bovis AF2122/97
uggucgcugcugcgaucgccgc

SEQ ID NO: 1126453 - RNA, 18 nt, Mycobacterium bovis subsp bovis AF2122/97
uggugccuacaccggcaa

SEQ ID NO: 1126454 - RNA, 13 nt, Mycobacterium bovis subsp bovis AF2122/97
aaucaagcagcgu

SEQ ID NO: 1126455 - RNA, 16 nt, Mycobacterium bovis subsp bovis AF2122/97
uggugauggccgacgu

SEQ ID NO: 1126456 - RNA, 15 nt, Mycobacterium bovis subsp bovis AF2122/97
uggugucggcgagag

SEQ ID NO: 1126457 - RNA, 13 nt, Mycobacterium bovis subsp bovis AF2122/97
ugguguccaccgc

SEQ ID NO: 1126458 - RNA, 15 nt, Mycobacterium bovis subsp bovis AF2122/97
uggugugucggguug

SEQ ID NO: 1126459 - RNA, 17 nt, Mycobacterium bovis subsp bovis AF2122/97
uggugugccugcgucuc

SEQ ID NO: 1126460 - RNA, 18 nt, Mycobacterium bovis subsp bovis AF2122/97
ugguguuaaugaccgcgu

SEQ ID NO: 1126461 - RNA, 19 nt, Mycobacterium bovis subsp bovis AF2122/97
ugguguuauugaugcccga

SEQ ID NO: 1126462 - RNA, 21 nt, Mycobacterium bovis subsp bovis AF2122/97
uggugguuauucuucgguggu

SEQ ID NO: 1126463 - RNA, 23 nt, Mycobacterium bovis subsp bovis AF2122/97
ugguggugcguggaauggcgccg

SEQ ID NO: 1126464 - RNA, 17 nt, Mycobacterium bovis subsp bovis AF2122/97
uggugucaaugacaccg

SEQ ID NO: 1126465 - RNA, 14 nt, Mycobacterium bovis subsp bovis AF2122/97
uggugucagccacc

SEQ ID NO: 1126466 - RNA, 12 nt, Mycobacterium bovis subsp bovis AF2122/97
ugguguccacca

SEQ ID NO: 1126467 - RNA, 15 nt, Mycobacterium bovis subsp bovis AF2122/97
uggugcgccacgcca

SEQ ID NO: 1126468 - RNA, 23 nt, Mycobacterium bovis subsp bovis AF2122/97
uggugguagccauucgguguggc

SEQ ID NO: 1126469 - RNA, 13 nt, Mycobacterium bovis subsp bovis AF2122/97
ugguggucaccac

SEQ ID NO: 1126470 - RNA, 13 nt, Mycobacterium bovis subsp bovis AF2122/97
ugucgaucaccug

SEQ ID NO: 1126471 - RNA, 13 nt, Mycobacterium bovis subsp bovis AF2122/97
ugucgagcgcgau

SEQ ID NO: 1126472 - RNA, 15 nt, Mycobacterium bovis subsp bovis AF2122/97
ugucgacggccaccc

SEQ ID NO: 1126473 - RNA, 15 nt, Mycobacterium bovis subsp bovis AF2122/97
ugucgagcaccucga

SEQ ID NO: 1126474 - RNA, 12 nt, Mycobacterium bovis subsp bovis AF2122/97
ugucgauccggc

SEQ ID NO: 1126475 - RNA, 14 nt, Mycobacterium bovis subsp bovis AF2122/97
ugucgaucagcgcg

SEQ ID NO: 1126476 - RNA, 15 nt, Mycobacterium bovis subsp bovis AF2122/97
ugucgaucagcgcga

SEQ ID NO: 1126477 - RNA, 16 nt, Mycobacterium bovis subsp bovis AF2122/97
ugucgaucagcgcgac

SEQ ID NO: 1126478 - RNA, 15 nt, Mycobacterium bovis subsp bovis AF2122/97
ugucgaugcgcgccg

SEQ ID NO: 1126479 - RNA, 15 nt, Mycobacterium bovis subsp bovis AF2122/97
ugucgaugcgcagcc

SEQ ID NO: 1126480 - RNA, 19 nt, Mycobacterium bovis subsp bovis AF2122/97
ugucgauggggacggcggc

SEQ ID NO: 1126481 - RNA, 23 nt, Mycobacterium bovis subsp bovis AF2122/97
ugucgauggggacggcggcgagg

SEQ ID NO: 1126482 - RNA, 21 nt, Mycobacterium bovis subsp bovis AF2122/97
ugucgaagagcaggcccauac

SEQ ID NO: 1126483 - RNA, 22 nt, Mycobacterium bovis subsp bovis AF2122/97
ugucgaccuccucgaccagagc

SEQ ID NO: 1126484 - RNA, 14 nt, Mycobacterium bovis subsp bovis AF2122/97
ugucgacaccggcg

SEQ ID NO: 1126485 - RNA, 17 nt, Mycobacterium bovis subsp bovis AF2122/97
uguccuuugccaccucg

SEQ ID NO: 1126486 - RNA, 21 nt, Mycobacterium bovis subsp bovis AF2122/97
uguccuugcgguccaggccgg

SEQ ID NO: 1126487 - RNA, 14 nt, Mycobacterium bovis subsp bovis AF2122/97
ugucgcgcugcugu

SEQ ID NO: 1126488 - RNA, 22 nt, Mycobacterium bovis subsp bovis AF2122/97
ugucgcggacccgcgcgucgcc

SEQ ID NO: 1126489 - RNA, 14 nt, Mycobacterium bovis subsp bovis AF2122/97
ugucgcgguggugg

SEQ ID NO: 1126490 - RNA, 13 nt, Mycobacterium bovis subsp bovis AF2122/97
ugucgcggucgag

SEQ ID NO: 1126491 - RNA, 15 nt, Mycobacterium bovis subsp bovis AF2122/97
ugucgccucgaugcc

SEQ ID NO: 1126492 - RNA, 11 nt, Mycobacterium bovis subsp bovis AF2122/97
ugucgcgcacc

SEQ ID NO: 1126493 - RNA, 19 nt, Mycobacterium bovis subsp bovis AF2122/97
ugucgcccucgaucgccac

SEQ ID NO: 1126494 - RNA, 16 nt, Mycobacterium bovis subsp bovis AF2122/97
ugucgccgaucaccgc

SEQ ID NO: 1126495 - RNA, 14 nt, Mycobacterium bovis subsp bovis AF2122/97
ugucgccgccguug

SEQ ID NO: 1126496 - RNA, 22 nt, Mycobacterium bovis subsp bovis AF2122/97
ugucgcccucgaucgccacgac

SEQ ID NO: 1126497 - RNA, 23 nt, Mycobacterium bovis subsp bovis AF2122/97
ugucgccgauguuggcagggcca

SEQ ID NO: 1126498 - RNA, 17 nt, Mycobacterium bovis subsp bovis AF2122/97
ugucgauguccacgccg

SEQ ID NO: 1126499 - RNA, 17 nt, Mycobacterium bovis subsp bovis AF2122/97
ugucgcauuucgacgag

SEQ ID NO: 1126500 - RNA, 20 nt, Mycobacterium bovis subsp bovis AF2122/97
ugucgauuucgaugacgaac

SEQ ID NO: 1126501 - RNA, 13 nt, Mycobacterium bovis subsp bovis AF2122/97
uguccgcagcggu

SEQ ID NO: 1126502 - RNA, 14 nt, Mycobacterium bovis subsp bovis AF2122/97
uguccgcgacggcc

SEQ ID NO: 1126503 - RNA, 15 nt, Mycobacterium bovis subsp bovis AF2122/97
uguccgcgggccgcg

SEQ ID NO: 1126504 - RNA, 15 nt, Mycobacterium bovis subsp bovis AF2122/97
uguccgcucgccgcc

SEQ ID NO: 1126505 - RNA, 16 nt, Mycobacterium bovis subsp bovis AF2122/97
uguccgaccucgccgc

SEQ ID NO: 1126506 - RNA, 21 nt, Mycobacterium bovis subsp bovis AF2122/97
uguccgacgccaccgccacca

SEQ ID NO: 1126507 - RNA, 19 nt, Mycobacterium bovis subsp bovis AF2122/97
uguccgggcugcaugcggu

SEQ ID NO: 1126508 - RNA, 20 nt, Mycobacterium bovis subsp bovis AF2122/97
uguccggggaccucggcgau

SEQ ID NO: 1126509 - RNA, 22 nt, Mycobacterium bovis subsp bovis AF2122/97
uguccggcccuacgcagcgcgg

SEQ ID NO: 1126510 - RNA, 15 nt, Mycobacterium bovis subsp bovis AF2122/97
uguccggcaucggug

SEQ ID NO: 1126511 - RNA, 17 nt, Mycobacterium bovis subsp bovis AF2122/97
uguccggcgugggcacc

SEQ ID NO: 1126512 - RNA, 15 nt, Mycobacterium bovis subsp bovis AF2122/97
uguccguccgcgaca

SEQ ID NO: 1126513 - RNA, 18 nt, Mycobacterium bovis subsp bovis AF2122/97
uguccucgaccgucacgc

SEQ ID NO: 1126514 - RNA, 15 nt, Mycobacterium bovis subsp bovis AF2122/97
uguccaggcgcgcac

SEQ ID NO: 1126515 - RNA, 23 nt, Mycobacterium bovis subsp bovis AF2122/97
uguccaggcgcgcaccaccgcgg

SEQ ID NO: 1126516 - RNA, 22 nt, Mycobacterium bovis subsp bovis AF2122/97
uguccaggaucgcguggcgcac

SEQ ID NO: 1126517 - RNA, 14 nt, Mycobacterium bovis subsp bovis AF2122/97
uguccauagccggc

SEQ ID NO: 1126518 - RNA, 18 nt, Mycobacterium bovis subsp bovis AF2122/97
uguccagcaugcccgcca

SEQ ID NO: 1126519 - RNA, 22 nt, Mycobacterium bovis subsp bovis AF2122/97
uguccagcagcgaaaaccgucg

SEQ ID NO: 1126520 - RNA, 13 nt, Mycobacterium bovis subsp bovis AF2122/97
uguccccgacgga

SEQ ID NO: 1126521 - RNA, 13 nt, Mycobacterium bovis subsp bovis AF2122/97
uguccccgccgag

SEQ ID NO: 1126522 - RNA, 17 nt, Mycobacterium bovis subsp bovis AF2122/97
ugucccaucgcgucggc

SEQ ID NO: 1126523 - RNA, 14 nt, Mycobacterium bovis subsp bovis AF2122/97
uguccaucgcgcgg

SEQ ID NO: 1126524 - RNA, 16 nt, Mycobacterium bovis subsp bovis AF2122/97
uguccaccgccaccac

SEQ ID NO: 1126525 - RNA, 21 nt, Mycobacterium bovis subsp bovis AF2122/97
uguccacguccagcccgucca

SEQ ID NO: 1126526 - RNA, 16 nt, Mycobacterium bovis subsp bovis AF2122/97
uguccacugccaccgc

SEQ ID NO: 1126527 - RNA, 18 nt, Mycobacterium bovis subsp bovis AF2122/97
uguccacgaugacgucga

SEQ ID NO: 1126528 - RNA, 16 nt, Mycobacterium bovis subsp bovis AF2122/97
uguccaccaccggcac

SEQ ID NO: 1126529 - RNA, 16 nt, Mycobacterium bovis subsp bovis AF2122/97
ugucauagcgcaccac

SEQ ID NO: 1126530 - RNA, 16 nt, Mycobacterium bovis subsp bovis AF2122/97
ugucauccccggccag

SEQ ID NO: 1126531 - RNA, 22 nt, Mycobacterium bovis subsp bovis AF2122/97
ugucaggcucacacucggccgg

SEQ ID NO: 1126532 - RNA, 19 nt, Mycobacterium bovis subsp bovis AF2122/97
ugucagcuaauaccugcgg

SEQ ID NO: 1126533 - RNA, 14 nt, Mycobacterium bovis subsp bovis AF2122/97
ugucagcggccgcg

SEQ ID NO: 1126534 - RNA, 15 nt, Mycobacterium bovis subsp bovis AF2122/97
uguaugcauccacug

SEQ ID NO: 1126535 - RNA, 14 nt, Mycobacterium bovis subsp bovis AF2122/97
ugguuccggcgugc

SEQ ID NO: 1126536 - RNA, 17 nt, Mycobacterium bovis subsp bovis AF2122/97
ugguuccagaggcccga

SEQ ID NO: 1126537 - RNA, 14 nt, Mycobacterium bovis subsp bovis AF2122/97
ugguucaccucggc

SEQ ID NO: 1126538 - RNA, 13 nt, Mycobacterium bovis subsp bovis AF2122/97
ugguucaaccgga

SEQ ID NO: 1126539 - RNA, 13 nt, Mycobacterium bovis subsp bovis AF2122/97
ugguucaccucgg

SEQ ID NO: 1126540 - RNA, 13 nt, Mycobacterium bovis subsp bovis AF2122/97
ugguugaccucgg

SEQ ID NO: 1126541 - RNA, 16 nt, Mycobacterium bovis subsp bovis AF2122/97
uguaaccaucguuguu

SEQ ID NO: 1126542 - RNA, 14 nt, Mycobacterium bovis subsp bovis AF2122/97
ugcgcaucgccgac

SEQ ID NO: 1126543 - RNA, 14 nt, Mycobacterium bovis subsp bovis AF2122/97
ugcgccgccggcgc

SEQ ID NO: 1126544 - RNA, 19 nt, Mycobacterium bovis subsp bovis AF2122/97
ugcgccgccagcgccgccg

SEQ ID NO: 1126545 - RNA, 17 nt, Mycobacterium bovis subsp bovis AF2122/97
ugcgccaaaauccgccc

SEQ ID NO: 1126546 - RNA, 18 nt, Mycobacterium bovis subsp bovis AF2122/97
ugcgccaaaauccgccca

SEQ ID NO: 1126547 - RNA, 19 nt, Mycobacterium bovis subsp bovis AF2122/97
ugcgccgcaugccaccgag

SEQ ID NO: 1126548 - RNA, 12 nt, Mycobacterium bovis subsp bovis AF2122/97
ugcgccgcccgc

SEQ ID NO: 1126549 - RNA, 15 nt, Mycobacterium bovis subsp bovis AF2122/97
ugcgccggaccagcu

SEQ ID NO: 1126550 - RNA, 16 nt, Mycobacterium bovis subsp bovis AF2122/97
ugcgccggaugacacc

SEQ ID NO: 1126551 - RNA, 18 nt, Mycobacterium bovis subsp bovis AF2122/97
ugcgccggaugacaccga

SEQ ID NO: 1126552 - RNA, 16 nt, Mycobacterium bovis subsp bovis AF2122/97
ugcgcgaccacccgcc

SEQ ID NO: 1126553 - RNA, 19 nt, Mycobacterium bovis subsp bovis AF2122/97
ugcgcgaccacccgccgca

SEQ ID NO: 1126554 - RNA, 16 nt, Mycobacterium bovis subsp bovis AF2122/97
ugcgcgaagccaccag

SEQ ID NO: 1126555 - RNA, 19 nt, Mycobacterium bovis subsp bovis AF2122/97
ugcgcgaaucgcgucgagc

SEQ ID NO: 1126556 - RNA, 21 nt, Mycobacterium bovis subsp bovis AF2122/97
ugcgcgccauuggcgccgccg

SEQ ID NO: 1126557 - RNA, 22 nt, Mycobacterium bovis subsp bovis AF2122/97
ugcgcgcccaccgggcggcggc

SEQ ID NO: 1126558 - RNA, 16 nt, Mycobacterium bovis subsp bovis AF2122/97
ugcgcgauaggugcuc

SEQ ID NO: 1126559 - RNA, 20 nt, Mycobacterium bovis subsp bovis AF2122/97
ugcgcgcagacucgccaccg

SEQ ID NO: 1126560 - RNA, 19 nt, Mycobacterium bovis subsp bovis AF2122/97
ugcgcgcaggugcugggcg

SEQ ID NO: 1126561 - RNA, 14 nt, Mycobacterium bovis subsp bovis AF2122/97
ugcgcgccagacac

SEQ ID NO: 1126562 - RNA, 14 nt, Mycobacterium bovis subsp bovis AF2122/97
ugcgcgcggcgacc

SEQ ID NO: 1126563 - RNA, 15 nt, Mycobacterium bovis subsp bovis AF2122/97
ugcgcgcguugcggu

SEQ ID NO: 1126564 - RNA, 22 nt, Mycobacterium bovis subsp bovis AF2122/97
ugcgcgcgcagaucguccaccg

SEQ ID NO: 1126565 - RNA, 13 nt, Mycobacterium bovis subsp bovis AF2122/97
ugcgcgcgccggu

SEQ ID NO: 1126566 - RNA, 22 nt, Mycobacterium bovis subsp bovis AF2122/97
ugcgcggcgaucgcuccgcggc

SEQ ID NO: 1126567 - RNA, 20 nt, Mycobacterium bovis subsp bovis AF2122/97
ugcgcggaguacuccagccg

SEQ ID NO: 1126568 - RNA, 22 nt, Mycobacterium bovis subsp bovis AF2122/97
ugcgcggaguacuccagccgca

SEQ ID NO: 1126569 - RNA, 19 nt, Mycobacterium bovis subsp bovis AF2122/97
ugcgcggaucaacaggccg

SEQ ID NO: 1126570 - RNA, 23 nt, Mycobacterium bovis subsp bovis AF2122/97
ugcgcggcuugucgcggugcggc

SEQ ID NO: 1126571 - RNA, 19 nt, Mycobacterium bovis subsp bovis AF2122/97
ugcgcgucggugucgaugc

SEQ ID NO: 1126572 - RNA, 21 nt, Mycobacterium bovis subsp bovis AF2122/97
ugcgcgucggugucgaugcug

SEQ ID NO: 1126573 - RNA, 23 nt, Mycobacterium bovis subsp bovis AF2122/97
ugcgcguccagauaggccaaccg

SEQ ID NO: 1126574 - RNA, 20 nt, Mycobacterium bovis subsp bovis AF2122/97
ugcgcguccccagcgccacc

SEQ ID NO: 1126575 - RNA, 17 nt, Mycobacterium bovis subsp bovis AF2122/97
ugcgcgugacgaccagc

SEQ ID NO: 1126576 - RNA, 20 nt, Mycobacterium bovis subsp bovis AF2122/97
ugcgcgucagccgcaccccg

SEQ ID NO: 1126577 - RNA, 15 nt, Mycobacterium bovis subsp bovis AF2122/97
ugcgcgucagccgca

SEQ ID NO: 1126578 - RNA, 16 nt, Mycobacterium bovis subsp bovis AF2122/97
ugcgcggucgcgcgau

SEQ ID NO: 1126579 - RNA, 13 nt, Mycobacterium bovis subsp bovis AF2122/97
ugcgcggugaccg

SEQ ID NO: 1126580 - RNA, 13 nt, Mycobacterium bovis subsp bovis AF2122/97
ugcgcucgcggau

SEQ ID NO: 1126581 - RNA, 16 nt, Mycobacterium bovis subsp bovis AF2122/97
ugcgcugcggccagcg

SEQ ID NO: 1126582 - RNA, 15 nt, Mycobacterium bovis subsp bovis AF2122/97
ugcgcugcagcgaga

SEQ ID NO: 1126583 - RNA, 18 nt, Mycobacterium bovis subsp bovis AF2122/97
ugcgcguuacccaucgcc

SEQ ID NO: 1126584 - RNA, 15 nt, Mycobacterium bovis subsp bovis AF2122/97
ugcgcgugcugcgga

SEQ ID NO: 1126585 - RNA, 23 nt, Mycobacterium bovis subsp bovis AF2122/97
ugcgcucacugcagcgccucgau

SEQ ID NO: 1126586 - RNA, 13 nt, Mycobacterium bovis subsp bovis AF2122/97
ugcgcuaggugcg

SEQ ID NO: 1126587 - RNA, 16 nt, Mycobacterium bovis subsp bovis AF2122/97
ugcggacaucaccggc

SEQ ID NO: 1126588 - RNA, 18 nt, Mycobacterium bovis subsp bovis AF2122/97
ugcggaccugcgccggug

SEQ ID NO: 1126589 - RNA, 18 nt, Mycobacterium bovis subsp bovis AF2122/97
ugcggaccuggcggcggu

SEQ ID NO: 1126590 - RNA, 19 nt, Mycobacterium bovis subsp bovis AF2122/97
ugcggacgguguacagguc

SEQ ID NO: 1126591 - RNA, 17 nt, Mycobacterium bovis subsp bovis AF2122/97
ugcggacaagucggcac

SEQ ID NO: 1126592 - RNA, 17 nt, Mycobacterium bovis subsp bovis AF2122/97
ugcggacuucgaugucg

SEQ ID NO: 1126593 - RNA, 18 nt, Mycobacterium bovis subsp bovis AF2122/97
ugcggacuucgccgcccg

SEQ ID NO: 1126594 - RNA, 17 nt, Mycobacterium bovis subsp bovis AF2122/97
ugcggaacaccgcccgg

SEQ ID NO: 1126595 - RNA, 21 nt, Mycobacterium bovis subsp bovis AF2122/97
ugcggaacaccagcaggcggc

SEQ ID NO: 1126596 - RNA, 17 nt, Mycobacterium bovis subsp bovis AF2122/97
ugcgcuguugcuggcgc

SEQ ID NO: 1126597 - RNA, 19 nt, Mycobacterium bovis subsp bovis AF2122/97
ugcggaaccugcucggccg

SEQ ID NO: 1126598 - RNA, 14 nt, Mycobacterium bovis subsp bovis AF2122/97
ugcggaaucagcac

SEQ ID NO: 1126599 - RNA, 22 nt, Mycobacterium bovis subsp bovis AF2122/97
ugcgcuggaggcuccuggucgc

SEQ ID NO: 1126600 - RNA, 16 nt, Mycobacterium bovis subsp bovis AF2122/97
ugcgcuggcgccgccg

SEQ ID NO: 1126601 - RNA, 19 nt, Mycobacterium bovis subsp bovis AF2122/97
ugcgcugggugaugagcgc

SEQ ID NO: 1126602 - RNA, 13 nt, Mycobacterium bovis subsp bovis AF2122/97
ugcgcuggucgca

SEQ ID NO: 1126603 - RNA, 12 nt, Mycobacterium bovis subsp bovis AF2122/97
ugcgcuggcgcc

SEQ ID NO: 1126604 - RNA, 14 nt, Mycobacterium bovis subsp bovis AF2122/97
ugcggcagcgcggc

SEQ ID NO: 1126605 - RNA, 15 nt, Mycobacterium bovis subsp bovis AF2122/97
ugcggcagcgcggcc

SEQ ID NO: 1126606 - RNA, 22 nt, Mycobacterium bovis subsp bovis AF2122/97
ugcggcagcggguuugccgggc

SEQ ID NO: 1126607 - RNA, 12 nt, Mycobacterium bovis subsp bovis AF2122/97
ugcggcagcggu

SEQ ID NO: 1126608 - RNA, 13 nt, Mycobacterium bovis subsp bovis AF2122/97
ugcggauccacca

SEQ ID NO: 1126609 - RNA, 17 nt, Mycobacterium bovis subsp bovis AF2122/97
ugcggcagauacucggc

SEQ ID NO: 1126610 - RNA, 19 nt, Mycobacterium bovis subsp bovis AF2122/97
ugcggcacucccuggggua

SEQ ID NO: 1126611 - RNA, 14 nt, Mycobacterium bovis subsp bovis AF2122/97
ugcggauagcaacg

SEQ ID NO: 1126612 - RNA, 24 nt, Mycobacterium bovis subsp bovis AF2122/97
ugcggauauuccuuuaacgcaggc

SEQ ID NO: 1126613 - RNA, 20 nt, Mycobacterium bovis subsp bovis AF2122/97
ugcggaucacucccccacac

SEQ ID NO: 1126614 - RNA, 16 nt, Mycobacterium bovis subsp bovis AF2122/97
ugcggcccaaccgguc

SEQ ID NO: 1126615 - RNA, 18 nt, Mycobacterium bovis subsp bovis AF2122/97
ugcggccacucgcccgau

SEQ ID NO: 1126616 - RNA, 20 nt, Mycobacterium bovis subsp bovis AF2122/97
ugcggcccacaccagcgcag

SEQ ID NO: 1126617 - RNA, 21 nt, Mycobacterium bovis subsp bovis AF2122/97
ugcggccagcgcggcgcgcgg

SEQ ID NO: 1126618 - RNA, 19 nt, Mycobacterium bovis subsp bovis AF2122/97
ugcggcauugguaccggcu

SEQ ID NO: 1126619 - RNA, 23 nt, Mycobacterium bovis subsp bovis AF2122/97
ugcggcaggucgaugcugccagc

SEQ ID NO: 1126620 - RNA, 17 nt, Mycobacterium bovis subsp bovis AF2122/97
ugcggcaguaccccucg

SEQ ID NO: 1126621 - RNA, 13 nt, Mycobacterium bovis subsp bovis AF2122/97
ugccgugcccggu

SEQ ID NO: 1126622 - RNA, 16 nt, Mycobacterium bovis subsp bovis AF2122/97
ugccguggaagacguc

SEQ ID NO: 1126623 - RNA, 17 nt, Mycobacterium bovis subsp bovis AF2122/97
ugccgucagcggcggcc

SEQ ID NO: 1126624 - RNA, 21 nt, Mycobacterium bovis subsp bovis AF2122/97
ugccgcguacgacccccgauc

SEQ ID NO: 1126625 - RNA, 18 nt, Mycobacterium bovis subsp bovis AF2122/97
ugccguagaagcgcucca

SEQ ID NO: 1126626 - RNA, 14 nt, Mycobacterium bovis subsp bovis AF2122/97
ugccguacgcccag

SEQ ID NO: 1126627 - RNA, 20 nt, Mycobacterium bovis subsp bovis AF2122/97
ugccgucaagauugaacgag

SEQ ID NO: 1126628 - RNA, 19 nt, Mycobacterium bovis subsp bovis AF2122/97
ugccguauggcaucggccu

SEQ ID NO: 1126629 - RNA, 16 nt, Mycobacterium bovis subsp bovis AF2122/97
ugccguauagcgcaua

SEQ ID NO: 1126630 - RNA, 21 nt, Mycobacterium bovis subsp bovis AF2122/97
ugccguagguugcgccccgac

SEQ ID NO: 1126631 - RNA, 21 nt, Mycobacterium bovis subsp bovis AF2122/97
ugccgcggccaguacgucgau

SEQ ID NO: 1126632 - RNA, 17 nt, Mycobacterium bovis subsp bovis AF2122/97
ugccgcggccggcgugc

SEQ ID NO: 1126633 - RNA, 18 nt, Mycobacterium bovis subsp bovis AF2122/97
ugccgcggccaccgccgc

SEQ ID NO: 1126634 - RNA, 20 nt, Mycobacterium bovis subsp bovis AF2122/97
ugccgcggccaguacgucga

SEQ ID NO: 1126635 - RNA, 12 nt, Mycobacterium bovis subsp bovis AF2122/97
ugccgcggcgga

SEQ ID NO: 1126636 - RNA, 15 nt, Mycobacterium bovis subsp bovis AF2122/97
ugccgcggucggcga

SEQ ID NO: 1126637 - RNA, 17 nt, Mycobacterium bovis subsp bovis AF2122/97
ugccgcggucggcgacg

SEQ ID NO: 1126638 - RNA, 22 nt, Mycobacterium bovis subsp bovis AF2122/97
ugccgcggucggcgacguagac

SEQ ID NO: 1126639 - RNA, 19 nt, Mycobacterium bovis subsp bovis AF2122/97
ugccgcgguugugcugggu

SEQ ID NO: 1126640 - RNA, 15 nt, Mycobacterium bovis subsp bovis AF2122/97
ugccgcgcggcgaga

SEQ ID NO: 1126641 - RNA, 14 nt, Mycobacterium bovis subsp bovis AF2122/97
ugccgcggccaccg

SEQ ID NO: 1126642 - RNA, 15 nt, Mycobacterium bovis subsp bovis AF2122/97
ugccgcggccaccgc

SEQ ID NO: 1126643 - RNA, 15 nt, Mycobacterium bovis subsp bovis AF2122/97
ugccucucagcacgg

SEQ ID NO: 1126644 - RNA, 18 nt, Mycobacterium bovis subsp bovis AF2122/97
ugccucucuccgcgcucg

SEQ ID NO: 1126645 - RNA, 19 nt, Mycobacterium bovis subsp bovis AF2122/97
ugccucgcggggucugucg

SEQ ID NO: 1126646 - RNA, 16 nt, Mycobacterium bovis subsp bovis AF2122/97
ugccucccuuccgcgc

SEQ ID NO: 1126647 - RNA, 22 nt, Mycobacterium bovis subsp bovis AF2122/97
ugccuacaccggcaagccacgc

SEQ ID NO: 1126648 - RNA, 19 nt, Mycobacterium bovis subsp bovis AF2122/97
ugccuaccgugcuggcacc

SEQ ID NO: 1126649 - RNA, 14 nt, Mycobacterium bovis subsp bovis AF2122/97
ugccucaccgccgc

SEQ ID NO: 1126650 - RNA, 14 nt, Mycobacterium bovis subsp bovis AF2122/97
ugccguuggagccg

SEQ ID NO: 1126651 - RNA, 16 nt, Mycobacterium bovis subsp bovis AF2122/97
ugccguugcgaucgcg

SEQ ID NO: 1126652 - RNA, 19 nt, Mycobacterium bovis subsp bovis AF2122/97
ugccguugagugggagcua

SEQ ID NO: 1126653 - RNA, 19 nt, Mycobacterium bovis subsp bovis AF2122/97
ugccguuguagacggcggc

SEQ ID NO: 1126654 - RNA, 21 nt, Mycobacterium bovis subsp bovis AF2122/97
ugccguucggggcgcgguacc

SEQ ID NO: 1126655 - RNA, 16 nt, Mycobacterium bovis subsp bovis AF2122/97
ugccgugcucacggca

SEQ ID NO: 1126656 - RNA, 16 nt, Mycobacterium bovis subsp bovis AF2122/97
ugccgugguggacgau

SEQ ID NO: 1126657 - RNA, 18 nt, Mycobacterium bovis subsp bovis AF2122/97
ugccgugguggacgaugc

SEQ ID NO: 1126658 - RNA, 21 nt, Mycobacterium bovis subsp bovis AF2122/97
ugccgugguggacgaugcggu

SEQ ID NO: 1126659 - RNA, 16 nt, Mycobacterium bovis subsp bovis AF2122/97
ugccguguccagcaug

SEQ ID NO: 1126660 - RNA, 14 nt, Mycobacterium bovis subsp bovis AF2122/97
ugccguucucgucg

SEQ ID NO: 1126661 - RNA, 14 nt, Mycobacterium bovis subsp bovis AF2122/97
ugcgacccgcagac

SEQ ID NO: 1126662 - RNA, 20 nt, Mycobacterium bovis subsp bovis AF2122/97
ugcgaccacaucaugccagc

SEQ ID NO: 1126663 - RNA, 14 nt, Mycobacterium bovis subsp bovis AF2122/97
ugcgaccaggcgcg

SEQ ID NO: 1126664 - RNA, 18 nt, Mycobacterium bovis subsp bovis AF2122/97
ugcgaccgccggaccgcc

SEQ ID NO: 1126665 - RNA, 19 nt, Mycobacterium bovis subsp bovis AF2122/97
ugcgaccggcaacgcggcc

SEQ ID NO: 1126666 - RNA, 21 nt, Mycobacterium bovis subsp bovis AF2122/97
ugcgaccgucccggccucgau

SEQ ID NO: 1126667 - RNA, 15 nt, Mycobacterium bovis subsp bovis AF2122/97
ugcgaccccgccgag

SEQ ID NO: 1126668 - RNA, 15 nt, Mycobacterium bovis subsp bovis AF2122/97
ugcgacgaaccggau

SEQ ID NO: 1126669 - RNA, 13 nt, Mycobacterium bovis subsp bovis AF2122/97
ugcgagcugcggg

SEQ ID NO: 1126670 - RNA, 21 nt, Mycobacterium bovis subsp bovis AF2122/97
ugcgacgcagaccguccagca

SEQ ID NO: 1126671 - RNA, 23 nt, Mycobacterium bovis subsp bovis AF2122/97
ugcgacgcagaccguccagcaac

SEQ ID NO: 1126672 - RNA, 14 nt, Mycobacterium bovis subsp bovis AF2122/97
ugcgacgaugccgc

SEQ ID NO: 1126673 - RNA, 20 nt, Mycobacterium bovis subsp bovis AF2122/97
ugcgacgaaccggaucaucg

SEQ ID NO: 1126674 - RNA, 21 nt, Mycobacterium bovis subsp bovis AF2122/97
ugcgacgaaccggaucaucgc

SEQ ID NO: 1126675 - RNA, 19 nt, Mycobacterium bovis subsp bovis AF2122/97
ugcgacgacgccaaugccg

SEQ ID NO: 1126676 - RNA, 21 nt, Mycobacterium bovis subsp bovis AF2122/97
ugcgacgacgccaaugccgcg

SEQ ID NO: 1126677 - RNA, 14 nt, Mycobacterium bovis subsp bovis AF2122/97
ugcgacgauaucgg

SEQ ID NO: 1126678 - RNA, 16 nt, Mycobacterium bovis subsp bovis AF2122/97
ugcgagucgucgccaa

SEQ ID NO: 1126679 - RNA, 19 nt, Mycobacterium bovis subsp bovis AF2122/97
ugcgagugcggcacgaucg

SEQ ID NO: 1126680 - RNA, 13 nt, Mycobacterium bovis subsp bovis AF2122/97
ugcgaggccgcac

SEQ ID NO: 1126681 - RNA, 16 nt, Mycobacterium bovis subsp bovis AF2122/97
ugcgaggccgcacguc

SEQ ID NO: 1126682 - RNA, 20 nt, Mycobacterium bovis subsp bovis AF2122/97
ugcgaggccgcacgucgacc

SEQ ID NO: 1126683 - RNA, 16 nt, Mycobacterium bovis subsp bovis AF2122/97
ugcgacagcacgugcc

SEQ ID NO: 1126684 - RNA, 18 nt, Mycobacterium bovis subsp bovis AF2122/97
ugcgacaggacgucggcg

SEQ ID NO: 1126685 - RNA, 18 nt, Mycobacterium bovis subsp bovis AF2122/97
ugccuggucgcggggccg

SEQ ID NO: 1126686 - RNA, 17 nt, Mycobacterium bovis subsp bovis AF2122/97
ugccuggaaucgcggag

SEQ ID NO: 1126687 - RNA, 22 nt, Mycobacterium bovis subsp bovis AF2122/97
ugccugggcgaccggcucggaa

SEQ ID NO: 1126688 - RNA, 12 nt, Mycobacterium bovis subsp bovis AF2122/97
ugccugcgcacg

SEQ ID NO: 1126689 - RNA, 17 nt, Mycobacterium bovis subsp bovis AF2122/97
ugccugcgcgagugcca

SEQ ID NO: 1126690 - RNA, 15 nt, Mycobacterium bovis subsp bovis AF2122/97
ugccugcuuggccac

SEQ ID NO: 1126691 - RNA, 17 nt, Mycobacterium bovis subsp bovis AF2122/97
ugccugccgcacguucg

SEQ ID NO: 1126692 - RNA, 22 nt, Mycobacterium bovis subsp bovis AF2122/97
ugcgcagccaggugucgucgau

SEQ ID NO: 1126693 - RNA, 12 nt, Mycobacterium bovis subsp bovis AF2122/97
ugcgcagcagcg

SEQ ID NO: 1126694 - RNA, 17 nt, Mycobacterium bovis subsp bovis AF2122/97
ugcgcagcgcaacaucg

SEQ ID NO: 1126695 - RNA, 16 nt, Mycobacterium bovis subsp bovis AF2122/97
ugcgcagcgccugcgg

SEQ ID NO: 1126696 - RNA, 17 nt, Mycobacterium bovis subsp bovis AF2122/97
ugcgcagguacgccucg

SEQ ID NO: 1126697 - RNA, 12 nt, Mycobacterium bovis subsp bovis AF2122/97
ugcgaucgccgc

SEQ ID NO: 1126698 - RNA, 18 nt, Mycobacterium bovis subsp bovis AF2122/97
ugcgauuuugugucugcu

SEQ ID NO: 1126699 - RNA, 17 nt, Mycobacterium bovis subsp bovis AF2122/97
ugcgcaaauaggacugc

SEQ ID NO: 1126700 - RNA, 19 nt, Mycobacterium bovis subsp bovis AF2122/97
ugcgauuuugugucugcuc

SEQ ID NO: 1126701 - RNA, 20 nt, Mycobacterium bovis subsp bovis AF2122/97
ugcgauuuugugucugcucg

SEQ ID NO: 1126702 - RNA, 21 nt, Mycobacterium bovis subsp bovis AF2122/97
ugcgauuuugugucugcucgc

SEQ ID NO: 1126703 - RNA, 19 nt, Mycobacterium bovis subsp bovis AF2122/97
ugcgcaacaccgugcacca

SEQ ID NO: 1126704 - RNA, 22 nt, Mycobacterium bovis subsp bovis AF2122/97
aauaggcuccagcgcgcgccgc

SEQ ID NO: 1126705 - RNA, 16 nt, Mycobacterium bovis subsp bovis AF2122/97
aauaggugucgacgcg

SEQ ID NO: 1126706 - RNA, 14 nt, Mycobacterium bovis subsp bovis AF2122/97
aauagucggcaucg

SEQ ID NO: 1126707 - RNA, 16 nt, Mycobacterium bovis subsp bovis AF2122/97
uggcacccuccgccgg

SEQ ID NO: 1126708 - RNA, 17 nt, Mycobacterium bovis subsp bovis AF2122/97
uggcacaguccgcgaag

SEQ ID NO: 1126709 - RNA, 21 nt, Mycobacterium bovis subsp bovis AF2122/97
uggcaccaccccgaggccgac

SEQ ID NO: 1126710 - RNA, 13 nt, Mycobacterium bovis subsp bovis AF2122/97
uggcaccagccgg

SEQ ID NO: 1126711 - RNA, 15 nt, Mycobacterium bovis subsp bovis AF2122/97
uggcaccagccggug

SEQ ID NO: 1126712 - RNA, 21 nt, Mycobacterium bovis subsp bovis AF2122/97
uggcaaucgaggaaggugugc

SEQ ID NO: 1126713 - RNA, 21 nt, Mycobacterium bovis subsp bovis AF2122/97
uggcaagcacggcgucgaugu

SEQ ID NO: 1126714 - RNA, 16 nt, Mycobacterium bovis subsp bovis AF2122/97
uggcaacgccgcgccg

SEQ ID NO: 1126715 - RNA, 17 nt, Mycobacterium bovis subsp bovis AF2122/97
uggcaacgccgcgccgu

SEQ ID NO: 1126716 - RNA, 20 nt, Mycobacterium bovis subsp bovis AF2122/97
uggcagcuuugagucccggu

SEQ ID NO: 1126717 - RNA, 23 nt, Mycobacterium bovis subsp bovis AF2122/97
uggcagcugcucuccgucgcgca

SEQ ID NO: 1126718 - RNA, 17 nt, Mycobacterium bovis subsp bovis AF2122/97
uggcagcgcggccgggc

SEQ ID NO: 1126719 - RNA, 13 nt, Mycobacterium bovis subsp bovis AF2122/97
uggcagcgcuggc

SEQ ID NO: 1126720 - RNA, 13 nt, Mycobacterium bovis subsp bovis AF2122/97
uggcagcggcggu

SEQ ID NO: 1126721 - RNA, 20 nt, Mycobacterium bovis subsp bovis AF2122/97
uggcacugccggcacgccga

SEQ ID NO: 1126722 - RNA, 20 nt, Mycobacterium bovis subsp bovis AF2122/97
uggcaaugaccccggcguug

SEQ ID NO: 1126723 - RNA, 13 nt, Mycobacterium bovis subsp bovis AF2122/97
uggcacgcaugag

SEQ ID NO: 1126724 - RNA, 21 nt, Mycobacterium bovis subsp bovis AF2122/97
uggcacggaaguacuccaccc

SEQ ID NO: 1126725 - RNA, 13 nt, Mycobacterium bovis subsp bovis AF2122/97
uggcagagccgcc

SEQ ID NO: 1126726 - RNA, 15 nt, Mycobacterium bovis subsp bovis AF2122/97
uggcagagccgccgu

SEQ ID NO: 1126727 - RNA, 17 nt, Mycobacterium bovis subsp bovis AF2122/97
uggcagagccgccguug

SEQ ID NO: 1126728 - RNA, 24 nt, Mycobacterium bovis subsp bovis AF2122/97
uggcagaugugacuuauccggcca

SEQ ID NO: 1126729 - RNA, 12 nt, Mycobacterium bovis subsp bovis AF2122/97
uggcagcgcacc

SEQ ID NO: 1126730 - RNA, 13 nt, Mycobacterium bovis subsp bovis AF2122/97
uggauggcgcccu

SEQ ID NO: 1126731 - RNA, 15 nt, Mycobacterium bovis subsp bovis AF2122/97
uggaugcgccgcacg

SEQ ID NO: 1126732 - RNA, 18 nt, Mycobacterium bovis subsp bovis AF2122/97
uggauguaggcuucgccg

SEQ ID NO: 1126733 - RNA, 17 nt, Mycobacterium bovis subsp bovis AF2122/97
uggaugugggcgcucgc

SEQ ID NO: 1126734 - RNA, 20 nt, Mycobacterium bovis subsp bovis AF2122/97
uggaugcccguagacgccga

SEQ ID NO: 1126735 - RNA, 18 nt, Mycobacterium bovis subsp bovis AF2122/97
uggaugcccugccccgga

SEQ ID NO: 1126736 - RNA, 12 nt, Mycobacterium bovis subsp bovis AF2122/97
uggcaaccgcac

SEQ ID NO: 1126737 - RNA, 17 nt, Mycobacterium bovis subsp bovis AF2122/97
uggauucuucagcgcgg

SEQ ID NO: 1126738 - RNA, 17 nt, Mycobacterium bovis subsp bovis AF2122/97
uggaucgccaccggcgc

SEQ ID NO: 1126739 - RNA, 19 nt, Mycobacterium bovis subsp bovis AF2122/97
uggauccggcagcagccgg

SEQ ID NO: 1126740 - RNA, 22 nt, Mycobacterium bovis subsp bovis AF2122/97
uggauccgggagucgacggugc

SEQ ID NO: 1126741 - RNA, 14 nt, Mycobacterium bovis subsp bovis AF2122/97
uggaucuggcgcag

SEQ ID NO: 1126742 - RNA, 16 nt, Mycobacterium bovis subsp bovis AF2122/97
uggaucacgucgaugu

SEQ ID NO: 1126743 - RNA, 19 nt, Mycobacterium bovis subsp bovis AF2122/97
uggacgauacgcgcaccgu

SEQ ID NO: 1126744 - RNA, 20 nt, Mycobacterium bovis subsp bovis AF2122/97
uggaccgagacuugcuggcc

SEQ ID NO: 1126745 - RNA, 13 nt, Mycobacterium bovis subsp bovis AF2122/97
uggacgacccggg

SEQ ID NO: 1126746 - RNA, 14 nt, Mycobacterium bovis subsp bovis AF2122/97
uggacgacccgggc

SEQ ID NO: 1126747 - RNA, 20 nt, Mycobacterium bovis subsp bovis AF2122/97
uggacgaugaaccgggcagc

SEQ ID NO: 1126748 - RNA, 18 nt, Mycobacterium bovis subsp bovis AF2122/97
uggacgcccgcccgcacg

SEQ ID NO: 1126749 - RNA, 21 nt, Mycobacterium bovis subsp bovis AF2122/97
uggaccgggucgggcaccgcg

SEQ ID NO: 1126750 - RNA, 15 nt, Mycobacterium bovis subsp bovis AF2122/97
uggaccgaacgacuc

SEQ ID NO: 1126751 - RNA, 18 nt, Mycobacterium bovis subsp bovis AF2122/97
uggaccacagccgcgccg

SEQ ID NO: 1126752 - RNA, 21 nt, Mycobacterium bovis subsp bovis AF2122/97
uggaccagcgccccggcgcgu

SEQ ID NO: 1126753 - RNA, 14 nt, Mycobacterium bovis subsp bovis AF2122/97
uggaagccgucucu

SEQ ID NO: 1126754 - RNA, 17 nt, Mycobacterium bovis subsp bovis AF2122/97
uggaaguacacggcggc

SEQ ID NO: 1126755 - RNA, 18 nt, Mycobacterium bovis subsp bovis AF2122/97
uggaaguacacggcggcc

SEQ ID NO: 1126756 - RNA, 16 nt, Mycobacterium bovis subsp bovis AF2122/97
uggaagccgaccaccg

SEQ ID NO: 1126757 - RNA, 16 nt, Mycobacterium bovis subsp bovis AF2122/97
uggaacggcuugcgau

SEQ ID NO: 1126758 - RNA, 17 nt, Mycobacterium bovis subsp bovis AF2122/97
uggaacuuggcgucgac

SEQ ID NO: 1126759 - RNA, 13 nt, Mycobacterium bovis subsp bovis AF2122/97
ugcuggucgaugg

SEQ ID NO: 1126760 - RNA, 14 nt, Mycobacterium bovis subsp bovis AF2122/97
ugcugucggugccg

SEQ ID NO: 1126761 - RNA, 18 nt, Mycobacterium bovis subsp bovis AF2122/97
ugcugucggugccgucga

SEQ ID NO: 1126762 - RNA, 19 nt, Mycobacterium bovis subsp bovis AF2122/97
uggaggccaccaccuucgg

SEQ ID NO: 1126763 - RNA, 21 nt, Mycobacterium bovis subsp bovis AF2122/97
uggaggaaucguucggggugg

SEQ ID NO: 1126764 - RNA, 21 nt, Mycobacterium bovis subsp bovis AF2122/97
uggagaugucggugaucacgg

SEQ ID NO: 1126765 - RNA, 20 nt, Mycobacterium bovis subsp bovis AF2122/97
uggaggcuccuggucgccgu

SEQ ID NO: 1126766 - RNA, 22 nt, Mycobacterium bovis subsp bovis AF2122/97
uggaggcuccuggucgccgugg

SEQ ID NO: 1126767 - RNA, 17 nt, Mycobacterium bovis subsp bovis AF2122/97
uggagaucgccgccggc

SEQ ID NO: 1126768 - RNA, 17 nt, Mycobacterium bovis subsp bovis AF2122/97
uggacggccuccaucgc

SEQ ID NO: 1126769 - RNA, 18 nt, Mycobacterium bovis subsp bovis AF2122/97
uggacggauaguucacca

SEQ ID NO: 1126770 - RNA, 16 nt, Mycobacterium bovis subsp bovis AF2122/97
uggacggcaccggccc

SEQ ID NO: 1126771 - RNA, 23 nt, Mycobacterium bovis subsp bovis AF2122/97
uggacggcaggcggccgccggga

SEQ ID NO: 1126772 - RNA, 16 nt, Mycobacterium bovis subsp bovis AF2122/97
uggacgcgcaugcccc

SEQ ID NO: 1126773 - RNA, 20 nt, Mycobacterium bovis subsp bovis AF2122/97
uggacgcgcauuucaccggg

SEQ ID NO: 1126774 - RNA, 17 nt, Mycobacterium bovis subsp bovis AF2122/97
uggacucaucggcgugc

SEQ ID NO: 1126775 - RNA, 15 nt, Mycobacterium bovis subsp bovis AF2122/97
uggacugaucgcgau

SEQ ID NO: 1126776 - RNA, 12 nt, Mycobacterium bovis subsp bovis AF2122/97
ugcugggugccg

SEQ ID NO: 1126777 - RNA, 13 nt, Mycobacterium bovis subsp bovis AF2122/97
ugcugguccagcc

SEQ ID NO: 1126778 - RNA, 14 nt, Mycobacterium bovis subsp bovis AF2122/97
ugcugguccagccg

SEQ ID NO: 1126779 - RNA, 16 nt, Mycobacterium bovis subsp bovis AF2122/97
ugcuggucagcggcgc

SEQ ID NO: 1126780 - RNA, 17 nt, Mycobacterium bovis subsp bovis AF2122/97
ugcugguauagccggcg

SEQ ID NO: 1126781 - RNA, 14 nt, Mycobacterium bovis subsp bovis AF2122/97
ugcuggcggccucg

SEQ ID NO: 1126782 - RNA, 22 nt, Mycobacterium bovis subsp bovis AF2122/97
ugcuggcggccucgccggcgcg

SEQ ID NO: 1126783 - RNA, 22 nt, Mycobacterium bovis subsp bovis AF2122/97
ugcuggcgccgaaguagccgac

SEQ ID NO: 1126784 - RNA, 13 nt, Mycobacterium bovis subsp bovis AF2122/97
ugcuggcgaucgc

SEQ ID NO: 1126785 - RNA, 13 nt, Mycobacterium bovis subsp bovis AF2122/97
ugcuggccgcgau

SEQ ID NO: 1126786 - RNA, 15 nt, Mycobacterium bovis subsp bovis AF2122/97
ugcuggccgcggcug

SEQ ID NO: 1126787 - RNA, 20 nt, Mycobacterium bovis subsp bovis AF2122/97
ugcugcgcaccaaggccgug

SEQ ID NO: 1126788 - RNA, 22 nt, Mycobacterium bovis subsp bovis AF2122/97
ugcugcgcaacaccaucagcga

SEQ ID NO: 1126789 - RNA, 23 nt, Mycobacterium bovis subsp bovis AF2122/97
ugcuggcagcggccuccgggcca

SEQ ID NO: 1126790 - RNA, 22 nt, Mycobacterium bovis subsp bovis AF2122/97
ugcugccguauccaggcgugca

SEQ ID NO: 1126791 - RNA, 18 nt, Mycobacterium bovis subsp bovis AF2122/97
ugcugccguugggcaccg

SEQ ID NO: 1126792 - RNA, 21 nt, Mycobacterium bovis subsp bovis AF2122/97
ugcugccuugggaccgcgcca

SEQ ID NO: 1126793 - RNA, 22 nt, Mycobacterium bovis subsp bovis AF2122/97
ugcugccggagacacccgccag

SEQ ID NO: 1126794 - RNA, 15 nt, Mycobacterium bovis subsp bovis AF2122/97
ugcugccgcugcgaa

SEQ ID NO: 1126795 - RNA, 20 nt, Mycobacterium bovis subsp bovis AF2122/97
ugcugcccugguuggugacg

SEQ ID NO: 1126796 - RNA, 21 nt, Mycobacterium bovis subsp bovis AF2122/97
ugcugcccugguuggugacgu

SEQ ID NO: 1126797 - RNA, 15 nt, Mycobacterium bovis subsp bovis AF2122/97
ugcugccgccgccgc

SEQ ID NO: 1126798 - RNA, 20 nt, Mycobacterium bovis subsp bovis AF2122/97
ugcugccgccgccgccggcg

SEQ ID NO: 1126799 - RNA, 18 nt, Mycobacterium bovis subsp bovis AF2122/97
ugcugcccgacacccgca

SEQ ID NO: 1126800 - RNA, 16 nt, Mycobacterium bovis subsp bovis AF2122/97
ugcugcccaucccggc

SEQ ID NO: 1126801 - RNA, 16 nt, Mycobacterium bovis subsp bovis AF2122/97
ugcugccauugccgca

SEQ ID NO: 1126802 - RNA, 15 nt, Mycobacterium bovis subsp bovis AF2122/97
ugcugaccaugaccg

SEQ ID NO: 1126803 - RNA, 21 nt, Mycobacterium bovis subsp bovis AF2122/97
ugcucggccagaaagaucggu

SEQ ID NO: 1126804 - RNA, 12 nt, Mycobacterium bovis subsp bovis AF2122/97
ugcucagcgcgc

SEQ ID NO: 1126805 - RNA, 21 nt, Mycobacterium bovis subsp bovis AF2122/97
ugcucagcgcgcgccgcuggg

SEQ ID NO: 1126806 - RNA, 15 nt, Mycobacterium bovis subsp bovis AF2122/97
ugcucgggggccgac

SEQ ID NO: 1126807 - RNA, 13 nt, Mycobacterium bovis subsp bovis AF2122/97
ugcucaccggcgc

SEQ ID NO: 1126808 - RNA, 24 nt, Mycobacterium bovis subsp bovis AF2122/97
ugcucacgaucugcgcgucaggcc

SEQ ID NO: 1126809 - RNA, 16 nt, Mycobacterium bovis subsp bovis AF2122/97
ugcucacccgucguca

SEQ ID NO: 1126810 - RNA, 14 nt, Mycobacterium bovis subsp bovis AF2122/97
ugcucacggcggcg

SEQ ID NO: 1126811 - RNA, 15 nt, Mycobacterium bovis subsp bovis AF2122/97
ugcucagcaacggcg

SEQ ID NO: 1126812 - RNA, 22 nt, Mycobacterium bovis subsp bovis AF2122/97
ugcucaacggcgacaucggccc

SEQ ID NO: 1126813 - RNA, 18 nt, Mycobacterium bovis subsp bovis AF2122/97
ugcuauucgccagcgccg

SEQ ID NO: 1126814 - RNA, 12 nt, Mycobacterium bovis subsp bovis AF2122/97
ugcucggugacg

SEQ ID NO: 1126815 - RNA, 15 nt, Mycobacterium bovis subsp bovis AF2122/97
ugcucguaggugccg

SEQ ID NO: 1126816 - RNA, 15 nt, Mycobacterium bovis subsp bovis AF2122/97
ugcucgucggcgccg

SEQ ID NO: 1126817 - RNA, 16 nt, Mycobacterium bovis subsp bovis AF2122/97
ugcucgucggcgccgg

SEQ ID NO: 1126818 - RNA, 16 nt, Mycobacterium bovis subsp bovis AF2122/97
ugcucgucggucaccg

SEQ ID NO: 1126819 - RNA, 15 nt, Mycobacterium bovis subsp bovis AF2122/97
ugcucguggguaccg

SEQ ID NO: 1126820 - RNA, 13 nt, Mycobacterium bovis subsp bovis AF2122/97
ugcucgucgucga

SEQ ID NO: 1126821 - RNA, 19 nt, Mycobacterium bovis subsp bovis AF2122/97
ugcucgucuuggcggcggu

SEQ ID NO: 1126822 - RNA, 14 nt, Mycobacterium bovis subsp bovis AF2122/97
ugcucuucggcacc

SEQ ID NO: 1126823 - RNA, 16 nt, Mycobacterium bovis subsp bovis AF2122/97
ugcugaacuccgccgc

SEQ ID NO: 1126824 - RNA, 18 nt, Mycobacterium bovis subsp bovis AF2122/97
ugcggccccaugcgccag

SEQ ID NO: 1126825 - RNA, 21 nt, Mycobacterium bovis subsp bovis AF2122/97
ugcggccgggucgcgcuggcg

SEQ ID NO: 1126826 - RNA, 22 nt, Mycobacterium bovis subsp bovis AF2122/97
ugcggccuuggcgacgucgcgg

SEQ ID NO: 1126827 - RNA, 13 nt, Mycobacterium bovis subsp bovis AF2122/97
ugcggcgcagcga

SEQ ID NO: 1126828 - RNA, 18 nt, Mycobacterium bovis subsp bovis AF2122/97
ugcggcgaggacgcgccc

SEQ ID NO: 1126829 - RNA, 12 nt, Mycobacterium bovis subsp bovis AF2122/97
ugcggcgcgacc

SEQ ID NO: 1126830 - RNA, 14 nt, Mycobacterium bovis subsp bovis AF2122/97
ugcguagcggguca

SEQ ID NO: 1126831 - RNA, 16 nt, Mycobacterium bovis subsp bovis AF2122/97
ugcguagcaggucgac

SEQ ID NO: 1126832 - RNA, 17 nt, Mycobacterium bovis subsp bovis AF2122/97
ugcgugcggucgauccg

SEQ ID NO: 1126833 - RNA, 13 nt, Mycobacterium bovis subsp bovis AF2122/97
ugcgugcggcgaa

SEQ ID NO: 1126834 - RNA, 18 nt, Mycobacterium bovis subsp bovis AF2122/97
ugcgugcauaggccgcgu

SEQ ID NO: 1126835 - RNA, 21 nt, Mycobacterium bovis subsp bovis AF2122/97
ugcgugccuugaucugagcgc

SEQ ID NO: 1126836 - RNA, 15 nt, Mycobacterium bovis subsp bovis AF2122/97
ugcgugccgcaccgc

SEQ ID NO: 1126837 - RNA, 16 nt, Mycobacterium bovis subsp bovis AF2122/97
ugcgugaugguugcuc

SEQ ID NO: 1126838 - RNA, 11 nt, Mycobacterium bovis subsp bovis AF2122/97
ugcguccagau

SEQ ID NO: 1126839 - RNA, 20 nt, Mycobacterium bovis subsp bovis AF2122/97
ugcguccagcaaaugcggcg

SEQ ID NO: 1126840 - RNA, 19 nt, Mycobacterium bovis subsp bovis AF2122/97
ugcguccaggccagggcgg

SEQ ID NO: 1126841 - RNA, 20 nt, Mycobacterium bovis subsp bovis AF2122/97
ugcguccggaaccaaccucg

SEQ ID NO: 1126842 - RNA, 13 nt, Mycobacterium bovis subsp bovis AF2122/97
ugcguaugcccac

SEQ ID NO: 1126843 - RNA, 17 nt, Mycobacterium bovis subsp bovis AF2122/97
ugcuaggcaugccacac

SEQ ID NO: 1126844 - RNA, 21 nt, Mycobacterium bovis subsp bovis AF2122/97
ugcuacccauucggcggcggu

SEQ ID NO: 1126845 - RNA, 19 nt, Mycobacterium bovis subsp bovis AF2122/97
ugcuacccgagccggcacg

SEQ ID NO: 1126846 - RNA, 17 nt, Mycobacterium bovis subsp bovis AF2122/97
ugcguuugcacuguucg

SEQ ID NO: 1126847 - RNA, 22 nt, Mycobacterium bovis subsp bovis AF2122/97
ugcguugucggcuggacggcgc

SEQ ID NO: 1126848 - RNA, 17 nt, Mycobacterium bovis subsp bovis AF2122/97
ugcguuccaucgccgac

SEQ ID NO: 1126849 - RNA, 20 nt, Mycobacterium bovis subsp bovis AF2122/97
ugcguucaucauccacaccg

SEQ ID NO: 1126850 - RNA, 13 nt, Mycobacterium bovis subsp bovis AF2122/97
ugcguuccaucgc

SEQ ID NO: 1126851 - RNA, 16 nt, Mycobacterium bovis subsp bovis AF2122/97
ugcguucgccgcccgg

SEQ ID NO: 1126852 - RNA, 22 nt, Mycobacterium bovis subsp bovis AF2122/97
ugcguuggcgccaccagucacg

SEQ ID NO: 1126853 - RNA, 20 nt, Mycobacterium bovis subsp bovis AF2122/97
ugcguggcgggcugcagccg

SEQ ID NO: 1126854 - RNA, 20 nt, Mycobacterium bovis subsp bovis AF2122/97
ugcguggcguugguggucug

SEQ ID NO: 1126855 - RNA, 22 nt, Mycobacterium bovis subsp bovis AF2122/97
ugcguggcguugguggucugcc

SEQ ID NO: 1126856 - RNA, 16 nt, Mycobacterium bovis subsp bovis AF2122/97
ugcguggaauggcgcc

SEQ ID NO: 1126857 - RNA, 19 nt, Mycobacterium bovis subsp bovis AF2122/97
ugcguggaauggcgccggc

SEQ ID NO: 1126858 - RNA, 21 nt, Mycobacterium bovis subsp bovis AF2122/97
ugcguggaauggcgccggccg

SEQ ID NO: 1126859 - RNA, 19 nt, Mycobacterium bovis subsp bovis AF2122/97
gugucgcugcaaccgccgg

SEQ ID NO: 1126860 - RNA, 22 nt, Mycobacterium bovis subsp bovis AF2122/97
gugucgcugcggcgcuggccag

SEQ ID NO: 1126861 - RNA, 13 nt, Mycobacterium bovis subsp bovis AF2122/97
gugucgcugcuga

SEQ ID NO: 1126862 - RNA, 22 nt, Mycobacterium bovis subsp bovis AF2122/97
gugucgggaacgaguacgggca

SEQ ID NO: 1126863 - RNA, 17 nt, Mycobacterium bovis subsp bovis AF2122/97
gugucgggcgcgcugcc

SEQ ID NO: 1126864 - RNA, 16 nt, Mycobacterium bovis subsp bovis AF2122/97
gugucgggcugucagg

SEQ ID NO: 1126865 - RNA, 14 nt, Mycobacterium bovis subsp bovis AF2122/97
gugucggcucgagu

SEQ ID NO: 1126866 - RNA, 13 nt, Mycobacterium bovis subsp bovis AF2122/97
gugucggcgccga

SEQ ID NO: 1126867 - RNA, 14 nt, Mycobacterium bovis subsp bovis AF2122/97
gugucgacgguguc

SEQ ID NO: 1126868 - RNA, 22 nt, Mycobacterium bovis subsp bovis AF2122/97
gugucgacuugugacggucguc

SEQ ID NO: 1126869 - RNA, 16 nt, Mycobacterium bovis subsp bovis AF2122/97
gugucgccgucgcggc

SEQ ID NO: 1126870 - RNA, 15 nt, Mycobacterium bovis subsp bovis AF2122/97
gugucgccacccgcg

SEQ ID NO: 1126871 - RNA, 22 nt, Mycobacterium bovis subsp bovis AF2122/97
gugucgccgccguugccgccgg

SEQ ID NO: 1126872 - RNA, 21 nt, Mycobacterium bovis subsp bovis AF2122/97
gugugguaggaacuacccgcc

SEQ ID NO: 1126873 - RNA, 12 nt, Mycobacterium bovis subsp bovis AF2122/97
guguggucacca

SEQ ID NO: 1126874 - RNA, 21 nt, Mycobacterium bovis subsp bovis AF2122/97
guguggcuugcgucgcggacg

SEQ ID NO: 1126875 - RNA, 18 nt, Mycobacterium bovis subsp bovis AF2122/97
guguggcgaugaccacgc

SEQ ID NO: 1126876 - RNA, 18 nt, Mycobacterium bovis subsp bovis AF2122/97
guguggucauuggggugg

SEQ ID NO: 1126877 - RNA, 17 nt, Mycobacterium bovis subsp bovis AF2122/97
guguggucgguggcggg

SEQ ID NO: 1126878 - RNA, 22 nt, Mycobacterium bovis subsp bovis AF2122/97
guguguuccaacuccugcagcc

SEQ ID NO: 1126879 - RNA, 17 nt, Mycobacterium bovis subsp bovis AF2122/97
guguguucggagcuggg

SEQ ID NO: 1126880 - RNA, 21 nt, Mycobacterium bovis subsp bovis AF2122/97
guguggcccaaccgcauucgg

SEQ ID NO: 1126881 - RNA, 19 nt, Mycobacterium bovis subsp bovis AF2122/97
guguggaauacgcugcugg

SEQ ID NO: 1126882 - RNA, 20 nt, Mycobacterium bovis subsp bovis AF2122/97
guguggaauggaccagcgcc

SEQ ID NO: 1126883 - RNA, 15 nt, Mycobacterium bovis subsp bovis AF2122/97
guguggacgcacggc

SEQ ID NO: 1126884 - RNA, 18 nt, Mycobacterium bovis subsp bovis AF2122/97
guguggacuucagcaggc

SEQ ID NO: 1126885 - RNA, 14 nt, Mycobacterium bovis subsp bovis AF2122/97
gugugcugccaccg

SEQ ID NO: 1126886 - RNA, 13 nt, Mycobacterium bovis subsp bovis AF2122/97
gugugcugccgca

SEQ ID NO: 1126887 - RNA, 17 nt, Mycobacterium bovis subsp bovis AF2122/97
guguggcacguggcgac

SEQ ID NO: 1126888 - RNA, 22 nt, Mycobacterium bovis subsp bovis AF2122/97
guguggcacguggcgaccggcg

SEQ ID NO: 1126889 - RNA, 19 nt, Mycobacterium bovis subsp bovis AF2122/97
gugucgguggccgcggcgg

SEQ ID NO: 1126890 - RNA, 18 nt, Mycobacterium bovis subsp bovis AF2122/97
gugucggugguaccggcg

SEQ ID NO: 1126891 - RNA, 15 nt, Mycobacterium bovis subsp bovis AF2122/97
gugucguaccagcca

SEQ ID NO: 1126892 - RNA, 16 nt, Mycobacterium bovis subsp bovis AF2122/97
gugucguacccggcaa

SEQ ID NO: 1126893 - RNA, 23 nt, Mycobacterium bovis subsp bovis AF2122/97
gugugcggcauugguaccggcuu

SEQ ID NO: 1126894 - RNA, 20 nt, Mycobacterium bovis subsp bovis AF2122/97
gugucggggcccccgccgga

SEQ ID NO: 1126895 - RNA, 13 nt, Mycobacterium bovis subsp bovis AF2122/97
gugugcggcagcc

SEQ ID NO: 1126896 - RNA, 15 nt, Mycobacterium bovis subsp bovis AF2122/97
gugucugcccgaggu

SEQ ID NO: 1126897 - RNA, 13 nt, Mycobacterium bovis subsp bovis AF2122/97
gugucugcucgcg

SEQ ID NO: 1126898 - RNA, 21 nt, Mycobacterium bovis subsp bovis AF2122/97
gugucugggaccccgcugcga

SEQ ID NO: 1126899 - RNA, 18 nt, Mycobacterium bovis subsp bovis AF2122/97
guguccccggcugccagc

SEQ ID NO: 1126900 - RNA, 17 nt, Mycobacterium bovis subsp bovis AF2122/97
guguccagccaggcgau

SEQ ID NO: 1126901 - RNA, 12 nt, Mycobacterium bovis subsp bovis AF2122/97
gugucccgcgag

SEQ ID NO: 1126902 - RNA, 18 nt, Mycobacterium bovis subsp bovis AF2122/97
gugucccaagccugccga

SEQ ID NO: 1126903 - RNA, 16 nt, Mycobacterium bovis subsp bovis AF2122/97
guguccgccgucaccc

SEQ ID NO: 1126904 - RNA, 13 nt, Mycobacterium bovis subsp bovis AF2122/97
guguccucgaccg

SEQ ID NO: 1126905 - RNA, 13 nt, Mycobacterium bovis subsp bovis AF2122/97
guguccucgucga

SEQ ID NO: 1126906 - RNA, 16 nt, Mycobacterium bovis subsp bovis AF2122/97
guguccuuggccgcca

SEQ ID NO: 1126907 - RNA, 21 nt, Mycobacterium bovis subsp bovis AF2122/97
gugguuguccacggcguuacg

SEQ ID NO: 1126908 - RNA, 14 nt, Mycobacterium bovis subsp bovis AF2122/97
gugguucggcgucg

SEQ ID NO: 1126909 - RNA, 18 nt, Mycobacterium bovis subsp bovis AF2122/97
gugguuauucuucggugg

SEQ ID NO: 1126910 - RNA, 20 nt, Mycobacterium bovis subsp bovis AF2122/97
gugguucaccucggcgacga

SEQ ID NO: 1126911 - RNA, 17 nt, Mycobacterium bovis subsp bovis AF2122/97
guguccagaacgguggc

SEQ ID NO: 1126912 - RNA, 20 nt, Mycobacterium bovis subsp bovis AF2122/97
guguccaccaccggcacccg

SEQ ID NO: 1126913 - RNA, 21 nt, Mycobacterium bovis subsp bovis AF2122/97
guguccaccggaccgaccacc

SEQ ID NO: 1126914 - RNA, 14 nt, Mycobacterium bovis subsp bovis AF2122/97
gugguggggccgug

SEQ ID NO: 1126915 - RNA, 18 nt, Mycobacterium bovis subsp bovis AF2122/97
gugguggguugaucgcgc

SEQ ID NO: 1126916 - RNA, 20 nt, Mycobacterium bovis subsp bovis AF2122/97
guggugggcuaggucgcgcu

SEQ ID NO: 1126917 - RNA, 19 nt, Mycobacterium bovis subsp bovis AF2122/97
guggugggcuuggcugugg

SEQ ID NO: 1126918 - RNA, 12 nt, Mycobacterium bovis subsp bovis AF2122/97
gugguggcguug

SEQ ID NO: 1126919 - RNA, 20 nt, Mycobacterium bovis subsp bovis AF2122/97
gugguggcccggcuggcuag

SEQ ID NO: 1126920 - RNA, 22 nt, Mycobacterium bovis subsp bovis AF2122/97
gugguggccggggugccggcga

SEQ ID NO: 1126921 - RNA, 23 nt, Mycobacterium bovis subsp bovis AF2122/97
gugguggaguuuccgaagcccgg

SEQ ID NO: 1126922 - RNA, 19 nt, Mycobacterium bovis subsp bovis AF2122/97
gugguggcauaaccgcuga

SEQ ID NO: 1126923 - RNA, 14 nt, Mycobacterium bovis subsp bovis AF2122/97
guggugguagccau

SEQ ID NO: 1126924 - RNA, 20 nt, Mycobacterium bovis subsp bovis AF2122/97
gugguguaucgacggcggcc

SEQ ID NO: 1126925 - RNA, 19 nt, Mycobacterium bovis subsp bovis AF2122/97
guggugucagccaccggug

SEQ ID NO: 1126926 - RNA, 15 nt, Mycobacterium bovis subsp bovis AF2122/97
guggugucggcgaga

SEQ ID NO: 1126927 - RNA, 16 nt, Mycobacterium bovis subsp bovis AF2122/97
guggugugucaccgga

SEQ ID NO: 1126928 - RNA, 13 nt, Mycobacterium bovis subsp bovis AF2122/97
guggucucgacgg

SEQ ID NO: 1126929 - RNA, 16 nt, Mycobacterium bovis subsp bovis AF2122/97
guggucuccggcaccg

SEQ ID NO: 1126930 - RNA, 17 nt, Mycobacterium bovis subsp bovis AF2122/97
guggucgguggcgggga

SEQ ID NO: 1126931 - RNA, 12 nt, Mycobacterium bovis subsp bovis AF2122/97
guggucggcccg

SEQ ID NO: 1126932 - RNA, 13 nt, Mycobacterium bovis subsp bovis AF2122/97
guggucggcuccg

SEQ ID NO: 1126933 - RNA, 16 nt, Mycobacterium bovis subsp bovis AF2122/97
guggucggcuccgcga

SEQ ID NO: 1126934 - RNA, 18 nt, Mycobacterium bovis subsp bovis AF2122/97
guggucgggucgaucacc

SEQ ID NO: 1126935 - RNA, 13 nt, Mycobacterium bovis subsp bovis AF2122/97
guggucugcgcgg

SEQ ID NO: 1126936 - RNA, 14 nt, Mycobacterium bovis subsp bovis AF2122/97
guggucuuggcccg

SEQ ID NO: 1126937 - RNA, 13 nt, Mycobacterium bovis subsp bovis AF2122/97
guggucuuggcgg

SEQ ID NO: 1126938 - RNA, 20 nt, Mycobacterium bovis subsp bovis AF2122/97
guggucuuggcgguggcccg

SEQ ID NO: 1126939 - RNA, 18 nt, Mycobacterium bovis subsp bovis AF2122/97
guggucucgacggcgccg

SEQ ID NO: 1126940 - RNA, 20 nt, Mycobacterium bovis subsp bovis AF2122/97
guggucucgacggcgccgcc

SEQ ID NO: 1126941 - RNA, 22 nt, Mycobacterium bovis subsp bovis AF2122/97
guggugaaguagucggcgccga

SEQ ID NO: 1126942 - RNA, 17 nt, Mycobacterium bovis subsp bovis AF2122/97
guggugaaaugccgaga

SEQ ID NO: 1126943 - RNA, 23 nt, Mycobacterium bovis subsp bovis AF2122/97
guggcugcgccggaaccccucga

SEQ ID NO: 1126944 - RNA, 20 nt, Mycobacterium bovis subsp bovis AF2122/97
guggcuuaagucuggaguga

SEQ ID NO: 1126945 - RNA, 14 nt, Mycobacterium bovis subsp bovis AF2122/97
guggcuucaacccg

SEQ ID NO: 1126946 - RNA, 22 nt, Mycobacterium bovis subsp bovis AF2122/97
guggcuucaacccgggcagcau

SEQ ID NO: 1126947 - RNA, 15 nt, Mycobacterium bovis subsp bovis AF2122/97
guggcuucacccaac

SEQ ID NO: 1126948 - RNA, 18 nt, Mycobacterium bovis subsp bovis AF2122/97
guggcuugcgucgcggac

SEQ ID NO: 1126949 - RNA, 23 nt, Mycobacterium bovis subsp bovis AF2122/97
guggcuugcgucgcggacggugc

SEQ ID NO: 1126950 - RNA, 16 nt, Mycobacterium bovis subsp bovis AF2122/97
guggcuucgacggcgg

SEQ ID NO: 1126951 - RNA, 17 nt, Mycobacterium bovis subsp bovis AF2122/97
gugggaaccaccagcac

SEQ ID NO: 1126952 - RNA, 23 nt, Mycobacterium bovis subsp bovis AF2122/97
gugggacaaagacgccgucggcg

SEQ ID NO: 1126953 - RNA, 19 nt, Mycobacterium bovis subsp bovis AF2122/97
guggcagcgcggccgggcg

SEQ ID NO: 1126954 - RNA, 21 nt, Mycobacterium bovis subsp bovis AF2122/97
guggccaccaaacgcugcugg

SEQ ID NO: 1126955 - RNA, 14 nt, Mycobacterium bovis subsp bovis AF2122/97
guggcugcgcucgc

SEQ ID NO: 1126956 - RNA, 16 nt, Mycobacterium bovis subsp bovis AF2122/97
guggcugcgcucgccc

SEQ ID NO: 1126957 - RNA, 14 nt, Mycobacterium bovis subsp bovis AF2122/97
guggcuggcggcga

SEQ ID NO: 1126958 - RNA, 20 nt, Mycobacterium bovis subsp bovis AF2122/97
guggcuguacccgaccagca

SEQ ID NO: 1126959 - RNA, 14 nt, Mycobacterium bovis subsp bovis AF2122/97
gugggagguggcgc

SEQ ID NO: 1126960 - RNA, 16 nt, Mycobacterium bovis subsp bovis AF2122/97
gugggacuggcgugaa

SEQ ID NO: 1126961 - RNA, 12 nt, Mycobacterium bovis subsp bovis AF2122/97
gugggacgcggc

SEQ ID NO: 1126962 - RNA, 16 nt, Mycobacterium bovis subsp bovis AF2122/97
gugggacgcggccgag

SEQ ID NO: 1126963 - RNA, 22 nt, Mycobacterium bovis subsp bovis AF2122/97
gugggagcagccgaaccggcac

SEQ ID NO: 1126964 - RNA, 12 nt, Mycobacterium bovis subsp bovis AF2122/97
gugggccgacgu

SEQ ID NO: 1126965 - RNA, 14 nt, Mycobacterium bovis subsp bovis AF2122/97
gugggcgacggcga

SEQ ID NO: 1126966 - RNA, 18 nt, Mycobacterium bovis subsp bovis AF2122/97
gugggcgacggcggcguc

SEQ ID NO: 1126967 - RNA, 16 nt, Mycobacterium bovis subsp bovis AF2122/97
gugggcgacgucaucg

SEQ ID NO: 1126968 - RNA, 15 nt, Mycobacterium bovis subsp bovis AF2122/97
guggcagcgcacccg

SEQ ID NO: 1126969 - RNA, 18 nt, Mycobacterium bovis subsp bovis AF2122/97
guggcagccugcugcaca

SEQ ID NO: 1126970 - RNA, 18 nt, Mycobacterium bovis subsp bovis AF2122/97
guggcacccgcgucgagu

SEQ ID NO: 1126971 - RNA, 16 nt, Mycobacterium bovis subsp bovis AF2122/97
guggcaccggcggcga

SEQ ID NO: 1126972 - RNA, 12 nt, Mycobacterium bovis subsp bovis AF2122/97
guggcaccgguu

SEQ ID NO: 1126973 - RNA, 15 nt, Mycobacterium bovis subsp bovis AF2122/97
guggcacguggcgac

SEQ ID NO: 1126974 - RNA, 21 nt, Mycobacterium bovis subsp bovis AF2122/97
guggcacugacgcgcccgacg

SEQ ID NO: 1126975 - RNA, 23 nt, Mycobacterium bovis subsp bovis AF2122/97
guggcaggugaucccgaugguca

SEQ ID NO: 1126976 - RNA, 20 nt, Mycobacterium bovis subsp bovis AF2122/97
guggcaguacaccggcgugc

SEQ ID NO: 1126977 - RNA, 19 nt, Mycobacterium bovis subsp bovis AF2122/97
guggcagucgcacggugcc

SEQ ID NO: 1126978 - RNA, 22 nt, Mycobacterium bovis subsp bovis AF2122/97
guggcagugaaauugccgccgc

SEQ ID NO: 1126979 - RNA, 16 nt, Mycobacterium bovis subsp bovis AF2122/97
guggcauaaccgcuga

SEQ ID NO: 1126980 - RNA, 15 nt, Mycobacterium bovis subsp bovis AF2122/97
guggcauccagcagc

SEQ ID NO: 1126981 - RNA, 23 nt, Mycobacterium bovis subsp bovis AF2122/97
guggcauccuugccaaucgccgu

SEQ ID NO: 1126982 - RNA, 16 nt, Mycobacterium bovis subsp bovis AF2122/97
guggccaacaccgcca

SEQ ID NO: 1126983 - RNA, 20 nt, Mycobacterium bovis subsp bovis AF2122/97
guggccaacaccgccagcau

SEQ ID NO: 1126984 - RNA, 19 nt, Mycobacterium bovis subsp bovis AF2122/97
guggccaauccggcggcga

SEQ ID NO: 1126985 - RNA, 21 nt, Mycobacterium bovis subsp bovis AF2122/97
guggcaugcgacagaugccgg

SEQ ID NO: 1126986 - RNA, 22 nt, Mycobacterium bovis subsp bovis AF2122/97
guggucagucaccaaccacaug

SEQ ID NO: 1126987 - RNA, 21 nt, Mycobacterium bovis subsp bovis AF2122/97
guggucaucgccacgccugcu

SEQ ID NO: 1126988 - RNA, 20 nt, Mycobacterium bovis subsp bovis AF2122/97
guggucaccccuucgccagc

SEQ ID NO: 1126989 - RNA, 22 nt, Mycobacterium bovis subsp bovis AF2122/97
guggucaccccuucgccagcgc

SEQ ID NO: 1126990 - RNA, 21 nt, Mycobacterium bovis subsp bovis AF2122/97
guggucacgcagucgggcagc

SEQ ID NO: 1126991 - RNA, 16 nt, Mycobacterium bovis subsp bovis AF2122/97
guggucgagcggucgc

SEQ ID NO: 1126992 - RNA, 17 nt, Mycobacterium bovis subsp bovis AF2122/97
guggucgagggcggcgu

SEQ ID NO: 1126993 - RNA, 19 nt, Mycobacterium bovis subsp bovis AF2122/97
guggucgacccggccagga

SEQ ID NO: 1126994 - RNA, 15 nt, Mycobacterium bovis subsp bovis AF2122/97
guggucccccgcagc

SEQ ID NO: 1126995 - RNA, 16 nt, Mycobacterium bovis subsp bovis AF2122/97
guggucccccgcagcc

SEQ ID NO: 1126996 - RNA, 18 nt, Mycobacterium bovis subsp bovis AF2122/97
guggucccccgcagccag

SEQ ID NO: 1126997 - RNA, 19 nt, Mycobacterium bovis subsp bovis AF2122/97
guggucauugggguggcau

SEQ ID NO: 1126998 - RNA, 16 nt, Mycobacterium bovis subsp bovis AF2122/97
gugguccaaccgggcc

SEQ ID NO: 1126999 - RNA, 20 nt, Mycobacterium bovis subsp bovis AF2122/97
gugguccaaccgggccggcu

SEQ ID NO: 1127000 - RNA, 20 nt, Mycobacterium bovis subsp bovis AF2122/97
gugggccucgaucagcgccg

SEQ ID NO: 1127001 - RNA, 14 nt, Mycobacterium bovis subsp bovis AF2122/97
gugggcgaucggcg

SEQ ID NO: 1127002 - RNA, 15 nt, Mycobacterium bovis subsp bovis AF2122/97
gugggcgccgacacc

SEQ ID NO: 1127003 - RNA, 16 nt, Mycobacterium bovis subsp bovis AF2122/97
gugggcgccgcaaccg

SEQ ID NO: 1127004 - RNA, 13 nt, Mycobacterium bovis subsp bovis AF2122/97
gugggcgcuguca

SEQ ID NO: 1127005 - RNA, 21 nt, Mycobacterium bovis subsp bovis AF2122/97
gugggucugcucagcgcggcc

SEQ ID NO: 1127006 - RNA, 14 nt, Mycobacterium bovis subsp bovis AF2122/97
gugggucgauccgg

SEQ ID NO: 1127007 - RNA, 22 nt, Mycobacterium bovis subsp bovis AF2122/97
gugggugccggcucaacaccga

SEQ ID NO: 1127008 - RNA, 15 nt, Mycobacterium bovis subsp bovis AF2122/97
gugguaacggcggcc

SEQ ID NO: 1127009 - RNA, 16 nt, Mycobacterium bovis subsp bovis AF2122/97
gugguaacggcggcca

SEQ ID NO: 1127010 - RNA, 16 nt, Mycobacterium bovis subsp bovis AF2122/97
gugguaacggggcugc

SEQ ID NO: 1127011 - RNA, 12 nt, Mycobacterium bovis subsp bovis AF2122/97
gugggugccagc

SEQ ID NO: 1127012 - RNA, 14 nt, Mycobacterium bovis subsp bovis AF2122/97
gugguaggccgccg

SEQ ID NO: 1127013 - RNA, 23 nt, Mycobacterium bovis subsp bovis AF2122/97
gugguaucgauugaugcgugguu

SEQ ID NO: 1127014 - RNA, 15 nt, Mycobacterium bovis subsp bovis AF2122/97
gugguaccggcggcg

SEQ ID NO: 1127015 - RNA, 17 nt, Mycobacterium bovis subsp bovis AF2122/97
gugguaccggcggcgcc

SEQ ID NO: 1127016 - RNA, 18 nt, Mycobacterium bovis subsp bovis AF2122/97
gugguaccggcggcgccg

SEQ ID NO: 1127017 - RNA, 16 nt, Mycobacterium bovis subsp bovis AF2122/97
gugguacggcucggcg

SEQ ID NO: 1127018 - RNA, 19 nt, Mycobacterium bovis subsp bovis AF2122/97
gugguacggcucggcgcug

SEQ ID NO: 1127019 - RNA, 16 nt, Mycobacterium bovis subsp bovis AF2122/97
gugguacgugcgagcc

SEQ ID NO: 1127020 - RNA, 20 nt, Mycobacterium bovis subsp bovis AF2122/97
guucaucgccggcgcgccga

SEQ ID NO: 1127021 - RNA, 18 nt, Mycobacterium bovis subsp bovis AF2122/97
guucaucacgccgccgga

SEQ ID NO: 1127022 - RNA, 15 nt, Mycobacterium bovis subsp bovis AF2122/97
guuccacgcugccca

SEQ ID NO: 1127023 - RNA, 14 nt, Mycobacterium bovis subsp bovis AF2122/97
guuccacggccagg

SEQ ID NO: 1127024 - RNA, 15 nt, Mycobacterium bovis subsp bovis AF2122/97
guuccacgaucaccc

SEQ ID NO: 1127025 - RNA, 23 nt, Mycobacterium bovis subsp bovis AF2122/97
guuccacgccggcaucgucgacg

SEQ ID NO: 1127026 - RNA, 20 nt, Mycobacterium bovis subsp bovis AF2122/97
guucaugcaaaagccgcgau

SEQ ID NO: 1127027 - RNA, 15 nt, Mycobacterium bovis subsp bovis AF2122/97
guucaugcggcggcg

SEQ ID NO: 1127028 - RNA, 19 nt, Mycobacterium bovis subsp bovis AF2122/97
guucaugcggcggcgcucg

SEQ ID NO: 1127029 - RNA, 15 nt, Mycobacterium bovis subsp bovis AF2122/97
guuccaccgggcguc

SEQ ID NO: 1127030 - RNA, 16 nt, Mycobacterium bovis subsp bovis AF2122/97
guuccaucgccgacgc

SEQ ID NO: 1127031 - RNA, 22 nt, Mycobacterium bovis subsp bovis AF2122/97
guuccaggucauauugcggugc

SEQ ID NO: 1127032 - RNA, 20 nt, Mycobacterium bovis subsp bovis AF2122/97
guuccccgucgccagggccu

SEQ ID NO: 1127033 - RNA, 19 nt, Mycobacterium bovis subsp bovis AF2122/97
guucccccggcaccgccgg

SEQ ID NO: 1127034 - RNA, 14 nt, Mycobacterium bovis subsp bovis AF2122/97
guuccauggcccgc

SEQ ID NO: 1127035 - RNA, 22 nt, Mycobacterium bovis subsp bovis AF2122/97
guucccaccaccaccgccggug

SEQ ID NO: 1127036 - RNA, 14 nt, Mycobacterium bovis subsp bovis AF2122/97
guucccgacgucgg

SEQ ID NO: 1127037 - RNA, 15 nt, Mycobacterium bovis subsp bovis AF2122/97
guucccgccggcacg

SEQ ID NO: 1127038 - RNA, 17 nt, Mycobacterium bovis subsp bovis AF2122/97
guucccgcucgggcaac

SEQ ID NO: 1127039 - RNA, 14 nt, Mycobacterium bovis subsp bovis AF2122/97
guuccgcaucggcc

SEQ ID NO: 1127040 - RNA, 15 nt, Mycobacterium bovis subsp bovis AF2122/97
guuccgcccagcgag

SEQ ID NO: 1127041 - RNA, 16 nt, Mycobacterium bovis subsp bovis AF2122/97
guuccgcccagcgagg

SEQ ID NO: 1127042 - RNA, 20 nt, Mycobacterium bovis subsp bovis AF2122/97
guucccuuguucccgaaacc

SEQ ID NO: 1127043 - RNA, 14 nt, Mycobacterium bovis subsp bovis AF2122/97
guucccucggcacg

SEQ ID NO: 1127044 - RNA, 21 nt, Mycobacterium bovis subsp bovis AF2122/97
guucccucggcacggucgccc

SEQ ID NO: 1127045 - RNA, 18 nt, Mycobacterium bovis subsp bovis AF2122/97
guuccgggguggacggcg

SEQ ID NO: 1127046 - RNA, 15 nt, Mycobacterium bovis subsp bovis AF2122/97
guuccggcugguggg

SEQ ID NO: 1127047 - RNA, 20 nt, Mycobacterium bovis subsp bovis AF2122/97
guuccggcuucguccaccgc

SEQ ID NO: 1127048 - RNA, 16 nt, Mycobacterium bovis subsp bovis AF2122/97
guuccguccccgacgu

SEQ ID NO: 1127049 - RNA, 19 nt, Mycobacterium bovis subsp bovis AF2122/97
guuccgggguggacggcga

SEQ ID NO: 1127050 - RNA, 15 nt, Mycobacterium bovis subsp bovis AF2122/97
guuccgcucgccguu

SEQ ID NO: 1127051 - RNA, 15 nt, Mycobacterium bovis subsp bovis AF2122/97
guuccgccggcccca

SEQ ID NO: 1127052 - RNA, 23 nt, Mycobacterium bovis subsp bovis AF2122/97
guuccgccggccccaccgguacc

SEQ ID NO: 1127053 - RNA, 18 nt, Mycobacterium bovis subsp bovis AF2122/97
guuccgcgacaaccacga

SEQ ID NO: 1127054 - RNA, 18 nt, Mycobacterium bovis subsp bovis AF2122/97
guuccggauccgaugaca

SEQ ID NO: 1127055 - RNA, 16 nt, Mycobacterium bovis subsp bovis AF2122/97
guuccuugcggccgcu

SEQ ID NO: 1127056 - RNA, 17 nt, Mycobacterium bovis subsp bovis AF2122/97
guuccuugugaccccgg

SEQ ID NO: 1127057 - RNA, 16 nt, Mycobacterium bovis subsp bovis AF2122/97
guucgaaagcaccgau

SEQ ID NO: 1127058 - RNA, 23 nt, Mycobacterium bovis subsp bovis AF2122/97
guuccucggugacuucacucguu

SEQ ID NO: 1127059 - RNA, 18 nt, Mycobacterium bovis subsp bovis AF2122/97
guuccucgaucgucgacg

SEQ ID NO: 1127060 - RNA, 19 nt, Mycobacterium bovis subsp bovis AF2122/97
guuccguugaugccgccgg

SEQ ID NO: 1127061 - RNA, 19 nt, Mycobacterium bovis subsp bovis AF2122/97
guguugcucccggccgccg

SEQ ID NO: 1127062 - RNA, 17 nt, Mycobacterium bovis subsp bovis AF2122/97
guguugcucgccgucgu

SEQ ID NO: 1127063 - RNA, 13 nt, Mycobacterium bovis subsp bovis AF2122/97
guguugccgccgg

SEQ ID NO: 1127064 - RNA, 19 nt, Mycobacterium bovis subsp bovis AF2122/97
guguugccggagacgucgc

SEQ ID NO: 1127065 - RNA, 15 nt, Mycobacterium bovis subsp bovis AF2122/97
guguugcacccgaau

SEQ ID NO: 1127066 - RNA, 22 nt, Mycobacterium bovis subsp bovis AF2122/97
guguuguugaagggggcgucgu

SEQ ID NO: 1127067 - RNA, 22 nt, Mycobacterium bovis subsp bovis AF2122/97
guguugggagccaccggcgucg

SEQ ID NO: 1127068 - RNA, 23 nt, Mycobacterium bovis subsp bovis AF2122/97
guguugggagccaccggcgucga

SEQ ID NO: 1127069 - RNA, 20 nt, Mycobacterium bovis subsp bovis AF2122/97
guuagaggauggucagcagc

SEQ ID NO: 1127070 - RNA, 19 nt, Mycobacterium bovis subsp bovis AF2122/97
guuagcauugaguucggcc

SEQ ID NO: 1127071 - RNA, 19 nt, Mycobacterium bovis subsp bovis AF2122/97
guuagccaggucgauaccg

SEQ ID NO: 1127072 - RNA, 17 nt, Mycobacterium bovis subsp bovis AF2122/97
guuagccccgcaggggg

SEQ ID NO: 1127073 - RNA, 15 nt, Mycobacterium bovis subsp bovis AF2122/97
guguuuggccgccga

SEQ ID NO: 1127074 - RNA, 20 nt, Mycobacterium bovis subsp bovis AF2122/97
guuagcuuagcugccgucgg

SEQ ID NO: 1127075 - RNA, 18 nt, Mycobacterium bovis subsp bovis AF2122/97
guuaggaguggccgggcg

SEQ ID NO: 1127076 - RNA, 22 nt, Mycobacterium bovis subsp bovis AF2122/97
guuagaucacccgcagccgcgc

SEQ ID NO: 1127077 - RNA, 16 nt, Mycobacterium bovis subsp bovis AF2122/97
guuaucagccgcgcgc

SEQ ID NO: 1127078 - RNA, 20 nt, Mycobacterium bovis subsp bovis AF2122/97
guuauccgaccacuccacgc

SEQ ID NO: 1127079 - RNA, 14 nt, Mycobacterium bovis subsp bovis AF2122/97
guuagucggccuga

SEQ ID NO: 1127080 - RNA, 15 nt, Mycobacterium bovis subsp bovis AF2122/97
guucacgcucguaga

SEQ ID NO: 1127081 - RNA, 16 nt, Mycobacterium bovis subsp bovis AF2122/97
guucacguucagccca

SEQ ID NO: 1127082 - RNA, 14 nt, Mycobacterium bovis subsp bovis AF2122/97
guucacgccgccgg

SEQ ID NO: 1127083 - RNA, 18 nt, Mycobacterium bovis subsp bovis AF2122/97
guucacgccgccggagau

SEQ ID NO: 1127084 - RNA, 14 nt, Mycobacterium bovis subsp bovis AF2122/97
guucaccgacgcga

SEQ ID NO: 1127085 - RNA, 17 nt, Mycobacterium bovis subsp bovis AF2122/97
guucaccgacgcgaacg

SEQ ID NO: 1127086 - RNA, 23 nt, Mycobacterium bovis subsp bovis AF2122/97
guucaccgacgcgaacgcggcca

SEQ ID NO: 1127087 - RNA, 20 nt, Mycobacterium bovis subsp bovis AF2122/97
guucaccgaggugccgcgca

SEQ ID NO: 1127088 - RNA, 16 nt, Mycobacterium bovis subsp bovis AF2122/97
guucaccgcgcgcucg

SEQ ID NO: 1127089 - RNA, 19 nt, Mycobacterium bovis subsp bovis AF2122/97
guucaccaugucggccacc

SEQ ID NO: 1127090 - RNA, 16 nt, Mycobacterium bovis subsp bovis AF2122/97
guuaugagcgcucggg

SEQ ID NO: 1127091 - RNA, 17 nt, Mycobacterium bovis subsp bovis AF2122/97
guucagcgcuggcaggc

SEQ ID NO: 1127092 - RNA, 15 nt, Mycobacterium bovis subsp bovis AF2122/97
guucagcgacggccg

SEQ ID NO: 1127093 - RNA, 19 nt, Mycobacterium bovis subsp bovis AF2122/97
guucagcccaugcccggcg

SEQ ID NO: 1127094 - RNA, 16 nt, Mycobacterium bovis subsp bovis AF2122/97
guucagcccgaacucg

SEQ ID NO: 1127095 - RNA, 20 nt, Mycobacterium bovis subsp bovis AF2122/97
guucagccacgcagcacggc

SEQ ID NO: 1127096 - RNA, 17 nt, Mycobacterium bovis subsp bovis AF2122/97
gugccaacugcgccguu

SEQ ID NO: 1127097 - RNA, 18 nt, Mycobacterium bovis subsp bovis AF2122/97
gugccaacugcgccguuc

SEQ ID NO: 1127098 - RNA, 18 nt, Mycobacterium bovis subsp bovis AF2122/97
gugccaaaggacgacacc

SEQ ID NO: 1127099 - RNA, 19 nt, Mycobacterium bovis subsp bovis AF2122/97
gugccaaaggacgacaccg

SEQ ID NO: 1127100 - RNA, 22 nt, Mycobacterium bovis subsp bovis AF2122/97
gugccaaaggacgacaccgcga

SEQ ID NO: 1127101 - RNA, 17 nt, Mycobacterium bovis subsp bovis AF2122/97
gugccaaaugaugacga

SEQ ID NO: 1127102 - RNA, 15 nt, Mycobacterium bovis subsp bovis AF2122/97
gugcaugcaugccgg

SEQ ID NO: 1127103 - RNA, 15 nt, Mycobacterium bovis subsp bovis AF2122/97
gugcaggaucggcuu

SEQ ID NO: 1127104 - RNA, 19 nt, Mycobacterium bovis subsp bovis AF2122/97
gugcaggauucggcggucg

SEQ ID NO: 1127105 - RNA, 20 nt, Mycobacterium bovis subsp bovis AF2122/97
gugcaggauucggcggucgc

SEQ ID NO: 1127106 - RNA, 12 nt, Mycobacterium bovis subsp bovis AF2122/97
gugcaucgacuc

SEQ ID NO: 1127107 - RNA, 18 nt, Mycobacterium bovis subsp bovis AF2122/97
gugcaucgaucaccgcuu

SEQ ID NO: 1127108 - RNA, 16 nt, Mycobacterium bovis subsp bovis AF2122/97
gugcaucgccaccacc

SEQ ID NO: 1127109 - RNA, 21 nt, Mycobacterium bovis subsp bovis AF2122/97
gugcaucgccaccaccggaac

SEQ ID NO: 1127110 - RNA, 14 nt, Mycobacterium bovis subsp bovis AF2122/97
gugcaggaucggcu

SEQ ID NO: 1127111 - RNA, 24 nt, Mycobacterium bovis subsp bovis AF2122/97
gugcacccgggccgccucgaucga

SEQ ID NO: 1127112 - RNA, 22 nt, Mycobacterium bovis subsp bovis AF2122/97
gugcaggaccagcaccgccgcg

SEQ ID NO: 1127113 - RNA, 20 nt, Mycobacterium bovis subsp bovis AF2122/97
gugcagcgugggcagcgcga

SEQ ID NO: 1127114 - RNA, 20 nt, Mycobacterium bovis subsp bovis AF2122/97
gugcagcucggucagcguca

SEQ ID NO: 1127115 - RNA, 20 nt, Mycobacterium bovis subsp bovis AF2122/97
gugcccgcaccguagccgcu

SEQ ID NO: 1127116 - RNA, 17 nt, Mycobacterium bovis subsp bovis AF2122/97
gugcccgcacugccgcc

SEQ ID NO: 1127117 - RNA, 22 nt, Mycobacterium bovis subsp bovis AF2122/97
gugcccaaggccaggaucuccc

SEQ ID NO: 1127118 - RNA, 17 nt, Mycobacterium bovis subsp bovis AF2122/97
gugccaucuacaucguc

SEQ ID NO: 1127119 - RNA, 14 nt, Mycobacterium bovis subsp bovis AF2122/97
gugccaucgguggu

SEQ ID NO: 1127120 - RNA, 14 nt, Mycobacterium bovis subsp bovis AF2122/97
gugcaucggcgacc

SEQ ID NO: 1127121 - RNA, 13 nt, Mycobacterium bovis subsp bovis AF2122/97
gugcagcggcggg

SEQ ID NO: 1127122 - RNA, 15 nt, Mycobacterium bovis subsp bovis AF2122/97
gugcagcggcgggcg

SEQ ID NO: 1127123 - RNA, 20 nt, Mycobacterium bovis subsp bovis AF2122/97
gugcacgacgacaucgagcc

SEQ ID NO: 1127124 - RNA, 21 nt, Mycobacterium bovis subsp bovis AF2122/97
gugcacgacgacaucgagcca

SEQ ID NO: 1127125 - RNA, 14 nt, Mycobacterium bovis subsp bovis AF2122/97
gugcagcccgccgg

SEQ ID NO: 1127126 - RNA, 18 nt, Mycobacterium bovis subsp bovis AF2122/97
gugcaccgaagauggcca

SEQ ID NO: 1127127 - RNA, 20 nt, Mycobacterium bovis subsp bovis AF2122/97
gugcacccgggccgccucga

SEQ ID NO: 1127128 - RNA, 23 nt, Mycobacterium bovis subsp bovis AF2122/97
gugauauccgugaauggcagcac

SEQ ID NO: 1127129 - RNA, 16 nt, Mycobacterium bovis subsp bovis AF2122/97
gugcacaccgucgcac

SEQ ID NO: 1127130 - RNA, 20 nt, Mycobacterium bovis subsp bovis AF2122/97
gugcacaccgucgcgcucgc

SEQ ID NO: 1127131 - RNA, 22 nt, Mycobacterium bovis subsp bovis AF2122/97
gugauagaggauaucgccgaga

SEQ ID NO: 1127132 - RNA, 14 nt, Mycobacterium bovis subsp bovis AF2122/97
gugagguggucagc

SEQ ID NO: 1127133 - RNA, 17 nt, Mycobacterium bovis subsp bovis AF2122/97
gugagggucccacggcg

SEQ ID NO: 1127134 - RNA, 12 nt, Mycobacterium bovis subsp bovis AF2122/97
gugaguucggcg

SEQ ID NO: 1127135 - RNA, 21 nt, Mycobacterium bovis subsp bovis AF2122/97
gugaguggcucgcucugcgcg

SEQ ID NO: 1127136 - RNA, 17 nt, Mycobacterium bovis subsp bovis AF2122/97
gugagguagucggcgcg

SEQ ID NO: 1127137 - RNA, 20 nt, Mycobacterium bovis subsp bovis AF2122/97
gugaggugaccaacggugcu

SEQ ID NO: 1127138 - RNA, 15 nt, Mycobacterium bovis subsp bovis AF2122/97
gugagucccacgcca

SEQ ID NO: 1127139 - RNA, 18 nt, Mycobacterium bovis subsp bovis AF2122/97
gugagucccacgccagcg

SEQ ID NO: 1127140 - RNA, 18 nt, Mycobacterium bovis subsp bovis AF2122/97
gugccgcccgcgccuccg

SEQ ID NO: 1127141 - RNA, 15 nt, Mycobacterium bovis subsp bovis AF2122/97
gugccgccaucgccg

SEQ ID NO: 1127142 - RNA, 16 nt, Mycobacterium bovis subsp bovis AF2122/97
gugccgcccccggcac

SEQ ID NO: 1127143 - RNA, 11 nt, Mycobacterium bovis subsp bovis AF2122/97
gugccgcccgc

SEQ ID NO: 1127144 - RNA, 18 nt, Mycobacterium bovis subsp bovis AF2122/97
gugccgcccgcgccgccc

SEQ ID NO: 1127145 - RNA, 19 nt, Mycobacterium bovis subsp bovis AF2122/97
gugccgcccgcgccgccgc

SEQ ID NO: 1127146 - RNA, 21 nt, Mycobacterium bovis subsp bovis AF2122/97
gugccgcccgcgccgccgcua

SEQ ID NO: 1127147 - RNA, 16 nt, Mycobacterium bovis subsp bovis AF2122/97
gugccgccaccaccgg

SEQ ID NO: 1127148 - RNA, 17 nt, Mycobacterium bovis subsp bovis AF2122/97
gugccgccaccaccggc

SEQ ID NO: 1127149 - RNA, 12 nt, Mycobacterium bovis subsp bovis AF2122/97
gugccgccaccg

SEQ ID NO: 1127150 - RNA, 20 nt, Mycobacterium bovis subsp bovis AF2122/97
gugccgccaccgccaccgcg

SEQ ID NO: 1127151 - RNA, 22 nt, Mycobacterium bovis subsp bovis AF2122/97
gugccgccaccgccaccgcggc

SEQ ID NO: 1127152 - RNA, 14 nt, Mycobacterium bovis subsp bovis AF2122/97
gugccgccaccggc

SEQ ID NO: 1127153 - RNA, 15 nt, Mycobacterium bovis subsp bovis AF2122/97
gugccgccaccggcg

SEQ ID NO: 1127154 - RNA, 13 nt, Mycobacterium bovis subsp bovis AF2122/97
gugccgccagcaa

SEQ ID NO: 1127155 - RNA, 18 nt, Mycobacterium bovis subsp bovis AF2122/97
gugccgccaucgccgccg

SEQ ID NO: 1127156 - RNA, 19 nt, Mycobacterium bovis subsp bovis AF2122/97
gugccgccaucgccgccgg

SEQ ID NO: 1127157 - RNA, 22 nt, Mycobacterium bovis subsp bovis AF2122/97
gugccgccaucgccgccggugc

SEQ ID NO: 1127158 - RNA, 17 nt, Mycobacterium bovis subsp bovis AF2122/97
gugccgcacgauggccg

SEQ ID NO: 1127159 - RNA, 20 nt, Mycobacterium bovis subsp bovis AF2122/97
gugccgcacgauggccgucg

SEQ ID NO: 1127160 - RNA, 21 nt, Mycobacterium bovis subsp bovis AF2122/97
gugccgcacgauggccgucga

SEQ ID NO: 1127161 - RNA, 16 nt, Mycobacterium bovis subsp bovis AF2122/97
gugccgcaccgccugc

SEQ ID NO: 1127162 - RNA, 22 nt, Mycobacterium bovis subsp bovis AF2122/97
gugccgcaccgccugcucggcg

SEQ ID NO: 1127163 - RNA, 14 nt, Mycobacterium bovis subsp bovis AF2122/97
gugccgaugaccga

SEQ ID NO: 1127164 - RNA, 15 nt, Mycobacterium bovis subsp bovis AF2122/97
gugccgcaaccggcg

SEQ ID NO: 1127165 - RNA, 19 nt, Mycobacterium bovis subsp bovis AF2122/97
gugccgcaagccucguggu

SEQ ID NO: 1127166 - RNA, 16 nt, Mycobacterium bovis subsp bovis AF2122/97
gugccgaugccggcga

SEQ ID NO: 1127167 - RNA, 16 nt, Mycobacterium bovis subsp bovis AF2122/97
gugccgcagcggcggc

SEQ ID NO: 1127168 - RNA, 14 nt, Mycobacterium bovis subsp bovis AF2122/97
gugccgccaccacc

SEQ ID NO: 1127169 - RNA, 15 nt, Mycobacterium bovis subsp bovis AF2122/97
gugccgccaccaccg

SEQ ID NO: 1127170 - RNA, 19 nt, Mycobacterium bovis subsp bovis AF2122/97
gugcccguauaaccggcca

SEQ ID NO: 1127171 - RNA, 17 nt, Mycobacterium bovis subsp bovis AF2122/97
gugcccggcggccaacg

SEQ ID NO: 1127172 - RNA, 13 nt, Mycobacterium bovis subsp bovis AF2122/97
gugcccgggcguc

SEQ ID NO: 1127173 - RNA, 14 nt, Mycobacterium bovis subsp bovis AF2122/97
gugccgagaugccg

SEQ ID NO: 1127174 - RNA, 19 nt, Mycobacterium bovis subsp bovis AF2122/97
gugccgagaugccggcgag

SEQ ID NO: 1127175 - RNA, 21 nt, Mycobacterium bovis subsp bovis AF2122/97
gugccgagcacucggccacga

SEQ ID NO: 1127176 - RNA, 13 nt, Mycobacterium bovis subsp bovis AF2122/97
gugccgaucagca

SEQ ID NO: 1127177 - RNA, 16 nt, Mycobacterium bovis subsp bovis AF2122/97
gugccgagcuggcgac

SEQ ID NO: 1127178 - RNA, 14 nt, Mycobacterium bovis subsp bovis AF2122/97
gugcccggccgcca

SEQ ID NO: 1127179 - RNA, 21 nt, Mycobacterium bovis subsp bovis AF2122/97
gugcccggccgccagcgcgcc

SEQ ID NO: 1127180 - RNA, 17 nt, Mycobacterium bovis subsp bovis AF2122/97
gugcccggccaaccacc

SEQ ID NO: 1127181 - RNA, 12 nt, Mycobacterium bovis subsp bovis AF2122/97
gugcccgccugg

SEQ ID NO: 1127182 - RNA, 13 nt, Mycobacterium bovis subsp bovis AF2122/97
gugcccggcggcc

SEQ ID NO: 1127183 - RNA, 14 nt, Mycobacterium bovis subsp bovis AF2122/97
gugcccggcggcca

SEQ ID NO: 1127184 - RNA, 15 nt, Mycobacterium bovis subsp bovis AF2122/97
gugcccggcggccaa

SEQ ID NO: 1127185 - RNA, 12 nt, Mycobacterium bovis subsp bovis AF2122/97
gugcccgccggc

SEQ ID NO: 1127186 - RNA, 13 nt, Mycobacterium bovis subsp bovis AF2122/97
gugcccgccccga

SEQ ID NO: 1127187 - RNA, 19 nt, Mycobacterium bovis subsp bovis AF2122/97
gugcccgcacugccgccgg

SEQ ID NO: 1127188 - RNA, 21 nt, Mycobacterium bovis subsp bovis AF2122/97
gugcccgcacugccgccgguu

SEQ ID NO: 1127189 - RNA, 12 nt, Mycobacterium bovis subsp bovis AF2122/97
gugcccgccacc

SEQ ID NO: 1127190 - RNA, 18 nt, Mycobacterium bovis subsp bovis AF2122/97
gugcccgccaccggcgcg

SEQ ID NO: 1127191 - RNA, 21 nt, Mycobacterium bovis subsp bovis AF2122/97
gugccgucagcggcggccacg

SEQ ID NO: 1127192 - RNA, 16 nt, Mycobacterium bovis subsp bovis AF2122/97
gugccggggccccaug

SEQ ID NO: 1127193 - RNA, 21 nt, Mycobacterium bovis subsp bovis AF2122/97
gugccggggauaucacgacgc

SEQ ID NO: 1127194 - RNA, 23 nt, Mycobacterium bovis subsp bovis AF2122/97
gugccgguaugcgccaucucgac

SEQ ID NO: 1127195 - RNA, 19 nt, Mycobacterium bovis subsp bovis AF2122/97
gugccggucaccucgccgg

SEQ ID NO: 1127196 - RNA, 15 nt, Mycobacterium bovis subsp bovis AF2122/97
gugccgggucaccga

SEQ ID NO: 1127197 - RNA, 20 nt, Mycobacterium bovis subsp bovis AF2122/97
gugccggugauggccgacca

SEQ ID NO: 1127198 - RNA, 15 nt, Mycobacterium bovis subsp bovis AF2122/97
gugccgguggugacg

SEQ ID NO: 1127199 - RNA, 18 nt, Mycobacterium bovis subsp bovis AF2122/97
gugccgguggugacggcg

SEQ ID NO: 1127200 - RNA, 13 nt, Mycobacterium bovis subsp bovis AF2122/97
gugccguacgccc

SEQ ID NO: 1127201 - RNA, 21 nt, Mycobacterium bovis subsp bovis AF2122/97
gugccgucaacgaugguggcg

SEQ ID NO: 1127202 - RNA, 18 nt, Mycobacterium bovis subsp bovis AF2122/97
gugccgcccuggacgucg

SEQ ID NO: 1127203 - RNA, 22 nt, Mycobacterium bovis subsp bovis AF2122/97
gugccgcccuggacgucggcga

SEQ ID NO: 1127204 - RNA, 14 nt, Mycobacterium bovis subsp bovis AF2122/97
gugccgccgacacc

SEQ ID NO: 1127205 - RNA, 21 nt, Mycobacterium bovis subsp bovis AF2122/97
gugccgccgacaccaccggcg

SEQ ID NO: 1127206 - RNA, 22 nt, Mycobacterium bovis subsp bovis AF2122/97
gugccgccgacaccaccggcgc

SEQ ID NO: 1127207 - RNA, 20 nt, Mycobacterium bovis subsp bovis AF2122/97
gugccgccgccggcgccgga

SEQ ID NO: 1127208 - RNA, 22 nt, Mycobacterium bovis subsp bovis AF2122/97
gugccgccgcggccaccaccgc

SEQ ID NO: 1127209 - RNA, 13 nt, Mycobacterium bovis subsp bovis AF2122/97
gugccgccggcca

SEQ ID NO: 1127210 - RNA, 19 nt, Mycobacterium bovis subsp bovis AF2122/97
gugccgccgauaccgccgg

SEQ ID NO: 1127211 - RNA, 13 nt, Mycobacterium bovis subsp bovis AF2122/97
gugccgccggcgc

SEQ ID NO: 1127212 - RNA, 20 nt, Mycobacterium bovis subsp bovis AF2122/97
gugccgccgauaccgccggc

SEQ ID NO: 1127213 - RNA, 12 nt, Mycobacterium bovis subsp bovis AF2122/97
gugccgccgaug

SEQ ID NO: 1127214 - RNA, 15 nt, Mycobacterium bovis subsp bovis AF2122/97
gugccgcccggucgg

SEQ ID NO: 1127215 - RNA, 20 nt, Mycobacterium bovis subsp bovis AF2122/97
gugccgccggccaguccgcg

SEQ ID NO: 1127216 - RNA, 19 nt, Mycobacterium bovis subsp bovis AF2122/97
gugccgccuccgccugccc

SEQ ID NO: 1127217 - RNA, 17 nt, Mycobacterium bovis subsp bovis AF2122/97
gugccgccugcgccgcc

SEQ ID NO: 1127218 - RNA, 14 nt, Mycobacterium bovis subsp bovis AF2122/97
gugccgccggcgcc

SEQ ID NO: 1127219 - RNA, 21 nt, Mycobacterium bovis subsp bovis AF2122/97
gugccgccggcgccacccgcg

SEQ ID NO: 1127220 - RNA, 15 nt, Mycobacterium bovis subsp bovis AF2122/97
gugccgccgucgccg

SEQ ID NO: 1127221 - RNA, 13 nt, Mycobacterium bovis subsp bovis AF2122/97
gugccgcgaucgc

SEQ ID NO: 1127222 - RNA, 14 nt, Mycobacterium bovis subsp bovis AF2122/97
gugccgggcgaugc

SEQ ID NO: 1127223 - RNA, 20 nt, Mycobacterium bovis subsp bovis AF2122/97
gugccgggcaccaccacacc

SEQ ID NO: 1127224 - RNA, 14 nt, Mycobacterium bovis subsp bovis AF2122/97
gugccgcggccacc

SEQ ID NO: 1127225 - RNA, 15 nt, Mycobacterium bovis subsp bovis AF2122/97
gugccgcggccaccg

SEQ ID NO: 1127226 - RNA, 21 nt, Mycobacterium bovis subsp bovis AF2122/97
gugccgcggccaccgccgccg

SEQ ID NO: 1127227 - RNA, 21 nt, Mycobacterium bovis subsp bovis AF2122/97
gugccgggaugccgccgcuga

SEQ ID NO: 1127228 - RNA, 17 nt, Mycobacterium bovis subsp bovis AF2122/97
gugcggugucacaacgc

SEQ ID NO: 1127229 - RNA, 17 nt, Mycobacterium bovis subsp bovis AF2122/97
gugcgggcuucaacaca

SEQ ID NO: 1127230 - RNA, 14 nt, Mycobacterium bovis subsp bovis AF2122/97
gugcgggcggcguc

SEQ ID NO: 1127231 - RNA, 12 nt, Mycobacterium bovis subsp bovis AF2122/97
gugcgggcggug

SEQ ID NO: 1127232 - RNA, 13 nt, Mycobacterium bovis subsp bovis AF2122/97
gugcgggcgcacc

SEQ ID NO: 1127233 - RNA, 13 nt, Mycobacterium bovis subsp bovis AF2122/97
gugcgguugcgcg

SEQ ID NO: 1127234 - RNA, 17 nt, Mycobacterium bovis subsp bovis AF2122/97
gugcgguuggaucggcg

SEQ ID NO: 1127235 - RNA, 22 nt, Mycobacterium bovis subsp bovis AF2122/97
gugcgguucucguagucaacca

SEQ ID NO: 1127236 - RNA, 18 nt, Mycobacterium bovis subsp bovis AF2122/97
gugcgguuucaccgacga

SEQ ID NO: 1127237 - RNA, 21 nt, Mycobacterium bovis subsp bovis AF2122/97
gugcgguuucaccgacgacgc

SEQ ID NO: 1127238 - RNA, 21 nt, Mycobacterium bovis subsp bovis AF2122/97
gugcgugaacaagauucgcuc

SEQ ID NO: 1127239 - RNA, 13 nt, Mycobacterium bovis subsp bovis AF2122/97
gugcgucgcggaa

SEQ ID NO: 1127240 - RNA, 22 nt, Mycobacterium bovis subsp bovis AF2122/97
gugcgucugggcaucaucgacg

SEQ ID NO: 1127241 - RNA, 14 nt, Mycobacterium bovis subsp bovis AF2122/97
gugcgucucggugg

SEQ ID NO: 1127242 - RNA, 14 nt, Mycobacterium bovis subsp bovis AF2122/97
gugcgucgaugagc

SEQ ID NO: 1127243 - RNA, 18 nt, Mycobacterium bovis subsp bovis AF2122/97
gugcgucgauggcgucgg

SEQ ID NO: 1127244 - RNA, 19 nt, Mycobacterium bovis subsp bovis AF2122/97
gugcgucgauggcgucggu

SEQ ID NO: 1127245 - RNA, 15 nt, Mycobacterium bovis subsp bovis AF2122/97
gugcguccaggccag

SEQ ID NO: 1127246 - RNA, 16 nt, Mycobacterium bovis subsp bovis AF2122/97
gugcguccggugcugg

SEQ ID NO: 1127247 - RNA, 11 nt, Mycobacterium bovis subsp bovis AF2122/97
gugcggcggca

SEQ ID NO: 1127248 - RNA, 16 nt, Mycobacterium bovis subsp bovis AF2122/97
gugcggcggccucggg

SEQ ID NO: 1127249 - RNA, 13 nt, Mycobacterium bovis subsp bovis AF2122/97
gugcggcucgccg

SEQ ID NO: 1127250 - RNA, 16 nt, Mycobacterium bovis subsp bovis AF2122/97
gugcggcucgccggcg

SEQ ID NO: 1127251 - RNA, 17 nt, Mycobacterium bovis subsp bovis AF2122/97
gugcggcucgccggcgg

SEQ ID NO: 1127252 - RNA, 16 nt, Mycobacterium bovis subsp bovis AF2122/97
gugcggcggcguccgg

SEQ ID NO: 1127253 - RNA, 17 nt, Mycobacterium bovis subsp bovis AF2122/97
gugcggcugcaccggcu

SEQ ID NO: 1127254 - RNA, 15 nt, Mycobacterium bovis subsp bovis AF2122/97
gugcgggacgccgaa

SEQ ID NO: 1127255 - RNA, 20 nt, Mycobacterium bovis subsp bovis AF2122/97
gugcggccgggucgcgcugg

SEQ ID NO: 1127256 - RNA, 14 nt, Mycobacterium bovis subsp bovis AF2122/97
gugcggccguggcg

SEQ ID NO: 1127257 - RNA, 14 nt, Mycobacterium bovis subsp bovis AF2122/97
gugcggccgacggg

SEQ ID NO: 1127258 - RNA, 20 nt, Mycobacterium bovis subsp bovis AF2122/97
gugcggccaaugacgucgga

SEQ ID NO: 1127259 - RNA, 17 nt, Mycobacterium bovis subsp bovis AF2122/97
gugcggccacucgcccg

SEQ ID NO: 1127260 - RNA, 22 nt, Mycobacterium bovis subsp bovis AF2122/97
gugcggccccgacauacgucgg

SEQ ID NO: 1127261 - RNA, 13 nt, Mycobacterium bovis subsp bovis AF2122/97
gugcggcagcccg

SEQ ID NO: 1127262 - RNA, 20 nt, Mycobacterium bovis subsp bovis AF2122/97
gugcggcagauacucggcga

SEQ ID NO: 1127263 - RNA, 21 nt, Mycobacterium bovis subsp bovis AF2122/97
gugcgccagcgauaucggcgg

SEQ ID NO: 1127264 - RNA, 22 nt, Mycobacterium bovis subsp bovis AF2122/97
gugcgccagcgauaucggcggc

SEQ ID NO: 1127265 - RNA, 15 nt, Mycobacterium bovis subsp bovis AF2122/97
gugcgcaaggccgcg

SEQ ID NO: 1127266 - RNA, 22 nt, Mycobacterium bovis subsp bovis AF2122/97
gugcgcaacccagccgcgccag

SEQ ID NO: 1127267 - RNA, 17 nt, Mycobacterium bovis subsp bovis AF2122/97
gugcgcccaggugaucg

SEQ ID NO: 1127268 - RNA, 20 nt, Mycobacterium bovis subsp bovis AF2122/97
gugcgcccgacggaguucga

SEQ ID NO: 1127269 - RNA, 19 nt, Mycobacterium bovis subsp bovis AF2122/97
gugcgcccggccaagccgg

SEQ ID NO: 1127270 - RNA, 23 nt, Mycobacterium bovis subsp bovis AF2122/97
gugcgcccggccaagccggcgag

SEQ ID NO: 1127271 - RNA, 18 nt, Mycobacterium bovis subsp bovis AF2122/97
gugcggaacaccgcccgg

SEQ ID NO: 1127272 - RNA, 20 nt, Mycobacterium bovis subsp bovis AF2122/97
gugcggaacaccgcccggcc

SEQ ID NO: 1127273 - RNA, 16 nt, Mycobacterium bovis subsp bovis AF2122/97
gugcggcaacagcgcc

SEQ ID NO: 1127274 - RNA, 22 nt, Mycobacterium bovis subsp bovis AF2122/97
gugcgaucgcaacaccgguguc

SEQ ID NO: 1127275 - RNA, 13 nt, Mycobacterium bovis subsp bovis AF2122/97
gugcgaucggugc

SEQ ID NO: 1127276 - RNA, 18 nt, Mycobacterium bovis subsp bovis AF2122/97
gugcgagcugcgggucgc

SEQ ID NO: 1127277 - RNA, 19 nt, Mycobacterium bovis subsp bovis AF2122/97
gugcgauuccgcgucugcu

SEQ ID NO: 1127278 - RNA, 20 nt, Mycobacterium bovis subsp bovis AF2122/97
gugcgauuccgcgucugcuc

SEQ ID NO: 1127279 - RNA, 19 nt, Mycobacterium bovis subsp bovis AF2122/97
gugcgauucugcgucugcu

SEQ ID NO: 1127280 - RNA, 20 nt, Mycobacterium bovis subsp bovis AF2122/97
gugcgauucugcgucugcuc

SEQ ID NO: 1127281 - RNA, 19 nt, Mycobacterium bovis subsp bovis AF2122/97
gugcgauucugugucugcu

SEQ ID NO: 1127282 - RNA, 20 nt, Mycobacterium bovis subsp bovis AF2122/97
gugcgauucugugucugcuc

SEQ ID NO: 1127283 - RNA, 21 nt, Mycobacterium bovis subsp bovis AF2122/97
gugcgauuuugugucugcucg

SEQ ID NO: 1127284 - RNA, 15 nt, Mycobacterium bovis subsp bovis AF2122/97
gugcgaagguaacga

SEQ ID NO: 1127285 - RNA, 15 nt, Mycobacterium bovis subsp bovis AF2122/97
gugcgagcgacaccg

SEQ ID NO: 1127286 - RNA, 21 nt, Mycobacterium bovis subsp bovis AF2122/97
gugcgacguaaagggcgucgu

SEQ ID NO: 1127287 - RNA, 19 nt, Mycobacterium bovis subsp bovis AF2122/97
gugcgacaacacgaccucu

SEQ ID NO: 1127288 - RNA, 16 nt, Mycobacterium bovis subsp bovis AF2122/97
gugcgacccgggcguc

SEQ ID NO: 1127289 - RNA, 15 nt, Mycobacterium bovis subsp bovis AF2122/97
gugcgacgacggcgc

SEQ ID NO: 1127290 - RNA, 20 nt, Mycobacterium bovis subsp bovis AF2122/97
gugcgacaacacgaccucuu

SEQ ID NO: 1127291 - RNA, 22 nt, Mycobacterium bovis subsp bovis AF2122/97
guggacacggcgcugcccacgc

SEQ ID NO: 1127292 - RNA, 17 nt, Mycobacterium bovis subsp bovis AF2122/97
guggacagaaucgaccg

SEQ ID NO: 1127293 - RNA, 19 nt, Mycobacterium bovis subsp bovis AF2122/97
guggacgcagagucaacga

SEQ ID NO: 1127294 - RNA, 15 nt, Mycobacterium bovis subsp bovis AF2122/97
guggacgaggcgguc

SEQ ID NO: 1127295 - RNA, 14 nt, Mycobacterium bovis subsp bovis AF2122/97
guggaccgccgauc

SEQ ID NO: 1127296 - RNA, 17 nt, Mycobacterium bovis subsp bovis AF2122/97
guggacgaccgcgcggc

SEQ ID NO: 1127297 - RNA, 16 nt, Mycobacterium bovis subsp bovis AF2122/97
guggagccggccguga

SEQ ID NO: 1127298 - RNA, 22 nt, Mycobacterium bovis subsp bovis AF2122/97
guggacuucagcaggcccagcg

SEQ ID NO: 1127299 - RNA, 17 nt, Mycobacterium bovis subsp bovis AF2122/97
guggacgugucaucacg

SEQ ID NO: 1127300 - RNA, 18 nt, Mycobacterium bovis subsp bovis AF2122/97
guggacggcaggcggccg

SEQ ID NO: 1127301 - RNA, 22 nt, Mycobacterium bovis subsp bovis AF2122/97
guggacagaaucgaccgccgcu

SEQ ID NO: 1127302 - RNA, 23 nt, Mycobacterium bovis subsp bovis AF2122/97
guggacgcccgcccgcacgacga

SEQ ID NO: 1127303 - RNA, 15 nt, Mycobacterium bovis subsp bovis AF2122/97
guggaggcccgucac

SEQ ID NO: 1127304 - RNA, 14 nt, Mycobacterium bovis subsp bovis AF2122/97
guggagaucuccuc

SEQ ID NO: 1127305 - RNA, 13 nt, Mycobacterium bovis subsp bovis AF2122/97
guggagcggcgcg

SEQ ID NO: 1127306 - RNA, 16 nt, Mycobacterium bovis subsp bovis AF2122/97
guggagcucgcggcgc

SEQ ID NO: 1127307 - RNA, 18 nt, Mycobacterium bovis subsp bovis AF2122/97
guggaggaaucguucggg

SEQ ID NO: 1127308 - RNA, 16 nt, Mycobacterium bovis subsp bovis AF2122/97
guggaucuggcgcagc

SEQ ID NO: 1127309 - RNA, 18 nt, Mycobacterium bovis subsp bovis AF2122/97
guggaucuggcgcagcau

SEQ ID NO: 1127310 - RNA, 19 nt, Mycobacterium bovis subsp bovis AF2122/97
guggaugccgacggcgggc

SEQ ID NO: 1127311 - RNA, 16 nt, Mycobacterium bovis subsp bovis AF2122/97
guggaucuuggccagc

SEQ ID NO: 1127312 - RNA, 15 nt, Mycobacterium bovis subsp bovis AF2122/97
guggaugucgcgguc

SEQ ID NO: 1127313 - RNA, 18 nt, Mycobacterium bovis subsp bovis AF2122/97
guggaucauguucggcca

SEQ ID NO: 1127314 - RNA, 19 nt, Mycobacterium bovis subsp bovis AF2122/97
guggaucauguucggccac

SEQ ID NO: 1127315 - RNA, 15 nt, Mycobacterium bovis subsp bovis AF2122/97
guggauccggcagca

SEQ ID NO: 1127316 - RNA, 20 nt, Mycobacterium bovis subsp bovis AF2122/97
guggauccggcagcagccgg

SEQ ID NO: 1127317 - RNA, 19 nt, Mycobacterium bovis subsp bovis AF2122/97
guggacguacugucgucgc

SEQ ID NO: 1127318 - RNA, 18 nt, Mycobacterium bovis subsp bovis AF2122/97
guggaguacggcgaugcg

SEQ ID NO: 1127319 - RNA, 15 nt, Mycobacterium bovis subsp bovis AF2122/97
guggaucauguucgg

SEQ ID NO: 1127320 - RNA, 23 nt, Mycobacterium bovis subsp bovis AF2122/97
guggauugugucccauggugagc

SEQ ID NO: 1127321 - RNA, 15 nt, Mycobacterium bovis subsp bovis AF2122/97
guggcacacccgcac

SEQ ID NO: 1127322 - RNA, 22 nt, Mycobacterium bovis subsp bovis AF2122/97
guggcaacggaggugccggcgc

SEQ ID NO: 1127323 - RNA, 13 nt, Mycobacterium bovis subsp bovis AF2122/97
guggcaacgguac

SEQ ID NO: 1127324 - RNA, 15 nt, Mycobacterium bovis subsp bovis AF2122/97
guggcaaccgcaccg

SEQ ID NO: 1127325 - RNA, 23 nt, Mycobacterium bovis subsp bovis AF2122/97
guggacaaaucgaugaccgucgc

SEQ ID NO: 1127326 - RNA, 16 nt, Mycobacterium bovis subsp bovis AF2122/97
guggacaagcacagcg

SEQ ID NO: 1127327 - RNA, 15 nt, Mycobacterium bovis subsp bovis AF2122/97
guggaauacgcugcu

SEQ ID NO: 1127328 - RNA, 20 nt, Mycobacterium bovis subsp bovis AF2122/97
guggaauacgcugcuggucu

SEQ ID NO: 1127329 - RNA, 16 nt, Mycobacterium bovis subsp bovis AF2122/97
guggaauccaccagcc

SEQ ID NO: 1127330 - RNA, 21 nt, Mycobacterium bovis subsp bovis AF2122/97
guggaauggaccagcgccccg

SEQ ID NO: 1127331 - RNA, 15 nt, Mycobacterium bovis subsp bovis AF2122/97
guggaauggcgccgg

SEQ ID NO: 1127332 - RNA, 18 nt, Mycobacterium bovis subsp bovis AF2122/97
guggaacuccguccgccg

SEQ ID NO: 1127333 - RNA, 15 nt, Mycobacterium bovis subsp bovis AF2122/97
guggaagcccgucgc

SEQ ID NO: 1127334 - RNA, 16 nt, Mycobacterium bovis subsp bovis AF2122/97
guggaagcccgucgcg

SEQ ID NO: 1127335 - RNA, 17 nt, Mycobacterium bovis subsp bovis AF2122/97
guggaagcccgucgcgg

SEQ ID NO: 1127336 - RNA, 13 nt, Mycobacterium bovis subsp bovis AF2122/97
guggaaccuggcg

SEQ ID NO: 1127337 - RNA, 21 nt, Mycobacterium bovis subsp bovis AF2122/97
guggaaguacuucgcggcggu

SEQ ID NO: 1127338 - RNA, 11 nt, Mycobacterium bovis subsp bovis AF2122/97
guggaacaugu

SEQ ID NO: 1127339 - RNA, 19 nt, Mycobacterium bovis subsp bovis AF2122/97
gugcuuuggguccgggcgg

SEQ ID NO: 1127340 - RNA, 21 nt, Mycobacterium bovis subsp bovis AF2122/97
guggaaaccggugguagcgac

SEQ ID NO: 1127341 - RNA, 17 nt, Mycobacterium bovis subsp bovis AF2122/97
guggaacaccgcggcaa

SEQ ID NO: 1127342 - RNA, 12 nt, Mycobacterium bovis subsp bovis AF2122/97
gugcucgccgga

SEQ ID NO: 1127343 - RNA, 18 nt, Mycobacterium bovis subsp bovis AF2122/97
gugcuuccauucgcgguc

SEQ ID NO: 1127344 - RNA, 14 nt, Mycobacterium bovis subsp bovis AF2122/97
gugcucggugacgu

SEQ ID NO: 1127345 - RNA, 18 nt, Mycobacterium bovis subsp bovis AF2122/97
gugcucgccgggucagcc

SEQ ID NO: 1127346 - RNA, 17 nt, Mycobacterium bovis subsp bovis AF2122/97
gugcucgccgaccagcu

SEQ ID NO: 1127347 - RNA, 21 nt, Mycobacterium bovis subsp bovis AF2122/97
gugcucgcaaucguuggccau

SEQ ID NO: 1127348 - RNA, 19 nt, Mycobacterium bovis subsp bovis AF2122/97
gugcucgaugcgaucgacg

SEQ ID NO: 1127349 - RNA, 15 nt, Mycobacterium bovis subsp bovis AF2122/97
gugcucgacgcgcau

SEQ ID NO: 1127350 - RNA, 21 nt, Mycobacterium bovis subsp bovis AF2122/97
guugccgaaccacgcgcccgc

SEQ ID NO: 1127351 - RNA, 23 nt, Mycobacterium bovis subsp bovis AF2122/97
guugccgaccgauacaccgacgg

SEQ ID NO: 1127352 - RNA, 17 nt, Mycobacterium bovis subsp bovis AF2122/97
guugccgaagccggaga

SEQ ID NO: 1127353 - RNA, 23 nt, Mycobacterium bovis subsp bovis AF2122/97
guugccgaagccggaugcgcuuc

SEQ ID NO: 1127354 - RNA, 14 nt, Mycobacterium bovis subsp bovis AF2122/97
guugccgaucagcc

SEQ ID NO: 1127355 - RNA, 17 nt, Mycobacterium bovis subsp bovis AF2122/97
guugccgaucccggcga

SEQ ID NO: 1127356 - RNA, 20 nt, Mycobacterium bovis subsp bovis AF2122/97
guugccgacgaucgacgccg

SEQ ID NO: 1127357 - RNA, 23 nt, Mycobacterium bovis subsp bovis AF2122/97
guugccgacgaucgacgccgcca

SEQ ID NO: 1127358 - RNA, 21 nt, Mycobacterium bovis subsp bovis AF2122/97
guugccgacgcucacgcugcu

SEQ ID NO: 1127359 - RNA, 13 nt, Mycobacterium bovis subsp bovis AF2122/97
guugcggcggcgc

SEQ ID NO: 1127360 - RNA, 14 nt, Mycobacterium bovis subsp bovis AF2122/97
guugcggcugaccu

SEQ ID NO: 1127361 - RNA, 14 nt, Mycobacterium bovis subsp bovis AF2122/97
guugcggcagcugg

SEQ ID NO: 1127362 - RNA, 20 nt, Mycobacterium bovis subsp bovis AF2122/97
guugcggaaucagcacccca

SEQ ID NO: 1127363 - RNA, 21 nt, Mycobacterium bovis subsp bovis AF2122/97
guugcggaaucagcaccccau

SEQ ID NO: 1127364 - RNA, 23 nt, Mycobacterium bovis subsp bovis AF2122/97
guugcccccauugccgccgucgc

SEQ ID NO: 1127365 - RNA, 15 nt, Mycobacterium bovis subsp bovis AF2122/97
guugccccgaccgcc

SEQ ID NO: 1127366 - RNA, 16 nt, Mycobacterium bovis subsp bovis AF2122/97
guugccccggcgaccc

SEQ ID NO: 1127367 - RNA, 18 nt, Mycobacterium bovis subsp bovis AF2122/97
guugccccggucggcgac

SEQ ID NO: 1127368 - RNA, 19 nt, Mycobacterium bovis subsp bovis AF2122/97
guugccccggucggcgacg

SEQ ID NO: 1127369 - RNA, 20 nt, Mycobacterium bovis subsp bovis AF2122/97
guugccccggucggcgacgu

SEQ ID NO: 1127370 - RNA, 19 nt, Mycobacterium bovis subsp bovis AF2122/97
guugcccgacccgccgacg

SEQ ID NO: 1127371 - RNA, 22 nt, Mycobacterium bovis subsp bovis AF2122/97
guugcccgacccgccgacgccg

SEQ ID NO: 1127372 - RNA, 15 nt, Mycobacterium bovis subsp bovis AF2122/97
guugccagucgaucg

SEQ ID NO: 1127373 - RNA, 17 nt, Mycobacterium bovis subsp bovis AF2122/97
guugccagucgaucgcg

SEQ ID NO: 1127374 - RNA, 15 nt, Mycobacterium bovis subsp bovis AF2122/97
guugccaacaccggc

SEQ ID NO: 1127375 - RNA, 18 nt, Mycobacterium bovis subsp bovis AF2122/97
guugccaaugacgucgcg

SEQ ID NO: 1127376 - RNA, 23 nt, Mycobacterium bovis subsp bovis AF2122/97
guugcaucaugccgcccaucacc

SEQ ID NO: 1127377 - RNA, 19 nt, Mycobacterium bovis subsp bovis AF2122/97
guugccagcgacgcgguca

SEQ ID NO: 1127378 - RNA, 22 nt, Mycobacterium bovis subsp bovis AF2122/97
guugccaacgaaccgcucagcg

SEQ ID NO: 1127379 - RNA, 16 nt, Mycobacterium bovis subsp bovis AF2122/97
guugccaccggugccg

SEQ ID NO: 1127380 - RNA, 22 nt, Mycobacterium bovis subsp bovis AF2122/97
guugccaccggugccggcgacg

SEQ ID NO: 1127381 - RNA, 14 nt, Mycobacterium bovis subsp bovis AF2122/97
guugccaccuuggu

SEQ ID NO: 1127382 - RNA, 14 nt, Mycobacterium bovis subsp bovis AF2122/97
guugccacgccgcc

SEQ ID NO: 1127383 - RNA, 16 nt, Mycobacterium bovis subsp bovis AF2122/97
guugggaagugcggug

SEQ ID NO: 1127384 - RNA, 17 nt, Mycobacterium bovis subsp bovis AF2122/97
guugggaagugcgguga

SEQ ID NO: 1127385 - RNA, 19 nt, Mycobacterium bovis subsp bovis AF2122/97
guugggcaccuuggccagg

SEQ ID NO: 1127386 - RNA, 20 nt, Mycobacterium bovis subsp bovis AF2122/97
guuggcgccguuaccgccgu

SEQ ID NO: 1127387 - RNA, 15 nt, Mycobacterium bovis subsp bovis AF2122/97
guuggcuugcgcgca

SEQ ID NO: 1127388 - RNA, 14 nt, Mycobacterium bovis subsp bovis AF2122/97
guugggagccaccg

SEQ ID NO: 1127389 - RNA, 21 nt, Mycobacterium bovis subsp bovis AF2122/97
guuggcgagcuuggcuuggcc

SEQ ID NO: 1127390 - RNA, 22 nt, Mycobacterium bovis subsp bovis AF2122/97
guuggcgaagucgucgagguca

SEQ ID NO: 1127391 - RNA, 17 nt, Mycobacterium bovis subsp bovis AF2122/97
guuggcgaagcccgaga

SEQ ID NO: 1127392 - RNA, 16 nt, Mycobacterium bovis subsp bovis AF2122/97
guuggcgaagcccgag

SEQ ID NO: 1127393 - RNA, 14 nt, Mycobacterium bovis subsp bovis AF2122/97
guuggcgccaccag

SEQ ID NO: 1127394 - RNA, 17 nt, Mycobacterium bovis subsp bovis AF2122/97
guuggcgaccaccgcgu

SEQ ID NO: 1127395 - RNA, 13 nt, Mycobacterium bovis subsp bovis AF2122/97
guugcuggccgcg

SEQ ID NO: 1127396 - RNA, 17 nt, Mycobacterium bovis subsp bovis AF2122/97
guuggccggcgcugccc

SEQ ID NO: 1127397 - RNA, 18 nt, Mycobacterium bovis subsp bovis AF2122/97
guuggccggcgcugcccg

SEQ ID NO: 1127398 - RNA, 21 nt, Mycobacterium bovis subsp bovis AF2122/97
guugcugaugucgccgguguc

SEQ ID NO: 1127399 - RNA, 21 nt, Mycobacterium bovis subsp bovis AF2122/97
guugcugagcguaggccagcg

SEQ ID NO: 1127400 - RNA, 13 nt, Mycobacterium bovis subsp bovis AF2122/97
guugcucggucuc

SEQ ID NO: 1127401 - RNA, 19 nt, Mycobacterium bovis subsp bovis AF2122/97
guugcucguccaagccggc

SEQ ID NO: 1127402 - RNA, 11 nt, Mycobacterium bovis subsp bovis AF2122/97
guugcucggcu

SEQ ID NO: 1127403 - RNA, 13 nt, Mycobacterium bovis subsp bovis AF2122/97
guugcggucaccg

SEQ ID NO: 1127404 - RNA, 14 nt, Mycobacterium bovis subsp bovis AF2122/97
guugcgggcgugga

SEQ ID NO: 1127405 - RNA, 22 nt, Mycobacterium bovis subsp bovis AF2122/97
guugcguucggucagugggacg

SEQ ID NO: 1127406 - RNA, 15 nt, Mycobacterium bovis subsp bovis AF2122/97
guugcguugcaggaa

SEQ ID NO: 1127407 - RNA, 16 nt, Mycobacterium bovis subsp bovis AF2122/97
guugcguuggcgccac

SEQ ID NO: 1127408 - RNA, 20 nt, Mycobacterium bovis subsp bovis AF2122/97
guugaguggaugcgccgcac

SEQ ID NO: 1127409 - RNA, 12 nt, Mycobacterium bovis subsp bovis AF2122/97
guugaucaccga

SEQ ID NO: 1127410 - RNA, 16 nt, Mycobacterium bovis subsp bovis AF2122/97
guugaugacggcgucg

SEQ ID NO: 1127411 - RNA, 20 nt, Mycobacterium bovis subsp bovis AF2122/97
guugaugacguugcagccgg

SEQ ID NO: 1127412 - RNA, 23 nt, Mycobacterium bovis subsp bovis AF2122/97
guugaucgacaucaccaccgccg

SEQ ID NO: 1127413 - RNA, 13 nt, Mycobacterium bovis subsp bovis AF2122/97
guugaucgcgcug

SEQ ID NO: 1127414 - RNA, 15 nt, Mycobacterium bovis subsp bovis AF2122/97
guugaucgcggacac

SEQ ID NO: 1127415 - RNA, 19 nt, Mycobacterium bovis subsp bovis AF2122/97
guugaugcggaugucgucg

SEQ ID NO: 1127416 - RNA, 15 nt, Mycobacterium bovis subsp bovis AF2122/97
guugaugcggccgcg

SEQ ID NO: 1127417 - RNA, 14 nt, Mycobacterium bovis subsp bovis AF2122/97
guugauggccccgg

SEQ ID NO: 1127418 - RNA, 19 nt, Mycobacterium bovis subsp bovis AF2122/97
guugaugggcagccgcccg

SEQ ID NO: 1127419 - RNA, 15 nt, Mycobacterium bovis subsp bovis AF2122/97
guugcacagcagcgg

SEQ ID NO: 1127420 - RNA, 23 nt, Mycobacterium bovis subsp bovis AF2122/97
guugcaacggguacacccgcucg

SEQ ID NO: 1127421 - RNA, 16 nt, Mycobacterium bovis subsp bovis AF2122/97
guugcaggacgcccac

SEQ ID NO: 1127422 - RNA, 19 nt, Mycobacterium bovis subsp bovis AF2122/97
guugcaguacuagcagcgg

SEQ ID NO: 1127423 - RNA, 15 nt, Mycobacterium bovis subsp bovis AF2122/97
guugcaguggcgacg

SEQ ID NO: 1127424 - RNA, 23 nt, Mycobacterium bovis subsp bovis AF2122/97
guugcagccggcauagcggccca

SEQ ID NO: 1127425 - RNA, 15 nt, Mycobacterium bovis subsp bovis AF2122/97
guugacgaucacccc

SEQ ID NO: 1127426 - RNA, 17 nt, Mycobacterium bovis subsp bovis AF2122/97
guugacgaucaccccgc

SEQ ID NO: 1127427 - RNA, 21 nt, Mycobacterium bovis subsp bovis AF2122/97
guugacgaucaccccgccaug

SEQ ID NO: 1127428 - RNA, 14 nt, Mycobacterium bovis subsp bovis AF2122/97
guugacgaucaguc

SEQ ID NO: 1127429 - RNA, 18 nt, Mycobacterium bovis subsp bovis AF2122/97
guugacgauccggucggc

SEQ ID NO: 1127430 - RNA, 21 nt, Mycobacterium bovis subsp bovis AF2122/97
guugacgaucuccgccaaccg

SEQ ID NO: 1127431 - RNA, 14 nt, Mycobacterium bovis subsp bovis AF2122/97
guugaccucgcgca

SEQ ID NO: 1127432 - RNA, 15 nt, Mycobacterium bovis subsp bovis AF2122/97
guugacccggcgaug

SEQ ID NO: 1127433 - RNA, 20 nt, Mycobacterium bovis subsp bovis AF2122/97
guugacccguacccacgacg

SEQ ID NO: 1127434 - RNA, 16 nt, Mycobacterium bovis subsp bovis AF2122/97
guugaacucgaccacc

SEQ ID NO: 1127435 - RNA, 21 nt, Mycobacterium bovis subsp bovis AF2122/97
guugaacucgaccaccgccgg

SEQ ID NO: 1127436 - RNA, 18 nt, Mycobacterium bovis subsp bovis AF2122/97
guugacggugguccugau

SEQ ID NO: 1127437 - RNA, 19 nt, Mycobacterium bovis subsp bovis AF2122/97
guugacgguugccccggcg

SEQ ID NO: 1127438 - RNA, 21 nt, Mycobacterium bovis subsp bovis AF2122/97
guugacguccaacagcgcucg

SEQ ID NO: 1127439 - RNA, 13 nt, Mycobacterium bovis subsp bovis AF2122/97
guugacgccgguc

SEQ ID NO: 1127440 - RNA, 15 nt, Mycobacterium bovis subsp bovis AF2122/97
guugacgccacgacg

SEQ ID NO: 1127441 - RNA, 12 nt, Mycobacterium bovis subsp bovis AF2122/97
guugacgcagcc

SEQ ID NO: 1127442 - RNA, 18 nt, Mycobacterium bovis subsp bovis AF2122/97
guugaggaugacgacggu

SEQ ID NO: 1127443 - RNA, 12 nt, Mycobacterium bovis subsp bovis AF2122/97
guugacggcggg

SEQ ID NO: 1127444 - RNA, 23 nt, Mycobacterium bovis subsp bovis AF2122/97
guugacggcggggcggcgguggg

SEQ ID NO: 1127445 - RNA, 14 nt, Mycobacterium bovis subsp bovis AF2122/97
guugacgggcucgg

SEQ ID NO: 1127446 - RNA, 19 nt, Mycobacterium bovis subsp bovis AF2122/97
guugaggaugccggagagu

SEQ ID NO: 1127447 - RNA, 16 nt, Mycobacterium bovis subsp bovis AF2122/97
guugaggccggugaac

SEQ ID NO: 1127448 - RNA, 17 nt, Mycobacterium bovis subsp bovis AF2122/97
guugaggccgucgaacg

SEQ ID NO: 1127449 - RNA, 22 nt, Mycobacterium bovis subsp bovis AF2122/97
guugaggaugacgacggugacc

SEQ ID NO: 1127450 - RNA, 14 nt, Mycobacterium bovis subsp bovis AF2122/97
guugagguagguga

SEQ ID NO: 1127451 - RNA, 23 nt, Mycobacterium bovis subsp bovis AF2122/97
guucgaacuggcugguggcgugc

SEQ ID NO: 1127452 - RNA, 15 nt, Mycobacterium bovis subsp bovis AF2122/97
guucgaaggccaccc

SEQ ID NO: 1127453 - RNA, 14 nt, Mycobacterium bovis subsp bovis AF2122/97
guucgaacgcgauc

SEQ ID NO: 1127454 - RNA, 17 nt, Mycobacterium bovis subsp bovis AF2122/97
guucgaaguucucggug

SEQ ID NO: 1127455 - RNA, 20 nt, Mycobacterium bovis subsp bovis AF2122/97
guucgacccccgcaucggcg

SEQ ID NO: 1127456 - RNA, 13 nt, Mycobacterium bovis subsp bovis AF2122/97
guugaacguuccc

SEQ ID NO: 1127457 - RNA, 17 nt, Mycobacterium bovis subsp bovis AF2122/97
guugaaaacgcccggca

SEQ ID NO: 1127458 - RNA, 16 nt, Mycobacterium bovis subsp bovis AF2122/97
guugaaaaggcgcugg

SEQ ID NO: 1127459 - RNA, 22 nt, Mycobacterium bovis subsp bovis AF2122/97
guucuucugcgccacgucgacg

SEQ ID NO: 1127460 - RNA, 14 nt, Mycobacterium bovis subsp bovis AF2122/97
guucuuggcgaccu

SEQ ID NO: 1127461 - RNA, 16 nt, Mycobacterium bovis subsp bovis AF2122/97
guucuugucgaaguaa

SEQ ID NO: 1127462 - RNA, 22 nt, Mycobacterium bovis subsp bovis AF2122/97
guuggugaacgagaugccgcga

SEQ ID NO: 1127463 - RNA, 23 nt, Mycobacterium bovis subsp bovis AF2122/97
guuggguugaaaacgcccggcac

SEQ ID NO: 1127464 - RNA, 15 nt, Mycobacterium bovis subsp bovis AF2122/97
guuggugccagccgg

SEQ ID NO: 1127465 - RNA, 20 nt, Mycobacterium bovis subsp bovis AF2122/97
guuggucagcguggacgccc

SEQ ID NO: 1127466 - RNA, 13 nt, Mycobacterium bovis subsp bovis AF2122/97
guuggucgcgguc

SEQ ID NO: 1127467 - RNA, 22 nt, Mycobacterium bovis subsp bovis AF2122/97
guuggucaucaacgccacgaug

SEQ ID NO: 1127468 - RNA, 20 nt, Mycobacterium bovis subsp bovis AF2122/97
guuggcgccaccagucacgc

SEQ ID NO: 1127469 - RNA, 14 nt, Mycobacterium bovis subsp bovis AF2122/97
guugggguggcggu

SEQ ID NO: 1127470 - RNA, 22 nt, Mycobacterium bovis subsp bovis AF2122/97
guugguauuagggccggcguug

SEQ ID NO: 1127471 - RNA, 20 nt, Mycobacterium bovis subsp bovis AF2122/97
guugguggccgggucgauca

SEQ ID NO: 1127472 - RNA, 23 nt, Mycobacterium bovis subsp bovis AF2122/97
guuguagcccaaaaacggcagca

SEQ ID NO: 1127473 - RNA, 15 nt, Mycobacterium bovis subsp bovis AF2122/97
guuguagaucugcgc

SEQ ID NO: 1127474 - RNA, 17 nt, Mycobacterium bovis subsp bovis AF2122/97
guuguagauucccgaga

SEQ ID NO: 1127475 - RNA, 21 nt, Mycobacterium bovis subsp bovis AF2122/97
guuguacaggaagucgcggac

SEQ ID NO: 1127476 - RNA, 20 nt, Mycobacterium bovis subsp bovis AF2122/97
guugguuugccggcgguggc

SEQ ID NO: 1127477 - RNA, 13 nt, Mycobacterium bovis subsp bovis AF2122/97
guuguagacggcg

SEQ ID NO: 1127478 - RNA, 17 nt, Mycobacterium bovis subsp bovis AF2122/97
guuguagacggcggcau

SEQ ID NO: 1127479 - RNA, 14 nt, Mycobacterium bovis subsp bovis AF2122/97
guuucguccccaga

SEQ ID NO: 1127480 - RNA, 17 nt, Mycobacterium bovis subsp bovis AF2122/97
guuucguccccagaccg

SEQ ID NO: 1127481 - RNA, 19 nt, Mycobacterium bovis subsp bovis AF2122/97
guuucggugguaacggggc

SEQ ID NO: 1127482 - RNA, 18 nt, Mycobacterium bovis subsp bovis AF2122/97
guuucgcucgcaccgccc

SEQ ID NO: 1127483 - RNA, 13 nt, Mycobacterium bovis subsp bovis AF2122/97
guuucggcgccgu

SEQ ID NO: 1127484 - RNA, 19 nt, Mycobacterium bovis subsp bovis AF2122/97
guuuccggccugcacggcg

SEQ ID NO: 1127485 - RNA, 18 nt, Mycobacterium bovis subsp bovis AF2122/97
guuguaguccgcgccgac

SEQ ID NO: 1127486 - RNA, 21 nt, Mycobacterium bovis subsp bovis AF2122/97
guuuccgccgccgccgccauc

SEQ ID NO: 1127487 - RNA, 24 nt, Mycobacterium bovis subsp bovis AF2122/97
guuuggauggcuggccagcacgcc

SEQ ID NO: 1127488 - RNA, 11 nt, Mycobacterium bovis subsp bovis AF2122/97
guuuggccagu

SEQ ID NO: 1127489 - RNA, 13 nt, Mycobacterium bovis subsp bovis AF2122/97
guuugcgccgcgc

SEQ ID NO: 1127490 - RNA, 16 nt, Mycobacterium bovis subsp bovis AF2122/97
guuugccggcgguggc

SEQ ID NO: 1127491 - RNA, 13 nt, Mycobacterium bovis subsp bovis AF2122/97
guuugcgacgacg

SEQ ID NO: 1127492 - RNA, 17 nt, Mycobacterium bovis subsp bovis AF2122/97
guuugguuuucccggcg

SEQ ID NO: 1127493 - RNA, 17 nt, Mycobacterium bovis subsp bovis AF2122/97
guuuguaucugcugccg

SEQ ID NO: 1127494 - RNA, 17 nt, Mycobacterium bovis subsp bovis AF2122/97
guuugcacuguucgcgg

SEQ ID NO: 1127495 - RNA, 12 nt, Mycobacterium bovis subsp bovis AF2122/97
guuugaccagcc

SEQ ID NO: 1127496 - RNA, 17 nt, Mycobacterium bovis subsp bovis AF2122/97
guuugacgcgcucgcgc

SEQ ID NO: 1127497 - RNA, 15 nt, Mycobacterium bovis subsp bovis AF2122/97
guuucuccgccgccc

SEQ ID NO: 1127498 - RNA, 14 nt, Mycobacterium bovis subsp bovis AF2122/97
guuuucucgccguu

SEQ ID NO: 1127499 - RNA, 21 nt, Mycobacterium bovis subsp bovis AF2122/97
guuuucggguugggcaucagg

SEQ ID NO: 1127500 - RNA, 16 nt, Mycobacterium bovis subsp bovis AF2122/97
guuuucccgucgccgc

SEQ ID NO: 1127501 - RNA, 14 nt, Mycobacterium bovis subsp bovis AF2122/97
guuuuccaccagcg

SEQ ID NO: 1127502 - RNA, 16 nt, Mycobacterium bovis subsp bovis AF2122/97
guuuuccagccgacgu

SEQ ID NO: 1127503 - RNA, 18 nt, Mycobacterium bovis subsp bovis AF2122/97
guuuuuguauguucggcg

SEQ ID NO: 1127504 - RNA, 22 nt, Mycobacterium bovis subsp bovis AF2122/97
uaacccugcccuagcccgauuc

SEQ ID NO: 1127505 - RNA, 17 nt, Mycobacterium bovis subsp bovis AF2122/97
uaaccgagccgaccggc

SEQ ID NO: 1127506 - RNA, 17 nt, Mycobacterium bovis subsp bovis AF2122/97
uaaccgcuuggugugau

SEQ ID NO: 1127507 - RNA, 22 nt, Mycobacterium bovis subsp bovis AF2122/97
uaacgcaccugcgcgcggccgc

SEQ ID NO: 1127508 - RNA, 17 nt, Mycobacterium bovis subsp bovis AF2122/97
uaacggucgcugucggc

SEQ ID NO: 1127509 - RNA, 18 nt, Mycobacterium bovis subsp bovis AF2122/97
uaacggucgcugucggca

SEQ ID NO: 1127510 - RNA, 14 nt, Mycobacterium bovis subsp bovis AF2122/97
uaacggcgaccgcc

SEQ ID NO: 1127511 - RNA, 18 nt, Mycobacterium bovis subsp bovis AF2122/97
uaacgccaacaccggcau

SEQ ID NO: 1127512 - RNA, 13 nt, Mycobacterium bovis subsp bovis AF2122/97
uaacgcgcguccg

SEQ ID NO: 1127513 - RNA, 15 nt, Mycobacterium bovis subsp bovis AF2122/97
uaaaccagccaccac

SEQ ID NO: 1127514 - RNA, 17 nt, Mycobacterium bovis subsp bovis AF2122/97
uaaaccguggccgcgau

SEQ ID NO: 1127515 - RNA, 21 nt, Mycobacterium bovis subsp bovis AF2122/97
uaaacgggccggugcgcacca

SEQ ID NO: 1127516 - RNA, 18 nt, Mycobacterium bovis subsp bovis AF2122/97
uaagcgaacccgagccgc

SEQ ID NO: 1127517 - RNA, 22 nt, Mycobacterium bovis subsp bovis AF2122/97
uaagcgaacggguagucgggca

SEQ ID NO: 1127518 - RNA, 21 nt, Mycobacterium bovis subsp bovis AF2122/97
uaagccuucggugucgccgaa

SEQ ID NO: 1127519 - RNA, 16 nt, Mycobacterium bovis subsp bovis AF2122/97
uaagcgaacagcggca

SEQ ID NO: 1127520 - RNA, 19 nt, Mycobacterium bovis subsp bovis AF2122/97
uaaggcccuggccgcgccg

SEQ ID NO: 1127521 - RNA, 13 nt, Mycobacterium bovis subsp bovis AF2122/97
uaagcccggucgc

SEQ ID NO: 1127522 - RNA, 21 nt, Mycobacterium bovis subsp bovis AF2122/97
uaagggucaucgccagcggca

SEQ ID NO: 1127523 - RNA, 22 nt, Mycobacterium bovis subsp bovis AF2122/97
uaauauugccgccuccggugca

SEQ ID NO: 1127524 - RNA, 13 nt, Mycobacterium bovis subsp bovis AF2122/97
uacagcggcggcg

SEQ ID NO: 1127525 - RNA, 18 nt, Mycobacterium bovis subsp bovis AF2122/97
uacagcgggaucccgauc

SEQ ID NO: 1127526 - RNA, 17 nt, Mycobacterium bovis subsp bovis AF2122/97
uacagcuugaucgccga

SEQ ID NO: 1127527 - RNA, 17 nt, Mycobacterium bovis subsp bovis AF2122/97
uacaggccacgcaccgg

SEQ ID NO: 1127528 - RNA, 22 nt, Mycobacterium bovis subsp bovis AF2122/97
uacaggcccgccagcagggcca

SEQ ID NO: 1127529 - RNA, 22 nt, Mycobacterium bovis subsp bovis AF2122/97
uacagcgcccggauguccgccg

SEQ ID NO: 1127530 - RNA, 19 nt, Mycobacterium bovis subsp bovis AF2122/97
uacagcgcuucacgggccg

SEQ ID NO: 1127531 - RNA, 16 nt, Mycobacterium bovis subsp bovis AF2122/97
uacagcgcguuggcga

SEQ ID NO: 1127532 - RNA, 20 nt, Mycobacterium bovis subsp bovis AF2122/97
uacacguugagugucccgau

SEQ ID NO: 1127533 - RNA, 21 nt, Mycobacterium bovis subsp bovis AF2122/97
uaccacggcgauccggucggc

SEQ ID NO: 1127534 - RNA, 22 nt, Mycobacterium bovis subsp bovis AF2122/97
uaccacggcgauccggucggcc

SEQ ID NO: 1127535 - RNA, 18 nt, Mycobacterium bovis subsp bovis AF2122/97
uaccaccgucaccgccgg

SEQ ID NO: 1127536 - RNA, 18 nt, Mycobacterium bovis subsp bovis AF2122/97
uaccaccgucuccggcgc

SEQ ID NO: 1127537 - RNA, 12 nt, Mycobacterium bovis subsp bovis AF2122/97
uaccaccggcac

SEQ ID NO: 1127538 - RNA, 14 nt, Mycobacterium bovis subsp bovis AF2122/97
uaccaccggcaccg

SEQ ID NO: 1127539 - RNA, 16 nt, Mycobacterium bovis subsp bovis AF2122/97
uaccaccggcacggug

SEQ ID NO: 1127540 - RNA, 14 nt, Mycobacterium bovis subsp bovis AF2122/97
uaccaccgucaccg

SEQ ID NO: 1127541 - RNA, 13 nt, Mycobacterium bovis subsp bovis AF2122/97
uaauugccgaccg

SEQ ID NO: 1127542 - RNA, 19 nt, Mycobacterium bovis subsp bovis AF2122/97
uaauuggcaacacagcuga

SEQ ID NO: 1127543 - RNA, 16 nt, Mycobacterium bovis subsp bovis AF2122/97
uacaccgugcgccgaa

SEQ ID NO: 1127544 - RNA, 12 nt, Mycobacterium bovis subsp bovis AF2122/97
uacaccgcccgg

SEQ ID NO: 1127545 - RNA, 22 nt, Mycobacterium bovis subsp bovis AF2122/97
uacaccuuguggacccgccagg

SEQ ID NO: 1127546 - RNA, 13 nt, Mycobacterium bovis subsp bovis AF2122/97
uacacggcggcga

SEQ ID NO: 1127547 - RNA, 17 nt, Mycobacterium bovis subsp bovis AF2122/97
uacacauucauccaccc

SEQ ID NO: 1127548 - RNA, 22 nt, Mycobacterium bovis subsp bovis AF2122/97
uacaccgacgggauauccgguc

SEQ ID NO: 1127549 - RNA, 20 nt, Mycobacterium bovis subsp bovis AF2122/97
uacacagcaugguuagcggu

SEQ ID NO: 1127550 - RNA, 24 nt, Mycobacterium bovis subsp bovis AF2122/97
uacacagcaugguuagcggugaug

SEQ ID NO: 1127551 - RNA, 20 nt, Mycobacterium bovis subsp bovis AF2122/97
uacaacacagaacucaccga

SEQ ID NO: 1127552 - RNA, 19 nt, Mycobacterium bovis subsp bovis AF2122/97
uacaacagcgucuggccgu

SEQ ID NO: 1127553 - RNA, 22 nt, Mycobacterium bovis subsp bovis AF2122/97
uacaacacagaacucaccgacg

SEQ ID NO: 1127554 - RNA, 22 nt, Mycobacterium bovis subsp bovis AF2122/97
uaggcccacggcagcgccgguc

SEQ ID NO: 1127555 - RNA, 19 nt, Mycobacterium bovis subsp bovis AF2122/97
uaggcccagcaaccgcucg

SEQ ID NO: 1127556 - RNA, 19 nt, Mycobacterium bovis subsp bovis AF2122/97
uaggccgcauauugcggcg

SEQ ID NO: 1127557 - RNA, 14 nt, Mycobacterium bovis subsp bovis AF2122/97
uaggccgccagccg

SEQ ID NO: 1127558 - RNA, 16 nt, Mycobacterium bovis subsp bovis AF2122/97
uaggccgcgcggcggc

SEQ ID NO: 1127559 - RNA, 20 nt, Mycobacterium bovis subsp bovis AF2122/97
uaggccgcgcggcggcgccg

SEQ ID NO: 1127560 - RNA, 14 nt, Mycobacterium bovis subsp bovis AF2122/97
uaggccaccuccga

SEQ ID NO: 1127561 - RNA, 20 nt, Mycobacterium bovis subsp bovis AF2122/97
uaggccaccuccgaggccgc

SEQ ID NO: 1127562 - RNA, 22 nt, Mycobacterium bovis subsp bovis AF2122/97
uaggcgaaaauugcuccaccac

SEQ ID NO: 1127563 - RNA, 19 nt, Mycobacterium bovis subsp bovis AF2122/97
uaggcgcuccuucagggcg

SEQ ID NO: 1127564 - RNA, 16 nt, Mycobacterium bovis subsp bovis AF2122/97
uaggcgaucgucuccu

SEQ ID NO: 1127565 - RNA, 14 nt, Mycobacterium bovis subsp bovis AF2122/97
uaggcgaccgccau

SEQ ID NO: 1127566 - RNA, 21 nt, Mycobacterium bovis subsp bovis AF2122/97
uaggcggccaugucagcggcc

SEQ ID NO: 1127567 - RNA, 23 nt, Mycobacterium bovis subsp bovis AF2122/97
uaggcggccaugucagcggccug

SEQ ID NO: 1127568 - RNA, 16 nt, Mycobacterium bovis subsp bovis AF2122/97
uaggcggcggcccgca

SEQ ID NO: 1127569 - RNA, 17 nt, Mycobacterium bovis subsp bovis AF2122/97
uaggcuccaagcaauuc

SEQ ID NO: 1127570 - RNA, 17 nt, Mycobacterium bovis subsp bovis AF2122/97
uaggacggcgcgagccg

SEQ ID NO: 1127571 - RNA, 20 nt, Mycobacterium bovis subsp bovis AF2122/97
uaggacugcgccaccgguga

SEQ ID NO: 1127572 - RNA, 22 nt, Mycobacterium bovis subsp bovis AF2122/97
uaggaggagugguugcccgcac

SEQ ID NO: 1127573 - RNA, 15 nt, Mycobacterium bovis subsp bovis AF2122/97
uaggaguggccgggc

SEQ ID NO: 1127574 - RNA, 17 nt, Mycobacterium bovis subsp bovis AF2122/97
uaggaguggccgggcgg

SEQ ID NO: 1127575 - RNA, 16 nt, Mycobacterium bovis subsp bovis AF2122/97
uaggccaccggcgacc

SEQ ID NO: 1127576 - RNA, 12 nt, Mycobacterium bovis subsp bovis AF2122/97
uagccgucgauc

SEQ ID NO: 1127577 - RNA, 17 nt, Mycobacterium bovis subsp bovis AF2122/97
uagccgucgaucccggu

SEQ ID NO: 1127578 - RNA, 18 nt, Mycobacterium bovis subsp bovis AF2122/97
uagccgucgucgucgaga

SEQ ID NO: 1127579 - RNA, 21 nt, Mycobacterium bovis subsp bovis AF2122/97
uagccgugggccacgaugauc

SEQ ID NO: 1127580 - RNA, 15 nt, Mycobacterium bovis subsp bovis AF2122/97
uagccguugccgccg

SEQ ID NO: 1127581 - RNA, 19 nt, Mycobacterium bovis subsp bovis AF2122/97
uagccgccgcuucacccca

SEQ ID NO: 1127582 - RNA, 18 nt, Mycobacterium bovis subsp bovis AF2122/97
uagccgccggugccgccg

SEQ ID NO: 1127583 - RNA, 21 nt, Mycobacterium bovis subsp bovis AF2122/97
uagccgccggugccgccggug

SEQ ID NO: 1127584 - RNA, 16 nt, Mycobacterium bovis subsp bovis AF2122/97
uagccuuacgcgggug

SEQ ID NO: 1127585 - RNA, 20 nt, Mycobacterium bovis subsp bovis AF2122/97
uagcgacagcagcgccaccc

SEQ ID NO: 1127586 - RNA, 19 nt, Mycobacterium bovis subsp bovis AF2122/97
uagcgaccgcggucgcugc

SEQ ID NO: 1127587 - RNA, 15 nt, Mycobacterium bovis subsp bovis AF2122/97
uagcgcggccagcag

SEQ ID NO: 1127588 - RNA, 15 nt, Mycobacterium bovis subsp bovis AF2122/97
uagcccuccgagcac

SEQ ID NO: 1127589 - RNA, 14 nt, Mycobacterium bovis subsp bovis AF2122/97
uagccgaccaggac

SEQ ID NO: 1127590 - RNA, 17 nt, Mycobacterium bovis subsp bovis AF2122/97
uagccgacuaucggccg

SEQ ID NO: 1127591 - RNA, 22 nt, Mycobacterium bovis subsp bovis AF2122/97
uagccgacuaucggccgccgga

SEQ ID NO: 1127592 - RNA, 19 nt, Mycobacterium bovis subsp bovis AF2122/97
uagccgaucaacagggcca

SEQ ID NO: 1127593 - RNA, 15 nt, Mycobacterium bovis subsp bovis AF2122/97
uagccgauccagcag

SEQ ID NO: 1127594 - RNA, 22 nt, Mycobacterium bovis subsp bovis AF2122/97
uagcacguugacguccaacagc

SEQ ID NO: 1127595 - RNA, 15 nt, Mycobacterium bovis subsp bovis AF2122/97
uagcaccgcgccgaa

SEQ ID NO: 1127596 - RNA, 17 nt, Mycobacterium bovis subsp bovis AF2122/97
uagcacgggcacgaucg

SEQ ID NO: 1127597 - RNA, 21 nt, Mycobacterium bovis subsp bovis AF2122/97
uagcacgggcacgaucgucgc

SEQ ID NO: 1127598 - RNA, 16 nt, Mycobacterium bovis subsp bovis AF2122/97
uagcaacgcugcggca

SEQ ID NO: 1127599 - RNA, 13 nt, Mycobacterium bovis subsp bovis AF2122/97
uagcgcggccgau

SEQ ID NO: 1127600 - RNA, 18 nt, Mycobacterium bovis subsp bovis AF2122/97
uagcgcucgaucagguug

SEQ ID NO: 1127601 - RNA, 22 nt, Mycobacterium bovis subsp bovis AF2122/97
uagcggaccgaugacgaucggc

SEQ ID NO: 1127602 - RNA, 17 nt, Mycobacterium bovis subsp bovis AF2122/97
uagcgcuugacccgcgg

SEQ ID NO: 1127603 - RNA, 14 nt, Mycobacterium bovis subsp bovis AF2122/97
uagcggccgcaggc

SEQ ID NO: 1127604 - RNA, 21 nt, Mycobacterium bovis subsp bovis AF2122/97
uagcggcccaucgggcgccca

SEQ ID NO: 1127605 - RNA, 16 nt, Mycobacterium bovis subsp bovis AF2122/97
uagcggcccgaucacc

SEQ ID NO: 1127606 - RNA, 14 nt, Mycobacterium bovis subsp bovis AF2122/97
uagcguguggcgca

SEQ ID NO: 1127607 - RNA, 15 nt, Mycobacterium bovis subsp bovis AF2122/97
uagcugccgucggug

SEQ ID NO: 1127608 - RNA, 16 nt, Mycobacterium bovis subsp bovis AF2122/97
uagcugccgucggugc

SEQ ID NO: 1127609 - RNA, 20 nt, Mycobacterium bovis subsp bovis AF2122/97
uagcugcgggucucgccgac

SEQ ID NO: 1127610 - RNA, 21 nt, Mycobacterium bovis subsp bovis AF2122/97
uagcugacaccgaaccgccgc

SEQ ID NO: 1127611 - RNA, 13 nt, Mycobacterium bovis subsp bovis AF2122/97
uagcugacguguc

SEQ ID NO: 1127612 - RNA, 14 nt, Mycobacterium bovis subsp bovis AF2122/97
uagcucgucgagga

SEQ ID NO: 1127613 - RNA, 21 nt, Mycobacterium bovis subsp bovis AF2122/97
uacguuacgccgagaugcugc

SEQ ID NO: 1127614 - RNA, 15 nt, Mycobacterium bovis subsp bovis AF2122/97
uacgucgguccaccc

SEQ ID NO: 1127615 - RNA, 20 nt, Mycobacterium bovis subsp bovis AF2122/97
uacguucaccaccgcacauc

SEQ ID NO: 1127616 - RNA, 16 nt, Mycobacterium bovis subsp bovis AF2122/97
uacgucugcucgcgca

SEQ ID NO: 1127617 - RNA, 21 nt, Mycobacterium bovis subsp bovis AF2122/97
uacgucgaccgacgggucgua

SEQ ID NO: 1127618 - RNA, 18 nt, Mycobacterium bovis subsp bovis AF2122/97
uacggugccaagggccgg

SEQ ID NO: 1127619 - RNA, 17 nt, Mycobacterium bovis subsp bovis AF2122/97
uacggugcccugcauag

SEQ ID NO: 1127620 - RNA, 18 nt, Mycobacterium bovis subsp bovis AF2122/97
uacguacaggguggugau

SEQ ID NO: 1127621 - RNA, 22 nt, Mycobacterium bovis subsp bovis AF2122/97
uacuaggcccagcacggucaac

SEQ ID NO: 1127622 - RNA, 19 nt, Mycobacterium bovis subsp bovis AF2122/97
uacugcgaccaagucaugc

SEQ ID NO: 1127623 - RNA, 13 nt, Mycobacterium bovis subsp bovis AF2122/97
uagaccuggccgu

SEQ ID NO: 1127624 - RNA, 16 nt, Mycobacterium bovis subsp bovis AF2122/97
uagacgaccccgguga

SEQ ID NO: 1127625 - RNA, 14 nt, Mycobacterium bovis subsp bovis AF2122/97
uagacgccgccguu

SEQ ID NO: 1127626 - RNA, 18 nt, Mycobacterium bovis subsp bovis AF2122/97
uagacgccgccgcugccg

SEQ ID NO: 1127627 - RNA, 14 nt, Mycobacterium bovis subsp bovis AF2122/97
uagacgaaacggcc

SEQ ID NO: 1127628 - RNA, 23 nt, Mycobacterium bovis subsp bovis AF2122/97
uagacgacaucgucaucagcgcg

SEQ ID NO: 1127629 - RNA, 18 nt, Mycobacterium bovis subsp bovis AF2122/97
uagaccagucucguggcg

SEQ ID NO: 1127630 - RNA, 12 nt, Mycobacterium bovis subsp bovis AF2122/97
uagacaccgcga

SEQ ID NO: 1127631 - RNA, 22 nt, Mycobacterium bovis subsp bovis AF2122/97
uagacaaggccaagcgccaaca

SEQ ID NO: 1127632 - RNA, 17 nt, Mycobacterium bovis subsp bovis AF2122/97
uaccagcucacggcgga

SEQ ID NO: 1127633 - RNA, 15 nt, Mycobacterium bovis subsp bovis AF2122/97
uaccagaccggccga

SEQ ID NO: 1127634 - RNA, 20 nt, Mycobacterium bovis subsp bovis AF2122/97
uaccagaccggccgacguga

SEQ ID NO: 1127635 - RNA, 22 nt, Mycobacterium bovis subsp bovis AF2122/97
uaccagccaugcucgucuuggg

SEQ ID NO: 1127636 - RNA, 23 nt, Mycobacterium bovis subsp bovis AF2122/97
uacgacccccgaucaggccgacg

SEQ ID NO: 1127637 - RNA, 16 nt, Mycobacterium bovis subsp bovis AF2122/97
uacgaccgucgcgcug

SEQ ID NO: 1127638 - RNA, 19 nt, Mycobacterium bovis subsp bovis AF2122/97
uacgaccgucgcgcugccg

SEQ ID NO: 1127639 - RNA, 15 nt, Mycobacterium bovis subsp bovis AF2122/97
uacgacgacccgacg

SEQ ID NO: 1127640 - RNA, 18 nt, Mycobacterium bovis subsp bovis AF2122/97
uacgaacucaccgccaug

SEQ ID NO: 1127641 - RNA, 22 nt, Mycobacterium bovis subsp bovis AF2122/97
uacgacgguccguucgcgccgu

SEQ ID NO: 1127642 - RNA, 12 nt, Mycobacterium bovis subsp bovis AF2122/97
uacgcaccggua

SEQ ID NO: 1127643 - RNA, 15 nt, Mycobacterium bovis subsp bovis AF2122/97
uacgaugcucagcug

SEQ ID NO: 1127644 - RNA, 18 nt, Mycobacterium bovis subsp bovis AF2122/97
uacgaugcucagcugguc

SEQ ID NO: 1127645 - RNA, 17 nt, Mycobacterium bovis subsp bovis AF2122/97
uacgcggggccggccgg

SEQ ID NO: 1127646 - RNA, 20 nt, Mycobacterium bovis subsp bovis AF2122/97
uacgcgcgcucgcucaccgg

SEQ ID NO: 1127647 - RNA, 14 nt, Mycobacterium bovis subsp bovis AF2122/97
uacgcgaccgcgau

SEQ ID NO: 1127648 - RNA, 18 nt, Mycobacterium bovis subsp bovis AF2122/97
uacgcgacgccgucaugc

SEQ ID NO: 1127649 - RNA, 14 nt, Mycobacterium bovis subsp bovis AF2122/97
uacgcgacgggccg

SEQ ID NO: 1127650 - RNA, 22 nt, Mycobacterium bovis subsp bovis AF2122/97
uacgggucgccggacugcggcc

SEQ ID NO: 1127651 - RNA, 15 nt, Mycobacterium bovis subsp bovis AF2122/97
uacggugaucgccgg

SEQ ID NO: 1127652 - RNA, 21 nt, Mycobacterium bovis subsp bovis AF2122/97
uacgguagacguugccaacac

SEQ ID NO: 1127653 - RNA, 18 nt, Mycobacterium bovis subsp bovis AF2122/97
uacggccaccaggugccg

SEQ ID NO: 1127654 - RNA, 19 nt, Mycobacterium bovis subsp bovis AF2122/97
uacggccugccgcucgccg

SEQ ID NO: 1127655 - RNA, 18 nt, Mycobacterium bovis subsp bovis AF2122/97
uacggcgaugcggucggc

SEQ ID NO: 1127656 - RNA, 19 nt, Mycobacterium bovis subsp bovis AF2122/97
uacggcgaugcggucggcc

SEQ ID NO: 1127657 - RNA, 23 nt, Mycobacterium bovis subsp bovis AF2122/97
ucaaugcuggcagcggccuccgg

SEQ ID NO: 1127658 - RNA, 18 nt, Mycobacterium bovis subsp bovis AF2122/97
ucaaugaacgcgcuuggu

SEQ ID NO: 1127659 - RNA, 18 nt, Mycobacterium bovis subsp bovis AF2122/97
ucaaugaccaccgggcgc

SEQ ID NO: 1127660 - RNA, 22 nt, Mycobacterium bovis subsp bovis AF2122/97
ucaagccggcgcccgccgcgaa

SEQ ID NO: 1127661 - RNA, 21 nt, Mycobacterium bovis subsp bovis AF2122/97
ucaagcgaugucccaucgcgu

SEQ ID NO: 1127662 - RNA, 19 nt, Mycobacterium bovis subsp bovis AF2122/97
ucaaggagauccagggccu

SEQ ID NO: 1127663 - RNA, 17 nt, Mycobacterium bovis subsp bovis AF2122/97
ucaaggaagccgcggcc

SEQ ID NO: 1127664 - RNA, 18 nt, Mycobacterium bovis subsp bovis AF2122/97
ucaaggacgcaccgccag

SEQ ID NO: 1127665 - RNA, 20 nt, Mycobacterium bovis subsp bovis AF2122/97
ucaagcuggcccgcucauac

SEQ ID NO: 1127666 - RNA, 18 nt, Mycobacterium bovis subsp bovis AF2122/97
ucaagcacacuggccaca

SEQ ID NO: 1127667 - RNA, 22 nt, Mycobacterium bovis subsp bovis AF2122/97
ucaagcacagcccggcgacgac

SEQ ID NO: 1127668 - RNA, 13 nt, Mycobacterium bovis subsp bovis AF2122/97
ucaagcagcgugg

SEQ ID NO: 1127669 - RNA, 15 nt, Mycobacterium bovis subsp bovis AF2122/97
ucaagaucggugcca

SEQ ID NO: 1127670 - RNA, 17 nt, Mycobacterium bovis subsp bovis AF2122/97
ucaagucucccggccgc

SEQ ID NO: 1127671 - RNA, 14 nt, Mycobacterium bovis subsp bovis AF2122/97
ucaaggugucgacg

SEQ ID NO: 1127672 - RNA, 16 nt, Mycobacterium bovis subsp bovis AF2122/97
ucaaggcuucggcggc

SEQ ID NO: 1127673 - RNA, 22 nt, Mycobacterium bovis subsp bovis AF2122/97
ucaagucugugcucacggcggc

SEQ ID NO: 1127674 - RNA, 16 nt, Mycobacterium bovis subsp bovis AF2122/97
ucaagugccagcgugg

SEQ ID NO: 1127675 - RNA, 14 nt, Mycobacterium bovis subsp bovis AF2122/97
ucaaguucgccgau

SEQ ID NO: 1127676 - RNA, 15 nt, Mycobacterium bovis subsp bovis AF2122/97
ucaacccucgccacg

SEQ ID NO: 1127677 - RNA, 14 nt, Mycobacterium bovis subsp bovis AF2122/97
ucaaccgggucagc

SEQ ID NO: 1127678 - RNA, 20 nt, Mycobacterium bovis subsp bovis AF2122/97
ucaacccgcaccccggccgc

SEQ ID NO: 1127679 - RNA, 16 nt, Mycobacterium bovis subsp bovis AF2122/97
ucaaccgggucagccc

SEQ ID NO: 1127680 - RNA, 15 nt, Mycobacterium bovis subsp bovis AF2122/97
ucaacgaggccgacg

SEQ ID NO: 1127681 - RNA, 17 nt, Mycobacterium bovis subsp bovis AF2122/97
ucaacgaggccgacgac

SEQ ID NO: 1127682 - RNA, 19 nt, Mycobacterium bovis subsp bovis AF2122/97
ucaaccugaaccggccgcg

SEQ ID NO: 1127683 - RNA, 20 nt, Mycobacterium bovis subsp bovis AF2122/97
ucaacgaaaauuugacgacg

SEQ ID NO: 1127684 - RNA, 22 nt, Mycobacterium bovis subsp bovis AF2122/97
ucaacgacaccauaggccgacg

SEQ ID NO: 1127685 - RNA, 20 nt, Mycobacterium bovis subsp bovis AF2122/97
ucaacgacauugccacggcg

SEQ ID NO: 1127686 - RNA, 13 nt, Mycobacterium bovis subsp bovis AF2122/97
ucaacuccggcac

SEQ ID NO: 1127687 - RNA, 10 nt, Mycobacterium bovis subsp bovis AF2122/97
ucaacucggg

SEQ ID NO: 1127688 - RNA, 13 nt, Mycobacterium bovis subsp bovis AF2122/97
ucaacguucaacg

SEQ ID NO: 1127689 - RNA, 15 nt, Mycobacterium bovis subsp bovis AF2122/97
ucaagaaggccagcg

SEQ ID NO: 1127690 - RNA, 16 nt, Mycobacterium bovis subsp bovis AF2122/97
ucaagaaaggcaaccg

SEQ ID NO: 1127691 - RNA, 15 nt, Mycobacterium bovis subsp bovis AF2122/97
ucaaacuaccgaaca

SEQ ID NO: 1127692 - RNA, 13 nt, Mycobacterium bovis subsp bovis AF2122/97
ucaaaccggcggc

SEQ ID NO: 1127693 - RNA, 22 nt, Mycobacterium bovis subsp bovis AF2122/97
ucaaaccggcggcgacggcggc

SEQ ID NO: 1127694 - RNA, 14 nt, Mycobacterium bovis subsp bovis AF2122/97
uauugcugcggugc

SEQ ID NO: 1127695 - RNA, 13 nt, Mycobacterium bovis subsp bovis AF2122/97
uauugcggcgccg

SEQ ID NO: 1127696 - RNA, 23 nt, Mycobacterium bovis subsp bovis AF2122/97
uauugcaggaaaucguccuugga

SEQ ID NO: 1127697 - RNA, 18 nt, Mycobacterium bovis subsp bovis AF2122/97
uauccagucgauccuuga

SEQ ID NO: 1127698 - RNA, 12 nt, Mycobacterium bovis subsp bovis AF2122/97
uauccgaugcga

SEQ ID NO: 1127699 - RNA, 20 nt, Mycobacterium bovis subsp bovis AF2122/97
uaucggcuuauugcccguca

SEQ ID NO: 1127700 - RNA, 22 nt, Mycobacterium bovis subsp bovis AF2122/97
uaucgggcccccuggaucgcgc

SEQ ID NO: 1127701 - RNA, 12 nt, Mycobacterium bovis subsp bovis AF2122/97
uauccggccgag

SEQ ID NO: 1127702 - RNA, 23 nt, Mycobacterium bovis subsp bovis AF2122/97
uauccggccgagccguugcgccu

SEQ ID NO: 1127703 - RNA, 13 nt, Mycobacterium bovis subsp bovis AF2122/97
uagggcgcccgcc

SEQ ID NO: 1127704 - RNA, 18 nt, Mycobacterium bovis subsp bovis AF2122/97
uaggggcuuuugcgucug

SEQ ID NO: 1127705 - RNA, 19 nt, Mycobacterium bovis subsp bovis AF2122/97
uaggcuuccggcgcgaccg

SEQ ID NO: 1127706 - RNA, 18 nt, Mycobacterium bovis subsp bovis AF2122/97
uagggccaccgccgccug

SEQ ID NO: 1127707 - RNA, 19 nt, Mycobacterium bovis subsp bovis AF2122/97
uaggggcuuuugcgucugc

SEQ ID NO: 1127708 - RNA, 18 nt, Mycobacterium bovis subsp bovis AF2122/97
uaggguucuucgacgcgg

SEQ ID NO: 1127709 - RNA, 14 nt, Mycobacterium bovis subsp bovis AF2122/97
uaggucgccgccgc

SEQ ID NO: 1127710 - RNA, 15 nt, Mycobacterium bovis subsp bovis AF2122/97
uaugcaacaccgcac

SEQ ID NO: 1127711 - RNA, 12 nt, Mycobacterium bovis subsp bovis AF2122/97
uaugcacccgca

SEQ ID NO: 1127712 - RNA, 13 nt, Mycobacterium bovis subsp bovis AF2122/97
uauguucggcaau

SEQ ID NO: 1127713 - RNA, 22 nt, Mycobacterium bovis subsp bovis AF2122/97
uaugcccacgaaccgugcuggg

SEQ ID NO: 1127714 - RNA, 13 nt, Mycobacterium bovis subsp bovis AF2122/97
uaugcccggcaaa

SEQ ID NO: 1127715 - RNA, 17 nt, Mycobacterium bovis subsp bovis AF2122/97
uaucguuggcgaccacc

SEQ ID NO: 1127716 - RNA, 13 nt, Mycobacterium bovis subsp bovis AF2122/97
uaucgucgacgcc

SEQ ID NO: 1127717 - RNA, 14 nt, Mycobacterium bovis subsp bovis AF2122/97
uaucgucgacgccg

SEQ ID NO: 1127718 - RNA, 18 nt, Mycobacterium bovis subsp bovis AF2122/97
uaucgucgacgccgaucg

SEQ ID NO: 1127719 - RNA, 12 nt, Mycobacterium bovis subsp bovis AF2122/97
uaucgucgacgc

SEQ ID NO: 1127720 - RNA, 19 nt, Mycobacterium bovis subsp bovis AF2122/97
uaucgucgugucgccgccg

SEQ ID NO: 1127721 - RNA, 15 nt, Mycobacterium bovis subsp bovis AF2122/97
uaucugccacguuga

SEQ ID NO: 1127722 - RNA, 15 nt, Mycobacterium bovis subsp bovis AF2122/97
uaugaccucgacguc

SEQ ID NO: 1127723 - RNA, 21 nt, Mycobacterium bovis subsp bovis AF2122/97
ucauguagcgguuguagaccu

SEQ ID NO: 1127724 - RNA, 19 nt, Mycobacterium bovis subsp bovis AF2122/97
ucaugucagcgcugagccg

SEQ ID NO: 1127725 - RNA, 14 nt, Mycobacterium bovis subsp bovis AF2122/97
ucaugucggcgcag

SEQ ID NO: 1127726 - RNA, 13 nt, Mycobacterium bovis subsp bovis AF2122/97
ucaucuggcgcug

SEQ ID NO: 1127727 - RNA, 14 nt, Mycobacterium bovis subsp bovis AF2122/97
ucauugcccuugac

SEQ ID NO: 1127728 - RNA, 17 nt, Mycobacterium bovis subsp bovis AF2122/97
ucauuggcuagguaccg

SEQ ID NO: 1127729 - RNA, 22 nt, Mycobacterium bovis subsp bovis AF2122/97
uccaaaacacucggaaucggcg

SEQ ID NO: 1127730 - RNA, 16 nt, Mycobacterium bovis subsp bovis AF2122/97
uccaauccacgguugc

SEQ ID NO: 1127731 - RNA, 23 nt, Mycobacterium bovis subsp bovis AF2122/97
uccaauccacgguugccggcggc

SEQ ID NO: 1127732 - RNA, 23 nt, Mycobacterium bovis subsp bovis AF2122/97
uccaagugcuuccggccauugcg

SEQ ID NO: 1127733 - RNA, 14 nt, Mycobacterium bovis subsp bovis AF2122/97
uccaagcguacucg

SEQ ID NO: 1127734 - RNA, 19 nt, Mycobacterium bovis subsp bovis AF2122/97
uccaaggcggucaccaccg

SEQ ID NO: 1127735 - RNA, 22 nt, Mycobacterium bovis subsp bovis AF2122/97
ucaucgacgagccgcggucggc

SEQ ID NO: 1127736 - RNA, 22 nt, Mycobacterium bovis subsp bovis AF2122/97
ucauccuucgccggcgccagca

SEQ ID NO: 1127737 - RNA, 12 nt, Mycobacterium bovis subsp bovis AF2122/97
ucaucgaugcga

SEQ ID NO: 1127738 - RNA, 18 nt, Mycobacterium bovis subsp bovis AF2122/97
ucaucgcagucaugucca

SEQ ID NO: 1127739 - RNA, 20 nt, Mycobacterium bovis subsp bovis AF2122/97
ucaucgacuugccgccgcac

SEQ ID NO: 1127740 - RNA, 22 nt, Mycobacterium bovis subsp bovis AF2122/97
ucaucggugaauguugccgccg

SEQ ID NO: 1127741 - RNA, 22 nt, Mycobacterium bovis subsp bovis AF2122/97
ucaucgguugaccggucgacca

SEQ ID NO: 1127742 - RNA, 23 nt, Mycobacterium bovis subsp bovis AF2122/97
ucaucgguugaccggucgaccaa

SEQ ID NO: 1127743 - RNA, 17 nt, Mycobacterium bovis subsp bovis AF2122/97
ucaucagagcgcugguu

SEQ ID NO: 1127744 - RNA, 14 nt, Mycobacterium bovis subsp bovis AF2122/97
ucaucaugugguca

SEQ ID NO: 1127745 - RNA, 17 nt, Mycobacterium bovis subsp bovis AF2122/97
ucauccgggcgaccacc

SEQ ID NO: 1127746 - RNA, 20 nt, Mycobacterium bovis subsp bovis AF2122/97
ucaggccagggugaccaggc

SEQ ID NO: 1127747 - RNA, 16 nt, Mycobacterium bovis subsp bovis AF2122/97
ucaggccagagucgcc

SEQ ID NO: 1127748 - RNA, 20 nt, Mycobacterium bovis subsp bovis AF2122/97
ucaggccagagucgcccgca

SEQ ID NO: 1127749 - RNA, 20 nt, Mycobacterium bovis subsp bovis AF2122/97
ucaggcccucgggacugcgc

SEQ ID NO: 1127750 - RNA, 22 nt, Mycobacterium bovis subsp bovis AF2122/97
ucaguugguagagcaccagguu

SEQ ID NO: 1127751 - RNA, 13 nt, Mycobacterium bovis subsp bovis AF2122/97
ucauaggccugca

SEQ ID NO: 1127752 - RNA, 12 nt, Mycobacterium bovis subsp bovis AF2122/97
ucauagcgccgg

SEQ ID NO: 1127753 - RNA, 16 nt, Mycobacterium bovis subsp bovis AF2122/97
uccaucgucggcaaca

SEQ ID NO: 1127754 - RNA, 16 nt, Mycobacterium bovis subsp bovis AF2122/97
uccaucgccaccgcgu

SEQ ID NO: 1127755 - RNA, 21 nt, Mycobacterium bovis subsp bovis AF2122/97
uccaucgcgaccucggaggcg

SEQ ID NO: 1127756 - RNA, 15 nt, Mycobacterium bovis subsp bovis AF2122/97
uccaucgcgcaccgc

SEQ ID NO: 1127757 - RNA, 17 nt, Mycobacterium bovis subsp bovis AF2122/97
uccaucgcgcaccgcau

SEQ ID NO: 1127758 - RNA, 17 nt, Mycobacterium bovis subsp bovis AF2122/97
uccaucgcgcugcggcc

SEQ ID NO: 1127759 - RNA, 15 nt, Mycobacterium bovis subsp bovis AF2122/97
uccaucagagacagc

SEQ ID NO: 1127760 - RNA, 19 nt, Mycobacterium bovis subsp bovis AF2122/97
uccaucaccacaccggcag

SEQ ID NO: 1127761 - RNA, 15 nt, Mycobacterium bovis subsp bovis AF2122/97
uccauucggcggcgg

SEQ ID NO: 1127762 - RNA, 18 nt, Mycobacterium bovis subsp bovis AF2122/97
uccauucggcggcggcgu

SEQ ID NO: 1127763 - RNA, 18 nt, Mycobacterium bovis subsp bovis AF2122/97
uccaucugugcgcggaca

SEQ ID NO: 1127764 - RNA, 14 nt, Mycobacterium bovis subsp bovis AF2122/97
uccaugauggccgu

SEQ ID NO: 1127765 - RNA, 13 nt, Mycobacterium bovis subsp bovis AF2122/97
uccaugagccgua

SEQ ID NO: 1127766 - RNA, 16 nt, Mycobacterium bovis subsp bovis AF2122/97
uccaugauggccguca

SEQ ID NO: 1127767 - RNA, 20 nt, Mycobacterium bovis subsp bovis AF2122/97
uccaugcggguaaaccaggu

SEQ ID NO: 1127768 - RNA, 16 nt, Mycobacterium bovis subsp bovis AF2122/97
uccaggucugggcuuu

SEQ ID NO: 1127769 - RNA, 14 nt, Mycobacterium bovis subsp bovis AF2122/97
uccagcucggccag

SEQ ID NO: 1127770 - RNA, 19 nt, Mycobacterium bovis subsp bovis AF2122/97
uccagcguuugcuggcgga

SEQ ID NO: 1127771 - RNA, 15 nt, Mycobacterium bovis subsp bovis AF2122/97
uccagcggccgccgc

SEQ ID NO: 1127772 - RNA, 18 nt, Mycobacterium bovis subsp bovis AF2122/97
uccagguucuucuccacc

SEQ ID NO: 1127773 - RNA, 22 nt, Mycobacterium bovis subsp bovis AF2122/97
uccagguucuucuccaccaccg

SEQ ID NO: 1127774 - RNA, 19 nt, Mycobacterium bovis subsp bovis AF2122/97
uccaguaaccguccgcgga

SEQ ID NO: 1127775 - RNA, 16 nt, Mycobacterium bovis subsp bovis AF2122/97
uccagcgucgccgcca

SEQ ID NO: 1127776 - RNA, 17 nt, Mycobacterium bovis subsp bovis AF2122/97
uccaguggcagccagcg

SEQ ID NO: 1127777 - RNA, 15 nt, Mycobacterium bovis subsp bovis AF2122/97
uccagauaucgaagc

SEQ ID NO: 1127778 - RNA, 16 nt, Mycobacterium bovis subsp bovis AF2122/97
uccagauccacgccga

SEQ ID NO: 1127779 - RNA, 18 nt, Mycobacterium bovis subsp bovis AF2122/97
uccagcaacagcgagcgg

SEQ ID NO: 1127780 - RNA, 13 nt, Mycobacterium bovis subsp bovis AF2122/97
uccagcaccaccg

SEQ ID NO: 1127781 - RNA, 20 nt, Mycobacterium bovis subsp bovis AF2122/97
uccagcccgacgcccgacug

SEQ ID NO: 1127782 - RNA, 20 nt, Mycobacterium bovis subsp bovis AF2122/97
uccagcccguccaggcgcug

SEQ ID NO: 1127783 - RNA, 19 nt, Mycobacterium bovis subsp bovis AF2122/97
uccagccggugccgccguu

SEQ ID NO: 1127784 - RNA, 19 nt, Mycobacterium bovis subsp bovis AF2122/97
uccagccgcgcgccggcca

SEQ ID NO: 1127785 - RNA, 12 nt, Mycobacterium bovis subsp bovis AF2122/97
uccagcgaaccg

SEQ ID NO: 1127786 - RNA, 22 nt, Mycobacterium bovis subsp bovis AF2122/97
uccagcgaaccgacccggccgc

SEQ ID NO: 1127787 - RNA, 22 nt, Mycobacterium bovis subsp bovis AF2122/97
uccagcagcgacgcugccgcca

SEQ ID NO: 1127788 - RNA, 16 nt, Mycobacterium bovis subsp bovis AF2122/97
uccagcccaacucggc

SEQ ID NO: 1127789 - RNA, 18 nt, Mycobacterium bovis subsp bovis AF2122/97
uccagcccaacucggcca

SEQ ID NO: 1127790 - RNA, 21 nt, Mycobacterium bovis subsp bovis AF2122/97
uccagcccaacucggccagcu

SEQ ID NO: 1127791 - RNA, 16 nt, Mycobacterium bovis subsp bovis AF2122/97
uccagccccccggcga

SEQ ID NO: 1127792 - RNA, 14 nt, Mycobacterium bovis subsp bovis AF2122/97
uccagcacgccguc

SEQ ID NO: 1127793 - RNA, 18 nt, Mycobacterium bovis subsp bovis AF2122/97
uccacauaguccgaaccg

SEQ ID NO: 1127794 - RNA, 19 nt, Mycobacterium bovis subsp bovis AF2122/97
uccacauaguccgaaccga

SEQ ID NO: 1127795 - RNA, 15 nt, Mycobacterium bovis subsp bovis AF2122/97
uccacaauccgcucg

SEQ ID NO: 1127796 - RNA, 17 nt, Mycobacterium bovis subsp bovis AF2122/97
uccacacacagccggug

SEQ ID NO: 1127797 - RNA, 12 nt, Mycobacterium bovis subsp bovis AF2122/97
uccacaccagcu

SEQ ID NO: 1127798 - RNA, 14 nt, Mycobacterium bovis subsp bovis AF2122/97
uccacaaguaccgc

SEQ ID NO: 1127799 - RNA, 19 nt, Mycobacterium bovis subsp bovis AF2122/97
uccaauugcgaaccggccg

SEQ ID NO: 1127800 - RNA, 14 nt, Mycobacterium bovis subsp bovis AF2122/97
uccaaucgccgggu

SEQ ID NO: 1127801 - RNA, 17 nt, Mycobacterium bovis subsp bovis AF2122/97
uccagaaggccgcaccg

SEQ ID NO: 1127802 - RNA, 13 nt, Mycobacterium bovis subsp bovis AF2122/97
uccacuucacgug

SEQ ID NO: 1127803 - RNA, 16 nt, Mycobacterium bovis subsp bovis AF2122/97
uccacuuuuccgccgg

SEQ ID NO: 1127804 - RNA, 20 nt, Mycobacterium bovis subsp bovis AF2122/97
uccacuuccgggcgaccaac

SEQ ID NO: 1127805 - RNA, 16 nt, Mycobacterium bovis subsp bovis AF2122/97
uccacugccaccgcga

SEQ ID NO: 1127806 - RNA, 12 nt, Mycobacterium bovis subsp bovis AF2122/97
uccacucggucu

SEQ ID NO: 1127807 - RNA, 14 nt, Mycobacterium bovis subsp bovis AF2122/97
ucacggucgcggau

SEQ ID NO: 1127808 - RNA, 23 nt, Mycobacterium bovis subsp bovis AF2122/97
ucacuacgggucuggccaacgcc

SEQ ID NO: 1127809 - RNA, 17 nt, Mycobacterium bovis subsp bovis AF2122/97
ucacucacgacgccguu

SEQ ID NO: 1127810 - RNA, 19 nt, Mycobacterium bovis subsp bovis AF2122/97
ucagaaccgacggccagca

SEQ ID NO: 1127811 - RNA, 14 nt, Mycobacterium bovis subsp bovis AF2122/97
ucagaacggcggca

SEQ ID NO: 1127812 - RNA, 22 nt, Mycobacterium bovis subsp bovis AF2122/97
ucacggccgucgauugcagguc

SEQ ID NO: 1127813 - RNA, 20 nt, Mycobacterium bovis subsp bovis AF2122/97
ucacggaucugagcuagccg

SEQ ID NO: 1127814 - RNA, 14 nt, Mycobacterium bovis subsp bovis AF2122/97
ucacggcaggcggu

SEQ ID NO: 1127815 - RNA, 17 nt, Mycobacterium bovis subsp bovis AF2122/97
ucacggcaggcggugaa

SEQ ID NO: 1127816 - RNA, 14 nt, Mycobacterium bovis subsp bovis AF2122/97
ucacgcugccccgc

SEQ ID NO: 1127817 - RNA, 16 nt, Mycobacterium bovis subsp bovis AF2122/97
ucacggagguccggug

SEQ ID NO: 1127818 - RNA, 18 nt, Mycobacterium bovis subsp bovis AF2122/97
ucacggagguccggugga

SEQ ID NO: 1127819 - RNA, 14 nt, Mycobacterium bovis subsp bovis AF2122/97
ucacggaccgccac

SEQ ID NO: 1127820 - RNA, 15 nt, Mycobacterium bovis subsp bovis AF2122/97
ucacggaccgccacc

SEQ ID NO: 1127821 - RNA, 15 nt, Mycobacterium bovis subsp bovis AF2122/97
ucacgggugcuggca

SEQ ID NO: 1127822 - RNA, 13 nt, Mycobacterium bovis subsp bovis AF2122/97
ucacgggucagca

SEQ ID NO: 1127823 - RNA, 18 nt, Mycobacterium bovis subsp bovis AF2122/97
ucacggcgucgacuggcc

SEQ ID NO: 1127824 - RNA, 17 nt, Mycobacterium bovis subsp bovis AF2122/97
ucacgugcccgcgcggc

SEQ ID NO: 1127825 - RNA, 14 nt, Mycobacterium bovis subsp bovis AF2122/97
ucacgugcgacgaa

SEQ ID NO: 1127826 - RNA, 15 nt, Mycobacterium bovis subsp bovis AF2122/97
ucacgugcugccgau

SEQ ID NO: 1127827 - RNA, 14 nt, Mycobacterium bovis subsp bovis AF2122/97
ucacguggaccacg

SEQ ID NO: 1127828 - RNA, 21 nt, Mycobacterium bovis subsp bovis AF2122/97
ucacguggucggcaugacgaa

SEQ ID NO: 1127829 - RNA, 14 nt, Mycobacterium bovis subsp bovis AF2122/97
ucacguucggcgac

SEQ ID NO: 1127830 - RNA, 15 nt, Mycobacterium bovis subsp bovis AF2122/97
ucacguucggcgacg

SEQ ID NO: 1127831 - RNA, 19 nt, Mycobacterium bovis subsp bovis AF2122/97
ucacguucaguuccgcggc

SEQ ID NO: 1127832 - RNA, 20 nt, Mycobacterium bovis subsp bovis AF2122/97
ucacguucaguuccgcggcg

SEQ ID NO: 1127833 - RNA, 14 nt, Mycobacterium bovis subsp bovis AF2122/97
ucacggucgacgau

SEQ ID NO: 1127834 - RNA, 22 nt, Mycobacterium bovis subsp bovis AF2122/97
ucaccgcguugaugaccagguc

SEQ ID NO: 1127835 - RNA, 19 nt, Mycobacterium bovis subsp bovis AF2122/97
ucaccgcguaguccaggcc

SEQ ID NO: 1127836 - RNA, 18 nt, Mycobacterium bovis subsp bovis AF2122/97
ucaccgccagcugggcag

SEQ ID NO: 1127837 - RNA, 16 nt, Mycobacterium bovis subsp bovis AF2122/97
ucaccggaacccccag

SEQ ID NO: 1127838 - RNA, 16 nt, Mycobacterium bovis subsp bovis AF2122/97
ucaccggaggccgccg

SEQ ID NO: 1127839 - RNA, 16 nt, Mycobacterium bovis subsp bovis AF2122/97
ucaccggauucuucgg

SEQ ID NO: 1127840 - RNA, 21 nt, Mycobacterium bovis subsp bovis AF2122/97
ucaccgcggagauaccggacc

SEQ ID NO: 1127841 - RNA, 20 nt, Mycobacterium bovis subsp bovis AF2122/97
ucaccgcggaucgacuucga

SEQ ID NO: 1127842 - RNA, 19 nt, Mycobacterium bovis subsp bovis AF2122/97
ucaccgaucucgaccagcg

SEQ ID NO: 1127843 - RNA, 23 nt, Mycobacterium bovis subsp bovis AF2122/97
ucaccgacgcacaggcgacggcc

SEQ ID NO: 1127844 - RNA, 16 nt, Mycobacterium bovis subsp bovis AF2122/97
ucaccgacggagaucg

SEQ ID NO: 1127845 - RNA, 17 nt, Mycobacterium bovis subsp bovis AF2122/97
ucaccgacggaugauca

SEQ ID NO: 1127846 - RNA, 18 nt, Mycobacterium bovis subsp bovis AF2122/97
ucaccgaggugccgcgca

SEQ ID NO: 1127847 - RNA, 19 nt, Mycobacterium bovis subsp bovis AF2122/97
ucaccgagucgacggccag

SEQ ID NO: 1127848 - RNA, 17 nt, Mycobacterium bovis subsp bovis AF2122/97
ucaccgacgucgccaag

SEQ ID NO: 1127849 - RNA, 15 nt, Mycobacterium bovis subsp bovis AF2122/97
ucaccgaacggcgag

SEQ ID NO: 1127850 - RNA, 22 nt, Mycobacterium bovis subsp bovis AF2122/97
ucacaccagcgggcaucgcgaa

SEQ ID NO: 1127851 - RNA, 24 nt, Mycobacterium bovis subsp bovis AF2122/97
ucaccgaagaacaguugcccgacg

SEQ ID NO: 1127852 - RNA, 17 nt, Mycobacterium bovis subsp bovis AF2122/97
ucaccgaauaccgccgc

SEQ ID NO: 1127853 - RNA, 17 nt, Mycobacterium bovis subsp bovis AF2122/97
ucaccgaaugcacgacg

SEQ ID NO: 1127854 - RNA, 12 nt, Mycobacterium bovis subsp bovis AF2122/97
ucaccgacaccg

SEQ ID NO: 1127855 - RNA, 13 nt, Mycobacterium bovis subsp bovis AF2122/97
ucaccgacaccgu

SEQ ID NO: 1127856 - RNA, 15 nt, Mycobacterium bovis subsp bovis AF2122/97
ucacaccacgguugg

SEQ ID NO: 1127857 - RNA, 20 nt, Mycobacterium bovis subsp bovis AF2122/97
ucacaagucgacacgccgaa

SEQ ID NO: 1127858 - RNA, 18 nt, Mycobacterium bovis subsp bovis AF2122/97
ucacaacgcgugaccagg

SEQ ID NO: 1127859 - RNA, 19 nt, Mycobacterium bovis subsp bovis AF2122/97
ucacgccaccgcaacucgc

SEQ ID NO: 1127860 - RNA, 19 nt, Mycobacterium bovis subsp bovis AF2122/97
ucacgcguuccauggcccg

SEQ ID NO: 1127861 - RNA, 18 nt, Mycobacterium bovis subsp bovis AF2122/97
ucacgcucggcguccgcc

SEQ ID NO: 1127862 - RNA, 21 nt, Mycobacterium bovis subsp bovis AF2122/97
ucacgcucggcguccgcccag

SEQ ID NO: 1127863 - RNA, 23 nt, Mycobacterium bovis subsp bovis AF2122/97
ucacgcucggcguccgcccagca

SEQ ID NO: 1127864 - RNA, 20 nt, Mycobacterium bovis subsp bovis AF2122/97
ucacgcccaugaccggccgc

SEQ ID NO: 1127865 - RNA, 20 nt, Mycobacterium bovis subsp bovis AF2122/97
ucacgccagucccacugggc

SEQ ID NO: 1127866 - RNA, 13 nt, Mycobacterium bovis subsp bovis AF2122/97
ucacgcaaccggc

SEQ ID NO: 1127867 - RNA, 15 nt, Mycobacterium bovis subsp bovis AF2122/97
ucacgcacccggcgc

SEQ ID NO: 1127868 - RNA, 15 nt, Mycobacterium bovis subsp bovis AF2122/97
ucacgcaccggcgca

SEQ ID NO: 1127869 - RNA, 17 nt, Mycobacterium bovis subsp bovis AF2122/97
ucaccugcgggugcguc

SEQ ID NO: 1127870 - RNA, 20 nt, Mycobacterium bovis subsp bovis AF2122/97
ucaccugcgggugcgucgau

SEQ ID NO: 1127871 - RNA, 22 nt, Mycobacterium bovis subsp bovis AF2122/97
ucaccugcugcaaccgacuucg

SEQ ID NO: 1127872 - RNA, 18 nt, Mycobacterium bovis subsp bovis AF2122/97
ucaccuggcgugucgccg

SEQ ID NO: 1127873 - RNA, 23 nt, Mycobacterium bovis subsp bovis AF2122/97
ucaccuggcgugucgccgccacc

SEQ ID NO: 1127874 - RNA, 21 nt, Mycobacterium bovis subsp bovis AF2122/97
ucaccugccagugggccgacg

SEQ ID NO: 1127875 - RNA, 17 nt, Mycobacterium bovis subsp bovis AF2122/97
ucacgaugcgguucucg

SEQ ID NO: 1127876 - RNA, 16 nt, Mycobacterium bovis subsp bovis AF2122/97
ucacgaugcucgccgu

SEQ ID NO: 1127877 - RNA, 19 nt, Mycobacterium bovis subsp bovis AF2122/97
ucacgauguccucgaugcg

SEQ ID NO: 1127878 - RNA, 16 nt, Mycobacterium bovis subsp bovis AF2122/97
ucacgaugucguugua

SEQ ID NO: 1127879 - RNA, 15 nt, Mycobacterium bovis subsp bovis AF2122/97
ucaccuucggccgac

SEQ ID NO: 1127880 - RNA, 23 nt, Mycobacterium bovis subsp bovis AF2122/97
ucaccuucgucgcggccgcggcc

SEQ ID NO: 1127881 - RNA, 14 nt, Mycobacterium bovis subsp bovis AF2122/97
ucaccuugcgcacc

SEQ ID NO: 1127882 - RNA, 15 nt, Mycobacterium bovis subsp bovis AF2122/97
ucaccuugcgcacca

SEQ ID NO: 1127883 - RNA, 20 nt, Mycobacterium bovis subsp bovis AF2122/97
ucaccuugucaaaggugcac

SEQ ID NO: 1127884 - RNA, 18 nt, Mycobacterium bovis subsp bovis AF2122/97
ucagcguggacgcccgcc

SEQ ID NO: 1127885 - RNA, 19 nt, Mycobacterium bovis subsp bovis AF2122/97
ucagcguggacgcccgccc

SEQ ID NO: 1127886 - RNA, 21 nt, Mycobacterium bovis subsp bovis AF2122/97
ucagcguggacgcccgcccgc

SEQ ID NO: 1127887 - RNA, 21 nt, Mycobacterium bovis subsp bovis AF2122/97
ucagcguggcgcccgugccgc

SEQ ID NO: 1127888 - RNA, 22 nt, Mycobacterium bovis subsp bovis AF2122/97
ucagcguugaccgcaucgucga

SEQ ID NO: 1127889 - RNA, 18 nt, Mycobacterium bovis subsp bovis AF2122/97
ucagcgucggcgcaucac

SEQ ID NO: 1127890 - RNA, 22 nt, Mycobacterium bovis subsp bovis AF2122/97
ucagcgucucucgcagcuccuc

SEQ ID NO: 1127891 - RNA, 15 nt, Mycobacterium bovis subsp bovis AF2122/97
ucagcgucugagcgc

SEQ ID NO: 1127892 - RNA, 20 nt, Mycobacterium bovis subsp bovis AF2122/97
ucagcgucugagcgccggca

SEQ ID NO: 1127893 - RNA, 14 nt, Mycobacterium bovis subsp bovis AF2122/97
ucagcgguugggcg

SEQ ID NO: 1127894 - RNA, 15 nt, Mycobacterium bovis subsp bovis AF2122/97
ucagcuaccuccgcc

SEQ ID NO: 1127895 - RNA, 21 nt, Mycobacterium bovis subsp bovis AF2122/97
ucagcuagcgcgggcucacau

SEQ ID NO: 1127896 - RNA, 22 nt, Mycobacterium bovis subsp bovis AF2122/97
ucagcucgaucacgccggccuc

SEQ ID NO: 1127897 - RNA, 19 nt, Mycobacterium bovis subsp bovis AF2122/97
ucagcucgcgcacgucgac

SEQ ID NO: 1127898 - RNA, 14 nt, Mycobacterium bovis subsp bovis AF2122/97
ucagcucgaugccg

SEQ ID NO: 1127899 - RNA, 16 nt, Mycobacterium bovis subsp bovis AF2122/97
ucagcucgaugccgug

SEQ ID NO: 1127900 - RNA, 13 nt, Mycobacterium bovis subsp bovis AF2122/97
ucagcucgaggac

SEQ ID NO: 1127901 - RNA, 17 nt, Mycobacterium bovis subsp bovis AF2122/97
ucagcucgaucacgccg

SEQ ID NO: 1127902 - RNA, 15 nt, Mycobacterium bovis subsp bovis AF2122/97
ucagcgcuggcaggc

SEQ ID NO: 1127903 - RNA, 17 nt, Mycobacterium bovis subsp bovis AF2122/97
ucagcgcuggcaggccg

SEQ ID NO: 1127904 - RNA, 21 nt, Mycobacterium bovis subsp bovis AF2122/97
ucagcgcuggcaggccgggca

SEQ ID NO: 1127905 - RNA, 15 nt, Mycobacterium bovis subsp bovis AF2122/97
ucagcggggugcugc

SEQ ID NO: 1127906 - RNA, 22 nt, Mycobacterium bovis subsp bovis AF2122/97
ucagcgguacguaaucgagcgc

SEQ ID NO: 1127907 - RNA, 19 nt, Mycobacterium bovis subsp bovis AF2122/97
ucagcgucccggucgccaa

SEQ ID NO: 1127908 - RNA, 15 nt, Mycobacterium bovis subsp bovis AF2122/97
ucagcgcggcgaccu

SEQ ID NO: 1127909 - RNA, 12 nt, Mycobacterium bovis subsp bovis AF2122/97
ucagcgcuggca

SEQ ID NO: 1127910 - RNA, 16 nt, Mycobacterium bovis subsp bovis AF2122/97
ucagcgcugagccgcu

SEQ ID NO: 1127911 - RNA, 14 nt, Mycobacterium bovis subsp bovis AF2122/97
ucaggaucccggug

SEQ ID NO: 1127912 - RNA, 22 nt, Mycobacterium bovis subsp bovis AF2122/97
ucaggaacaaguagccgucguc

SEQ ID NO: 1127913 - RNA, 18 nt, Mycobacterium bovis subsp bovis AF2122/97
ucaggacgaacgcuggcg

SEQ ID NO: 1127914 - RNA, 18 nt, Mycobacterium bovis subsp bovis AF2122/97
ucaggcaguccaccgcgc

SEQ ID NO: 1127915 - RNA, 20 nt, Mycobacterium bovis subsp bovis AF2122/97
ucaggcaguccaccgcgcgg

SEQ ID NO: 1127916 - RNA, 20 nt, Mycobacterium bovis subsp bovis AF2122/97
ucagcugauuaccgacaccg

SEQ ID NO: 1127917 - RNA, 18 nt, Mycobacterium bovis subsp bovis AF2122/97
ucagcugcaccuccgacg

SEQ ID NO: 1127918 - RNA, 21 nt, Mycobacterium bovis subsp bovis AF2122/97
ucagcugcaccuccgacggcc

SEQ ID NO: 1127919 - RNA, 23 nt, Mycobacterium bovis subsp bovis AF2122/97
ucagcugcaccuccgacggccgc

SEQ ID NO: 1127920 - RNA, 20 nt, Mycobacterium bovis subsp bovis AF2122/97
ucaggaagcgugcggucguu

SEQ ID NO: 1127921 - RNA, 22 nt, Mycobacterium bovis subsp bovis AF2122/97
ucagcuugugggcgacggcgau

SEQ ID NO: 1127922 - RNA, 16 nt, Mycobacterium bovis subsp bovis AF2122/97
ucagcuuuaucggccc

SEQ ID NO: 1127923 - RNA, 16 nt, Mycobacterium bovis subsp bovis AF2122/97
ucagcuuggacccugc

SEQ ID NO: 1127924 - RNA, 22 nt, Mycobacterium bovis subsp bovis AF2122/97
ucagcuucuuaccgcgggccgc

SEQ ID NO: 1127925 - RNA, 18 nt, Mycobacterium bovis subsp bovis AF2122/97
ucagccccgacugcgccc

SEQ ID NO: 1127926 - RNA, 16 nt, Mycobacterium bovis subsp bovis AF2122/97
ucagccguacgccgua

SEQ ID NO: 1127927 - RNA, 22 nt, Mycobacterium bovis subsp bovis AF2122/97
ucagcccgacaccguccagcag

SEQ ID NO: 1127928 - RNA, 17 nt, Mycobacterium bovis subsp bovis AF2122/97
ucagcgacgcauaaccg

SEQ ID NO: 1127929 - RNA, 21 nt, Mycobacterium bovis subsp bovis AF2122/97
ucagcgacgcauaaccggcgc

SEQ ID NO: 1127930 - RNA, 20 nt, Mycobacterium bovis subsp bovis AF2122/97
ucagcgacggccgccagcag

SEQ ID NO: 1127931 - RNA, 20 nt, Mycobacterium bovis subsp bovis AF2122/97
ucagcgaaccaccggcgccg

SEQ ID NO: 1127932 - RNA, 21 nt, Mycobacterium bovis subsp bovis AF2122/97
ucagccgugcccaggccaccg

SEQ ID NO: 1127933 - RNA, 18 nt, Mycobacterium bovis subsp bovis AF2122/97
ucagcgacuugcuggcgu

SEQ ID NO: 1127934 - RNA, 20 nt, Mycobacterium bovis subsp bovis AF2122/97
ucagcgcgaccgucaggguc

SEQ ID NO: 1127935 - RNA, 16 nt, Mycobacterium bovis subsp bovis AF2122/97
ucagcgccugguccuc

SEQ ID NO: 1127936 - RNA, 19 nt, Mycobacterium bovis subsp bovis AF2122/97
ucagcgcgcgccgcugggu

SEQ ID NO: 1127937 - RNA, 14 nt, Mycobacterium bovis subsp bovis AF2122/97
ucagcgcggcgccc

SEQ ID NO: 1127938 - RNA, 14 nt, Mycobacterium bovis subsp bovis AF2122/97
ucagccaggccgca

SEQ ID NO: 1127939 - RNA, 12 nt, Mycobacterium bovis subsp bovis AF2122/97
ucagcccaggug

SEQ ID NO: 1127940 - RNA, 16 nt, Mycobacterium bovis subsp bovis AF2122/97
ucagcccaugcccggc

SEQ ID NO: 1127941 - RNA, 16 nt, Mycobacterium bovis subsp bovis AF2122/97
ucagccaguccagcgc

SEQ ID NO: 1127942 - RNA, 14 nt, Mycobacterium bovis subsp bovis AF2122/97
ucagccaccgcaug

SEQ ID NO: 1127943 - RNA, 12 nt, Mycobacterium bovis subsp bovis AF2122/97
ucagauccucga

SEQ ID NO: 1127944 - RNA, 20 nt, Mycobacterium bovis subsp bovis AF2122/97
ucagaucgucacucccgaca

SEQ ID NO: 1127945 - RNA, 21 nt, Mycobacterium bovis subsp bovis AF2122/97
ucagauagauagcggugccgu

SEQ ID NO: 1127946 - RNA, 22 nt, Mycobacterium bovis subsp bovis AF2122/97
ucagaucuccaagcucgacaac

SEQ ID NO: 1127947 - RNA, 17 nt, Mycobacterium bovis subsp bovis AF2122/97
ugaccagcaggccgggc

SEQ ID NO: 1127948 - RNA, 14 nt, Mycobacterium bovis subsp bovis AF2122/97
ugaccacgccgacg

SEQ ID NO: 1127949 - RNA, 20 nt, Mycobacterium bovis subsp bovis AF2122/97
ugaccagcacaccgcccgca

SEQ ID NO: 1127950 - RNA, 16 nt, Mycobacterium bovis subsp bovis AF2122/97
ugaccaggccggcccg

SEQ ID NO: 1127951 - RNA, 18 nt, Mycobacterium bovis subsp bovis AF2122/97
ugaccaggccggcccgca

SEQ ID NO: 1127952 - RNA, 15 nt, Mycobacterium bovis subsp bovis AF2122/97
ugaccaggcggcgcg

SEQ ID NO: 1127953 - RNA, 18 nt, Mycobacterium bovis subsp bovis AF2122/97
ugaccaggcuccggccgg

SEQ ID NO: 1127954 - RNA, 17 nt, Mycobacterium bovis subsp bovis AF2122/97
ugaccagcuucggcugg

SEQ ID NO: 1127955 - RNA, 15 nt, Mycobacterium bovis subsp bovis AF2122/97
ugaccacgccguggc

SEQ ID NO: 1127956 - RNA, 19 nt, Mycobacterium bovis subsp bovis AF2122/97
ugaccaaugucagugcccc

SEQ ID NO: 1127957 - RNA, 16 nt, Mycobacterium bovis subsp bovis AF2122/97
ugaccaaugugccggu

SEQ ID NO: 1127958 - RNA, 18 nt, Mycobacterium bovis subsp bovis AF2122/97
ugaccaccaccgagccgu

SEQ ID NO: 1127959 - RNA, 15 nt, Mycobacterium bovis subsp bovis AF2122/97
ugacagccccgccgc

SEQ ID NO: 1127960 - RNA, 20 nt, Mycobacterium bovis subsp bovis AF2122/97
ugacagcuuucuuggcgggc

SEQ ID NO: 1127961 - RNA, 18 nt, Mycobacterium bovis subsp bovis AF2122/97
ugacauagguaugcccgg

SEQ ID NO: 1127962 - RNA, 14 nt, Mycobacterium bovis subsp bovis AF2122/97
ugaccaacgucgac

SEQ ID NO: 1127963 - RNA, 18 nt, Mycobacterium bovis subsp bovis AF2122/97
ugaccaacccucgccggu

SEQ ID NO: 1127964 - RNA, 18 nt, Mycobacterium bovis subsp bovis AF2122/97
ugacaucgggccgccgag

SEQ ID NO: 1127965 - RNA, 15 nt, Mycobacterium bovis subsp bovis AF2122/97
ugacaucggucagca

SEQ ID NO: 1127966 - RNA, 13 nt, Mycobacterium bovis subsp bovis AF2122/97
ugaauggugaccg

SEQ ID NO: 1127967 - RNA, 19 nt, Mycobacterium bovis subsp bovis AF2122/97
ugaauguugccgccgcggc

SEQ ID NO: 1127968 - RNA, 23 nt, Mycobacterium bovis subsp bovis AF2122/97
ugaauguugccgccgcggcgccc

SEQ ID NO: 1127969 - RNA, 13 nt, Mycobacterium bovis subsp bovis AF2122/97
ugaauugccgggc

SEQ ID NO: 1127970 - RNA, 17 nt, Mycobacterium bovis subsp bovis AF2122/97
ugaaucgguucggccag

SEQ ID NO: 1127971 - RNA, 13 nt, Mycobacterium bovis subsp bovis AF2122/97
ugacaccggccac

SEQ ID NO: 1127972 - RNA, 19 nt, Mycobacterium bovis subsp bovis AF2122/97
ugacacccaucgaccgccc

SEQ ID NO: 1127973 - RNA, 13 nt, Mycobacterium bovis subsp bovis AF2122/97
ugacaccgaccgg

SEQ ID NO: 1127974 - RNA, 19 nt, Mycobacterium bovis subsp bovis AF2122/97
ugacaccgaggucggccag

SEQ ID NO: 1127975 - RNA, 18 nt, Mycobacterium bovis subsp bovis AF2122/97
ugacacgaugcccggcau

SEQ ID NO: 1127976 - RNA, 19 nt, Mycobacterium bovis subsp bovis AF2122/97
ugacacaacaccggcgugg

SEQ ID NO: 1127977 - RNA, 20 nt, Mycobacterium bovis subsp bovis AF2122/97
ugacaccaacaccgguggcu

SEQ ID NO: 1127978 - RNA, 15 nt, Mycobacterium bovis subsp bovis AF2122/97
ugacaacugcgccgg

SEQ ID NO: 1127979 - RNA, 18 nt, Mycobacterium bovis subsp bovis AF2122/97
ugacaaggugcgcugggu

SEQ ID NO: 1127980 - RNA, 14 nt, Mycobacterium bovis subsp bovis AF2122/97
ugaauuggcgccga

SEQ ID NO: 1127981 - RNA, 16 nt, Mycobacterium bovis subsp bovis AF2122/97
ugaacgguucggccgg

SEQ ID NO: 1127982 - RNA, 22 nt, Mycobacterium bovis subsp bovis AF2122/97
ugaacgucacguggucggccac

SEQ ID NO: 1127983 - RNA, 19 nt, Mycobacterium bovis subsp bovis AF2122/97
ugaacguucugcggucggu

SEQ ID NO: 1127984 - RNA, 21 nt, Mycobacterium bovis subsp bovis AF2122/97
ugaacguuuccagcugacggc

SEQ ID NO: 1127985 - RNA, 20 nt, Mycobacterium bovis subsp bovis AF2122/97
ugaacggcaaggucgcggcc

SEQ ID NO: 1127986 - RNA, 22 nt, Mycobacterium bovis subsp bovis AF2122/97
ugaacggcaaggucgcggccag

SEQ ID NO: 1127987 - RNA, 21 nt, Mycobacterium bovis subsp bovis AF2122/97
ugaacgcggacaccgcggcga

SEQ ID NO: 1127988 - RNA, 16 nt, Mycobacterium bovis subsp bovis AF2122/97
ugaaaccaccggccgu

SEQ ID NO: 1127989 - RNA, 20 nt, Mycobacterium bovis subsp bovis AF2122/97
ugaagccgcuggaagucggu

SEQ ID NO: 1127990 - RNA, 23 nt, Mycobacterium bovis subsp bovis AF2122/97
ugaagccgcuggaagucggucug

SEQ ID NO: 1127991 - RNA, 23 nt, Mycobacterium bovis subsp bovis AF2122/97
ugaagcccaacagcaacccgccg

SEQ ID NO: 1127992 - RNA, 11 nt, Mycobacterium bovis subsp bovis AF2122/97
ugaagccagcg

SEQ ID NO: 1127993 - RNA, 13 nt, Mycobacterium bovis subsp bovis AF2122/97
ugaagccagcgca

SEQ ID NO: 1127994 - RNA, 19 nt, Mycobacterium bovis subsp bovis AF2122/97
ugaagaugucuuccugcgc

SEQ ID NO: 1127995 - RNA, 20 nt, Mycobacterium bovis subsp bovis AF2122/97
ugaagccaagaaucacggcc

SEQ ID NO: 1127996 - RNA, 19 nt, Mycobacterium bovis subsp bovis AF2122/97
ugaagccaagcgacucgcc

SEQ ID NO: 1127997 - RNA, 22 nt, Mycobacterium bovis subsp bovis AF2122/97
ugaagaagcccgaagacggggu

SEQ ID NO: 1127998 - RNA, 19 nt, Mycobacterium bovis subsp bovis AF2122/97
ugaagaugauuucgccgag

SEQ ID NO: 1127999 - RNA, 20 nt, Mycobacterium bovis subsp bovis AF2122/97
ugaaggccccgccgguggcc

SEQ ID NO: 1128000 - RNA, 16 nt, Mycobacterium bovis subsp bovis AF2122/97
ugaagguucgaucgcg

SEQ ID NO: 1128001 - RNA, 14 nt, Mycobacterium bovis subsp bovis AF2122/97
ugaagucggugccg

SEQ ID NO: 1128002 - RNA, 19 nt, Mycobacterium bovis subsp bovis AF2122/97
ugaagugggcguuggcggc

SEQ ID NO: 1128003 - RNA, 18 nt, Mycobacterium bovis subsp bovis AF2122/97
ugaaguucgggcaacggc

SEQ ID NO: 1128004 - RNA, 14 nt, Mycobacterium bovis subsp bovis AF2122/97
ugaaguuggcgugg

SEQ ID NO: 1128005 - RNA, 18 nt, Mycobacterium bovis subsp bovis AF2122/97
ugaaucaccggagcgccg

SEQ ID NO: 1128006 - RNA, 20 nt, Mycobacterium bovis subsp bovis AF2122/97
ugaaucaccggagcgccgag

SEQ ID NO: 1128007 - RNA, 14 nt, Mycobacterium bovis subsp bovis AF2122/97
ucuguucgccgacg

SEQ ID NO: 1128008 - RNA, 15 nt, Mycobacterium bovis subsp bovis AF2122/97
ucuuccccucggccg

SEQ ID NO: 1128009 - RNA, 15 nt, Mycobacterium bovis subsp bovis AF2122/97
ucuuccggugcgccg

SEQ ID NO: 1128010 - RNA, 15 nt, Mycobacterium bovis subsp bovis AF2122/97
ucuugcaucgccaau

SEQ ID NO: 1128011 - RNA, 14 nt, Mycobacterium bovis subsp bovis AF2122/97
ucuugccaccgcug

SEQ ID NO: 1128012 - RNA, 12 nt, Mycobacterium bovis subsp bovis AF2122/97
ucuugaccagca

SEQ ID NO: 1128013 - RNA, 13 nt, Mycobacterium bovis subsp bovis AF2122/97
ucuuugcccgcca

SEQ ID NO: 1128014 - RNA, 23 nt, Mycobacterium bovis subsp bovis AF2122/97
ucuuugguuguuggugccagccg

SEQ ID NO: 1128015 - RNA, 16 nt, Mycobacterium bovis subsp bovis AF2122/97
ugaaacagucgaccga

SEQ ID NO: 1128016 - RNA, 12 nt, Mycobacterium bovis subsp bovis AF2122/97
ucugggcuggca

SEQ ID NO: 1128017 - RNA, 13 nt, Mycobacterium bovis subsp bovis AF2122/97
ucugggcgaucgc

SEQ ID NO: 1128018 - RNA, 20 nt, Mycobacterium bovis subsp bovis AF2122/97
ucugggaccccgcugcgacg

SEQ ID NO: 1128019 - RNA, 17 nt, Mycobacterium bovis subsp bovis AF2122/97
ucuggccguugcccgac

SEQ ID NO: 1128020 - RNA, 12 nt, Mycobacterium bovis subsp bovis AF2122/97
ucuggcgcagca

SEQ ID NO: 1128021 - RNA, 22 nt, Mycobacterium bovis subsp bovis AF2122/97
ucugcucgccgggcuuaggccg

SEQ ID NO: 1128022 - RNA, 13 nt, Mycobacterium bovis subsp bovis AF2122/97
ucugcucggcgca

SEQ ID NO: 1128023 - RNA, 19 nt, Mycobacterium bovis subsp bovis AF2122/97
ucugcucgccgugguggau

SEQ ID NO: 1128024 - RNA, 13 nt, Mycobacterium bovis subsp bovis AF2122/97
ucugcucgccgag

SEQ ID NO: 1128025 - RNA, 14 nt, Mycobacterium bovis subsp bovis AF2122/97
ucucgaaagccgcg

SEQ ID NO: 1128026 - RNA, 17 nt, Mycobacterium bovis subsp bovis AF2122/97
ucucgaaagccgcggcc

SEQ ID NO: 1128027 - RNA, 14 nt, Mycobacterium bovis subsp bovis AF2122/97
ucucgaccgcgccu

SEQ ID NO: 1128028 - RNA, 19 nt, Mycobacterium bovis subsp bovis AF2122/97
ucugcgcggcuucgucgac

SEQ ID NO: 1128029 - RNA, 16 nt, Mycobacterium bovis subsp bovis AF2122/97
ucucgacaucggccag

SEQ ID NO: 1128030 - RNA, 13 nt, Mycobacterium bovis subsp bovis AF2122/97
ucucgaccagcgc

SEQ ID NO: 1128031 - RNA, 17 nt, Mycobacterium bovis subsp bovis AF2122/97
ucucgacaguggcgacg

SEQ ID NO: 1128032 - RNA, 17 nt, Mycobacterium bovis subsp bovis AF2122/97
ucugcggccuagggcgg

SEQ ID NO: 1128033 - RNA, 15 nt, Mycobacterium bovis subsp bovis AF2122/97
ucugcggcgcccggu

SEQ ID NO: 1128034 - RNA, 14 nt, Mycobacterium bovis subsp bovis AF2122/97
ucugcggcggucuc

SEQ ID NO: 1128035 - RNA, 17 nt, Mycobacterium bovis subsp bovis AF2122/97
ucugcggaggcgacccc

SEQ ID NO: 1128036 - RNA, 22 nt, Mycobacterium bovis subsp bovis AF2122/97
ucugcgcucccguacgccggcg

SEQ ID NO: 1128037 - RNA, 23 nt, Mycobacterium bovis subsp bovis AF2122/97
ucugcggggugagugaccacgcu

SEQ ID NO: 1128038 - RNA, 22 nt, Mycobacterium bovis subsp bovis AF2122/97
ucugcuagcuuggcggccagcg

SEQ ID NO: 1128039 - RNA, 21 nt, Mycobacterium bovis subsp bovis AF2122/97
aauacugccguucggggcgcg

SEQ ID NO: 1128040 - RNA, 21 nt, Mycobacterium bovis subsp bovis AF2122/97
ucuggguggacaggucgggcc

SEQ ID NO: 1128041 - RNA, 17 nt, Mycobacterium bovis subsp bovis AF2122/97
ucuggggguagccgccg

SEQ ID NO: 1128042 - RNA, 16 nt, Mycobacterium bovis subsp bovis AF2122/97
ucuggucaagacccgc

SEQ ID NO: 1128043 - RNA, 20 nt, Mycobacterium bovis subsp bovis AF2122/97
ucuggucagccgcggcggca

SEQ ID NO: 1128044 - RNA, 19 nt, Mycobacterium bovis subsp bovis AF2122/97
ucuggugacggugaagccg

SEQ ID NO: 1128045 - RNA, 17 nt, Mycobacterium bovis subsp bovis AF2122/97
ucugguggucggcgacg

SEQ ID NO: 1128046 - RNA, 17 nt, Mycobacterium bovis subsp bovis AF2122/97
ucugguguccaccgcaa

SEQ ID NO: 1128047 - RNA, 15 nt, Mycobacterium bovis subsp bovis AF2122/97
ucugguggcagcgca

SEQ ID NO: 1128048 - RNA, 20 nt, Mycobacterium bovis subsp bovis AF2122/97
ucuggguccgucgagucgcc

SEQ ID NO: 1128049 - RNA, 16 nt, Mycobacterium bovis subsp bovis AF2122/97
ucugucccggcgcgcc

SEQ ID NO: 1128050 - RNA, 21 nt, Mycobacterium bovis subsp bovis AF2122/97
ucggugcggugauuccagccg

SEQ ID NO: 1128051 - RNA, 20 nt, Mycobacterium bovis subsp bovis AF2122/97
ucggugcugaccccgccggc

SEQ ID NO: 1128052 - RNA, 21 nt, Mycobacterium bovis subsp bovis AF2122/97
ucggugcgcuggcggcgcagc

SEQ ID NO: 1128053 - RNA, 24 nt, Mycobacterium bovis subsp bovis AF2122/97
ucggugcggaacacgaugcgcggu

SEQ ID NO: 1128054 - RNA, 14 nt, Mycobacterium bovis subsp bovis AF2122/97
ucgguggcaacggg

SEQ ID NO: 1128055 - RNA, 18 nt, Mycobacterium bovis subsp bovis AF2122/97
ucgguggcaacgggucgg

SEQ ID NO: 1128056 - RNA, 19 nt, Mycobacterium bovis subsp bovis AF2122/97
ucgguggcaacgggucggc

SEQ ID NO: 1128057 - RNA, 17 nt, Mycobacterium bovis subsp bovis AF2122/97
ucgguggagggcgagca

SEQ ID NO: 1128058 - RNA, 20 nt, Mycobacterium bovis subsp bovis AF2122/97
ucgguggcgccgaacgccag

SEQ ID NO: 1128059 - RNA, 16 nt, Mycobacterium bovis subsp bovis AF2122/97
ucgguggccaccaccg

SEQ ID NO: 1128060 - RNA, 15 nt, Mycobacterium bovis subsp bovis AF2122/97
ucgguggcgccgggg

SEQ ID NO: 1128061 - RNA, 14 nt, Mycobacterium bovis subsp bovis AF2122/97
ucgguggccaucgc

SEQ ID NO: 1128062 - RNA, 20 nt, Mycobacterium bovis subsp bovis AF2122/97
ucgguggcuacgccccacug

SEQ ID NO: 1128063 - RNA, 14 nt, Mycobacterium bovis subsp bovis AF2122/97
ucgguggcugccac

SEQ ID NO: 1128064 - RNA, 17 nt, Mycobacterium bovis subsp bovis AF2122/97
ucgguggcugcgccgga

SEQ ID NO: 1128065 - RNA, 15 nt, Mycobacterium bovis subsp bovis AF2122/97
ucgguggcggacggc

SEQ ID NO: 1128066 - RNA, 14 nt, Mycobacterium bovis subsp bovis AF2122/97
ucgguggcggcagc

SEQ ID NO: 1128067 - RNA, 21 nt, Mycobacterium bovis subsp bovis AF2122/97
ucggugggguauucguuggcg

SEQ ID NO: 1128068 - RNA, 21 nt, Mycobacterium bovis subsp bovis AF2122/97
ucgguggggucgcugccgccg

SEQ ID NO: 1128069 - RNA, 17 nt, Mycobacterium bovis subsp bovis AF2122/97
ucggugggugccagccg

SEQ ID NO: 1128070 - RNA, 16 nt, Mycobacterium bovis subsp bovis AF2122/97
ucgguggggcgccggg

SEQ ID NO: 1128071 - RNA, 18 nt, Mycobacterium bovis subsp bovis AF2122/97
ucggugggcuugccgcgc

SEQ ID NO: 1128072 - RNA, 19 nt, Mycobacterium bovis subsp bovis AF2122/97
ucggugggcuugccgcgca

SEQ ID NO: 1128073 - RNA, 19 nt, Mycobacterium bovis subsp bovis AF2122/97
ucgguggucucgacggcgc

SEQ ID NO: 1128074 - RNA, 13 nt, Mycobacterium bovis subsp bovis AF2122/97
ucggugguaacgg

SEQ ID NO: 1128075 - RNA, 15 nt, Mycobacterium bovis subsp bovis AF2122/97
ucggugguccagcgc

SEQ ID NO: 1128076 - RNA, 15 nt, Mycobacterium bovis subsp bovis AF2122/97
ucggugccgcggacg

SEQ ID NO: 1128077 - RNA, 11 nt, Mycobacterium bovis subsp bovis AF2122/97
ucggugccggc

SEQ ID NO: 1128078 - RNA, 21 nt, Mycobacterium bovis subsp bovis AF2122/97
ucggugccggggcugccgccg

SEQ ID NO: 1128079 - RNA, 19 nt, Mycobacterium bovis subsp bovis AF2122/97
ucggugccgagcacucggc

SEQ ID NO: 1128080 - RNA, 19 nt, Mycobacterium bovis subsp bovis AF2122/97
ucggugccgcccaggagca

SEQ ID NO: 1128081 - RNA, 15 nt, Mycobacterium bovis subsp bovis AF2122/97
ucggucucgucgcgg

SEQ ID NO: 1128082 - RNA, 15 nt, Mycobacterium bovis subsp bovis AF2122/97
ucggugccacggcac

SEQ ID NO: 1128083 - RNA, 16 nt, Mycobacterium bovis subsp bovis AF2122/97
ucggugccacggcacc

SEQ ID NO: 1128084 - RNA, 23 nt, Mycobacterium bovis subsp bovis AF2122/97
ucggugccacggcaccgaagucg

SEQ ID NO: 1128085 - RNA, 21 nt, Mycobacterium bovis subsp bovis AF2122/97
ucggugccagcacuccaccgc

SEQ ID NO: 1128086 - RNA, 20 nt, Mycobacterium bovis subsp bovis AF2122/97
ucggugauggagccggugac

SEQ ID NO: 1128087 - RNA, 22 nt, Mycobacterium bovis subsp bovis AF2122/97
ucggugaucucguacuccccgc

SEQ ID NO: 1128088 - RNA, 22 nt, Mycobacterium bovis subsp bovis AF2122/97
ucggugagccgugccgccagca

SEQ ID NO: 1128089 - RNA, 22 nt, Mycobacterium bovis subsp bovis AF2122/97
ucggugagcccguugaccugcg

SEQ ID NO: 1128090 - RNA, 22 nt, Mycobacterium bovis subsp bovis AF2122/97
ucggugaucaaaccggcggcga

SEQ ID NO: 1128091 - RNA, 20 nt, Mycobacterium bovis subsp bovis AF2122/97
ucggugaucacggucggcgg

SEQ ID NO: 1128092 - RNA, 14 nt, Mycobacterium bovis subsp bovis AF2122/97
ucggugaucgcggu

SEQ ID NO: 1128093 - RNA, 15 nt, Mycobacterium bovis subsp bovis AF2122/97
ucggcuccgccgcgg

SEQ ID NO: 1128094 - RNA, 17 nt, Mycobacterium bovis subsp bovis AF2122/97
ucggcuccgccgcgggc

SEQ ID NO: 1128095 - RNA, 17 nt, Mycobacterium bovis subsp bovis AF2122/97
ucggcugccgcggcugc

SEQ ID NO: 1128096 - RNA, 22 nt, Mycobacterium bovis subsp bovis AF2122/97
ucggcugcgacaggacgucggc

SEQ ID NO: 1128097 - RNA, 17 nt, Mycobacterium bovis subsp bovis AF2122/97
ucggcuggccgcgccuc

SEQ ID NO: 1128098 - RNA, 16 nt, Mycobacterium bovis subsp bovis AF2122/97
ucggcugccaccgcag

SEQ ID NO: 1128099 - RNA, 19 nt, Mycobacterium bovis subsp bovis AF2122/97
ucggcugccaccgcagacg

SEQ ID NO: 1128100 - RNA, 15 nt, Mycobacterium bovis subsp bovis AF2122/97
ucggcugccgcgcgc

SEQ ID NO: 1128101 - RNA, 21 nt, Mycobacterium bovis subsp bovis AF2122/97
ucggguuccgaucucaagggc

SEQ ID NO: 1128102 - RNA, 20 nt, Mycobacterium bovis subsp bovis AF2122/97
ucggguguggucaccaggcc

SEQ ID NO: 1128103 - RNA, 21 nt, Mycobacterium bovis subsp bovis AF2122/97
ucggguguggucaccaggccg

SEQ ID NO: 1128104 - RNA, 18 nt, Mycobacterium bovis subsp bovis AF2122/97
ucggguuccacgaucacc

SEQ ID NO: 1128105 - RNA, 14 nt, Mycobacterium bovis subsp bovis AF2122/97
ucggguguggucac

SEQ ID NO: 1128106 - RNA, 21 nt, Mycobacterium bovis subsp bovis AF2122/97
ucggcugucacaagccugccg

SEQ ID NO: 1128107 - RNA, 15 nt, Mycobacterium bovis subsp bovis AF2122/97
ucggguuuggccgac

SEQ ID NO: 1128108 - RNA, 20 nt, Mycobacterium bovis subsp bovis AF2122/97
ucggguuuggccgacagcca

SEQ ID NO: 1128109 - RNA, 14 nt, Mycobacterium bovis subsp bovis AF2122/97
ucggguugcgacga

SEQ ID NO: 1128110 - RNA, 23 nt, Mycobacterium bovis subsp bovis AF2122/97
ucggguugggcaucaggccgcgc

SEQ ID NO: 1128111 - RNA, 15 nt, Mycobacterium bovis subsp bovis AF2122/97
ucggguuucgaucuu

SEQ ID NO: 1128112 - RNA, 21 nt, Mycobacterium bovis subsp bovis AF2122/97
ucggucuccaccaccgacgag

SEQ ID NO: 1128113 - RNA, 21 nt, Mycobacterium bovis subsp bovis AF2122/97
ucggucguugccgcggucggc

SEQ ID NO: 1128114 - RNA, 17 nt, Mycobacterium bovis subsp bovis AF2122/97
ucgguaggcaggccggc

SEQ ID NO: 1128115 - RNA, 15 nt, Mycobacterium bovis subsp bovis AF2122/97
ucgguaggcgguguc

SEQ ID NO: 1128116 - RNA, 17 nt, Mycobacterium bovis subsp bovis AF2122/97
ucgguaggcggugucca

SEQ ID NO: 1128117 - RNA, 21 nt, Mycobacterium bovis subsp bovis AF2122/97
ucggucugguggucggcgacg

SEQ ID NO: 1128118 - RNA, 14 nt, Mycobacterium bovis subsp bovis AF2122/97
ucgguacccgcacc

SEQ ID NO: 1128119 - RNA, 13 nt, Mycobacterium bovis subsp bovis AF2122/97
ucgguaagugccu

SEQ ID NO: 1128120 - RNA, 14 nt, Mycobacterium bovis subsp bovis AF2122/97
ucgguaauggccgc

SEQ ID NO: 1128121 - RNA, 18 nt, Mycobacterium bovis subsp bovis AF2122/97
ucgguaauggccgccggu

SEQ ID NO: 1128122 - RNA, 14 nt, Mycobacterium bovis subsp bovis AF2122/97
ucgguagcauccag

SEQ ID NO: 1128123 - RNA, 20 nt, Mycobacterium bovis subsp bovis AF2122/97
ucgguagcgaucgugcugcc

SEQ ID NO: 1128124 - RNA, 15 nt, Mycobacterium bovis subsp bovis AF2122/97
ucgguagcugaccgu

SEQ ID NO: 1128125 - RNA, 19 nt, Mycobacterium bovis subsp bovis AF2122/97
ucggugagcagggcggcga

SEQ ID NO: 1128126 - RNA, 23 nt, Mycobacterium bovis subsp bovis AF2122/97
ucggugacgcgccguaacagccg

SEQ ID NO: 1128127 - RNA, 22 nt, Mycobacterium bovis subsp bovis AF2122/97
ucggugacgaagagcaccgcgc

SEQ ID NO: 1128128 - RNA, 16 nt, Mycobacterium bovis subsp bovis AF2122/97
ucggugacccgggcgg

SEQ ID NO: 1128129 - RNA, 15 nt, Mycobacterium bovis subsp bovis AF2122/97
ucggugaccaggccg

SEQ ID NO: 1128130 - RNA, 22 nt, Mycobacterium bovis subsp bovis AF2122/97
ucggucuuuggcauugccgcca

SEQ ID NO: 1128131 - RNA, 22 nt, Mycobacterium bovis subsp bovis AF2122/97
ucggugaaaugacggcugaacc

SEQ ID NO: 1128132 - RNA, 20 nt, Mycobacterium bovis subsp bovis AF2122/97
ucggugaacgccgccccgau

SEQ ID NO: 1128133 - RNA, 18 nt, Mycobacterium bovis subsp bovis AF2122/97
ucggugaaugccgucgcc

SEQ ID NO: 1128134 - RNA, 22 nt, Mycobacterium bovis subsp bovis AF2122/97
ucgucggcaugggccggcgccg

SEQ ID NO: 1128135 - RNA, 22 nt, Mycobacterium bovis subsp bovis AF2122/97
ucgucgccgucggugccgccgc

SEQ ID NO: 1128136 - RNA, 21 nt, Mycobacterium bovis subsp bovis AF2122/97
ucgucggcaaccaaccgcgcg

SEQ ID NO: 1128137 - RNA, 20 nt, Mycobacterium bovis subsp bovis AF2122/97
ucgucgcgugcaucgccugc

SEQ ID NO: 1128138 - RNA, 13 nt, Mycobacterium bovis subsp bovis AF2122/97
ucgucgcucccgg

SEQ ID NO: 1128139 - RNA, 20 nt, Mycobacterium bovis subsp bovis AF2122/97
ucgucgcugaacagacggcu

SEQ ID NO: 1128140 - RNA, 13 nt, Mycobacterium bovis subsp bovis AF2122/97
ucgucgcugagca

SEQ ID NO: 1128141 - RNA, 17 nt, Mycobacterium bovis subsp bovis AF2122/97
ucgucgcugagcagcgc

SEQ ID NO: 1128142 - RNA, 19 nt, Mycobacterium bovis subsp bovis AF2122/97
ucgucgcugagcagcgccg

SEQ ID NO: 1128143 - RNA, 21 nt, Mycobacterium bovis subsp bovis AF2122/97
ucgucgcuguaggcgauaucg

SEQ ID NO: 1128144 - RNA, 19 nt, Mycobacterium bovis subsp bovis AF2122/97
ucgucgccgucggugccgc

SEQ ID NO: 1128145 - RNA, 15 nt, Mycobacterium bovis subsp bovis AF2122/97
ucgucgccggcggcg

SEQ ID NO: 1128146 - RNA, 21 nt, Mycobacterium bovis subsp bovis AF2122/97
ucgucgccggcggcggugcgc

SEQ ID NO: 1128147 - RNA, 15 nt, Mycobacterium bovis subsp bovis AF2122/97
ucgucgccgccggug

SEQ ID NO: 1128148 - RNA, 14 nt, Mycobacterium bovis subsp bovis AF2122/97
ucgucgccgcgcag

SEQ ID NO: 1128149 - RNA, 20 nt, Mycobacterium bovis subsp bovis AF2122/97
ucgucgccuagccgcuccgc

SEQ ID NO: 1128150 - RNA, 18 nt, Mycobacterium bovis subsp bovis AF2122/97
ucgucgcgggccaccgcu

SEQ ID NO: 1128151 - RNA, 17 nt, Mycobacterium bovis subsp bovis AF2122/97
ucgucgcggguguucca

SEQ ID NO: 1128152 - RNA, 14 nt, Mycobacterium bovis subsp bovis AF2122/97
ucgucgagccgacc

SEQ ID NO: 1128153 - RNA, 16 nt, Mycobacterium bovis subsp bovis AF2122/97
ucgucgagccgaccgc

SEQ ID NO: 1128154 - RNA, 16 nt, Mycobacterium bovis subsp bovis AF2122/97
ucgucgagccgaucgc

SEQ ID NO: 1128155 - RNA, 15 nt, Mycobacterium bovis subsp bovis AF2122/97
ucgucgaggucacgc

SEQ ID NO: 1128156 - RNA, 14 nt, Mycobacterium bovis subsp bovis AF2122/97
ucgucgagcaccac

SEQ ID NO: 1128157 - RNA, 22 nt, Mycobacterium bovis subsp bovis AF2122/97
ucgucgagcgcggugccgccac

SEQ ID NO: 1128158 - RNA, 13 nt, Mycobacterium bovis subsp bovis AF2122/97
ucgucgaguuggc

SEQ ID NO: 1128159 - RNA, 14 nt, Mycobacterium bovis subsp bovis AF2122/97
ucgucgagguccuc

SEQ ID NO: 1128160 - RNA, 22 nt, Mycobacterium bovis subsp bovis AF2122/97
ucgucgaggucacgcgaggcga

SEQ ID NO: 1128161 - RNA, 18 nt, Mycobacterium bovis subsp bovis AF2122/97
ucgucgagauagccgacg

SEQ ID NO: 1128162 - RNA, 22 nt, Mycobacterium bovis subsp bovis AF2122/97
ucgucgagauagccgacgucgc

SEQ ID NO: 1128163 - RNA, 13 nt, Mycobacterium bovis subsp bovis AF2122/97
ucgucgacgucgu

SEQ ID NO: 1128164 - RNA, 12 nt, Mycobacterium bovis subsp bovis AF2122/97
ucgucgacgcgu

SEQ ID NO: 1128165 - RNA, 22 nt, Mycobacterium bovis subsp bovis AF2122/97
ucgucgacgcgucguggucggc

SEQ ID NO: 1128166 - RNA, 17 nt, Mycobacterium bovis subsp bovis AF2122/97
ucgucgacuugcaggcg

SEQ ID NO: 1128167 - RNA, 13 nt, Mycobacterium bovis subsp bovis AF2122/97
ucgucgacgucgg

SEQ ID NO: 1128168 - RNA, 14 nt, Mycobacterium bovis subsp bovis AF2122/97
ucguccggugcgau

SEQ ID NO: 1128169 - RNA, 13 nt, Mycobacterium bovis subsp bovis AF2122/97
ucgucccgcggcg

SEQ ID NO: 1128170 - RNA, 16 nt, Mycobacterium bovis subsp bovis AF2122/97
ucguccccagaccggc

SEQ ID NO: 1128171 - RNA, 19 nt, Mycobacterium bovis subsp bovis AF2122/97
ucgucccagucccgcgucg

SEQ ID NO: 1128172 - RNA, 13 nt, Mycobacterium bovis subsp bovis AF2122/97
ucgucaguaccgc

SEQ ID NO: 1128173 - RNA, 16 nt, Mycobacterium bovis subsp bovis AF2122/97
ucgucaguaccgcacg

SEQ ID NO: 1128174 - RNA, 17 nt, Mycobacterium bovis subsp bovis AF2122/97
ucgucaguaccgcacgc

SEQ ID NO: 1128175 - RNA, 14 nt, Mycobacterium bovis subsp bovis AF2122/97
ucgucaucagcgcg

SEQ ID NO: 1128176 - RNA, 12 nt, Mycobacterium bovis subsp bovis AF2122/97
ucgucagcggcc

SEQ ID NO: 1128177 - RNA, 18 nt, Mycobacterium bovis subsp bovis AF2122/97
ucgucagccagcguugug

SEQ ID NO: 1128178 - RNA, 19 nt, Mycobacterium bovis subsp bovis AF2122/97
ucgucacgccccucacgug

SEQ ID NO: 1128179 - RNA, 22 nt, Mycobacterium bovis subsp bovis AF2122/97
ucgucacggacccuuccgccgc

SEQ ID NO: 1128180 - RNA, 22 nt, Mycobacterium bovis subsp bovis AF2122/97
ucguagaaggaccgcucgucgc

SEQ ID NO: 1128181 - RNA, 14 nt, Mycobacterium bovis subsp bovis AF2122/97
ucgucacugccacc

SEQ ID NO: 1128182 - RNA, 16 nt, Mycobacterium bovis subsp bovis AF2122/97
ucgucacugccaccuc

SEQ ID NO: 1128183 - RNA, 21 nt, Mycobacterium bovis subsp bovis AF2122/97
ucguacggaccgucgccggug

SEQ ID NO: 1128184 - RNA, 14 nt, Mycobacterium bovis subsp bovis AF2122/97
ucguagaaccgggg

SEQ ID NO: 1128185 - RNA, 19 nt, Mycobacterium bovis subsp bovis AF2122/97
ucgucaccgaugcgccgga

SEQ ID NO: 1128186 - RNA, 22 nt, Mycobacterium bovis subsp bovis AF2122/97
ucgucaccgaugcgccggacca

SEQ ID NO: 1128187 - RNA, 18 nt, Mycobacterium bovis subsp bovis AF2122/97
ucgucaccggucagcgac

SEQ ID NO: 1128188 - RNA, 16 nt, Mycobacterium bovis subsp bovis AF2122/97
ucgucacauugccacc

SEQ ID NO: 1128189 - RNA, 19 nt, Mycobacterium bovis subsp bovis AF2122/97
ucguaccgguugacgggcu

SEQ ID NO: 1128190 - RNA, 18 nt, Mycobacterium bovis subsp bovis AF2122/97
ucguaccagccaugcucg

SEQ ID NO: 1128191 - RNA, 17 nt, Mycobacterium bovis subsp bovis AF2122/97
ucguaccgcgcguugug

SEQ ID NO: 1128192 - RNA, 19 nt, Mycobacterium bovis subsp bovis AF2122/97
ucguacaacacgggcagcu

SEQ ID NO: 1128193 - RNA, 18 nt, Mycobacterium bovis subsp bovis AF2122/97
ucguacaccucgagcgcg

SEQ ID NO: 1128194 - RNA, 19 nt, Mycobacterium bovis subsp bovis AF2122/97
ucguacaccucgagcgcgg

SEQ ID NO: 1128195 - RNA, 15 nt, Mycobacterium bovis subsp bovis AF2122/97
ucguacaugggcaga

SEQ ID NO: 1128196 - RNA, 19 nt, Mycobacterium bovis subsp bovis AF2122/97
ucggugguggguugaucgc

SEQ ID NO: 1128197 - RNA, 18 nt, Mycobacterium bovis subsp bovis AF2122/97
ucgugcaccgcgaccgcg

SEQ ID NO: 1128198 - RNA, 14 nt, Mycobacterium bovis subsp bovis AF2122/97
ucgugcaccgucgg

SEQ ID NO: 1128199 - RNA, 16 nt, Mycobacterium bovis subsp bovis AF2122/97
ucgucggccgacaccg

SEQ ID NO: 1128200 - RNA, 16 nt, Mycobacterium bovis subsp bovis AF2122/97
ucgucggcgacggcca

SEQ ID NO: 1128201 - RNA, 12 nt, Mycobacterium bovis subsp bovis AF2122/97
ucgucggccagc

SEQ ID NO: 1128202 - RNA, 13 nt, Mycobacterium bovis subsp bovis AF2122/97
ucgucggccagca

SEQ ID NO: 1128203 - RNA, 15 nt, Mycobacterium bovis subsp bovis AF2122/97
ucgugcaggcgacgg

SEQ ID NO: 1128204 - RNA, 16 nt, Mycobacterium bovis subsp bovis AF2122/97
ucgugcaggcgacggc

SEQ ID NO: 1128205 - RNA, 13 nt, Mycobacterium bovis subsp bovis AF2122/97
ucgugccgggacc

SEQ ID NO: 1128206 - RNA, 15 nt, Mycobacterium bovis subsp bovis AF2122/97
ucgugccccggcgcg

SEQ ID NO: 1128207 - RNA, 17 nt, Mycobacterium bovis subsp bovis AF2122/97
ucgugcccgggcggucg

SEQ ID NO: 1128208 - RNA, 22 nt, Mycobacterium bovis subsp bovis AF2122/97
ucgugcccuguccggcgccgag

SEQ ID NO: 1128209 - RNA, 15 nt, Mycobacterium bovis subsp bovis AF2122/97
ucgugcacggcggcc

SEQ ID NO: 1128210 - RNA, 14 nt, Mycobacterium bovis subsp bovis AF2122/97
ucgugcaaucgcgu

SEQ ID NO: 1128211 - RNA, 19 nt, Mycobacterium bovis subsp bovis AF2122/97
ucgugcacgacgacaucga

SEQ ID NO: 1128212 - RNA, 24 nt, Mycobacterium bovis subsp bovis AF2122/97
ucgugcacgacgacaucgagccaa

SEQ ID NO: 1128213 - RNA, 15 nt, Mycobacterium bovis subsp bovis AF2122/97
ucgugcgccgacggu

SEQ ID NO: 1128214 - RNA, 20 nt, Mycobacterium bovis subsp bovis AF2122/97
ucgugcgauuuugugucugc

SEQ ID NO: 1128215 - RNA, 19 nt, Mycobacterium bovis subsp bovis AF2122/97
ucgugccggggcugccgaa

SEQ ID NO: 1128216 - RNA, 14 nt, Mycobacterium bovis subsp bovis AF2122/97
ucgugccucggaca

SEQ ID NO: 1128217 - RNA, 21 nt, Mycobacterium bovis subsp bovis AF2122/97
ucgugcgacgcaggaucacac

SEQ ID NO: 1128218 - RNA, 12 nt, Mycobacterium bovis subsp bovis AF2122/97
ucgugcgcggcc

SEQ ID NO: 1128219 - RNA, 20 nt, Mycobacterium bovis subsp bovis AF2122/97
ucgugcgcuuggucgaccgc

SEQ ID NO: 1128220 - RNA, 16 nt, Mycobacterium bovis subsp bovis AF2122/97
ucgugcucucggcgaa

SEQ ID NO: 1128221 - RNA, 21 nt, Mycobacterium bovis subsp bovis AF2122/97
ucgugcugccauugccgcaug

SEQ ID NO: 1128222 - RNA, 21 nt, Mycobacterium bovis subsp bovis AF2122/97
ucgugcgcuuggucgaccgcc

SEQ ID NO: 1128223 - RNA, 17 nt, Mycobacterium bovis subsp bovis AF2122/97
ucgugcgugggcgcggc

SEQ ID NO: 1128224 - RNA, 23 nt, Mycobacterium bovis subsp bovis AF2122/97
ucgugucgccgccguugccgccg

SEQ ID NO: 1128225 - RNA, 13 nt, Mycobacterium bovis subsp bovis AF2122/97
ucgugucggugcg

SEQ ID NO: 1128226 - RNA, 21 nt, Mycobacterium bovis subsp bovis AF2122/97
ucgugugaggccuucgccgac

SEQ ID NO: 1128227 - RNA, 22 nt, Mycobacterium bovis subsp bovis AF2122/97
ucgugcuggugguaucggcgug

SEQ ID NO: 1128228 - RNA, 21 nt, Mycobacterium bovis subsp bovis AF2122/97
ucgugugguucacucucggcg

SEQ ID NO: 1128229 - RNA, 20 nt, Mycobacterium bovis subsp bovis AF2122/97
ucguugaguggaugcgccgc

SEQ ID NO: 1128230 - RNA, 19 nt, Mycobacterium bovis subsp bovis AF2122/97
ucguugaggccggugaacg

SEQ ID NO: 1128231 - RNA, 16 nt, Mycobacterium bovis subsp bovis AF2122/97
ucguugauuucggcgg

SEQ ID NO: 1128232 - RNA, 15 nt, Mycobacterium bovis subsp bovis AF2122/97
ucguucgugcagccc

SEQ ID NO: 1128233 - RNA, 23 nt, Mycobacterium bovis subsp bovis AF2122/97
ucguugaccagaaccuggagccg

SEQ ID NO: 1128234 - RNA, 14 nt, Mycobacterium bovis subsp bovis AF2122/97
ucguuccucgaccg

SEQ ID NO: 1128235 - RNA, 19 nt, Mycobacterium bovis subsp bovis AF2122/97
ucguucgcgggugcgcugc

SEQ ID NO: 1128236 - RNA, 19 nt, Mycobacterium bovis subsp bovis AF2122/97
ucguuccaggccgcgucga

SEQ ID NO: 1128237 - RNA, 17 nt, Mycobacterium bovis subsp bovis AF2122/97
ucguuccgcuggacgga

SEQ ID NO: 1128238 - RNA, 19 nt, Mycobacterium bovis subsp bovis AF2122/97
ucguuccgcuggacggauc

SEQ ID NO: 1128239 - RNA, 14 nt, Mycobacterium bovis subsp bovis AF2122/97
ucguucagcgucga

SEQ ID NO: 1128240 - RNA, 17 nt, Mycobacterium bovis subsp bovis AF2122/97
ucguugccguccaccga

SEQ ID NO: 1128241 - RNA, 22 nt, Mycobacterium bovis subsp bovis AF2122/97
ucguugacucugcguccaccac

SEQ ID NO: 1128242 - RNA, 16 nt, Mycobacterium bovis subsp bovis AF2122/97
ucguuggcgaccaccg

SEQ ID NO: 1128243 - RNA, 20 nt, Mycobacterium bovis subsp bovis AF2122/97
ucguuggcgaccaccgcguc

SEQ ID NO: 1128244 - RNA, 21 nt, Mycobacterium bovis subsp bovis AF2122/97
ucguuggcgaccaccgcgucg

SEQ ID NO: 1128245 - RNA, 12 nt, Mycobacterium bovis subsp bovis AF2122/97
ucguugcucggu

SEQ ID NO: 1128246 - RNA, 21 nt, Mycobacterium bovis subsp bovis AF2122/97
ucguugcucggucucgucgcg

SEQ ID NO: 1128247 - RNA, 19 nt, Mycobacterium bovis subsp bovis AF2122/97
ucguugccgcggucggcga

SEQ ID NO: 1128248 - RNA, 18 nt, Mycobacterium bovis subsp bovis AF2122/97
ucguugccguccaccgau

SEQ ID NO: 1128249 - RNA, 19 nt, Mycobacterium bovis subsp bovis AF2122/97
ucguugccucgucgccgcg

SEQ ID NO: 1128250 - RNA, 14 nt, Mycobacterium bovis subsp bovis AF2122/97
ucguuggcggcggu

SEQ ID NO: 1128251 - RNA, 18 nt, Mycobacterium bovis subsp bovis AF2122/97
ucguuggcggcggucggc

SEQ ID NO: 1128252 - RNA, 19 nt, Mycobacterium bovis subsp bovis AF2122/97
ucguuggcggcggucggcu

SEQ ID NO: 1128253 - RNA, 22 nt, Mycobacterium bovis subsp bovis AF2122/97
ucguugugauccgguggugggc

SEQ ID NO: 1128254 - RNA, 19 nt, Mycobacterium bovis subsp bovis AF2122/97
ucguugugccggucgauga

SEQ ID NO: 1128255 - RNA, 23 nt, Mycobacterium bovis subsp bovis AF2122/97
ucguugugcggacaucaccggca

SEQ ID NO: 1128256 - RNA, 13 nt, Mycobacterium bovis subsp bovis AF2122/97
ucguugucggcgg

SEQ ID NO: 1128257 - RNA, 16 nt, Mycobacterium bovis subsp bovis AF2122/97
ucguuucgaagugccg

SEQ ID NO: 1128258 - RNA, 14 nt, Mycobacterium bovis subsp bovis AF2122/97
ucuccaucgucggc

SEQ ID NO: 1128259 - RNA, 16 nt, Mycobacterium bovis subsp bovis AF2122/97
ucuccauguuggcgaa

SEQ ID NO: 1128260 - RNA, 20 nt, Mycobacterium bovis subsp bovis AF2122/97
ucuccaucaugugcgcgacc

SEQ ID NO: 1128261 - RNA, 18 nt, Mycobacterium bovis subsp bovis AF2122/97
ucuccguccucgucccag

SEQ ID NO: 1128262 - RNA, 12 nt, Mycobacterium bovis subsp bovis AF2122/97
ucuccgucggcc

SEQ ID NO: 1128263 - RNA, 19 nt, Mycobacterium bovis subsp bovis AF2122/97
ucuccugaguugcggugug

SEQ ID NO: 1128264 - RNA, 14 nt, Mycobacterium bovis subsp bovis AF2122/97
ucuccaccgucgcc

SEQ ID NO: 1128265 - RNA, 21 nt, Mycobacterium bovis subsp bovis AF2122/97
ucuccaccuucugguccagca

SEQ ID NO: 1128266 - RNA, 15 nt, Mycobacterium bovis subsp bovis AF2122/97
ucuccaccaccgacg

SEQ ID NO: 1128267 - RNA, 15 nt, Mycobacterium bovis subsp bovis AF2122/97
ucuccaccagcgugg

SEQ ID NO: 1128268 - RNA, 23 nt, Mycobacterium bovis subsp bovis AF2122/97
ucuccaccagcguggacguacug

SEQ ID NO: 1128269 - RNA, 23 nt, Mycobacterium bovis subsp bovis AF2122/97
ucuacucgcggccggcgucggcg

SEQ ID NO: 1128270 - RNA, 14 nt, Mycobacterium bovis subsp bovis AF2122/97
ucuacuucggcgcc

SEQ ID NO: 1128271 - RNA, 23 nt, Mycobacterium bovis subsp bovis AF2122/97
ucuacgcaucccgaauggccgau

SEQ ID NO: 1128272 - RNA, 21 nt, Mycobacterium bovis subsp bovis AF2122/97
ucuacgccgggaauuucgaca

SEQ ID NO: 1128273 - RNA, 13 nt, Mycobacterium bovis subsp bovis AF2122/97
ucuacaucgucga

SEQ ID NO: 1128274 - RNA, 19 nt, Mycobacterium bovis subsp bovis AF2122/97
ucuaccaacaccgcccgca

SEQ ID NO: 1128275 - RNA, 19 nt, Mycobacterium bovis subsp bovis AF2122/97
ucguuuuccagccgacgua

SEQ ID NO: 1128276 - RNA, 20 nt, Mycobacterium bovis subsp bovis AF2122/97
ucguuuucgccgaucccggc

SEQ ID NO: 1128277 - RNA, 19 nt, Mycobacterium bovis subsp bovis AF2122/97
ugccgcccacgcugcccac

SEQ ID NO: 1128278 - RNA, 15 nt, Mycobacterium bovis subsp bovis AF2122/97
ugccgccaucaccgc

SEQ ID NO: 1128279 - RNA, 19 nt, Mycobacterium bovis subsp bovis AF2122/97
ugccgccauuccagccggu

SEQ ID NO: 1128280 - RNA, 20 nt, Mycobacterium bovis subsp bovis AF2122/97
ugccgccauugacgccguug

SEQ ID NO: 1128281 - RNA, 15 nt, Mycobacterium bovis subsp bovis AF2122/97
ugccgccacaaagaa

SEQ ID NO: 1128282 - RNA, 14 nt, Mycobacterium bovis subsp bovis AF2122/97
ugccgccaucaccg

SEQ ID NO: 1128283 - RNA, 15 nt, Mycobacterium bovis subsp bovis AF2122/97
ugccgccaucgccgc

SEQ ID NO: 1128284 - RNA, 18 nt, Mycobacterium bovis subsp bovis AF2122/97
ugccgcccgcuccgccgu

SEQ ID NO: 1128285 - RNA, 22 nt, Mycobacterium bovis subsp bovis AF2122/97
ugccgcccgcuccgccgucgcc

SEQ ID NO: 1128286 - RNA, 21 nt, Mycobacterium bovis subsp bovis AF2122/97
ugccgcccaggagcaccucga

SEQ ID NO: 1128287 - RNA, 17 nt, Mycobacterium bovis subsp bovis AF2122/97
ugccgcccgagccggug

SEQ ID NO: 1128288 - RNA, 14 nt, Mycobacterium bovis subsp bovis AF2122/97
ugccgcccgcgccg

SEQ ID NO: 1128289 - RNA, 18 nt, Mycobacterium bovis subsp bovis AF2122/97
ugccgcccgcgccgccgc

SEQ ID NO: 1128290 - RNA, 19 nt, Mycobacterium bovis subsp bovis AF2122/97
ugccgcccgcgccgccgga

SEQ ID NO: 1128291 - RNA, 17 nt, Mycobacterium bovis subsp bovis AF2122/97
ugccgccgacaccaccg

SEQ ID NO: 1128292 - RNA, 15 nt, Mycobacterium bovis subsp bovis AF2122/97
ugccgccgaagccga

SEQ ID NO: 1128293 - RNA, 16 nt, Mycobacterium bovis subsp bovis AF2122/97
ugccgccgaagccgac

SEQ ID NO: 1128294 - RNA, 20 nt, Mycobacterium bovis subsp bovis AF2122/97
ugccgcccucaccgccugug

SEQ ID NO: 1128295 - RNA, 21 nt, Mycobacterium bovis subsp bovis AF2122/97
ugccgccgaagaggagaacga

SEQ ID NO: 1128296 - RNA, 10 nt, Mycobacterium bovis subsp bovis AF2122/97
ugccgccgaa

SEQ ID NO: 1128297 - RNA, 21 nt, Mycobacterium bovis subsp bovis AF2122/97
ugccgccaccgcugucgaugg

SEQ ID NO: 1128298 - RNA, 16 nt, Mycobacterium bovis subsp bovis AF2122/97
ugccgccaccaccggc

SEQ ID NO: 1128299 - RNA, 17 nt, Mycobacterium bovis subsp bovis AF2122/97
ugccgccaccaccggcg

SEQ ID NO: 1128300 - RNA, 18 nt, Mycobacterium bovis subsp bovis AF2122/97
ugccgccaccaccggcgc

SEQ ID NO: 1128301 - RNA, 12 nt, Mycobacterium bovis subsp bovis AF2122/97
ugccgccaccgc

SEQ ID NO: 1128302 - RNA, 20 nt, Mycobacterium bovis subsp bovis AF2122/97
ugccgccaccgccaccgcgg

SEQ ID NO: 1128303 - RNA, 20 nt, Mycobacterium bovis subsp bovis AF2122/97
ugccgccacgggcggccacc

SEQ ID NO: 1128304 - RNA, 21 nt, Mycobacterium bovis subsp bovis AF2122/97
ugccgccagcaacccugcggu

SEQ ID NO: 1128305 - RNA, 16 nt, Mycobacterium bovis subsp bovis AF2122/97
ugccgcaucacccggg

SEQ ID NO: 1128306 - RNA, 19 nt, Mycobacterium bovis subsp bovis AF2122/97
ugccgcaugcgcuccggcg

SEQ ID NO: 1128307 - RNA, 16 nt, Mycobacterium bovis subsp bovis AF2122/97
ugccgcagcggcggca

SEQ ID NO: 1128308 - RNA, 15 nt, Mycobacterium bovis subsp bovis AF2122/97
ugccgccgccgagau

SEQ ID NO: 1128309 - RNA, 15 nt, Mycobacterium bovis subsp bovis AF2122/97
ugccgccgccgccgg

SEQ ID NO: 1128310 - RNA, 17 nt, Mycobacterium bovis subsp bovis AF2122/97
ugccgccgagcuggcgc

SEQ ID NO: 1128311 - RNA, 23 nt, Mycobacterium bovis subsp bovis AF2122/97
ugccgccgaucgacacccgcucg

SEQ ID NO: 1128312 - RNA, 19 nt, Mycobacterium bovis subsp bovis AF2122/97
ugccgccgacaccaccggc

SEQ ID NO: 1128313 - RNA, 23 nt, Mycobacterium bovis subsp bovis AF2122/97
ugccgccgacaccaccggcgccg

SEQ ID NO: 1128314 - RNA, 23 nt, Mycobacterium bovis subsp bovis AF2122/97
ugccgccgagcuggcgcgcgggg

SEQ ID NO: 1128315 - RNA, 18 nt, Mycobacterium bovis subsp bovis AF2122/97
ugccgccgagggcgccgg

SEQ ID NO: 1128316 - RNA, 20 nt, Mycobacterium bovis subsp bovis AF2122/97
ugccgccgauaccgccggcc

SEQ ID NO: 1128317 - RNA, 18 nt, Mycobacterium bovis subsp bovis AF2122/97
ugccgccgccuccgccga

SEQ ID NO: 1128318 - RNA, 19 nt, Mycobacterium bovis subsp bovis AF2122/97
ugccgccgccuccgccgag

SEQ ID NO: 1128319 - RNA, 19 nt, Mycobacterium bovis subsp bovis AF2122/97
ugccgcccuggacgucggc

SEQ ID NO: 1128320 - RNA, 14 nt, Mycobacterium bovis subsp bovis AF2122/97
ugccgccggcgccg

SEQ ID NO: 1128321 - RNA, 15 nt, Mycobacterium bovis subsp bovis AF2122/97
ugccgccggcgccgc

SEQ ID NO: 1128322 - RNA, 11 nt, Mycobacterium bovis subsp bovis AF2122/97
ugccgccgggg

SEQ ID NO: 1128323 - RNA, 12 nt, Mycobacterium bovis subsp bovis AF2122/97
ugccgccggccc

SEQ ID NO: 1128324 - RNA, 18 nt, Mycobacterium bovis subsp bovis AF2122/97
ugccgccggccccgccag

SEQ ID NO: 1128325 - RNA, 22 nt, Mycobacterium bovis subsp bovis AF2122/97
ugccgccggccccgccgucgcc

SEQ ID NO: 1128326 - RNA, 18 nt, Mycobacterium bovis subsp bovis AF2122/97
ugccgccggcaccgccgg

SEQ ID NO: 1128327 - RNA, 13 nt, Mycobacterium bovis subsp bovis AF2122/97
ugccgccgcggcc

SEQ ID NO: 1128328 - RNA, 15 nt, Mycobacterium bovis subsp bovis AF2122/97
ugccgccgcggccac

SEQ ID NO: 1128329 - RNA, 18 nt, Mycobacterium bovis subsp bovis AF2122/97
ugccgccgcggccaccac

SEQ ID NO: 1128330 - RNA, 22 nt, Mycobacterium bovis subsp bovis AF2122/97
ugccgccgcggcgcccggcgga

SEQ ID NO: 1128331 - RNA, 16 nt, Mycobacterium bovis subsp bovis AF2122/97
ugccgccgucgccgau

SEQ ID NO: 1128332 - RNA, 15 nt, Mycobacterium bovis subsp bovis AF2122/97
ugccgccgucgccgc

SEQ ID NO: 1128333 - RNA, 15 nt, Mycobacterium bovis subsp bovis AF2122/97
ugccgccguccccgc

SEQ ID NO: 1128334 - RNA, 21 nt, Mycobacterium bovis subsp bovis AF2122/97
ugccgccguuaccgagcccga

SEQ ID NO: 1128335 - RNA, 18 nt, Mycobacterium bovis subsp bovis AF2122/97
ugccgccguugaugaacg

SEQ ID NO: 1128336 - RNA, 17 nt, Mycobacterium bovis subsp bovis AF2122/97
ugccgccguugccgcca

SEQ ID NO: 1128337 - RNA, 18 nt, Mycobacterium bovis subsp bovis AF2122/97
ugccgccguugccgccgg

SEQ ID NO: 1128338 - RNA, 20 nt, Mycobacterium bovis subsp bovis AF2122/97
ugccgccguugccgccggug

SEQ ID NO: 1128339 - RNA, 13 nt, Mycobacterium bovis subsp bovis AF2122/97
ugccgccgucgcc

SEQ ID NO: 1128340 - RNA, 15 nt, Mycobacterium bovis subsp bovis AF2122/97
ugccgccgucgccac

SEQ ID NO: 1128341 - RNA, 12 nt, Mycobacterium bovis subsp bovis AF2122/97
ugccgccgucac

SEQ ID NO: 1128342 - RNA, 17 nt, Mycobacterium bovis subsp bovis AF2122/97
ugccgccggugccgcca

SEQ ID NO: 1128343 - RNA, 19 nt, Mycobacterium bovis subsp bovis AF2122/97
ugccgccggugccgccauu

SEQ ID NO: 1128344 - RNA, 19 nt, Mycobacterium bovis subsp bovis AF2122/97
ugccgccggugccgccgau

SEQ ID NO: 1128345 - RNA, 18 nt, Mycobacterium bovis subsp bovis AF2122/97
ugccgccggugccgccgg

SEQ ID NO: 1128346 - RNA, 17 nt, Mycobacterium bovis subsp bovis AF2122/97
ugccgccgguggugccg

SEQ ID NO: 1128347 - RNA, 20 nt, Mycobacterium bovis subsp bovis AF2122/97
ugccgccgguuccgccggcc

SEQ ID NO: 1128348 - RNA, 21 nt, Mycobacterium bovis subsp bovis AF2122/97
ugccgccgguuccgccggccc

SEQ ID NO: 1128349 - RNA, 16 nt, Mycobacterium bovis subsp bovis AF2122/97
ugccgccuccgccugc

SEQ ID NO: 1128350 - RNA, 22 nt, Mycobacterium bovis subsp bovis AF2122/97
ugccgccuuggucgcgucggcu

SEQ ID NO: 1128351 - RNA, 17 nt, Mycobacterium bovis subsp bovis AF2122/97
ugccgcgaaugaagccc

SEQ ID NO: 1128352 - RNA, 15 nt, Mycobacterium bovis subsp bovis AF2122/97
ugccgccugcgccgc

SEQ ID NO: 1128353 - RNA, 17 nt, Mycobacterium bovis subsp bovis AF2122/97
ugccgccugcgccgcca

SEQ ID NO: 1128354 - RNA, 15 nt, Mycobacterium bovis subsp bovis AF2122/97
ugccgccugguaccg

SEQ ID NO: 1128355 - RNA, 18 nt, Mycobacterium bovis subsp bovis AF2122/97
ugccgccugucccgccgg

SEQ ID NO: 1128356 - RNA, 21 nt, Mycobacterium bovis subsp bovis AF2122/97
ugccgccugucccgccggccc

SEQ ID NO: 1128357 - RNA, 12 nt, Mycobacterium bovis subsp bovis AF2122/97
ugccgcgaucgc

SEQ ID NO: 1128358 - RNA, 18 nt, Mycobacterium bovis subsp bovis AF2122/97
ugccgccuccggugcaua

SEQ ID NO: 1128359 - RNA, 18 nt, Mycobacterium bovis subsp bovis AF2122/97
ugccgaagcggccaccgc

SEQ ID NO: 1128360 - RNA, 18 nt, Mycobacterium bovis subsp bovis AF2122/97
ugccgaauaccgguggca

SEQ ID NO: 1128361 - RNA, 19 nt, Mycobacterium bovis subsp bovis AF2122/97
ugccgacucaggucggugc

SEQ ID NO: 1128362 - RNA, 17 nt, Mycobacterium bovis subsp bovis AF2122/97
ugccgacucaucggccg

SEQ ID NO: 1128363 - RNA, 19 nt, Mycobacterium bovis subsp bovis AF2122/97
ugccgacucaucggccgcg

SEQ ID NO: 1128364 - RNA, 18 nt, Mycobacterium bovis subsp bovis AF2122/97
ugccgaccagcaucucgg

SEQ ID NO: 1128365 - RNA, 23 nt, Mycobacterium bovis subsp bovis AF2122/97
ugccgagcacgacgacgucgggg

SEQ ID NO: 1128366 - RNA, 19 nt, Mycobacterium bovis subsp bovis AF2122/97
ugccgagcacucggccacg

SEQ ID NO: 1128367 - RNA, 15 nt, Mycobacterium bovis subsp bovis AF2122/97
ugccgagaugccggc

SEQ ID NO: 1128368 - RNA, 21 nt, Mycobacterium bovis subsp bovis AF2122/97
ugccgaauugggcgauuuugc

SEQ ID NO: 1128369 - RNA, 17 nt, Mycobacterium bovis subsp bovis AF2122/97
ugccgagaacaccggcc

SEQ ID NO: 1128370 - RNA, 19 nt, Mycobacterium bovis subsp bovis AF2122/97
ugccgagcgugcgcuggug

SEQ ID NO: 1128371 - RNA, 15 nt, Mycobacterium bovis subsp bovis AF2122/97
ugccgagcuggcgac

SEQ ID NO: 1128372 - RNA, 22 nt, Mycobacterium bovis subsp bovis AF2122/97
ugccgagcagcuucucggcgag

SEQ ID NO: 1128373 - RNA, 17 nt, Mycobacterium bovis subsp bovis AF2122/97
ugccgagcuugucgagc

SEQ ID NO: 1128374 - RNA, 20 nt, Mycobacterium bovis subsp bovis AF2122/97
ugccgaucggccaacagguc

SEQ ID NO: 1128375 - RNA, 15 nt, Mycobacterium bovis subsp bovis AF2122/97
ugccgauagcgcggc

SEQ ID NO: 1128376 - RNA, 21 nt, Mycobacterium bovis subsp bovis AF2122/97
ugccgaucggccugcagcgau

SEQ ID NO: 1128377 - RNA, 12 nt, Mycobacterium bovis subsp bovis AF2122/97
ugccgaucccca

SEQ ID NO: 1128378 - RNA, 17 nt, Mycobacterium bovis subsp bovis AF2122/97
ugccgaucccggcgagc

SEQ ID NO: 1128379 - RNA, 23 nt, Mycobacterium bovis subsp bovis AF2122/97
ugccgaucccgugguggcgccau

SEQ ID NO: 1128380 - RNA, 21 nt, Mycobacterium bovis subsp bovis AF2122/97
ugccgaucgggcucacucgcc

SEQ ID NO: 1128381 - RNA, 15 nt, Mycobacterium bovis subsp bovis AF2122/97
ugccgaugacgaugc

SEQ ID NO: 1128382 - RNA, 19 nt, Mycobacterium bovis subsp bovis AF2122/97
ugccgaugacgauggccgc

SEQ ID NO: 1128383 - RNA, 23 nt, Mycobacterium bovis subsp bovis AF2122/97
ugccgaugacgauggccgccgcg

SEQ ID NO: 1128384 - RNA, 15 nt, Mycobacterium bovis subsp bovis AF2122/97
ugccgauggcggugg

SEQ ID NO: 1128385 - RNA, 16 nt, Mycobacterium bovis subsp bovis AF2122/97
ugccgauggcgguggc

SEQ ID NO: 1128386 - RNA, 21 nt, Mycobacterium bovis subsp bovis AF2122/97
ugccgaugucgaugccgcgca

SEQ ID NO: 1128387 - RNA, 18 nt, Mycobacterium bovis subsp bovis AF2122/97
ugccgauuacggugaucg

SEQ ID NO: 1128388 - RNA, 14 nt, Mycobacterium bovis subsp bovis AF2122/97
ugccgcacccgguc

SEQ ID NO: 1128389 - RNA, 14 nt, Mycobacterium bovis subsp bovis AF2122/97
ugccgaaccggcgc

SEQ ID NO: 1128390 - RNA, 13 nt, Mycobacterium bovis subsp bovis AF2122/97
ugcccucggccgc

SEQ ID NO: 1128391 - RNA, 16 nt, Mycobacterium bovis subsp bovis AF2122/97
ugccgaagcggccacc

SEQ ID NO: 1128392 - RNA, 13 nt, Mycobacterium bovis subsp bovis AF2122/97
ugccgaagccgga

SEQ ID NO: 1128393 - RNA, 16 nt, Mycobacterium bovis subsp bovis AF2122/97
ugccgaaccgcgcgua

SEQ ID NO: 1128394 - RNA, 15 nt, Mycobacterium bovis subsp bovis AF2122/97
ugccgaagaugaccg

SEQ ID NO: 1128395 - RNA, 22 nt, Mycobacterium bovis subsp bovis AF2122/97
ugccgaagcccccgacguugcu

SEQ ID NO: 1128396 - RNA, 22 nt, Mycobacterium bovis subsp bovis AF2122/97
ugccgaagcugcccaaccgguc

SEQ ID NO: 1128397 - RNA, 14 nt, Mycobacterium bovis subsp bovis AF2122/97
ugcccuagcccgau

SEQ ID NO: 1128398 - RNA, 16 nt, Mycobacterium bovis subsp bovis AF2122/97
ugcccucaacgaucgc

SEQ ID NO: 1128399 - RNA, 13 nt, Mycobacterium bovis subsp bovis AF2122/97
ugcccucaacggc

SEQ ID NO: 1128400 - RNA, 14 nt, Mycobacterium bovis subsp bovis AF2122/97
ugcccucaacggcg

SEQ ID NO: 1128401 - RNA, 21 nt, Mycobacterium bovis subsp bovis AF2122/97
ugcccuccggguauggcggcg

SEQ ID NO: 1128402 - RNA, 15 nt, Mycobacterium bovis subsp bovis AF2122/97
ugcccuccgugggca

SEQ ID NO: 1128403 - RNA, 22 nt, Mycobacterium bovis subsp bovis AF2122/97
ugccccgagcugccgucgcugc

SEQ ID NO: 1128404 - RNA, 12 nt, Mycobacterium bovis subsp bovis AF2122/97
ugccccgcccgg

SEQ ID NO: 1128405 - RNA, 17 nt, Mycobacterium bovis subsp bovis AF2122/97
ugccccggucggcgacg

SEQ ID NO: 1128406 - RNA, 19 nt, Mycobacterium bovis subsp bovis AF2122/97
ugccccgguugaucuuguc

SEQ ID NO: 1128407 - RNA, 13 nt, Mycobacterium bovis subsp bovis AF2122/97
ugcccgacgacca

SEQ ID NO: 1128408 - RNA, 18 nt, Mycobacterium bovis subsp bovis AF2122/97
ugcccgacgagucgccgc

SEQ ID NO: 1128409 - RNA, 16 nt, Mycobacterium bovis subsp bovis AF2122/97
ugcccgacccgccgac

SEQ ID NO: 1128410 - RNA, 16 nt, Mycobacterium bovis subsp bovis AF2122/97
ugcccgacacccgcau

SEQ ID NO: 1128411 - RNA, 21 nt, Mycobacterium bovis subsp bovis AF2122/97
ugcccgacacccgcauggcag

SEQ ID NO: 1128412 - RNA, 21 nt, Mycobacterium bovis subsp bovis AF2122/97
ugccccuucaaagcggccucg

SEQ ID NO: 1128413 - RNA, 15 nt, Mycobacterium bovis subsp bovis AF2122/97
ugcccgaaccaccac

SEQ ID NO: 1128414 - RNA, 20 nt, Mycobacterium bovis subsp bovis AF2122/97
ugcccgucucguugaccaac

SEQ ID NO: 1128415 - RNA, 20 nt, Mycobacterium bovis subsp bovis AF2122/97
ugcccgacugaacgucaccg

SEQ ID NO: 1128416 - RNA, 14 nt, Mycobacterium bovis subsp bovis AF2122/97
ugcccgacucggcc

SEQ ID NO: 1128417 - RNA, 13 nt, Mycobacterium bovis subsp bovis AF2122/97
ugcccgacugaac

SEQ ID NO: 1128418 - RNA, 19 nt, Mycobacterium bovis subsp bovis AF2122/97
ugcccguucaugcggcggc

SEQ ID NO: 1128419 - RNA, 18 nt, Mycobacterium bovis subsp bovis AF2122/97
ugcccguggugauggucg

SEQ ID NO: 1128420 - RNA, 16 nt, Mycobacterium bovis subsp bovis AF2122/97
ugcccguucugcccag

SEQ ID NO: 1128421 - RNA, 12 nt, Mycobacterium bovis subsp bovis AF2122/97
ugccaguccaaa

SEQ ID NO: 1128422 - RNA, 17 nt, Mycobacterium bovis subsp bovis AF2122/97
ugccaguucuuggcgac

SEQ ID NO: 1128423 - RNA, 19 nt, Mycobacterium bovis subsp bovis AF2122/97
ugccagugcgcagcccgca

SEQ ID NO: 1128424 - RNA, 15 nt, Mycobacterium bovis subsp bovis AF2122/97
ugccagugggccgac

SEQ ID NO: 1128425 - RNA, 16 nt, Mycobacterium bovis subsp bovis AF2122/97
ugccagugccagcguc

SEQ ID NO: 1128426 - RNA, 20 nt, Mycobacterium bovis subsp bovis AF2122/97
ugccagugccagcguccguc

SEQ ID NO: 1128427 - RNA, 15 nt, Mycobacterium bovis subsp bovis AF2122/97
ugccagucgaucgcg

SEQ ID NO: 1128428 - RNA, 21 nt, Mycobacterium bovis subsp bovis AF2122/97
ugccagggcgggcgucgaggu

SEQ ID NO: 1128429 - RNA, 20 nt, Mycobacterium bovis subsp bovis AF2122/97
ugccaggaucgcggcgccgu

SEQ ID NO: 1128430 - RNA, 20 nt, Mycobacterium bovis subsp bovis AF2122/97
ugccagcuguugcggggugc

SEQ ID NO: 1128431 - RNA, 15 nt, Mycobacterium bovis subsp bovis AF2122/97
ugccaccggcuggug

SEQ ID NO: 1128432 - RNA, 13 nt, Mycobacterium bovis subsp bovis AF2122/97
ugccaccgcggcc

SEQ ID NO: 1128433 - RNA, 16 nt, Mycobacterium bovis subsp bovis AF2122/97
ugccaccgcggccgcg

SEQ ID NO: 1128434 - RNA, 14 nt, Mycobacterium bovis subsp bovis AF2122/97
ugccaccgcggugg

SEQ ID NO: 1128435 - RNA, 17 nt, Mycobacterium bovis subsp bovis AF2122/97
ugccaccgcugccggca

SEQ ID NO: 1128436 - RNA, 18 nt, Mycobacterium bovis subsp bovis AF2122/97
ugccaccgguaccgccgg

SEQ ID NO: 1128437 - RNA, 18 nt, Mycobacterium bovis subsp bovis AF2122/97
ugccaccguugccgccgu

SEQ ID NO: 1128438 - RNA, 18 nt, Mycobacterium bovis subsp bovis AF2122/97
ugccaccguugggccgac

SEQ ID NO: 1128439 - RNA, 23 nt, Mycobacterium bovis subsp bovis AF2122/97
ugccacacacugccggacagcca

SEQ ID NO: 1128440 - RNA, 22 nt, Mycobacterium bovis subsp bovis AF2122/97
ugccaaugacuuggccagcagc

SEQ ID NO: 1128441 - RNA, 20 nt, Mycobacterium bovis subsp bovis AF2122/97
ugccacaucccacgguggug

SEQ ID NO: 1128442 - RNA, 19 nt, Mycobacterium bovis subsp bovis AF2122/97
ugccaccaaguccaacgac

SEQ ID NO: 1128443 - RNA, 18 nt, Mycobacterium bovis subsp bovis AF2122/97
ugccacccuugccgccgg

SEQ ID NO: 1128444 - RNA, 20 nt, Mycobacterium bovis subsp bovis AF2122/97
ugccacccuugccgccggug

SEQ ID NO: 1128445 - RNA, 12 nt, Mycobacterium bovis subsp bovis AF2122/97
ugccaccgagca

SEQ ID NO: 1128446 - RNA, 12 nt, Mycobacterium bovis subsp bovis AF2122/97
ugccaccagaca

SEQ ID NO: 1128447 - RNA, 23 nt, Mycobacterium bovis subsp bovis AF2122/97
ugccccaagccauguggcgucgc

SEQ ID NO: 1128448 - RNA, 22 nt, Mycobacterium bovis subsp bovis AF2122/97
ugccccccagacaauccgccgc

SEQ ID NO: 1128449 - RNA, 18 nt, Mycobacterium bovis subsp bovis AF2122/97
ugcccccgccggccgucg

SEQ ID NO: 1128450 - RNA, 19 nt, Mycobacterium bovis subsp bovis AF2122/97
ugcccccggugccgcccgc

SEQ ID NO: 1128451 - RNA, 13 nt, Mycobacterium bovis subsp bovis AF2122/97
ugccccgaccgcg

SEQ ID NO: 1128452 - RNA, 17 nt, Mycobacterium bovis subsp bovis AF2122/97
ugccccgaccgcguaca

SEQ ID NO: 1128453 - RNA, 16 nt, Mycobacterium bovis subsp bovis AF2122/97
ugccccgagcugccgu

SEQ ID NO: 1128454 - RNA, 19 nt, Mycobacterium bovis subsp bovis AF2122/97
ugccccacccgcggcgccg

SEQ ID NO: 1128455 - RNA, 14 nt, Mycobacterium bovis subsp bovis AF2122/97
ugccccaugcgcag

SEQ ID NO: 1128456 - RNA, 19 nt, Mycobacterium bovis subsp bovis AF2122/97
ugccccaucguucguugac

SEQ ID NO: 1128457 - RNA, 15 nt, Mycobacterium bovis subsp bovis AF2122/97
ugcccaccaucccgc

SEQ ID NO: 1128458 - RNA, 21 nt, Mycobacterium bovis subsp bovis AF2122/97
ugcccaauucgacugcaacuc

SEQ ID NO: 1128459 - RNA, 18 nt, Mycobacterium bovis subsp bovis AF2122/97
ugcccaagcucagggugg

SEQ ID NO: 1128460 - RNA, 17 nt, Mycobacterium bovis subsp bovis AF2122/97
ugcccaaggccaggauc

SEQ ID NO: 1128461 - RNA, 21 nt, Mycobacterium bovis subsp bovis AF2122/97
ugcccaagcccucgacgucca

SEQ ID NO: 1128462 - RNA, 23 nt, Mycobacterium bovis subsp bovis AF2122/97
ugcccaacccacucgcagcagca

SEQ ID NO: 1128463 - RNA, 21 nt, Mycobacterium bovis subsp bovis AF2122/97
ugccauacagcaccccgccgg

SEQ ID NO: 1128464 - RNA, 13 nt, Mycobacterium bovis subsp bovis AF2122/97
ugcaccucgcccu

SEQ ID NO: 1128465 - RNA, 16 nt, Mycobacterium bovis subsp bovis AF2122/97
ugcaccuccgacggcc

SEQ ID NO: 1128466 - RNA, 16 nt, Mycobacterium bovis subsp bovis AF2122/97
ugcaccuucuccaccg

SEQ ID NO: 1128467 - RNA, 13 nt, Mycobacterium bovis subsp bovis AF2122/97
ugcaccucguguc

SEQ ID NO: 1128468 - RNA, 20 nt, Mycobacterium bovis subsp bovis AF2122/97
ugcagggaauagcggcgccc

SEQ ID NO: 1128469 - RNA, 19 nt, Mycobacterium bovis subsp bovis AF2122/97
ugcagggacccggcgccgu

SEQ ID NO: 1128470 - RNA, 15 nt, Mycobacterium bovis subsp bovis AF2122/97
ugcaggugcgggccg

SEQ ID NO: 1128471 - RNA, 13 nt, Mycobacterium bovis subsp bovis AF2122/97
ugcaggucgaggu

SEQ ID NO: 1128472 - RNA, 20 nt, Mycobacterium bovis subsp bovis AF2122/97
ugcagguagguauagccggu

SEQ ID NO: 1128473 - RNA, 17 nt, Mycobacterium bovis subsp bovis AF2122/97
ugcagugaccucgucgg

SEQ ID NO: 1128474 - RNA, 18 nt, Mycobacterium bovis subsp bovis AF2122/97
ugcaguaucgaggccgac

SEQ ID NO: 1128475 - RNA, 20 nt, Mycobacterium bovis subsp bovis AF2122/97
ugcaguaucgaggccgacga

SEQ ID NO: 1128476 - RNA, 15 nt, Mycobacterium bovis subsp bovis AF2122/97
ugcagucgauuucgg

SEQ ID NO: 1128477 - RNA, 15 nt, Mycobacterium bovis subsp bovis AF2122/97
ugcaucagcacgucg

SEQ ID NO: 1128478 - RNA, 16 nt, Mycobacterium bovis subsp bovis AF2122/97
ugcaucagcacgucgc

SEQ ID NO: 1128479 - RNA, 14 nt, Mycobacterium bovis subsp bovis AF2122/97
ugccaaccugggcc

SEQ ID NO: 1128480 - RNA, 15 nt, Mycobacterium bovis subsp bovis AF2122/97
ugccaacugcgccgu

SEQ ID NO: 1128481 - RNA, 21 nt, Mycobacterium bovis subsp bovis AF2122/97
ugccaaacuaacggcagccac

SEQ ID NO: 1128482 - RNA, 14 nt, Mycobacterium bovis subsp bovis AF2122/97
ugcaucgccaccac

SEQ ID NO: 1128483 - RNA, 16 nt, Mycobacterium bovis subsp bovis AF2122/97
ugcaucgccaccaccg

SEQ ID NO: 1128484 - RNA, 14 nt, Mycobacterium bovis subsp bovis AF2122/97
ugcaucgccgcgau

SEQ ID NO: 1128485 - RNA, 11 nt, Mycobacterium bovis subsp bovis AF2122/97
ugcaucggcag

SEQ ID NO: 1128486 - RNA, 22 nt, Mycobacterium bovis subsp bovis AF2122/97
ugcaucggcagccccugccgau

SEQ ID NO: 1128487 - RNA, 14 nt, Mycobacterium bovis subsp bovis AF2122/97
ugcaucgcggcggc

SEQ ID NO: 1128488 - RNA, 17 nt, Mycobacterium bovis subsp bovis AF2122/97
ugcaucggucagcgccg

SEQ ID NO: 1128489 - RNA, 20 nt, Mycobacterium bovis subsp bovis AF2122/97
ugcaugaacugcucgccgag

SEQ ID NO: 1128490 - RNA, 23 nt, Mycobacterium bovis subsp bovis AF2122/97
ugcaugcccagaaaaccgccgca

SEQ ID NO: 1128491 - RNA, 21 nt, Mycobacterium bovis subsp bovis AF2122/97
ugacucugcguccaccggacg

SEQ ID NO: 1128492 - RNA, 13 nt, Mycobacterium bovis subsp bovis AF2122/97
ugacgugcggcgc

SEQ ID NO: 1128493 - RNA, 22 nt, Mycobacterium bovis subsp bovis AF2122/97
ugacgucguggcgcucggcgag

SEQ ID NO: 1128494 - RNA, 18 nt, Mycobacterium bovis subsp bovis AF2122/97
ugacgugaguuucaccac

SEQ ID NO: 1128495 - RNA, 21 nt, Mycobacterium bovis subsp bovis AF2122/97
ugacguagaccacgccgguga

SEQ ID NO: 1128496 - RNA, 18 nt, Mycobacterium bovis subsp bovis AF2122/97
ugacgucgacaacgaucg

SEQ ID NO: 1128497 - RNA, 15 nt, Mycobacterium bovis subsp bovis AF2122/97
ugacgucgcaacggc

SEQ ID NO: 1128498 - RNA, 19 nt, Mycobacterium bovis subsp bovis AF2122/97
ugacugcacaccaccgccg

SEQ ID NO: 1128499 - RNA, 19 nt, Mycobacterium bovis subsp bovis AF2122/97
ugacgucacguucggcgca

SEQ ID NO: 1128500 - RNA, 13 nt, Mycobacterium bovis subsp bovis AF2122/97
ugacgucaggcug

SEQ ID NO: 1128501 - RNA, 15 nt, Mycobacterium bovis subsp bovis AF2122/97
ugacgucaggcugaa

SEQ ID NO: 1128502 - RNA, 16 nt, Mycobacterium bovis subsp bovis AF2122/97
ugacguaggcggcggc

SEQ ID NO: 1128503 - RNA, 15 nt, Mycobacterium bovis subsp bovis AF2122/97
ugacguagggcagcg

SEQ ID NO: 1128504 - RNA, 23 nt, Mycobacterium bovis subsp bovis AF2122/97
ugacgucaagagugcucagcgcg

SEQ ID NO: 1128505 - RNA, 18 nt, Mycobacterium bovis subsp bovis AF2122/97
ugacgucaccacgaucgc

SEQ ID NO: 1128506 - RNA, 20 nt, Mycobacterium bovis subsp bovis AF2122/97
ugacgguugccccggcgacc

SEQ ID NO: 1128507 - RNA, 19 nt, Mycobacterium bovis subsp bovis AF2122/97
ugacguagaagucgaucgc

SEQ ID NO: 1128508 - RNA, 13 nt, Mycobacterium bovis subsp bovis AF2122/97
ugacccccagcag

SEQ ID NO: 1128509 - RNA, 16 nt, Mycobacterium bovis subsp bovis AF2122/97
ugacccauucucggcc

SEQ ID NO: 1128510 - RNA, 15 nt, Mycobacterium bovis subsp bovis AF2122/97
ugacccgcaagucga

SEQ ID NO: 1128511 - RNA, 15 nt, Mycobacterium bovis subsp bovis AF2122/97
ugaccccuggccgcc

SEQ ID NO: 1128512 - RNA, 17 nt, Mycobacterium bovis subsp bovis AF2122/97
ugaccccuggccgccgg

SEQ ID NO: 1128513 - RNA, 19 nt, Mycobacterium bovis subsp bovis AF2122/97
ugaccccuggccgccggcg

SEQ ID NO: 1128514 - RNA, 19 nt, Mycobacterium bovis subsp bovis AF2122/97
ugacccgaaccgcaaggcc

SEQ ID NO: 1128515 - RNA, 17 nt, Mycobacterium bovis subsp bovis AF2122/97
ugaccccggcagcgccc

SEQ ID NO: 1128516 - RNA, 15 nt, Mycobacterium bovis subsp bovis AF2122/97
ugaccaugaugaccg

SEQ ID NO: 1128517 - RNA, 22 nt, Mycobacterium bovis subsp bovis AF2122/97
ugaccaugaugaccggcaauuc

SEQ ID NO: 1128518 - RNA, 20 nt, Mycobacterium bovis subsp bovis AF2122/97
ugaccagugaucagcgcauc

SEQ ID NO: 1128519 - RNA, 19 nt, Mycobacterium bovis subsp bovis AF2122/97
ugacccacacaccgagcac

SEQ ID NO: 1128520 - RNA, 23 nt, Mycobacterium bovis subsp bovis AF2122/97
ugacccacauuccguagccggcg

SEQ ID NO: 1128521 - RNA, 23 nt, Mycobacterium bovis subsp bovis AF2122/97
ugacccaccgccccggcggcggc

SEQ ID NO: 1128522 - RNA, 14 nt, Mycobacterium bovis subsp bovis AF2122/97
ugagcaugcgacgu

SEQ ID NO: 1128523 - RNA, 12 nt, Mycobacterium bovis subsp bovis AF2122/97
ugagcaggugcc

SEQ ID NO: 1128524 - RNA, 17 nt, Mycobacterium bovis subsp bovis AF2122/97
ugagcauaugacgucgc

SEQ ID NO: 1128525 - RNA, 12 nt, Mycobacterium bovis subsp bovis AF2122/97
ugagcaucaccg

SEQ ID NO: 1128526 - RNA, 23 nt, Mycobacterium bovis subsp bovis AF2122/97
ugagcagcuuagucagggccgag

SEQ ID NO: 1128527 - RNA, 12 nt, Mycobacterium bovis subsp bovis AF2122/97
ugagcacguuca

SEQ ID NO: 1128528 - RNA, 20 nt, Mycobacterium bovis subsp bovis AF2122/97
ugagcaccggauacagccac

SEQ ID NO: 1128529 - RNA, 20 nt, Mycobacterium bovis subsp bovis AF2122/97
ugagaacacguucggcgucg

SEQ ID NO: 1128530 - RNA, 22 nt, Mycobacterium bovis subsp bovis AF2122/97
ugagaacaacgggauccgcgcg

SEQ ID NO: 1128531 - RNA, 14 nt, Mycobacterium bovis subsp bovis AF2122/97
ugagacucgucgau

SEQ ID NO: 1128532 - RNA, 21 nt, Mycobacterium bovis subsp bovis AF2122/97
ugagacucgucgaugcggugg

SEQ ID NO: 1128533 - RNA, 15 nt, Mycobacterium bovis subsp bovis AF2122/97
ugagacugccgccgc

SEQ ID NO: 1128534 - RNA, 14 nt, Mycobacterium bovis subsp bovis AF2122/97
ugacugcgaccggu

SEQ ID NO: 1128535 - RNA, 15 nt, Mycobacterium bovis subsp bovis AF2122/97
ugacuggccgcccgg

SEQ ID NO: 1128536 - RNA, 18 nt, Mycobacterium bovis subsp bovis AF2122/97
ugacugguggcgccaacg

SEQ ID NO: 1128537 - RNA, 17 nt, Mycobacterium bovis subsp bovis AF2122/97
ugacuuggagugcgggu

SEQ ID NO: 1128538 - RNA, 22 nt, Mycobacterium bovis subsp bovis AF2122/97
ugaggucuuugcucucggucug

SEQ ID NO: 1128539 - RNA, 14 nt, Mycobacterium bovis subsp bovis AF2122/97
ugaggucgaugccg

SEQ ID NO: 1128540 - RNA, 15 nt, Mycobacterium bovis subsp bovis AF2122/97
ugaggugugccgacc

SEQ ID NO: 1128541 - RNA, 17 nt, Mycobacterium bovis subsp bovis AF2122/97
ugagguucaucgccggc

SEQ ID NO: 1128542 - RNA, 18 nt, Mycobacterium bovis subsp bovis AF2122/97
ugagguucaucgccggcg

SEQ ID NO: 1128543 - RNA, 16 nt, Mycobacterium bovis subsp bovis AF2122/97
ugagguagcugcgcgg

SEQ ID NO: 1128544 - RNA, 18 nt, Mycobacterium bovis subsp bovis AF2122/97
ugagguauugggcgcggc

SEQ ID NO: 1128545 - RNA, 15 nt, Mycobacterium bovis subsp bovis AF2122/97
ugaguaacacguggg

SEQ ID NO: 1128546 - RNA, 20 nt, Mycobacterium bovis subsp bovis AF2122/97
ugagguucuucugcgccacg

SEQ ID NO: 1128547 - RNA, 11 nt, Mycobacterium bovis subsp bovis AF2122/97
ugaguaccaau

SEQ ID NO: 1128548 - RNA, 16 nt, Mycobacterium bovis subsp bovis AF2122/97
ugaguaccauccgggc

SEQ ID NO: 1128549 - RNA, 13 nt, Mycobacterium bovis subsp bovis AF2122/97
ugagucacccggc

SEQ ID NO: 1128550 - RNA, 17 nt, Mycobacterium bovis subsp bovis AF2122/97
ugagugaccacgcugcu

SEQ ID NO: 1128551 - RNA, 15 nt, Mycobacterium bovis subsp bovis AF2122/97
ugagugccggcgugc

SEQ ID NO: 1128552 - RNA, 20 nt, Mycobacterium bovis subsp bovis AF2122/97
ugagugccggcgugcgcgag

SEQ ID NO: 1128553 - RNA, 20 nt, Mycobacterium bovis subsp bovis AF2122/97
ugagucguaguaggcgccgc

SEQ ID NO: 1128554 - RNA, 23 nt, Mycobacterium bovis subsp bovis AF2122/97
ugagucguaguaggcgccgcgac

SEQ ID NO: 1128555 - RNA, 19 nt, Mycobacterium bovis subsp bovis AF2122/97
ugaguccaauacucgccau

SEQ ID NO: 1128556 - RNA, 20 nt, Mycobacterium bovis subsp bovis AF2122/97
ugaguccagccggcgcgccg

SEQ ID NO: 1128557 - RNA, 22 nt, Mycobacterium bovis subsp bovis AF2122/97
ugagucccacgccagcgcgacc

SEQ ID NO: 1128558 - RNA, 20 nt, Mycobacterium bovis subsp bovis AF2122/97
ugaucagccgccaaccgcag

SEQ ID NO: 1128559 - RNA, 18 nt, Mycobacterium bovis subsp bovis AF2122/97
ugaguggcaaucccgcca

SEQ ID NO: 1128560 - RNA, 21 nt, Mycobacterium bovis subsp bovis AF2122/97
ugauaguggcgcgcggcgccg

SEQ ID NO: 1128561 - RNA, 14 nt, Mycobacterium bovis subsp bovis AF2122/97
ugagcggccggcau

SEQ ID NO: 1128562 - RNA, 23 nt, Mycobacterium bovis subsp bovis AF2122/97
ugagcggccaccguagccagcag

SEQ ID NO: 1128563 - RNA, 19 nt, Mycobacterium bovis subsp bovis AF2122/97
ugagccgcucgauggccug

SEQ ID NO: 1128564 - RNA, 21 nt, Mycobacterium bovis subsp bovis AF2122/97
ugagccuguccacguccagcc

SEQ ID NO: 1128565 - RNA, 21 nt, Mycobacterium bovis subsp bovis AF2122/97
ugagccggucuugcaucgcca

SEQ ID NO: 1128566 - RNA, 23 nt, Mycobacterium bovis subsp bovis AF2122/97
ugagccggucuugcaucgccaau

SEQ ID NO: 1128567 - RNA, 15 nt, Mycobacterium bovis subsp bovis AF2122/97
ugagcccgccgcgac

SEQ ID NO: 1128568 - RNA, 17 nt, Mycobacterium bovis subsp bovis AF2122/97
ugagcccgccgcgacca

SEQ ID NO: 1128569 - RNA, 21 nt, Mycobacterium bovis subsp bovis AF2122/97
ugagccgcagaugcaccugcg

SEQ ID NO: 1128570 - RNA, 22 nt, Mycobacterium bovis subsp bovis AF2122/97
ugagccgcagcaccucgucgau

SEQ ID NO: 1128571 - RNA, 18 nt, Mycobacterium bovis subsp bovis AF2122/97
ugagccgcaucuggccgg

SEQ ID NO: 1128572 - RNA, 14 nt, Mycobacterium bovis subsp bovis AF2122/97
ugagccgccccggc

SEQ ID NO: 1128573 - RNA, 15 nt, Mycobacterium bovis subsp bovis AF2122/97
ugagccacagggaag

SEQ ID NO: 1128574 - RNA, 21 nt, Mycobacterium bovis subsp bovis AF2122/97
ugagccaccaacaccgcguca

SEQ ID NO: 1128575 - RNA, 14 nt, Mycobacterium bovis subsp bovis AF2122/97
ugagccacguucgc

SEQ ID NO: 1128576 - RNA, 14 nt, Mycobacterium bovis subsp bovis AF2122/97
ugagcccagccgcg

SEQ ID NO: 1128577 - RNA, 23 nt, Mycobacterium bovis subsp bovis AF2122/97
ugagccaggcgguagucgucgac

SEQ ID NO: 1128578 - RNA, 19 nt, Mycobacterium bovis subsp bovis AF2122/97
ugaggcgggucgccgccau

SEQ ID NO: 1128579 - RNA, 20 nt, Mycobacterium bovis subsp bovis AF2122/97
ugagggcggaaaaucggcug

SEQ ID NO: 1128580 - RNA, 23 nt, Mycobacterium bovis subsp bovis AF2122/97
ugagggcggaaaaucggcuggcc

SEQ ID NO: 1128581 - RNA, 20 nt, Mycobacterium bovis subsp bovis AF2122/97
ugagggcggaauaucggccg

SEQ ID NO: 1128582 - RNA, 22 nt, Mycobacterium bovis subsp bovis AF2122/97
ugagggcggaauaucggccgaa

SEQ ID NO: 1128583 - RNA, 19 nt, Mycobacterium bovis subsp bovis AF2122/97
ugagggcucgguggcgccg

SEQ ID NO: 1128584 - RNA, 15 nt, Mycobacterium bovis subsp bovis AF2122/97
ugagcuaugcuggca

SEQ ID NO: 1128585 - RNA, 17 nt, Mycobacterium bovis subsp bovis AF2122/97
ugagcucccgccgggau

SEQ ID NO: 1128586 - RNA, 22 nt, Mycobacterium bovis subsp bovis AF2122/97
ugagcuagccguucggcugccg

SEQ ID NO: 1128587 - RNA, 21 nt, Mycobacterium bovis subsp bovis AF2122/97
ugagcgugccgcagcggcggc

SEQ ID NO: 1128588 - RNA, 13 nt, Mycobacterium bovis subsp bovis AF2122/97
ugaugucgccgau

SEQ ID NO: 1128589 - RNA, 17 nt, Mycobacterium bovis subsp bovis AF2122/97
ugauguccgcacaacga

SEQ ID NO: 1128590 - RNA, 14 nt, Mycobacterium bovis subsp bovis AF2122/97
ugaugucggugcgu

SEQ ID NO: 1128591 - RNA, 21 nt, Mycobacterium bovis subsp bovis AF2122/97
ugaugucggccgcgggucccg

SEQ ID NO: 1128592 - RNA, 17 nt, Mycobacterium bovis subsp bovis AF2122/97
ugauguucgacgggccg

SEQ ID NO: 1128593 - RNA, 15 nt, Mycobacterium bovis subsp bovis AF2122/97
ugauguccgcgacgg

SEQ ID NO: 1128594 - RNA, 16 nt, Mycobacterium bovis subsp bovis AF2122/97
ugaugugaguccagcc

SEQ ID NO: 1128595 - RNA, 17 nt, Mycobacterium bovis subsp bovis AF2122/97
ugauucgcgcagcgcga

SEQ ID NO: 1128596 - RNA, 19 nt, Mycobacterium bovis subsp bovis AF2122/97
ugauugcaagcgggcaccg

SEQ ID NO: 1128597 - RNA, 20 nt, Mycobacterium bovis subsp bovis AF2122/97
ugauugccaggaccgcgccg

SEQ ID NO: 1128598 - RNA, 17 nt, Mycobacterium bovis subsp bovis AF2122/97
ugaugagucaggcgccg

SEQ ID NO: 1128599 - RNA, 21 nt, Mycobacterium bovis subsp bovis AF2122/97
ugaugaguucgcgcaucaacg

SEQ ID NO: 1128600 - RNA, 12 nt, Mycobacterium bovis subsp bovis AF2122/97
ugauccggccgg

SEQ ID NO: 1128601 - RNA, 15 nt, Mycobacterium bovis subsp bovis AF2122/97
ugauccgggcgccga

SEQ ID NO: 1128602 - RNA, 12 nt, Mycobacterium bovis subsp bovis AF2122/97
ugauccgcuggg

SEQ ID NO: 1128603 - RNA, 17 nt, Mycobacterium bovis subsp bovis AF2122/97
ugaucccagaucggcgu

SEQ ID NO: 1128604 - RNA, 13 nt, Mycobacterium bovis subsp bovis AF2122/97
ugaugaugccggc

SEQ ID NO: 1128605 - RNA, 17 nt, Mycobacterium bovis subsp bovis AF2122/97
ugaugcaacucggcaga

SEQ ID NO: 1128606 - RNA, 23 nt, Mycobacterium bovis subsp bovis AF2122/97
ugaugcagggcccgcaacaucgg

SEQ ID NO: 1128607 - RNA, 16 nt, Mycobacterium bovis subsp bovis AF2122/97
ugaugccacggcgucg

SEQ ID NO: 1128608 - RNA, 15 nt, Mycobacterium bovis subsp bovis AF2122/97
ugaugccgaugucga

SEQ ID NO: 1128609 - RNA, 13 nt, Mycobacterium bovis subsp bovis AF2122/97
ugaugccgccgug

SEQ ID NO: 1128610 - RNA, 18 nt, Mycobacterium bovis subsp bovis AF2122/97
ugauccgccgacagccca

SEQ ID NO: 1128611 - RNA, 18 nt, Mycobacterium bovis subsp bovis AF2122/97
ugauccgccggcaacgcg

SEQ ID NO: 1128612 - RNA, 19 nt, Mycobacterium bovis subsp bovis AF2122/97
ugaucccguagccgugcca

SEQ ID NO: 1128613 - RNA, 13 nt, Mycobacterium bovis subsp bovis AF2122/97
ugaucccgaaccg

SEQ ID NO: 1128614 - RNA, 19 nt, Mycobacterium bovis subsp bovis AF2122/97
ugaucccggccaggccgac

SEQ ID NO: 1128615 - RNA, 18 nt, Mycobacterium bovis subsp bovis AF2122/97
ugauccaaguacgcuccg

SEQ ID NO: 1128616 - RNA, 14 nt, Mycobacterium bovis subsp bovis AF2122/97
ugaucaggccccac

SEQ ID NO: 1128617 - RNA, 21 nt, Mycobacterium bovis subsp bovis AF2122/97
ugaucagcucgcgcacgucga

SEQ ID NO: 1128618 - RNA, 13 nt, Mycobacterium bovis subsp bovis AF2122/97
ugaucaucccggc

SEQ ID NO: 1128619 - RNA, 16 nt, Mycobacterium bovis subsp bovis AF2122/97
ugaucaucccggcgcg

SEQ ID NO: 1128620 - RNA, 17 nt, Mycobacterium bovis subsp bovis AF2122/97
ugaucaucccggcgcgu

SEQ ID NO: 1128621 - RNA, 18 nt, Mycobacterium bovis subsp bovis AF2122/97
ugaucaucccggcgcguu

SEQ ID NO: 1128622 - RNA, 19 nt, Mycobacterium bovis subsp bovis AF2122/97
ugaucaggccgaugcgggu

SEQ ID NO: 1128623 - RNA, 19 nt, Mycobacterium bovis subsp bovis AF2122/97
ugcaccgcgucguagccac

SEQ ID NO: 1128624 - RNA, 19 nt, Mycobacterium bovis subsp bovis AF2122/97
ugcaccgccaggucgaggc

SEQ ID NO: 1128625 - RNA, 15 nt, Mycobacterium bovis subsp bovis AF2122/97
ugcaccuccgacggc

SEQ ID NO: 1128626 - RNA, 16 nt, Mycobacterium bovis subsp bovis AF2122/97
ugcaccgccaggucga

SEQ ID NO: 1128627 - RNA, 20 nt, Mycobacterium bovis subsp bovis AF2122/97
ugcacccgggccgccucgau

SEQ ID NO: 1128628 - RNA, 16 nt, Mycobacterium bovis subsp bovis AF2122/97
ugcacaccgucgcacc

SEQ ID NO: 1128629 - RNA, 16 nt, Mycobacterium bovis subsp bovis AF2122/97
ugcacacugguggugc

SEQ ID NO: 1128630 - RNA, 13 nt, Mycobacterium bovis subsp bovis AF2122/97
ugcacaggucagc

SEQ ID NO: 1128631 - RNA, 13 nt, Mycobacterium bovis subsp bovis AF2122/97
ugcacccgcgcgg

SEQ ID NO: 1128632 - RNA, 17 nt, Mycobacterium bovis subsp bovis AF2122/97
ugcacaaccgcugcugc

SEQ ID NO: 1128633 - RNA, 17 nt, Mycobacterium bovis subsp bovis AF2122/97
ugcacaccaccgccgaa

SEQ ID NO: 1128634 - RNA, 21 nt, Mycobacterium bovis subsp bovis AF2122/97
ugcacacagaggucggucagc

SEQ ID NO: 1128635 - RNA, 19 nt, Mycobacterium bovis subsp bovis AF2122/97
ugcacacagaggucgguca

SEQ ID NO: 1128636 - RNA, 16 nt, Mycobacterium bovis subsp bovis AF2122/97
ugcaacacgccggccc

SEQ ID NO: 1128637 - RNA, 22 nt, Mycobacterium bovis subsp bovis AF2122/97
ugcaagacaaagccgucgacgc

SEQ ID NO: 1128638 - RNA, 18 nt, Mycobacterium bovis subsp bovis AF2122/97
ugcaaggaauuccggcug

SEQ ID NO: 1128639 - RNA, 15 nt, Mycobacterium bovis subsp bovis AF2122/97
ugcaacacaccgcgg

SEQ ID NO: 1128640 - RNA, 19 nt, Mycobacterium bovis subsp bovis AF2122/97
ucccacagguuugcgccgc

SEQ ID NO: 1128641 - RNA, 19 nt, Mycobacterium bovis subsp bovis AF2122/97
ucccacccucggguccaac

SEQ ID NO: 1128642 - RNA, 20 nt, Mycobacterium bovis subsp bovis AF2122/97
ucccaccaccaccgccggug

SEQ ID NO: 1128643 - RNA, 15 nt, Mycobacterium bovis subsp bovis AF2122/97
ucccaccaccgcucg

SEQ ID NO: 1128644 - RNA, 14 nt, Mycobacterium bovis subsp bovis AF2122/97
ucccaccaccggug

SEQ ID NO: 1128645 - RNA, 23 nt, Mycobacterium bovis subsp bovis AF2122/97
ucccaaugcaacaaggcaaagga

SEQ ID NO: 1128646 - RNA, 14 nt, Mycobacterium bovis subsp bovis AF2122/97
ucccaaaugucgua

SEQ ID NO: 1128647 - RNA, 23 nt, Mycobacterium bovis subsp bovis AF2122/97
uccccuacugcguugacgucaag

SEQ ID NO: 1128648 - RNA, 14 nt, Mycobacterium bovis subsp bovis AF2122/97
uccccucgcaaccg

SEQ ID NO: 1128649 - RNA, 12 nt, Mycobacterium bovis subsp bovis AF2122/97
ucccacggccgg

SEQ ID NO: 1128650 - RNA, 16 nt, Mycobacterium bovis subsp bovis AF2122/97
ucccacggccggccgc

SEQ ID NO: 1128651 - RNA, 12 nt, Mycobacterium bovis subsp bovis AF2122/97
ucccacggcgcg

SEQ ID NO: 1128652 - RNA, 14 nt, Mycobacterium bovis subsp bovis AF2122/97
ucccacggcgguug

SEQ ID NO: 1128653 - RNA, 17 nt, Mycobacterium bovis subsp bovis AF2122/97
ucccaccagcggcggcc

SEQ ID NO: 1128654 - RNA, 22 nt, Mycobacterium bovis subsp bovis AF2122/97
ucccaccagguacgcgaucagc

SEQ ID NO: 1128655 - RNA, 14 nt, Mycobacterium bovis subsp bovis AF2122/97
ucccacaacucggc

SEQ ID NO: 1128656 - RNA, 14 nt, Mycobacterium bovis subsp bovis AF2122/97
ucccacgaguuggc

SEQ ID NO: 1128657 - RNA, 14 nt, Mycobacterium bovis subsp bovis AF2122/97
ucccacgccgccgu

SEQ ID NO: 1128658 - RNA, 15 nt, Mycobacterium bovis subsp bovis AF2122/97
ucccacgccgccguu

SEQ ID NO: 1128659 - RNA, 21 nt, Mycobacterium bovis subsp bovis AF2122/97
ucccacgccgccguugccgau

SEQ ID NO: 1128660 - RNA, 12 nt, Mycobacterium bovis subsp bovis AF2122/97
ucccgacccugc

SEQ ID NO: 1128661 - RNA, 14 nt, Mycobacterium bovis subsp bovis AF2122/97
ucccgaaucgugcg

SEQ ID NO: 1128662 - RNA, 20 nt, Mycobacterium bovis subsp bovis AF2122/97
ucccgaaucgugcggcgacc

SEQ ID NO: 1128663 - RNA, 19 nt, Mycobacterium bovis subsp bovis AF2122/97
ucccgaaucucacccacau

SEQ ID NO: 1128664 - RNA, 15 nt, Mycobacterium bovis subsp bovis AF2122/97
ucccgaauggccgau

SEQ ID NO: 1128665 - RNA, 17 nt, Mycobacterium bovis subsp bovis AF2122/97
ucccgaaauucucgccc

SEQ ID NO: 1128666 - RNA, 15 nt, Mycobacterium bovis subsp bovis AF2122/97
uccccuggccagcag

SEQ ID NO: 1128667 - RNA, 20 nt, Mycobacterium bovis subsp bovis AF2122/97
uccccuggaaagggccgccg

SEQ ID NO: 1128668 - RNA, 19 nt, Mycobacterium bovis subsp bovis AF2122/97
uccccguugacccagaccg

SEQ ID NO: 1128669 - RNA, 16 nt, Mycobacterium bovis subsp bovis AF2122/97
ucccgaugguggccgc

SEQ ID NO: 1128670 - RNA, 21 nt, Mycobacterium bovis subsp bovis AF2122/97
ucccgaugguggccgcgcggu

SEQ ID NO: 1128671 - RNA, 14 nt, Mycobacterium bovis subsp bovis AF2122/97
ucccgauccugccc

SEQ ID NO: 1128672 - RNA, 23 nt, Mycobacterium bovis subsp bovis AF2122/97
ucccgagccacaaaggcgccggg

SEQ ID NO: 1128673 - RNA, 22 nt, Mycobacterium bovis subsp bovis AF2122/97
ucccgaccaccucagcugcgga

SEQ ID NO: 1128674 - RNA, 15 nt, Mycobacterium bovis subsp bovis AF2122/97
ucccgauacggccgg

SEQ ID NO: 1128675 - RNA, 18 nt, Mycobacterium bovis subsp bovis AF2122/97
ucccgagcuccgcggcga

SEQ ID NO: 1128676 - RNA, 16 nt, Mycobacterium bovis subsp bovis AF2122/97
ucccggcgaccggguc

SEQ ID NO: 1128677 - RNA, 24 nt, Mycobacterium bovis subsp bovis AF2122/97
ucccggcgagcacccgcuggucga

SEQ ID NO: 1128678 - RNA, 14 nt, Mycobacterium bovis subsp bovis AF2122/97
ucccggcgccgcgg

SEQ ID NO: 1128679 - RNA, 17 nt, Mycobacterium bovis subsp bovis AF2122/97
ucccgccauugccgccg

SEQ ID NO: 1128680 - RNA, 16 nt, Mycobacterium bovis subsp bovis AF2122/97
ucccggcgcgguggcc

SEQ ID NO: 1128681 - RNA, 16 nt, Mycobacterium bovis subsp bovis AF2122/97
ucccgggcagccgcac

SEQ ID NO: 1128682 - RNA, 15 nt, Mycobacterium bovis subsp bovis AF2122/97
ucccgggcggcggcc

SEQ ID NO: 1128683 - RNA, 14 nt, Mycobacterium bovis subsp bovis AF2122/97
ucccgggcgagccg

SEQ ID NO: 1128684 - RNA, 13 nt, Mycobacterium bovis subsp bovis AF2122/97
ucccgggccgccg

SEQ ID NO: 1128685 - RNA, 21 nt, Mycobacterium bovis subsp bovis AF2122/97
ucccgggccgccgcgauggcc

SEQ ID NO: 1128686 - RNA, 15 nt, Mycobacterium bovis subsp bovis AF2122/97
ucccggcggcgcgcc

SEQ ID NO: 1128687 - RNA, 21 nt, Mycobacterium bovis subsp bovis AF2122/97
ucccggguccuggaucagcca

SEQ ID NO: 1128688 - RNA, 14 nt, Mycobacterium bovis subsp bovis AF2122/97
ucccgcaaugcgag

SEQ ID NO: 1128689 - RNA, 17 nt, Mycobacterium bovis subsp bovis AF2122/97
ucccgcaauucgcgguc

SEQ ID NO: 1128690 - RNA, 15 nt, Mycobacterium bovis subsp bovis AF2122/97
ucccgcagccgggca

SEQ ID NO: 1128691 - RNA, 14 nt, Mycobacterium bovis subsp bovis AF2122/97
ucccgcacggccgg

SEQ ID NO: 1128692 - RNA, 23 nt, Mycobacterium bovis subsp bovis AF2122/97
ucccggccuccauaucgcagcgu

SEQ ID NO: 1128693 - RNA, 19 nt, Mycobacterium bovis subsp bovis AF2122/97
ucccggccucgaugucgcg

SEQ ID NO: 1128694 - RNA, 12 nt, Mycobacterium bovis subsp bovis AF2122/97
ucccggccgccg

SEQ ID NO: 1128695 - RNA, 13 nt, Mycobacterium bovis subsp bovis AF2122/97
ucccggccgccga

SEQ ID NO: 1128696 - RNA, 20 nt, Mycobacterium bovis subsp bovis AF2122/97
ucccggccgaguaccagccc

SEQ ID NO: 1128697 - RNA, 21 nt, Mycobacterium bovis subsp bovis AF2122/97
ucccggccaggggcgcagcgc

SEQ ID NO: 1128698 - RNA, 13 nt, Mycobacterium bovis subsp bovis AF2122/97
ucccgccacgucg

SEQ ID NO: 1128699 - RNA, 20 nt, Mycobacterium bovis subsp bovis AF2122/97
uccgccagaauugccggcga

SEQ ID NO: 1128700 - RNA, 21 nt, Mycobacterium bovis subsp bovis AF2122/97
uccgccagaucucgcgcgcgg

SEQ ID NO: 1128701 - RNA, 19 nt, Mycobacterium bovis subsp bovis AF2122/97
uccgccacuggcgccggug

SEQ ID NO: 1128702 - RNA, 17 nt, Mycobacterium bovis subsp bovis AF2122/97
uccgccaaguacugggc

SEQ ID NO: 1128703 - RNA, 18 nt, Mycobacterium bovis subsp bovis AF2122/97
uccgcaucaugucgaaga

SEQ ID NO: 1128704 - RNA, 14 nt, Mycobacterium bovis subsp bovis AF2122/97
uccgcccagccgca

SEQ ID NO: 1128705 - RNA, 16 nt, Mycobacterium bovis subsp bovis AF2122/97
uccgccagaucucgcg

SEQ ID NO: 1128706 - RNA, 22 nt, Mycobacterium bovis subsp bovis AF2122/97
uccgcaacggauaacccguggc

SEQ ID NO: 1128707 - RNA, 22 nt, Mycobacterium bovis subsp bovis AF2122/97
uccgcaaaacgagcuuccacgc

SEQ ID NO: 1128708 - RNA, 21 nt, Mycobacterium bovis subsp bovis AF2122/97
uccgcaaccccuggggugcuc

SEQ ID NO: 1128709 - RNA, 19 nt, Mycobacterium bovis subsp bovis AF2122/97
uccgaugguaugcccgccg

SEQ ID NO: 1128710 - RNA, 17 nt, Mycobacterium bovis subsp bovis AF2122/97
uccgcaaucgcgacggg

SEQ ID NO: 1128711 - RNA, 18 nt, Mycobacterium bovis subsp bovis AF2122/97
uccgcaaucgcgacgggg

SEQ ID NO: 1128712 - RNA, 22 nt, Mycobacterium bovis subsp bovis AF2122/97
uccgcaaucgcgacggggucgc

SEQ ID NO: 1128713 - RNA, 14 nt, Mycobacterium bovis subsp bovis AF2122/97
uccgcacagcaaca

SEQ ID NO: 1128714 - RNA, 15 nt, Mycobacterium bovis subsp bovis AF2122/97
uccgcacagcgacga

SEQ ID NO: 1128715 - RNA, 19 nt, Mycobacterium bovis subsp bovis AF2122/97
uccgcaccccauacucggc

SEQ ID NO: 1128716 - RNA, 16 nt, Mycobacterium bovis subsp bovis AF2122/97
uccgcacccccgucga

SEQ ID NO: 1128717 - RNA, 15 nt, Mycobacterium bovis subsp bovis AF2122/97
uccgcaguccggggc

SEQ ID NO: 1128718 - RNA, 17 nt, Mycobacterium bovis subsp bovis AF2122/97
uccgcaguucggucguc

SEQ ID NO: 1128719 - RNA, 23 nt, Mycobacterium bovis subsp bovis AF2122/97
uccgcagagaccaagguccgcac

SEQ ID NO: 1128720 - RNA, 14 nt, Mycobacterium bovis subsp bovis AF2122/97
uccgcacgaucgcc

SEQ ID NO: 1128721 - RNA, 15 nt, Mycobacterium bovis subsp bovis AF2122/97
uccgcacgaucgccc

SEQ ID NO: 1128722 - RNA, 16 nt, Mycobacterium bovis subsp bovis AF2122/97
uccgcacccggccgcg

SEQ ID NO: 1128723 - RNA, 13 nt, Mycobacterium bovis subsp bovis AF2122/97
uccgcaccgaaac

SEQ ID NO: 1128724 - RNA, 17 nt, Mycobacterium bovis subsp bovis AF2122/97
uccgacggccgcggcgu

SEQ ID NO: 1128725 - RNA, 22 nt, Mycobacterium bovis subsp bovis AF2122/97
uccgacgguguagccgccggca

SEQ ID NO: 1128726 - RNA, 15 nt, Mycobacterium bovis subsp bovis AF2122/97
uccgacgucgacgag

SEQ ID NO: 1128727 - RNA, 16 nt, Mycobacterium bovis subsp bovis AF2122/97
uccgacgugcccccgu

SEQ ID NO: 1128728 - RNA, 21 nt, Mycobacterium bovis subsp bovis AF2122/97
uccgacggcggauaaccggca

SEQ ID NO: 1128729 - RNA, 23 nt, Mycobacterium bovis subsp bovis AF2122/97
uccgacauuggccgucaucgccg

SEQ ID NO: 1128730 - RNA, 15 nt, Mycobacterium bovis subsp bovis AF2122/97
uccgaccccgccgag

SEQ ID NO: 1128731 - RNA, 16 nt, Mycobacterium bovis subsp bovis AF2122/97
uccgaccccgccgagc

SEQ ID NO: 1128732 - RNA, 13 nt, Mycobacterium bovis subsp bovis AF2122/97
uccgacgccuggg

SEQ ID NO: 1128733 - RNA, 14 nt, Mycobacterium bovis subsp bovis AF2122/97
uccgaccucgccgc

SEQ ID NO: 1128734 - RNA, 20 nt, Mycobacterium bovis subsp bovis AF2122/97
ucccggugagggguugcggu

SEQ ID NO: 1128735 - RNA, 23 nt, Mycobacterium bovis subsp bovis AF2122/97
uccgacaccacggaccagcgccg

SEQ ID NO: 1128736 - RNA, 16 nt, Mycobacterium bovis subsp bovis AF2122/97
uccgaccagggaucga

SEQ ID NO: 1128737 - RNA, 13 nt, Mycobacterium bovis subsp bovis AF2122/97
uccgacccaacga

SEQ ID NO: 1128738 - RNA, 15 nt, Mycobacterium bovis subsp bovis AF2122/97
uccgacaguccgcgc

SEQ ID NO: 1128739 - RNA, 14 nt, Mycobacterium bovis subsp bovis AF2122/97
ucccggugggcggc

SEQ ID NO: 1128740 - RNA, 16 nt, Mycobacterium bovis subsp bovis AF2122/97
ucccgguguccagcca

SEQ ID NO: 1128741 - RNA, 18 nt, Mycobacterium bovis subsp bovis AF2122/97
ucccgguguccagccacg

SEQ ID NO: 1128742 - RNA, 13 nt, Mycobacterium bovis subsp bovis AF2122/97
ucccggugucgau

SEQ ID NO: 1128743 - RNA, 17 nt, Mycobacterium bovis subsp bovis AF2122/97
ucccggugucgaugcgc

SEQ ID NO: 1128744 - RNA, 19 nt, Mycobacterium bovis subsp bovis AF2122/97
ucccggugucgaugcgcag

SEQ ID NO: 1128745 - RNA, 17 nt, Mycobacterium bovis subsp bovis AF2122/97
ucccggucuacgacguc

SEQ ID NO: 1128746 - RNA, 21 nt, Mycobacterium bovis subsp bovis AF2122/97
ucccggucuuuaauccagcgc

SEQ ID NO: 1128747 - RNA, 20 nt, Mycobacterium bovis subsp bovis AF2122/97
uccgagggcgucgccgccgu

SEQ ID NO: 1128748 - RNA, 21 nt, Mycobacterium bovis subsp bovis AF2122/97
uccgagggcgucgccgccguu

SEQ ID NO: 1128749 - RNA, 17 nt, Mycobacterium bovis subsp bovis AF2122/97
uccgagggcugcguggc

SEQ ID NO: 1128750 - RNA, 13 nt, Mycobacterium bovis subsp bovis AF2122/97
uccgagcuuggcc

SEQ ID NO: 1128751 - RNA, 17 nt, Mycobacterium bovis subsp bovis AF2122/97
uccgagcuuggccgccg

SEQ ID NO: 1128752 - RNA, 19 nt, Mycobacterium bovis subsp bovis AF2122/97
uccgaggaauacagcuuga

SEQ ID NO: 1128753 - RNA, 20 nt, Mycobacterium bovis subsp bovis AF2122/97
uccgaggauguugugccgau

SEQ ID NO: 1128754 - RNA, 22 nt, Mycobacterium bovis subsp bovis AF2122/97
uccgaggauguugugccgaucg

SEQ ID NO: 1128755 - RNA, 14 nt, Mycobacterium bovis subsp bovis AF2122/97
uccgaggccgccau

SEQ ID NO: 1128756 - RNA, 17 nt, Mycobacterium bovis subsp bovis AF2122/97
uccgagcgcggcggcgg

SEQ ID NO: 1128757 - RNA, 16 nt, Mycobacterium bovis subsp bovis AF2122/97
uccgacuugucgccau

SEQ ID NO: 1128758 - RNA, 21 nt, Mycobacterium bovis subsp bovis AF2122/97
uccgaugaccagggucugcuc

SEQ ID NO: 1128759 - RNA, 22 nt, Mycobacterium bovis subsp bovis AF2122/97
uccgaugaccagggucugcuca

SEQ ID NO: 1128760 - RNA, 18 nt, Mycobacterium bovis subsp bovis AF2122/97
uccgaucggcgcgccgau

SEQ ID NO: 1128761 - RNA, 13 nt, Mycobacterium bovis subsp bovis AF2122/97
uccgaguugaacg

SEQ ID NO: 1128762 - RNA, 12 nt, Mycobacterium bovis subsp bovis AF2122/97
uccgaucaccuc

SEQ ID NO: 1128763 - RNA, 18 nt, Mycobacterium bovis subsp bovis AF2122/97
uccgaucaccucggcgac

SEQ ID NO: 1128764 - RNA, 20 nt, Mycobacterium bovis subsp bovis AF2122/97
uccgaucaugucggccgggg

SEQ ID NO: 1128765 - RNA, 21 nt, Mycobacterium bovis subsp bovis AF2122/97
uccggaguuuaagacgcccga

SEQ ID NO: 1128766 - RNA, 12 nt, Mycobacterium bovis subsp bovis AF2122/97
uccggauccgau

SEQ ID NO: 1128767 - RNA, 22 nt, Mycobacterium bovis subsp bovis AF2122/97
uccggcgacgaucucgccgcca

SEQ ID NO: 1128768 - RNA, 17 nt, Mycobacterium bovis subsp bovis AF2122/97
uccggcgaucucgaccg

SEQ ID NO: 1128769 - RNA, 21 nt, Mycobacterium bovis subsp bovis AF2122/97
uccggcaucgagacgcacggc

SEQ ID NO: 1128770 - RNA, 16 nt, Mycobacterium bovis subsp bovis AF2122/97
uccggcauugccgccg

SEQ ID NO: 1128771 - RNA, 18 nt, Mycobacterium bovis subsp bovis AF2122/97
uccggccacacucgccag

SEQ ID NO: 1128772 - RNA, 20 nt, Mycobacterium bovis subsp bovis AF2122/97
uccggccacacucgccaggg

SEQ ID NO: 1128773 - RNA, 21 nt, Mycobacterium bovis subsp bovis AF2122/97
uccggccagacccuggccguc

SEQ ID NO: 1128774 - RNA, 15 nt, Mycobacterium bovis subsp bovis AF2122/97
uccggcucauccgac

SEQ ID NO: 1128775 - RNA, 16 nt, Mycobacterium bovis subsp bovis AF2122/97
uccggcucauccgacg

SEQ ID NO: 1128776 - RNA, 18 nt, Mycobacterium bovis subsp bovis AF2122/97
uccggcucauccgacggg

SEQ ID NO: 1128777 - RNA, 18 nt, Mycobacterium bovis subsp bovis AF2122/97
uccggcuucguccaccgc

SEQ ID NO: 1128778 - RNA, 21 nt, Mycobacterium bovis subsp bovis AF2122/97
uccggcuggaagcggcgacua

SEQ ID NO: 1128779 - RNA, 20 nt, Mycobacterium bovis subsp bovis AF2122/97
uccggcuucguccaccgcga

SEQ ID NO: 1128780 - RNA, 12 nt, Mycobacterium bovis subsp bovis AF2122/97
uccggcugcggg

SEQ ID NO: 1128781 - RNA, 12 nt, Mycobacterium bovis subsp bovis AF2122/97
uccggcugcggu

SEQ ID NO: 1128782 - RNA, 15 nt, Mycobacterium bovis subsp bovis AF2122/97
uccggcuucggcgaa

SEQ ID NO: 1128783 - RNA, 17 nt, Mycobacterium bovis subsp bovis AF2122/97
uccggcuucguccaccg

SEQ ID NO: 1128784 - RNA, 17 nt, Mycobacterium bovis subsp bovis AF2122/97
uccggcgcacgaaaccg

SEQ ID NO: 1128785 - RNA, 20 nt, Mycobacterium bovis subsp bovis AF2122/97
uccggcgcacgaaaccgcag

SEQ ID NO: 1128786 - RNA, 16 nt, Mycobacterium bovis subsp bovis AF2122/97
uccggcgccaccgccg

SEQ ID NO: 1128787 - RNA, 17 nt, Mycobacterium bovis subsp bovis AF2122/97
uccggcgccaccgccgc

SEQ ID NO: 1128788 - RNA, 17 nt, Mycobacterium bovis subsp bovis AF2122/97
uccggcgcagcgaccgg

SEQ ID NO: 1128789 - RNA, 23 nt, Mycobacterium bovis subsp bovis AF2122/97
uccggcgcagguucucggugccg

SEQ ID NO: 1128790 - RNA, 13 nt, Mycobacterium bovis subsp bovis AF2122/97
uccggcgcagugc

SEQ ID NO: 1128791 - RNA, 14 nt, Mycobacterium bovis subsp bovis AF2122/97
uccgccgccgccgg

SEQ ID NO: 1128792 - RNA, 12 nt, Mycobacterium bovis subsp bovis AF2122/97
uccgccgggcgc

SEQ ID NO: 1128793 - RNA, 17 nt, Mycobacterium bovis subsp bovis AF2122/97
uccgccgggccaggccg

SEQ ID NO: 1128794 - RNA, 20 nt, Mycobacterium bovis subsp bovis AF2122/97
uccgccgggccaggccgaug

SEQ ID NO: 1128795 - RNA, 22 nt, Mycobacterium bovis subsp bovis AF2122/97
uccgccgggccaggccgaugcc

SEQ ID NO: 1128796 - RNA, 14 nt, Mycobacterium bovis subsp bovis AF2122/97
uccgcgagcccggc

SEQ ID NO: 1128797 - RNA, 14 nt, Mycobacterium bovis subsp bovis AF2122/97
uccgcgacgcucgc

SEQ ID NO: 1128798 - RNA, 16 nt, Mycobacterium bovis subsp bovis AF2122/97
uccgccggugccgccg

SEQ ID NO: 1128799 - RNA, 17 nt, Mycobacterium bovis subsp bovis AF2122/97
uccgccguaugccgcca

SEQ ID NO: 1128800 - RNA, 19 nt, Mycobacterium bovis subsp bovis AF2122/97
uccggaaccgguaucgcca

SEQ ID NO: 1128801 - RNA, 21 nt, Mycobacterium bovis subsp bovis AF2122/97
uccggaaagcucucggcaccc

SEQ ID NO: 1128802 - RNA, 19 nt, Mycobacterium bovis subsp bovis AF2122/97
uccggaaauuccggcgcgg

SEQ ID NO: 1128803 - RNA, 20 nt, Mycobacterium bovis subsp bovis AF2122/97
uccggaaauuccggcgcggc

SEQ ID NO: 1128804 - RNA, 20 nt, Mycobacterium bovis subsp bovis AF2122/97
uccggacccacccgcaccgc

SEQ ID NO: 1128805 - RNA, 17 nt, Mycobacterium bovis subsp bovis AF2122/97
uccggacgcacgauccg

SEQ ID NO: 1128806 - RNA, 16 nt, Mycobacterium bovis subsp bovis AF2122/97
uccggaaucgcccggg

SEQ ID NO: 1128807 - RNA, 15 nt, Mycobacterium bovis subsp bovis AF2122/97
uccggacggcagccg

SEQ ID NO: 1128808 - RNA, 14 nt, Mycobacterium bovis subsp bovis AF2122/97
uccgcgccgcacca

SEQ ID NO: 1128809 - RNA, 21 nt, Mycobacterium bovis subsp bovis AF2122/97
uccgcgacggccuuggcgacg

SEQ ID NO: 1128810 - RNA, 17 nt, Mycobacterium bovis subsp bovis AF2122/97
uccgcuugcucucgcag

SEQ ID NO: 1128811 - RNA, 22 nt, Mycobacterium bovis subsp bovis AF2122/97
uccgcuugggcggugucgucga

SEQ ID NO: 1128812 - RNA, 15 nt, Mycobacterium bovis subsp bovis AF2122/97
uccgcgcccgagccg

SEQ ID NO: 1128813 - RNA, 23 nt, Mycobacterium bovis subsp bovis AF2122/97
uccgggcgcguggaaaccggugg

SEQ ID NO: 1128814 - RNA, 18 nt, Mycobacterium bovis subsp bovis AF2122/97
uccgggcgaccaccaccg

SEQ ID NO: 1128815 - RNA, 19 nt, Mycobacterium bovis subsp bovis AF2122/97
uccgggcaaucacaucaaa

SEQ ID NO: 1128816 - RNA, 20 nt, Mycobacterium bovis subsp bovis AF2122/97
uccgggcgaccaccaccgcc

SEQ ID NO: 1128817 - RNA, 19 nt, Mycobacterium bovis subsp bovis AF2122/97
uccggggaaagccgcagcc

SEQ ID NO: 1128818 - RNA, 20 nt, Mycobacterium bovis subsp bovis AF2122/97
uccggggaaagccgcagccg

SEQ ID NO: 1128819 - RNA, 15 nt, Mycobacterium bovis subsp bovis AF2122/97
uccgggcccaucgcc

SEQ ID NO: 1128820 - RNA, 12 nt, Mycobacterium bovis subsp bovis AF2122/97
uccgggccccac

SEQ ID NO: 1128821 - RNA, 14 nt, Mycobacterium bovis subsp bovis AF2122/97
uccgggccgagcgc

SEQ ID NO: 1128822 - RNA, 15 nt, Mycobacterium bovis subsp bovis AF2122/97
uccgggccgaucacc

SEQ ID NO: 1128823 - RNA, 23 nt, Mycobacterium bovis subsp bovis AF2122/97
uccgggccuggccugcccagcac

SEQ ID NO: 1128824 - RNA, 23 nt, Mycobacterium bovis subsp bovis AF2122/97
uccgggccgaucaccccggugga

SEQ ID NO: 1128825 - RNA, 19 nt, Mycobacterium bovis subsp bovis AF2122/97
uccgggacuaccacccgca

SEQ ID NO: 1128826 - RNA, 14 nt, Mycobacterium bovis subsp bovis AF2122/97
uccgggacggugaa

SEQ ID NO: 1128827 - RNA, 18 nt, Mycobacterium bovis subsp bovis AF2122/97
uccgggaugucgaagucg

SEQ ID NO: 1128828 - RNA, 14 nt, Mycobacterium bovis subsp bovis AF2122/97
uccgucgccgaaca

SEQ ID NO: 1128829 - RNA, 19 nt, Mycobacterium bovis subsp bovis AF2122/97
uccgucgacaccgcggacc

SEQ ID NO: 1128830 - RNA, 17 nt, Mycobacterium bovis subsp bovis AF2122/97
uccgucgauggaccgca

SEQ ID NO: 1128831 - RNA, 22 nt, Mycobacterium bovis subsp bovis AF2122/97
uccgucggccuggaucgugccg

SEQ ID NO: 1128832 - RNA, 12 nt, Mycobacterium bovis subsp bovis AF2122/97
uccgucggcgga

SEQ ID NO: 1128833 - RNA, 19 nt, Mycobacterium bovis subsp bovis AF2122/97
uccgucgaaccuaccgugu

SEQ ID NO: 1128834 - RNA, 13 nt, Mycobacterium bovis subsp bovis AF2122/97
uccguccucgucc

SEQ ID NO: 1128835 - RNA, 13 nt, Mycobacterium bovis subsp bovis AF2122/97
uccgugacaccgg

SEQ ID NO: 1128836 - RNA, 22 nt, Mycobacterium bovis subsp bovis AF2122/97
uccgugcgggucguccgccugc

SEQ ID NO: 1128837 - RNA, 20 nt, Mycobacterium bovis subsp bovis AF2122/97
uccgugggcagcgcgcccga

SEQ ID NO: 1128838 - RNA, 22 nt, Mycobacterium bovis subsp bovis AF2122/97
uccgucgauggaccgcacugac

SEQ ID NO: 1128839 - RNA, 14 nt, Mycobacterium bovis subsp bovis AF2122/97
uccgugccgaugcc

SEQ ID NO: 1128840 - RNA, 14 nt, Mycobacterium bovis subsp bovis AF2122/97
uccguucgaugcca

SEQ ID NO: 1128841 - RNA, 14 nt, Mycobacterium bovis subsp bovis AF2122/97
uccucgaucagacg

SEQ ID NO: 1128842 - RNA, 22 nt, Mycobacterium bovis subsp bovis AF2122/97
uccucgaucagacgcucgaccu

SEQ ID NO: 1128843 - RNA, 16 nt, Mycobacterium bovis subsp bovis AF2122/97
uccucgaugaggcgca

SEQ ID NO: 1128844 - RNA, 20 nt, Mycobacterium bovis subsp bovis AF2122/97
uccucgaugaggcgcagcgc

SEQ ID NO: 1128845 - RNA, 21 nt, Mycobacterium bovis subsp bovis AF2122/97
uccucgaguacccaaccggua

SEQ ID NO: 1128846 - RNA, 18 nt, Mycobacterium bovis subsp bovis AF2122/97
uccucgagugccgccguc

SEQ ID NO: 1128847 - RNA, 14 nt, Mycobacterium bovis subsp bovis AF2122/97
uccucgacacccau

SEQ ID NO: 1128848 - RNA, 17 nt, Mycobacterium bovis subsp bovis AF2122/97
uccucgacgucggcgag

SEQ ID NO: 1128849 - RNA, 15 nt, Mycobacterium bovis subsp bovis AF2122/97
uccucgaccgcggcc

SEQ ID NO: 1128850 - RNA, 11 nt, Mycobacterium bovis subsp bovis AF2122/97
uccucgacgag

SEQ ID NO: 1128851 - RNA, 14 nt, Mycobacterium bovis subsp bovis AF2122/97
uccuccccgaccgc

SEQ ID NO: 1128852 - RNA, 21 nt, Mycobacterium bovis subsp bovis AF2122/97
uccuccggaaagcucucggca

SEQ ID NO: 1128853 - RNA, 22 nt, Mycobacterium bovis subsp bovis AF2122/97
uccuccggcaccaacgccaccg

SEQ ID NO: 1128854 - RNA, 13 nt, Mycobacterium bovis subsp bovis AF2122/97
uccuccucgucga

SEQ ID NO: 1128855 - RNA, 14 nt, Mycobacterium bovis subsp bovis AF2122/97
uccuccucgacccc

SEQ ID NO: 1128856 - RNA, 18 nt, Mycobacterium bovis subsp bovis AF2122/97
uccuccgguaucggcgac

SEQ ID NO: 1128857 - RNA, 21 nt, Mycobacterium bovis subsp bovis AF2122/97
uccuccggguuggcgacgauc

SEQ ID NO: 1128858 - RNA, 19 nt, Mycobacterium bovis subsp bovis AF2122/97
uccucauagagcggcacca

SEQ ID NO: 1128859 - RNA, 23 nt, Mycobacterium bovis subsp bovis AF2122/97
uccuccaccagugccccgccgag

SEQ ID NO: 1128860 - RNA, 17 nt, Mycobacterium bovis subsp bovis AF2122/97
uccuaucagugagccgc

SEQ ID NO: 1128861 - RNA, 18 nt, Mycobacterium bovis subsp bovis AF2122/97
uccguugaugccgccgga

SEQ ID NO: 1128862 - RNA, 22 nt, Mycobacterium bovis subsp bovis AF2122/97
uccguugcccccauugccgccg

SEQ ID NO: 1128863 - RNA, 17 nt, Mycobacterium bovis subsp bovis AF2122/97
uccguuuggcugccgaa

SEQ ID NO: 1128864 - RNA, 14 nt, Mycobacterium bovis subsp bovis AF2122/97
uccguuuuaccucg

SEQ ID NO: 1128865 - RNA, 19 nt, Mycobacterium bovis subsp bovis AF2122/97
ucgacggcugcgccgaaca

SEQ ID NO: 1128866 - RNA, 23 nt, Mycobacterium bovis subsp bovis AF2122/97
ucgacggcggccgccacuccgug

SEQ ID NO: 1128867 - RNA, 17 nt, Mycobacterium bovis subsp bovis AF2122/97
ucgacggcggccgcgau

SEQ ID NO: 1128868 - RNA, 15 nt, Mycobacterium bovis subsp bovis AF2122/97
ucgacggcgauggcg

SEQ ID NO: 1128869 - RNA, 22 nt, Mycobacterium bovis subsp bovis AF2122/97
ucgacggcgauggcgcgcaacg

SEQ ID NO: 1128870 - RNA, 16 nt, Mycobacterium bovis subsp bovis AF2122/97
ucgacgccgcgcagcc

SEQ ID NO: 1128871 - RNA, 21 nt, Mycobacterium bovis subsp bovis AF2122/97
ucgacggcccgccguccggcg

SEQ ID NO: 1128872 - RNA, 19 nt, Mycobacterium bovis subsp bovis AF2122/97
ucgacggccucgucgaugu

SEQ ID NO: 1128873 - RNA, 15 nt, Mycobacterium bovis subsp bovis AF2122/97
ucgacggccuggggc

SEQ ID NO: 1128874 - RNA, 20 nt, Mycobacterium bovis subsp bovis AF2122/97
ucgacggccuggggcagccg

SEQ ID NO: 1128875 - RNA, 19 nt, Mycobacterium bovis subsp bovis AF2122/97
ucgacgggagcgacgucgg

SEQ ID NO: 1128876 - RNA, 16 nt, Mycobacterium bovis subsp bovis AF2122/97
ucgacgggccggacca

SEQ ID NO: 1128877 - RNA, 22 nt, Mycobacterium bovis subsp bovis AF2122/97
ucgacgggccggaccaucagcg

SEQ ID NO: 1128878 - RNA, 20 nt, Mycobacterium bovis subsp bovis AF2122/97
ucgacggugacgaccacguc

SEQ ID NO: 1128879 - RNA, 23 nt, Mycobacterium bovis subsp bovis AF2122/97
ucgacggggaacguccgcgccga

SEQ ID NO: 1128880 - RNA, 18 nt, Mycobacterium bovis subsp bovis AF2122/97
ucgacggggcggucggcc

SEQ ID NO: 1128881 - RNA, 19 nt, Mycobacterium bovis subsp bovis AF2122/97
ucgacgggucggcgccgag

SEQ ID NO: 1128882 - RNA, 21 nt, Mycobacterium bovis subsp bovis AF2122/97
ucgacgggucggcgccgagca

SEQ ID NO: 1128883 - RNA, 14 nt, Mycobacterium bovis subsp bovis AF2122/97
ucgacggucaccgg

SEQ ID NO: 1128884 - RNA, 18 nt, Mycobacterium bovis subsp bovis AF2122/97
ucgacggucaccggcgca

SEQ ID NO: 1128885 - RNA, 17 nt, Mycobacterium bovis subsp bovis AF2122/97
ucgacgguggcgccguc

SEQ ID NO: 1128886 - RNA, 21 nt, Mycobacterium bovis subsp bovis AF2122/97
ucgacgguggcgccgucggcc

SEQ ID NO: 1128887 - RNA, 22 nt, Mycobacterium bovis subsp bovis AF2122/97
ucgacgguggcgccgucggccg

SEQ ID NO: 1128888 - RNA, 22 nt, Mycobacterium bovis subsp bovis AF2122/97
ucgagcaccuccacugggucgc

SEQ ID NO: 1128889 - RNA, 19 nt, Mycobacterium bovis subsp bovis AF2122/97
ucgagcaccuugcgauugc

SEQ ID NO: 1128890 - RNA, 17 nt, Mycobacterium bovis subsp bovis AF2122/97
ucgacggucguuggucg

SEQ ID NO: 1128891 - RNA, 21 nt, Mycobacterium bovis subsp bovis AF2122/97
ucgagcacgaugucgaugccg

SEQ ID NO: 1128892 - RNA, 21 nt, Mycobacterium bovis subsp bovis AF2122/97
ucgagcaccgacaccggccgc

SEQ ID NO: 1128893 - RNA, 22 nt, Mycobacterium bovis subsp bovis AF2122/97
ucgagcaccuugcgauugcgca

SEQ ID NO: 1128894 - RNA, 21 nt, Mycobacterium bovis subsp bovis AF2122/97
ucgagcaccuuggggugggcg

SEQ ID NO: 1128895 - RNA, 15 nt, Mycobacterium bovis subsp bovis AF2122/97
ucgagcaggcgcacc

SEQ ID NO: 1128896 - RNA, 18 nt, Mycobacterium bovis subsp bovis AF2122/97
ucgagcaggcgcaccagg

SEQ ID NO: 1128897 - RNA, 20 nt, Mycobacterium bovis subsp bovis AF2122/97
ucgagcgcgccgcgcucgcc

SEQ ID NO: 1128898 - RNA, 21 nt, Mycobacterium bovis subsp bovis AF2122/97
ucgagcgcgccgcgcucgccg

SEQ ID NO: 1128899 - RNA, 16 nt, Mycobacterium bovis subsp bovis AF2122/97
ucgagcgcgcgacgga

SEQ ID NO: 1128900 - RNA, 13 nt, Mycobacterium bovis subsp bovis AF2122/97
ucgagcgcgccgc

SEQ ID NO: 1128901 - RNA, 19 nt, Mycobacterium bovis subsp bovis AF2122/97
ucgagcgcgccgcgcucgc

SEQ ID NO: 1128902 - RNA, 16 nt, Mycobacterium bovis subsp bovis AF2122/97
ucgagcgccgcggacu

SEQ ID NO: 1128903 - RNA, 12 nt, Mycobacterium bovis subsp bovis AF2122/97
ucgagcgccggc

SEQ ID NO: 1128904 - RNA, 16 nt, Mycobacterium bovis subsp bovis AF2122/97
ucgagcgccggccgcg

SEQ ID NO: 1128905 - RNA, 22 nt, Mycobacterium bovis subsp bovis AF2122/97
ucgagcgaaccgaagccgucga

SEQ ID NO: 1128906 - RNA, 20 nt, Mycobacterium bovis subsp bovis AF2122/97
ucgagcgaccccacacgccg

SEQ ID NO: 1128907 - RNA, 15 nt, Mycobacterium bovis subsp bovis AF2122/97
ucgagcgacccccag

SEQ ID NO: 1128908 - RNA, 13 nt, Mycobacterium bovis subsp bovis AF2122/97
ucgagccggcggc

SEQ ID NO: 1128909 - RNA, 18 nt, Mycobacterium bovis subsp bovis AF2122/97
ucgaucagaugcggcccg

SEQ ID NO: 1128910 - RNA, 16 nt, Mycobacterium bovis subsp bovis AF2122/97
ucgaucaccgacaccg

SEQ ID NO: 1128911 - RNA, 18 nt, Mycobacterium bovis subsp bovis AF2122/97
ucgaucaccgacaccgug

SEQ ID NO: 1128912 - RNA, 20 nt, Mycobacterium bovis subsp bovis AF2122/97
ucgaucacacguccgcgcac

SEQ ID NO: 1128913 - RNA, 21 nt, Mycobacterium bovis subsp bovis AF2122/97
ucgaucaccugcagcacgacg

SEQ ID NO: 1128914 - RNA, 15 nt, Mycobacterium bovis subsp bovis AF2122/97
ucgaucacggccguc

SEQ ID NO: 1128915 - RNA, 13 nt, Mycobacterium bovis subsp bovis AF2122/97
ucgaucacgucgu

SEQ ID NO: 1128916 - RNA, 18 nt, Mycobacterium bovis subsp bovis AF2122/97
ucgaucacguggugcggc

SEQ ID NO: 1128917 - RNA, 22 nt, Mycobacterium bovis subsp bovis AF2122/97
ucgaucaacaccaacgacagcg

SEQ ID NO: 1128918 - RNA, 23 nt, Mycobacterium bovis subsp bovis AF2122/97
ucgaucaacaccaacgacagcga

SEQ ID NO: 1128919 - RNA, 23 nt, Mycobacterium bovis subsp bovis AF2122/97
ucgagggugaaguggcgcagcac

SEQ ID NO: 1128920 - RNA, 20 nt, Mycobacterium bovis subsp bovis AF2122/97
ucgagggugaccaacgucga

SEQ ID NO: 1128921 - RNA, 15 nt, Mycobacterium bovis subsp bovis AF2122/97
ucgauaauggccgag

SEQ ID NO: 1128922 - RNA, 14 nt, Mycobacterium bovis subsp bovis AF2122/97
ucgauaccgcacca

SEQ ID NO: 1128923 - RNA, 15 nt, Mycobacterium bovis subsp bovis AF2122/97
ucgauagcggcggcg

SEQ ID NO: 1128924 - RNA, 17 nt, Mycobacterium bovis subsp bovis AF2122/97
ucgauagcggcggcggc

SEQ ID NO: 1128925 - RNA, 18 nt, Mycobacterium bovis subsp bovis AF2122/97
ucgagcguaacgguaacc

SEQ ID NO: 1128926 - RNA, 18 nt, Mycobacterium bovis subsp bovis AF2122/97
ucgaggcgaucaccgcgc

SEQ ID NO: 1128927 - RNA, 15 nt, Mycobacterium bovis subsp bovis AF2122/97
ucgaggcgucggcaa

SEQ ID NO: 1128928 - RNA, 13 nt, Mycobacterium bovis subsp bovis AF2122/97
ucgagcgccagcg

SEQ ID NO: 1128929 - RNA, 12 nt, Mycobacterium bovis subsp bovis AF2122/97
ucgaggcggcgg

SEQ ID NO: 1128930 - RNA, 15 nt, Mycobacterium bovis subsp bovis AF2122/97
ucgagggagcgccgc

SEQ ID NO: 1128931 - RNA, 18 nt, Mycobacterium bovis subsp bovis AF2122/97
ucgaggcugaccguggcg

SEQ ID NO: 1128932 - RNA, 23 nt, Mycobacterium bovis subsp bovis AF2122/97
ucgaggcugaccguggcgccggu

SEQ ID NO: 1128933 - RNA, 22 nt, Mycobacterium bovis subsp bovis AF2122/97
ucgaggcaggccucggcgccgc

SEQ ID NO: 1128934 - RNA, 19 nt, Mycobacterium bovis subsp bovis AF2122/97
ucgaggccacgccagcucg

SEQ ID NO: 1128935 - RNA, 21 nt, Mycobacterium bovis subsp bovis AF2122/97
ucgaugcauggcuugcucugc

SEQ ID NO: 1128936 - RNA, 12 nt, Mycobacterium bovis subsp bovis AF2122/97
ucgaugccggcu

SEQ ID NO: 1128937 - RNA, 12 nt, Mycobacterium bovis subsp bovis AF2122/97
ucgaugccgcgu

SEQ ID NO: 1128938 - RNA, 18 nt, Mycobacterium bovis subsp bovis AF2122/97
ucgaugccgcguagcugg

SEQ ID NO: 1128939 - RNA, 13 nt, Mycobacterium bovis subsp bovis AF2122/97
ucgaugcgacgaa

SEQ ID NO: 1128940 - RNA, 22 nt, Mycobacterium bovis subsp bovis AF2122/97
ucgaugcgacgaaccucggcgg

SEQ ID NO: 1128941 - RNA, 16 nt, Mycobacterium bovis subsp bovis AF2122/97
ucgaugcgcgccggcu

SEQ ID NO: 1128942 - RNA, 16 nt, Mycobacterium bovis subsp bovis AF2122/97
ucgaugcgaucgacga

SEQ ID NO: 1128943 - RNA, 20 nt, Mycobacterium bovis subsp bovis AF2122/97
ucgauggccaggcuggcguc

SEQ ID NO: 1128944 - RNA, 17 nt, Mycobacterium bovis subsp bovis AF2122/97
ucgauggcaucggccau

SEQ ID NO: 1128945 - RNA, 19 nt, Mycobacterium bovis subsp bovis AF2122/97
ucgaugcggguggcgccgg

SEQ ID NO: 1128946 - RNA, 23 nt, Mycobacterium bovis subsp bovis AF2122/97
ucgaugaugcccauccggccguc

SEQ ID NO: 1128947 - RNA, 12 nt, Mycobacterium bovis subsp bovis AF2122/97
ucgaugacgccg

SEQ ID NO: 1128948 - RNA, 23 nt, Mycobacterium bovis subsp bovis AF2122/97
ucgaugagcgcgaaguacgacga

SEQ ID NO: 1128949 - RNA, 21 nt, Mycobacterium bovis subsp bovis AF2122/97
ucgaugaggcgcagcgccagc

SEQ ID NO: 1128950 - RNA, 22 nt, Mycobacterium bovis subsp bovis AF2122/97
ucgaugaggcgcagcgccagcg

SEQ ID NO: 1128951 - RNA, 18 nt, Mycobacterium bovis subsp bovis AF2122/97
ucgaugagguucaucgcc

SEQ ID NO: 1128952 - RNA, 22 nt, Mycobacterium bovis subsp bovis AF2122/97
ucgaugagugacgguccguucg

SEQ ID NO: 1128953 - RNA, 14 nt, Mycobacterium bovis subsp bovis AF2122/97
ucgaucagcgccgg

SEQ ID NO: 1128954 - RNA, 15 nt, Mycobacterium bovis subsp bovis AF2122/97
ucgaucagcgccgga

SEQ ID NO: 1128955 - RNA, 18 nt, Mycobacterium bovis subsp bovis AF2122/97
ucgaucagcuugggcagc

SEQ ID NO: 1128956 - RNA, 23 nt, Mycobacterium bovis subsp bovis AF2122/97
ucgaucagcuugggcagcagcgc

SEQ ID NO: 1128957 - RNA, 15 nt, Mycobacterium bovis subsp bovis AF2122/97
ucgaucaggucguca

SEQ ID NO: 1128958 - RNA, 19 nt, Mycobacterium bovis subsp bovis AF2122/97
ucgaucagucgugggcugu

SEQ ID NO: 1128959 - RNA, 17 nt, Mycobacterium bovis subsp bovis AF2122/97
ucgaucaguucguggcu

SEQ ID NO: 1128960 - RNA, 21 nt, Mycobacterium bovis subsp bovis AF2122/97
ucgcaccggagucggcgucga

SEQ ID NO: 1128961 - RNA, 22 nt, Mycobacterium bovis subsp bovis AF2122/97
ucgcacccagggcguuggcggc

SEQ ID NO: 1128962 - RNA, 15 nt, Mycobacterium bovis subsp bovis AF2122/97
ucgcaccccggcggc

SEQ ID NO: 1128963 - RNA, 16 nt, Mycobacterium bovis subsp bovis AF2122/97
ucgcaccccggcggcg

SEQ ID NO: 1128964 - RNA, 17 nt, Mycobacterium bovis subsp bovis AF2122/97
ucgcaccaccugggcgg

SEQ ID NO: 1128965 - RNA, 19 nt, Mycobacterium bovis subsp bovis AF2122/97
ucgcacaccuccucgaccg

SEQ ID NO: 1128966 - RNA, 17 nt, Mycobacterium bovis subsp bovis AF2122/97
ucgcaaggcccgcaccg

SEQ ID NO: 1128967 - RNA, 22 nt, Mycobacterium bovis subsp bovis AF2122/97
ucgcacagcaccacgugcgagg

SEQ ID NO: 1128968 - RNA, 15 nt, Mycobacterium bovis subsp bovis AF2122/97
ucgcaagcgcggcga

SEQ ID NO: 1128969 - RNA, 18 nt, Mycobacterium bovis subsp bovis AF2122/97
ucgcaauauccggccgag

SEQ ID NO: 1128970 - RNA, 19 nt, Mycobacterium bovis subsp bovis AF2122/97
ucgcaauaugccacagacc

SEQ ID NO: 1128971 - RNA, 19 nt, Mycobacterium bovis subsp bovis AF2122/97
ucgaugggugacgguggcc

SEQ ID NO: 1128972 - RNA, 16 nt, Mycobacterium bovis subsp bovis AF2122/97
ucgauggugucgcgca

SEQ ID NO: 1128973 - RNA, 15 nt, Mycobacterium bovis subsp bovis AF2122/97
ucgauguacaccgug

SEQ ID NO: 1128974 - RNA, 22 nt, Mycobacterium bovis subsp bovis AF2122/97
ucgauggugcggcccaaccggu

SEQ ID NO: 1128975 - RNA, 16 nt, Mycobacterium bovis subsp bovis AF2122/97
ucgauguauccgaugc

SEQ ID NO: 1128976 - RNA, 17 nt, Mycobacterium bovis subsp bovis AF2122/97
ucgauguauccgaugcg

SEQ ID NO: 1128977 - RNA, 17 nt, Mycobacterium bovis subsp bovis AF2122/97
ucgauguccucgauccg

SEQ ID NO: 1128978 - RNA, 17 nt, Mycobacterium bovis subsp bovis AF2122/97
ucgauguccccggcggc

SEQ ID NO: 1128979 - RNA, 18 nt, Mycobacterium bovis subsp bovis AF2122/97
ucgauguccucgacaccc

SEQ ID NO: 1128980 - RNA, 22 nt, Mycobacterium bovis subsp bovis AF2122/97
ucgauguucgccgcgcggaaca

SEQ ID NO: 1128981 - RNA, 18 nt, Mycobacterium bovis subsp bovis AF2122/97
ucgauuaucgcgcgcaac

SEQ ID NO: 1128982 - RNA, 20 nt, Mycobacterium bovis subsp bovis AF2122/97
ucgauuaucgcgcgcaaccg

SEQ ID NO: 1128983 - RNA, 18 nt, Mycobacterium bovis subsp bovis AF2122/97
ucgauuccgggugcgauc

SEQ ID NO: 1128984 - RNA, 20 nt, Mycobacterium bovis subsp bovis AF2122/97
ucgauuggcucgccgaacca

SEQ ID NO: 1128985 - RNA, 18 nt, Mycobacterium bovis subsp bovis AF2122/97
ucgaccgugcgucgaugg

SEQ ID NO: 1128986 - RNA, 20 nt, Mycobacterium bovis subsp bovis AF2122/97
ucgaccgugcgucgauggcg

SEQ ID NO: 1128987 - RNA, 20 nt, Mycobacterium bovis subsp bovis AF2122/97
ucgaccguggcugcgcucgc

SEQ ID NO: 1128988 - RNA, 18 nt, Mycobacterium bovis subsp bovis AF2122/97
ucgaccguauugaccagc

SEQ ID NO: 1128989 - RNA, 22 nt, Mycobacterium bovis subsp bovis AF2122/97
ucgaccguccgggucaccagcg

SEQ ID NO: 1128990 - RNA, 13 nt, Mycobacterium bovis subsp bovis AF2122/97
ucgaccggugaug

SEQ ID NO: 1128991 - RNA, 11 nt, Mycobacterium bovis subsp bovis AF2122/97
ucgaccggcgg

SEQ ID NO: 1128992 - RNA, 17 nt, Mycobacterium bovis subsp bovis AF2122/97
ucgaccggaaugcccgg

SEQ ID NO: 1128993 - RNA, 21 nt, Mycobacterium bovis subsp bovis AF2122/97
ucgaccggacaaagcugcucg

SEQ ID NO: 1128994 - RNA, 13 nt, Mycobacterium bovis subsp bovis AF2122/97
ucgaccgcuggau

SEQ ID NO: 1128995 - RNA, 24 nt, Mycobacterium bovis subsp bovis AF2122/97
ucgaccgcggcccggacgucggcg

SEQ ID NO: 1128996 - RNA, 16 nt, Mycobacterium bovis subsp bovis AF2122/97
ucgaccucgcgggcga

SEQ ID NO: 1128997 - RNA, 21 nt, Mycobacterium bovis subsp bovis AF2122/97
ucgaccucggcaaccaccucg

SEQ ID NO: 1128998 - RNA, 21 nt, Mycobacterium bovis subsp bovis AF2122/97
ucgaccgugucaccgccggga

SEQ ID NO: 1128999 - RNA, 20 nt, Mycobacterium bovis subsp bovis AF2122/97
ucgaccucacccacccgcgg

SEQ ID NO: 1129000 - RNA, 19 nt, Mycobacterium bovis subsp bovis AF2122/97
ucgaccucgucggccgaca

SEQ ID NO: 1129001 - RNA, 19 nt, Mycobacterium bovis subsp bovis AF2122/97
ucgaccguauugaccagcg

SEQ ID NO: 1129002 - RNA, 19 nt, Mycobacterium bovis subsp bovis AF2122/97
ucgaccuguugucguggcg

SEQ ID NO: 1129003 - RNA, 15 nt, Mycobacterium bovis subsp bovis AF2122/97
ucgaccuucgggaca

SEQ ID NO: 1129004 - RNA, 18 nt, Mycobacterium bovis subsp bovis AF2122/97
ucgaccuugcaccggccg

SEQ ID NO: 1129005 - RNA, 18 nt, Mycobacterium bovis subsp bovis AF2122/97
ucgaccuucucgaugcug

SEQ ID NO: 1129006 - RNA, 20 nt, Mycobacterium bovis subsp bovis AF2122/97
ucgaccuucucgaugcugac

SEQ ID NO: 1129007 - RNA, 14 nt, Mycobacterium bovis subsp bovis AF2122/97
ucgacgaacuccgc

SEQ ID NO: 1129008 - RNA, 20 nt, Mycobacterium bovis subsp bovis AF2122/97
ucgacgccgaucgcggcggc

SEQ ID NO: 1129009 - RNA, 19 nt, Mycobacterium bovis subsp bovis AF2122/97
ucgacgccgagaccgccgc

SEQ ID NO: 1129010 - RNA, 15 nt, Mycobacterium bovis subsp bovis AF2122/97
ucgacgcccgcccug

SEQ ID NO: 1129011 - RNA, 15 nt, Mycobacterium bovis subsp bovis AF2122/97
ucgacgccgcagcgu

SEQ ID NO: 1129012 - RNA, 22 nt, Mycobacterium bovis subsp bovis AF2122/97
ucgacgccgccacccggcgggc

SEQ ID NO: 1129013 - RNA, 23 nt, Mycobacterium bovis subsp bovis AF2122/97
ucgacgaagaucuucaccggccg

SEQ ID NO: 1129014 - RNA, 22 nt, Mycobacterium bovis subsp bovis AF2122/97
ucgacgaacgccucaccgacgu

SEQ ID NO: 1129015 - RNA, 12 nt, Mycobacterium bovis subsp bovis AF2122/97
ucgacgaacucc

SEQ ID NO: 1129016 - RNA, 20 nt, Mycobacterium bovis subsp bovis AF2122/97
ucgacgcagugcccgaucgc

SEQ ID NO: 1129017 - RNA, 15 nt, Mycobacterium bovis subsp bovis AF2122/97
ucgacgaagguggcg

SEQ ID NO: 1129018 - RNA, 19 nt, Mycobacterium bovis subsp bovis AF2122/97
ucgacgccaaaucggccaa

SEQ ID NO: 1129019 - RNA, 19 nt, Mycobacterium bovis subsp bovis AF2122/97
ucgacccuccagcacgccg

SEQ ID NO: 1129020 - RNA, 21 nt, Mycobacterium bovis subsp bovis AF2122/97
ucgaccgacugcccgauggcu

SEQ ID NO: 1129021 - RNA, 18 nt, Mycobacterium bovis subsp bovis AF2122/97
ucgaccgccagccgcgag

SEQ ID NO: 1129022 - RNA, 21 nt, Mycobacterium bovis subsp bovis AF2122/97
ucgaccgccagccgcgagccg

SEQ ID NO: 1129023 - RNA, 12 nt, Mycobacterium bovis subsp bovis AF2122/97
ucgaccgcccgc

SEQ ID NO: 1129024 - RNA, 14 nt, Mycobacterium bovis subsp bovis AF2122/97
ucgaccgcccgcca

SEQ ID NO: 1129025 - RNA, 21 nt, Mycobacterium bovis subsp bovis AF2122/97
ucgaccgccgagauagcaacg

SEQ ID NO: 1129026 - RNA, 19 nt, Mycobacterium bovis subsp bovis AF2122/97
ucgacaucaccaccgccgg

SEQ ID NO: 1129027 - RNA, 15 nt, Mycobacterium bovis subsp bovis AF2122/97
ucgacaguugcgcca

SEQ ID NO: 1129028 - RNA, 19 nt, Mycobacterium bovis subsp bovis AF2122/97
ucgacaguuuucaccgcga

SEQ ID NO: 1129029 - RNA, 15 nt, Mycobacterium bovis subsp bovis AF2122/97
ucgacagcagcgcga

SEQ ID NO: 1129030 - RNA, 17 nt, Mycobacterium bovis subsp bovis AF2122/97
ucgacagcagcgcgaca

SEQ ID NO: 1129031 - RNA, 16 nt, Mycobacterium bovis subsp bovis AF2122/97
ucgacacccgcucggc

SEQ ID NO: 1129032 - RNA, 19 nt, Mycobacterium bovis subsp bovis AF2122/97
ucgacaccgugaccgccgc

SEQ ID NO: 1129033 - RNA, 20 nt, Mycobacterium bovis subsp bovis AF2122/97
ucgacaccgugaccgccgcg

SEQ ID NO: 1129034 - RNA, 22 nt, Mycobacterium bovis subsp bovis AF2122/97
ucgacaccgugaccgccgcgcc

SEQ ID NO: 1129035 - RNA, 14 nt, Mycobacterium bovis subsp bovis AF2122/97
ucgacagcggcgau

SEQ ID NO: 1129036 - RNA, 23 nt, Mycobacterium bovis subsp bovis AF2122/97
ucgacacccauccucgcggugcg

SEQ ID NO: 1129037 - RNA, 16 nt, Mycobacterium bovis subsp bovis AF2122/97
ucgacaaguccgcgau

SEQ ID NO: 1129038 - RNA, 24 nt, Mycobacterium bovis subsp bovis AF2122/97
ucgacaaaccacagacugcgcggc

SEQ ID NO: 1129039 - RNA, 20 nt, Mycobacterium bovis subsp bovis AF2122/97
ucgacacacccaccggacca

SEQ ID NO: 1129040 - RNA, 22 nt, Mycobacterium bovis subsp bovis AF2122/97
ucgacaacgcggcaccuucggc

SEQ ID NO: 1129041 - RNA, 21 nt, Mycobacterium bovis subsp bovis AF2122/97
ucgacaaagcggcugcccgag

SEQ ID NO: 1129042 - RNA, 17 nt, Mycobacterium bovis subsp bovis AF2122/97
ucgacaacaaacccggc

SEQ ID NO: 1129043 - RNA, 23 nt, Mycobacterium bovis subsp bovis AF2122/97
ucgacaacaaacccggccucggu

SEQ ID NO: 1129044 - RNA, 16 nt, Mycobacterium bovis subsp bovis AF2122/97
ucgaagcccggcggca

SEQ ID NO: 1129045 - RNA, 18 nt, Mycobacterium bovis subsp bovis AF2122/97
ucgaagugcaggugcggg

SEQ ID NO: 1129046 - RNA, 22 nt, Mycobacterium bovis subsp bovis AF2122/97
ucgaauagguguguggcgccgg

SEQ ID NO: 1129047 - RNA, 18 nt, Mycobacterium bovis subsp bovis AF2122/97
ucgaauaguugaccaggc

SEQ ID NO: 1129048 - RNA, 16 nt, Mycobacterium bovis subsp bovis AF2122/97
ucgaagccccucaccu

SEQ ID NO: 1129049 - RNA, 20 nt, Mycobacterium bovis subsp bovis AF2122/97
ucgaagccccucaccucggc

SEQ ID NO: 1129050 - RNA, 12 nt, Mycobacterium bovis subsp bovis AF2122/97
ucgaagcccgga

SEQ ID NO: 1129051 - RNA, 18 nt, Mycobacterium bovis subsp bovis AF2122/97
ucgaagacgaacgugucg

SEQ ID NO: 1129052 - RNA, 20 nt, Mycobacterium bovis subsp bovis AF2122/97
ucgaagaccgccuccaccgc

SEQ ID NO: 1129053 - RNA, 21 nt, Mycobacterium bovis subsp bovis AF2122/97
ucgaagaccucgucgcgucgc

SEQ ID NO: 1129054 - RNA, 22 nt, Mycobacterium bovis subsp bovis AF2122/97
ucgaagacgaacgugucgggug

SEQ ID NO: 1129055 - RNA, 16 nt, Mycobacterium bovis subsp bovis AF2122/97
ucgaagaucgagccga

SEQ ID NO: 1129056 - RNA, 19 nt, Mycobacterium bovis subsp bovis AF2122/97
ucgaacacggcacaaucgg

SEQ ID NO: 1129057 - RNA, 23 nt, Mycobacterium bovis subsp bovis AF2122/97
ucgaacacggcacaaucggcgcc

SEQ ID NO: 1129058 - RNA, 21 nt, Mycobacterium bovis subsp bovis AF2122/97
ucgaacggcuuggcgucggcc

SEQ ID NO: 1129059 - RNA, 22 nt, Mycobacterium bovis subsp bovis AF2122/97
ucgaacggcuuggcgucggccg

SEQ ID NO: 1129060 - RNA, 14 nt, Mycobacterium bovis subsp bovis AF2122/97
ucgaacgccgcccg

SEQ ID NO: 1129061 - RNA, 13 nt, Mycobacterium bovis subsp bovis AF2122/97
ucgaagaaccggc

SEQ ID NO: 1129062 - RNA, 15 nt, Mycobacterium bovis subsp bovis AF2122/97
ucgaagaaccggccg

SEQ ID NO: 1129063 - RNA, 20 nt, Mycobacterium bovis subsp bovis AF2122/97
ucgaagaaccggccgacgaa

SEQ ID NO: 1129064 - RNA, 18 nt, Mycobacterium bovis subsp bovis AF2122/97
ucgaacuugaucaccgcg

SEQ ID NO: 1129065 - RNA, 22 nt, Mycobacterium bovis subsp bovis AF2122/97
ucgaacuccccggucgccgcgu

SEQ ID NO: 1129066 - RNA, 13 nt, Mycobacterium bovis subsp bovis AF2122/97
ucgaacugggggc

SEQ ID NO: 1129067 - RNA, 18 nt, Mycobacterium bovis subsp bovis AF2122/97
ucgaacugggggccggca

SEQ ID NO: 1129068 - RNA, 21 nt, Mycobacterium bovis subsp bovis AF2122/97
ucgaacugguuucgcaccgug

SEQ ID NO: 1129069 - RNA, 19 nt, Mycobacterium bovis subsp bovis AF2122/97
uccucgacgucggcgagca

SEQ ID NO: 1129070 - RNA, 14 nt, Mycobacterium bovis subsp bovis AF2122/97
uccucgcccuugac

SEQ ID NO: 1129071 - RNA, 16 nt, Mycobacterium bovis subsp bovis AF2122/97
uccucgcgaaaccgcc

SEQ ID NO: 1129072 - RNA, 16 nt, Mycobacterium bovis subsp bovis AF2122/97
uccucggauugcagcg

SEQ ID NO: 1129073 - RNA, 17 nt, Mycobacterium bovis subsp bovis AF2122/97
uccucggauugcagcgc

SEQ ID NO: 1129074 - RNA, 13 nt, Mycobacterium bovis subsp bovis AF2122/97
uccucggccagcg

SEQ ID NO: 1129075 - RNA, 14 nt, Mycobacterium bovis subsp bovis AF2122/97
uccucggccacccg

SEQ ID NO: 1129076 - RNA, 16 nt, Mycobacterium bovis subsp bovis AF2122/97
uccuguccgggcugca

SEQ ID NO: 1129077 - RNA, 21 nt, Mycobacterium bovis subsp bovis AF2122/97
ucgaaagagaaggcggcgucg

SEQ ID NO: 1129078 - RNA, 23 nt, Mycobacterium bovis subsp bovis AF2122/97
ucgaaagcaccgaugcugacgau

SEQ ID NO: 1129079 - RNA, 17 nt, Mycobacterium bovis subsp bovis AF2122/97
ucgaaaucgcacagcgc

SEQ ID NO: 1129080 - RNA, 13 nt, Mycobacterium bovis subsp bovis AF2122/97
ucgaaagccgcgg

SEQ ID NO: 1129081 - RNA, 16 nt, Mycobacterium bovis subsp bovis AF2122/97
uccuucagggcgucga

SEQ ID NO: 1129082 - RNA, 13 nt, Mycobacterium bovis subsp bovis AF2122/97
ucgaaaacagcga

SEQ ID NO: 1129083 - RNA, 18 nt, Mycobacterium bovis subsp bovis AF2122/97
ucgaaaacagcgauccga

SEQ ID NO: 1129084 - RNA, 16 nt, Mycobacterium bovis subsp bovis AF2122/97
ucgcgcugccggccgc

SEQ ID NO: 1129085 - RNA, 14 nt, Mycobacterium bovis subsp bovis AF2122/97
ucgcgcugaucagc

SEQ ID NO: 1129086 - RNA, 20 nt, Mycobacterium bovis subsp bovis AF2122/97
ucgcgcugcugucgauuucg

SEQ ID NO: 1129087 - RNA, 13 nt, Mycobacterium bovis subsp bovis AF2122/97
ucgcgcugccggc

SEQ ID NO: 1129088 - RNA, 22 nt, Mycobacterium bovis subsp bovis AF2122/97
ucgcgcuggcgccggccagcca

SEQ ID NO: 1129089 - RNA, 18 nt, Mycobacterium bovis subsp bovis AF2122/97
ucgcgcgguagucgucgc

SEQ ID NO: 1129090 - RNA, 22 nt, Mycobacterium bovis subsp bovis AF2122/97
ucgcgcucauugcaucugccaa

SEQ ID NO: 1129091 - RNA, 13 nt, Mycobacterium bovis subsp bovis AF2122/97
ucgcgcucgcacc

SEQ ID NO: 1129092 - RNA, 15 nt, Mycobacterium bovis subsp bovis AF2122/97
ucgcgcucgccggug

SEQ ID NO: 1129093 - RNA, 23 nt, Mycobacterium bovis subsp bovis AF2122/97
ucgcgcucgccgguguccuuggc

SEQ ID NO: 1129094 - RNA, 14 nt, Mycobacterium bovis subsp bovis AF2122/97
ucgcggaacucguc

SEQ ID NO: 1129095 - RNA, 14 nt, Mycobacterium bovis subsp bovis AF2122/97
ucgcgcuggccaug

SEQ ID NO: 1129096 - RNA, 14 nt, Mycobacterium bovis subsp bovis AF2122/97
ucgcgcuugcgccg

SEQ ID NO: 1129097 - RNA, 20 nt, Mycobacterium bovis subsp bovis AF2122/97
ucgcggaaccguacgccaga

SEQ ID NO: 1129098 - RNA, 21 nt, Mycobacterium bovis subsp bovis AF2122/97
ucgcggaagcgggcgaugccg

SEQ ID NO: 1129099 - RNA, 22 nt, Mycobacterium bovis subsp bovis AF2122/97
ucgcggagcgugagccaugccg

SEQ ID NO: 1129100 - RNA, 22 nt, Mycobacterium bovis subsp bovis AF2122/97
ucgcggauccgggcguggugga

SEQ ID NO: 1129101 - RNA, 19 nt, Mycobacterium bovis subsp bovis AF2122/97
ucgcggagucugcugaucg

SEQ ID NO: 1129102 - RNA, 20 nt, Mycobacterium bovis subsp bovis AF2122/97
ucgcggagucugcugaucga

SEQ ID NO: 1129103 - RNA, 21 nt, Mycobacterium bovis subsp bovis AF2122/97
ucgcggagccaggacgacgcc

SEQ ID NO: 1129104 - RNA, 23 nt, Mycobacterium bovis subsp bovis AF2122/97
ucgcggagccaggacgacgccga

SEQ ID NO: 1129105 - RNA, 13 nt, Mycobacterium bovis subsp bovis AF2122/97
ucgcggacgucgc

SEQ ID NO: 1129106 - RNA, 14 nt, Mycobacterium bovis subsp bovis AF2122/97
ucgcggacgucgcc

SEQ ID NO: 1129107 - RNA, 20 nt, Mycobacterium bovis subsp bovis AF2122/97
ucgcggacccgucggcgugg

SEQ ID NO: 1129108 - RNA, 22 nt, Mycobacterium bovis subsp bovis AF2122/97
ucgcggacucguagcaccgguc

SEQ ID NO: 1129109 - RNA, 22 nt, Mycobacterium bovis subsp bovis AF2122/97
ucgcggcaaugaggccgucugc

SEQ ID NO: 1129110 - RNA, 21 nt, Mycobacterium bovis subsp bovis AF2122/97
ucgcggcacgaucaaccgggu

SEQ ID NO: 1129111 - RNA, 19 nt, Mycobacterium bovis subsp bovis AF2122/97
ucgcggauuucucgcccug

SEQ ID NO: 1129112 - RNA, 18 nt, Mycobacterium bovis subsp bovis AF2122/97
ucgcggaucugggcggcc

SEQ ID NO: 1129113 - RNA, 17 nt, Mycobacterium bovis subsp bovis AF2122/97
ucgcggcaucgacgcgg

SEQ ID NO: 1129114 - RNA, 19 nt, Mycobacterium bovis subsp bovis AF2122/97
ucgcggcaucgacgcggcc

SEQ ID NO: 1129115 - RNA, 18 nt, Mycobacterium bovis subsp bovis AF2122/97
ucgcggcagccggcggag

SEQ ID NO: 1129116 - RNA, 15 nt, Mycobacterium bovis subsp bovis AF2122/97
ucgcggccacgguca

SEQ ID NO: 1129117 - RNA, 22 nt, Mycobacterium bovis subsp bovis AF2122/97
ucgcggcacgcccacagcugac

SEQ ID NO: 1129118 - RNA, 19 nt, Mycobacterium bovis subsp bovis AF2122/97
ucgcggccaacccauuucg

SEQ ID NO: 1129119 - RNA, 23 nt, Mycobacterium bovis subsp bovis AF2122/97
ucgcggccgaaacuucgcccggg

SEQ ID NO: 1129120 - RNA, 13 nt, Mycobacterium bovis subsp bovis AF2122/97
ucgcggccagcag

SEQ ID NO: 1129121 - RNA, 13 nt, Mycobacterium bovis subsp bovis AF2122/97
ucgcggcgaucgc

SEQ ID NO: 1129122 - RNA, 13 nt, Mycobacterium bovis subsp bovis AF2122/97
ucgcggccggcgu

SEQ ID NO: 1129123 - RNA, 15 nt, Mycobacterium bovis subsp bovis AF2122/97
ucgcggccggcgucg

SEQ ID NO: 1129124 - RNA, 15 nt, Mycobacterium bovis subsp bovis AF2122/97
ucgcggccgucgcgg

SEQ ID NO: 1129125 - RNA, 16 nt, Mycobacterium bovis subsp bovis AF2122/97
ucgcggcggcgcuggc

SEQ ID NO: 1129126 - RNA, 14 nt, Mycobacterium bovis subsp bovis AF2122/97
ucgcggcgccgucg

SEQ ID NO: 1129127 - RNA, 21 nt, Mycobacterium bovis subsp bovis AF2122/97
ucgcggcggcacuacgcagcc

SEQ ID NO: 1129128 - RNA, 16 nt, Mycobacterium bovis subsp bovis AF2122/97
ucgcggcgcggccgca

SEQ ID NO: 1129129 - RNA, 16 nt, Mycobacterium bovis subsp bovis AF2122/97
ucgcggcggcgugcuc

SEQ ID NO: 1129130 - RNA, 13 nt, Mycobacterium bovis subsp bovis AF2122/97
ucgcggcggugaa

SEQ ID NO: 1129131 - RNA, 11 nt, Mycobacterium bovis subsp bovis AF2122/97
ucgcgcacguc

SEQ ID NO: 1129132 - RNA, 18 nt, Mycobacterium bovis subsp bovis AF2122/97
ucgcgcagcgccgccacc

SEQ ID NO: 1129133 - RNA, 13 nt, Mycobacterium bovis subsp bovis AF2122/97
ucgcgcagcgcga

SEQ ID NO: 1129134 - RNA, 15 nt, Mycobacterium bovis subsp bovis AF2122/97
ucgcgcagcuccacc

SEQ ID NO: 1129135 - RNA, 22 nt, Mycobacterium bovis subsp bovis AF2122/97
ucgcgcaguuggccaugcaccg

SEQ ID NO: 1129136 - RNA, 18 nt, Mycobacterium bovis subsp bovis AF2122/97
ucgcgcagguagcgccgc

SEQ ID NO: 1129137 - RNA, 12 nt, Mycobacterium bovis subsp bovis AF2122/97
ucgcgccgguga

SEQ ID NO: 1129138 - RNA, 15 nt, Mycobacterium bovis subsp bovis AF2122/97
ucgcgccgucgucga

SEQ ID NO: 1129139 - RNA, 16 nt, Mycobacterium bovis subsp bovis AF2122/97
ucgcgccgucgucgac

SEQ ID NO: 1129140 - RNA, 18 nt, Mycobacterium bovis subsp bovis AF2122/97
ucgcgccguggcgucggu

SEQ ID NO: 1129141 - RNA, 20 nt, Mycobacterium bovis subsp bovis AF2122/97
ucgcgcaucgccuccucgac

SEQ ID NO: 1129142 - RNA, 20 nt, Mycobacterium bovis subsp bovis AF2122/97
ucgcgccgcgugguuccggc

SEQ ID NO: 1129143 - RNA, 20 nt, Mycobacterium bovis subsp bovis AF2122/97
ucgcgaggcgucaccccggu

SEQ ID NO: 1129144 - RNA, 17 nt, Mycobacterium bovis subsp bovis AF2122/97
ucgcgaggcucgcgugg

SEQ ID NO: 1129145 - RNA, 21 nt, Mycobacterium bovis subsp bovis AF2122/97
ucgcgaggcuguccgaaccga

SEQ ID NO: 1129146 - RNA, 17 nt, Mycobacterium bovis subsp bovis AF2122/97
ucgcgagguccagcaug

SEQ ID NO: 1129147 - RNA, 21 nt, Mycobacterium bovis subsp bovis AF2122/97
ucgcgagcucccuaacaucgu

SEQ ID NO: 1129148 - RNA, 21 nt, Mycobacterium bovis subsp bovis AF2122/97
ucgcgagcugcgacgaugccg

SEQ ID NO: 1129149 - RNA, 18 nt, Mycobacterium bovis subsp bovis AF2122/97
ucgcgagcuuggccggca

SEQ ID NO: 1129150 - RNA, 22 nt, Mycobacterium bovis subsp bovis AF2122/97
ucgcgagccagcugcuccaccc

SEQ ID NO: 1129151 - RNA, 19 nt, Mycobacterium bovis subsp bovis AF2122/97
ucgcgacuagacgccgccg

SEQ ID NO: 1129152 - RNA, 20 nt, Mycobacterium bovis subsp bovis AF2122/97
ucgcgacuagacgccgccgc

SEQ ID NO: 1129153 - RNA, 17 nt, Mycobacterium bovis subsp bovis AF2122/97
ucgcgagaaggugcugc

SEQ ID NO: 1129154 - RNA, 15 nt, Mycobacterium bovis subsp bovis AF2122/97
ucgcgacggcaagca

SEQ ID NO: 1129155 - RNA, 18 nt, Mycobacterium bovis subsp bovis AF2122/97
ucgcgacggcccgauccc

SEQ ID NO: 1129156 - RNA, 12 nt, Mycobacterium bovis subsp bovis AF2122/97
ucgcgacgucgg

SEQ ID NO: 1129157 - RNA, 15 nt, Mycobacterium bovis subsp bovis AF2122/97
ucgcgacgucggccg

SEQ ID NO: 1129158 - RNA, 19 nt, Mycobacterium bovis subsp bovis AF2122/97
ucgcgacgucugccaggcg

SEQ ID NO: 1129159 - RNA, 20 nt, Mycobacterium bovis subsp bovis AF2122/97
ucgcgcacauaggcgaucgc

SEQ ID NO: 1129160 - RNA, 19 nt, Mycobacterium bovis subsp bovis AF2122/97
ucgcgauaaggaugcaucg

SEQ ID NO: 1129161 - RNA, 18 nt, Mycobacterium bovis subsp bovis AF2122/97
ucgccgggucagcccggc

SEQ ID NO: 1129162 - RNA, 21 nt, Mycobacterium bovis subsp bovis AF2122/97
ucgccgggucagcccggcgcg

SEQ ID NO: 1129163 - RNA, 20 nt, Mycobacterium bovis subsp bovis AF2122/97
ucgccggucagcgugcaggu

SEQ ID NO: 1129164 - RNA, 15 nt, Mycobacterium bovis subsp bovis AF2122/97
ucgccggucaggccg

SEQ ID NO: 1129165 - RNA, 20 nt, Mycobacterium bovis subsp bovis AF2122/97
ucgccgguaggcggccagcg

SEQ ID NO: 1129166 - RNA, 18 nt, Mycobacterium bovis subsp bovis AF2122/97
ucgccgguaugccgaacg

SEQ ID NO: 1129167 - RNA, 20 nt, Mycobacterium bovis subsp bovis AF2122/97
ucgccggggccgcuggcggu

SEQ ID NO: 1129168 - RNA, 15 nt, Mycobacterium bovis subsp bovis AF2122/97
ucgccggucccccgc

SEQ ID NO: 1129169 - RNA, 18 nt, Mycobacterium bovis subsp bovis AF2122/97
ucgccggugacgggguug

SEQ ID NO: 1129170 - RNA, 13 nt, Mycobacterium bovis subsp bovis AF2122/97
ucgcgacgacgua

SEQ ID NO: 1129171 - RNA, 15 nt, Mycobacterium bovis subsp bovis AF2122/97
ucgcgacgcgacggu

SEQ ID NO: 1129172 - RNA, 15 nt, Mycobacterium bovis subsp bovis AF2122/97
ucgcgacgcgcgaga

SEQ ID NO: 1129173 - RNA, 18 nt, Mycobacterium bovis subsp bovis AF2122/97
ucgccgucacgcacgccg

SEQ ID NO: 1129174 - RNA, 20 nt, Mycobacterium bovis subsp bovis AF2122/97
ucgccgucacgcacgccgcg

SEQ ID NO: 1129175 - RNA, 22 nt, Mycobacterium bovis subsp bovis AF2122/97
ucgcgaccuugcccgcuagcgc

SEQ ID NO: 1129176 - RNA, 15 nt, Mycobacterium bovis subsp bovis AF2122/97
ucgccggugagccgg

SEQ ID NO: 1129177 - RNA, 20 nt, Mycobacterium bovis subsp bovis AF2122/97
ucgccguagagcuggugcgg

SEQ ID NO: 1129178 - RNA, 18 nt, Mycobacterium bovis subsp bovis AF2122/97
ucgccguaagcaccagcc

SEQ ID NO: 1129179 - RNA, 19 nt, Mycobacterium bovis subsp bovis AF2122/97
ucgccgccuuccuggcggg

SEQ ID NO: 1129180 - RNA, 14 nt, Mycobacterium bovis subsp bovis AF2122/97
ucgccgcgaagggg

SEQ ID NO: 1129181 - RNA, 20 nt, Mycobacterium bovis subsp bovis AF2122/97
ucgccgcgaaugucgccgcc

SEQ ID NO: 1129182 - RNA, 13 nt, Mycobacterium bovis subsp bovis AF2122/97
ucgccgcgcagcc

SEQ ID NO: 1129183 - RNA, 22 nt, Mycobacterium bovis subsp bovis AF2122/97
ucgccgcgcagccuucucgcug

SEQ ID NO: 1129184 - RNA, 13 nt, Mycobacterium bovis subsp bovis AF2122/97
ucgccgcgcaccg

SEQ ID NO: 1129185 - RNA, 16 nt, Mycobacterium bovis subsp bovis AF2122/97
ucgccgccgucaccgc

SEQ ID NO: 1129186 - RNA, 17 nt, Mycobacterium bovis subsp bovis AF2122/97
ucgccgccgucaccgcc

SEQ ID NO: 1129187 - RNA, 15 nt, Mycobacterium bovis subsp bovis AF2122/97
ucgccgccggugccg

SEQ ID NO: 1129188 - RNA, 20 nt, Mycobacterium bovis subsp bovis AF2122/97
ucgccgccggugccgcccga

SEQ ID NO: 1129189 - RNA, 19 nt, Mycobacterium bovis subsp bovis AF2122/97
ucgccgccuuacgcaccga

SEQ ID NO: 1129190 - RNA, 15 nt, Mycobacterium bovis subsp bovis AF2122/97
ucgccgccguugccg

SEQ ID NO: 1129191 - RNA, 18 nt, Mycobacterium bovis subsp bovis AF2122/97
ucgccgccguugccgccg

SEQ ID NO: 1129192 - RNA, 23 nt, Mycobacterium bovis subsp bovis AF2122/97
ucgccgccggugaggaucagcgu

SEQ ID NO: 1129193 - RNA, 20 nt, Mycobacterium bovis subsp bovis AF2122/97
ucgccgccggcgccgccggu

SEQ ID NO: 1129194 - RNA, 12 nt, Mycobacterium bovis subsp bovis AF2122/97
ucgccgccgggc

SEQ ID NO: 1129195 - RNA, 19 nt, Mycobacterium bovis subsp bovis AF2122/97
ucgccgccaccagggcacg

SEQ ID NO: 1129196 - RNA, 23 nt, Mycobacterium bovis subsp bovis AF2122/97
ucgccgccaccagcgcacgcucg

SEQ ID NO: 1129197 - RNA, 15 nt, Mycobacterium bovis subsp bovis AF2122/97
ucgccgccaccggcg

SEQ ID NO: 1129198 - RNA, 20 nt, Mycobacterium bovis subsp bovis AF2122/97
ucgccgccaccggcgacgcc

SEQ ID NO: 1129199 - RNA, 23 nt, Mycobacterium bovis subsp bovis AF2122/97
ucgccgaucagcugcgcaucgcc

SEQ ID NO: 1129200 - RNA, 20 nt, Mycobacterium bovis subsp bovis AF2122/97
ucgccgaucagcugcgcauc

SEQ ID NO: 1129201 - RNA, 17 nt, Mycobacterium bovis subsp bovis AF2122/97
ucgccgaguaccggcca

SEQ ID NO: 1129202 - RNA, 16 nt, Mycobacterium bovis subsp bovis AF2122/97
ucgccgauaucugcca

SEQ ID NO: 1129203 - RNA, 18 nt, Mycobacterium bovis subsp bovis AF2122/97
ucgccgauaucugccacg

SEQ ID NO: 1129204 - RNA, 21 nt, Mycobacterium bovis subsp bovis AF2122/97
ucgccgauaucugccacguug

SEQ ID NO: 1129205 - RNA, 22 nt, Mycobacterium bovis subsp bovis AF2122/97
ucgccgagguagauggcgaacc

SEQ ID NO: 1129206 - RNA, 21 nt, Mycobacterium bovis subsp bovis AF2122/97
ucgccgaggccucggccagcg

SEQ ID NO: 1129207 - RNA, 16 nt, Mycobacterium bovis subsp bovis AF2122/97
ucgccgagauccgcgc

SEQ ID NO: 1129208 - RNA, 17 nt, Mycobacterium bovis subsp bovis AF2122/97
ucgccgaggacgccggc

SEQ ID NO: 1129209 - RNA, 21 nt, Mycobacterium bovis subsp bovis AF2122/97
ucgccgaggacgccggcgccg

SEQ ID NO: 1129210 - RNA, 22 nt, Mycobacterium bovis subsp bovis AF2122/97
ucgccgaggacgccggcgccgc

SEQ ID NO: 1129211 - RNA, 17 nt, Mycobacterium bovis subsp bovis AF2122/97
ucgccgaggcagcgucg

SEQ ID NO: 1129212 - RNA, 14 nt, Mycobacterium bovis subsp bovis AF2122/97
ucgccgaugcugua

SEQ ID NO: 1129213 - RNA, 14 nt, Mycobacterium bovis subsp bovis AF2122/97
ucgccgcgauggcg

SEQ ID NO: 1129214 - RNA, 12 nt, Mycobacterium bovis subsp bovis AF2122/97
ucgccgcgccgu

SEQ ID NO: 1129215 - RNA, 17 nt, Mycobacterium bovis subsp bovis AF2122/97
ucgccgcgcgucaaguc

SEQ ID NO: 1129216 - RNA, 21 nt, Mycobacterium bovis subsp bovis AF2122/97
ucgccgcgcuugcgaucgccg

SEQ ID NO: 1129217 - RNA, 19 nt, Mycobacterium bovis subsp bovis AF2122/97
ucgccgcgcuugcgaucgc

SEQ ID NO: 1129218 - RNA, 16 nt, Mycobacterium bovis subsp bovis AF2122/97
ucgccggagacccggg

SEQ ID NO: 1129219 - RNA, 13 nt, Mycobacterium bovis subsp bovis AF2122/97
ucgccgcggcggc

SEQ ID NO: 1129220 - RNA, 14 nt, Mycobacterium bovis subsp bovis AF2122/97
ucgccgcggcggca

SEQ ID NO: 1129221 - RNA, 20 nt, Mycobacterium bovis subsp bovis AF2122/97
ucgccggaucuugccgcugg

SEQ ID NO: 1129222 - RNA, 17 nt, Mycobacterium bovis subsp bovis AF2122/97
ucgccggauucgaugac

SEQ ID NO: 1129223 - RNA, 15 nt, Mycobacterium bovis subsp bovis AF2122/97
ucgccggagucgacc

SEQ ID NO: 1129224 - RNA, 14 nt, Mycobacterium bovis subsp bovis AF2122/97
ucgccggagucgau

SEQ ID NO: 1129225 - RNA, 15 nt, Mycobacterium bovis subsp bovis AF2122/97
ucgccggagucgauc

SEQ ID NO: 1129226 - RNA, 22 nt, Mycobacterium bovis subsp bovis AF2122/97
ucgccggagucgaucagcuugg

SEQ ID NO: 1129227 - RNA, 14 nt, Mycobacterium bovis subsp bovis AF2122/97
ucgccggcaccggc

SEQ ID NO: 1129228 - RNA, 16 nt, Mycobacterium bovis subsp bovis AF2122/97
ucgccggcacgcagcc

SEQ ID NO: 1129229 - RNA, 18 nt, Mycobacterium bovis subsp bovis AF2122/97
ucgccggccaacugggcc

SEQ ID NO: 1129230 - RNA, 17 nt, Mycobacterium bovis subsp bovis AF2122/97
ucgccggccaccagccg

SEQ ID NO: 1129231 - RNA, 19 nt, Mycobacterium bovis subsp bovis AF2122/97
ucgccggccaccagccggu

SEQ ID NO: 1129232 - RNA, 22 nt, Mycobacterium bovis subsp bovis AF2122/97
ucgccggccacccgcgcgaugc

SEQ ID NO: 1129233 - RNA, 16 nt, Mycobacterium bovis subsp bovis AF2122/97
ucgccggccacgaccu

SEQ ID NO: 1129234 - RNA, 15 nt, Mycobacterium bovis subsp bovis AF2122/97
ucgccggccccgccg

SEQ ID NO: 1129235 - RNA, 18 nt, Mycobacterium bovis subsp bovis AF2122/97
ucgccggccccgccggcg

SEQ ID NO: 1129236 - RNA, 18 nt, Mycobacterium bovis subsp bovis AF2122/97
ucgccggcuucgcccaga

SEQ ID NO: 1129237 - RNA, 16 nt, Mycobacterium bovis subsp bovis AF2122/97
ucgccggccgcgugac

SEQ ID NO: 1129238 - RNA, 16 nt, Mycobacterium bovis subsp bovis AF2122/97
ucgccggcuccgcagc

SEQ ID NO: 1129239 - RNA, 13 nt, Mycobacterium bovis subsp bovis AF2122/97
ucgccgggucagc

SEQ ID NO: 1129240 - RNA, 20 nt, Mycobacterium bovis subsp bovis AF2122/97
ucgccggggacgccgcggcg

SEQ ID NO: 1129241 - RNA, 19 nt, Mycobacterium bovis subsp bovis AF2122/97
ucgccggggccgcuggcgg

SEQ ID NO: 1129242 - RNA, 16 nt, Mycobacterium bovis subsp bovis AF2122/97
ucgccgggugcaggcg

SEQ ID NO: 1129243 - RNA, 19 nt, Mycobacterium bovis subsp bovis AF2122/97
ucgccgggcuuaggccgcg

SEQ ID NO: 1129244 - RNA, 23 nt, Mycobacterium bovis subsp bovis AF2122/97
ucgccgggcuuggccgcgccggu

SEQ ID NO: 1129245 - RNA, 14 nt, Mycobacterium bovis subsp bovis AF2122/97
ucgccgggcccguc

SEQ ID NO: 1129246 - RNA, 22 nt, Mycobacterium bovis subsp bovis AF2122/97
ucgccgggcggcauccugcacg

SEQ ID NO: 1129247 - RNA, 17 nt, Mycobacterium bovis subsp bovis AF2122/97
ucgccgggacgauaccg

SEQ ID NO: 1129248 - RNA, 22 nt, Mycobacterium bovis subsp bovis AF2122/97
ucgccgggcagcuacggggcgg

SEQ ID NO: 1129249 - RNA, 14 nt, Mycobacterium bovis subsp bovis AF2122/97
ucgccgaaucggca

SEQ ID NO: 1129250 - RNA, 18 nt, Mycobacterium bovis subsp bovis AF2122/97
ucgccgaaucucaccguc

SEQ ID NO: 1129251 - RNA, 15 nt, Mycobacterium bovis subsp bovis AF2122/97
ucgccgaaguagacg

SEQ ID NO: 1129252 - RNA, 20 nt, Mycobacterium bovis subsp bovis AF2122/97
ucgccgaaguagacgguggu

SEQ ID NO: 1129253 - RNA, 21 nt, Mycobacterium bovis subsp bovis AF2122/97
ucgccgaagcgccgcuuggcg

SEQ ID NO: 1129254 - RNA, 19 nt, Mycobacterium bovis subsp bovis AF2122/97
ucgccgaagcgggcccgca

SEQ ID NO: 1129255 - RNA, 14 nt, Mycobacterium bovis subsp bovis AF2122/97
ucgccgagcagguc

SEQ ID NO: 1129256 - RNA, 16 nt, Mycobacterium bovis subsp bovis AF2122/97
ucgccgaaaucggcca

SEQ ID NO: 1129257 - RNA, 21 nt, Mycobacterium bovis subsp bovis AF2122/97
ucgcccggguggcgucgaucu

SEQ ID NO: 1129258 - RNA, 19 nt, Mycobacterium bovis subsp bovis AF2122/97
ucgcccgcgcuagcgguug

SEQ ID NO: 1129259 - RNA, 14 nt, Mycobacterium bovis subsp bovis AF2122/97
ucgcccggaugauc

SEQ ID NO: 1129260 - RNA, 21 nt, Mycobacterium bovis subsp bovis AF2122/97
ucgcccaucgcaagcugggcg

SEQ ID NO: 1129261 - RNA, 16 nt, Mycobacterium bovis subsp bovis AF2122/97
ucgcccagucgccgcg

SEQ ID NO: 1129262 - RNA, 19 nt, Mycobacterium bovis subsp bovis AF2122/97
ucgcccagugugcgccgug

SEQ ID NO: 1129263 - RNA, 21 nt, Mycobacterium bovis subsp bovis AF2122/97
ucgcccgcccgucuuccagcc

SEQ ID NO: 1129264 - RNA, 22 nt, Mycobacterium bovis subsp bovis AF2122/97
ucgccaugauggacagcugcgg

SEQ ID NO: 1129265 - RNA, 13 nt, Mycobacterium bovis subsp bovis AF2122/97
ucgccaucguuuc

SEQ ID NO: 1129266 - RNA, 21 nt, Mycobacterium bovis subsp bovis AF2122/97
ucgccagugcuccaaaucggc

SEQ ID NO: 1129267 - RNA, 22 nt, Mycobacterium bovis subsp bovis AF2122/97
ucgccagugcuccaaaucggca

SEQ ID NO: 1129268 - RNA, 15 nt, Mycobacterium bovis subsp bovis AF2122/97
ucgcccaggaagccg

SEQ ID NO: 1129269 - RNA, 23 nt, Mycobacterium bovis subsp bovis AF2122/97
ucgcccaggccaagguggccacc

SEQ ID NO: 1129270 - RNA, 15 nt, Mycobacterium bovis subsp bovis AF2122/97
ucgcccagcccgaca

SEQ ID NO: 1129271 - RNA, 20 nt, Mycobacterium bovis subsp bovis AF2122/97
ucgcccagccgagcguggcg

SEQ ID NO: 1129272 - RNA, 20 nt, Mycobacterium bovis subsp bovis AF2122/97
ucgccagggccaucuggcug

SEQ ID NO: 1129273 - RNA, 18 nt, Mycobacterium bovis subsp bovis AF2122/97
ucgcagaucaggacgcga

SEQ ID NO: 1129274 - RNA, 19 nt, Mycobacterium bovis subsp bovis AF2122/97
ucgcagaucaggacgcgau

SEQ ID NO: 1129275 - RNA, 15 nt, Mycobacterium bovis subsp bovis AF2122/97
ucgcagauugugagc

SEQ ID NO: 1129276 - RNA, 21 nt, Mycobacterium bovis subsp bovis AF2122/97
ucgcacgacgcgacacgccgg

SEQ ID NO: 1129277 - RNA, 17 nt, Mycobacterium bovis subsp bovis AF2122/97
ucgcacgagccaacaag

SEQ ID NO: 1129278 - RNA, 21 nt, Mycobacterium bovis subsp bovis AF2122/97
ucgcacgcucaugaccgcucg

SEQ ID NO: 1129279 - RNA, 21 nt, Mycobacterium bovis subsp bovis AF2122/97
ucgcacggaaggcccggcgcg

SEQ ID NO: 1129280 - RNA, 16 nt, Mycobacterium bovis subsp bovis AF2122/97
ucgcacggugccgccg

SEQ ID NO: 1129281 - RNA, 18 nt, Mycobacterium bovis subsp bovis AF2122/97
ucgcacggugccgccguc

SEQ ID NO: 1129282 - RNA, 21 nt, Mycobacterium bovis subsp bovis AF2122/97
ucgcacggugccgccgucgau

SEQ ID NO: 1129283 - RNA, 17 nt, Mycobacterium bovis subsp bovis AF2122/97
ucgcagacggcugccac

SEQ ID NO: 1129284 - RNA, 23 nt, Mycobacterium bovis subsp bovis AF2122/97
ucgcagacacugcugcggcagcg

SEQ ID NO: 1129285 - RNA, 22 nt, Mycobacterium bovis subsp bovis AF2122/97
ucgcacucauagaacucgccgc

SEQ ID NO: 1129286 - RNA, 21 nt, Mycobacterium bovis subsp bovis AF2122/97
ucggccgggccguguccgccg

SEQ ID NO: 1129287 - RNA, 21 nt, Mycobacterium bovis subsp bovis AF2122/97
ucggccgguauuucggcgacu

SEQ ID NO: 1129288 - RNA, 16 nt, Mycobacterium bovis subsp bovis AF2122/97
ucggccgucagggugu

SEQ ID NO: 1129289 - RNA, 20 nt, Mycobacterium bovis subsp bovis AF2122/97
ucggccgugaccgagccgcg

SEQ ID NO: 1129290 - RNA, 17 nt, Mycobacterium bovis subsp bovis AF2122/97
ucggccguuuccaccgu

SEQ ID NO: 1129291 - RNA, 23 nt, Mycobacterium bovis subsp bovis AF2122/97
ucggccucgagacggucgaucac

SEQ ID NO: 1129292 - RNA, 17 nt, Mycobacterium bovis subsp bovis AF2122/97
ucggccucugaccagcc

SEQ ID NO: 1129293 - RNA, 22 nt, Mycobacterium bovis subsp bovis AF2122/97
ucggccugaagcuuguccagau

SEQ ID NO: 1129294 - RNA, 13 nt, Mycobacterium bovis subsp bovis AF2122/97
ucggccugagcgg

SEQ ID NO: 1129295 - RNA, 14 nt, Mycobacterium bovis subsp bovis AF2122/97
ucggcgagcagcgc

SEQ ID NO: 1129296 - RNA, 20 nt, Mycobacterium bovis subsp bovis AF2122/97
ucggccuggcaggguggggc

SEQ ID NO: 1129297 - RNA, 15 nt, Mycobacterium bovis subsp bovis AF2122/97
ucggccugcgccggc

SEQ ID NO: 1129298 - RNA, 20 nt, Mycobacterium bovis subsp bovis AF2122/97
ucggccugcgccggcgcugc

SEQ ID NO: 1129299 - RNA, 18 nt, Mycobacterium bovis subsp bovis AF2122/97
ucggccugcagcgaugac

SEQ ID NO: 1129300 - RNA, 20 nt, Mycobacterium bovis subsp bovis AF2122/97
ucggcgaucacgcgaaugac

SEQ ID NO: 1129301 - RNA, 15 nt, Mycobacterium bovis subsp bovis AF2122/97
ucggcgcaucaccac

SEQ ID NO: 1129302 - RNA, 21 nt, Mycobacterium bovis subsp bovis AF2122/97
ucggcgcaucaccacccgacc

SEQ ID NO: 1129303 - RNA, 15 nt, Mycobacterium bovis subsp bovis AF2122/97
ucggcgcccagcucg

SEQ ID NO: 1129304 - RNA, 21 nt, Mycobacterium bovis subsp bovis AF2122/97
ucggcgcccagcucgucgagc

SEQ ID NO: 1129305 - RNA, 21 nt, Mycobacterium bovis subsp bovis AF2122/97
ucggcgaggaacuggaccggu

SEQ ID NO: 1129306 - RNA, 22 nt, Mycobacterium bovis subsp bovis AF2122/97
ucggcgagcucggccccgccgc

SEQ ID NO: 1129307 - RNA, 15 nt, Mycobacterium bovis subsp bovis AF2122/97
ucggcgagcgcaucg

SEQ ID NO: 1129308 - RNA, 22 nt, Mycobacterium bovis subsp bovis AF2122/97
ucggcgagugucuuagccagca

SEQ ID NO: 1129309 - RNA, 23 nt, Mycobacterium bovis subsp bovis AF2122/97
ucggcgagugucuuagccagcag

SEQ ID NO: 1129310 - RNA, 20 nt, Mycobacterium bovis subsp bovis AF2122/97
ucggcgaggucccggccgag

SEQ ID NO: 1129311 - RNA, 18 nt, Mycobacterium bovis subsp bovis AF2122/97
ucggcgaguagaccucga

SEQ ID NO: 1129312 - RNA, 17 nt, Mycobacterium bovis subsp bovis AF2122/97
ucggcgauaacuccgcg

SEQ ID NO: 1129313 - RNA, 20 nt, Mycobacterium bovis subsp bovis AF2122/97
ucggcgauaacuccgcggcg

SEQ ID NO: 1129314 - RNA, 17 nt, Mycobacterium bovis subsp bovis AF2122/97
ucggcgaucaacgcgca

SEQ ID NO: 1129315 - RNA, 20 nt, Mycobacterium bovis subsp bovis AF2122/97
ucggcgaucaauugcccggc

SEQ ID NO: 1129316 - RNA, 20 nt, Mycobacterium bovis subsp bovis AF2122/97
ucggcggccggcacgggcgg

SEQ ID NO: 1129317 - RNA, 16 nt, Mycobacterium bovis subsp bovis AF2122/97
ucggcggccggcgccg

SEQ ID NO: 1129318 - RNA, 14 nt, Mycobacterium bovis subsp bovis AF2122/97
ucggcggccgcgac

SEQ ID NO: 1129319 - RNA, 22 nt, Mycobacterium bovis subsp bovis AF2122/97
ucggcggccgcgaccagcgccg

SEQ ID NO: 1129320 - RNA, 23 nt, Mycobacterium bovis subsp bovis AF2122/97
ucggcggccgcgaccagcgccgc

SEQ ID NO: 1129321 - RNA, 13 nt, Mycobacterium bovis subsp bovis AF2122/97
ucggcggccgccg

SEQ ID NO: 1129322 - RNA, 20 nt, Mycobacterium bovis subsp bovis AF2122/97
ucggcggccgagcgcaccgc

SEQ ID NO: 1129323 - RNA, 13 nt, Mycobacterium bovis subsp bovis AF2122/97
ucggcggccucgc

SEQ ID NO: 1129324 - RNA, 20 nt, Mycobacterium bovis subsp bovis AF2122/97
ucggcggccguggccucgau

SEQ ID NO: 1129325 - RNA, 15 nt, Mycobacterium bovis subsp bovis AF2122/97
ucggcggccguggcu

SEQ ID NO: 1129326 - RNA, 19 nt, Mycobacterium bovis subsp bovis AF2122/97
ucggcggccgugucgggcg

SEQ ID NO: 1129327 - RNA, 14 nt, Mycobacterium bovis subsp bovis AF2122/97
ucggcggcgaccgc

SEQ ID NO: 1129328 - RNA, 15 nt, Mycobacterium bovis subsp bovis AF2122/97
ucggcggcgaccgcc

SEQ ID NO: 1129329 - RNA, 19 nt, Mycobacterium bovis subsp bovis AF2122/97
ucggcggcgaccgccagcg

SEQ ID NO: 1129330 - RNA, 22 nt, Mycobacterium bovis subsp bovis AF2122/97
ucggcggcgaccgccagcgugg

SEQ ID NO: 1129331 - RNA, 16 nt, Mycobacterium bovis subsp bovis AF2122/97
ucggcggcccggccga

SEQ ID NO: 1129332 - RNA, 17 nt, Mycobacterium bovis subsp bovis AF2122/97
ucggcggcaaccgccgc

SEQ ID NO: 1129333 - RNA, 21 nt, Mycobacterium bovis subsp bovis AF2122/97
ucggcggcaaccgccgccacc

SEQ ID NO: 1129334 - RNA, 14 nt, Mycobacterium bovis subsp bovis AF2122/97
ucggcggcaacggc

SEQ ID NO: 1129335 - RNA, 13 nt, Mycobacterium bovis subsp bovis AF2122/97
ucggcggagucga

SEQ ID NO: 1129336 - RNA, 19 nt, Mycobacterium bovis subsp bovis AF2122/97
ucggcggcauguucaucgc

SEQ ID NO: 1129337 - RNA, 13 nt, Mycobacterium bovis subsp bovis AF2122/97
ucggcgcccgcuc

SEQ ID NO: 1129338 - RNA, 12 nt, Mycobacterium bovis subsp bovis AF2122/97
ucggcgccgaac

SEQ ID NO: 1129339 - RNA, 17 nt, Mycobacterium bovis subsp bovis AF2122/97
ucggcgcccuccuuggc

SEQ ID NO: 1129340 - RNA, 22 nt, Mycobacterium bovis subsp bovis AF2122/97
ucggcgcccuccuuggcguugc

SEQ ID NO: 1129341 - RNA, 21 nt, Mycobacterium bovis subsp bovis AF2122/97
ucggcgccgagcagcccgcgg

SEQ ID NO: 1129342 - RNA, 19 nt, Mycobacterium bovis subsp bovis AF2122/97
ucggcgcugcgcaccgccg

SEQ ID NO: 1129343 - RNA, 15 nt, Mycobacterium bovis subsp bovis AF2122/97
ucggcgcugcgcacc

SEQ ID NO: 1129344 - RNA, 16 nt, Mycobacterium bovis subsp bovis AF2122/97
ucggcggacaggcccg

SEQ ID NO: 1129345 - RNA, 14 nt, Mycobacterium bovis subsp bovis AF2122/97
ucggcggacccggu

SEQ ID NO: 1129346 - RNA, 13 nt, Mycobacterium bovis subsp bovis AF2122/97
ucggcggaagacc

SEQ ID NO: 1129347 - RNA, 16 nt, Mycobacterium bovis subsp bovis AF2122/97
ucggcgagggcgcgcc

SEQ ID NO: 1129348 - RNA, 19 nt, Mycobacterium bovis subsp bovis AF2122/97
ucggcgugcggacugacgu

SEQ ID NO: 1129349 - RNA, 18 nt, Mycobacterium bovis subsp bovis AF2122/97
ucggcgugacgucgucga

SEQ ID NO: 1129350 - RNA, 17 nt, Mycobacterium bovis subsp bovis AF2122/97
ucggcguggucgcgcgg

SEQ ID NO: 1129351 - RNA, 19 nt, Mycobacterium bovis subsp bovis AF2122/97
ucggcgugguguccaccgc

SEQ ID NO: 1129352 - RNA, 23 nt, Mycobacterium bovis subsp bovis AF2122/97
ucggcuaggccggccggaguccg

SEQ ID NO: 1129353 - RNA, 21 nt, Mycobacterium bovis subsp bovis AF2122/97
ucggcuaccuaacccgcgccg

SEQ ID NO: 1129354 - RNA, 18 nt, Mycobacterium bovis subsp bovis AF2122/97
ucggcuaccuuguccggc

SEQ ID NO: 1129355 - RNA, 19 nt, Mycobacterium bovis subsp bovis AF2122/97
ucggcuacgccucggcgug

SEQ ID NO: 1129356 - RNA, 13 nt, Mycobacterium bovis subsp bovis AF2122/97
ucggcuagcaacg

SEQ ID NO: 1129357 - RNA, 16 nt, Mycobacterium bovis subsp bovis AF2122/97
ucggcuauggguucgc

SEQ ID NO: 1129358 - RNA, 14 nt, Mycobacterium bovis subsp bovis AF2122/97
ucggcucaucccga

SEQ ID NO: 1129359 - RNA, 18 nt, Mycobacterium bovis subsp bovis AF2122/97
ucggcgucccagggcaca

SEQ ID NO: 1129360 - RNA, 20 nt, Mycobacterium bovis subsp bovis AF2122/97
ucggcgucgagcucguccuc

SEQ ID NO: 1129361 - RNA, 15 nt, Mycobacterium bovis subsp bovis AF2122/97
ucggcgucgagcucg

SEQ ID NO: 1129362 - RNA, 22 nt, Mycobacterium bovis subsp bovis AF2122/97
ucggcgucgaagugggugaacc

SEQ ID NO: 1129363 - RNA, 20 nt, Mycobacterium bovis subsp bovis AF2122/97
ucggcgucguggcuuccggu

SEQ ID NO: 1129364 - RNA, 20 nt, Mycobacterium bovis subsp bovis AF2122/97
ucggcgucgugguggccacg

SEQ ID NO: 1129365 - RNA, 21 nt, Mycobacterium bovis subsp bovis AF2122/97
ucggcgucgugguggccacgg

SEQ ID NO: 1129366 - RNA, 17 nt, Mycobacterium bovis subsp bovis AF2122/97
ucggcgucgucgacggc

SEQ ID NO: 1129367 - RNA, 20 nt, Mycobacterium bovis subsp bovis AF2122/97
ucggcgucguauucgaugcc

SEQ ID NO: 1129368 - RNA, 19 nt, Mycobacterium bovis subsp bovis AF2122/97
ucggcgucacgguggacga

SEQ ID NO: 1129369 - RNA, 20 nt, Mycobacterium bovis subsp bovis AF2122/97
ucggcguccuugcgcagcac

SEQ ID NO: 1129370 - RNA, 19 nt, Mycobacterium bovis subsp bovis AF2122/97
ucggcguccuugcgcagca

SEQ ID NO: 1129371 - RNA, 17 nt, Mycobacterium bovis subsp bovis AF2122/97
ucggcggcuucguggcg

SEQ ID NO: 1129372 - RNA, 14 nt, Mycobacterium bovis subsp bovis AF2122/97
ucggcggcuuggcc

SEQ ID NO: 1129373 - RNA, 20 nt, Mycobacterium bovis subsp bovis AF2122/97
ucggcggcuuggccgccccg

SEQ ID NO: 1129374 - RNA, 22 nt, Mycobacterium bovis subsp bovis AF2122/97
ucggcggcuuggccgccccggc

SEQ ID NO: 1129375 - RNA, 19 nt, Mycobacterium bovis subsp bovis AF2122/97
ucggcgggaaacacguucu

SEQ ID NO: 1129376 - RNA, 14 nt, Mycobacterium bovis subsp bovis AF2122/97
ucggcggcugccag

SEQ ID NO: 1129377 - RNA, 16 nt, Mycobacterium bovis subsp bovis AF2122/97
ucggcggcugccagcg

SEQ ID NO: 1129378 - RNA, 22 nt, Mycobacterium bovis subsp bovis AF2122/97
ucggcggcuucgauugcgcugc

SEQ ID NO: 1129379 - RNA, 18 nt, Mycobacterium bovis subsp bovis AF2122/97
ucggcggcucuagaucgc

SEQ ID NO: 1129380 - RNA, 19 nt, Mycobacterium bovis subsp bovis AF2122/97
ucggcggcucuagaucgcc

SEQ ID NO: 1129381 - RNA, 14 nt, Mycobacterium bovis subsp bovis AF2122/97
ucggcggcgucuuc

SEQ ID NO: 1129382 - RNA, 14 nt, Mycobacterium bovis subsp bovis AF2122/97
ucggcggcgcgccg

SEQ ID NO: 1129383 - RNA, 20 nt, Mycobacterium bovis subsp bovis AF2122/97
ucggcggccagcucggccag

SEQ ID NO: 1129384 - RNA, 11 nt, Mycobacterium bovis subsp bovis AF2122/97
ucggcggcggc

SEQ ID NO: 1129385 - RNA, 17 nt, Mycobacterium bovis subsp bovis AF2122/97
ucggcggccucgcugcu

SEQ ID NO: 1129386 - RNA, 14 nt, Mycobacterium bovis subsp bovis AF2122/97
ucggcggcgaugac

SEQ ID NO: 1129387 - RNA, 15 nt, Mycobacterium bovis subsp bovis AF2122/97
ucggcggcgguggcg

SEQ ID NO: 1129388 - RNA, 23 nt, Mycobacterium bovis subsp bovis AF2122/97
ucggcggcgguggcgaacagcac

SEQ ID NO: 1129389 - RNA, 20 nt, Mycobacterium bovis subsp bovis AF2122/97
ucggcggguagaaccagccc

SEQ ID NO: 1129390 - RNA, 20 nt, Mycobacterium bovis subsp bovis AF2122/97
ucggcggguauauggugcgc

SEQ ID NO: 1129391 - RNA, 23 nt, Mycobacterium bovis subsp bovis AF2122/97
ucggcggcucuagaucgccgagc

SEQ ID NO: 1129392 - RNA, 21 nt, Mycobacterium bovis subsp bovis AF2122/97
ucggcgggggaccccgccagc

SEQ ID NO: 1129393 - RNA, 17 nt, Mycobacterium bovis subsp bovis AF2122/97
ucggcgggcgacaucga

SEQ ID NO: 1129394 - RNA, 16 nt, Mycobacterium bovis subsp bovis AF2122/97
ucggcggggcccacac

SEQ ID NO: 1129395 - RNA, 23 nt, Mycobacterium bovis subsp bovis AF2122/97
ucggcgggucaggccagggugac

SEQ ID NO: 1129396 - RNA, 23 nt, Mycobacterium bovis subsp bovis AF2122/97
ucggcgguaaaugccugcccacc

SEQ ID NO: 1129397 - RNA, 20 nt, Mycobacterium bovis subsp bovis AF2122/97
ucggcguagucgcugucggc

SEQ ID NO: 1129398 - RNA, 18 nt, Mycobacterium bovis subsp bovis AF2122/97
ucggcggugacggugccg

SEQ ID NO: 1129399 - RNA, 21 nt, Mycobacterium bovis subsp bovis AF2122/97
ucggcguacaaaccgucgggg

SEQ ID NO: 1129400 - RNA, 15 nt, Mycobacterium bovis subsp bovis AF2122/97
ucggcgguucgaucc

SEQ ID NO: 1129401 - RNA, 14 nt, Mycobacterium bovis subsp bovis AF2122/97
ucggcggugccgcg

SEQ ID NO: 1129402 - RNA, 20 nt, Mycobacterium bovis subsp bovis AF2122/97
ucggcggugcccagcagcgc

SEQ ID NO: 1129403 - RNA, 16 nt, Mycobacterium bovis subsp bovis AF2122/97
ucggcggugcagaucg

SEQ ID NO: 1129404 - RNA, 21 nt, Mycobacterium bovis subsp bovis AF2122/97
ucggcggugaacuucuccacc

SEQ ID NO: 1129405 - RNA, 16 nt, Mycobacterium bovis subsp bovis AF2122/97
ucggcggugagcaacu

SEQ ID NO: 1129406 - RNA, 24 nt, Mycobacterium bovis subsp bovis AF2122/97
ucggcggugaacuucuccaccagc

SEQ ID NO: 1129407 - RNA, 15 nt, Mycobacterium bovis subsp bovis AF2122/97
ucgcgggccaagccg

SEQ ID NO: 1129408 - RNA, 19 nt, Mycobacterium bovis subsp bovis AF2122/97
ucgcgggagaaaacggcgg

SEQ ID NO: 1129409 - RNA, 20 nt, Mycobacterium bovis subsp bovis AF2122/97
ucgcgggagaacgugccgag

SEQ ID NO: 1129410 - RNA, 21 nt, Mycobacterium bovis subsp bovis AF2122/97
ucgcgggacgcgacucggcgg

SEQ ID NO: 1129411 - RNA, 19 nt, Mycobacterium bovis subsp bovis AF2122/97
ucgcgggcgucccgcauac

SEQ ID NO: 1129412 - RNA, 15 nt, Mycobacterium bovis subsp bovis AF2122/97
ucgcgggcgauggcc

SEQ ID NO: 1129413 - RNA, 21 nt, Mycobacterium bovis subsp bovis AF2122/97
ucgcgggcgaccaccgcggca

SEQ ID NO: 1129414 - RNA, 16 nt, Mycobacterium bovis subsp bovis AF2122/97
ucgcgggcgaucggca

SEQ ID NO: 1129415 - RNA, 15 nt, Mycobacterium bovis subsp bovis AF2122/97
ucgcuguaggccagc

SEQ ID NO: 1129416 - RNA, 17 nt, Mycobacterium bovis subsp bovis AF2122/97
ucgcuguaggccagccc

SEQ ID NO: 1129417 - RNA, 15 nt, Mycobacterium bovis subsp bovis AF2122/97
ucgcugggacgggcg

SEQ ID NO: 1129418 - RNA, 15 nt, Mycobacterium bovis subsp bovis AF2122/97
ucgcugggugcgcga

SEQ ID NO: 1129419 - RNA, 16 nt, Mycobacterium bovis subsp bovis AF2122/97
ucgcugggugcgcgaa

SEQ ID NO: 1129420 - RNA, 21 nt, Mycobacterium bovis subsp bovis AF2122/97
ucgcugguauagcucacggug

SEQ ID NO: 1129421 - RNA, 12 nt, Mycobacterium bovis subsp bovis AF2122/97
ucgcuggccgcg

SEQ ID NO: 1129422 - RNA, 16 nt, Mycobacterium bovis subsp bovis AF2122/97
ucgcugggcgcaacgc

SEQ ID NO: 1129423 - RNA, 18 nt, Mycobacterium bovis subsp bovis AF2122/97
ucgcugcaaccgccggug

SEQ ID NO: 1129424 - RNA, 22 nt, Mycobacterium bovis subsp bovis AF2122/97
ucgcugagcacggcgcggcgga

SEQ ID NO: 1129425 - RNA, 17 nt, Mycobacterium bovis subsp bovis AF2122/97
ucgcugagcagcgccgc

SEQ ID NO: 1129426 - RNA, 17 nt, Mycobacterium bovis subsp bovis AF2122/97
ucgcugaccuggggcuu

SEQ ID NO: 1129427 - RNA, 20 nt, Mycobacterium bovis subsp bovis AF2122/97
ucgcugaccuuguugaccac

SEQ ID NO: 1129428 - RNA, 23 nt, Mycobacterium bovis subsp bovis AF2122/97
ucgcugaccuuguugaccaccac

SEQ ID NO: 1129429 - RNA, 23 nt, Mycobacterium bovis subsp bovis AF2122/97
ucgcugccgccaccgcugucgau

SEQ ID NO: 1129430 - RNA, 21 nt, Mycobacterium bovis subsp bovis AF2122/97
ucgcugcccaucacacccggu

SEQ ID NO: 1129431 - RNA, 22 nt, Mycobacterium bovis subsp bovis AF2122/97
ucgcugccagcggccgggcggc

SEQ ID NO: 1129432 - RNA, 18 nt, Mycobacterium bovis subsp bovis AF2122/97
ucggagccgacaacgacg

SEQ ID NO: 1129433 - RNA, 22 nt, Mycobacterium bovis subsp bovis AF2122/97
ucggagccgacaacgacgucgc

SEQ ID NO: 1129434 - RNA, 20 nt, Mycobacterium bovis subsp bovis AF2122/97
ucggagauacucgaguggcg

SEQ ID NO: 1129435 - RNA, 14 nt, Mycobacterium bovis subsp bovis AF2122/97
ucggacagcagccg

SEQ ID NO: 1129436 - RNA, 16 nt, Mycobacterium bovis subsp bovis AF2122/97
ucggacagcagccggc

SEQ ID NO: 1129437 - RNA, 21 nt, Mycobacterium bovis subsp bovis AF2122/97
ucggacagcgccuggccggaa

SEQ ID NO: 1129438 - RNA, 17 nt, Mycobacterium bovis subsp bovis AF2122/97
ucggacacacaggcggc

SEQ ID NO: 1129439 - RNA, 21 nt, Mycobacterium bovis subsp bovis AF2122/97
ucggaggugccggugcuccuc

SEQ ID NO: 1129440 - RNA, 18 nt, Mycobacterium bovis subsp bovis AF2122/97
ucggagucaccagcaaca

SEQ ID NO: 1129441 - RNA, 19 nt, Mycobacterium bovis subsp bovis AF2122/97
ucggagucaccagcaacag

SEQ ID NO: 1129442 - RNA, 17 nt, Mycobacterium bovis subsp bovis AF2122/97
ucggagucacgcagccg

SEQ ID NO: 1129443 - RNA, 21 nt, Mycobacterium bovis subsp bovis AF2122/97
ucggaggcgaccacgucggcg

SEQ ID NO: 1129444 - RNA, 13 nt, Mycobacterium bovis subsp bovis AF2122/97
ucggagccggcca

SEQ ID NO: 1129445 - RNA, 16 nt, Mycobacterium bovis subsp bovis AF2122/97
ucggagcgggugcggg

SEQ ID NO: 1129446 - RNA, 23 nt, Mycobacterium bovis subsp bovis AF2122/97
ucggagcugggcugauggacggu

SEQ ID NO: 1129447 - RNA, 12 nt, Mycobacterium bovis subsp bovis AF2122/97
ucggaggcgauc

SEQ ID NO: 1129448 - RNA, 22 nt, Mycobacterium bovis subsp bovis AF2122/97
ucggagucgacggucacggugg

SEQ ID NO: 1129449 - RNA, 22 nt, Mycobacterium bovis subsp bovis AF2122/97
ucggauacccagccggccuguc

SEQ ID NO: 1129450 - RNA, 14 nt, Mycobacterium bovis subsp bovis AF2122/97
ucggauccgcccgc

SEQ ID NO: 1129451 - RNA, 20 nt, Mycobacterium bovis subsp bovis AF2122/97
ucgcugggacgggcgcgucg

SEQ ID NO: 1129452 - RNA, 16 nt, Mycobacterium bovis subsp bovis AF2122/97
ucgcuguccacugcca

SEQ ID NO: 1129453 - RNA, 18 nt, Mycobacterium bovis subsp bovis AF2122/97
ucgcuguccacugccacc

SEQ ID NO: 1129454 - RNA, 15 nt, Mycobacterium bovis subsp bovis AF2122/97
ucgcugucggcaugc

SEQ ID NO: 1129455 - RNA, 21 nt, Mycobacterium bovis subsp bovis AF2122/97
ucggaaacggagccgagccga

SEQ ID NO: 1129456 - RNA, 13 nt, Mycobacterium bovis subsp bovis AF2122/97
ucggaaugggcgc

SEQ ID NO: 1129457 - RNA, 18 nt, Mycobacterium bovis subsp bovis AF2122/97
ucggacaaagccgucgcg

SEQ ID NO: 1129458 - RNA, 16 nt, Mycobacterium bovis subsp bovis AF2122/97
ucggaagagucgacgc

SEQ ID NO: 1129459 - RNA, 22 nt, Mycobacterium bovis subsp bovis AF2122/97
ucggcccgaucaccauccagcc

SEQ ID NO: 1129460 - RNA, 14 nt, Mycobacterium bovis subsp bovis AF2122/97
ucggccccggccgc

SEQ ID NO: 1129461 - RNA, 16 nt, Mycobacterium bovis subsp bovis AF2122/97
ucggcccgcggucgcg

SEQ ID NO: 1129462 - RNA, 15 nt, Mycobacterium bovis subsp bovis AF2122/97
ucggccggagccgcc

SEQ ID NO: 1129463 - RNA, 14 nt, Mycobacterium bovis subsp bovis AF2122/97
ucggccggcggcgc

SEQ ID NO: 1129464 - RNA, 17 nt, Mycobacterium bovis subsp bovis AF2122/97
ucggcccacgguguccc

SEQ ID NO: 1129465 - RNA, 12 nt, Mycobacterium bovis subsp bovis AF2122/97
ucggccauggcg

SEQ ID NO: 1129466 - RNA, 18 nt, Mycobacterium bovis subsp bovis AF2122/97
ucggccagcaucagcucg

SEQ ID NO: 1129467 - RNA, 18 nt, Mycobacterium bovis subsp bovis AF2122/97
ucggccagccagcgggcg

SEQ ID NO: 1129468 - RNA, 17 nt, Mycobacterium bovis subsp bovis AF2122/97
ucggccagcgcccgcag

SEQ ID NO: 1129469 - RNA, 17 nt, Mycobacterium bovis subsp bovis AF2122/97
ucggcaggaaugccgcg

SEQ ID NO: 1129470 - RNA, 20 nt, Mycobacterium bovis subsp bovis AF2122/97
ucggcagcuucucgccgacg

SEQ ID NO: 1129471 - RNA, 19 nt, Mycobacterium bovis subsp bovis AF2122/97
ucggcagcguggacaucgg

SEQ ID NO: 1129472 - RNA, 22 nt, Mycobacterium bovis subsp bovis AF2122/97
ucggcagcucccgccacgucgc

SEQ ID NO: 1129473 - RNA, 15 nt, Mycobacterium bovis subsp bovis AF2122/97
ucggcagucccagcg

SEQ ID NO: 1129474 - RNA, 19 nt, Mycobacterium bovis subsp bovis AF2122/97
ucggcagucccagcgccgc

SEQ ID NO: 1129475 - RNA, 20 nt, Mycobacterium bovis subsp bovis AF2122/97
ucggcaggguggccagcagg

SEQ ID NO: 1129476 - RNA, 20 nt, Mycobacterium bovis subsp bovis AF2122/97
ucggcagggcccccaguucg

SEQ ID NO: 1129477 - RNA, 22 nt, Mycobacterium bovis subsp bovis AF2122/97
ucggcauacccaucaacaucgg

SEQ ID NO: 1129478 - RNA, 22 nt, Mycobacterium bovis subsp bovis AF2122/97
ucggcaucgacugccagcgccg

SEQ ID NO: 1129479 - RNA, 15 nt, Mycobacterium bovis subsp bovis AF2122/97
ucggcaucgagcagc

SEQ ID NO: 1129480 - RNA, 14 nt, Mycobacterium bovis subsp bovis AF2122/97
ucggcaucggcgac

SEQ ID NO: 1129481 - RNA, 23 nt, Mycobacterium bovis subsp bovis AF2122/97
ucggccagcagcgacuccagcgc

SEQ ID NO: 1129482 - RNA, 24 nt, Mycobacterium bovis subsp bovis AF2122/97
ucggcagcagcgcaacggccagcg

SEQ ID NO: 1129483 - RNA, 21 nt, Mycobacterium bovis subsp bovis AF2122/97
ucggcagcagcggugcagccc

SEQ ID NO: 1129484 - RNA, 15 nt, Mycobacterium bovis subsp bovis AF2122/97
ucggcagccagggcg

SEQ ID NO: 1129485 - RNA, 15 nt, Mycobacterium bovis subsp bovis AF2122/97
ucggcagcgacgccg

SEQ ID NO: 1129486 - RNA, 20 nt, Mycobacterium bovis subsp bovis AF2122/97
ucggcagcgacgccggcccg

SEQ ID NO: 1129487 - RNA, 18 nt, Mycobacterium bovis subsp bovis AF2122/97
ucggcagcccggugugcu

SEQ ID NO: 1129488 - RNA, 13 nt, Mycobacterium bovis subsp bovis AF2122/97
ucggcagccgcau

SEQ ID NO: 1129489 - RNA, 13 nt, Mycobacterium bovis subsp bovis AF2122/97
ucggcagccggcu

SEQ ID NO: 1129490 - RNA, 13 nt, Mycobacterium bovis subsp bovis AF2122/97
ucggcagcgcggc

SEQ ID NO: 1129491 - RNA, 14 nt, Mycobacterium bovis subsp bovis AF2122/97
ucggcagcggcgcg

SEQ ID NO: 1129492 - RNA, 12 nt, Mycobacterium bovis subsp bovis AF2122/97
ucggaucgaagu

SEQ ID NO: 1129493 - RNA, 15 nt, Mycobacterium bovis subsp bovis AF2122/97
ucggaucggcgccgc

SEQ ID NO: 1129494 - RNA, 17 nt, Mycobacterium bovis subsp bovis AF2122/97
ucggaucuugacguucg

SEQ ID NO: 1129495 - RNA, 17 nt, Mycobacterium bovis subsp bovis AF2122/97
agcgcaucggccagcag

SEQ ID NO: 1129496 - RNA, 21 nt, Mycobacterium bovis subsp bovis AF2122/97
agcgcaucgccgcuggccagc

SEQ ID NO: 1129497 - RNA, 24 nt, Mycobacterium bovis subsp bovis AF2122/97
agcgcaucgccgcuggccagcaca

SEQ ID NO: 1129498 - RNA, 12 nt, Mycobacterium bovis subsp bovis AF2122/97
agcgcaucgcca

SEQ ID NO: 1129499 - RNA, 20 nt, Mycobacterium bovis subsp bovis AF2122/97
agcgcauccaauaucgcuuu

SEQ ID NO: 1129500 - RNA, 18 nt, Mycobacterium bovis subsp bovis AF2122/97
agcgcauccacaaucaca

SEQ ID NO: 1129501 - RNA, 13 nt, Mycobacterium bovis subsp bovis AF2122/97
agcgcagccgauc

SEQ ID NO: 1129502 - RNA, 14 nt, Mycobacterium bovis subsp bovis AF2122/97
agcgcagccgaucg

SEQ ID NO: 1129503 - RNA, 15 nt, Mycobacterium bovis subsp bovis AF2122/97
agcgcaguaacgucg

SEQ ID NO: 1129504 - RNA, 19 nt, Mycobacterium bovis subsp bovis AF2122/97
agcgcaguaacgucgucgc

SEQ ID NO: 1129505 - RNA, 17 nt, Mycobacterium bovis subsp bovis AF2122/97
agcgccacauacaccgg

SEQ ID NO: 1129506 - RNA, 23 nt, Mycobacterium bovis subsp bovis AF2122/97
agcgccacauacaccggccgguc

SEQ ID NO: 1129507 - RNA, 22 nt, Mycobacterium bovis subsp bovis AF2122/97
agcgccaccacaugcgagucgc

SEQ ID NO: 1129508 - RNA, 18 nt, Mycobacterium bovis subsp bovis AF2122/97
agcgccacccgguccggc

SEQ ID NO: 1129509 - RNA, 14 nt, Mycobacterium bovis subsp bovis AF2122/97
agcgccaaacccgg

SEQ ID NO: 1129510 - RNA, 19 nt, Mycobacterium bovis subsp bovis AF2122/97
agcgccaaacccggcgggc

SEQ ID NO: 1129511 - RNA, 15 nt, Mycobacterium bovis subsp bovis AF2122/97
agcgccaacucgaga

SEQ ID NO: 1129512 - RNA, 15 nt, Mycobacterium bovis subsp bovis AF2122/97
agcgccaagacgucg

SEQ ID NO: 1129513 - RNA, 17 nt, Mycobacterium bovis subsp bovis AF2122/97
agcgccaagacgucggc

SEQ ID NO: 1129514 - RNA, 18 nt, Mycobacterium bovis subsp bovis AF2122/97
agcgccaagacgucggcg

SEQ ID NO: 1129515 - RNA, 17 nt, Mycobacterium bovis subsp bovis AF2122/97
agcgccgcggcccgcuc

SEQ ID NO: 1129516 - RNA, 20 nt, Mycobacterium bovis subsp bovis AF2122/97
agcgccgcgcuugcgaucgg

SEQ ID NO: 1129517 - RNA, 12 nt, Mycobacterium bovis subsp bovis AF2122/97
agcgccgcggcc

SEQ ID NO: 1129518 - RNA, 19 nt, Mycobacterium bovis subsp bovis AF2122/97
agcgccgcuaugaggcagu

SEQ ID NO: 1129519 - RNA, 22 nt, Mycobacterium bovis subsp bovis AF2122/97
agcgccgcugacuccugcggca

SEQ ID NO: 1129520 - RNA, 15 nt, Mycobacterium bovis subsp bovis AF2122/97
agcgccgcuuggcga

SEQ ID NO: 1129521 - RNA, 16 nt, Mycobacterium bovis subsp bovis AF2122/97
agcgccggcaccgaca

SEQ ID NO: 1129522 - RNA, 17 nt, Mycobacterium bovis subsp bovis AF2122/97
agcgccagcagccaccc

SEQ ID NO: 1129523 - RNA, 13 nt, Mycobacterium bovis subsp bovis AF2122/97
agcgccagcagcc

SEQ ID NO: 1129524 - RNA, 20 nt, Mycobacterium bovis subsp bovis AF2122/97
agcgccagccgcugccacag

SEQ ID NO: 1129525 - RNA, 12 nt, Mycobacterium bovis subsp bovis AF2122/97
agcgcccacugg

SEQ ID NO: 1129526 - RNA, 17 nt, Mycobacterium bovis subsp bovis AF2122/97
agcgccauuccaagacg

SEQ ID NO: 1129527 - RNA, 21 nt, Mycobacterium bovis subsp bovis AF2122/97
agcgccaugcccucggcgccg

SEQ ID NO: 1129528 - RNA, 16 nt, Mycobacterium bovis subsp bovis AF2122/97
agcgaccaccgucacg

SEQ ID NO: 1129529 - RNA, 20 nt, Mycobacterium bovis subsp bovis AF2122/97
agcgacccccagcgcccgcc

SEQ ID NO: 1129530 - RNA, 19 nt, Mycobacterium bovis subsp bovis AF2122/97
agcgaccaaugcagugcga

SEQ ID NO: 1129531 - RNA, 18 nt, Mycobacterium bovis subsp bovis AF2122/97
agcgacccccagcgcccg

SEQ ID NO: 1129532 - RNA, 17 nt, Mycobacterium bovis subsp bovis AF2122/97
agcgaccgucgucaccg

SEQ ID NO: 1129533 - RNA, 16 nt, Mycobacterium bovis subsp bovis AF2122/97
agcgaccuagcagcgc

SEQ ID NO: 1129534 - RNA, 19 nt, Mycobacterium bovis subsp bovis AF2122/97
agcgaccucacugcggcgc

SEQ ID NO: 1129535 - RNA, 21 nt, Mycobacterium bovis subsp bovis AF2122/97
agcgaccucacugcggcgcca

SEQ ID NO: 1129536 - RNA, 17 nt, Mycobacterium bovis subsp bovis AF2122/97
agcgaccgcggccccgc

SEQ ID NO: 1129537 - RNA, 16 nt, Mycobacterium bovis subsp bovis AF2122/97
agcgaccaggucgcca

SEQ ID NO: 1129538 - RNA, 17 nt, Mycobacterium bovis subsp bovis AF2122/97
agcgaaggcgccgaaca

SEQ ID NO: 1129539 - RNA, 14 nt, Mycobacterium bovis subsp bovis AF2122/97
agcgaacggccagg

SEQ ID NO: 1129540 - RNA, 15 nt, Mycobacterium bovis subsp bovis AF2122/97
agcgaacggcgcagu

SEQ ID NO: 1129541 - RNA, 18 nt, Mycobacterium bovis subsp bovis AF2122/97
agcgaaccgaagccgucg

SEQ ID NO: 1129542 - RNA, 18 nt, Mycobacterium bovis subsp bovis AF2122/97
agcgacugcagcggcgca

SEQ ID NO: 1129543 - RNA, 21 nt, Mycobacterium bovis subsp bovis AF2122/97
agcgacgcgauuucgucgucg

SEQ ID NO: 1129544 - RNA, 16 nt, Mycobacterium bovis subsp bovis AF2122/97
agcgacgccaucugcu

SEQ ID NO: 1129545 - RNA, 22 nt, Mycobacterium bovis subsp bovis AF2122/97
agcgaccgucccagcgccgcag

SEQ ID NO: 1129546 - RNA, 15 nt, Mycobacterium bovis subsp bovis AF2122/97
agcgacgaccacacc

SEQ ID NO: 1129547 - RNA, 15 nt, Mycobacterium bovis subsp bovis AF2122/97
agcgacgagcagcaa

SEQ ID NO: 1129548 - RNA, 18 nt, Mycobacterium bovis subsp bovis AF2122/97
agcgacgcaaagcagcgc

SEQ ID NO: 1129549 - RNA, 17 nt, Mycobacterium bovis subsp bovis AF2122/97
agcgacgcauaaccggc

SEQ ID NO: 1129550 - RNA, 22 nt, Mycobacterium bovis subsp bovis AF2122/97
agcgagcccagcugcgccgaac

SEQ ID NO: 1129551 - RNA, 13 nt, Mycobacterium bovis subsp bovis AF2122/97
agcgaguugcagu

SEQ ID NO: 1129552 - RNA, 19 nt, Mycobacterium bovis subsp bovis AF2122/97
agcgagacuucgacgcggc

SEQ ID NO: 1129553 - RNA, 21 nt, Mycobacterium bovis subsp bovis AF2122/97
agcgagacuucgacgcggcga

SEQ ID NO: 1129554 - RNA, 16 nt, Mycobacterium bovis subsp bovis AF2122/97
agcgcaacggccagcg

SEQ ID NO: 1129555 - RNA, 14 nt, Mycobacterium bovis subsp bovis AF2122/97
agcgcaacggccag

SEQ ID NO: 1129556 - RNA, 15 nt, Mycobacterium bovis subsp bovis AF2122/97
agcgcaacggccagc

SEQ ID NO: 1129557 - RNA, 16 nt, Mycobacterium bovis subsp bovis AF2122/97
agcgcacgcagccgau

SEQ ID NO: 1129558 - RNA, 13 nt, Mycobacterium bovis subsp bovis AF2122/97
agcgcaacaucga

SEQ ID NO: 1129559 - RNA, 21 nt, Mycobacterium bovis subsp bovis AF2122/97
agcgauuuggcgucgccgagg

SEQ ID NO: 1129560 - RNA, 16 nt, Mycobacterium bovis subsp bovis AF2122/97
agcgcaaaaucaccgg

SEQ ID NO: 1129561 - RNA, 13 nt, Mycobacterium bovis subsp bovis AF2122/97
agcgcaaccgcgc

SEQ ID NO: 1129562 - RNA, 12 nt, Mycobacterium bovis subsp bovis AF2122/97
agcgcagcagcg

SEQ ID NO: 1129563 - RNA, 17 nt, Mycobacterium bovis subsp bovis AF2122/97
agcgcacugccgggugg

SEQ ID NO: 1129564 - RNA, 18 nt, Mycobacterium bovis subsp bovis AF2122/97
agcgcacgauagccaccg

SEQ ID NO: 1129565 - RNA, 23 nt, Mycobacterium bovis subsp bovis AF2122/97
agcgcacgauagccaccgacgac

SEQ ID NO: 1129566 - RNA, 17 nt, Mycobacterium bovis subsp bovis AF2122/97
agcgcacgcagccgaua

SEQ ID NO: 1129567 - RNA, 22 nt, Mycobacterium bovis subsp bovis AF2122/97
agcgauucgccuagcgagcgca

SEQ ID NO: 1129568 - RNA, 24 nt, Mycobacterium bovis subsp bovis AF2122/97
agcgauucugggcuucaucggcga

SEQ ID NO: 1129569 - RNA, 13 nt, Mycobacterium bovis subsp bovis AF2122/97
agcgaugcggcgu

SEQ ID NO: 1129570 - RNA, 19 nt, Mycobacterium bovis subsp bovis AF2122/97
agcgaugaugucggccgcg

SEQ ID NO: 1129571 - RNA, 16 nt, Mycobacterium bovis subsp bovis AF2122/97
agcgaugcaccccaug

SEQ ID NO: 1129572 - RNA, 20 nt, Mycobacterium bovis subsp bovis AF2122/97
agcgaucuccgugagccgga

SEQ ID NO: 1129573 - RNA, 15 nt, Mycobacterium bovis subsp bovis AF2122/97
agcgaucccggcaac

SEQ ID NO: 1129574 - RNA, 14 nt, Mycobacterium bovis subsp bovis AF2122/97
agcgauccgauccg

SEQ ID NO: 1129575 - RNA, 17 nt, Mycobacterium bovis subsp bovis AF2122/97
agcgauccgauccgcuc

SEQ ID NO: 1129576 - RNA, 19 nt, Mycobacterium bovis subsp bovis AF2122/97
agcgaucgugcugcccgca

SEQ ID NO: 1129577 - RNA, 16 nt, Mycobacterium bovis subsp bovis AF2122/97
agcgaucgccggccgc

SEQ ID NO: 1129578 - RNA, 20 nt, Mycobacterium bovis subsp bovis AF2122/97
agcgaucgugcugcccgcaa

SEQ ID NO: 1129579 - RNA, 22 nt, Mycobacterium bovis subsp bovis AF2122/97
agccggccaauggccugcagcg

SEQ ID NO: 1129580 - RNA, 19 nt, Mycobacterium bovis subsp bovis AF2122/97
agccggccaccucggugcg

SEQ ID NO: 1129581 - RNA, 19 nt, Mycobacterium bovis subsp bovis AF2122/97
agccggccauacgcgcgcg

SEQ ID NO: 1129582 - RNA, 17 nt, Mycobacterium bovis subsp bovis AF2122/97
agccggccugucccgca

SEQ ID NO: 1129583 - RNA, 20 nt, Mycobacterium bovis subsp bovis AF2122/97
agccggccugucccgcaccc

SEQ ID NO: 1129584 - RNA, 15 nt, Mycobacterium bovis subsp bovis AF2122/97
agccggcccgucgcg

SEQ ID NO: 1129585 - RNA, 24 nt, Mycobacterium bovis subsp bovis AF2122/97
agccggcccugcucgccgucucgg

SEQ ID NO: 1129586 - RNA, 22 nt, Mycobacterium bovis subsp bovis AF2122/97
agccggauaaucauccgagcgg

SEQ ID NO: 1129587 - RNA, 17 nt, Mycobacterium bovis subsp bovis AF2122/97
agccggccgcuuggccg

SEQ ID NO: 1129588 - RNA, 12 nt, Mycobacterium bovis subsp bovis AF2122/97
agccggccgcga

SEQ ID NO: 1129589 - RNA, 14 nt, Mycobacterium bovis subsp bovis AF2122/97
agccggccgcgacc

SEQ ID NO: 1129590 - RNA, 17 nt, Mycobacterium bovis subsp bovis AF2122/97
agccggccgcgaccgcg

SEQ ID NO: 1129591 - RNA, 12 nt, Mycobacterium bovis subsp bovis AF2122/97
agccggcgcagc

SEQ ID NO: 1129592 - RNA, 16 nt, Mycobacterium bovis subsp bovis AF2122/97
agccggcgacaccgca

SEQ ID NO: 1129593 - RNA, 13 nt, Mycobacterium bovis subsp bovis AF2122/97
agccggcgcgccc

SEQ ID NO: 1129594 - RNA, 22 nt, Mycobacterium bovis subsp bovis AF2122/97
agccggcgcgccccaccgcgcc

SEQ ID NO: 1129595 - RNA, 15 nt, Mycobacterium bovis subsp bovis AF2122/97
agccggcgguggggc

SEQ ID NO: 1129596 - RNA, 18 nt, Mycobacterium bovis subsp bovis AF2122/97
agccggcgcccgccgcga

SEQ ID NO: 1129597 - RNA, 19 nt, Mycobacterium bovis subsp bovis AF2122/97
agccggcggagaaggcgac

SEQ ID NO: 1129598 - RNA, 15 nt, Mycobacterium bovis subsp bovis AF2122/97
agccgggauugccgc

SEQ ID NO: 1129599 - RNA, 22 nt, Mycobacterium bovis subsp bovis AF2122/97
agccggcugcauccuccucguc

SEQ ID NO: 1129600 - RNA, 13 nt, Mycobacterium bovis subsp bovis AF2122/97
agccgggcaaggc

SEQ ID NO: 1129601 - RNA, 21 nt, Mycobacterium bovis subsp bovis AF2122/97
agccggcuugggcgguagccg

SEQ ID NO: 1129602 - RNA, 20 nt, Mycobacterium bovis subsp bovis AF2122/97
agccgggaacgcugacgccc

SEQ ID NO: 1129603 - RNA, 20 nt, Mycobacterium bovis subsp bovis AF2122/97
agccgggaccauagucgccg

SEQ ID NO: 1129604 - RNA, 21 nt, Mycobacterium bovis subsp bovis AF2122/97
agccgggaccauagucgccgu

SEQ ID NO: 1129605 - RNA, 15 nt, Mycobacterium bovis subsp bovis AF2122/97
agccgcggcuaggcc

SEQ ID NO: 1129606 - RNA, 22 nt, Mycobacterium bovis subsp bovis AF2122/97
agccgcggcuaggccagcacgg

SEQ ID NO: 1129607 - RNA, 24 nt, Mycobacterium bovis subsp bovis AF2122/97
agccgcggcuaggccagcacggcg

SEQ ID NO: 1129608 - RNA, 17 nt, Mycobacterium bovis subsp bovis AF2122/97
agccgcgguagacggca

SEQ ID NO: 1129609 - RNA, 13 nt, Mycobacterium bovis subsp bovis AF2122/97
agccgcggucggc

SEQ ID NO: 1129610 - RNA, 21 nt, Mycobacterium bovis subsp bovis AF2122/97
agccgcugauguacccggcga

SEQ ID NO: 1129611 - RNA, 15 nt, Mycobacterium bovis subsp bovis AF2122/97
agccgcugccuggcc

SEQ ID NO: 1129612 - RNA, 15 nt, Mycobacterium bovis subsp bovis AF2122/97
agccgcugcggcacc

SEQ ID NO: 1129613 - RNA, 17 nt, Mycobacterium bovis subsp bovis AF2122/97
agccgcugcgccagguc

SEQ ID NO: 1129614 - RNA, 17 nt, Mycobacterium bovis subsp bovis AF2122/97
agccgcugcggcaccga

SEQ ID NO: 1129615 - RNA, 21 nt, Mycobacterium bovis subsp bovis AF2122/97
agccgcuggaagucggucugc

SEQ ID NO: 1129616 - RNA, 19 nt, Mycobacterium bovis subsp bovis AF2122/97
agccggaccgcgacggcgc

SEQ ID NO: 1129617 - RNA, 22 nt, Mycobacterium bovis subsp bovis AF2122/97
agccggaccgcgacggcgccgg

SEQ ID NO: 1129618 - RNA, 18 nt, Mycobacterium bovis subsp bovis AF2122/97
agccggcauagcggccca

SEQ ID NO: 1129619 - RNA, 15 nt, Mycobacterium bovis subsp bovis AF2122/97
agccggcagcagcgg

SEQ ID NO: 1129620 - RNA, 22 nt, Mycobacterium bovis subsp bovis AF2122/97
agccggauucggcugccaccgc

SEQ ID NO: 1129621 - RNA, 12 nt, Mycobacterium bovis subsp bovis AF2122/97
agccgggcccca

SEQ ID NO: 1129622 - RNA, 13 nt, Mycobacterium bovis subsp bovis AF2122/97
agccgggccaacc

SEQ ID NO: 1129623 - RNA, 17 nt, Mycobacterium bovis subsp bovis AF2122/97
agccgggauugccgcca

SEQ ID NO: 1129624 - RNA, 14 nt, Mycobacterium bovis subsp bovis AF2122/97
agccgggcgcgccg

SEQ ID NO: 1129625 - RNA, 18 nt, Mycobacterium bovis subsp bovis AF2122/97
agccgggcgcgccggcca

SEQ ID NO: 1129626 - RNA, 17 nt, Mycobacterium bovis subsp bovis AF2122/97
agccgucgcgacgucgg

SEQ ID NO: 1129627 - RNA, 12 nt, Mycobacterium bovis subsp bovis AF2122/97
agccgucgaugu

SEQ ID NO: 1129628 - RNA, 14 nt, Mycobacterium bovis subsp bovis AF2122/97
agccgucgauguug

SEQ ID NO: 1129629 - RNA, 16 nt, Mycobacterium bovis subsp bovis AF2122/97
agccucagugcgcacg

SEQ ID NO: 1129630 - RNA, 14 nt, Mycobacterium bovis subsp bovis AF2122/97
agccucgaccgguc

SEQ ID NO: 1129631 - RNA, 16 nt, Mycobacterium bovis subsp bovis AF2122/97
agccgugcccaagcuc

SEQ ID NO: 1129632 - RNA, 20 nt, Mycobacterium bovis subsp bovis AF2122/97
agccgugcagcucggucagc

SEQ ID NO: 1129633 - RNA, 16 nt, Mycobacterium bovis subsp bovis AF2122/97
agccgugauauccgua

SEQ ID NO: 1129634 - RNA, 19 nt, Mycobacterium bovis subsp bovis AF2122/97
agccgugcaccagcgacca

SEQ ID NO: 1129635 - RNA, 21 nt, Mycobacterium bovis subsp bovis AF2122/97
agccgucguccgcugacccgc

SEQ ID NO: 1129636 - RNA, 19 nt, Mycobacterium bovis subsp bovis AF2122/97
agccgucggcgcugcgcgc

SEQ ID NO: 1129637 - RNA, 17 nt, Mycobacterium bovis subsp bovis AF2122/97
agcgaaacgagccggug

SEQ ID NO: 1129638 - RNA, 18 nt, Mycobacterium bovis subsp bovis AF2122/97
agcgaaaacccggucggc

SEQ ID NO: 1129639 - RNA, 13 nt, Mycobacterium bovis subsp bovis AF2122/97
agcgaaacaccgg

SEQ ID NO: 1129640 - RNA, 21 nt, Mycobacterium bovis subsp bovis AF2122/97
agcgaaccaccggcgccgccg

SEQ ID NO: 1129641 - RNA, 22 nt, Mycobacterium bovis subsp bovis AF2122/97
agcgaaccaccggcgccgccgg

SEQ ID NO: 1129642 - RNA, 14 nt, Mycobacterium bovis subsp bovis AF2122/97
agcgaaaugcccau

SEQ ID NO: 1129643 - RNA, 20 nt, Mycobacterium bovis subsp bovis AF2122/97
agcgaaaugcccaucaccag

SEQ ID NO: 1129644 - RNA, 18 nt, Mycobacterium bovis subsp bovis AF2122/97
agcgaaaugccggugccg

SEQ ID NO: 1129645 - RNA, 19 nt, Mycobacterium bovis subsp bovis AF2122/97
agcgaaaugccggugccgg

SEQ ID NO: 1129646 - RNA, 17 nt, Mycobacterium bovis subsp bovis AF2122/97
agccuucggugucgccg

SEQ ID NO: 1129647 - RNA, 15 nt, Mycobacterium bovis subsp bovis AF2122/97
agccuugcagcgccc

SEQ ID NO: 1129648 - RNA, 14 nt, Mycobacterium bovis subsp bovis AF2122/97
agccuugaucucgu

SEQ ID NO: 1129649 - RNA, 20 nt, Mycobacterium bovis subsp bovis AF2122/97
agccuuucgugcaccgcgac

SEQ ID NO: 1129650 - RNA, 22 nt, Mycobacterium bovis subsp bovis AF2122/97
agccuuucgugcaccgcgaccg

SEQ ID NO: 1129651 - RNA, 21 nt, Mycobacterium bovis subsp bovis AF2122/97
agccugccgaugacgauggcc

SEQ ID NO: 1129652 - RNA, 17 nt, Mycobacterium bovis subsp bovis AF2122/97
agccugcagcgaaacac

SEQ ID NO: 1129653 - RNA, 17 nt, Mycobacterium bovis subsp bovis AF2122/97
agccugcaggccgccgg

SEQ ID NO: 1129654 - RNA, 24 nt, Mycobacterium bovis subsp bovis AF2122/97
agccugcgccgacccgcgcgccgg

SEQ ID NO: 1129655 - RNA, 15 nt, Mycobacterium bovis subsp bovis AF2122/97
agccugcggcggcgu

SEQ ID NO: 1129656 - RNA, 14 nt, Mycobacterium bovis subsp bovis AF2122/97
agccugcgggccgg

SEQ ID NO: 1129657 - RNA, 17 nt, Mycobacterium bovis subsp bovis AF2122/97
agccucggcgagccgug

SEQ ID NO: 1129658 - RNA, 17 nt, Mycobacterium bovis subsp bovis AF2122/97
agccucuuggucaacgg

SEQ ID NO: 1129659 - RNA, 21 nt, Mycobacterium bovis subsp bovis AF2122/97
agccgauacaggccacgcacc

SEQ ID NO: 1129660 - RNA, 22 nt, Mycobacterium bovis subsp bovis AF2122/97
agccgauacaggccacgcaccg

SEQ ID NO: 1129661 - RNA, 21 nt, Mycobacterium bovis subsp bovis AF2122/97
agccgagguucaaagcagcgc

SEQ ID NO: 1129662 - RNA, 14 nt, Mycobacterium bovis subsp bovis AF2122/97
agccgaggucgccc

SEQ ID NO: 1129663 - RNA, 14 nt, Mycobacterium bovis subsp bovis AF2122/97
agccgaagcgcccg

SEQ ID NO: 1129664 - RNA, 22 nt, Mycobacterium bovis subsp bovis AF2122/97
agccgaucacgggcuaccggca

SEQ ID NO: 1129665 - RNA, 13 nt, Mycobacterium bovis subsp bovis AF2122/97
agccgaagccgaa

SEQ ID NO: 1129666 - RNA, 20 nt, Mycobacterium bovis subsp bovis AF2122/97
agccgaaaucacugaggcug

SEQ ID NO: 1129667 - RNA, 17 nt, Mycobacterium bovis subsp bovis AF2122/97
agccgaacaccgucagc

SEQ ID NO: 1129668 - RNA, 20 nt, Mycobacterium bovis subsp bovis AF2122/97
agcccuucagcgaagccggg

SEQ ID NO: 1129669 - RNA, 22 nt, Mycobacterium bovis subsp bovis AF2122/97
agccgcauaggccccgccagcg

SEQ ID NO: 1129670 - RNA, 15 nt, Mycobacterium bovis subsp bovis AF2122/97
agccgcaggugggcg

SEQ ID NO: 1129671 - RNA, 20 nt, Mycobacterium bovis subsp bovis AF2122/97
agccgcauaggccccgccag

SEQ ID NO: 1129672 - RNA, 23 nt, Mycobacterium bovis subsp bovis AF2122/97
agccgccaccguacgacagucgc

SEQ ID NO: 1129673 - RNA, 18 nt, Mycobacterium bovis subsp bovis AF2122/97
agccgcaucuugucgagc

SEQ ID NO: 1129674 - RNA, 14 nt, Mycobacterium bovis subsp bovis AF2122/97
agccgccaggugcu

SEQ ID NO: 1129675 - RNA, 21 nt, Mycobacterium bovis subsp bovis AF2122/97
agccgcagcaccucggucccg

SEQ ID NO: 1129676 - RNA, 21 nt, Mycobacterium bovis subsp bovis AF2122/97
agccgcagcaccucgucgauc

SEQ ID NO: 1129677 - RNA, 23 nt, Mycobacterium bovis subsp bovis AF2122/97
agccgcagcaccucgucgaucgc

SEQ ID NO: 1129678 - RNA, 17 nt, Mycobacterium bovis subsp bovis AF2122/97
agccgcagccgcaggcc

SEQ ID NO: 1129679 - RNA, 16 nt, Mycobacterium bovis subsp bovis AF2122/97
agccgaucaccgccgg

SEQ ID NO: 1129680 - RNA, 17 nt, Mycobacterium bovis subsp bovis AF2122/97
agccgauccgaucgcag

SEQ ID NO: 1129681 - RNA, 18 nt, Mycobacterium bovis subsp bovis AF2122/97
agccgaucaucaccggca

SEQ ID NO: 1129682 - RNA, 14 nt, Mycobacterium bovis subsp bovis AF2122/97
agccgauccagcag

SEQ ID NO: 1129683 - RNA, 17 nt, Mycobacterium bovis subsp bovis AF2122/97
agccgauccagcaggcc

SEQ ID NO: 1129684 - RNA, 16 nt, Mycobacterium bovis subsp bovis AF2122/97
agccgauccgaucgca

SEQ ID NO: 1129685 - RNA, 13 nt, Mycobacterium bovis subsp bovis AF2122/97
agccgcgagccgg

SEQ ID NO: 1129686 - RNA, 14 nt, Mycobacterium bovis subsp bovis AF2122/97
agccgcgacgcggc

SEQ ID NO: 1129687 - RNA, 16 nt, Mycobacterium bovis subsp bovis AF2122/97
agccgcgacgcggcgu

SEQ ID NO: 1129688 - RNA, 15 nt, Mycobacterium bovis subsp bovis AF2122/97
agccgcgacauccgc

SEQ ID NO: 1129689 - RNA, 13 nt, Mycobacterium bovis subsp bovis AF2122/97
agccgccccggca

SEQ ID NO: 1129690 - RNA, 22 nt, Mycobacterium bovis subsp bovis AF2122/97
agccgccgcggucagauccaga

SEQ ID NO: 1129691 - RNA, 20 nt, Mycobacterium bovis subsp bovis AF2122/97
agccgccgccugugcgcggu

SEQ ID NO: 1129692 - RNA, 16 nt, Mycobacterium bovis subsp bovis AF2122/97
agccgccgcgacggca

SEQ ID NO: 1129693 - RNA, 11 nt, Mycobacterium bovis subsp bovis AF2122/97
agccgcccgcc

SEQ ID NO: 1129694 - RNA, 23 nt, Mycobacterium bovis subsp bovis AF2122/97
agccgcccgcccggacgcaacac

SEQ ID NO: 1129695 - RNA, 11 nt, Mycobacterium bovis subsp bovis AF2122/97
agccgccgacu

SEQ ID NO: 1129696 - RNA, 15 nt, Mycobacterium bovis subsp bovis AF2122/97
agccgccgacucggc

SEQ ID NO: 1129697 - RNA, 17 nt, Mycobacterium bovis subsp bovis AF2122/97
agccgcccaagccgccg

SEQ ID NO: 1129698 - RNA, 18 nt, Mycobacterium bovis subsp bovis AF2122/97
agccgcccaagccgccgg

SEQ ID NO: 1129699 - RNA, 15 nt, Mycobacterium bovis subsp bovis AF2122/97
agccgccagcccguc

SEQ ID NO: 1129700 - RNA, 19 nt, Mycobacterium bovis subsp bovis AF2122/97
agccgcgcguccgggcagc

SEQ ID NO: 1129701 - RNA, 13 nt, Mycobacterium bovis subsp bovis AF2122/97
agccgcgcgguac

SEQ ID NO: 1129702 - RNA, 22 nt, Mycobacterium bovis subsp bovis AF2122/97
agccgcggaucauccuucgccg

SEQ ID NO: 1129703 - RNA, 17 nt, Mycobacterium bovis subsp bovis AF2122/97
agccgcggcaacaccac

SEQ ID NO: 1129704 - RNA, 17 nt, Mycobacterium bovis subsp bovis AF2122/97
agccgcggcaccgccga

SEQ ID NO: 1129705 - RNA, 15 nt, Mycobacterium bovis subsp bovis AF2122/97
agccgcggcccgcgu

SEQ ID NO: 1129706 - RNA, 13 nt, Mycobacterium bovis subsp bovis AF2122/97
agccgcgccgggu

SEQ ID NO: 1129707 - RNA, 23 nt, Mycobacterium bovis subsp bovis AF2122/97
agccgcggaucauccuucgccgg

SEQ ID NO: 1129708 - RNA, 13 nt, Mycobacterium bovis subsp bovis AF2122/97
agccgcgccgacc

SEQ ID NO: 1129709 - RNA, 16 nt, Mycobacterium bovis subsp bovis AF2122/97
agccgcgcgccaucgc

SEQ ID NO: 1129710 - RNA, 13 nt, Mycobacterium bovis subsp bovis AF2122/97
agccgcgcgccgg

SEQ ID NO: 1129711 - RNA, 15 nt, Mycobacterium bovis subsp bovis AF2122/97
agccgcgcgccggcc

SEQ ID NO: 1129712 - RNA, 16 nt, Mycobacterium bovis subsp bovis AF2122/97
agccgcgcgccggcca

SEQ ID NO: 1129713 - RNA, 22 nt, Mycobacterium bovis subsp bovis AF2122/97
agccgcgaugugguggacgcca

SEQ ID NO: 1129714 - RNA, 20 nt, Mycobacterium bovis subsp bovis AF2122/97
agcccgagcgcuugaccccg

SEQ ID NO: 1129715 - RNA, 21 nt, Mycobacterium bovis subsp bovis AF2122/97
agcccgaguugaaggugccgg

SEQ ID NO: 1129716 - RNA, 20 nt, Mycobacterium bovis subsp bovis AF2122/97
agcccgaucggcgggcuggu

SEQ ID NO: 1129717 - RNA, 15 nt, Mycobacterium bovis subsp bovis AF2122/97
agcccgauggugccg

SEQ ID NO: 1129718 - RNA, 18 nt, Mycobacterium bovis subsp bovis AF2122/97
agcccgauggugccgacc

SEQ ID NO: 1129719 - RNA, 22 nt, Mycobacterium bovis subsp bovis AF2122/97
agcccgaugguggugccgaccu

SEQ ID NO: 1129720 - RNA, 17 nt, Mycobacterium bovis subsp bovis AF2122/97
agcccgauucagcgccc

SEQ ID NO: 1129721 - RNA, 12 nt, Mycobacterium bovis subsp bovis AF2122/97
agcccgcaucgc

SEQ ID NO: 1129722 - RNA, 17 nt, Mycobacterium bovis subsp bovis AF2122/97
agcccgcaucgcaccag

SEQ ID NO: 1129723 - RNA, 15 nt, Mycobacterium bovis subsp bovis AF2122/97
agcccggaacccgag

SEQ ID NO: 1129724 - RNA, 14 nt, Mycobacterium bovis subsp bovis AF2122/97
agcccggaaucgcg

SEQ ID NO: 1129725 - RNA, 16 nt, Mycobacterium bovis subsp bovis AF2122/97
agcccggacgcgcgga

SEQ ID NO: 1129726 - RNA, 21 nt, Mycobacterium bovis subsp bovis AF2122/97
agcccggacguaggcaccccg

SEQ ID NO: 1129727 - RNA, 13 nt, Mycobacterium bovis subsp bovis AF2122/97
agcccggccagcc

SEQ ID NO: 1129728 - RNA, 13 nt, Mycobacterium bovis subsp bovis AF2122/97
agcccgucgauca

SEQ ID NO: 1129729 - RNA, 20 nt, Mycobacterium bovis subsp bovis AF2122/97
agcccgucgcggccggcggc

SEQ ID NO: 1129730 - RNA, 20 nt, Mycobacterium bovis subsp bovis AF2122/97
agcccggaccgcccgugccg

SEQ ID NO: 1129731 - RNA, 12 nt, Mycobacterium bovis subsp bovis AF2122/97
agcccggccgcg

SEQ ID NO: 1129732 - RNA, 16 nt, Mycobacterium bovis subsp bovis AF2122/97
agcccguucgugccgu

SEQ ID NO: 1129733 - RNA, 19 nt, Mycobacterium bovis subsp bovis AF2122/97
agcccgucggcgccgaaca

SEQ ID NO: 1129734 - RNA, 15 nt, Mycobacterium bovis subsp bovis AF2122/97
agcccuaucagccga

SEQ ID NO: 1129735 - RNA, 13 nt, Mycobacterium bovis subsp bovis AF2122/97
agcccuccgagca

SEQ ID NO: 1129736 - RNA, 23 nt, Mycobacterium bovis subsp bovis AF2122/97
agcccugcgccucggcggccagc

SEQ ID NO: 1129737 - RNA, 16 nt, Mycobacterium bovis subsp bovis AF2122/97
agcccugaccggggug

SEQ ID NO: 1129738 - RNA, 17 nt, Mycobacterium bovis subsp bovis AF2122/97
agcccgaccgguccagc

SEQ ID NO: 1129739 - RNA, 15 nt, Mycobacterium bovis subsp bovis AF2122/97
agccccgaagccggu

SEQ ID NO: 1129740 - RNA, 15 nt, Mycobacterium bovis subsp bovis AF2122/97
agcccgagcucgccg

SEQ ID NO: 1129741 - RNA, 16 nt, Mycobacterium bovis subsp bovis AF2122/97
agcccgagcucgccgc

SEQ ID NO: 1129742 - RNA, 17 nt, Mycobacterium bovis subsp bovis AF2122/97
agcccgagcucgccgca

SEQ ID NO: 1129743 - RNA, 18 nt, Mycobacterium bovis subsp bovis AF2122/97
agcccgagcucgccgcag

SEQ ID NO: 1129744 - RNA, 14 nt, Mycobacterium bovis subsp bovis AF2122/97
agcccccgacguug

SEQ ID NO: 1129745 - RNA, 19 nt, Mycobacterium bovis subsp bovis AF2122/97
agccccauugccgucgcgg

SEQ ID NO: 1129746 - RNA, 14 nt, Mycobacterium bovis subsp bovis AF2122/97
agccccaucaccac

SEQ ID NO: 1129747 - RNA, 22 nt, Mycobacterium bovis subsp bovis AF2122/97
agccccaucaccaccggcaccg

SEQ ID NO: 1129748 - RNA, 17 nt, Mycobacterium bovis subsp bovis AF2122/97
agccaugccgcucggca

SEQ ID NO: 1129749 - RNA, 19 nt, Mycobacterium bovis subsp bovis AF2122/97
agccaugccgcucggcaac

SEQ ID NO: 1129750 - RNA, 18 nt, Mycobacterium bovis subsp bovis AF2122/97
agccauguggcgucgcuc

SEQ ID NO: 1129751 - RNA, 19 nt, Mycobacterium bovis subsp bovis AF2122/97
agccauucaaguucgccga

SEQ ID NO: 1129752 - RNA, 20 nt, Mycobacterium bovis subsp bovis AF2122/97
agccauguggcgucgcucgu

SEQ ID NO: 1129753 - RNA, 22 nt, Mycobacterium bovis subsp bovis AF2122/97
agccagccgaaacauugcccgu

SEQ ID NO: 1129754 - RNA, 13 nt, Mycobacterium bovis subsp bovis AF2122/97
agccagccgcgaa

SEQ ID NO: 1129755 - RNA, 17 nt, Mycobacterium bovis subsp bovis AF2122/97
agccagcccagccgcca

SEQ ID NO: 1129756 - RNA, 16 nt, Mycobacterium bovis subsp bovis AF2122/97
agccacggcuucgccg

SEQ ID NO: 1129757 - RNA, 20 nt, Mycobacterium bovis subsp bovis AF2122/97
agccacggguagcugccgcg

SEQ ID NO: 1129758 - RNA, 21 nt, Mycobacterium bovis subsp bovis AF2122/97
agccacgcccacaggggcagc

SEQ ID NO: 1129759 - RNA, 19 nt, Mycobacterium bovis subsp bovis AF2122/97
agccacgcagcacggcacc

SEQ ID NO: 1129760 - RNA, 20 nt, Mycobacterium bovis subsp bovis AF2122/97
agccacgccagccaggcgaa

SEQ ID NO: 1129761 - RNA, 22 nt, Mycobacterium bovis subsp bovis AF2122/97
agccacgcacaauacggucagc

SEQ ID NO: 1129762 - RNA, 18 nt, Mycobacterium bovis subsp bovis AF2122/97
agccaggaagcgguggcc

SEQ ID NO: 1129763 - RNA, 18 nt, Mycobacterium bovis subsp bovis AF2122/97
agccaggagccgaucacg

SEQ ID NO: 1129764 - RNA, 16 nt, Mycobacterium bovis subsp bovis AF2122/97
agccagcgcagccagg

SEQ ID NO: 1129765 - RNA, 19 nt, Mycobacterium bovis subsp bovis AF2122/97
agccagcgcagccaggcug

SEQ ID NO: 1129766 - RNA, 15 nt, Mycobacterium bovis subsp bovis AF2122/97
agccagucggccacc

SEQ ID NO: 1129767 - RNA, 22 nt, Mycobacterium bovis subsp bovis AF2122/97
agccaguguugcaguggcgacg

SEQ ID NO: 1129768 - RNA, 20 nt, Mycobacterium bovis subsp bovis AF2122/97
agcaugacaccggccaccag

SEQ ID NO: 1129769 - RNA, 19 nt, Mycobacterium bovis subsp bovis AF2122/97
agcauauccgccggcgaca

SEQ ID NO: 1129770 - RNA, 14 nt, Mycobacterium bovis subsp bovis AF2122/97
agcaucaacaccgg

SEQ ID NO: 1129771 - RNA, 17 nt, Mycobacterium bovis subsp bovis AF2122/97
agcaucaaccguccccg

SEQ ID NO: 1129772 - RNA, 22 nt, Mycobacterium bovis subsp bovis AF2122/97
agcaugcccucgcuguuggccg

SEQ ID NO: 1129773 - RNA, 15 nt, Mycobacterium bovis subsp bovis AF2122/97
agcauggcuccgaag

SEQ ID NO: 1129774 - RNA, 17 nt, Mycobacterium bovis subsp bovis AF2122/97
agcaugcccagcgcacg

SEQ ID NO: 1129775 - RNA, 21 nt, Mycobacterium bovis subsp bovis AF2122/97
agcaugcgauacacggcggcg

SEQ ID NO: 1129776 - RNA, 23 nt, Mycobacterium bovis subsp bovis AF2122/97
agcaugcgauacacggcggcgau

SEQ ID NO: 1129777 - RNA, 17 nt, Mycobacterium bovis subsp bovis AF2122/97
agccaaaucagccaggc

SEQ ID NO: 1129778 - RNA, 21 nt, Mycobacterium bovis subsp bovis AF2122/97
agccaccgggcgugcggcggc

SEQ ID NO: 1129779 - RNA, 13 nt, Mycobacterium bovis subsp bovis AF2122/97
agccaccgggugg

SEQ ID NO: 1129780 - RNA, 22 nt, Mycobacterium bovis subsp bovis AF2122/97
agccaccucgacggugacgacc

SEQ ID NO: 1129781 - RNA, 16 nt, Mycobacterium bovis subsp bovis AF2122/97
agccaccugacaaacg

SEQ ID NO: 1129782 - RNA, 13 nt, Mycobacterium bovis subsp bovis AF2122/97
agccaacgagcgc

SEQ ID NO: 1129783 - RNA, 23 nt, Mycobacterium bovis subsp bovis AF2122/97
agccaaccagcccggccgccgag

SEQ ID NO: 1129784 - RNA, 21 nt, Mycobacterium bovis subsp bovis AF2122/97
agccaacucaggccgguaccg

SEQ ID NO: 1129785 - RNA, 19 nt, Mycobacterium bovis subsp bovis AF2122/97
agccaacucgaccgacugc

SEQ ID NO: 1129786 - RNA, 18 nt, Mycobacterium bovis subsp bovis AF2122/97
agccaagaaucacggcca

SEQ ID NO: 1129787 - RNA, 22 nt, Mycobacterium bovis subsp bovis AF2122/97
agcaggccuccaagcccgccgg

SEQ ID NO: 1129788 - RNA, 18 nt, Mycobacterium bovis subsp bovis AF2122/97
agcaggccgggacagcgc

SEQ ID NO: 1129789 - RNA, 19 nt, Mycobacterium bovis subsp bovis AF2122/97
agcagcugggcaucaccgc

SEQ ID NO: 1129790 - RNA, 15 nt, Mycobacterium bovis subsp bovis AF2122/97
agcagggccggcacc

SEQ ID NO: 1129791 - RNA, 16 nt, Mycobacterium bovis subsp bovis AF2122/97
agcagggccggcaccg

SEQ ID NO: 1129792 - RNA, 14 nt, Mycobacterium bovis subsp bovis AF2122/97
agcagggcggcgaa

SEQ ID NO: 1129793 - RNA, 15 nt, Mycobacterium bovis subsp bovis AF2122/97
agcagggcggcgaac

SEQ ID NO: 1129794 - RNA, 16 nt, Mycobacterium bovis subsp bovis AF2122/97
agcagggugccggcgc

SEQ ID NO: 1129795 - RNA, 20 nt, Mycobacterium bovis subsp bovis AF2122/97
agcagggugccggcgccgcc

SEQ ID NO: 1129796 - RNA, 17 nt, Mycobacterium bovis subsp bovis AF2122/97
agcagggugugcgucug

SEQ ID NO: 1129797 - RNA, 15 nt, Mycobacterium bovis subsp bovis AF2122/97
agcagggcuucgugc

SEQ ID NO: 1129798 - RNA, 23 nt, Mycobacterium bovis subsp bovis AF2122/97
agcaggggacgaccaugccgauc

SEQ ID NO: 1129799 - RNA, 13 nt, Mycobacterium bovis subsp bovis AF2122/97
agcaguuggccga

SEQ ID NO: 1129800 - RNA, 23 nt, Mycobacterium bovis subsp bovis AF2122/97
agcauaccgccgcugccaugcgg

SEQ ID NO: 1129801 - RNA, 16 nt, Mycobacterium bovis subsp bovis AF2122/97
agauuggguccagcga

SEQ ID NO: 1129802 - RNA, 13 nt, Mycobacterium bovis subsp bovis AF2122/97
agauugccgggcc

SEQ ID NO: 1129803 - RNA, 21 nt, Mycobacterium bovis subsp bovis AF2122/97
agauugccugggcggccgggc

SEQ ID NO: 1129804 - RNA, 20 nt, Mycobacterium bovis subsp bovis AF2122/97
agauucgcucaccaccgacc

SEQ ID NO: 1129805 - RNA, 18 nt, Mycobacterium bovis subsp bovis AF2122/97
agcagcucgccggcacgc

SEQ ID NO: 1129806 - RNA, 18 nt, Mycobacterium bovis subsp bovis AF2122/97
agcagcuagcccggcagc

SEQ ID NO: 1129807 - RNA, 21 nt, Mycobacterium bovis subsp bovis AF2122/97
agcagcugcgauauggucacc

SEQ ID NO: 1129808 - RNA, 19 nt, Mycobacterium bovis subsp bovis AF2122/97
agcagcucggccgaggcgg

SEQ ID NO: 1129809 - RNA, 21 nt, Mycobacterium bovis subsp bovis AF2122/97
agcagcugaaaauaggccggg

SEQ ID NO: 1129810 - RNA, 22 nt, Mycobacterium bovis subsp bovis AF2122/97
agcagcgugaccaccgccgaca

SEQ ID NO: 1129811 - RNA, 16 nt, Mycobacterium bovis subsp bovis AF2122/97
aggcccucgacggcgu

SEQ ID NO: 1129812 - RNA, 15 nt, Mycobacterium bovis subsp bovis AF2122/97
aggcccugcggccac

SEQ ID NO: 1129813 - RNA, 19 nt, Mycobacterium bovis subsp bovis AF2122/97
aggcccuggccgcgccggg

SEQ ID NO: 1129814 - RNA, 20 nt, Mycobacterium bovis subsp bovis AF2122/97
aggcccuggccgcgccgggg

SEQ ID NO: 1129815 - RNA, 21 nt, Mycobacterium bovis subsp bovis AF2122/97
aggccgacaaugucggcgaug

SEQ ID NO: 1129816 - RNA, 19 nt, Mycobacterium bovis subsp bovis AF2122/97
aggcccguugucgaccgaa

SEQ ID NO: 1129817 - RNA, 17 nt, Mycobacterium bovis subsp bovis AF2122/97
aggccaugggaaccgac

SEQ ID NO: 1129818 - RNA, 23 nt, Mycobacterium bovis subsp bovis AF2122/97
aggccauccgggcugccaaggcc

SEQ ID NO: 1129819 - RNA, 23 nt, Mycobacterium bovis subsp bovis AF2122/97
aggcccagcaaccgcucggcgau

SEQ ID NO: 1129820 - RNA, 18 nt, Mycobacterium bovis subsp bovis AF2122/97
aggcccagcaaccgcucg

SEQ ID NO: 1129821 - RNA, 14 nt, Mycobacterium bovis subsp bovis AF2122/97
aggcccagcacggu

SEQ ID NO: 1129822 - RNA, 18 nt, Mycobacterium bovis subsp bovis AF2122/97
aggcccagcacggucaac

SEQ ID NO: 1129823 - RNA, 19 nt, Mycobacterium bovis subsp bovis AF2122/97
aggccacccgcgaagccgc

SEQ ID NO: 1129824 - RNA, 19 nt, Mycobacterium bovis subsp bovis AF2122/97
aggccaccggcgaccgacg

SEQ ID NO: 1129825 - RNA, 23 nt, Mycobacterium bovis subsp bovis AF2122/97
aggccaccggcggugccgguggu

SEQ ID NO: 1129826 - RNA, 14 nt, Mycobacterium bovis subsp bovis AF2122/97
aggccaccgucgcg

SEQ ID NO: 1129827 - RNA, 19 nt, Mycobacterium bovis subsp bovis AF2122/97
aggccagggugaccaggcc

SEQ ID NO: 1129828 - RNA, 20 nt, Mycobacterium bovis subsp bovis AF2122/97
aggccauagucagacgacga

SEQ ID NO: 1129829 - RNA, 21 nt, Mycobacterium bovis subsp bovis AF2122/97
aggccauagucagacgacgau

SEQ ID NO: 1129830 - RNA, 18 nt, Mycobacterium bovis subsp bovis AF2122/97
aggccacagcccggcgau

SEQ ID NO: 1129831 - RNA, 14 nt, Mycobacterium bovis subsp bovis AF2122/97
aggccaccccgacc

SEQ ID NO: 1129832 - RNA, 13 nt, Mycobacterium bovis subsp bovis AF2122/97
aggccaaccgguu

SEQ ID NO: 1129833 - RNA, 20 nt, Mycobacterium bovis subsp bovis AF2122/97
aggccaccacugcgcccgcc

SEQ ID NO: 1129834 - RNA, 21 nt, Mycobacterium bovis subsp bovis AF2122/97
aggccaccacugcgcccgcca

SEQ ID NO: 1129835 - RNA, 14 nt, Mycobacterium bovis subsp bovis AF2122/97
aggccaacggcgcu

SEQ ID NO: 1129836 - RNA, 20 nt, Mycobacterium bovis subsp bovis AF2122/97
aggccaacuuggcggccagc

SEQ ID NO: 1129837 - RNA, 20 nt, Mycobacterium bovis subsp bovis AF2122/97
aggccaagguggccaccaaa

SEQ ID NO: 1129838 - RNA, 18 nt, Mycobacterium bovis subsp bovis AF2122/97
aggcaccgaucggugccg

SEQ ID NO: 1129839 - RNA, 21 nt, Mycobacterium bovis subsp bovis AF2122/97
aggcaccgaucggugccggcc

SEQ ID NO: 1129840 - RNA, 21 nt, Mycobacterium bovis subsp bovis AF2122/97
aggcaccuauagggacgugcc

SEQ ID NO: 1129841 - RNA, 13 nt, Mycobacterium bovis subsp bovis AF2122/97
aggcacggguguu

SEQ ID NO: 1129842 - RNA, 19 nt, Mycobacterium bovis subsp bovis AF2122/97
aggcacguucagccaggcg

SEQ ID NO: 1129843 - RNA, 15 nt, Mycobacterium bovis subsp bovis AF2122/97
aggcauucucccggu

SEQ ID NO: 1129844 - RNA, 22 nt, Mycobacterium bovis subsp bovis AF2122/97
aggcacucccggaguggccagu

SEQ ID NO: 1129845 - RNA, 20 nt, Mycobacterium bovis subsp bovis AF2122/97
aggcaccccgaucacccgca

SEQ ID NO: 1129846 - RNA, 18 nt, Mycobacterium bovis subsp bovis AF2122/97
aggcacaaucaccgccgc

SEQ ID NO: 1129847 - RNA, 17 nt, Mycobacterium bovis subsp bovis AF2122/97
aggcacaacaucgccgc

SEQ ID NO: 1129848 - RNA, 23 nt, Mycobacterium bovis subsp bovis AF2122/97
aggauguaguuggugaugccgau

SEQ ID NO: 1129849 - RNA, 23 nt, Mycobacterium bovis subsp bovis AF2122/97
aggauucagccgguggucugcgc

SEQ ID NO: 1129850 - RNA, 14 nt, Mycobacterium bovis subsp bovis AF2122/97
aggauucugcugac

SEQ ID NO: 1129851 - RNA, 13 nt, Mycobacterium bovis subsp bovis AF2122/97
aggacggucgcca

SEQ ID NO: 1129852 - RNA, 23 nt, Mycobacterium bovis subsp bovis AF2122/97
aggacgguugagauggucaccgg

SEQ ID NO: 1129853 - RNA, 20 nt, Mycobacterium bovis subsp bovis AF2122/97
aggacggcguagacguccgc

SEQ ID NO: 1129854 - RNA, 14 nt, Mycobacterium bovis subsp bovis AF2122/97
aggacuccggccgc

SEQ ID NO: 1129855 - RNA, 15 nt, Mycobacterium bovis subsp bovis AF2122/97
aggacugcgccaccg

SEQ ID NO: 1129856 - RNA, 17 nt, Mycobacterium bovis subsp bovis AF2122/97
aggacuggcaccgccag

SEQ ID NO: 1129857 - RNA, 18 nt, Mycobacterium bovis subsp bovis AF2122/97
aggacucacgcagcgcca

SEQ ID NO: 1129858 - RNA, 15 nt, Mycobacterium bovis subsp bovis AF2122/97
aggagaucagcaccg

SEQ ID NO: 1129859 - RNA, 22 nt, Mycobacterium bovis subsp bovis AF2122/97
aggagcagggcucguccaucag

SEQ ID NO: 1129860 - RNA, 22 nt, Mycobacterium bovis subsp bovis AF2122/97
aggagaucucugagcgggcggg

SEQ ID NO: 1129861 - RNA, 17 nt, Mycobacterium bovis subsp bovis AF2122/97
aggagaugagcaccaaa

SEQ ID NO: 1129862 - RNA, 12 nt, Mycobacterium bovis subsp bovis AF2122/97
aggagaugccga

SEQ ID NO: 1129863 - RNA, 12 nt, Mycobacterium bovis subsp bovis AF2122/97
aggagccgggcc

SEQ ID NO: 1129864 - RNA, 13 nt, Mycobacterium bovis subsp bovis AF2122/97
aggagccgucacg

SEQ ID NO: 1129865 - RNA, 14 nt, Mycobacterium bovis subsp bovis AF2122/97
aggagggccgcgau

SEQ ID NO: 1129866 - RNA, 19 nt, Mycobacterium bovis subsp bovis AF2122/97
aggagggccgcgaucgacg

SEQ ID NO: 1129867 - RNA, 22 nt, Mycobacterium bovis subsp bovis AF2122/97
aggagccccagguagucgacca

SEQ ID NO: 1129868 - RNA, 23 nt, Mycobacterium bovis subsp bovis AF2122/97
aggagccggcaaccgacucgaca

SEQ ID NO: 1129869 - RNA, 16 nt, Mycobacterium bovis subsp bovis AF2122/97
aggauggucagcagcu

SEQ ID NO: 1129870 - RNA, 19 nt, Mycobacterium bovis subsp bovis AF2122/97
aggauggugcggccgcggc

SEQ ID NO: 1129871 - RNA, 22 nt, Mycobacterium bovis subsp bovis AF2122/97
aggaucgccugagcgccgcggc

SEQ ID NO: 1129872 - RNA, 22 nt, Mycobacterium bovis subsp bovis AF2122/97
aggaugcgcaacaccucaccgc

SEQ ID NO: 1129873 - RNA, 18 nt, Mycobacterium bovis subsp bovis AF2122/97
aggaugcaucgcaacgag

SEQ ID NO: 1129874 - RNA, 18 nt, Mycobacterium bovis subsp bovis AF2122/97
aggaucgcgcccaccgau

SEQ ID NO: 1129875 - RNA, 23 nt, Mycobacterium bovis subsp bovis AF2122/97
aggaucgcguggcgcaccaccgc

SEQ ID NO: 1129876 - RNA, 16 nt, Mycobacterium bovis subsp bovis AF2122/97
aggaucgcuacgucga

SEQ ID NO: 1129877 - RNA, 14 nt, Mycobacterium bovis subsp bovis AF2122/97
aggaucggcagcag

SEQ ID NO: 1129878 - RNA, 21 nt, Mycobacterium bovis subsp bovis AF2122/97
aggaucgguuucugcggcccc

SEQ ID NO: 1129879 - RNA, 17 nt, Mycobacterium bovis subsp bovis AF2122/97
aggaucccgccgcugcc

SEQ ID NO: 1129880 - RNA, 18 nt, Mycobacterium bovis subsp bovis AF2122/97
aggauccgaccccgcgcc

SEQ ID NO: 1129881 - RNA, 15 nt, Mycobacterium bovis subsp bovis AF2122/97
aggaucgcggcgccg

SEQ ID NO: 1129882 - RNA, 24 nt, Mycobacterium bovis subsp bovis AF2122/97
aggaucgcggcgccgucgucagcg

SEQ ID NO: 1129883 - RNA, 19 nt, Mycobacterium bovis subsp bovis AF2122/97
aggaugagcgcuucugcgu

SEQ ID NO: 1129884 - RNA, 16 nt, Mycobacterium bovis subsp bovis AF2122/97
aggauccgcugcggcc

SEQ ID NO: 1129885 - RNA, 16 nt, Mycobacterium bovis subsp bovis AF2122/97
aggaucaguacgcugc

SEQ ID NO: 1129886 - RNA, 20 nt, Mycobacterium bovis subsp bovis AF2122/97
aggaucauguccaucgcgcg

SEQ ID NO: 1129887 - RNA, 12 nt, Mycobacterium bovis subsp bovis AF2122/97
aggaucagcccg

SEQ ID NO: 1129888 - RNA, 17 nt, Mycobacterium bovis subsp bovis AF2122/97
aggaucagaacgcggcc

SEQ ID NO: 1129889 - RNA, 15 nt, Mycobacterium bovis subsp bovis AF2122/97
aggaguggccgggcg

SEQ ID NO: 1129890 - RNA, 19 nt, Mycobacterium bovis subsp bovis AF2122/97
aaacuaacggcagccaccg

SEQ ID NO: 1129891 - RNA, 21 nt, Mycobacterium bovis subsp bovis AF2122/97
aggauagggcuuugucaccgg

SEQ ID NO: 1129892 - RNA, 22 nt, Mycobacterium bovis subsp bovis AF2122/97
aggauagggcuuugucaccggc

SEQ ID NO: 1129893 - RNA, 19 nt, Mycobacterium bovis subsp bovis AF2122/97
aggaacccgaacaacgccg

SEQ ID NO: 1129894 - RNA, 13 nt, Mycobacterium bovis subsp bovis AF2122/97
aggaacccgugga

SEQ ID NO: 1129895 - RNA, 19 nt, Mycobacterium bovis subsp bovis AF2122/97
aggaaccgaucggucgauc

SEQ ID NO: 1129896 - RNA, 14 nt, Mycobacterium bovis subsp bovis AF2122/97
aggaaccgggcaaa

SEQ ID NO: 1129897 - RNA, 16 nt, Mycobacterium bovis subsp bovis AF2122/97
aggaaccccgcgcggu

SEQ ID NO: 1129898 - RNA, 23 nt, Mycobacterium bovis subsp bovis AF2122/97
aggaaccacccaccggccaccag

SEQ ID NO: 1129899 - RNA, 17 nt, Mycobacterium bovis subsp bovis AF2122/97
aggaacaacgcgcaacc

SEQ ID NO: 1129900 - RNA, 20 nt, Mycobacterium bovis subsp bovis AF2122/97
aggaaaaccccggccaccag

SEQ ID NO: 1129901 - RNA, 18 nt, Mycobacterium bovis subsp bovis AF2122/97
aggaagccguuggcgacg

SEQ ID NO: 1129902 - RNA, 18 nt, Mycobacterium bovis subsp bovis AF2122/97
aggaagccgcggccacgg

SEQ ID NO: 1129903 - RNA, 22 nt, Mycobacterium bovis subsp bovis AF2122/97
aggaagccgcggccacgguaga

SEQ ID NO: 1129904 - RNA, 17 nt, Mycobacterium bovis subsp bovis AF2122/97
aggaagcggcggcaacc

SEQ ID NO: 1129905 - RNA, 19 nt, Mycobacterium bovis subsp bovis AF2122/97
aggaacuacccgccagcaa

SEQ ID NO: 1129906 - RNA, 23 nt, Mycobacterium bovis subsp bovis AF2122/97
aggaacuggaccggugccagcag

SEQ ID NO: 1129907 - RNA, 17 nt, Mycobacterium bovis subsp bovis AF2122/97
aggaacggcucggccgg

SEQ ID NO: 1129908 - RNA, 14 nt, Mycobacterium bovis subsp bovis AF2122/97
aggaagaagccgaa

SEQ ID NO: 1129909 - RNA, 20 nt, Mycobacterium bovis subsp bovis AF2122/97
aggaagcccacgaucgcguc

SEQ ID NO: 1129910 - RNA, 19 nt, Mycobacterium bovis subsp bovis AF2122/97
aggaccagcaccgccgcgc

SEQ ID NO: 1129911 - RNA, 13 nt, Mycobacterium bovis subsp bovis AF2122/97
aggaccaccuggu

SEQ ID NO: 1129912 - RNA, 21 nt, Mycobacterium bovis subsp bovis AF2122/97
aggacccaucgccagcaucag

SEQ ID NO: 1129913 - RNA, 17 nt, Mycobacterium bovis subsp bovis AF2122/97
aggaccgcucugcggcc

SEQ ID NO: 1129914 - RNA, 20 nt, Mycobacterium bovis subsp bovis AF2122/97
aggaccgcucugcggccacg

SEQ ID NO: 1129915 - RNA, 11 nt, Mycobacterium bovis subsp bovis AF2122/97
aggaccgcucu

SEQ ID NO: 1129916 - RNA, 21 nt, Mycobacterium bovis subsp bovis AF2122/97
aggaccucgucaccggucagc

SEQ ID NO: 1129917 - RNA, 16 nt, Mycobacterium bovis subsp bovis AF2122/97
aggacgaacgcgccgg

SEQ ID NO: 1129918 - RNA, 14 nt, Mycobacterium bovis subsp bovis AF2122/97
aggaccucgucacc

SEQ ID NO: 1129919 - RNA, 16 nt, Mycobacterium bovis subsp bovis AF2122/97
aggaccugugcggccg

SEQ ID NO: 1129920 - RNA, 16 nt, Mycobacterium bovis subsp bovis AF2122/97
aggacgacgccgacga

SEQ ID NO: 1129921 - RNA, 12 nt, Mycobacterium bovis subsp bovis AF2122/97
aggacgcaccgc

SEQ ID NO: 1129922 - RNA, 13 nt, Mycobacterium bovis subsp bovis AF2122/97
aggacgcaccgcc

SEQ ID NO: 1129923 - RNA, 15 nt, Mycobacterium bovis subsp bovis AF2122/97
aggacaccggcacca

SEQ ID NO: 1129924 - RNA, 18 nt, Mycobacterium bovis subsp bovis AF2122/97
aggacaccgucaugccgu

SEQ ID NO: 1129925 - RNA, 16 nt, Mycobacterium bovis subsp bovis AF2122/97
aggacaagccgcugau

SEQ ID NO: 1129926 - RNA, 14 nt, Mycobacterium bovis subsp bovis AF2122/97
aggacaagugccgg

SEQ ID NO: 1129927 - RNA, 16 nt, Mycobacterium bovis subsp bovis AF2122/97
aggacaagugccggcg

SEQ ID NO: 1129928 - RNA, 20 nt, Mycobacterium bovis subsp bovis AF2122/97
aggaaguccagcuggccggg

SEQ ID NO: 1129929 - RNA, 22 nt, Mycobacterium bovis subsp bovis AF2122/97
aggaauacagcuugaucgccga

SEQ ID NO: 1129930 - RNA, 18 nt, Mycobacterium bovis subsp bovis AF2122/97
agcugcgcgaagccacca

SEQ ID NO: 1129931 - RNA, 16 nt, Mycobacterium bovis subsp bovis AF2122/97
agcugcgcgggcgagu

SEQ ID NO: 1129932 - RNA, 23 nt, Mycobacterium bovis subsp bovis AF2122/97
agcugcggaggguucgccgaagc

SEQ ID NO: 1129933 - RNA, 17 nt, Mycobacterium bovis subsp bovis AF2122/97
agcugcggauccaccac

SEQ ID NO: 1129934 - RNA, 20 nt, Mycobacterium bovis subsp bovis AF2122/97
agcugcggauccaccacgcu

SEQ ID NO: 1129935 - RNA, 14 nt, Mycobacterium bovis subsp bovis AF2122/97
agcugcggcggcca

SEQ ID NO: 1129936 - RNA, 19 nt, Mycobacterium bovis subsp bovis AF2122/97
agcugcggcuccggcggca

SEQ ID NO: 1129937 - RNA, 17 nt, Mycobacterium bovis subsp bovis AF2122/97
agcugcgggucucgccg

SEQ ID NO: 1129938 - RNA, 12 nt, Mycobacterium bovis subsp bovis AF2122/97
agcuggcgcgcg

SEQ ID NO: 1129939 - RNA, 17 nt, Mycobacterium bovis subsp bovis AF2122/97
agcuggcgcgcggggug

SEQ ID NO: 1129940 - RNA, 20 nt, Mycobacterium bovis subsp bovis AF2122/97
agcugggcaucaccgccgcg

SEQ ID NO: 1129941 - RNA, 24 nt, Mycobacterium bovis subsp bovis AF2122/97
agcugggcaucaucagcggcgccg

SEQ ID NO: 1129942 - RNA, 22 nt, Mycobacterium bovis subsp bovis AF2122/97
agcugggugaccucgucgaccg

SEQ ID NO: 1129943 - RNA, 21 nt, Mycobacterium bovis subsp bovis AF2122/97
agcugguaggucaccggucac

SEQ ID NO: 1129944 - RNA, 23 nt, Mycobacterium bovis subsp bovis AF2122/97
agcuggucccacaccuccucgag

SEQ ID NO: 1129945 - RNA, 23 nt, Mycobacterium bovis subsp bovis AF2122/97
agcugguccuccaaggcggucac

SEQ ID NO: 1129946 - RNA, 22 nt, Mycobacterium bovis subsp bovis AF2122/97
agcuggugaucagcucagugau

SEQ ID NO: 1129947 - RNA, 15 nt, Mycobacterium bovis subsp bovis AF2122/97
agcuggucggugggc

SEQ ID NO: 1129948 - RNA, 17 nt, Mycobacterium bovis subsp bovis AF2122/97
agcugugguggugaugg

SEQ ID NO: 1129949 - RNA, 15 nt, Mycobacterium bovis subsp bovis AF2122/97
agcugucgucgcccc

SEQ ID NO: 1129950 - RNA, 16 nt, Mycobacterium bovis subsp bovis AF2122/97
agcuguccucgcgggc

SEQ ID NO: 1129951 - RNA, 15 nt, Mycobacterium bovis subsp bovis AF2122/97
agcugucgaccgcga

SEQ ID NO: 1129952 - RNA, 19 nt, Mycobacterium bovis subsp bovis AF2122/97
agcugucgaccgcgaucac

SEQ ID NO: 1129953 - RNA, 21 nt, Mycobacterium bovis subsp bovis AF2122/97
agcuggugcagaauucggcgc

SEQ ID NO: 1129954 - RNA, 15 nt, Mycobacterium bovis subsp bovis AF2122/97
agcugguugacggcg

SEQ ID NO: 1129955 - RNA, 16 nt, Mycobacterium bovis subsp bovis AF2122/97
agcugguugacggcga

SEQ ID NO: 1129956 - RNA, 15 nt, Mycobacterium bovis subsp bovis AF2122/97
agcugguuggcgccg

SEQ ID NO: 1129957 - RNA, 20 nt, Mycobacterium bovis subsp bovis AF2122/97
agcuguacauacucugcgac

SEQ ID NO: 1129958 - RNA, 15 nt, Mycobacterium bovis subsp bovis AF2122/97
agcuucaacaccggc

SEQ ID NO: 1129959 - RNA, 16 nt, Mycobacterium bovis subsp bovis AF2122/97
agcuuccaaacccggu

SEQ ID NO: 1129960 - RNA, 12 nt, Mycobacterium bovis subsp bovis AF2122/97
agcuuccgcgcg

SEQ ID NO: 1129961 - RNA, 15 nt, Mycobacterium bovis subsp bovis AF2122/97
agcuuccgguccagc

SEQ ID NO: 1129962 - RNA, 17 nt, Mycobacterium bovis subsp bovis AF2122/97
agcuuccgguccagcgg

SEQ ID NO: 1129963 - RNA, 21 nt, Mycobacterium bovis subsp bovis AF2122/97
agcuuccgguccagcggccgc

SEQ ID NO: 1129964 - RNA, 17 nt, Mycobacterium bovis subsp bovis AF2122/97
agcuugagcgugagcgc

SEQ ID NO: 1129965 - RNA, 19 nt, Mycobacterium bovis subsp bovis AF2122/97
agcuugagcgugagcgccg

SEQ ID NO: 1129966 - RNA, 15 nt, Mycobacterium bovis subsp bovis AF2122/97
agcuugacccacgag

SEQ ID NO: 1129967 - RNA, 23 nt, Mycobacterium bovis subsp bovis AF2122/97
agcuugacccacgagagcgcugu

SEQ ID NO: 1129968 - RNA, 19 nt, Mycobacterium bovis subsp bovis AF2122/97
agcuugagcacacguccgg

SEQ ID NO: 1129969 - RNA, 19 nt, Mycobacterium bovis subsp bovis AF2122/97
agcuugaccgaccacgcga

SEQ ID NO: 1129970 - RNA, 18 nt, Mycobacterium bovis subsp bovis AF2122/97
agcuugacaucggucagc

SEQ ID NO: 1129971 - RNA, 14 nt, Mycobacterium bovis subsp bovis AF2122/97
agcuuggucgccgg

SEQ ID NO: 1129972 - RNA, 16 nt, Mycobacterium bovis subsp bovis AF2122/97
agcuuguagcgcucgu

SEQ ID NO: 1129973 - RNA, 18 nt, Mycobacterium bovis subsp bovis AF2122/97
agcuuggccucagccacc

SEQ ID NO: 1129974 - RNA, 15 nt, Mycobacterium bovis subsp bovis AF2122/97
agcuugggcgaucgu

SEQ ID NO: 1129975 - RNA, 15 nt, Mycobacterium bovis subsp bovis AF2122/97
agcuuggcggccagc

SEQ ID NO: 1129976 - RNA, 13 nt, Mycobacterium bovis subsp bovis AF2122/97
agcuugcgccgca

SEQ ID NO: 1129977 - RNA, 19 nt, Mycobacterium bovis subsp bovis AF2122/97
agcuuggagaggcggugca

SEQ ID NO: 1129978 - RNA, 16 nt, Mycobacterium bovis subsp bovis AF2122/97
agcuugcccgacggcg

SEQ ID NO: 1129979 - RNA, 17 nt, Mycobacterium bovis subsp bovis AF2122/97
agcuugcccgagcccag

SEQ ID NO: 1129980 - RNA, 16 nt, Mycobacterium bovis subsp bovis AF2122/97
agcuugcagugccgcc

SEQ ID NO: 1129981 - RNA, 18 nt, Mycobacterium bovis subsp bovis AF2122/97
agcuugccgucgcugacg

SEQ ID NO: 1129982 - RNA, 17 nt, Mycobacterium bovis subsp bovis AF2122/97
agcgcuuugaugccgau

SEQ ID NO: 1129983 - RNA, 17 nt, Mycobacterium bovis subsp bovis AF2122/97
agcgcuuuggucgucgg

SEQ ID NO: 1129984 - RNA, 23 nt, Mycobacterium bovis subsp bovis AF2122/97
agcggaugggcugaggaacgccg

SEQ ID NO: 1129985 - RNA, 15 nt, Mycobacterium bovis subsp bovis AF2122/97
agcggcaaagccggg

SEQ ID NO: 1129986 - RNA, 17 nt, Mycobacterium bovis subsp bovis AF2122/97
agcggaauccgaacgcg

SEQ ID NO: 1129987 - RNA, 23 nt, Mycobacterium bovis subsp bovis AF2122/97
agcggaauggcgccggccggcgc

SEQ ID NO: 1129988 - RNA, 17 nt, Mycobacterium bovis subsp bovis AF2122/97
agcgcucggcagccggc

SEQ ID NO: 1129989 - RNA, 20 nt, Mycobacterium bovis subsp bovis AF2122/97
agcgcuggcaggccgggcac

SEQ ID NO: 1129990 - RNA, 19 nt, Mycobacterium bovis subsp bovis AF2122/97
agcgcuggcaggccgggca

SEQ ID NO: 1129991 - RNA, 17 nt, Mycobacterium bovis subsp bovis AF2122/97
agcgcucgaucacggcg

SEQ ID NO: 1129992 - RNA, 19 nt, Mycobacterium bovis subsp bovis AF2122/97
agcgcggcggcaucucgca

SEQ ID NO: 1129993 - RNA, 16 nt, Mycobacterium bovis subsp bovis AF2122/97
agcgcggcggagccgg

SEQ ID NO: 1129994 - RNA, 18 nt, Mycobacterium bovis subsp bovis AF2122/97
agcgcggcggagccgggu

SEQ ID NO: 1129995 - RNA, 21 nt, Mycobacterium bovis subsp bovis AF2122/97
agcgcggcggagccgggugag

SEQ ID NO: 1129996 - RNA, 13 nt, Mycobacterium bovis subsp bovis AF2122/97
agcgcggcgucgc

SEQ ID NO: 1129997 - RNA, 20 nt, Mycobacterium bovis subsp bovis AF2122/97
agcgcggcguguacgucgau

SEQ ID NO: 1129998 - RNA, 22 nt, Mycobacterium bovis subsp bovis AF2122/97
agcgcggcuggggccccgcgcc

SEQ ID NO: 1129999 - RNA, 13 nt, Mycobacterium bovis subsp bovis AF2122/97
agcgcgucgccga

SEQ ID NO: 1130000 - RNA, 12 nt, Mycobacterium bovis subsp bovis AF2122/97
agcgcgucgcgg

SEQ ID NO: 1130001 - RNA, 22 nt, Mycobacterium bovis subsp bovis AF2122/97
agcgcgucgcgggauugcgcgc

SEQ ID NO: 1130002 - RNA, 17 nt, Mycobacterium bovis subsp bovis AF2122/97
agcgcgucggucaccga

SEQ ID NO: 1130003 - RNA, 14 nt, Mycobacterium bovis subsp bovis AF2122/97
agcgcgucgucacg

SEQ ID NO: 1130004 - RNA, 24 nt, Mycobacterium bovis subsp bovis AF2122/97
agcgcgucgucacgaucgugccgg

SEQ ID NO: 1130005 - RNA, 13 nt, Mycobacterium bovis subsp bovis AF2122/97
agcgcgucgucca

SEQ ID NO: 1130006 - RNA, 23 nt, Mycobacterium bovis subsp bovis AF2122/97
agcgcggcgacgauucgagcggu

SEQ ID NO: 1130007 - RNA, 18 nt, Mycobacterium bovis subsp bovis AF2122/97
agcgcggcgcgcggggcc

SEQ ID NO: 1130008 - RNA, 13 nt, Mycobacterium bovis subsp bovis AF2122/97
agcgcggcgcaca

SEQ ID NO: 1130009 - RNA, 16 nt, Mycobacterium bovis subsp bovis AF2122/97
agcgccguggcgcggu

SEQ ID NO: 1130010 - RNA, 18 nt, Mycobacterium bovis subsp bovis AF2122/97
agcgcggcgaagccgggu

SEQ ID NO: 1130011 - RNA, 18 nt, Mycobacterium bovis subsp bovis AF2122/97
agcgccgucaucgcagca

SEQ ID NO: 1130012 - RNA, 18 nt, Mycobacterium bovis subsp bovis AF2122/97
agcgccgguuuaggccau

SEQ ID NO: 1130013 - RNA, 13 nt, Mycobacterium bovis subsp bovis AF2122/97
agcgccggccgcg

SEQ ID NO: 1130014 - RNA, 18 nt, Mycobacterium bovis subsp bovis AF2122/97
agcgccggccgcggcggc

SEQ ID NO: 1130015 - RNA, 13 nt, Mycobacterium bovis subsp bovis AF2122/97
agcgccggccagg

SEQ ID NO: 1130016 - RNA, 22 nt, Mycobacterium bovis subsp bovis AF2122/97
agcggcgggggcgucgccgccg

SEQ ID NO: 1130017 - RNA, 13 nt, Mycobacterium bovis subsp bovis AF2122/97
agcggcggggggu

SEQ ID NO: 1130018 - RNA, 20 nt, Mycobacterium bovis subsp bovis AF2122/97
agcggcggggggugaucgcc

SEQ ID NO: 1130019 - RNA, 12 nt, Mycobacterium bovis subsp bovis AF2122/97
agcggcguuccg

SEQ ID NO: 1130020 - RNA, 13 nt, Mycobacterium bovis subsp bovis AF2122/97
agcgggauugccg

SEQ ID NO: 1130021 - RNA, 22 nt, Mycobacterium bovis subsp bovis AF2122/97
agcgggauugccgagaacaccg

SEQ ID NO: 1130022 - RNA, 23 nt, Mycobacterium bovis subsp bovis AF2122/97
agcgggaggaugucgagcccguc

SEQ ID NO: 1130023 - RNA, 22 nt, Mycobacterium bovis subsp bovis AF2122/97
agcgggauauggaugacaaacg

SEQ ID NO: 1130024 - RNA, 23 nt, Mycobacterium bovis subsp bovis AF2122/97
agcgggaucaugaccaucgaggc

SEQ ID NO: 1130025 - RNA, 18 nt, Mycobacterium bovis subsp bovis AF2122/97
agcggcguuccgggccga

SEQ ID NO: 1130026 - RNA, 16 nt, Mycobacterium bovis subsp bovis AF2122/97
agcgggaacacaccgc

SEQ ID NO: 1130027 - RNA, 12 nt, Mycobacterium bovis subsp bovis AF2122/97
agcgggcugcgc

SEQ ID NO: 1130028 - RNA, 14 nt, Mycobacterium bovis subsp bovis AF2122/97
agcgggcgucgcgg

SEQ ID NO: 1130029 - RNA, 17 nt, Mycobacterium bovis subsp bovis AF2122/97
agcgggcgaugagcgcg

SEQ ID NO: 1130030 - RNA, 22 nt, Mycobacterium bovis subsp bovis AF2122/97
agcgggcgcccuugagccgccg

SEQ ID NO: 1130031 - RNA, 20 nt, Mycobacterium bovis subsp bovis AF2122/97
agcgggccacugagccacag

SEQ ID NO: 1130032 - RNA, 13 nt, Mycobacterium bovis subsp bovis AF2122/97
agcgggccgcccu

SEQ ID NO: 1130033 - RNA, 15 nt, Mycobacterium bovis subsp bovis AF2122/97
agcgggcacgccgcc

SEQ ID NO: 1130034 - RNA, 20 nt, Mycobacterium bovis subsp bovis AF2122/97
agcgggcaagaugaucgcgu

SEQ ID NO: 1130035 - RNA, 22 nt, Mycobacterium bovis subsp bovis AF2122/97
agcgggacugcggaagccaccg

SEQ ID NO: 1130036 - RNA, 13 nt, Mycobacterium bovis subsp bovis AF2122/97
agcgggcaccgaa

SEQ ID NO: 1130037 - RNA, 20 nt, Mycobacterium bovis subsp bovis AF2122/97
agcggccgucgggacggcca

SEQ ID NO: 1130038 - RNA, 19 nt, Mycobacterium bovis subsp bovis AF2122/97
agcggccgguacacgucca

SEQ ID NO: 1130039 - RNA, 19 nt, Mycobacterium bovis subsp bovis AF2122/97
agcggccgaccgcgacccg

SEQ ID NO: 1130040 - RNA, 21 nt, Mycobacterium bovis subsp bovis AF2122/97
agcggccgaccgcgacccggc

SEQ ID NO: 1130041 - RNA, 23 nt, Mycobacterium bovis subsp bovis AF2122/97
agcggccgcgauggugcgccggg

SEQ ID NO: 1130042 - RNA, 18 nt, Mycobacterium bovis subsp bovis AF2122/97
agcggccgcgcgcaucgc

SEQ ID NO: 1130043 - RNA, 21 nt, Mycobacterium bovis subsp bovis AF2122/97
agcggccugaccggcucgccg

SEQ ID NO: 1130044 - RNA, 19 nt, Mycobacterium bovis subsp bovis AF2122/97
agcggccugcucgggggcc

SEQ ID NO: 1130045 - RNA, 19 nt, Mycobacterium bovis subsp bovis AF2122/97
agcggcgaccgcggucgcc

SEQ ID NO: 1130046 - RNA, 22 nt, Mycobacterium bovis subsp bovis AF2122/97
agcggcgaucggaggcccgcca

SEQ ID NO: 1130047 - RNA, 10 nt, Mycobacterium bovis subsp bovis AF2122/97
agcggcggcc

SEQ ID NO: 1130048 - RNA, 12 nt, Mycobacterium bovis subsp bovis AF2122/97
agcggcggcccu

SEQ ID NO: 1130049 - RNA, 21 nt, Mycobacterium bovis subsp bovis AF2122/97
agcggcggcccuaaacaccgc

SEQ ID NO: 1130050 - RNA, 23 nt, Mycobacterium bovis subsp bovis AF2122/97
agcggcggcccuaaacaccgcga

SEQ ID NO: 1130051 - RNA, 15 nt, Mycobacterium bovis subsp bovis AF2122/97
agcggcggcgacgag

SEQ ID NO: 1130052 - RNA, 23 nt, Mycobacterium bovis subsp bovis AF2122/97
agcggcgacuacccagccagccg

SEQ ID NO: 1130053 - RNA, 13 nt, Mycobacterium bovis subsp bovis AF2122/97
agcggcgaccgcg

SEQ ID NO: 1130054 - RNA, 18 nt, Mycobacterium bovis subsp bovis AF2122/97
agcggcgaccgcggucgc

SEQ ID NO: 1130055 - RNA, 15 nt, Mycobacterium bovis subsp bovis AF2122/97
agcggcccgaucacc

SEQ ID NO: 1130056 - RNA, 23 nt, Mycobacterium bovis subsp bovis AF2122/97
agcggccauaucgcccaccacga

SEQ ID NO: 1130057 - RNA, 19 nt, Mycobacterium bovis subsp bovis AF2122/97
agcggccauccggcggcgg

SEQ ID NO: 1130058 - RNA, 23 nt, Mycobacterium bovis subsp bovis AF2122/97
agcggccauccggcggcggccag

SEQ ID NO: 1130059 - RNA, 20 nt, Mycobacterium bovis subsp bovis AF2122/97
agcggcccaucgggcgccca

SEQ ID NO: 1130060 - RNA, 13 nt, Mycobacterium bovis subsp bovis AF2122/97
agcggccgccgcg

SEQ ID NO: 1130061 - RNA, 19 nt, Mycobacterium bovis subsp bovis AF2122/97
agcggcccuucgacgagga

SEQ ID NO: 1130062 - RNA, 23 nt, Mycobacterium bovis subsp bovis AF2122/97
agcggcccuucgacgaggacggc

SEQ ID NO: 1130063 - RNA, 12 nt, Mycobacterium bovis subsp bovis AF2122/97
agcggcaccgcg

SEQ ID NO: 1130064 - RNA, 13 nt, Mycobacterium bovis subsp bovis AF2122/97
agcggcaccgcgc

SEQ ID NO: 1130065 - RNA, 23 nt, Mycobacterium bovis subsp bovis AF2122/97
agcggcacacccaucaccgccag

SEQ ID NO: 1130066 - RNA, 23 nt, Mycobacterium bovis subsp bovis AF2122/97
agcggcacaucaugggcgcugcc

SEQ ID NO: 1130067 - RNA, 15 nt, Mycobacterium bovis subsp bovis AF2122/97
agcggccauaucgcc

SEQ ID NO: 1130068 - RNA, 17 nt, Mycobacterium bovis subsp bovis AF2122/97
agcggcaacaugucacc

SEQ ID NO: 1130069 - RNA, 18 nt, Mycobacterium bovis subsp bovis AF2122/97
agcggcaacgaucgacac

SEQ ID NO: 1130070 - RNA, 20 nt, Mycobacterium bovis subsp bovis AF2122/97
agcggcaagaaguucuucgc

SEQ ID NO: 1130071 - RNA, 17 nt, Mycobacterium bovis subsp bovis AF2122/97
agcggcaauggccagca

SEQ ID NO: 1130072 - RNA, 19 nt, Mycobacterium bovis subsp bovis AF2122/97
agcgguuuuaggcagccca

SEQ ID NO: 1130073 - RNA, 13 nt, Mycobacterium bovis subsp bovis AF2122/97
agcgguugccguc

SEQ ID NO: 1130074 - RNA, 17 nt, Mycobacterium bovis subsp bovis AF2122/97
agcgguugccgucugcg

SEQ ID NO: 1130075 - RNA, 22 nt, Mycobacterium bovis subsp bovis AF2122/97
agcgguuuccgcacgaucgccc

SEQ ID NO: 1130076 - RNA, 17 nt, Mycobacterium bovis subsp bovis AF2122/97
agcgggcgaugccgaug

SEQ ID NO: 1130077 - RNA, 17 nt, Mycobacterium bovis subsp bovis AF2122/97
agcgguguagccggcgc

SEQ ID NO: 1130078 - RNA, 19 nt, Mycobacterium bovis subsp bovis AF2122/97
agcgguguugccggagacg

SEQ ID NO: 1130079 - RNA, 16 nt, Mycobacterium bovis subsp bovis AF2122/97
agcgguggucggcgcg

SEQ ID NO: 1130080 - RNA, 20 nt, Mycobacterium bovis subsp bovis AF2122/97
agcgguggugagugcgucuc

SEQ ID NO: 1130081 - RNA, 12 nt, Mycobacterium bovis subsp bovis AF2122/97
agcgguugggcg

SEQ ID NO: 1130082 - RNA, 23 nt, Mycobacterium bovis subsp bovis AF2122/97
agcgguguugccggagacgucgc

SEQ ID NO: 1130083 - RNA, 20 nt, Mycobacterium bovis subsp bovis AF2122/97
agcgguuauguauccgcgcc

SEQ ID NO: 1130084 - RNA, 19 nt, Mycobacterium bovis subsp bovis AF2122/97
agcgucacccugucgcgca

SEQ ID NO: 1130085 - RNA, 18 nt, Mycobacterium bovis subsp bovis AF2122/97
agcgucaaccacggccgc

SEQ ID NO: 1130086 - RNA, 20 nt, Mycobacterium bovis subsp bovis AF2122/97
agcguauuggacgcugccgc

SEQ ID NO: 1130087 - RNA, 17 nt, Mycobacterium bovis subsp bovis AF2122/97
agcguaucggccggcag

SEQ ID NO: 1130088 - RNA, 13 nt, Mycobacterium bovis subsp bovis AF2122/97
agcguagcccgag

SEQ ID NO: 1130089 - RNA, 23 nt, Mycobacterium bovis subsp bovis AF2122/97
agcguagcgaccucgccgcggcg

SEQ ID NO: 1130090 - RNA, 17 nt, Mycobacterium bovis subsp bovis AF2122/97
agcgucucgaucaccuc

SEQ ID NO: 1130091 - RNA, 20 nt, Mycobacterium bovis subsp bovis AF2122/97
agcgugucgaugcgggcugu

SEQ ID NO: 1130092 - RNA, 18 nt, Mycobacterium bovis subsp bovis AF2122/97
agcguguggagcucgcgg

SEQ ID NO: 1130093 - RNA, 17 nt, Mycobacterium bovis subsp bovis AF2122/97
agcgugucggccggcca

SEQ ID NO: 1130094 - RNA, 21 nt, Mycobacterium bovis subsp bovis AF2122/97
agcgugucggccggccaggug

SEQ ID NO: 1130095 - RNA, 20 nt, Mycobacterium bovis subsp bovis AF2122/97
agcguggugaagucggugcc

SEQ ID NO: 1130096 - RNA, 16 nt, Mycobacterium bovis subsp bovis AF2122/97
agcguggugauccggu

SEQ ID NO: 1130097 - RNA, 22 nt, Mycobacterium bovis subsp bovis AF2122/97
agcgugguacuuucacgcucgu

SEQ ID NO: 1130098 - RNA, 15 nt, Mycobacterium bovis subsp bovis AF2122/97
agcgucucgaucacc

SEQ ID NO: 1130099 - RNA, 13 nt, Mycobacterium bovis subsp bovis AF2122/97
agcguguggcgca

SEQ ID NO: 1130100 - RNA, 14 nt, Mycobacterium bovis subsp bovis AF2122/97
agcgucgcggccac

SEQ ID NO: 1130101 - RNA, 17 nt, Mycobacterium bovis subsp bovis AF2122/97
agcgucgcugaccgcgu

SEQ ID NO: 1130102 - RNA, 18 nt, Mycobacterium bovis subsp bovis AF2122/97
agcgucgcugcccgcggu

SEQ ID NO: 1130103 - RNA, 19 nt, Mycobacterium bovis subsp bovis AF2122/97
agcucggccagcacgccgc

SEQ ID NO: 1130104 - RNA, 21 nt, Mycobacterium bovis subsp bovis AF2122/97
agcucggccagcacgccgccg

SEQ ID NO: 1130105 - RNA, 22 nt, Mycobacterium bovis subsp bovis AF2122/97
agcucggcagcaucuccgucgg

SEQ ID NO: 1130106 - RNA, 24 nt, Mycobacterium bovis subsp bovis AF2122/97
agcucggcagcaucuccgucggcc

SEQ ID NO: 1130107 - RNA, 17 nt, Mycobacterium bovis subsp bovis AF2122/97
agcucggccagugccgg

SEQ ID NO: 1130108 - RNA, 22 nt, Mycobacterium bovis subsp bovis AF2122/97
agcucggccccgccgccggugc

SEQ ID NO: 1130109 - RNA, 19 nt, Mycobacterium bovis subsp bovis AF2122/97
agcucggcgcccagcucgu

SEQ ID NO: 1130110 - RNA, 15 nt, Mycobacterium bovis subsp bovis AF2122/97
agcucgggcgcacgg

SEQ ID NO: 1130111 - RNA, 19 nt, Mycobacterium bovis subsp bovis AF2122/97
agcucgggggcgccggcgc

SEQ ID NO: 1130112 - RNA, 17 nt, Mycobacterium bovis subsp bovis AF2122/97
agcucggucaccacggc

SEQ ID NO: 1130113 - RNA, 18 nt, Mycobacterium bovis subsp bovis AF2122/97
agcucggucaccacggcg

SEQ ID NO: 1130114 - RNA, 14 nt, Mycobacterium bovis subsp bovis AF2122/97
agcucggucagcgu

SEQ ID NO: 1130115 - RNA, 23 nt, Mycobacterium bovis subsp bovis AF2122/97
agcugcaaugacuggaccgcggu

SEQ ID NO: 1130116 - RNA, 22 nt, Mycobacterium bovis subsp bovis AF2122/97
agcugcagcagacccgguggcg

SEQ ID NO: 1130117 - RNA, 18 nt, Mycobacterium bovis subsp bovis AF2122/97
agcugcaccuccgacggc

SEQ ID NO: 1130118 - RNA, 18 nt, Mycobacterium bovis subsp bovis AF2122/97
agcugcccgccagcgccg

SEQ ID NO: 1130119 - RNA, 21 nt, Mycobacterium bovis subsp bovis AF2122/97
agcugcccgccagcgccgccg

SEQ ID NO: 1130120 - RNA, 15 nt, Mycobacterium bovis subsp bovis AF2122/97
agcugccccgccacc

SEQ ID NO: 1130121 - RNA, 18 nt, Mycobacterium bovis subsp bovis AF2122/97
agcugccaggcccgugcc

SEQ ID NO: 1130122 - RNA, 21 nt, Mycobacterium bovis subsp bovis AF2122/97
agcugccaggcccgugccugg

SEQ ID NO: 1130123 - RNA, 12 nt, Mycobacterium bovis subsp bovis AF2122/97
agcugccggccc

SEQ ID NO: 1130124 - RNA, 13 nt, Mycobacterium bovis subsp bovis AF2122/97
agcugccgcggcc

SEQ ID NO: 1130125 - RNA, 17 nt, Mycobacterium bovis subsp bovis AF2122/97
agcugccgcggccggcg

SEQ ID NO: 1130126 - RNA, 15 nt, Mycobacterium bovis subsp bovis AF2122/97
agcugccgcaccccc

SEQ ID NO: 1130127 - RNA, 21 nt, Mycobacterium bovis subsp bovis AF2122/97
agcugccgcacccccuccgcg

SEQ ID NO: 1130128 - RNA, 14 nt, Mycobacterium bovis subsp bovis AF2122/97
agcugccgucgcug

SEQ ID NO: 1130129 - RNA, 17 nt, Mycobacterium bovis subsp bovis AF2122/97
agcugccgucggugccg

SEQ ID NO: 1130130 - RNA, 17 nt, Mycobacterium bovis subsp bovis AF2122/97
agcugcgacgaugccgc

SEQ ID NO: 1130131 - RNA, 22 nt, Mycobacterium bovis subsp bovis AF2122/97
agcugcgacgaugccgccuggu

SEQ ID NO: 1130132 - RNA, 14 nt, Mycobacterium bovis subsp bovis AF2122/97
agcuccugcaugcc

SEQ ID NO: 1130133 - RNA, 13 nt, Mycobacterium bovis subsp bovis AF2122/97
agcucaucgacga

SEQ ID NO: 1130134 - RNA, 19 nt, Mycobacterium bovis subsp bovis AF2122/97
agcuccaccgugacggcca

SEQ ID NO: 1130135 - RNA, 21 nt, Mycobacterium bovis subsp bovis AF2122/97
agcuccagcaaaacccgcucc

SEQ ID NO: 1130136 - RNA, 17 nt, Mycobacterium bovis subsp bovis AF2122/97
agcucgcaaccgagaug

SEQ ID NO: 1130137 - RNA, 14 nt, Mycobacterium bovis subsp bovis AF2122/97
agcucgaugccgug

SEQ ID NO: 1130138 - RNA, 14 nt, Mycobacterium bovis subsp bovis AF2122/97
agcucagcugcgga

SEQ ID NO: 1130139 - RNA, 22 nt, Mycobacterium bovis subsp bovis AF2122/97
agcuagcccggcagcacgugga

SEQ ID NO: 1130140 - RNA, 13 nt, Mycobacterium bovis subsp bovis AF2122/97
agcucaucaccgg

SEQ ID NO: 1130141 - RNA, 18 nt, Mycobacterium bovis subsp bovis AF2122/97
agcucagugaugcgcccc

SEQ ID NO: 1130142 - RNA, 17 nt, Mycobacterium bovis subsp bovis AF2122/97
agcuaccccgacggcga

SEQ ID NO: 1130143 - RNA, 21 nt, Mycobacterium bovis subsp bovis AF2122/97
agcuaaugcacgcccaggcga

SEQ ID NO: 1130144 - RNA, 22 nt, Mycobacterium bovis subsp bovis AF2122/97
agggcggcgaccucggcggcgg

SEQ ID NO: 1130145 - RNA, 18 nt, Mycobacterium bovis subsp bovis AF2122/97
agggccagaucgccgggc

SEQ ID NO: 1130146 - RNA, 14 nt, Mycobacterium bovis subsp bovis AF2122/97
agggcgacagcggc

SEQ ID NO: 1130147 - RNA, 14 nt, Mycobacterium bovis subsp bovis AF2122/97
agggccggcaccgc

SEQ ID NO: 1130148 - RNA, 16 nt, Mycobacterium bovis subsp bovis AF2122/97
agggccggcaccgcag

SEQ ID NO: 1130149 - RNA, 11 nt, Mycobacterium bovis subsp bovis AF2122/97
agggccggcgu

SEQ ID NO: 1130150 - RNA, 16 nt, Mycobacterium bovis subsp bovis AF2122/97
agggccuccacccgcc

SEQ ID NO: 1130151 - RNA, 16 nt, Mycobacterium bovis subsp bovis AF2122/97
agggccaccaccacgg

SEQ ID NO: 1130152 - RNA, 13 nt, Mycobacterium bovis subsp bovis AF2122/97
agggccaccgcgc

SEQ ID NO: 1130153 - RNA, 13 nt, Mycobacterium bovis subsp bovis AF2122/97
agggcaucgucgc

SEQ ID NO: 1130154 - RNA, 16 nt, Mycobacterium bovis subsp bovis AF2122/97
agggcauccgagcggg

SEQ ID NO: 1130155 - RNA, 21 nt, Mycobacterium bovis subsp bovis AF2122/97
agggcaguagugaucgaucgc

SEQ ID NO: 1130156 - RNA, 15 nt, Mycobacterium bovis subsp bovis AF2122/97
agggcggucagcggc

SEQ ID NO: 1130157 - RNA, 16 nt, Mycobacterium bovis subsp bovis AF2122/97
agggucaugucgauca

SEQ ID NO: 1130158 - RNA, 19 nt, Mycobacterium bovis subsp bovis AF2122/97
aggggcuuuugcgucugcu

SEQ ID NO: 1130159 - RNA, 22 nt, Mycobacterium bovis subsp bovis AF2122/97
aggggcuuuugcgucugcucgc

SEQ ID NO: 1130160 - RNA, 14 nt, Mycobacterium bovis subsp bovis AF2122/97
agggcggcggcgcg

SEQ ID NO: 1130161 - RNA, 16 nt, Mycobacterium bovis subsp bovis AF2122/97
agggugccggcgguga

SEQ ID NO: 1130162 - RNA, 23 nt, Mycobacterium bovis subsp bovis AF2122/97
agggugccggcggugacggcggc

SEQ ID NO: 1130163 - RNA, 14 nt, Mycobacterium bovis subsp bovis AF2122/97
aggguggaccgguc

SEQ ID NO: 1130164 - RNA, 18 nt, Mycobacterium bovis subsp bovis AF2122/97
aggguggaccggucgaca

SEQ ID NO: 1130165 - RNA, 19 nt, Mycobacterium bovis subsp bovis AF2122/97
agggugccggucacgucga

SEQ ID NO: 1130166 - RNA, 13 nt, Mycobacterium bovis subsp bovis AF2122/97
aggguggccgguc

SEQ ID NO: 1130167 - RNA, 22 nt, Mycobacterium bovis subsp bovis AF2122/97
aggguggggcgguggccggcga

SEQ ID NO: 1130168 - RNA, 15 nt, Mycobacterium bovis subsp bovis AF2122/97
agggugggcgagcga

SEQ ID NO: 1130169 - RNA, 18 nt, Mycobacterium bovis subsp bovis AF2122/97
aggguguauggccaccac

SEQ ID NO: 1130170 - RNA, 14 nt, Mycobacterium bovis subsp bovis AF2122/97
agggugugcgucug

SEQ ID NO: 1130171 - RNA, 13 nt, Mycobacterium bovis subsp bovis AF2122/97
aggguguugcggc

SEQ ID NO: 1130172 - RNA, 14 nt, Mycobacterium bovis subsp bovis AF2122/97
aggguugccgccga

SEQ ID NO: 1130173 - RNA, 20 nt, Mycobacterium bovis subsp bovis AF2122/97
aggguuuccaagucggagcg

SEQ ID NO: 1130174 - RNA, 14 nt, Mycobacterium bovis subsp bovis AF2122/97
agggcaccggcgau

SEQ ID NO: 1130175 - RNA, 14 nt, Mycobacterium bovis subsp bovis AF2122/97
agggcacgcgcaca

SEQ ID NO: 1130176 - RNA, 13 nt, Mycobacterium bovis subsp bovis AF2122/97
agggcacgucgag

SEQ ID NO: 1130177 - RNA, 18 nt, Mycobacterium bovis subsp bovis AF2122/97
agggauguagugcugcuc

SEQ ID NO: 1130178 - RNA, 18 nt, Mycobacterium bovis subsp bovis AF2122/97
agggaucaccccggccgg

SEQ ID NO: 1130179 - RNA, 23 nt, Mycobacterium bovis subsp bovis AF2122/97
agggaaccauugcccgacgaugc

SEQ ID NO: 1130180 - RNA, 14 nt, Mycobacterium bovis subsp bovis AF2122/97
aggcuggcgauggc

SEQ ID NO: 1130181 - RNA, 20 nt, Mycobacterium bovis subsp bovis AF2122/97
aggcuggcgauggccguccg

SEQ ID NO: 1130182 - RNA, 21 nt, Mycobacterium bovis subsp bovis AF2122/97
aggcuggccgccuccgcggca

SEQ ID NO: 1130183 - RNA, 22 nt, Mycobacterium bovis subsp bovis AF2122/97
aggcuuucgauauagccgccgg

SEQ ID NO: 1130184 - RNA, 17 nt, Mycobacterium bovis subsp bovis AF2122/97
aggcuugcggcacccag

SEQ ID NO: 1130185 - RNA, 20 nt, Mycobacterium bovis subsp bovis AF2122/97
aggcuucggcggccgagcgc

SEQ ID NO: 1130186 - RNA, 15 nt, Mycobacterium bovis subsp bovis AF2122/97
aggccgccagccggc

SEQ ID NO: 1130187 - RNA, 17 nt, Mycobacterium bovis subsp bovis AF2122/97
aggccgccaccgucacc

SEQ ID NO: 1130188 - RNA, 22 nt, Mycobacterium bovis subsp bovis AF2122/97
aggcgucgaacagugccucgcg

SEQ ID NO: 1130189 - RNA, 14 nt, Mycobacterium bovis subsp bovis AF2122/97
aggccgaccagcac

SEQ ID NO: 1130190 - RNA, 16 nt, Mycobacterium bovis subsp bovis AF2122/97
aggccgaugacgaugc

SEQ ID NO: 1130191 - RNA, 19 nt, Mycobacterium bovis subsp bovis AF2122/97
aggccgaugacgaugccgc

SEQ ID NO: 1130192 - RNA, 22 nt, Mycobacterium bovis subsp bovis AF2122/97
aggccgaugacgaugccgccga

SEQ ID NO: 1130193 - RNA, 23 nt, Mycobacterium bovis subsp bovis AF2122/97
aggccgaugacgaugccgccgaa

SEQ ID NO: 1130194 - RNA, 13 nt, Mycobacterium bovis subsp bovis AF2122/97
aggccgaugccga

SEQ ID NO: 1130195 - RNA, 20 nt, Mycobacterium bovis subsp bovis AF2122/97
aggccgacaaugucggcgau

SEQ ID NO: 1130196 - RNA, 17 nt, Mycobacterium bovis subsp bovis AF2122/97
aggccgcaauacccgag

SEQ ID NO: 1130197 - RNA, 13 nt, Mycobacterium bovis subsp bovis AF2122/97
aggccgcacgucg

SEQ ID NO: 1130198 - RNA, 14 nt, Mycobacterium bovis subsp bovis AF2122/97
aggccgcacagcac

SEQ ID NO: 1130199 - RNA, 21 nt, Mycobacterium bovis subsp bovis AF2122/97
aggcguguagccugcggcggu

SEQ ID NO: 1130200 - RNA, 17 nt, Mycobacterium bovis subsp bovis AF2122/97
aggcgugcuugaccgcc

SEQ ID NO: 1130201 - RNA, 13 nt, Mycobacterium bovis subsp bovis AF2122/97
aggcgugcaucgc

SEQ ID NO: 1130202 - RNA, 19 nt, Mycobacterium bovis subsp bovis AF2122/97
aggcgugacgcuaacgucg

SEQ ID NO: 1130203 - RNA, 18 nt, Mycobacterium bovis subsp bovis AF2122/97
aggcgugcacugaccgcg

SEQ ID NO: 1130204 - RNA, 19 nt, Mycobacterium bovis subsp bovis AF2122/97
aggcgugcacugaccgcgg

SEQ ID NO: 1130205 - RNA, 15 nt, Mycobacterium bovis subsp bovis AF2122/97
aggcugaucccgaug

SEQ ID NO: 1130206 - RNA, 21 nt, Mycobacterium bovis subsp bovis AF2122/97
aggcugcagugccgcacccag

SEQ ID NO: 1130207 - RNA, 17 nt, Mycobacterium bovis subsp bovis AF2122/97
aggcugccgcugcgccg

SEQ ID NO: 1130208 - RNA, 20 nt, Mycobacterium bovis subsp bovis AF2122/97
agguggcgcggggccgccgc

SEQ ID NO: 1130209 - RNA, 21 nt, Mycobacterium bovis subsp bovis AF2122/97
agguggcgggcgaugcgggcc

SEQ ID NO: 1130210 - RNA, 24 nt, Mycobacterium bovis subsp bovis AF2122/97
agguggcguaauugucgauguccg

SEQ ID NO: 1130211 - RNA, 13 nt, Mycobacterium bovis subsp bovis AF2122/97
agguggcgagcgc

SEQ ID NO: 1130212 - RNA, 20 nt, Mycobacterium bovis subsp bovis AF2122/97
agguggccgcucuccacccc

SEQ ID NO: 1130213 - RNA, 16 nt, Mycobacterium bovis subsp bovis AF2122/97
agguggccgucgccga

SEQ ID NO: 1130214 - RNA, 20 nt, Mycobacterium bovis subsp bovis AF2122/97
agguggucuuggcgguggcc

SEQ ID NO: 1130215 - RNA, 12 nt, Mycobacterium bovis subsp bovis AF2122/97
aggugggugaac

SEQ ID NO: 1130216 - RNA, 23 nt, Mycobacterium bovis subsp bovis AF2122/97
agguggucaucgccacgccugcu

SEQ ID NO: 1130217 - RNA, 14 nt, Mycobacterium bovis subsp bovis AF2122/97
agguggcugcgccg

SEQ ID NO: 1130218 - RNA, 15 nt, Mycobacterium bovis subsp bovis AF2122/97
agguggggugguggu

SEQ ID NO: 1130219 - RNA, 19 nt, Mycobacterium bovis subsp bovis AF2122/97
aggucgugcucccacguga

SEQ ID NO: 1130220 - RNA, 16 nt, Mycobacterium bovis subsp bovis AF2122/97
aggucgucggcgucgc

SEQ ID NO: 1130221 - RNA, 19 nt, Mycobacterium bovis subsp bovis AF2122/97
aggucgucggcgucgcgga

SEQ ID NO: 1130222 - RNA, 22 nt, Mycobacterium bovis subsp bovis AF2122/97
aggucgucacgccccucacgug

SEQ ID NO: 1130223 - RNA, 15 nt, Mycobacterium bovis subsp bovis AF2122/97
aggucuccggcaagc

SEQ ID NO: 1130224 - RNA, 21 nt, Mycobacterium bovis subsp bovis AF2122/97
aggucgccuucccagccgacg

SEQ ID NO: 1130225 - RNA, 15 nt, Mycobacterium bovis subsp bovis AF2122/97
aggucgcggucgagc

SEQ ID NO: 1130226 - RNA, 21 nt, Mycobacterium bovis subsp bovis AF2122/97
aggucggugggcggcgagcgc

SEQ ID NO: 1130227 - RNA, 18 nt, Mycobacterium bovis subsp bovis AF2122/97
aggucgcgauagccgccg

SEQ ID NO: 1130228 - RNA, 22 nt, Mycobacterium bovis subsp bovis AF2122/97
aggucgccgccgccacggcaau

SEQ ID NO: 1130229 - RNA, 19 nt, Mycobacterium bovis subsp bovis AF2122/97
aggucgccagcucggcacc

SEQ ID NO: 1130230 - RNA, 20 nt, Mycobacterium bovis subsp bovis AF2122/97
aggucgcccaacaccgcgcc

SEQ ID NO: 1130231 - RNA, 22 nt, Mycobacterium bovis subsp bovis AF2122/97
agguacgucuuggaucacgcga

SEQ ID NO: 1130232 - RNA, 18 nt, Mycobacterium bovis subsp bovis AF2122/97
agguacgcgaucagcgcg

SEQ ID NO: 1130233 - RNA, 14 nt, Mycobacterium bovis subsp bovis AF2122/97
agguaauucgucca

SEQ ID NO: 1130234 - RNA, 15 nt, Mycobacterium bovis subsp bovis AF2122/97
agguaggacucacgc

SEQ ID NO: 1130235 - RNA, 14 nt, Mycobacterium bovis subsp bovis AF2122/97
agguagucggcgcg

SEQ ID NO: 1130236 - RNA, 14 nt, Mycobacterium bovis subsp bovis AF2122/97
aguacaggcgcagc

SEQ ID NO: 1130237 - RNA, 14 nt, Mycobacterium bovis subsp bovis AF2122/97
aguacagaucgagg

SEQ ID NO: 1130238 - RNA, 17 nt, Mycobacterium bovis subsp bovis AF2122/97
aguagccgacgucgccg

SEQ ID NO: 1130239 - RNA, 22 nt, Mycobacterium bovis subsp bovis AF2122/97
aguaccgauagccugcggcggc

SEQ ID NO: 1130240 - RNA, 21 nt, Mycobacterium bovis subsp bovis AF2122/97
aguaccagcccaccggcgccg

SEQ ID NO: 1130241 - RNA, 18 nt, Mycobacterium bovis subsp bovis AF2122/97
agguucgugcguugucgg

SEQ ID NO: 1130242 - RNA, 16 nt, Mycobacterium bovis subsp bovis AF2122/97
agguuccacggccagg

SEQ ID NO: 1130243 - RNA, 20 nt, Mycobacterium bovis subsp bovis AF2122/97
agguuccacggccaggucga

SEQ ID NO: 1130244 - RNA, 18 nt, Mycobacterium bovis subsp bovis AF2122/97
agguucuucuccaccacc

SEQ ID NO: 1130245 - RNA, 16 nt, Mycobacterium bovis subsp bovis AF2122/97
aggugucgacgcgggc

SEQ ID NO: 1130246 - RNA, 15 nt, Mycobacterium bovis subsp bovis AF2122/97
aggugugguucccgg

SEQ ID NO: 1130247 - RNA, 16 nt, Mycobacterium bovis subsp bovis AF2122/97
agguguguggcgccgg

SEQ ID NO: 1130248 - RNA, 19 nt, Mycobacterium bovis subsp bovis AF2122/97
agguguugcggugggugaa

SEQ ID NO: 1130249 - RNA, 16 nt, Mycobacterium bovis subsp bovis AF2122/97
aguagcgaugcacccc

SEQ ID NO: 1130250 - RNA, 14 nt, Mycobacterium bovis subsp bovis AF2122/97
aguagccguagccg

SEQ ID NO: 1130251 - RNA, 15 nt, Mycobacterium bovis subsp bovis AF2122/97
aguagcggaucaggu

SEQ ID NO: 1130252 - RNA, 15 nt, Mycobacterium bovis subsp bovis AF2122/97
aguagcuguggcccg

SEQ ID NO: 1130253 - RNA, 23 nt, Mycobacterium bovis subsp bovis AF2122/97
aguagguccacguucggcugcga

SEQ ID NO: 1130254 - RNA, 17 nt, Mycobacterium bovis subsp bovis AF2122/97
agucaggaaaccggcgc

SEQ ID NO: 1130255 - RNA, 20 nt, Mycobacterium bovis subsp bovis AF2122/97
aguagugaucgaucgcggcg

SEQ ID NO: 1130256 - RNA, 18 nt, Mycobacterium bovis subsp bovis AF2122/97
aguagguuuucggcggcu

SEQ ID NO: 1130257 - RNA, 12 nt, Mycobacterium bovis subsp bovis AF2122/97
aguccaggccgu

SEQ ID NO: 1130258 - RNA, 15 nt, Mycobacterium bovis subsp bovis AF2122/97
agucccagcgccgca

SEQ ID NO: 1130259 - RNA, 15 nt, Mycobacterium bovis subsp bovis AF2122/97
aguccaggccggcag

SEQ ID NO: 1130260 - RNA, 16 nt, Mycobacterium bovis subsp bovis AF2122/97
aguccaggccggcagc

SEQ ID NO: 1130261 - RNA, 15 nt, Mycobacterium bovis subsp bovis AF2122/97
aguccagcuggccgg

SEQ ID NO: 1130262 - RNA, 23 nt, Mycobacterium bovis subsp bovis AF2122/97
aguccagcagcgacgcugccgcc

SEQ ID NO: 1130263 - RNA, 21 nt, Mycobacterium bovis subsp bovis AF2122/97
aguccaacgacuguggcgccg

SEQ ID NO: 1130264 - RNA, 20 nt, Mycobacterium bovis subsp bovis AF2122/97
aguccaccgcgcggcgcagc

SEQ ID NO: 1130265 - RNA, 19 nt, Mycobacterium bovis subsp bovis AF2122/97
agucgacgacguccucgac

SEQ ID NO: 1130266 - RNA, 18 nt, Mycobacterium bovis subsp bovis AF2122/97
agucgaccaugagccggc

SEQ ID NO: 1130267 - RNA, 22 nt, Mycobacterium bovis subsp bovis AF2122/97
agucgaccaugagccggcgccg

SEQ ID NO: 1130268 - RNA, 12 nt, Mycobacterium bovis subsp bovis AF2122/97
agucgacggcca

SEQ ID NO: 1130269 - RNA, 16 nt, Mycobacterium bovis subsp bovis AF2122/97
agucgacggucacggu

SEQ ID NO: 1130270 - RNA, 19 nt, Mycobacterium bovis subsp bovis AF2122/97
agucgacggugccgucggu

SEQ ID NO: 1130271 - RNA, 21 nt, Mycobacterium bovis subsp bovis AF2122/97
agucgacggugccgucggugc

SEQ ID NO: 1130272 - RNA, 14 nt, Mycobacterium bovis subsp bovis AF2122/97
agucgacgguggcg

SEQ ID NO: 1130273 - RNA, 13 nt, Mycobacterium bovis subsp bovis AF2122/97
agucgacgucgau

SEQ ID NO: 1130274 - RNA, 19 nt, Mycobacterium bovis subsp bovis AF2122/97
agucgacgucucuggugca

SEQ ID NO: 1130275 - RNA, 22 nt, Mycobacterium bovis subsp bovis AF2122/97
agucgagcaccugccgaucggg

SEQ ID NO: 1130276 - RNA, 16 nt, Mycobacterium bovis subsp bovis AF2122/97
agucgaaaacagcgau

SEQ ID NO: 1130277 - RNA, 19 nt, Mycobacterium bovis subsp bovis AF2122/97
agucgaaaacagcgauccg

SEQ ID NO: 1130278 - RNA, 12 nt, Mycobacterium bovis subsp bovis AF2122/97
aguccuugcgcc

SEQ ID NO: 1130279 - RNA, 21 nt, Mycobacterium bovis subsp bovis AF2122/97
agucgaaaacagcgauccgau

SEQ ID NO: 1130280 - RNA, 15 nt, Mycobacterium bovis subsp bovis AF2122/97
agucgaaucgucauc

SEQ ID NO: 1130281 - RNA, 21 nt, Mycobacterium bovis subsp bovis AF2122/97
agucgaacccgcgagcaucga

SEQ ID NO: 1130282 - RNA, 15 nt, Mycobacterium bovis subsp bovis AF2122/97
aguccggacggcagc

SEQ ID NO: 1130283 - RNA, 20 nt, Mycobacterium bovis subsp bovis AF2122/97
aguccggcuuaccggcgggc

SEQ ID NO: 1130284 - RNA, 24 nt, Mycobacterium bovis subsp bovis AF2122/97
aguccggcuuaccggcgggcgaac

SEQ ID NO: 1130285 - RNA, 19 nt, Mycobacterium bovis subsp bovis AF2122/97
aguccguucaccgucugcg

SEQ ID NO: 1130286 - RNA, 14 nt, Mycobacterium bovis subsp bovis AF2122/97
aguccggucgcggc

SEQ ID NO: 1130287 - RNA, 15 nt, Mycobacterium bovis subsp bovis AF2122/97
aguccgcgauggccg

SEQ ID NO: 1130288 - RNA, 16 nt, Mycobacterium bovis subsp bovis AF2122/97
aguccgcgccgacggc

SEQ ID NO: 1130289 - RNA, 20 nt, Mycobacterium bovis subsp bovis AF2122/97
aguccgcgccggcgggcgcg

SEQ ID NO: 1130290 - RNA, 18 nt, Mycobacterium bovis subsp bovis AF2122/97
aguccgcgcgcaagucga

SEQ ID NO: 1130291 - RNA, 14 nt, Mycobacterium bovis subsp bovis AF2122/97
aguccgcgcucagc

SEQ ID NO: 1130292 - RNA, 17 nt, Mycobacterium bovis subsp bovis AF2122/97
aguccgacaguccgcgc

SEQ ID NO: 1130293 - RNA, 22 nt, Mycobacterium bovis subsp bovis AF2122/97
aguccgacaccacggaccagcg

SEQ ID NO: 1130294 - RNA, 18 nt, Mycobacterium bovis subsp bovis AF2122/97
aguccgagggcgucgccg

SEQ ID NO: 1130295 - RNA, 23 nt, Mycobacterium bovis subsp bovis AF2122/97
aguccgauuuugugagccaggcg

SEQ ID NO: 1130296 - RNA, 16 nt, Mycobacterium bovis subsp bovis AF2122/97
aguccgcauggucagc

SEQ ID NO: 1130297 - RNA, 14 nt, Mycobacterium bovis subsp bovis AF2122/97
agucgccggucagg

SEQ ID NO: 1130298 - RNA, 16 nt, Mycobacterium bovis subsp bovis AF2122/97
agucgcccagccgagc

SEQ ID NO: 1130299 - RNA, 19 nt, Mycobacterium bovis subsp bovis AF2122/97
agucgccgaggacgccggc

SEQ ID NO: 1130300 - RNA, 23 nt, Mycobacterium bovis subsp bovis AF2122/97
agucgauuggcugcgccgauacc

SEQ ID NO: 1130301 - RNA, 17 nt, Mycobacterium bovis subsp bovis AF2122/97
agucgauugccaccgag

SEQ ID NO: 1130302 - RNA, 20 nt, Mycobacterium bovis subsp bovis AF2122/97
agucgcacugcgccggccgg

SEQ ID NO: 1130303 - RNA, 14 nt, Mycobacterium bovis subsp bovis AF2122/97
agucgcagccaggc

SEQ ID NO: 1130304 - RNA, 22 nt, Mycobacterium bovis subsp bovis AF2122/97
agucgcagccaggcacguccga

SEQ ID NO: 1130305 - RNA, 13 nt, Mycobacterium bovis subsp bovis AF2122/97
agucgcagcgagg

SEQ ID NO: 1130306 - RNA, 16 nt, Mycobacterium bovis subsp bovis AF2122/97
agucgcaggaucggcg

SEQ ID NO: 1130307 - RNA, 20 nt, Mycobacterium bovis subsp bovis AF2122/97
agucgaugaugcccauccgg

SEQ ID NO: 1130308 - RNA, 23 nt, Mycobacterium bovis subsp bovis AF2122/97
agucgaucacguacgccgccgau

SEQ ID NO: 1130309 - RNA, 13 nt, Mycobacterium bovis subsp bovis AF2122/97
agucgaucgcggc

SEQ ID NO: 1130310 - RNA, 18 nt, Mycobacterium bovis subsp bovis AF2122/97
agucgcgguaccaucacc

SEQ ID NO: 1130311 - RNA, 19 nt, Mycobacterium bovis subsp bovis AF2122/97
agucgcgggugcggacacc

SEQ ID NO: 1130312 - RNA, 18 nt, Mycobacterium bovis subsp bovis AF2122/97
agucgcggcguucggcuu

SEQ ID NO: 1130313 - RNA, 15 nt, Mycobacterium bovis subsp bovis AF2122/97
agucgcggacgucgc

SEQ ID NO: 1130314 - RNA, 23 nt, Mycobacterium bovis subsp bovis AF2122/97
agucgcucgcugaugcaucccaa

SEQ ID NO: 1130315 - RNA, 21 nt, Mycobacterium bovis subsp bovis AF2122/97
agucgcgguaccaucaccgcg

SEQ ID NO: 1130316 - RNA, 17 nt, Mycobacterium bovis subsp bovis AF2122/97
agucggcaccggugccc

SEQ ID NO: 1130317 - RNA, 13 nt, Mycobacterium bovis subsp bovis AF2122/97
agucggccggcgg

SEQ ID NO: 1130318 - RNA, 16 nt, Mycobacterium bovis subsp bovis AF2122/97
agucgcugucggcaug

SEQ ID NO: 1130319 - RNA, 12 nt, Mycobacterium bovis subsp bovis AF2122/97
agucggcaucgc

SEQ ID NO: 1130320 - RNA, 17 nt, Mycobacterium bovis subsp bovis AF2122/97
agucggcaucgcgagcu

SEQ ID NO: 1130321 - RNA, 21 nt, Mycobacterium bovis subsp bovis AF2122/97
agucggcauugcugguugcgc

SEQ ID NO: 1130322 - RNA, 20 nt, Mycobacterium bovis subsp bovis AF2122/97
agugccgcacccagaccgcc

SEQ ID NO: 1130323 - RNA, 22 nt, Mycobacterium bovis subsp bovis AF2122/97
agugccgcacccagaccgccga

SEQ ID NO: 1130324 - RNA, 14 nt, Mycobacterium bovis subsp bovis AF2122/97
agugccgccaccgc

SEQ ID NO: 1130325 - RNA, 20 nt, Mycobacterium bovis subsp bovis AF2122/97
agugccccgcagcacucgcc

SEQ ID NO: 1130326 - RNA, 15 nt, Mycobacterium bovis subsp bovis AF2122/97
agugcccggccaacc

SEQ ID NO: 1130327 - RNA, 21 nt, Mycobacterium bovis subsp bovis AF2122/97
agugccgcgucgaguggccgu

SEQ ID NO: 1130328 - RNA, 15 nt, Mycobacterium bovis subsp bovis AF2122/97
agugccgccgucgcc

SEQ ID NO: 1130329 - RNA, 12 nt, Mycobacterium bovis subsp bovis AF2122/97
agugccgccggc

SEQ ID NO: 1130330 - RNA, 14 nt, Mycobacterium bovis subsp bovis AF2122/97
agugccgccggcca

SEQ ID NO: 1130331 - RNA, 19 nt, Mycobacterium bovis subsp bovis AF2122/97
aguggcgacgagcaacgcc

SEQ ID NO: 1130332 - RNA, 14 nt, Mycobacterium bovis subsp bovis AF2122/97
agugccucggcgau

SEQ ID NO: 1130333 - RNA, 15 nt, Mycobacterium bovis subsp bovis AF2122/97
agugccucggcggcg

SEQ ID NO: 1130334 - RNA, 13 nt, Mycobacterium bovis subsp bovis AF2122/97
aguggcgcggcga

SEQ ID NO: 1130335 - RNA, 14 nt, Mycobacterium bovis subsp bovis AF2122/97
aguggccgccgggc

SEQ ID NO: 1130336 - RNA, 22 nt, Mycobacterium bovis subsp bovis AF2122/97
aguggcguuacgcucggcgaac

SEQ ID NO: 1130337 - RNA, 22 nt, Mycobacterium bovis subsp bovis AF2122/97
aguggcuguacccgaccagcac

SEQ ID NO: 1130338 - RNA, 23 nt, Mycobacterium bovis subsp bovis AF2122/97
aguggucccguucgcccgcccgu

SEQ ID NO: 1130339 - RNA, 22 nt, Mycobacterium bovis subsp bovis AF2122/97
agugggcgcgaacggcggugug

SEQ ID NO: 1130340 - RNA, 18 nt, Mycobacterium bovis subsp bovis AF2122/97
agugggcguuggcggcaa

SEQ ID NO: 1130341 - RNA, 20 nt, Mycobacterium bovis subsp bovis AF2122/97
agugggcuuuugcgucugcu

SEQ ID NO: 1130342 - RNA, 18 nt, Mycobacterium bovis subsp bovis AF2122/97
aguggggguccggcggcc

SEQ ID NO: 1130343 - RNA, 20 nt, Mycobacterium bovis subsp bovis AF2122/97
agugggggugguaccggcgg

SEQ ID NO: 1130344 - RNA, 22 nt, Mycobacterium bovis subsp bovis AF2122/97
agugggggugguaccggcggcg

SEQ ID NO: 1130345 - RNA, 22 nt, Mycobacterium bovis subsp bovis AF2122/97
agugggugccggcacccgucgg

SEQ ID NO: 1130346 - RNA, 16 nt, Mycobacterium bovis subsp bovis AF2122/97
agugguaggccgccgg

SEQ ID NO: 1130347 - RNA, 14 nt, Mycobacterium bovis subsp bovis AF2122/97
agucguugccgauc

SEQ ID NO: 1130348 - RNA, 23 nt, Mycobacterium bovis subsp bovis AF2122/97
agucgucguguuggccgggucgu

SEQ ID NO: 1130349 - RNA, 13 nt, Mycobacterium bovis subsp bovis AF2122/97
agucgugggcugu

SEQ ID NO: 1130350 - RNA, 14 nt, Mycobacterium bovis subsp bovis AF2122/97
agucgucggcaugg

SEQ ID NO: 1130351 - RNA, 16 nt, Mycobacterium bovis subsp bovis AF2122/97
agucgguugucggggu

SEQ ID NO: 1130352 - RNA, 17 nt, Mycobacterium bovis subsp bovis AF2122/97
agucguagacggcgaaa

SEQ ID NO: 1130353 - RNA, 18 nt, Mycobacterium bovis subsp bovis AF2122/97
agucgucgacuugcaggc

SEQ ID NO: 1130354 - RNA, 19 nt, Mycobacterium bovis subsp bovis AF2122/97
agucgucgacuugcaggcg

SEQ ID NO: 1130355 - RNA, 16 nt, Mycobacterium bovis subsp bovis AF2122/97
agucggcgcuggccgu

SEQ ID NO: 1130356 - RNA, 17 nt, Mycobacterium bovis subsp bovis AF2122/97
agucgggaagcgagcag

SEQ ID NO: 1130357 - RNA, 19 nt, Mycobacterium bovis subsp bovis AF2122/97
agucgguaucggcagaugg

SEQ ID NO: 1130358 - RNA, 15 nt, Mycobacterium bovis subsp bovis AF2122/97
agucggggucgcgga

SEQ ID NO: 1130359 - RNA, 16 nt, Mycobacterium bovis subsp bovis AF2122/97
agugcacagacacggc

SEQ ID NO: 1130360 - RNA, 21 nt, Mycobacterium bovis subsp bovis AF2122/97
agugcaggugcccggccaaaa

SEQ ID NO: 1130361 - RNA, 18 nt, Mycobacterium bovis subsp bovis AF2122/97
agugcaguuccgcggggc

SEQ ID NO: 1130362 - RNA, 20 nt, Mycobacterium bovis subsp bovis AF2122/97
agugccaauuccagcccccc

SEQ ID NO: 1130363 - RNA, 15 nt, Mycobacterium bovis subsp bovis AF2122/97
agugcccagcgaugc

SEQ ID NO: 1130364 - RNA, 18 nt, Mycobacterium bovis subsp bovis AF2122/97
agugccagaacccggaca

SEQ ID NO: 1130365 - RNA, 16 nt, Mycobacterium bovis subsp bovis AF2122/97
agugcccauagccggu

SEQ ID NO: 1130366 - RNA, 14 nt, Mycobacterium bovis subsp bovis AF2122/97
agugcacgucggcg

SEQ ID NO: 1130367 - RNA, 23 nt, Mycobacterium bovis subsp bovis AF2122/97
agugcaagaccgcaucggcagcc

SEQ ID NO: 1130368 - RNA, 14 nt, Mycobacterium bovis subsp bovis AF2122/97
agucguugcgcggu

SEQ ID NO: 1130369 - RNA, 14 nt, Mycobacterium bovis subsp bovis AF2122/97
agugaucaccaacc

SEQ ID NO: 1130370 - RNA, 15 nt, Mycobacterium bovis subsp bovis AF2122/97
agugaucaccaaccc

SEQ ID NO: 1130371 - RNA, 15 nt, Mycobacterium bovis subsp bovis AF2122/97
agugaucggguaccc

SEQ ID NO: 1130372 - RNA, 16 nt, Mycobacterium bovis subsp bovis AF2122/97
aguucacccaucaucg

SEQ ID NO: 1130373 - RNA, 15 nt, Mycobacterium bovis subsp bovis AF2122/97
aguucacgcucgacg

SEQ ID NO: 1130374 - RNA, 23 nt, Mycobacterium bovis subsp bovis AF2122/97
aguuggcugagcagcgcggccag

SEQ ID NO: 1130375 - RNA, 20 nt, Mycobacterium bovis subsp bovis AF2122/97
aguuggccaguaugcggugc

SEQ ID NO: 1130376 - RNA, 13 nt, Mycobacterium bovis subsp bovis AF2122/97
aguuggccgcccg

SEQ ID NO: 1130377 - RNA, 18 nt, Mycobacterium bovis subsp bovis AF2122/97
aguuggcgaccugcgcga

SEQ ID NO: 1130378 - RNA, 21 nt, Mycobacterium bovis subsp bovis AF2122/97
aguuggcgcccgaagccgggc

SEQ ID NO: 1130379 - RNA, 23 nt, Mycobacterium bovis subsp bovis AF2122/97
aguugugcguugcgcugcgcgac

SEQ ID NO: 1130380 - RNA, 18 nt, Mycobacterium bovis subsp bovis AF2122/97
aguuggcaccagccggug

SEQ ID NO: 1130381 - RNA, 17 nt, Mycobacterium bovis subsp bovis AF2122/97
aguuguucgugccggcg

SEQ ID NO: 1130382 - RNA, 20 nt, Mycobacterium bovis subsp bovis AF2122/97
auacaccugcuggaagccgu

SEQ ID NO: 1130383 - RNA, 13 nt, Mycobacterium bovis subsp bovis AF2122/97
auacacggcggcg

SEQ ID NO: 1130384 - RNA, 17 nt, Mycobacterium bovis subsp bovis AF2122/97
auaagguucgugcguug

SEQ ID NO: 1130385 - RNA, 22 nt, Mycobacterium bovis subsp bovis AF2122/97
auaagcccccgcacgcucgccc

SEQ ID NO: 1130386 - RNA, 21 nt, Mycobacterium bovis subsp bovis AF2122/97
auaagcucguagagcaccgca

SEQ ID NO: 1130387 - RNA, 11 nt, Mycobacterium bovis subsp bovis AF2122/97
auacagcgccc

SEQ ID NO: 1130388 - RNA, 20 nt, Mycobacterium bovis subsp bovis AF2122/97
auaccagaccggccgacgug

SEQ ID NO: 1130389 - RNA, 21 nt, Mycobacterium bovis subsp bovis AF2122/97
auacccagcgcagcagcggca

SEQ ID NO: 1130390 - RNA, 20 nt, Mycobacterium bovis subsp bovis AF2122/97
auacccaucaacaucggccc

SEQ ID NO: 1130391 - RNA, 13 nt, Mycobacterium bovis subsp bovis AF2122/97
auagcugccggcc

SEQ ID NO: 1130392 - RNA, 19 nt, Mycobacterium bovis subsp bovis AF2122/97
auagugcggcagcgguggc

SEQ ID NO: 1130393 - RNA, 18 nt, Mycobacterium bovis subsp bovis AF2122/97
auaucauuacucaacagu

SEQ ID NO: 1130394 - RNA, 16 nt, Mycobacterium bovis subsp bovis AF2122/97
auaugcaggacucgcg

SEQ ID NO: 1130395 - RNA, 12 nt, Mycobacterium bovis subsp bovis AF2122/97
auauugcggugc

SEQ ID NO: 1130396 - RNA, 21 nt, Mycobacterium bovis subsp bovis AF2122/97
aucaacggaaugaaggcaccg

SEQ ID NO: 1130397 - RNA, 18 nt, Mycobacterium bovis subsp bovis AF2122/97
aucaaccgcugucaccgu

SEQ ID NO: 1130398 - RNA, 17 nt, Mycobacterium bovis subsp bovis AF2122/97
aucaacccuacccgcau

SEQ ID NO: 1130399 - RNA, 18 nt, Mycobacterium bovis subsp bovis AF2122/97
aucaaccgggucagccca

SEQ ID NO: 1130400 - RNA, 14 nt, Mycobacterium bovis subsp bovis AF2122/97
aucaacaggccucg

SEQ ID NO: 1130401 - RNA, 13 nt, Mycobacterium bovis subsp bovis AF2122/97
aucaaaccggcgg

SEQ ID NO: 1130402 - RNA, 13 nt, Mycobacterium bovis subsp bovis AF2122/97
aucagacgcucga

SEQ ID NO: 1130403 - RNA, 12 nt, Mycobacterium bovis subsp bovis AF2122/97
aucagcaugcgg

SEQ ID NO: 1130404 - RNA, 20 nt, Mycobacterium bovis subsp bovis AF2122/97
aucagacgauucggcggccg

SEQ ID NO: 1130405 - RNA, 20 nt, Mycobacterium bovis subsp bovis AF2122/97
aucagaccaaugaccgccag

SEQ ID NO: 1130406 - RNA, 17 nt, Mycobacterium bovis subsp bovis AF2122/97
aucagccgugcgggccg

SEQ ID NO: 1130407 - RNA, 13 nt, Mycobacterium bovis subsp bovis AF2122/97
aucagccguggca

SEQ ID NO: 1130408 - RNA, 21 nt, Mycobacterium bovis subsp bovis AF2122/97
aucagccguggcagucgcacg

SEQ ID NO: 1130409 - RNA, 23 nt, Mycobacterium bovis subsp bovis AF2122/97
aucagcgaaccaccggcgccgcc

SEQ ID NO: 1130410 - RNA, 19 nt, Mycobacterium bovis subsp bovis AF2122/97
aucagcggcagcaccgcac

SEQ ID NO: 1130411 - RNA, 20 nt, Mycobacterium bovis subsp bovis AF2122/97
aucagccgcgcgccaucgcc

SEQ ID NO: 1130412 - RNA, 23 nt, Mycobacterium bovis subsp bovis AF2122/97
aucagccgccaaccgcaggccga

SEQ ID NO: 1130413 - RNA, 17 nt, Mycobacterium bovis subsp bovis AF2122/97
aucagcccuucagcgaa

SEQ ID NO: 1130414 - RNA, 13 nt, Mycobacterium bovis subsp bovis AF2122/97
aucagcccgccgg

SEQ ID NO: 1130415 - RNA, 18 nt, Mycobacterium bovis subsp bovis AF2122/97
aucacggcggccccggca

SEQ ID NO: 1130416 - RNA, 19 nt, Mycobacterium bovis subsp bovis AF2122/97
aucacgggacgacggcaag

SEQ ID NO: 1130417 - RNA, 21 nt, Mycobacterium bovis subsp bovis AF2122/97
aucacgcugccccgccgccau

SEQ ID NO: 1130418 - RNA, 13 nt, Mycobacterium bovis subsp bovis AF2122/97
aucacggccaacc

SEQ ID NO: 1130419 - RNA, 14 nt, Mycobacterium bovis subsp bovis AF2122/97
aucacggcaccgaa

SEQ ID NO: 1130420 - RNA, 17 nt, Mycobacterium bovis subsp bovis AF2122/97
aucacggcaccgaagug

SEQ ID NO: 1130421 - RNA, 23 nt, Mycobacterium bovis subsp bovis AF2122/97
aucacgccaccauccccggcaac

SEQ ID NO: 1130422 - RNA, 21 nt, Mycobacterium bovis subsp bovis AF2122/97
aucagaacgcggccucgucga

SEQ ID NO: 1130423 - RNA, 19 nt, Mycobacterium bovis subsp bovis AF2122/97
aucaccgugcggucgugcc

SEQ ID NO: 1130424 - RNA, 22 nt, Mycobacterium bovis subsp bovis AF2122/97
aucaccgccuuugccgccggca

SEQ ID NO: 1130425 - RNA, 23 nt, Mycobacterium bovis subsp bovis AF2122/97
aucaccgccuuugccgccggcac

SEQ ID NO: 1130426 - RNA, 22 nt, Mycobacterium bovis subsp bovis AF2122/97
aucaccgcguaguccaggccgu

SEQ ID NO: 1130427 - RNA, 20 nt, Mycobacterium bovis subsp bovis AF2122/97
aucaccggagcgccgagcuc

SEQ ID NO: 1130428 - RNA, 14 nt, Mycobacterium bovis subsp bovis AF2122/97
aucacgccgccgga

SEQ ID NO: 1130429 - RNA, 16 nt, Mycobacterium bovis subsp bovis AF2122/97
aucacgccgccggcga

SEQ ID NO: 1130430 - RNA, 13 nt, Mycobacterium bovis subsp bovis AF2122/97
aucacgccgggcg

SEQ ID NO: 1130431 - RNA, 18 nt, Mycobacterium bovis subsp bovis AF2122/97
aucaccggugcgcuggag

SEQ ID NO: 1130432 - RNA, 11 nt, Mycobacterium bovis subsp bovis AF2122/97
aucaccgucgc

SEQ ID NO: 1130433 - RNA, 14 nt, Mycobacterium bovis subsp bovis AF2122/97
aucaccgucgcccg

SEQ ID NO: 1130434 - RNA, 20 nt, Mycobacterium bovis subsp bovis AF2122/97
aucaccggaacccccagcug

SEQ ID NO: 1130435 - RNA, 16 nt, Mycobacterium bovis subsp bovis AF2122/97
aucaccucaccaguca

SEQ ID NO: 1130436 - RNA, 19 nt, Mycobacterium bovis subsp bovis AF2122/97
aucacgauguccucgaugc

SEQ ID NO: 1130437 - RNA, 20 nt, Mycobacterium bovis subsp bovis AF2122/97
aucacgauguccucgaugcg

SEQ ID NO: 1130438 - RNA, 14 nt, Mycobacterium bovis subsp bovis AF2122/97
aucaccgccggcgg

SEQ ID NO: 1130439 - RNA, 13 nt, Mycobacterium bovis subsp bovis AF2122/97
aucaccgccgcgg

SEQ ID NO: 1130440 - RNA, 17 nt, Mycobacterium bovis subsp bovis AF2122/97
aucaagugcgguccggc

SEQ ID NO: 1130441 - RNA, 21 nt, Mycobacterium bovis subsp bovis AF2122/97
aucaacgcaaugccaaucgca

SEQ ID NO: 1130442 - RNA, 15 nt, Mycobacterium bovis subsp bovis AF2122/97
aucaagggugcgucg

SEQ ID NO: 1130443 - RNA, 15 nt, Mycobacterium bovis subsp bovis AF2122/97
aucaagguguugcgg

SEQ ID NO: 1130444 - RNA, 17 nt, Mycobacterium bovis subsp bovis AF2122/97
aucaguugcacaccgau

SEQ ID NO: 1130445 - RNA, 12 nt, Mycobacterium bovis subsp bovis AF2122/97
aucaguugcccc

SEQ ID NO: 1130446 - RNA, 15 nt, Mycobacterium bovis subsp bovis AF2122/97
aucaguacgcugcgg

SEQ ID NO: 1130447 - RNA, 16 nt, Mycobacterium bovis subsp bovis AF2122/97
aucaguagcagcggcu

SEQ ID NO: 1130448 - RNA, 22 nt, Mycobacterium bovis subsp bovis AF2122/97
aucaggucgucguccuguccgg

SEQ ID NO: 1130449 - RNA, 20 nt, Mycobacterium bovis subsp bovis AF2122/97
aucaggucgccgagaccggc

SEQ ID NO: 1130450 - RNA, 14 nt, Mycobacterium bovis subsp bovis AF2122/97
aucagcuccuccga

SEQ ID NO: 1130451 - RNA, 13 nt, Mycobacterium bovis subsp bovis AF2122/97
aucagcucgaugc

SEQ ID NO: 1130452 - RNA, 15 nt, Mycobacterium bovis subsp bovis AF2122/97
aucagcguggcgccc

SEQ ID NO: 1130453 - RNA, 23 nt, Mycobacterium bovis subsp bovis AF2122/97
aucagcguggcgcccgugccgcc

SEQ ID NO: 1130454 - RNA, 12 nt, Mycobacterium bovis subsp bovis AF2122/97
aucagcggcagu

SEQ ID NO: 1130455 - RNA, 21 nt, Mycobacterium bovis subsp bovis AF2122/97
aucagcgguacguaaucgagc

SEQ ID NO: 1130456 - RNA, 20 nt, Mycobacterium bovis subsp bovis AF2122/97
aucagcuugggcagcagcgc

SEQ ID NO: 1130457 - RNA, 17 nt, Mycobacterium bovis subsp bovis AF2122/97
aucaggcugggcagacc

SEQ ID NO: 1130458 - RNA, 16 nt, Mycobacterium bovis subsp bovis AF2122/97
aucagggcucgcucgc

SEQ ID NO: 1130459 - RNA, 22 nt, Mycobacterium bovis subsp bovis AF2122/97
aucauccuucgccggcgccagc

SEQ ID NO: 1130460 - RNA, 22 nt, Mycobacterium bovis subsp bovis AF2122/97
aucauacgacagcccgccggcg

SEQ ID NO: 1130461 - RNA, 13 nt, Mycobacterium bovis subsp bovis AF2122/97
aucaucagcggcg

SEQ ID NO: 1130462 - RNA, 14 nt, Mycobacterium bovis subsp bovis AF2122/97
aucaucaccggcau

SEQ ID NO: 1130463 - RNA, 22 nt, Mycobacterium bovis subsp bovis AF2122/97
aucaucgcccugggcgccggcg

SEQ ID NO: 1130464 - RNA, 15 nt, Mycobacterium bovis subsp bovis AF2122/97
aucaucgccgcggcc

SEQ ID NO: 1130465 - RNA, 18 nt, Mycobacterium bovis subsp bovis AF2122/97
aucaucgggagccgcacc

SEQ ID NO: 1130466 - RNA, 16 nt, Mycobacterium bovis subsp bovis AF2122/97
aucaucgggguggcca

SEQ ID NO: 1130467 - RNA, 15 nt, Mycobacterium bovis subsp bovis AF2122/97
aucaugagcagcacg

SEQ ID NO: 1130468 - RNA, 13 nt, Mycobacterium bovis subsp bovis AF2122/97
aucaugccggcga

SEQ ID NO: 1130469 - RNA, 17 nt, Mycobacterium bovis subsp bovis AF2122/97
auccggcggcggccagg

SEQ ID NO: 1130470 - RNA, 13 nt, Mycobacterium bovis subsp bovis AF2122/97
auccggccgucgg

SEQ ID NO: 1130471 - RNA, 15 nt, Mycobacterium bovis subsp bovis AF2122/97
auccggcccaccggu

SEQ ID NO: 1130472 - RNA, 19 nt, Mycobacterium bovis subsp bovis AF2122/97
auccgcgguuggcaguggc

SEQ ID NO: 1130473 - RNA, 14 nt, Mycobacterium bovis subsp bovis AF2122/97
auccgcgccgcacc

SEQ ID NO: 1130474 - RNA, 22 nt, Mycobacterium bovis subsp bovis AF2122/97
auccgcgguuggcaguggcgcg

SEQ ID NO: 1130475 - RNA, 22 nt, Mycobacterium bovis subsp bovis AF2122/97
auccgcguggugcugaccgcgc

SEQ ID NO: 1130476 - RNA, 23 nt, Mycobacterium bovis subsp bovis AF2122/97
auccgcguggugcugaccgcgcc

SEQ ID NO: 1130477 - RNA, 15 nt, Mycobacterium bovis subsp bovis AF2122/97
auccgcucacccgcc

SEQ ID NO: 1130478 - RNA, 16 nt, Mycobacterium bovis subsp bovis AF2122/97
auccggcaagccgggg

SEQ ID NO: 1130479 - RNA, 22 nt, Mycobacterium bovis subsp bovis AF2122/97
auccggaguuuaagacgcccga

SEQ ID NO: 1130480 - RNA, 14 nt, Mycobacterium bovis subsp bovis AF2122/97
auccggaucggccu

SEQ ID NO: 1130481 - RNA, 17 nt, Mycobacterium bovis subsp bovis AF2122/97
auccggaucggccuguc

SEQ ID NO: 1130482 - RNA, 19 nt, Mycobacterium bovis subsp bovis AF2122/97
auccgcgggaaguucgccg

SEQ ID NO: 1130483 - RNA, 15 nt, Mycobacterium bovis subsp bovis AF2122/97
auccgcugggccggg

SEQ ID NO: 1130484 - RNA, 17 nt, Mycobacterium bovis subsp bovis AF2122/97
auccgcuuacggguguc

SEQ ID NO: 1130485 - RNA, 13 nt, Mycobacterium bovis subsp bovis AF2122/97
auccgccggcaac

SEQ ID NO: 1130486 - RNA, 20 nt, Mycobacterium bovis subsp bovis AF2122/97
auccgcgcgcauauccgcag

SEQ ID NO: 1130487 - RNA, 14 nt, Mycobacterium bovis subsp bovis AF2122/97
auccgccgccgggu

SEQ ID NO: 1130488 - RNA, 14 nt, Mycobacterium bovis subsp bovis AF2122/97
auccgccccagcug

SEQ ID NO: 1130489 - RNA, 18 nt, Mycobacterium bovis subsp bovis AF2122/97
auccgccccagcugcggu

SEQ ID NO: 1130490 - RNA, 19 nt, Mycobacterium bovis subsp bovis AF2122/97
auccgccccgcccgcaccc

SEQ ID NO: 1130491 - RNA, 14 nt, Mycobacterium bovis subsp bovis AF2122/97
auccgcccgagccg

SEQ ID NO: 1130492 - RNA, 17 nt, Mycobacterium bovis subsp bovis AF2122/97
auccgccagaccgcggc

SEQ ID NO: 1130493 - RNA, 18 nt, Mycobacterium bovis subsp bovis AF2122/97
auccgaccccgcgccgac

SEQ ID NO: 1130494 - RNA, 17 nt, Mycobacterium bovis subsp bovis AF2122/97
auccgacagcagccggu

SEQ ID NO: 1130495 - RNA, 17 nt, Mycobacterium bovis subsp bovis AF2122/97
auccgaagagccagcaa

SEQ ID NO: 1130496 - RNA, 20 nt, Mycobacterium bovis subsp bovis AF2122/97
auccgaucaccucggcgacg

SEQ ID NO: 1130497 - RNA, 15 nt, Mycobacterium bovis subsp bovis AF2122/97
auccgaucacgacgu

SEQ ID NO: 1130498 - RNA, 16 nt, Mycobacterium bovis subsp bovis AF2122/97
auccgagugaucgggu

SEQ ID NO: 1130499 - RNA, 17 nt, Mycobacterium bovis subsp bovis AF2122/97
auccgaguugucgccgg

SEQ ID NO: 1130500 - RNA, 14 nt, Mycobacterium bovis subsp bovis AF2122/97
auccgacgaccgca

SEQ ID NO: 1130501 - RNA, 22 nt, Mycobacterium bovis subsp bovis AF2122/97
auccgacgggauagacgacccc

SEQ ID NO: 1130502 - RNA, 14 nt, Mycobacterium bovis subsp bovis AF2122/97
auccgagaccgcgu

SEQ ID NO: 1130503 - RNA, 14 nt, Mycobacterium bovis subsp bovis AF2122/97
auccgagcgcggcg

SEQ ID NO: 1130504 - RNA, 20 nt, Mycobacterium bovis subsp bovis AF2122/97
auccgcaccacgcccgacga

SEQ ID NO: 1130505 - RNA, 19 nt, Mycobacterium bovis subsp bovis AF2122/97
auccgcaguccggggcgca

SEQ ID NO: 1130506 - RNA, 12 nt, Mycobacterium bovis subsp bovis AF2122/97
auccgauccgca

SEQ ID NO: 1130507 - RNA, 13 nt, Mycobacterium bovis subsp bovis AF2122/97
auccgaucgccgc

SEQ ID NO: 1130508 - RNA, 15 nt, Mycobacterium bovis subsp bovis AF2122/97
auccgcaacaacgcc

SEQ ID NO: 1130509 - RNA, 18 nt, Mycobacterium bovis subsp bovis AF2122/97
auccgcaacagcucggcc

SEQ ID NO: 1130510 - RNA, 19 nt, Mycobacterium bovis subsp bovis AF2122/97
auccgcaacagcucggcca

SEQ ID NO: 1130511 - RNA, 21 nt, Mycobacterium bovis subsp bovis AF2122/97
auccgcaacagcucggccagg

SEQ ID NO: 1130512 - RNA, 15 nt, Mycobacterium bovis subsp bovis AF2122/97
auccgcacagcgacg

SEQ ID NO: 1130513 - RNA, 16 nt, Mycobacterium bovis subsp bovis AF2122/97
auccggugccgcgauc

SEQ ID NO: 1130514 - RNA, 19 nt, Mycobacterium bovis subsp bovis AF2122/97
auccggugccgcgaucgcg

SEQ ID NO: 1130515 - RNA, 20 nt, Mycobacterium bovis subsp bovis AF2122/97
auccggucggccaggccguc

SEQ ID NO: 1130516 - RNA, 19 nt, Mycobacterium bovis subsp bovis AF2122/97
auccggucuccgcugauga

SEQ ID NO: 1130517 - RNA, 21 nt, Mycobacterium bovis subsp bovis AF2122/97
auccggucccgccgugccgcg

SEQ ID NO: 1130518 - RNA, 19 nt, Mycobacterium bovis subsp bovis AF2122/97
auccggucgaugaccucgu

SEQ ID NO: 1130519 - RNA, 20 nt, Mycobacterium bovis subsp bovis AF2122/97
auccggucgaugaccucguc

SEQ ID NO: 1130520 - RNA, 19 nt, Mycobacterium bovis subsp bovis AF2122/97
auccggucgaugucagcca

SEQ ID NO: 1130521 - RNA, 17 nt, Mycobacterium bovis subsp bovis AF2122/97
auccgggucaguaggcg

SEQ ID NO: 1130522 - RNA, 22 nt, Mycobacterium bovis subsp bovis AF2122/97
auccgggugagcuacucacggu

SEQ ID NO: 1130523 - RNA, 22 nt, Mycobacterium bovis subsp bovis AF2122/97
auccggguggcgucaccgccgg

SEQ ID NO: 1130524 - RNA, 14 nt, Mycobacterium bovis subsp bovis AF2122/97
auccggucagcgcg

SEQ ID NO: 1130525 - RNA, 15 nt, Mycobacterium bovis subsp bovis AF2122/97
auccggcucgguggc

SEQ ID NO: 1130526 - RNA, 14 nt, Mycobacterium bovis subsp bovis AF2122/97
auccggcugccguc

SEQ ID NO: 1130527 - RNA, 22 nt, Mycobacterium bovis subsp bovis AF2122/97
auccggcgggugccgagcuggc

SEQ ID NO: 1130528 - RNA, 22 nt, Mycobacterium bovis subsp bovis AF2122/97
auccgggagugcgccggcuggc

SEQ ID NO: 1130529 - RNA, 15 nt, Mycobacterium bovis subsp bovis AF2122/97
auccgggcaaccgau

SEQ ID NO: 1130530 - RNA, 22 nt, Mycobacterium bovis subsp bovis AF2122/97
auccgggcaaccgaugacgcgu

SEQ ID NO: 1130531 - RNA, 16 nt, Mycobacterium bovis subsp bovis AF2122/97
auccgucccaggugca

SEQ ID NO: 1130532 - RNA, 16 nt, Mycobacterium bovis subsp bovis AF2122/97
auccgucgcguugagc

SEQ ID NO: 1130533 - RNA, 16 nt, Mycobacterium bovis subsp bovis AF2122/97
auccgucggcggagag

SEQ ID NO: 1130534 - RNA, 22 nt, Mycobacterium bovis subsp bovis AF2122/97
auccgugaaucgagcaccgcaa

SEQ ID NO: 1130535 - RNA, 17 nt, Mycobacterium bovis subsp bovis AF2122/97
auccgugaauggcagca

SEQ ID NO: 1130536 - RNA, 20 nt, Mycobacterium bovis subsp bovis AF2122/97
auccggucuccgcugaugag

SEQ ID NO: 1130537 - RNA, 18 nt, Mycobacterium bovis subsp bovis AF2122/97
auccgguggugcucgucg

SEQ ID NO: 1130538 - RNA, 20 nt, Mycobacterium bovis subsp bovis AF2122/97
auccgguguugagaucgccc

SEQ ID NO: 1130539 - RNA, 17 nt, Mycobacterium bovis subsp bovis AF2122/97
auccgguucgccgccgu

SEQ ID NO: 1130540 - RNA, 18 nt, Mycobacterium bovis subsp bovis AF2122/97
auccgguucgccgccguu

SEQ ID NO: 1130541 - RNA, 14 nt, Mycobacterium bovis subsp bovis AF2122/97
auccgugcagggca

SEQ ID NO: 1130542 - RNA, 23 nt, Mycobacterium bovis subsp bovis AF2122/97
auccguguuucgaacaccgucca

SEQ ID NO: 1130543 - RNA, 20 nt, Mycobacterium bovis subsp bovis AF2122/97
auccgugccgaaaaucgcag

SEQ ID NO: 1130544 - RNA, 22 nt, Mycobacterium bovis subsp bovis AF2122/97
auccgugccgaaaaucgcagcc

SEQ ID NO: 1130545 - RNA, 20 nt, Mycobacterium bovis subsp bovis AF2122/97
auccguguuucgaacaccgu

SEQ ID NO: 1130546 - RNA, 17 nt, Mycobacterium bovis subsp bovis AF2122/97
auccuccucgucgacgu

SEQ ID NO: 1130547 - RNA, 18 nt, Mycobacterium bovis subsp bovis AF2122/97
auccucgacuucggcggg

SEQ ID NO: 1130548 - RNA, 22 nt, Mycobacterium bovis subsp bovis AF2122/97
auccucgaugacaucggucagc

SEQ ID NO: 1130549 - RNA, 14 nt, Mycobacterium bovis subsp bovis AF2122/97
auccuggccgccgc

SEQ ID NO: 1130550 - RNA, 16 nt, Mycobacterium bovis subsp bovis AF2122/97
auccugcacgacccgc

SEQ ID NO: 1130551 - RNA, 18 nt, Mycobacterium bovis subsp bovis AF2122/97
auccugggugucgcgggu

SEQ ID NO: 1130552 - RNA, 19 nt, Mycobacterium bovis subsp bovis AF2122/97
auccugguaaggccggccg

SEQ ID NO: 1130553 - RNA, 23 nt, Mycobacterium bovis subsp bovis AF2122/97
auccuugaucaaggugucgacgg

SEQ ID NO: 1130554 - RNA, 18 nt, Mycobacterium bovis subsp bovis AF2122/97
auccuugccaaucgccgu

SEQ ID NO: 1130555 - RNA, 17 nt, Mycobacterium bovis subsp bovis AF2122/97
auccagggugccgguca

SEQ ID NO: 1130556 - RNA, 16 nt, Mycobacterium bovis subsp bovis AF2122/97
auccaggccaccccga

SEQ ID NO: 1130557 - RNA, 15 nt, Mycobacterium bovis subsp bovis AF2122/97
auccagggagcggcu

SEQ ID NO: 1130558 - RNA, 14 nt, Mycobacterium bovis subsp bovis AF2122/97
auccagcgccgacc

SEQ ID NO: 1130559 - RNA, 17 nt, Mycobacterium bovis subsp bovis AF2122/97
auccagcccaucccgau

SEQ ID NO: 1130560 - RNA, 22 nt, Mycobacterium bovis subsp bovis AF2122/97
auccagaucggauugccuccgg

SEQ ID NO: 1130561 - RNA, 15 nt, Mycobacterium bovis subsp bovis AF2122/97
auccagcaacgcggu

SEQ ID NO: 1130562 - RNA, 21 nt, Mycobacterium bovis subsp bovis AF2122/97
auccagaccaugcgcagagua

SEQ ID NO: 1130563 - RNA, 15 nt, Mycobacterium bovis subsp bovis AF2122/97
auccacgucgcccag

SEQ ID NO: 1130564 - RNA, 13 nt, Mycobacterium bovis subsp bovis AF2122/97
auccacgucgcgg

SEQ ID NO: 1130565 - RNA, 15 nt, Mycobacterium bovis subsp bovis AF2122/97
auccacgucgcggcg

SEQ ID NO: 1130566 - RNA, 14 nt, Mycobacterium bovis subsp bovis AF2122/97
auccacuccggcga

SEQ ID NO: 1130567 - RNA, 12 nt, Mycobacterium bovis subsp bovis AF2122/97
auccacggcgau

SEQ ID NO: 1130568 - RNA, 13 nt, Mycobacterium bovis subsp bovis AF2122/97
auccacggagacc

SEQ ID NO: 1130569 - RNA, 18 nt, Mycobacterium bovis subsp bovis AF2122/97
auccagaacgcaucgguc

SEQ ID NO: 1130570 - RNA, 12 nt, Mycobacterium bovis subsp bovis AF2122/97
auccacugccgc

SEQ ID NO: 1130571 - RNA, 13 nt, Mycobacterium bovis subsp bovis AF2122/97
auccacugcggcg

SEQ ID NO: 1130572 - RNA, 18 nt, Mycobacterium bovis subsp bovis AF2122/97
auccacuucagcacccgg

SEQ ID NO: 1130573 - RNA, 21 nt, Mycobacterium bovis subsp bovis AF2122/97
auccacuuccgggcgaccaac

SEQ ID NO: 1130574 - RNA, 12 nt, Mycobacterium bovis subsp bovis AF2122/97
auccacgccgac

SEQ ID NO: 1130575 - RNA, 13 nt, Mycobacterium bovis subsp bovis AF2122/97
auccacgccgacc

SEQ ID NO: 1130576 - RNA, 19 nt, Mycobacterium bovis subsp bovis AF2122/97
auccacccauagacccggc

SEQ ID NO: 1130577 - RNA, 13 nt, Mycobacterium bovis subsp bovis AF2122/97
auccaccgcagau

SEQ ID NO: 1130578 - RNA, 20 nt, Mycobacterium bovis subsp bovis AF2122/97
auccacaggcugaagacgaa

SEQ ID NO: 1130579 - RNA, 22 nt, Mycobacterium bovis subsp bovis AF2122/97
auccaccagcuggugagccaga

SEQ ID NO: 1130580 - RNA, 19 nt, Mycobacterium bovis subsp bovis AF2122/97
auccacaauccgcucgguc

SEQ ID NO: 1130581 - RNA, 14 nt, Mycobacterium bovis subsp bovis AF2122/97
auccacaccgcggc

SEQ ID NO: 1130582 - RNA, 16 nt, Mycobacterium bovis subsp bovis AF2122/97
auccacaccgcggcgg

SEQ ID NO: 1130583 - RNA, 14 nt, Mycobacterium bovis subsp bovis AF2122/97
auccaacuggccgc

SEQ ID NO: 1130584 - RNA, 16 nt, Mycobacterium bovis subsp bovis AF2122/97
auccaacuggccgcgu

SEQ ID NO: 1130585 - RNA, 18 nt, Mycobacterium bovis subsp bovis AF2122/97
aucauugcaugguuucgu

SEQ ID NO: 1130586 - RNA, 14 nt, Mycobacterium bovis subsp bovis AF2122/97
aucaugugcgcgac

SEQ ID NO: 1130587 - RNA, 19 nt, Mycobacterium bovis subsp bovis AF2122/97
aucaugucgaagaaccggc

SEQ ID NO: 1130588 - RNA, 23 nt, Mycobacterium bovis subsp bovis AF2122/97
aucaugucgaagaaccggccgac

SEQ ID NO: 1130589 - RNA, 14 nt, Mycobacterium bovis subsp bovis AF2122/97
aucaugucggccgg

SEQ ID NO: 1130590 - RNA, 14 nt, Mycobacterium bovis subsp bovis AF2122/97
aucaugucggcgca

SEQ ID NO: 1130591 - RNA, 19 nt, Mycobacterium bovis subsp bovis AF2122/97
aucaugucggcgcaggcgu

SEQ ID NO: 1130592 - RNA, 12 nt, Mycobacterium bovis subsp bovis AF2122/97
aucauguucggc

SEQ ID NO: 1130593 - RNA, 16 nt, Mycobacterium bovis subsp bovis AF2122/97
aucccgccgcccgcau

SEQ ID NO: 1130594 - RNA, 22 nt, Mycobacterium bovis subsp bovis AF2122/97
aucccgccgcccgcaucgcggc

SEQ ID NO: 1130595 - RNA, 11 nt, Mycobacterium bovis subsp bovis AF2122/97
aucccgcccaa

SEQ ID NO: 1130596 - RNA, 19 nt, Mycobacterium bovis subsp bovis AF2122/97
aucccgccccgggccacca

SEQ ID NO: 1130597 - RNA, 14 nt, Mycobacterium bovis subsp bovis AF2122/97
aucccgaucccggc

SEQ ID NO: 1130598 - RNA, 22 nt, Mycobacterium bovis subsp bovis AF2122/97
aucccgccggggcccugggaga

SEQ ID NO: 1130599 - RNA, 23 nt, Mycobacterium bovis subsp bovis AF2122/97
aucccgccgcccgcaucgcggca

SEQ ID NO: 1130600 - RNA, 17 nt, Mycobacterium bovis subsp bovis AF2122/97
aucccgcgcccggccgg

SEQ ID NO: 1130601 - RNA, 23 nt, Mycobacterium bovis subsp bovis AF2122/97
auccccuggccagcagagcggca

SEQ ID NO: 1130602 - RNA, 18 nt, Mycobacterium bovis subsp bovis AF2122/97
aucccgaccaccucagcu

SEQ ID NO: 1130603 - RNA, 20 nt, Mycobacterium bovis subsp bovis AF2122/97
aucccgauguaccccagcgc

SEQ ID NO: 1130604 - RNA, 14 nt, Mycobacterium bovis subsp bovis AF2122/97
aucccgaggcgccc

SEQ ID NO: 1130605 - RNA, 20 nt, Mycobacterium bovis subsp bovis AF2122/97
aucccgccaccgaacagucg

SEQ ID NO: 1130606 - RNA, 15 nt, Mycobacterium bovis subsp bovis AF2122/97
aucccgucccagcug

SEQ ID NO: 1130607 - RNA, 15 nt, Mycobacterium bovis subsp bovis AF2122/97
aucccguccgcgccc

SEQ ID NO: 1130608 - RNA, 14 nt, Mycobacterium bovis subsp bovis AF2122/97
aucccucggccgca

SEQ ID NO: 1130609 - RNA, 14 nt, Mycobacterium bovis subsp bovis AF2122/97
aucccucaaggucu

SEQ ID NO: 1130610 - RNA, 21 nt, Mycobacterium bovis subsp bovis AF2122/97
aucccuccgccaaggaggcca

SEQ ID NO: 1130611 - RNA, 16 nt, Mycobacterium bovis subsp bovis AF2122/97
aucccugugccagcag

SEQ ID NO: 1130612 - RNA, 22 nt, Mycobacterium bovis subsp bovis AF2122/97
aucccugugccagcagcagcgc

SEQ ID NO: 1130613 - RNA, 23 nt, Mycobacterium bovis subsp bovis AF2122/97
aucccugaaauaccaguccggcg

SEQ ID NO: 1130614 - RNA, 20 nt, Mycobacterium bovis subsp bovis AF2122/97
aucccggcgagcacccgcug

SEQ ID NO: 1130615 - RNA, 16 nt, Mycobacterium bovis subsp bovis AF2122/97
aucccggccgggucga

SEQ ID NO: 1130616 - RNA, 17 nt, Mycobacterium bovis subsp bovis AF2122/97
aucccggccgucgccgg

SEQ ID NO: 1130617 - RNA, 14 nt, Mycobacterium bovis subsp bovis AF2122/97
aucccggaacgccg

SEQ ID NO: 1130618 - RNA, 16 nt, Mycobacterium bovis subsp bovis AF2122/97
aucccggccaggccga

SEQ ID NO: 1130619 - RNA, 20 nt, Mycobacterium bovis subsp bovis AF2122/97
aucccgguuccggcgaucaa

SEQ ID NO: 1130620 - RNA, 20 nt, Mycobacterium bovis subsp bovis AF2122/97
aucccccgacacgccgaacg

SEQ ID NO: 1130621 - RNA, 17 nt, Mycobacterium bovis subsp bovis AF2122/97
aucccccagccgcggcg

SEQ ID NO: 1130622 - RNA, 14 nt, Mycobacterium bovis subsp bovis AF2122/97
aucccccaggcgaa

SEQ ID NO: 1130623 - RNA, 12 nt, Mycobacterium bovis subsp bovis AF2122/97
auccccgccacc

SEQ ID NO: 1130624 - RNA, 15 nt, Mycobacterium bovis subsp bovis AF2122/97
auccccgguacgucg

SEQ ID NO: 1130625 - RNA, 21 nt, Mycobacterium bovis subsp bovis AF2122/97
auccccgacugaacauacgaa

SEQ ID NO: 1130626 - RNA, 14 nt, Mycobacterium bovis subsp bovis AF2122/97
aucccacgcccggc

SEQ ID NO: 1130627 - RNA, 22 nt, Mycobacterium bovis subsp bovis AF2122/97
aucccacgcccggccccgcggc

SEQ ID NO: 1130628 - RNA, 23 nt, Mycobacterium bovis subsp bovis AF2122/97
aucccacgcccggccccgcggcc

SEQ ID NO: 1130629 - RNA, 22 nt, Mycobacterium bovis subsp bovis AF2122/97
aucccagugccagugccagcgu

SEQ ID NO: 1130630 - RNA, 15 nt, Mycobacterium bovis subsp bovis AF2122/97
auccccaagcccgau

SEQ ID NO: 1130631 - RNA, 19 nt, Mycobacterium bovis subsp bovis AF2122/97
auccaguaaccguccgcgg

SEQ ID NO: 1130632 - RNA, 16 nt, Mycobacterium bovis subsp bovis AF2122/97
auccaguucaccgcgc

SEQ ID NO: 1130633 - RNA, 15 nt, Mycobacterium bovis subsp bovis AF2122/97
auccaucugugcgcg

SEQ ID NO: 1130634 - RNA, 17 nt, Mycobacterium bovis subsp bovis AF2122/97
auccauguugaccucgc

SEQ ID NO: 1130635 - RNA, 16 nt, Mycobacterium bovis subsp bovis AF2122/97
auccaugucgcgccag

SEQ ID NO: 1130636 - RNA, 23 nt, Mycobacterium bovis subsp bovis AF2122/97
auccauuagcacaucgccggagu

SEQ ID NO: 1130637 - RNA, 12 nt, Mycobacterium bovis subsp bovis AF2122/97
caccggugucgg

SEQ ID NO: 1130638 - RNA, 17 nt, Mycobacterium bovis subsp bovis AF2122/97
caccggugucggccagc

SEQ ID NO: 1130639 - RNA, 18 nt, Mycobacterium bovis subsp bovis AF2122/97
caccggugucggccagca

SEQ ID NO: 1130640 - RNA, 20 nt, Mycobacterium bovis subsp bovis AF2122/97
caccggugucggccagcaac

SEQ ID NO: 1130641 - RNA, 16 nt, Mycobacterium bovis subsp bovis AF2122/97
caccggugucuucugc

SEQ ID NO: 1130642 - RNA, 12 nt, Mycobacterium bovis subsp bovis AF2122/97
caccgguggcgc

SEQ ID NO: 1130643 - RNA, 15 nt, Mycobacterium bovis subsp bovis AF2122/97
caccgguggcgcccu

SEQ ID NO: 1130644 - RNA, 19 nt, Mycobacterium bovis subsp bovis AF2122/97
caccgguggacccggcggu

SEQ ID NO: 1130645 - RNA, 14 nt, Mycobacterium bovis subsp bovis AF2122/97
caccggugcucguc

SEQ ID NO: 1130646 - RNA, 15 nt, Mycobacterium bovis subsp bovis AF2122/97
caccggugccggcga

SEQ ID NO: 1130647 - RNA, 16 nt, Mycobacterium bovis subsp bovis AF2122/97
caccgguuucgucggu

SEQ ID NO: 1130648 - RNA, 19 nt, Mycobacterium bovis subsp bovis AF2122/97
caccggucagcgacgcacg

SEQ ID NO: 1130649 - RNA, 19 nt, Mycobacterium bovis subsp bovis AF2122/97
caccgguuugacguccagg

SEQ ID NO: 1130650 - RNA, 18 nt, Mycobacterium bovis subsp bovis AF2122/97
caccguaaacagcgcgcc

SEQ ID NO: 1130651 - RNA, 22 nt, Mycobacterium bovis subsp bovis AF2122/97
caccguagagcaugccgcccgc

SEQ ID NO: 1130652 - RNA, 14 nt, Mycobacterium bovis subsp bovis AF2122/97
caccguagccagca

SEQ ID NO: 1130653 - RNA, 22 nt, Mycobacterium bovis subsp bovis AF2122/97
caccgucaccgccggcaccgcc

SEQ ID NO: 1130654 - RNA, 18 nt, Mycobacterium bovis subsp bovis AF2122/97
caccgucaccgccgucac

SEQ ID NO: 1130655 - RNA, 23 nt, Mycobacterium bovis subsp bovis AF2122/97
caccgucgcccggguggcgucga

SEQ ID NO: 1130656 - RNA, 14 nt, Mycobacterium bovis subsp bovis AF2122/97
caccgucaccgccg

SEQ ID NO: 1130657 - RNA, 13 nt, Mycobacterium bovis subsp bovis AF2122/97
caccgucaccgcc

SEQ ID NO: 1130658 - RNA, 22 nt, Mycobacterium bovis subsp bovis AF2122/97
caccguaggcgaucucacgcau

SEQ ID NO: 1130659 - RNA, 21 nt, Mycobacterium bovis subsp bovis AF2122/97
caccguaguaguucagccagg

SEQ ID NO: 1130660 - RNA, 24 nt, Mycobacterium bovis subsp bovis AF2122/97
caccguaguaguucagccaggccg

SEQ ID NO: 1130661 - RNA, 15 nt, Mycobacterium bovis subsp bovis AF2122/97
caccguaccgacgaa

SEQ ID NO: 1130662 - RNA, 16 nt, Mycobacterium bovis subsp bovis AF2122/97
caccguagccgcugca

SEQ ID NO: 1130663 - RNA, 19 nt, Mycobacterium bovis subsp bovis AF2122/97
caccgggaagucggggucg

SEQ ID NO: 1130664 - RNA, 18 nt, Mycobacterium bovis subsp bovis AF2122/97
caccgggauagccgcgac

SEQ ID NO: 1130665 - RNA, 20 nt, Mycobacterium bovis subsp bovis AF2122/97
caccgggauagccgcgacca

SEQ ID NO: 1130666 - RNA, 18 nt, Mycobacterium bovis subsp bovis AF2122/97
caccgggaugugcggcug

SEQ ID NO: 1130667 - RNA, 23 nt, Mycobacterium bovis subsp bovis AF2122/97
caccgggaugugcggcugcaccg

SEQ ID NO: 1130668 - RNA, 14 nt, Mycobacterium bovis subsp bovis AF2122/97
caccgggcaccagu

SEQ ID NO: 1130669 - RNA, 15 nt, Mycobacterium bovis subsp bovis AF2122/97
caccgggcaccaguc

SEQ ID NO: 1130670 - RNA, 17 nt, Mycobacterium bovis subsp bovis AF2122/97
caccgguaccgccacuu

SEQ ID NO: 1130671 - RNA, 18 nt, Mycobacterium bovis subsp bovis AF2122/97
caccggugaaacgaucgu

SEQ ID NO: 1130672 - RNA, 21 nt, Mycobacterium bovis subsp bovis AF2122/97
caccggugaaacgaucgugcg

SEQ ID NO: 1130673 - RNA, 14 nt, Mycobacterium bovis subsp bovis AF2122/97
caccggucggcagc

SEQ ID NO: 1130674 - RNA, 13 nt, Mycobacterium bovis subsp bovis AF2122/97
caccggucagcga

SEQ ID NO: 1130675 - RNA, 23 nt, Mycobacterium bovis subsp bovis AF2122/97
caccggugacgcacagcagcacc

SEQ ID NO: 1130676 - RNA, 21 nt, Mycobacterium bovis subsp bovis AF2122/97
caccggugauggugaccagca

SEQ ID NO: 1130677 - RNA, 23 nt, Mycobacterium bovis subsp bovis AF2122/97
caccggugauggugaccagcagg

SEQ ID NO: 1130678 - RNA, 13 nt, Mycobacterium bovis subsp bovis AF2122/97
caccggugccgcc

SEQ ID NO: 1130679 - RNA, 22 nt, Mycobacterium bovis subsp bovis AF2122/97
caccggugccgcccgcgccgcc

SEQ ID NO: 1130680 - RNA, 14 nt, Mycobacterium bovis subsp bovis AF2122/97
caccggugccgccg

SEQ ID NO: 1130681 - RNA, 16 nt, Mycobacterium bovis subsp bovis AF2122/97
caccgguccagcgccg

SEQ ID NO: 1130682 - RNA, 12 nt, Mycobacterium bovis subsp bovis AF2122/97
caccgguccagg

SEQ ID NO: 1130683 - RNA, 17 nt, Mycobacterium bovis subsp bovis AF2122/97
caccggucccugcgccg

SEQ ID NO: 1130684 - RNA, 20 nt, Mycobacterium bovis subsp bovis AF2122/97
caccggucccugcgccguca

SEQ ID NO: 1130685 - RNA, 15 nt, Mycobacterium bovis subsp bovis AF2122/97
caccggucgccgcga

SEQ ID NO: 1130686 - RNA, 16 nt, Mycobacterium bovis subsp bovis AF2122/97
caccggucgccgcgaa

SEQ ID NO: 1130687 - RNA, 13 nt, Mycobacterium bovis subsp bovis AF2122/97
caccggucaccgc

SEQ ID NO: 1130688 - RNA, 14 nt, Mycobacterium bovis subsp bovis AF2122/97
caccggucaccgcg

SEQ ID NO: 1130689 - RNA, 16 nt, Mycobacterium bovis subsp bovis AF2122/97
caccgguacugcgaug

SEQ ID NO: 1130690 - RNA, 16 nt, Mycobacterium bovis subsp bovis AF2122/97
caccggcucgucgaug

SEQ ID NO: 1130691 - RNA, 19 nt, Mycobacterium bovis subsp bovis AF2122/97
caccggcugaccgacccgg

SEQ ID NO: 1130692 - RNA, 21 nt, Mycobacterium bovis subsp bovis AF2122/97
caccggcugcaaccagcggca

SEQ ID NO: 1130693 - RNA, 17 nt, Mycobacterium bovis subsp bovis AF2122/97
caccggcugcaaccagc

SEQ ID NO: 1130694 - RNA, 19 nt, Mycobacterium bovis subsp bovis AF2122/97
caccggcugcaaccagcgg

SEQ ID NO: 1130695 - RNA, 21 nt, Mycobacterium bovis subsp bovis AF2122/97
caccggcguucaccugcgucg

SEQ ID NO: 1130696 - RNA, 21 nt, Mycobacterium bovis subsp bovis AF2122/97
caccggcuauaucccgccccg

SEQ ID NO: 1130697 - RNA, 17 nt, Mycobacterium bovis subsp bovis AF2122/97
caccggcuaugcuggcg

SEQ ID NO: 1130698 - RNA, 16 nt, Mycobacterium bovis subsp bovis AF2122/97
caccggcgucgacguc

SEQ ID NO: 1130699 - RNA, 17 nt, Mycobacterium bovis subsp bovis AF2122/97
caccggcgucgacgucg

SEQ ID NO: 1130700 - RNA, 17 nt, Mycobacterium bovis subsp bovis AF2122/97
caccggcgucggcgcgg

SEQ ID NO: 1130701 - RNA, 19 nt, Mycobacterium bovis subsp bovis AF2122/97
caccggcgucggcgcggcc

SEQ ID NO: 1130702 - RNA, 20 nt, Mycobacterium bovis subsp bovis AF2122/97
caccggcgucggcgcggccg

SEQ ID NO: 1130703 - RNA, 19 nt, Mycobacterium bovis subsp bovis AF2122/97
caccggcuggugccaacug

SEQ ID NO: 1130704 - RNA, 17 nt, Mycobacterium bovis subsp bovis AF2122/97
caccggcuggugccaac

SEQ ID NO: 1130705 - RNA, 17 nt, Mycobacterium bovis subsp bovis AF2122/97
caccggcuugggccagg

SEQ ID NO: 1130706 - RNA, 20 nt, Mycobacterium bovis subsp bovis AF2122/97
caccggcuuggugaaccgcg

SEQ ID NO: 1130707 - RNA, 14 nt, Mycobacterium bovis subsp bovis AF2122/97
caccggcggcccca

SEQ ID NO: 1130708 - RNA, 15 nt, Mycobacterium bovis subsp bovis AF2122/97
caccggcggcgacgg

SEQ ID NO: 1130709 - RNA, 14 nt, Mycobacterium bovis subsp bovis AF2122/97
caccggcgucgacg

SEQ ID NO: 1130710 - RNA, 15 nt, Mycobacterium bovis subsp bovis AF2122/97
caccggcgucgacgu

SEQ ID NO: 1130711 - RNA, 20 nt, Mycobacterium bovis subsp bovis AF2122/97
caccggcggugccgguggug

SEQ ID NO: 1130712 - RNA, 13 nt, Mycobacterium bovis subsp bovis AF2122/97
caccggcgucgaa

SEQ ID NO: 1130713 - RNA, 14 nt, Mycobacterium bovis subsp bovis AF2122/97
caccggcgucgaag

SEQ ID NO: 1130714 - RNA, 19 nt, Mycobacterium bovis subsp bovis AF2122/97
caccggcgcgaccgcggcg

SEQ ID NO: 1130715 - RNA, 12 nt, Mycobacterium bovis subsp bovis AF2122/97
caccggcgucga

SEQ ID NO: 1130716 - RNA, 14 nt, Mycobacterium bovis subsp bovis AF2122/97
caccggagccgaac

SEQ ID NO: 1130717 - RNA, 15 nt, Mycobacterium bovis subsp bovis AF2122/97
caccggacugcgccg

SEQ ID NO: 1130718 - RNA, 15 nt, Mycobacterium bovis subsp bovis AF2122/97
caccggaggccgccg

SEQ ID NO: 1130719 - RNA, 15 nt, Mycobacterium bovis subsp bovis AF2122/97
caccggagcgccgag

SEQ ID NO: 1130720 - RNA, 14 nt, Mycobacterium bovis subsp bovis AF2122/97
caccggcgcgaccg

SEQ ID NO: 1130721 - RNA, 16 nt, Mycobacterium bovis subsp bovis AF2122/97
caccggcgcgaccgcg

SEQ ID NO: 1130722 - RNA, 17 nt, Mycobacterium bovis subsp bovis AF2122/97
caccggcgcgaccgcgg

SEQ ID NO: 1130723 - RNA, 23 nt, Mycobacterium bovis subsp bovis AF2122/97
caccggaauccuggccgccgccc

SEQ ID NO: 1130724 - RNA, 19 nt, Mycobacterium bovis subsp bovis AF2122/97
caccggaccaccgccgaag

SEQ ID NO: 1130725 - RNA, 15 nt, Mycobacterium bovis subsp bovis AF2122/97
caccggaccgaccac

SEQ ID NO: 1130726 - RNA, 19 nt, Mycobacterium bovis subsp bovis AF2122/97
caccggaacccccagcugc

SEQ ID NO: 1130727 - RNA, 16 nt, Mycobacterium bovis subsp bovis AF2122/97
caccggaacgccgucg

SEQ ID NO: 1130728 - RNA, 20 nt, Mycobacterium bovis subsp bovis AF2122/97
caccggaacgccgucgagca

SEQ ID NO: 1130729 - RNA, 13 nt, Mycobacterium bovis subsp bovis AF2122/97
caccuccgcgacg

SEQ ID NO: 1130730 - RNA, 18 nt, Mycobacterium bovis subsp bovis AF2122/97
caccuccgcgacggcggc

SEQ ID NO: 1130731 - RNA, 15 nt, Mycobacterium bovis subsp bovis AF2122/97
caccuccugguugac

SEQ ID NO: 1130732 - RNA, 23 nt, Mycobacterium bovis subsp bovis AF2122/97
caccuccgacggccgcggcgucg

SEQ ID NO: 1130733 - RNA, 16 nt, Mycobacterium bovis subsp bovis AF2122/97
caccuccgaggccgcc

SEQ ID NO: 1130734 - RNA, 17 nt, Mycobacterium bovis subsp bovis AF2122/97
caccuccgaggccgcca

SEQ ID NO: 1130735 - RNA, 17 nt, Mycobacterium bovis subsp bovis AF2122/97
caccucccgcggcaccu

SEQ ID NO: 1130736 - RNA, 14 nt, Mycobacterium bovis subsp bovis AF2122/97
caccucccgggcga

SEQ ID NO: 1130737 - RNA, 18 nt, Mycobacterium bovis subsp bovis AF2122/97
caccguggcggaucgcga

SEQ ID NO: 1130738 - RNA, 22 nt, Mycobacterium bovis subsp bovis AF2122/97
caccgugggguaucgccagcca

SEQ ID NO: 1130739 - RNA, 20 nt, Mycobacterium bovis subsp bovis AF2122/97
caccgugggccugcccggcg

SEQ ID NO: 1130740 - RNA, 23 nt, Mycobacterium bovis subsp bovis AF2122/97
caccgugggccugcccggcgccg

SEQ ID NO: 1130741 - RNA, 16 nt, Mycobacterium bovis subsp bovis AF2122/97
caccgugggcggaacg

SEQ ID NO: 1130742 - RNA, 16 nt, Mycobacterium bovis subsp bovis AF2122/97
caccucgcccucccgg

SEQ ID NO: 1130743 - RNA, 14 nt, Mycobacterium bovis subsp bovis AF2122/97
caccucgccaucga

SEQ ID NO: 1130744 - RNA, 17 nt, Mycobacterium bovis subsp bovis AF2122/97
caccucgaugccgcccg

SEQ ID NO: 1130745 - RNA, 19 nt, Mycobacterium bovis subsp bovis AF2122/97
caccucgagcgcggcgauc

SEQ ID NO: 1130746 - RNA, 20 nt, Mycobacterium bovis subsp bovis AF2122/97
caccucgagcguggcaacga

SEQ ID NO: 1130747 - RNA, 17 nt, Mycobacterium bovis subsp bovis AF2122/97
caccucgaaggcccgcu

SEQ ID NO: 1130748 - RNA, 15 nt, Mycobacterium bovis subsp bovis AF2122/97
caccucgaucgcgcc

SEQ ID NO: 1130749 - RNA, 19 nt, Mycobacterium bovis subsp bovis AF2122/97
caccucgaucgcgccgucg

SEQ ID NO: 1130750 - RNA, 23 nt, Mycobacterium bovis subsp bovis AF2122/97
caccgucguacucggcggccacc

SEQ ID NO: 1130751 - RNA, 23 nt, Mycobacterium bovis subsp bovis AF2122/97
caccgucgucguuucgccagccg

SEQ ID NO: 1130752 - RNA, 15 nt, Mycobacterium bovis subsp bovis AF2122/97
caccgucucgccgcg

SEQ ID NO: 1130753 - RNA, 17 nt, Mycobacterium bovis subsp bovis AF2122/97
caccgucucgccgcgca

SEQ ID NO: 1130754 - RNA, 17 nt, Mycobacterium bovis subsp bovis AF2122/97
caccgucugcaccggca

SEQ ID NO: 1130755 - RNA, 22 nt, Mycobacterium bovis subsp bovis AF2122/97
caccgucgucguuucgccagcc

SEQ ID NO: 1130756 - RNA, 19 nt, Mycobacterium bovis subsp bovis AF2122/97
caccgucguacucggcggc

SEQ ID NO: 1130757 - RNA, 20 nt, Mycobacterium bovis subsp bovis AF2122/97
caccgucguacucggcggcc

SEQ ID NO: 1130758 - RNA, 23 nt, Mycobacterium bovis subsp bovis AF2122/97
caccgucgggauggacggcagcc

SEQ ID NO: 1130759 - RNA, 21 nt, Mycobacterium bovis subsp bovis AF2122/97
caccgucgcugcccgcgcggc

SEQ ID NO: 1130760 - RNA, 14 nt, Mycobacterium bovis subsp bovis AF2122/97
caccgucggcagca

SEQ ID NO: 1130761 - RNA, 15 nt, Mycobacterium bovis subsp bovis AF2122/97
caccgucacccccga

SEQ ID NO: 1130762 - RNA, 18 nt, Mycobacterium bovis subsp bovis AF2122/97
caccgucgggcccagccg

SEQ ID NO: 1130763 - RNA, 16 nt, Mycobacterium bovis subsp bovis AF2122/97
caccgucgcggcggca

SEQ ID NO: 1130764 - RNA, 13 nt, Mycobacterium bovis subsp bovis AF2122/97
caccgucgccgcc

SEQ ID NO: 1130765 - RNA, 15 nt, Mycobacterium bovis subsp bovis AF2122/97
caccgucgccgccgg

SEQ ID NO: 1130766 - RNA, 21 nt, Mycobacterium bovis subsp bovis AF2122/97
caccgucgcuaugcgccgcau

SEQ ID NO: 1130767 - RNA, 12 nt, Mycobacterium bovis subsp bovis AF2122/97
caccguggaucg

SEQ ID NO: 1130768 - RNA, 14 nt, Mycobacterium bovis subsp bovis AF2122/97
caccguggaucggc

SEQ ID NO: 1130769 - RNA, 16 nt, Mycobacterium bovis subsp bovis AF2122/97
caccguggaucggcag

SEQ ID NO: 1130770 - RNA, 13 nt, Mycobacterium bovis subsp bovis AF2122/97
caccgugcggucg

SEQ ID NO: 1130771 - RNA, 13 nt, Mycobacterium bovis subsp bovis AF2122/97
caccguggcgccc

SEQ ID NO: 1130772 - RNA, 23 nt, Mycobacterium bovis subsp bovis AF2122/97
caccguggaagauguugccgccg

SEQ ID NO: 1130773 - RNA, 16 nt, Mycobacterium bovis subsp bovis AF2122/97
caccgucucgcaccgc

SEQ ID NO: 1130774 - RNA, 16 nt, Mycobacterium bovis subsp bovis AF2122/97
caccgugcggaucgcg

SEQ ID NO: 1130775 - RNA, 16 nt, Mycobacterium bovis subsp bovis AF2122/97
caccugcaucgucgcc

SEQ ID NO: 1130776 - RNA, 16 nt, Mycobacterium bovis subsp bovis AF2122/97
caccugccagugggcc

SEQ ID NO: 1130777 - RNA, 23 nt, Mycobacterium bovis subsp bovis AF2122/97
caccugcagcacgacgugcgucg

SEQ ID NO: 1130778 - RNA, 18 nt, Mycobacterium bovis subsp bovis AF2122/97
caccugcaaccuucgugu

SEQ ID NO: 1130779 - RNA, 17 nt, Mycobacterium bovis subsp bovis AF2122/97
caccucucgcuugccga

SEQ ID NO: 1130780 - RNA, 17 nt, Mycobacterium bovis subsp bovis AF2122/97
caccugacgugcggcgc

SEQ ID NO: 1130781 - RNA, 22 nt, Mycobacterium bovis subsp bovis AF2122/97
caccugacgugcggcgcggcga

SEQ ID NO: 1130782 - RNA, 23 nt, Mycobacterium bovis subsp bovis AF2122/97
caccugacgugcggcgcggcgac

SEQ ID NO: 1130783 - RNA, 19 nt, Mycobacterium bovis subsp bovis AF2122/97
caccucuuggugccguucc

SEQ ID NO: 1130784 - RNA, 16 nt, Mycobacterium bovis subsp bovis AF2122/97
caccucuucgaucugu

SEQ ID NO: 1130785 - RNA, 23 nt, Mycobacterium bovis subsp bovis AF2122/97
caccucggcgacgucggcggcua

SEQ ID NO: 1130786 - RNA, 11 nt, Mycobacterium bovis subsp bovis AF2122/97
caccucggcga

SEQ ID NO: 1130787 - RNA, 14 nt, Mycobacterium bovis subsp bovis AF2122/97
caccucgccggccg

SEQ ID NO: 1130788 - RNA, 13 nt, Mycobacterium bovis subsp bovis AF2122/97
caccucggcgcga

SEQ ID NO: 1130789 - RNA, 12 nt, Mycobacterium bovis subsp bovis AF2122/97
caccucggcguu

SEQ ID NO: 1130790 - RNA, 21 nt, Mycobacterium bovis subsp bovis AF2122/97
caccucggcuuugccgcugug

SEQ ID NO: 1130791 - RNA, 23 nt, Mycobacterium bovis subsp bovis AF2122/97
caccucggugaccaggccggccc

SEQ ID NO: 1130792 - RNA, 23 nt, Mycobacterium bovis subsp bovis AF2122/97
caccucguauacccgggcggucg

SEQ ID NO: 1130793 - RNA, 24 nt, Mycobacterium bovis subsp bovis AF2122/97
caccucguauacccgggcggucga

SEQ ID NO: 1130794 - RNA, 18 nt, Mycobacterium bovis subsp bovis AF2122/97
caccucggugaccaggcc

SEQ ID NO: 1130795 - RNA, 20 nt, Mycobacterium bovis subsp bovis AF2122/97
caccucggguguggucacca

SEQ ID NO: 1130796 - RNA, 13 nt, Mycobacterium bovis subsp bovis AF2122/97
caccucgucgccu

SEQ ID NO: 1130797 - RNA, 18 nt, Mycobacterium bovis subsp bovis AF2122/97
caccucgucgccuagccg

SEQ ID NO: 1130798 - RNA, 14 nt, Mycobacterium bovis subsp bovis AF2122/97
caccucgucgaucg

SEQ ID NO: 1130799 - RNA, 17 nt, Mycobacterium bovis subsp bovis AF2122/97
caccgcgcuggucagcc

SEQ ID NO: 1130800 - RNA, 12 nt, Mycobacterium bovis subsp bovis AF2122/97
caccgcgcggcg

SEQ ID NO: 1130801 - RNA, 18 nt, Mycobacterium bovis subsp bovis AF2122/97
caccgcgccgucgucgag

SEQ ID NO: 1130802 - RNA, 11 nt, Mycobacterium bovis subsp bovis AF2122/97
caccgcgccgu

SEQ ID NO: 1130803 - RNA, 17 nt, Mycobacterium bovis subsp bovis AF2122/97
caccgcgccgucgucgc

SEQ ID NO: 1130804 - RNA, 12 nt, Mycobacterium bovis subsp bovis AF2122/97
caccgcggcaag

SEQ ID NO: 1130805 - RNA, 21 nt, Mycobacterium bovis subsp bovis AF2122/97
caccgcggcaugugacaucgg

SEQ ID NO: 1130806 - RNA, 23 nt, Mycobacterium bovis subsp bovis AF2122/97
caccgcgcuggucagccgugccg

SEQ ID NO: 1130807 - RNA, 22 nt, Mycobacterium bovis subsp bovis AF2122/97
caccgcggauaggccgcgcggc

SEQ ID NO: 1130808 - RNA, 14 nt, Mycobacterium bovis subsp bovis AF2122/97
caccgcgcggcgca

SEQ ID NO: 1130809 - RNA, 16 nt, Mycobacterium bovis subsp bovis AF2122/97
caccgcgcggcgcagc

SEQ ID NO: 1130810 - RNA, 20 nt, Mycobacterium bovis subsp bovis AF2122/97
caccgcgcggcgcagcaccg

SEQ ID NO: 1130811 - RNA, 12 nt, Mycobacterium bovis subsp bovis AF2122/97
caccgcggccgc

SEQ ID NO: 1130812 - RNA, 17 nt, Mycobacterium bovis subsp bovis AF2122/97
caccgcggccgcggucg

SEQ ID NO: 1130813 - RNA, 12 nt, Mycobacterium bovis subsp bovis AF2122/97
caccgcggccag

SEQ ID NO: 1130814 - RNA, 12 nt, Mycobacterium bovis subsp bovis AF2122/97
caccgcggcgau

SEQ ID NO: 1130815 - RNA, 19 nt, Mycobacterium bovis subsp bovis AF2122/97
caccgcgguacgccggucg

SEQ ID NO: 1130816 - RNA, 15 nt, Mycobacterium bovis subsp bovis AF2122/97
caccgcggucaccga

SEQ ID NO: 1130817 - RNA, 21 nt, Mycobacterium bovis subsp bovis AF2122/97
caccgcgggaucgguggcggc

SEQ ID NO: 1130818 - RNA, 14 nt, Mycobacterium bovis subsp bovis AF2122/97
caccgcggcggcgc

SEQ ID NO: 1130819 - RNA, 18 nt, Mycobacterium bovis subsp bovis AF2122/97
caccgcggcggcggccau

SEQ ID NO: 1130820 - RNA, 19 nt, Mycobacterium bovis subsp bovis AF2122/97
caccgcggcgcugaugccg

SEQ ID NO: 1130821 - RNA, 21 nt, Mycobacterium bovis subsp bovis AF2122/97
caccgcggcgauuacggccag

SEQ ID NO: 1130822 - RNA, 22 nt, Mycobacterium bovis subsp bovis AF2122/97
caccgcggcgauuacggccagu

SEQ ID NO: 1130823 - RNA, 17 nt, Mycobacterium bovis subsp bovis AF2122/97
caccgcggucaccgacg

SEQ ID NO: 1130824 - RNA, 16 nt, Mycobacterium bovis subsp bovis AF2122/97
caccgcgguggcggcg

SEQ ID NO: 1130825 - RNA, 15 nt, Mycobacterium bovis subsp bovis AF2122/97
caccgcuucaggcgc

SEQ ID NO: 1130826 - RNA, 21 nt, Mycobacterium bovis subsp bovis AF2122/97
caccgcuguugcaucgccgcg

SEQ ID NO: 1130827 - RNA, 12 nt, Mycobacterium bovis subsp bovis AF2122/97
caccgccggcga

SEQ ID NO: 1130828 - RNA, 14 nt, Mycobacterium bovis subsp bovis AF2122/97
caccgccggcgacg

SEQ ID NO: 1130829 - RNA, 22 nt, Mycobacterium bovis subsp bovis AF2122/97
caccgccggcgccaccgucgcc

SEQ ID NO: 1130830 - RNA, 14 nt, Mycobacterium bovis subsp bovis AF2122/97
caccgccggccuug

SEQ ID NO: 1130831 - RNA, 21 nt, Mycobacterium bovis subsp bovis AF2122/97
caccgccggcagcaucggcac

SEQ ID NO: 1130832 - RNA, 23 nt, Mycobacterium bovis subsp bovis AF2122/97
caccgccggcagcaucggcaccc

SEQ ID NO: 1130833 - RNA, 20 nt, Mycobacterium bovis subsp bovis AF2122/97
caccgccggcaauaccgcca

SEQ ID NO: 1130834 - RNA, 16 nt, Mycobacterium bovis subsp bovis AF2122/97
caccgccggcaccgcc

SEQ ID NO: 1130835 - RNA, 14 nt, Mycobacterium bovis subsp bovis AF2122/97
caccgcgccagccu

SEQ ID NO: 1130836 - RNA, 14 nt, Mycobacterium bovis subsp bovis AF2122/97
caccgcgcccgccg

SEQ ID NO: 1130837 - RNA, 13 nt, Mycobacterium bovis subsp bovis AF2122/97
caccgcgccgaac

SEQ ID NO: 1130838 - RNA, 18 nt, Mycobacterium bovis subsp bovis AF2122/97
caccgcgcccaccagcgg

SEQ ID NO: 1130839 - RNA, 19 nt, Mycobacterium bovis subsp bovis AF2122/97
caccgcgcccaccagcggc

SEQ ID NO: 1130840 - RNA, 23 nt, Mycobacterium bovis subsp bovis AF2122/97
caccgcgcccaccagcggcggca

SEQ ID NO: 1130841 - RNA, 15 nt, Mycobacterium bovis subsp bovis AF2122/97
caccgcgccggcggc

SEQ ID NO: 1130842 - RNA, 16 nt, Mycobacterium bovis subsp bovis AF2122/97
caccgcgccggcggca

SEQ ID NO: 1130843 - RNA, 14 nt, Mycobacterium bovis subsp bovis AF2122/97
caccgcgccggcgg

SEQ ID NO: 1130844 - RNA, 14 nt, Mycobacterium bovis subsp bovis AF2122/97
caccgcgccgcgcc

SEQ ID NO: 1130845 - RNA, 15 nt, Mycobacterium bovis subsp bovis AF2122/97
caccgcgccgcgccg

SEQ ID NO: 1130846 - RNA, 21 nt, Mycobacterium bovis subsp bovis AF2122/97
caccgcgccggagaucgucgc

SEQ ID NO: 1130847 - RNA, 13 nt, Mycobacterium bovis subsp bovis AF2122/97
caccgcgccgacg

SEQ ID NO: 1130848 - RNA, 14 nt, Mycobacterium bovis subsp bovis AF2122/97
caccgcgccgacga

SEQ ID NO: 1130849 - RNA, 12 nt, Mycobacterium bovis subsp bovis AF2122/97
caccgcgccgcg

SEQ ID NO: 1130850 - RNA, 14 nt, Mycobacterium bovis subsp bovis AF2122/97
caccgcgccgagca

SEQ ID NO: 1130851 - RNA, 14 nt, Mycobacterium bovis subsp bovis AF2122/97
caccgccgcgucga

SEQ ID NO: 1130852 - RNA, 14 nt, Mycobacterium bovis subsp bovis AF2122/97
caccgccgcggccg

SEQ ID NO: 1130853 - RNA, 18 nt, Mycobacterium bovis subsp bovis AF2122/97
caccgccgcgccggcggc

SEQ ID NO: 1130854 - RNA, 22 nt, Mycobacterium bovis subsp bovis AF2122/97
caccgccgcgccggcggccacc

SEQ ID NO: 1130855 - RNA, 17 nt, Mycobacterium bovis subsp bovis AF2122/97
caccgccgccggcaccg

SEQ ID NO: 1130856 - RNA, 20 nt, Mycobacterium bovis subsp bovis AF2122/97
caccgccgccggcaccgccg

SEQ ID NO: 1130857 - RNA, 13 nt, Mycobacterium bovis subsp bovis AF2122/97
caccgccgccugc

SEQ ID NO: 1130858 - RNA, 16 nt, Mycobacterium bovis subsp bovis AF2122/97
caccgccgcgaccgcc

SEQ ID NO: 1130859 - RNA, 19 nt, Mycobacterium bovis subsp bovis AF2122/97
caccgccgcgaccgccucg

SEQ ID NO: 1130860 - RNA, 15 nt, Mycobacterium bovis subsp bovis AF2122/97
caccgccgccggcac

SEQ ID NO: 1130861 - RNA, 22 nt, Mycobacterium bovis subsp bovis AF2122/97
caccgccgccgccaccggcgcc

SEQ ID NO: 1130862 - RNA, 14 nt, Mycobacterium bovis subsp bovis AF2122/97
caccgccgccgccg

SEQ ID NO: 1130863 - RNA, 22 nt, Mycobacterium bovis subsp bovis AF2122/97
caccgccgccgccgacgccgcc

SEQ ID NO: 1130864 - RNA, 12 nt, Mycobacterium bovis subsp bovis AF2122/97
caccgcccgcaa

SEQ ID NO: 1130865 - RNA, 15 nt, Mycobacterium bovis subsp bovis AF2122/97
caccgcccgccgaac

SEQ ID NO: 1130866 - RNA, 14 nt, Mycobacterium bovis subsp bovis AF2122/97
caccgccgccgcca

SEQ ID NO: 1130867 - RNA, 15 nt, Mycobacterium bovis subsp bovis AF2122/97
caccgccccgcgccc

SEQ ID NO: 1130868 - RNA, 19 nt, Mycobacterium bovis subsp bovis AF2122/97
caccgccagcugggcagcc

SEQ ID NO: 1130869 - RNA, 18 nt, Mycobacterium bovis subsp bovis AF2122/97
caccgcaccugggcggcg

SEQ ID NO: 1130870 - RNA, 22 nt, Mycobacterium bovis subsp bovis AF2122/97
caccgcacggaggcggaccagg

SEQ ID NO: 1130871 - RNA, 16 nt, Mycobacterium bovis subsp bovis AF2122/97
caccgcacggugcuga

SEQ ID NO: 1130872 - RNA, 16 nt, Mycobacterium bovis subsp bovis AF2122/97
caccgcagcgaccacc

SEQ ID NO: 1130873 - RNA, 14 nt, Mycobacterium bovis subsp bovis AF2122/97
caccgcagcgggcg

SEQ ID NO: 1130874 - RNA, 18 nt, Mycobacterium bovis subsp bovis AF2122/97
caccgcagacgccgucug

SEQ ID NO: 1130875 - RNA, 17 nt, Mycobacterium bovis subsp bovis AF2122/97
caccgauucggccagcg

SEQ ID NO: 1130876 - RNA, 19 nt, Mycobacterium bovis subsp bovis AF2122/97
caccgcaaccaaagcgacg

SEQ ID NO: 1130877 - RNA, 23 nt, Mycobacterium bovis subsp bovis AF2122/97
caccgcaaccaaagcgacgagca

SEQ ID NO: 1130878 - RNA, 21 nt, Mycobacterium bovis subsp bovis AF2122/97
caccgcaaccacgccccgauc

SEQ ID NO: 1130879 - RNA, 20 nt, Mycobacterium bovis subsp bovis AF2122/97
caccgcaacgcuucggcagc

SEQ ID NO: 1130880 - RNA, 16 nt, Mycobacterium bovis subsp bovis AF2122/97
caccgcaacucgccga

SEQ ID NO: 1130881 - RNA, 22 nt, Mycobacterium bovis subsp bovis AF2122/97
caccgcaagaaucagcagcagc

SEQ ID NO: 1130882 - RNA, 21 nt, Mycobacterium bovis subsp bovis AF2122/97
caccgagucgaucacguggug

SEQ ID NO: 1130883 - RNA, 19 nt, Mycobacterium bovis subsp bovis AF2122/97
caccgccagcaugacaccg

SEQ ID NO: 1130884 - RNA, 12 nt, Mycobacterium bovis subsp bovis AF2122/97
caccgccagcca

SEQ ID NO: 1130885 - RNA, 14 nt, Mycobacterium bovis subsp bovis AF2122/97
caccgccagcggca

SEQ ID NO: 1130886 - RNA, 19 nt, Mycobacterium bovis subsp bovis AF2122/97
caccgcauaacgccagucc

SEQ ID NO: 1130887 - RNA, 14 nt, Mycobacterium bovis subsp bovis AF2122/97
caccgcaucgccga

SEQ ID NO: 1130888 - RNA, 21 nt, Mycobacterium bovis subsp bovis AF2122/97
caccgagcaaacacgccucgc

SEQ ID NO: 1130889 - RNA, 16 nt, Mycobacterium bovis subsp bovis AF2122/97
caccgagcaccugacc

SEQ ID NO: 1130890 - RNA, 18 nt, Mycobacterium bovis subsp bovis AF2122/97
caccgagccacgacccag

SEQ ID NO: 1130891 - RNA, 18 nt, Mycobacterium bovis subsp bovis AF2122/97
caccgagcccgaucgcgg

SEQ ID NO: 1130892 - RNA, 19 nt, Mycobacterium bovis subsp bovis AF2122/97
caccgagcccgaucgcggc

SEQ ID NO: 1130893 - RNA, 23 nt, Mycobacterium bovis subsp bovis AF2122/97
caccgagcccgaucgcggcccgg

SEQ ID NO: 1130894 - RNA, 14 nt, Mycobacterium bovis subsp bovis AF2122/97
caccgagcggugaa

SEQ ID NO: 1130895 - RNA, 22 nt, Mycobacterium bovis subsp bovis AF2122/97
caccgagcggugaauucggcga

SEQ ID NO: 1130896 - RNA, 15 nt, Mycobacterium bovis subsp bovis AF2122/97
caccgagcgagacca

SEQ ID NO: 1130897 - RNA, 20 nt, Mycobacterium bovis subsp bovis AF2122/97
caccgagcgcaaucgaccac

SEQ ID NO: 1130898 - RNA, 13 nt, Mycobacterium bovis subsp bovis AF2122/97
caccgagcugagc

SEQ ID NO: 1130899 - RNA, 20 nt, Mycobacterium bovis subsp bovis AF2122/97
caccgagcugagcggccagc

SEQ ID NO: 1130900 - RNA, 17 nt, Mycobacterium bovis subsp bovis AF2122/97
caccgaggaccucguca

SEQ ID NO: 1130901 - RNA, 20 nt, Mycobacterium bovis subsp bovis AF2122/97
caccgaggucgagcgacccc

SEQ ID NO: 1130902 - RNA, 21 nt, Mycobacterium bovis subsp bovis AF2122/97
caccgaggucgagcgacccca

SEQ ID NO: 1130903 - RNA, 14 nt, Mycobacterium bovis subsp bovis AF2122/97
caccgaggccgccg

SEQ ID NO: 1130904 - RNA, 15 nt, Mycobacterium bovis subsp bovis AF2122/97
caccgaggccgccga

SEQ ID NO: 1130905 - RNA, 17 nt, Mycobacterium bovis subsp bovis AF2122/97
caccgaggccgccgaga

SEQ ID NO: 1130906 - RNA, 14 nt, Mycobacterium bovis subsp bovis AF2122/97
caccgacaccggcc

SEQ ID NO: 1130907 - RNA, 14 nt, Mycobacterium bovis subsp bovis AF2122/97
caccgacagcaccc

SEQ ID NO: 1130908 - RNA, 21 nt, Mycobacterium bovis subsp bovis AF2122/97
caccgacagcacccaaugcca

SEQ ID NO: 1130909 - RNA, 14 nt, Mycobacterium bovis subsp bovis AF2122/97
caccgacaccgugu

SEQ ID NO: 1130910 - RNA, 15 nt, Mycobacterium bovis subsp bovis AF2122/97
caccgacaccguguu

SEQ ID NO: 1130911 - RNA, 13 nt, Mycobacterium bovis subsp bovis AF2122/97
caccgacaccggc

SEQ ID NO: 1130912 - RNA, 23 nt, Mycobacterium bovis subsp bovis AF2122/97
caccgacagcacccggccaccgg

SEQ ID NO: 1130913 - RNA, 15 nt, Mycobacterium bovis subsp bovis AF2122/97
caccgacaugacgcg

SEQ ID NO: 1130914 - RNA, 19 nt, Mycobacterium bovis subsp bovis AF2122/97
caccgacugcugucaccgc

SEQ ID NO: 1130915 - RNA, 12 nt, Mycobacterium bovis subsp bovis AF2122/97
caccgacgucgc

SEQ ID NO: 1130916 - RNA, 18 nt, Mycobacterium bovis subsp bovis AF2122/97
caccgaccagggccgccg

SEQ ID NO: 1130917 - RNA, 14 nt, Mycobacterium bovis subsp bovis AF2122/97
caccgacgucgcca

SEQ ID NO: 1130918 - RNA, 22 nt, Mycobacterium bovis subsp bovis AF2122/97
caccgacguggccagcccgccc

SEQ ID NO: 1130919 - RNA, 19 nt, Mycobacterium bovis subsp bovis AF2122/97
caccgagaucaugccggcg

SEQ ID NO: 1130920 - RNA, 15 nt, Mycobacterium bovis subsp bovis AF2122/97
caccccggccaaccc

SEQ ID NO: 1130921 - RNA, 15 nt, Mycobacterium bovis subsp bovis AF2122/97
caccccggcucggcc

SEQ ID NO: 1130922 - RNA, 16 nt, Mycobacterium bovis subsp bovis AF2122/97
caccccgggcgccgau

SEQ ID NO: 1130923 - RNA, 21 nt, Mycobacterium bovis subsp bovis AF2122/97
caccccggucggagcggugcc

SEQ ID NO: 1130924 - RNA, 16 nt, Mycobacterium bovis subsp bovis AF2122/97
caccccggucggcccg

SEQ ID NO: 1130925 - RNA, 22 nt, Mycobacterium bovis subsp bovis AF2122/97
caccccguaggugcacaacccg

SEQ ID NO: 1130926 - RNA, 16 nt, Mycobacterium bovis subsp bovis AF2122/97
caccccgucggggucg

SEQ ID NO: 1130927 - RNA, 22 nt, Mycobacterium bovis subsp bovis AF2122/97
caccccgucggggucguugagg

SEQ ID NO: 1130928 - RNA, 15 nt, Mycobacterium bovis subsp bovis AF2122/97
caccccggcggcguc

SEQ ID NO: 1130929 - RNA, 13 nt, Mycobacterium bovis subsp bovis AF2122/97
caccccggccgcg

SEQ ID NO: 1130930 - RNA, 13 nt, Mycobacterium bovis subsp bovis AF2122/97
caccccggccggc

SEQ ID NO: 1130931 - RNA, 16 nt, Mycobacterium bovis subsp bovis AF2122/97
caccccgcuuggaccg

SEQ ID NO: 1130932 - RNA, 16 nt, Mycobacterium bovis subsp bovis AF2122/97
caccccgcgcgccagc

SEQ ID NO: 1130933 - RNA, 13 nt, Mycobacterium bovis subsp bovis AF2122/97
caccccauggcca

SEQ ID NO: 1130934 - RNA, 17 nt, Mycobacterium bovis subsp bovis AF2122/97
caccccauggccaccga

SEQ ID NO: 1130935 - RNA, 19 nt, Mycobacterium bovis subsp bovis AF2122/97
cacccccaaccgccggcca

SEQ ID NO: 1130936 - RNA, 16 nt, Mycobacterium bovis subsp bovis AF2122/97
caccccagcggccacc

SEQ ID NO: 1130937 - RNA, 22 nt, Mycobacterium bovis subsp bovis AF2122/97
cacgccccgaucggugacgcgc

SEQ ID NO: 1130938 - RNA, 14 nt, Mycobacterium bovis subsp bovis AF2122/97
cacgcccgcgagcu

SEQ ID NO: 1130939 - RNA, 13 nt, Mycobacterium bovis subsp bovis AF2122/97
cacgcccggcccc

SEQ ID NO: 1130940 - RNA, 21 nt, Mycobacterium bovis subsp bovis AF2122/97
cacgcccggccccgcggccag

SEQ ID NO: 1130941 - RNA, 23 nt, Mycobacterium bovis subsp bovis AF2122/97
cacgcccggccccgcggccagca

SEQ ID NO: 1130942 - RNA, 13 nt, Mycobacterium bovis subsp bovis AF2122/97
cacgcccggcgug

SEQ ID NO: 1130943 - RNA, 19 nt, Mycobacterium bovis subsp bovis AF2122/97
cacgcccucgacgcgcucg

SEQ ID NO: 1130944 - RNA, 14 nt, Mycobacterium bovis subsp bovis AF2122/97
cacgcccggcgugg

SEQ ID NO: 1130945 - RNA, 18 nt, Mycobacterium bovis subsp bovis AF2122/97
cacgcccucgucgaucgc

SEQ ID NO: 1130946 - RNA, 19 nt, Mycobacterium bovis subsp bovis AF2122/97
cacgcccugaagggccgcc

SEQ ID NO: 1130947 - RNA, 20 nt, Mycobacterium bovis subsp bovis AF2122/97
cacgcccucgucgaucgccg

SEQ ID NO: 1130948 - RNA, 22 nt, Mycobacterium bovis subsp bovis AF2122/97
cacgcccucgucgaucgccgcg

SEQ ID NO: 1130949 - RNA, 22 nt, Mycobacterium bovis subsp bovis AF2122/97
cacgcccuguucuccgugaucg

SEQ ID NO: 1130950 - RNA, 20 nt, Mycobacterium bovis subsp bovis AF2122/97
cacgccgaccaucucaccgg

SEQ ID NO: 1130951 - RNA, 22 nt, Mycobacterium bovis subsp bovis AF2122/97
cacgccgaccaucucaccgggc

SEQ ID NO: 1130952 - RNA, 14 nt, Mycobacterium bovis subsp bovis AF2122/97
cacgccgaccagca

SEQ ID NO: 1130953 - RNA, 13 nt, Mycobacterium bovis subsp bovis AF2122/97
cacgccgaccagc

SEQ ID NO: 1130954 - RNA, 19 nt, Mycobacterium bovis subsp bovis AF2122/97
cacgccgaacgugcggugg

SEQ ID NO: 1130955 - RNA, 13 nt, Mycobacterium bovis subsp bovis AF2122/97
cacgccgaccaau

SEQ ID NO: 1130956 - RNA, 17 nt, Mycobacterium bovis subsp bovis AF2122/97
cacgccgacguggaugg

SEQ ID NO: 1130957 - RNA, 19 nt, Mycobacterium bovis subsp bovis AF2122/97
cacgccgaucaacaugccg

SEQ ID NO: 1130958 - RNA, 13 nt, Mycobacterium bovis subsp bovis AF2122/97
cacgccgaucugg

SEQ ID NO: 1130959 - RNA, 22 nt, Mycobacterium bovis subsp bovis AF2122/97
cacgccgaugcggugcggauca

SEQ ID NO: 1130960 - RNA, 16 nt, Mycobacterium bovis subsp bovis AF2122/97
cacgccgaugggaacc

SEQ ID NO: 1130961 - RNA, 15 nt, Mycobacterium bovis subsp bovis AF2122/97
cacgccgauucgccg

SEQ ID NO: 1130962 - RNA, 15 nt, Mycobacterium bovis subsp bovis AF2122/97
cacgccgaccggugg

SEQ ID NO: 1130963 - RNA, 22 nt, Mycobacterium bovis subsp bovis AF2122/97
cacgccgaccgguggcaccggc

SEQ ID NO: 1130964 - RNA, 23 nt, Mycobacterium bovis subsp bovis AF2122/97
cacgccgaccgguggcaccggcg

SEQ ID NO: 1130965 - RNA, 18 nt, Mycobacterium bovis subsp bovis AF2122/97
cacgccgccggugaacgu

SEQ ID NO: 1130966 - RNA, 20 nt, Mycobacterium bovis subsp bovis AF2122/97
cacgccgccggugucgggcu

SEQ ID NO: 1130967 - RNA, 13 nt, Mycobacterium bovis subsp bovis AF2122/97
cacgccgccguug

SEQ ID NO: 1130968 - RNA, 15 nt, Mycobacterium bovis subsp bovis AF2122/97
cacgccgccgacgug

SEQ ID NO: 1130969 - RNA, 17 nt, Mycobacterium bovis subsp bovis AF2122/97
cacgccgccggccgcca

SEQ ID NO: 1130970 - RNA, 22 nt, Mycobacterium bovis subsp bovis AF2122/97
cacgccgccggcgcugaucgcg

SEQ ID NO: 1130971 - RNA, 19 nt, Mycobacterium bovis subsp bovis AF2122/97
cacgccgccccugcgcggc

SEQ ID NO: 1130972 - RNA, 21 nt, Mycobacterium bovis subsp bovis AF2122/97
cacgccgccccugcgcggcca

SEQ ID NO: 1130973 - RNA, 13 nt, Mycobacterium bovis subsp bovis AF2122/97
cacgccgccgacg

SEQ ID NO: 1130974 - RNA, 14 nt, Mycobacterium bovis subsp bovis AF2122/97
cacgccgccgacgu

SEQ ID NO: 1130975 - RNA, 16 nt, Mycobacterium bovis subsp bovis AF2122/97
cacgccgaccagcacc

SEQ ID NO: 1130976 - RNA, 18 nt, Mycobacterium bovis subsp bovis AF2122/97
cacgccgauucgccgucg

SEQ ID NO: 1130977 - RNA, 22 nt, Mycobacterium bovis subsp bovis AF2122/97
cacgccguagcgcagcgccucc

SEQ ID NO: 1130978 - RNA, 15 nt, Mycobacterium bovis subsp bovis AF2122/97
cacgccgguggcacg

SEQ ID NO: 1130979 - RNA, 20 nt, Mycobacterium bovis subsp bovis AF2122/97
cacgccgguggcacggcccc

SEQ ID NO: 1130980 - RNA, 13 nt, Mycobacterium bovis subsp bovis AF2122/97
cacgccgugcgug

SEQ ID NO: 1130981 - RNA, 14 nt, Mycobacterium bovis subsp bovis AF2122/97
cacgccucgccgaa

SEQ ID NO: 1130982 - RNA, 19 nt, Mycobacterium bovis subsp bovis AF2122/97
cacgccugaacgacccgcu

SEQ ID NO: 1130983 - RNA, 22 nt, Mycobacterium bovis subsp bovis AF2122/97
cacgccugagccaccaacaccg

SEQ ID NO: 1130984 - RNA, 22 nt, Mycobacterium bovis subsp bovis AF2122/97
cacgccugccgaaacgccgacc

SEQ ID NO: 1130985 - RNA, 19 nt, Mycobacterium bovis subsp bovis AF2122/97
cacgccugcucggagagca

SEQ ID NO: 1130986 - RNA, 15 nt, Mycobacterium bovis subsp bovis AF2122/97
cacgccuugagccga

SEQ ID NO: 1130987 - RNA, 19 nt, Mycobacterium bovis subsp bovis AF2122/97
cacgccgggugccgccacg

SEQ ID NO: 1130988 - RNA, 16 nt, Mycobacterium bovis subsp bovis AF2122/97
cacgccugggcgacga

SEQ ID NO: 1130989 - RNA, 14 nt, Mycobacterium bovis subsp bovis AF2122/97
cacgccuggcuacg

SEQ ID NO: 1130990 - RNA, 14 nt, Mycobacterium bovis subsp bovis AF2122/97
cacgccugggcgac

SEQ ID NO: 1130991 - RNA, 15 nt, Mycobacterium bovis subsp bovis AF2122/97
cacgccugggcgacg

SEQ ID NO: 1130992 - RNA, 13 nt, Mycobacterium bovis subsp bovis AF2122/97
cacgccggcgcug

SEQ ID NO: 1130993 - RNA, 14 nt, Mycobacterium bovis subsp bovis AF2122/97
cacgccggcggcgg

SEQ ID NO: 1130994 - RNA, 15 nt, Mycobacterium bovis subsp bovis AF2122/97
cacgccgggcaaggc

SEQ ID NO: 1130995 - RNA, 21 nt, Mycobacterium bovis subsp bovis AF2122/97
cacgccgggcaaggccaccgu

SEQ ID NO: 1130996 - RNA, 14 nt, Mycobacterium bovis subsp bovis AF2122/97
cacgccggugacgg

SEQ ID NO: 1130997 - RNA, 17 nt, Mycobacterium bovis subsp bovis AF2122/97
cacgccgggcaucggcg

SEQ ID NO: 1130998 - RNA, 19 nt, Mycobacterium bovis subsp bovis AF2122/97
cacgccgggcaucggcggu

SEQ ID NO: 1130999 - RNA, 12 nt, Mycobacterium bovis subsp bovis AF2122/97
cacgccggcccg

SEQ ID NO: 1131000 - RNA, 16 nt, Mycobacterium bovis subsp bovis AF2122/97
cacgccggcccgguga

SEQ ID NO: 1131001 - RNA, 14 nt, Mycobacterium bovis subsp bovis AF2122/97
cacgccggccagcg

SEQ ID NO: 1131002 - RNA, 19 nt, Mycobacterium bovis subsp bovis AF2122/97
cacgccggcaucgucgacg

SEQ ID NO: 1131003 - RNA, 13 nt, Mycobacterium bovis subsp bovis AF2122/97
cacgccggcaucg

SEQ ID NO: 1131004 - RNA, 17 nt, Mycobacterium bovis subsp bovis AF2122/97
cacgccggauggucggc

SEQ ID NO: 1131005 - RNA, 14 nt, Mycobacterium bovis subsp bovis AF2122/97
cacgcccaugaccg

SEQ ID NO: 1131006 - RNA, 19 nt, Mycobacterium bovis subsp bovis AF2122/97
cacgcccaugaccggccgc

SEQ ID NO: 1131007 - RNA, 15 nt, Mycobacterium bovis subsp bovis AF2122/97
cacgcccgacgagga

SEQ ID NO: 1131008 - RNA, 22 nt, Mycobacterium bovis subsp bovis AF2122/97
cacgcccacagcugacgagccg

SEQ ID NO: 1131009 - RNA, 20 nt, Mycobacterium bovis subsp bovis AF2122/97
cacgcccacaggggcagcgc

SEQ ID NO: 1131010 - RNA, 22 nt, Mycobacterium bovis subsp bovis AF2122/97
cacgcccacaggggcagcgcgg

SEQ ID NO: 1131011 - RNA, 14 nt, Mycobacterium bovis subsp bovis AF2122/97
cacgcccaggcgac

SEQ ID NO: 1131012 - RNA, 15 nt, Mycobacterium bovis subsp bovis AF2122/97
cacgccauaccggcu

SEQ ID NO: 1131013 - RNA, 17 nt, Mycobacterium bovis subsp bovis AF2122/97
cacgcaugagggcaucg

SEQ ID NO: 1131014 - RNA, 22 nt, Mycobacterium bovis subsp bovis AF2122/97
cacgccagucccacugggccgg

SEQ ID NO: 1131015 - RNA, 21 nt, Mycobacterium bovis subsp bovis AF2122/97
cacgcaggaaaaccccggcca

SEQ ID NO: 1131016 - RNA, 14 nt, Mycobacterium bovis subsp bovis AF2122/97
cacgcagucgggca

SEQ ID NO: 1131017 - RNA, 16 nt, Mycobacterium bovis subsp bovis AF2122/97
cacgcagucgggcagc

SEQ ID NO: 1131018 - RNA, 21 nt, Mycobacterium bovis subsp bovis AF2122/97
cacgccaaguccgcucaccuu

SEQ ID NO: 1131019 - RNA, 22 nt, Mycobacterium bovis subsp bovis AF2122/97
cacgcaugcgcgcgccggugcu

SEQ ID NO: 1131020 - RNA, 20 nt, Mycobacterium bovis subsp bovis AF2122/97
cacgccaggugaugccgccg

SEQ ID NO: 1131021 - RNA, 15 nt, Mycobacterium bovis subsp bovis AF2122/97
cacgccagcccgucc

SEQ ID NO: 1131022 - RNA, 21 nt, Mycobacterium bovis subsp bovis AF2122/97
cacgccagcccguccggcccc

SEQ ID NO: 1131023 - RNA, 12 nt, Mycobacterium bovis subsp bovis AF2122/97
cacgccagcgcg

SEQ ID NO: 1131024 - RNA, 15 nt, Mycobacterium bovis subsp bovis AF2122/97
cacgccagcgcgacc

SEQ ID NO: 1131025 - RNA, 13 nt, Mycobacterium bovis subsp bovis AF2122/97
cacgccaccgcaa

SEQ ID NO: 1131026 - RNA, 21 nt, Mycobacterium bovis subsp bovis AF2122/97
cacgccacguccaacucggcc

SEQ ID NO: 1131027 - RNA, 21 nt, Mycobacterium bovis subsp bovis AF2122/97
cacgccacauguugucgacgg

SEQ ID NO: 1131028 - RNA, 12 nt, Mycobacterium bovis subsp bovis AF2122/97
cacgccaccgcg

SEQ ID NO: 1131029 - RNA, 22 nt, Mycobacterium bovis subsp bovis AF2122/97
cacgccaccgcggucaccgacg

SEQ ID NO: 1131030 - RNA, 12 nt, Mycobacterium bovis subsp bovis AF2122/97
cacgcagcgcca

SEQ ID NO: 1131031 - RNA, 21 nt, Mycobacterium bovis subsp bovis AF2122/97
cacgcagcccgucggcgccga

SEQ ID NO: 1131032 - RNA, 16 nt, Mycobacterium bovis subsp bovis AF2122/97
cacgcagccgcgcggu

SEQ ID NO: 1131033 - RNA, 12 nt, Mycobacterium bovis subsp bovis AF2122/97
cacgcagcacgg

SEQ ID NO: 1131034 - RNA, 14 nt, Mycobacterium bovis subsp bovis AF2122/97
cacgcacgcgguuc

SEQ ID NO: 1131035 - RNA, 19 nt, Mycobacterium bovis subsp bovis AF2122/97
cacgcagccccucgucguc

SEQ ID NO: 1131036 - RNA, 15 nt, Mycobacterium bovis subsp bovis AF2122/97
cacgcacccggcgca

SEQ ID NO: 1131037 - RNA, 20 nt, Mycobacterium bovis subsp bovis AF2122/97
cacgcacagcaacgcccaac

SEQ ID NO: 1131038 - RNA, 15 nt, Mycobacterium bovis subsp bovis AF2122/97
cacgcaccacgagca

SEQ ID NO: 1131039 - RNA, 13 nt, Mycobacterium bovis subsp bovis AF2122/97
cacgcacccggca

SEQ ID NO: 1131040 - RNA, 13 nt, Mycobacterium bovis subsp bovis AF2122/97
cacgcacccggcg

SEQ ID NO: 1131041 - RNA, 19 nt, Mycobacterium bovis subsp bovis AF2122/97
cacgcaaccggcggacacc

SEQ ID NO: 1131042 - RNA, 18 nt, Mycobacterium bovis subsp bovis AF2122/97
cacgcaaaguucgucacc

SEQ ID NO: 1131043 - RNA, 20 nt, Mycobacterium bovis subsp bovis AF2122/97
cacgcaagcaaauucuggug

SEQ ID NO: 1131044 - RNA, 18 nt, Mycobacterium bovis subsp bovis AF2122/97
cacgcaaugucggcaggg

SEQ ID NO: 1131045 - RNA, 15 nt, Mycobacterium bovis subsp bovis AF2122/97
cacgaugaccgggga

SEQ ID NO: 1131046 - RNA, 18 nt, Mycobacterium bovis subsp bovis AF2122/97
cacgaugacguugacguc

SEQ ID NO: 1131047 - RNA, 14 nt, Mycobacterium bovis subsp bovis AF2122/97
cacgaugaucccaa

SEQ ID NO: 1131048 - RNA, 18 nt, Mycobacterium bovis subsp bovis AF2122/97
cacgaucugcgcgucagg

SEQ ID NO: 1131049 - RNA, 21 nt, Mycobacterium bovis subsp bovis AF2122/97
cacgaugcccaagcccucgac

SEQ ID NO: 1131050 - RNA, 23 nt, Mycobacterium bovis subsp bovis AF2122/97
cacgaugcccaagcccucgacgu

SEQ ID NO: 1131051 - RNA, 12 nt, Mycobacterium bovis subsp bovis AF2122/97
cacgauggcggc

SEQ ID NO: 1131052 - RNA, 14 nt, Mycobacterium bovis subsp bovis AF2122/97
cacgauggcggcca

SEQ ID NO: 1131053 - RNA, 17 nt, Mycobacterium bovis subsp bovis AF2122/97
cacgauguccucgaugc

SEQ ID NO: 1131054 - RNA, 14 nt, Mycobacterium bovis subsp bovis AF2122/97
cacgaugucgaugc

SEQ ID NO: 1131055 - RNA, 19 nt, Mycobacterium bovis subsp bovis AF2122/97
cacgauuucgagcgcugcu

SEQ ID NO: 1131056 - RNA, 17 nt, Mycobacterium bovis subsp bovis AF2122/97
cacgaccggccaacgcc

SEQ ID NO: 1131057 - RNA, 14 nt, Mycobacterium bovis subsp bovis AF2122/97
cacgaccgucucgg

SEQ ID NO: 1131058 - RNA, 20 nt, Mycobacterium bovis subsp bovis AF2122/97
cacgacccgcuggucgaugc

SEQ ID NO: 1131059 - RNA, 16 nt, Mycobacterium bovis subsp bovis AF2122/97
cacgacccgggaagga

SEQ ID NO: 1131060 - RNA, 21 nt, Mycobacterium bovis subsp bovis AF2122/97
cacgaccccggcgguaccgcc

SEQ ID NO: 1131061 - RNA, 13 nt, Mycobacterium bovis subsp bovis AF2122/97
cacgaccagcuga

SEQ ID NO: 1131062 - RNA, 14 nt, Mycobacterium bovis subsp bovis AF2122/97
cacgaccccggcgg

SEQ ID NO: 1131063 - RNA, 19 nt, Mycobacterium bovis subsp bovis AF2122/97
cacgacaucgucgcgacga

SEQ ID NO: 1131064 - RNA, 19 nt, Mycobacterium bovis subsp bovis AF2122/97
cacgaccaccggaucgccg

SEQ ID NO: 1131065 - RNA, 22 nt, Mycobacterium bovis subsp bovis AF2122/97
cacgaccaccggaucgccgucg

SEQ ID NO: 1131066 - RNA, 21 nt, Mycobacterium bovis subsp bovis AF2122/97
cacgacagcagaguggugauc

SEQ ID NO: 1131067 - RNA, 14 nt, Mycobacterium bovis subsp bovis AF2122/97
cacgaauccggcca

SEQ ID NO: 1131068 - RNA, 16 nt, Mycobacterium bovis subsp bovis AF2122/97
cacgaauccggccacu

SEQ ID NO: 1131069 - RNA, 21 nt, Mycobacterium bovis subsp bovis AF2122/97
cacgaauccggccacuccggu

SEQ ID NO: 1131070 - RNA, 14 nt, Mycobacterium bovis subsp bovis AF2122/97
cacgaaggucgcgg

SEQ ID NO: 1131071 - RNA, 13 nt, Mycobacterium bovis subsp bovis AF2122/97
cacgaauccggcc

SEQ ID NO: 1131072 - RNA, 23 nt, Mycobacterium bovis subsp bovis AF2122/97
cacgacgugcgucggcccggugc

SEQ ID NO: 1131073 - RNA, 13 nt, Mycobacterium bovis subsp bovis AF2122/97
cacgacgggccga

SEQ ID NO: 1131074 - RNA, 13 nt, Mycobacterium bovis subsp bovis AF2122/97
cacgacgcgacac

SEQ ID NO: 1131075 - RNA, 17 nt, Mycobacterium bovis subsp bovis AF2122/97
cacgacgcgacacgccg

SEQ ID NO: 1131076 - RNA, 20 nt, Mycobacterium bovis subsp bovis AF2122/97
cacgacgcgacacgccggcg

SEQ ID NO: 1131077 - RNA, 16 nt, Mycobacterium bovis subsp bovis AF2122/97
cacgacgaacaccagc

SEQ ID NO: 1131078 - RNA, 21 nt, Mycobacterium bovis subsp bovis AF2122/97
cacgacgaacaccagcgcgcc

SEQ ID NO: 1131079 - RNA, 19 nt, Mycobacterium bovis subsp bovis AF2122/97
cacgaccucgggaucggcg

SEQ ID NO: 1131080 - RNA, 19 nt, Mycobacterium bovis subsp bovis AF2122/97
cacgacgaauccccgacac

SEQ ID NO: 1131081 - RNA, 21 nt, Mycobacterium bovis subsp bovis AF2122/97
cacgacgaauguccgcagacg

SEQ ID NO: 1131082 - RNA, 21 nt, Mycobacterium bovis subsp bovis AF2122/97
cacgacgacaucgagccaacg

SEQ ID NO: 1131083 - RNA, 13 nt, Mycobacterium bovis subsp bovis AF2122/97
cacgacgacgaca

SEQ ID NO: 1131084 - RNA, 12 nt, Mycobacterium bovis subsp bovis AF2122/97
cacgacgccggc

SEQ ID NO: 1131085 - RNA, 13 nt, Mycobacterium bovis subsp bovis AF2122/97
cacgacgcccacc

SEQ ID NO: 1131086 - RNA, 16 nt, Mycobacterium bovis subsp bovis AF2122/97
cacgacgacgucgggg

SEQ ID NO: 1131087 - RNA, 13 nt, Mycobacterium bovis subsp bovis AF2122/97
cacgagcagccga

SEQ ID NO: 1131088 - RNA, 20 nt, Mycobacterium bovis subsp bovis AF2122/97
cacgagagcgcugucccgaa

SEQ ID NO: 1131089 - RNA, 21 nt, Mycobacterium bovis subsp bovis AF2122/97
cacgagcaaaccagauugccg

SEQ ID NO: 1131090 - RNA, 13 nt, Mycobacterium bovis subsp bovis AF2122/97
cacgagcacggga

SEQ ID NO: 1131091 - RNA, 16 nt, Mycobacterium bovis subsp bovis AF2122/97
cacgagagcgcugucc

SEQ ID NO: 1131092 - RNA, 17 nt, Mycobacterium bovis subsp bovis AF2122/97
cacgacguucgacgaca

SEQ ID NO: 1131093 - RNA, 15 nt, Mycobacterium bovis subsp bovis AF2122/97
cacgacguugccucg

SEQ ID NO: 1131094 - RNA, 16 nt, Mycobacterium bovis subsp bovis AF2122/97
cacgacguugcgaggc

SEQ ID NO: 1131095 - RNA, 20 nt, Mycobacterium bovis subsp bovis AF2122/97
cacgacguugcgaggccgca

SEQ ID NO: 1131096 - RNA, 21 nt, Mycobacterium bovis subsp bovis AF2122/97
cacgacguugcgaggccgcac

SEQ ID NO: 1131097 - RNA, 13 nt, Mycobacterium bovis subsp bovis AF2122/97
cacgaggcguuca

SEQ ID NO: 1131098 - RNA, 18 nt, Mycobacterium bovis subsp bovis AF2122/97
cacgaggacccgucgagc

SEQ ID NO: 1131099 - RNA, 13 nt, Mycobacterium bovis subsp bovis AF2122/97
cacgagcgcaugu

SEQ ID NO: 1131100 - RNA, 18 nt, Mycobacterium bovis subsp bovis AF2122/97
cacgagcgcauguugcag

SEQ ID NO: 1131101 - RNA, 13 nt, Mycobacterium bovis subsp bovis AF2122/97
cacgagcggcggu

SEQ ID NO: 1131102 - RNA, 15 nt, Mycobacterium bovis subsp bovis AF2122/97
cacgagcggcggugg

SEQ ID NO: 1131103 - RNA, 18 nt, Mycobacterium bovis subsp bovis AF2122/97
cacgagccaacaagucga

SEQ ID NO: 1131104 - RNA, 17 nt, Mycobacterium bovis subsp bovis AF2122/97
cacgaguacagaucgag

SEQ ID NO: 1131105 - RNA, 21 nt, Mycobacterium bovis subsp bovis AF2122/97
cacgagucgccagaccgcacc

SEQ ID NO: 1131106 - RNA, 22 nt, Mycobacterium bovis subsp bovis AF2122/97
cacgagccaaggcuuccuccga

SEQ ID NO: 1131107 - RNA, 19 nt, Mycobacterium bovis subsp bovis AF2122/97
cacgaggcuugcggcacaa

SEQ ID NO: 1131108 - RNA, 19 nt, Mycobacterium bovis subsp bovis AF2122/97
cacgagucgucguccgacg

SEQ ID NO: 1131109 - RNA, 15 nt, Mycobacterium bovis subsp bovis AF2122/97
cacgagugcggcgac

SEQ ID NO: 1131110 - RNA, 15 nt, Mycobacterium bovis subsp bovis AF2122/97
cacgaguuggccaag

SEQ ID NO: 1131111 - RNA, 13 nt, Mycobacterium bovis subsp bovis AF2122/97
cacgagggccacg

SEQ ID NO: 1131112 - RNA, 21 nt, Mycobacterium bovis subsp bovis AF2122/97
cacgagggccacguagcagca

SEQ ID NO: 1131113 - RNA, 19 nt, Mycobacterium bovis subsp bovis AF2122/97
cacgaucucguggaucugc

SEQ ID NO: 1131114 - RNA, 21 nt, Mycobacterium bovis subsp bovis AF2122/97
cacgaucgugccgggaccggu

SEQ ID NO: 1131115 - RNA, 15 nt, Mycobacterium bovis subsp bovis AF2122/97
cacgaucggcucacg

SEQ ID NO: 1131116 - RNA, 23 nt, Mycobacterium bovis subsp bovis AF2122/97
cacgaucggcggggguggaauca

SEQ ID NO: 1131117 - RNA, 23 nt, Mycobacterium bovis subsp bovis AF2122/97
cacgaucggcagucccagcgccg

SEQ ID NO: 1131118 - RNA, 17 nt, Mycobacterium bovis subsp bovis AF2122/97
cacgaucgcggugaugg

SEQ ID NO: 1131119 - RNA, 14 nt, Mycobacterium bovis subsp bovis AF2122/97
cacgaucgcgucgg

SEQ ID NO: 1131120 - RNA, 13 nt, Mycobacterium bovis subsp bovis AF2122/97
cacgaucgccaac

SEQ ID NO: 1131121 - RNA, 15 nt, Mycobacterium bovis subsp bovis AF2122/97
cacgaucgcggugac

SEQ ID NO: 1131122 - RNA, 19 nt, Mycobacterium bovis subsp bovis AF2122/97
cacgauaucgaugcggcga

SEQ ID NO: 1131123 - RNA, 16 nt, Mycobacterium bovis subsp bovis AF2122/97
cacgagguagccgacg

SEQ ID NO: 1131124 - RNA, 17 nt, Mycobacterium bovis subsp bovis AF2122/97
cacgaucacaccacggu

SEQ ID NO: 1131125 - RNA, 20 nt, Mycobacterium bovis subsp bovis AF2122/97
cacgauaucgaugcggcgac

SEQ ID NO: 1131126 - RNA, 19 nt, Mycobacterium bovis subsp bovis AF2122/97
cacgauaucgggcucagcg

SEQ ID NO: 1131127 - RNA, 22 nt, Mycobacterium bovis subsp bovis AF2122/97
cacgaucaucgggguggccacc

SEQ ID NO: 1131128 - RNA, 22 nt, Mycobacterium bovis subsp bovis AF2122/97
caccuggaguccagcucgggca

SEQ ID NO: 1131129 - RNA, 13 nt, Mycobacterium bovis subsp bovis AF2122/97
caccuggccgccc

SEQ ID NO: 1131130 - RNA, 14 nt, Mycobacterium bovis subsp bovis AF2122/97
caccuggccgcccg

SEQ ID NO: 1131131 - RNA, 16 nt, Mycobacterium bovis subsp bovis AF2122/97
caccugcgucggcccg

SEQ ID NO: 1131132 - RNA, 15 nt, Mycobacterium bovis subsp bovis AF2122/97
caccugcgcgcggcc

SEQ ID NO: 1131133 - RNA, 12 nt, Mycobacterium bovis subsp bovis AF2122/97
caccugcgcggc

SEQ ID NO: 1131134 - RNA, 16 nt, Mycobacterium bovis subsp bovis AF2122/97
caccugcgggcccacg

SEQ ID NO: 1131135 - RNA, 21 nt, Mycobacterium bovis subsp bovis AF2122/97
caccugcggcugcuuggucgc

SEQ ID NO: 1131136 - RNA, 22 nt, Mycobacterium bovis subsp bovis AF2122/97
caccugcgaugaugugcgacca

SEQ ID NO: 1131137 - RNA, 17 nt, Mycobacterium bovis subsp bovis AF2122/97
caccugccgacucaucg

SEQ ID NO: 1131138 - RNA, 20 nt, Mycobacterium bovis subsp bovis AF2122/97
caccugccgacucaucggcc

SEQ ID NO: 1131139 - RNA, 23 nt, Mycobacterium bovis subsp bovis AF2122/97
caccugccgacucaucggccgcg

SEQ ID NO: 1131140 - RNA, 13 nt, Mycobacterium bovis subsp bovis AF2122/97
caccugggcgcgc

SEQ ID NO: 1131141 - RNA, 17 nt, Mycobacterium bovis subsp bovis AF2122/97
caccugggcggcgcgaa

SEQ ID NO: 1131142 - RNA, 18 nt, Mycobacterium bovis subsp bovis AF2122/97
caccugggcugccggcca

SEQ ID NO: 1131143 - RNA, 16 nt, Mycobacterium bovis subsp bovis AF2122/97
caccuggucggccgca

SEQ ID NO: 1131144 - RNA, 17 nt, Mycobacterium bovis subsp bovis AF2122/97
caccuggucggccgcaa

SEQ ID NO: 1131145 - RNA, 23 nt, Mycobacterium bovis subsp bovis AF2122/97
caccuggucggccgcaaggcgcc

SEQ ID NO: 1131146 - RNA, 19 nt, Mycobacterium bovis subsp bovis AF2122/97
caccuggcgugucgccgcc

SEQ ID NO: 1131147 - RNA, 16 nt, Mycobacterium bovis subsp bovis AF2122/97
caccuggcgugucgcc

SEQ ID NO: 1131148 - RNA, 20 nt, Mycobacterium bovis subsp bovis AF2122/97
caccuguuggcaugccgccc

SEQ ID NO: 1131149 - RNA, 21 nt, Mycobacterium bovis subsp bovis AF2122/97
caccuguuggcaugccgcccg

SEQ ID NO: 1131150 - RNA, 17 nt, Mycobacterium bovis subsp bovis AF2122/97
cacgaacccucagccgc

SEQ ID NO: 1131151 - RNA, 18 nt, Mycobacterium bovis subsp bovis AF2122/97
cacgaacccucagccgcg

SEQ ID NO: 1131152 - RNA, 22 nt, Mycobacterium bovis subsp bovis AF2122/97
cacgaacccucagccgcgccgg

SEQ ID NO: 1131153 - RNA, 20 nt, Mycobacterium bovis subsp bovis AF2122/97
cacgaaccgugcugggcauc

SEQ ID NO: 1131154 - RNA, 22 nt, Mycobacterium bovis subsp bovis AF2122/97
cacgaacaucagaucgccgacu

SEQ ID NO: 1131155 - RNA, 19 nt, Mycobacterium bovis subsp bovis AF2122/97
cacgaacaucagaucgccg

SEQ ID NO: 1131156 - RNA, 13 nt, Mycobacterium bovis subsp bovis AF2122/97
cacgaaaaccggu

SEQ ID NO: 1131157 - RNA, 19 nt, Mycobacterium bovis subsp bovis AF2122/97
cacgaacgccugcucgucg

SEQ ID NO: 1131158 - RNA, 18 nt, Mycobacterium bovis subsp bovis AF2122/97
cacgaagaccaggccggu

SEQ ID NO: 1131159 - RNA, 19 nt, Mycobacterium bovis subsp bovis AF2122/97
cacgaacugaucgaccgcc

SEQ ID NO: 1131160 - RNA, 16 nt, Mycobacterium bovis subsp bovis AF2122/97
cacgaacgcgcgcagc

SEQ ID NO: 1131161 - RNA, 18 nt, Mycobacterium bovis subsp bovis AF2122/97
caccuuggcugggcccgc

SEQ ID NO: 1131162 - RNA, 20 nt, Mycobacterium bovis subsp bovis AF2122/97
caccuuggcugggcccgccg

SEQ ID NO: 1131163 - RNA, 22 nt, Mycobacterium bovis subsp bovis AF2122/97
caccuuggcugggcccgccguc

SEQ ID NO: 1131164 - RNA, 14 nt, Mycobacterium bovis subsp bovis AF2122/97
caccuuggccgggu

SEQ ID NO: 1131165 - RNA, 19 nt, Mycobacterium bovis subsp bovis AF2122/97
caccuugccgaacacucgc

SEQ ID NO: 1131166 - RNA, 23 nt, Mycobacterium bovis subsp bovis AF2122/97
caccuuggccagacccaccaccg

SEQ ID NO: 1131167 - RNA, 16 nt, Mycobacterium bovis subsp bovis AF2122/97
caccuucggccgaccg

SEQ ID NO: 1131168 - RNA, 19 nt, Mycobacterium bovis subsp bovis AF2122/97
caccuucgucgcggccgcg

SEQ ID NO: 1131169 - RNA, 19 nt, Mycobacterium bovis subsp bovis AF2122/97
cacccagcugggucccgcu

SEQ ID NO: 1131170 - RNA, 22 nt, Mycobacterium bovis subsp bovis AF2122/97
cacccagcuuggagaggcggug

SEQ ID NO: 1131171 - RNA, 22 nt, Mycobacterium bovis subsp bovis AF2122/97
cacccagcgugcccgccaccgg

SEQ ID NO: 1131172 - RNA, 12 nt, Mycobacterium bovis subsp bovis AF2122/97
cacccagcucgc

SEQ ID NO: 1131173 - RNA, 20 nt, Mycobacterium bovis subsp bovis AF2122/97
cacccaggccauaccgcaau

SEQ ID NO: 1131174 - RNA, 12 nt, Mycobacterium bovis subsp bovis AF2122/97
cacccagggcgu

SEQ ID NO: 1131175 - RNA, 14 nt, Mycobacterium bovis subsp bovis AF2122/97
cacccaggcgccga

SEQ ID NO: 1131176 - RNA, 16 nt, Mycobacterium bovis subsp bovis AF2122/97
cacccaggcgccgaug

SEQ ID NO: 1131177 - RNA, 17 nt, Mycobacterium bovis subsp bovis AF2122/97
cacccagcgccgaccca

SEQ ID NO: 1131178 - RNA, 17 nt, Mycobacterium bovis subsp bovis AF2122/97
cacccagcgcgcuggga

SEQ ID NO: 1131179 - RNA, 15 nt, Mycobacterium bovis subsp bovis AF2122/97
cacccagaugcaggc

SEQ ID NO: 1131180 - RNA, 14 nt, Mycobacterium bovis subsp bovis AF2122/97
cacccagaccgccg

SEQ ID NO: 1131181 - RNA, 15 nt, Mycobacterium bovis subsp bovis AF2122/97
cacccagucggcgcc

SEQ ID NO: 1131182 - RNA, 16 nt, Mycobacterium bovis subsp bovis AF2122/97
cacccagucggcgccg

SEQ ID NO: 1131183 - RNA, 16 nt, Mycobacterium bovis subsp bovis AF2122/97
cacccaccggccacca

SEQ ID NO: 1131184 - RNA, 16 nt, Mycobacterium bovis subsp bovis AF2122/97
cacccauagacccggc

SEQ ID NO: 1131185 - RNA, 21 nt, Mycobacterium bovis subsp bovis AF2122/97
cacccauagacccggcugagc

SEQ ID NO: 1131186 - RNA, 15 nt, Mycobacterium bovis subsp bovis AF2122/97
cacccaucaacgccg

SEQ ID NO: 1131187 - RNA, 21 nt, Mycobacterium bovis subsp bovis AF2122/97
cacccauaccuucggcgaucu

SEQ ID NO: 1131188 - RNA, 20 nt, Mycobacterium bovis subsp bovis AF2122/97
cacccaucaacgccggcgac

SEQ ID NO: 1131189 - RNA, 20 nt, Mycobacterium bovis subsp bovis AF2122/97
cacccauuuaaacgggccgg

SEQ ID NO: 1131190 - RNA, 15 nt, Mycobacterium bovis subsp bovis AF2122/97
cacccaucaccgcca

SEQ ID NO: 1131191 - RNA, 17 nt, Mycobacterium bovis subsp bovis AF2122/97
cacccaucaccgccagc

SEQ ID NO: 1131192 - RNA, 13 nt, Mycobacterium bovis subsp bovis AF2122/97
cacccaucaucgc

SEQ ID NO: 1131193 - RNA, 17 nt, Mycobacterium bovis subsp bovis AF2122/97
cacccaucgaccgcccg

SEQ ID NO: 1131194 - RNA, 20 nt, Mycobacterium bovis subsp bovis AF2122/97
caccaugaucacaccgagcg

SEQ ID NO: 1131195 - RNA, 21 nt, Mycobacterium bovis subsp bovis AF2122/97
cacccaaaccggcccgcagca

SEQ ID NO: 1131196 - RNA, 17 nt, Mycobacterium bovis subsp bovis AF2122/97
cacccaaccaggccgcg

SEQ ID NO: 1131197 - RNA, 18 nt, Mycobacterium bovis subsp bovis AF2122/97
cacccaaccaggccgcga

SEQ ID NO: 1131198 - RNA, 12 nt, Mycobacterium bovis subsp bovis AF2122/97
cacccaacccgg

SEQ ID NO: 1131199 - RNA, 14 nt, Mycobacterium bovis subsp bovis AF2122/97
cacccacacccagc

SEQ ID NO: 1131200 - RNA, 19 nt, Mycobacterium bovis subsp bovis AF2122/97
cacccaauucacgacgccg

SEQ ID NO: 1131201 - RNA, 14 nt, Mycobacterium bovis subsp bovis AF2122/97
cacccacauggcgg

SEQ ID NO: 1131202 - RNA, 20 nt, Mycobacterium bovis subsp bovis AF2122/97
cacccaagcucggucaacgc

SEQ ID NO: 1131203 - RNA, 14 nt, Mycobacterium bovis subsp bovis AF2122/97
cacccaaugccacc

SEQ ID NO: 1131204 - RNA, 18 nt, Mycobacterium bovis subsp bovis AF2122/97
cacccaaugccaccgcgg

SEQ ID NO: 1131205 - RNA, 16 nt, Mycobacterium bovis subsp bovis AF2122/97
cacccaauggagccgc

SEQ ID NO: 1131206 - RNA, 17 nt, Mycobacterium bovis subsp bovis AF2122/97
cacccaauggagccgcg

SEQ ID NO: 1131207 - RNA, 20 nt, Mycobacterium bovis subsp bovis AF2122/97
cacccacuuucgacccgcgg

SEQ ID NO: 1131208 - RNA, 21 nt, Mycobacterium bovis subsp bovis AF2122/97
cacccacuuuucgguggcggc

SEQ ID NO: 1131209 - RNA, 18 nt, Mycobacterium bovis subsp bovis AF2122/97
cacccacugcacggagcc

SEQ ID NO: 1131210 - RNA, 15 nt, Mycobacterium bovis subsp bovis AF2122/97
cacccacgugcugcc

SEQ ID NO: 1131211 - RNA, 17 nt, Mycobacterium bovis subsp bovis AF2122/97
cacccacgaucagcagc

SEQ ID NO: 1131212 - RNA, 14 nt, Mycobacterium bovis subsp bovis AF2122/97
cacccaccggacca

SEQ ID NO: 1131213 - RNA, 18 nt, Mycobacterium bovis subsp bovis AF2122/97
cacccaccggaccaccgc

SEQ ID NO: 1131214 - RNA, 13 nt, Mycobacterium bovis subsp bovis AF2122/97
cacccaccggcca

SEQ ID NO: 1131215 - RNA, 14 nt, Mycobacterium bovis subsp bovis AF2122/97
cacccaccggccac

SEQ ID NO: 1131216 - RNA, 21 nt, Mycobacterium bovis subsp bovis AF2122/97
cacccacccguucggcugcgc

SEQ ID NO: 1131217 - RNA, 15 nt, Mycobacterium bovis subsp bovis AF2122/97
cacccacauggcggc

SEQ ID NO: 1131218 - RNA, 16 nt, Mycobacterium bovis subsp bovis AF2122/97
cacccacauggugauc

SEQ ID NO: 1131219 - RNA, 23 nt, Mycobacterium bovis subsp bovis AF2122/97
caccaucuguuccgugccagcug

SEQ ID NO: 1131220 - RNA, 22 nt, Mycobacterium bovis subsp bovis AF2122/97
caccaucguugccggugccgcc

SEQ ID NO: 1131221 - RNA, 23 nt, Mycobacterium bovis subsp bovis AF2122/97
caccaucguugccggugccgccg

SEQ ID NO: 1131222 - RNA, 17 nt, Mycobacterium bovis subsp bovis AF2122/97
caccaucgccucggcgc

SEQ ID NO: 1131223 - RNA, 20 nt, Mycobacterium bovis subsp bovis AF2122/97
caccaucgccgccgcgcguu

SEQ ID NO: 1131224 - RNA, 15 nt, Mycobacterium bovis subsp bovis AF2122/97
caccaucgccgccgu

SEQ ID NO: 1131225 - RNA, 18 nt, Mycobacterium bovis subsp bovis AF2122/97
caccaucgccgccguugc

SEQ ID NO: 1131226 - RNA, 12 nt, Mycobacterium bovis subsp bovis AF2122/97
caccaucaucac

SEQ ID NO: 1131227 - RNA, 22 nt, Mycobacterium bovis subsp bovis AF2122/97
caccagucgcugauugcggucg

SEQ ID NO: 1131228 - RNA, 16 nt, Mycobacterium bovis subsp bovis AF2122/97
caccagugcaucgauc

SEQ ID NO: 1131229 - RNA, 18 nt, Mycobacterium bovis subsp bovis AF2122/97
caccagugccccgccgag

SEQ ID NO: 1131230 - RNA, 14 nt, Mycobacterium bovis subsp bovis AF2122/97
caccauccccggca

SEQ ID NO: 1131231 - RNA, 22 nt, Mycobacterium bovis subsp bovis AF2122/97
caccauccagcccaucccgauc

SEQ ID NO: 1131232 - RNA, 14 nt, Mycobacterium bovis subsp bovis AF2122/97
caccaguaccaccg

SEQ ID NO: 1131233 - RNA, 15 nt, Mycobacterium bovis subsp bovis AF2122/97
caccagucgcgcagc

SEQ ID NO: 1131234 - RNA, 15 nt, Mycobacterium bovis subsp bovis AF2122/97
caccaguccagcggg

SEQ ID NO: 1131235 - RNA, 18 nt, Mycobacterium bovis subsp bovis AF2122/97
caccaggucuucgaccac

SEQ ID NO: 1131236 - RNA, 16 nt, Mycobacterium bovis subsp bovis AF2122/97
caccagguugcaaccu

SEQ ID NO: 1131237 - RNA, 18 nt, Mycobacterium bovis subsp bovis AF2122/97
caccaggccgagccgccc

SEQ ID NO: 1131238 - RNA, 22 nt, Mycobacterium bovis subsp bovis AF2122/97
caccagcggcaccgcggccagc

SEQ ID NO: 1131239 - RNA, 14 nt, Mycobacterium bovis subsp bovis AF2122/97
caccagcggcaccg

SEQ ID NO: 1131240 - RNA, 18 nt, Mycobacterium bovis subsp bovis AF2122/97
caccagcggcaccgcggc

SEQ ID NO: 1131241 - RNA, 20 nt, Mycobacterium bovis subsp bovis AF2122/97
caccagcggcaccgcggcca

SEQ ID NO: 1131242 - RNA, 15 nt, Mycobacterium bovis subsp bovis AF2122/97
caccagcgcuccagc

SEQ ID NO: 1131243 - RNA, 16 nt, Mycobacterium bovis subsp bovis AF2122/97
caccaggacguggucg

SEQ ID NO: 1131244 - RNA, 23 nt, Mycobacterium bovis subsp bovis AF2122/97
caccagcgcgccguagaccagca

SEQ ID NO: 1131245 - RNA, 18 nt, Mycobacterium bovis subsp bovis AF2122/97
caccagcgccuugacgcc

SEQ ID NO: 1131246 - RNA, 20 nt, Mycobacterium bovis subsp bovis AF2122/97
caccagcccgaugaucccgc

SEQ ID NO: 1131247 - RNA, 13 nt, Mycobacterium bovis subsp bovis AF2122/97
caccagccacgcc

SEQ ID NO: 1131248 - RNA, 15 nt, Mycobacterium bovis subsp bovis AF2122/97
caccagcauucucgc

SEQ ID NO: 1131249 - RNA, 20 nt, Mycobacterium bovis subsp bovis AF2122/97
caccagcauucucgccgacg

SEQ ID NO: 1131250 - RNA, 21 nt, Mycobacterium bovis subsp bovis AF2122/97
caccagcaggaagaagccgaa

SEQ ID NO: 1131251 - RNA, 19 nt, Mycobacterium bovis subsp bovis AF2122/97
caccagcacggcaaccagc

SEQ ID NO: 1131252 - RNA, 15 nt, Mycobacterium bovis subsp bovis AF2122/97
caccagcagccagcc

SEQ ID NO: 1131253 - RNA, 19 nt, Mycobacterium bovis subsp bovis AF2122/97
caccaccuccccgaucugc

SEQ ID NO: 1131254 - RNA, 13 nt, Mycobacterium bovis subsp bovis AF2122/97
caccaccucguca

SEQ ID NO: 1131255 - RNA, 14 nt, Mycobacterium bovis subsp bovis AF2122/97
caccaccgcccgca

SEQ ID NO: 1131256 - RNA, 17 nt, Mycobacterium bovis subsp bovis AF2122/97
caccaccguggccgugu

SEQ ID NO: 1131257 - RNA, 17 nt, Mycobacterium bovis subsp bovis AF2122/97
caccacgaacucggccg

SEQ ID NO: 1131258 - RNA, 18 nt, Mycobacterium bovis subsp bovis AF2122/97
caccacgaacucggccgg

SEQ ID NO: 1131259 - RNA, 22 nt, Mycobacterium bovis subsp bovis AF2122/97
caccacgaacucggccgggcgg

SEQ ID NO: 1131260 - RNA, 19 nt, Mycobacterium bovis subsp bovis AF2122/97
caccacgaccgacaccccg

SEQ ID NO: 1131261 - RNA, 23 nt, Mycobacterium bovis subsp bovis AF2122/97
caccacgaccgacaccccgaugc

SEQ ID NO: 1131262 - RNA, 13 nt, Mycobacterium bovis subsp bovis AF2122/97
caccacgaccgcg

SEQ ID NO: 1131263 - RNA, 14 nt, Mycobacterium bovis subsp bovis AF2122/97
caccaccuggccgg

SEQ ID NO: 1131264 - RNA, 18 nt, Mycobacterium bovis subsp bovis AF2122/97
caccacgaacacguucgg

SEQ ID NO: 1131265 - RNA, 16 nt, Mycobacterium bovis subsp bovis AF2122/97
caccacugcgcccgcc

SEQ ID NO: 1131266 - RNA, 17 nt, Mycobacterium bovis subsp bovis AF2122/97
caccacucggucguugc

SEQ ID NO: 1131267 - RNA, 15 nt, Mycobacterium bovis subsp bovis AF2122/97
caccagacaacgccg

SEQ ID NO: 1131268 - RNA, 22 nt, Mycobacterium bovis subsp bovis AF2122/97
caccacuuggguggcgccguug

SEQ ID NO: 1131269 - RNA, 14 nt, Mycobacterium bovis subsp bovis AF2122/97
caccacuucggcgc

SEQ ID NO: 1131270 - RNA, 15 nt, Mycobacterium bovis subsp bovis AF2122/97
caccacuucggcgcc

SEQ ID NO: 1131271 - RNA, 13 nt, Mycobacterium bovis subsp bovis AF2122/97
caccagaaacacc

SEQ ID NO: 1131272 - RNA, 17 nt, Mycobacterium bovis subsp bovis AF2122/97
caccagaaacaccgacg

SEQ ID NO: 1131273 - RNA, 23 nt, Mycobacterium bovis subsp bovis AF2122/97
caccacuuggguggcgccguugu

SEQ ID NO: 1131274 - RNA, 18 nt, Mycobacterium bovis subsp bovis AF2122/97
caccagaaccagcgaccu

SEQ ID NO: 1131275 - RNA, 17 nt, Mycobacterium bovis subsp bovis AF2122/97
caccagcaacagcccga

SEQ ID NO: 1131276 - RNA, 18 nt, Mycobacterium bovis subsp bovis AF2122/97
caccagaucuucgagcgc

SEQ ID NO: 1131277 - RNA, 19 nt, Mycobacterium bovis subsp bovis AF2122/97
caccagauggcucucggug

SEQ ID NO: 1131278 - RNA, 17 nt, Mycobacterium bovis subsp bovis AF2122/97
caccacaccggagccga

SEQ ID NO: 1131279 - RNA, 17 nt, Mycobacterium bovis subsp bovis AF2122/97
caccacaauccacgcac

SEQ ID NO: 1131280 - RNA, 18 nt, Mycobacterium bovis subsp bovis AF2122/97
caccaagacaccggccug

SEQ ID NO: 1131281 - RNA, 15 nt, Mycobacterium bovis subsp bovis AF2122/97
caccaacucgacgug

SEQ ID NO: 1131282 - RNA, 19 nt, Mycobacterium bovis subsp bovis AF2122/97
caccaagguuggucggugc

SEQ ID NO: 1131283 - RNA, 14 nt, Mycobacterium bovis subsp bovis AF2122/97
caccaagcucggcc

SEQ ID NO: 1131284 - RNA, 20 nt, Mycobacterium bovis subsp bovis AF2122/97
caccacccgggccucggcgc

SEQ ID NO: 1131285 - RNA, 14 nt, Mycobacterium bovis subsp bovis AF2122/97
caccacccaggcca

SEQ ID NO: 1131286 - RNA, 16 nt, Mycobacterium bovis subsp bovis AF2122/97
caccaccccgucgagg

SEQ ID NO: 1131287 - RNA, 21 nt, Mycobacterium bovis subsp bovis AF2122/97
caccacccgggccucggcgcc

SEQ ID NO: 1131288 - RNA, 14 nt, Mycobacterium bovis subsp bovis AF2122/97
caccacccgucggc

SEQ ID NO: 1131289 - RNA, 15 nt, Mycobacterium bovis subsp bovis AF2122/97
caccaccgcaaccaa

SEQ ID NO: 1131290 - RNA, 22 nt, Mycobacterium bovis subsp bovis AF2122/97
caccaccaagguguggccuugc

SEQ ID NO: 1131291 - RNA, 21 nt, Mycobacterium bovis subsp bovis AF2122/97
caccacauuggcgaucagcag

SEQ ID NO: 1131292 - RNA, 19 nt, Mycobacterium bovis subsp bovis AF2122/97
caccacauuggcgaucagc

SEQ ID NO: 1131293 - RNA, 13 nt, Mycobacterium bovis subsp bovis AF2122/97
caccacaucgggc

SEQ ID NO: 1131294 - RNA, 20 nt, Mycobacterium bovis subsp bovis AF2122/97
caccacaucgggccggugga

SEQ ID NO: 1131295 - RNA, 13 nt, Mycobacterium bovis subsp bovis AF2122/97
caccacaucggug

SEQ ID NO: 1131296 - RNA, 22 nt, Mycobacterium bovis subsp bovis AF2122/97
caccacaucggugccacguucg

SEQ ID NO: 1131297 - RNA, 12 nt, Mycobacterium bovis subsp bovis AF2122/97
cacaggcuggcg

SEQ ID NO: 1131298 - RNA, 21 nt, Mycobacterium bovis subsp bovis AF2122/97
cacaggggcagcgcggccacc

SEQ ID NO: 1131299 - RNA, 21 nt, Mycobacterium bovis subsp bovis AF2122/97
cacagcgucgaaaagccgugc

SEQ ID NO: 1131300 - RNA, 12 nt, Mycobacterium bovis subsp bovis AF2122/97
cacagcggcgau

SEQ ID NO: 1131301 - RNA, 13 nt, Mycobacterium bovis subsp bovis AF2122/97
cacagcggcaucg

SEQ ID NO: 1131302 - RNA, 21 nt, Mycobacterium bovis subsp bovis AF2122/97
cacagcggccauaucgcccac

SEQ ID NO: 1131303 - RNA, 19 nt, Mycobacterium bovis subsp bovis AF2122/97
cacagguuugcgccgcgca

SEQ ID NO: 1131304 - RNA, 17 nt, Mycobacterium bovis subsp bovis AF2122/97
cacagucgccggccggc

SEQ ID NO: 1131305 - RNA, 12 nt, Mycobacterium bovis subsp bovis AF2122/97
cacaucgucggc

SEQ ID NO: 1131306 - RNA, 19 nt, Mycobacterium bovis subsp bovis AF2122/97
cacaugaccugauccggcc

SEQ ID NO: 1131307 - RNA, 15 nt, Mycobacterium bovis subsp bovis AF2122/97
cacaugacgaucgcg

SEQ ID NO: 1131308 - RNA, 15 nt, Mycobacterium bovis subsp bovis AF2122/97
caccaaccucaucgc

SEQ ID NO: 1131309 - RNA, 16 nt, Mycobacterium bovis subsp bovis AF2122/97
cacaugacgaucgcgg

SEQ ID NO: 1131310 - RNA, 18 nt, Mycobacterium bovis subsp bovis AF2122/97
cacaugacgaucgcggcg

SEQ ID NO: 1131311 - RNA, 17 nt, Mycobacterium bovis subsp bovis AF2122/97
caccaacgcgaucaggc

SEQ ID NO: 1131312 - RNA, 15 nt, Mycobacterium bovis subsp bovis AF2122/97
caccaacgccaccgu

SEQ ID NO: 1131313 - RNA, 20 nt, Mycobacterium bovis subsp bovis AF2122/97
cacaucggugccacguucgc

SEQ ID NO: 1131314 - RNA, 20 nt, Mycobacterium bovis subsp bovis AF2122/97
cacaucggugguuagguggc

SEQ ID NO: 1131315 - RNA, 22 nt, Mycobacterium bovis subsp bovis AF2122/97
cacagugccaauuccagccccc

SEQ ID NO: 1131316 - RNA, 15 nt, Mycobacterium bovis subsp bovis AF2122/97
cacagucgugagcca

SEQ ID NO: 1131317 - RNA, 14 nt, Mycobacterium bovis subsp bovis AF2122/97
cacaucgccggagu

SEQ ID NO: 1131318 - RNA, 19 nt, Mycobacterium bovis subsp bovis AF2122/97
cacaucgccggagucgacc

SEQ ID NO: 1131319 - RNA, 21 nt, Mycobacterium bovis subsp bovis AF2122/97
cacaucgcccggaaccggcgu

SEQ ID NO: 1131320 - RNA, 16 nt, Mycobacterium bovis subsp bovis AF2122/97
cacaucgaugucggcu

SEQ ID NO: 1131321 - RNA, 20 nt, Mycobacterium bovis subsp bovis AF2122/97
cacacgccgccggugucggg

SEQ ID NO: 1131322 - RNA, 14 nt, Mycobacterium bovis subsp bovis AF2122/97
cacacgccagccgg

SEQ ID NO: 1131323 - RNA, 17 nt, Mycobacterium bovis subsp bovis AF2122/97
cacacgguccgccacgg

SEQ ID NO: 1131324 - RNA, 20 nt, Mycobacterium bovis subsp bovis AF2122/97
cacacgguccgccacggcgg

SEQ ID NO: 1131325 - RNA, 21 nt, Mycobacterium bovis subsp bovis AF2122/97
cacacgcuuguacaagucgac

SEQ ID NO: 1131326 - RNA, 23 nt, Mycobacterium bovis subsp bovis AF2122/97
cacaccgucgucguacggcucau

SEQ ID NO: 1131327 - RNA, 16 nt, Mycobacterium bovis subsp bovis AF2122/97
cacaccgugaccagcc

SEQ ID NO: 1131328 - RNA, 16 nt, Mycobacterium bovis subsp bovis AF2122/97
cacaccgugggcgacg

SEQ ID NO: 1131329 - RNA, 23 nt, Mycobacterium bovis subsp bovis AF2122/97
cacaccgugggcgacggcggcgu

SEQ ID NO: 1131330 - RNA, 13 nt, Mycobacterium bovis subsp bovis AF2122/97
cacaccgccgcca

SEQ ID NO: 1131331 - RNA, 18 nt, Mycobacterium bovis subsp bovis AF2122/97
cacaccggggcggccgac

SEQ ID NO: 1131332 - RNA, 23 nt, Mycobacterium bovis subsp bovis AF2122/97
cacaccgaguauuuuucgaccag

SEQ ID NO: 1131333 - RNA, 18 nt, Mycobacterium bovis subsp bovis AF2122/97
cacaccguaccgacgaag

SEQ ID NO: 1131334 - RNA, 16 nt, Mycobacterium bovis subsp bovis AF2122/97
cacaccgucgcaccca

SEQ ID NO: 1131335 - RNA, 21 nt, Mycobacterium bovis subsp bovis AF2122/97
cacaccgucgcgcucgcacca

SEQ ID NO: 1131336 - RNA, 14 nt, Mycobacterium bovis subsp bovis AF2122/97
cacaccgagcgcaa

SEQ ID NO: 1131337 - RNA, 21 nt, Mycobacterium bovis subsp bovis AF2122/97
cacaccgagcgcaaucgacca

SEQ ID NO: 1131338 - RNA, 15 nt, Mycobacterium bovis subsp bovis AF2122/97
cacaccgacgccgcc

SEQ ID NO: 1131339 - RNA, 16 nt, Mycobacterium bovis subsp bovis AF2122/97
cacaccgacagcaccc

SEQ ID NO: 1131340 - RNA, 18 nt, Mycobacterium bovis subsp bovis AF2122/97
cacaccgacagcacccaa

SEQ ID NO: 1131341 - RNA, 15 nt, Mycobacterium bovis subsp bovis AF2122/97
cacaccgaucggcaa

SEQ ID NO: 1131342 - RNA, 12 nt, Mycobacterium bovis subsp bovis AF2122/97
cacaccgcggcg

SEQ ID NO: 1131343 - RNA, 15 nt, Mycobacterium bovis subsp bovis AF2122/97
cacacccgcaccgga

SEQ ID NO: 1131344 - RNA, 13 nt, Mycobacterium bovis subsp bovis AF2122/97
cacacccugcagc

SEQ ID NO: 1131345 - RNA, 23 nt, Mycobacterium bovis subsp bovis AF2122/97
cacacccgggacgaaccggccga

SEQ ID NO: 1131346 - RNA, 14 nt, Mycobacterium bovis subsp bovis AF2122/97
cacacccagcgcgc

SEQ ID NO: 1131347 - RNA, 15 nt, Mycobacterium bovis subsp bovis AF2122/97
cacacccaucaccgc

SEQ ID NO: 1131348 - RNA, 15 nt, Mycobacterium bovis subsp bovis AF2122/97
cacacccccgucugc

SEQ ID NO: 1131349 - RNA, 14 nt, Mycobacterium bovis subsp bovis AF2122/97
cacacccacgucga

SEQ ID NO: 1131350 - RNA, 22 nt, Mycobacterium bovis subsp bovis AF2122/97
cacaccaugauugccaggaccg

SEQ ID NO: 1131351 - RNA, 20 nt, Mycobacterium bovis subsp bovis AF2122/97
cacacuguuacuccgacggc

SEQ ID NO: 1131352 - RNA, 18 nt, Mycobacterium bovis subsp bovis AF2122/97
cacacugaagaucgcgcc

SEQ ID NO: 1131353 - RNA, 18 nt, Mycobacterium bovis subsp bovis AF2122/97
cacacugaccccgccgcc

SEQ ID NO: 1131354 - RNA, 22 nt, Mycobacterium bovis subsp bovis AF2122/97
cacacugaccccgccgccacgg

SEQ ID NO: 1131355 - RNA, 22 nt, Mycobacterium bovis subsp bovis AF2122/97
cacacugcccucaacgaucgcg

SEQ ID NO: 1131356 - RNA, 16 nt, Mycobacterium bovis subsp bovis AF2122/97
cacagaacucaccgac

SEQ ID NO: 1131357 - RNA, 23 nt, Mycobacterium bovis subsp bovis AF2122/97
cacagaaucgcccauuucggcac

SEQ ID NO: 1131358 - RNA, 17 nt, Mycobacterium bovis subsp bovis AF2122/97
cacacggggccgccagc

SEQ ID NO: 1131359 - RNA, 14 nt, Mycobacterium bovis subsp bovis AF2122/97
cacacggucaccgg

SEQ ID NO: 1131360 - RNA, 18 nt, Mycobacterium bovis subsp bovis AF2122/97
cacacggucaccggcacg

SEQ ID NO: 1131361 - RNA, 16 nt, Mycobacterium bovis subsp bovis AF2122/97
cacacggucgucgcga

SEQ ID NO: 1131362 - RNA, 19 nt, Mycobacterium bovis subsp bovis AF2122/97
cacacguccgcgcaccgca

SEQ ID NO: 1131363 - RNA, 20 nt, Mycobacterium bovis subsp bovis AF2122/97
cacacguccgcgcaccgcag

SEQ ID NO: 1131364 - RNA, 14 nt, Mycobacterium bovis subsp bovis AF2122/97
cacacucccgcgcc

SEQ ID NO: 1131365 - RNA, 17 nt, Mycobacterium bovis subsp bovis AF2122/97
cacacucccgcgcccga

SEQ ID NO: 1131366 - RNA, 17 nt, Mycobacterium bovis subsp bovis AF2122/97
cacacucagcacccaau

SEQ ID NO: 1131367 - RNA, 14 nt, Mycobacterium bovis subsp bovis AF2122/97
cacacucgggcggc

SEQ ID NO: 1131368 - RNA, 22 nt, Mycobacterium bovis subsp bovis AF2122/97
cacacucucggugaacgccgcc

SEQ ID NO: 1131369 - RNA, 14 nt, Mycobacterium bovis subsp bovis AF2122/97
cacagcggagacga

SEQ ID NO: 1131370 - RNA, 15 nt, Mycobacterium bovis subsp bovis AF2122/97
cacagcagcaccgcg

SEQ ID NO: 1131371 - RNA, 14 nt, Mycobacterium bovis subsp bovis AF2122/97
cacagcgaacagac

SEQ ID NO: 1131372 - RNA, 18 nt, Mycobacterium bovis subsp bovis AF2122/97
cacagcgcagccugcagc

SEQ ID NO: 1131373 - RNA, 15 nt, Mycobacterium bovis subsp bovis AF2122/97
cacagcaacgcccaa

SEQ ID NO: 1131374 - RNA, 16 nt, Mycobacterium bovis subsp bovis AF2122/97
cacagcaacgcccaac

SEQ ID NO: 1131375 - RNA, 19 nt, Mycobacterium bovis subsp bovis AF2122/97
cacagcaacgugugcacca

SEQ ID NO: 1131376 - RNA, 15 nt, Mycobacterium bovis subsp bovis AF2122/97
cacagcaccguccuc

SEQ ID NO: 1131377 - RNA, 20 nt, Mycobacterium bovis subsp bovis AF2122/97
cacagcaccguccucgguca

SEQ ID NO: 1131378 - RNA, 22 nt, Mycobacterium bovis subsp bovis AF2122/97
cacagcaccguccucggucacg

SEQ ID NO: 1131379 - RNA, 16 nt, Mycobacterium bovis subsp bovis AF2122/97
cacagcacagcgcagc

SEQ ID NO: 1131380 - RNA, 20 nt, Mycobacterium bovis subsp bovis AF2122/97
cacagcaccacaucgaaggu

SEQ ID NO: 1131381 - RNA, 12 nt, Mycobacterium bovis subsp bovis AF2122/97
cacagcaccacg

SEQ ID NO: 1131382 - RNA, 15 nt, Mycobacterium bovis subsp bovis AF2122/97
cacagcacccacgcc

SEQ ID NO: 1131383 - RNA, 16 nt, Mycobacterium bovis subsp bovis AF2122/97
cacagcacccacgccg

SEQ ID NO: 1131384 - RNA, 15 nt, Mycobacterium bovis subsp bovis AF2122/97
caaucgggaucgcug

SEQ ID NO: 1131385 - RNA, 14 nt, Mycobacterium bovis subsp bovis AF2122/97
caaucgcggucagg

SEQ ID NO: 1131386 - RNA, 14 nt, Mycobacterium bovis subsp bovis AF2122/97
caaucggcggcacc

SEQ ID NO: 1131387 - RNA, 17 nt, Mycobacterium bovis subsp bovis AF2122/97
caaugaccuggccgccc

SEQ ID NO: 1131388 - RNA, 15 nt, Mycobacterium bovis subsp bovis AF2122/97
caaugacucggccgc

SEQ ID NO: 1131389 - RNA, 18 nt, Mycobacterium bovis subsp bovis AF2122/97
caaugacuugcgacccgu

SEQ ID NO: 1131390 - RNA, 15 nt, Mycobacterium bovis subsp bovis AF2122/97
caaugaccaccgggc

SEQ ID NO: 1131391 - RNA, 15 nt, Mycobacterium bovis subsp bovis AF2122/97
caaugacaccggggc

SEQ ID NO: 1131392 - RNA, 14 nt, Mycobacterium bovis subsp bovis AF2122/97
caaugccgacgcca

SEQ ID NO: 1131393 - RNA, 18 nt, Mycobacterium bovis subsp bovis AF2122/97
caaugccgacgccaacgc

SEQ ID NO: 1131394 - RNA, 23 nt, Mycobacterium bovis subsp bovis AF2122/97
caaugccgcggaggcggccagcc

SEQ ID NO: 1131395 - RNA, 22 nt, Mycobacterium bovis subsp bovis AF2122/97
caaugccggaucgggaccggga

SEQ ID NO: 1131396 - RNA, 23 nt, Mycobacterium bovis subsp bovis AF2122/97
caaugccggccgcggggcaucgg

SEQ ID NO: 1131397 - RNA, 19 nt, Mycobacterium bovis subsp bovis AF2122/97
caaugcgcgacggucaagg

SEQ ID NO: 1131398 - RNA, 16 nt, Mycobacterium bovis subsp bovis AF2122/97
caaugcgaugcggucg

SEQ ID NO: 1131399 - RNA, 23 nt, Mycobacterium bovis subsp bovis AF2122/97
caaugcgagcacccguugaucgc

SEQ ID NO: 1131400 - RNA, 17 nt, Mycobacterium bovis subsp bovis AF2122/97
caaugcgagcgcgccgg

SEQ ID NO: 1131401 - RNA, 19 nt, Mycobacterium bovis subsp bovis AF2122/97
caaugcgagcgcgccggcc

SEQ ID NO: 1131402 - RNA, 20 nt, Mycobacterium bovis subsp bovis AF2122/97
caaucaguagcagcggcucg

SEQ ID NO: 1131403 - RNA, 19 nt, Mycobacterium bovis subsp bovis AF2122/97
caauccacgcacucgucgg

SEQ ID NO: 1131404 - RNA, 18 nt, Mycobacterium bovis subsp bovis AF2122/97
caauccacgguugccggc

SEQ ID NO: 1131405 - RNA, 16 nt, Mycobacterium bovis subsp bovis AF2122/97
caauccacgucgcggc

SEQ ID NO: 1131406 - RNA, 18 nt, Mycobacterium bovis subsp bovis AF2122/97
caaucaugucagcgcuga

SEQ ID NO: 1131407 - RNA, 16 nt, Mycobacterium bovis subsp bovis AF2122/97
caaucgcgugcuggaa

SEQ ID NO: 1131408 - RNA, 17 nt, Mycobacterium bovis subsp bovis AF2122/97
caaucgcgggcgauggc

SEQ ID NO: 1131409 - RNA, 14 nt, Mycobacterium bovis subsp bovis AF2122/97
caaucgcgacgggg

SEQ ID NO: 1131410 - RNA, 13 nt, Mycobacterium bovis subsp bovis AF2122/97
caaucgccgggug

SEQ ID NO: 1131411 - RNA, 15 nt, Mycobacterium bovis subsp bovis AF2122/97
caauacggcggcgcc

SEQ ID NO: 1131412 - RNA, 17 nt, Mycobacterium bovis subsp bovis AF2122/97
caauacggcggcgccgc

SEQ ID NO: 1131413 - RNA, 18 nt, Mycobacterium bovis subsp bovis AF2122/97
caaucagcccgacaccgu

SEQ ID NO: 1131414 - RNA, 13 nt, Mycobacterium bovis subsp bovis AF2122/97
caaucagccgccu

SEQ ID NO: 1131415 - RNA, 23 nt, Mycobacterium bovis subsp bovis AF2122/97
caauaccgccagcgccaccguua

SEQ ID NO: 1131416 - RNA, 18 nt, Mycobacterium bovis subsp bovis AF2122/97
caauaccugagcgcgcgc

SEQ ID NO: 1131417 - RNA, 22 nt, Mycobacterium bovis subsp bovis AF2122/97
caauaccugagcgcgcgcggug

SEQ ID NO: 1131418 - RNA, 23 nt, Mycobacterium bovis subsp bovis AF2122/97
caauacccgagcguccggugguc

SEQ ID NO: 1131419 - RNA, 16 nt, Mycobacterium bovis subsp bovis AF2122/97
caauaccgcacccgcu

SEQ ID NO: 1131420 - RNA, 20 nt, Mycobacterium bovis subsp bovis AF2122/97
cacaagcugacacgacgaac

SEQ ID NO: 1131421 - RNA, 19 nt, Mycobacterium bovis subsp bovis AF2122/97
cacaagccccgcgcguucg

SEQ ID NO: 1131422 - RNA, 17 nt, Mycobacterium bovis subsp bovis AF2122/97
cacaagccgugcagcuc

SEQ ID NO: 1131423 - RNA, 16 nt, Mycobacterium bovis subsp bovis AF2122/97
cacaagccugccggcu

SEQ ID NO: 1131424 - RNA, 17 nt, Mycobacterium bovis subsp bovis AF2122/97
cacaagccugccggcug

SEQ ID NO: 1131425 - RNA, 23 nt, Mycobacterium bovis subsp bovis AF2122/97
cacaacgccucgauggcgguggc

SEQ ID NO: 1131426 - RNA, 20 nt, Mycobacterium bovis subsp bovis AF2122/97
cacaacgccucgccauccau

SEQ ID NO: 1131427 - RNA, 13 nt, Mycobacterium bovis subsp bovis AF2122/97
cacaacgcgacgc

SEQ ID NO: 1131428 - RNA, 13 nt, Mycobacterium bovis subsp bovis AF2122/97
cacaacgccagga

SEQ ID NO: 1131429 - RNA, 18 nt, Mycobacterium bovis subsp bovis AF2122/97
cacaacggauaucagcaa

SEQ ID NO: 1131430 - RNA, 22 nt, Mycobacterium bovis subsp bovis AF2122/97
cacaacugauggcgcgcaacga

SEQ ID NO: 1131431 - RNA, 12 nt, Mycobacterium bovis subsp bovis AF2122/97
cacaaucaccgc

SEQ ID NO: 1131432 - RNA, 20 nt, Mycobacterium bovis subsp bovis AF2122/97
cacaaucagcccgacaccgu

SEQ ID NO: 1131433 - RNA, 20 nt, Mycobacterium bovis subsp bovis AF2122/97
cacaauccacgucgcggcgu

SEQ ID NO: 1131434 - RNA, 16 nt, Mycobacterium bovis subsp bovis AF2122/97
cacaaguaccgcaucg

SEQ ID NO: 1131435 - RNA, 13 nt, Mycobacterium bovis subsp bovis AF2122/97
cacaagucgacac

SEQ ID NO: 1131436 - RNA, 16 nt, Mycobacterium bovis subsp bovis AF2122/97
cacaaguggucgauga

SEQ ID NO: 1131437 - RNA, 15 nt, Mycobacterium bovis subsp bovis AF2122/97
cacaccacgauggcg

SEQ ID NO: 1131438 - RNA, 18 nt, Mycobacterium bovis subsp bovis AF2122/97
cacaccaacgucgauguc

SEQ ID NO: 1131439 - RNA, 17 nt, Mycobacterium bovis subsp bovis AF2122/97
cacacagguccugcgcc

SEQ ID NO: 1131440 - RNA, 17 nt, Mycobacterium bovis subsp bovis AF2122/97
cacacagucacggaccg

SEQ ID NO: 1131441 - RNA, 23 nt, Mycobacterium bovis subsp bovis AF2122/97
cacacaggcguccaucgccaccg

SEQ ID NO: 1131442 - RNA, 12 nt, Mycobacterium bovis subsp bovis AF2122/97
cacaccagcgca

SEQ ID NO: 1131443 - RNA, 18 nt, Mycobacterium bovis subsp bovis AF2122/97
cacaccagcgggcaucgc

SEQ ID NO: 1131444 - RNA, 14 nt, Mycobacterium bovis subsp bovis AF2122/97
cacaccagcggucg

SEQ ID NO: 1131445 - RNA, 15 nt, Mycobacterium bovis subsp bovis AF2122/97
cacaccagcggucgg

SEQ ID NO: 1131446 - RNA, 17 nt, Mycobacterium bovis subsp bovis AF2122/97
cacaccacgauggcggc

SEQ ID NO: 1131447 - RNA, 19 nt, Mycobacterium bovis subsp bovis AF2122/97
cacaccacgauggcggcca

SEQ ID NO: 1131448 - RNA, 21 nt, Mycobacterium bovis subsp bovis AF2122/97
cacaccagcuuguagcgcucg

SEQ ID NO: 1131449 - RNA, 13 nt, Mycobacterium bovis subsp bovis AF2122/97
cacaccaggccga

SEQ ID NO: 1131450 - RNA, 17 nt, Mycobacterium bovis subsp bovis AF2122/97
cacaccaggccgagccg

SEQ ID NO: 1131451 - RNA, 21 nt, Mycobacterium bovis subsp bovis AF2122/97
cacaccaggccgagccgcccg

SEQ ID NO: 1131452 - RNA, 22 nt, Mycobacterium bovis subsp bovis AF2122/97
cacacagaggucggucagccac

SEQ ID NO: 1131453 - RNA, 23 nt, Mycobacterium bovis subsp bovis AF2122/97
cacaauggcucugaggucaccgg

SEQ ID NO: 1131454 - RNA, 16 nt, Mycobacterium bovis subsp bovis AF2122/97
cacaaugcuucggcgu

SEQ ID NO: 1131455 - RNA, 12 nt, Mycobacterium bovis subsp bovis AF2122/97
cacaauggcggc

SEQ ID NO: 1131456 - RNA, 18 nt, Mycobacterium bovis subsp bovis AF2122/97
cacaauggcggcgccguc

SEQ ID NO: 1131457 - RNA, 19 nt, Mycobacterium bovis subsp bovis AF2122/97
cacaauggcggcgccgucg

SEQ ID NO: 1131458 - RNA, 20 nt, Mycobacterium bovis subsp bovis AF2122/97
caauguccaggcgcgcacca

SEQ ID NO: 1131459 - RNA, 21 nt, Mycobacterium bovis subsp bovis AF2122/97
caauguccaggcgcgcaccac

SEQ ID NO: 1131460 - RNA, 23 nt, Mycobacterium bovis subsp bovis AF2122/97
caaugucggugacaccaacaccg

SEQ ID NO: 1131461 - RNA, 17 nt, Mycobacterium bovis subsp bovis AF2122/97
caaugucguugcccgcg

SEQ ID NO: 1131462 - RNA, 19 nt, Mycobacterium bovis subsp bovis AF2122/97
caaugguucgugcacggcg

SEQ ID NO: 1131463 - RNA, 21 nt, Mycobacterium bovis subsp bovis AF2122/97
caauugcgguucgaacgcgau

SEQ ID NO: 1131464 - RNA, 13 nt, Mycobacterium bovis subsp bovis AF2122/97
caauugcccggca

SEQ ID NO: 1131465 - RNA, 16 nt, Mycobacterium bovis subsp bovis AF2122/97
caaugucgacaccggc

SEQ ID NO: 1131466 - RNA, 14 nt, Mycobacterium bovis subsp bovis AF2122/97
caaugugccgccgg

SEQ ID NO: 1131467 - RNA, 14 nt, Mycobacterium bovis subsp bovis AF2122/97
cacaacaccggcgu

SEQ ID NO: 1131468 - RNA, 18 nt, Mycobacterium bovis subsp bovis AF2122/97
caauuggcguagcaaccc

SEQ ID NO: 1131469 - RNA, 23 nt, Mycobacterium bovis subsp bovis AF2122/97
caacucggugacguuggcaggca

SEQ ID NO: 1131470 - RNA, 21 nt, Mycobacterium bovis subsp bovis AF2122/97
caacucggccaacgacggccg

SEQ ID NO: 1131471 - RNA, 22 nt, Mycobacterium bovis subsp bovis AF2122/97
caacucggccaacgacggccga

SEQ ID NO: 1131472 - RNA, 13 nt, Mycobacterium bovis subsp bovis AF2122/97
caacucggccacg

SEQ ID NO: 1131473 - RNA, 15 nt, Mycobacterium bovis subsp bovis AF2122/97
caacucggccacggc

SEQ ID NO: 1131474 - RNA, 16 nt, Mycobacterium bovis subsp bovis AF2122/97
caacuccggcaccggc

SEQ ID NO: 1131475 - RNA, 19 nt, Mycobacterium bovis subsp bovis AF2122/97
caacucggcgaugacauca

SEQ ID NO: 1131476 - RNA, 20 nt, Mycobacterium bovis subsp bovis AF2122/97
caacucgagaguggccucgu

SEQ ID NO: 1131477 - RNA, 18 nt, Mycobacterium bovis subsp bovis AF2122/97
caacuccgggaccggaaa

SEQ ID NO: 1131478 - RNA, 22 nt, Mycobacterium bovis subsp bovis AF2122/97
caacuccggucaacacccgccc

SEQ ID NO: 1131479 - RNA, 14 nt, Mycobacterium bovis subsp bovis AF2122/97
caacucaggccggu

SEQ ID NO: 1131480 - RNA, 21 nt, Mycobacterium bovis subsp bovis AF2122/97
caacagcaggugccaaccgcg

SEQ ID NO: 1131481 - RNA, 20 nt, Mycobacterium bovis subsp bovis AF2122/97
caacuccacccaacgcggug

SEQ ID NO: 1131482 - RNA, 18 nt, Mycobacterium bovis subsp bovis AF2122/97
caacuccagcacccgcug

SEQ ID NO: 1131483 - RNA, 19 nt, Mycobacterium bovis subsp bovis AF2122/97
caacuccacgcggaccucg

SEQ ID NO: 1131484 - RNA, 16 nt, Mycobacterium bovis subsp bovis AF2122/97
caacagcacguacugc

SEQ ID NO: 1131485 - RNA, 23 nt, Mycobacterium bovis subsp bovis AF2122/97
caacagcacccgggccacgucga

SEQ ID NO: 1131486 - RNA, 16 nt, Mycobacterium bovis subsp bovis AF2122/97
caacagcaccgcgacg

SEQ ID NO: 1131487 - RNA, 17 nt, Mycobacterium bovis subsp bovis AF2122/97
caacagcaccgcgacga

SEQ ID NO: 1131488 - RNA, 15 nt, Mycobacterium bovis subsp bovis AF2122/97
caacagaugccaccc

SEQ ID NO: 1131489 - RNA, 20 nt, Mycobacterium bovis subsp bovis AF2122/97
caacucguccagcagugcga

SEQ ID NO: 1131490 - RNA, 13 nt, Mycobacterium bovis subsp bovis AF2122/97
caacucgggcagc

SEQ ID NO: 1131491 - RNA, 15 nt, Mycobacterium bovis subsp bovis AF2122/97
caacuggccgcgucg

SEQ ID NO: 1131492 - RNA, 20 nt, Mycobacterium bovis subsp bovis AF2122/97
caacuggucgccaacgccag

SEQ ID NO: 1131493 - RNA, 15 nt, Mycobacterium bovis subsp bovis AF2122/97
caacuggugggccau

SEQ ID NO: 1131494 - RNA, 21 nt, Mycobacterium bovis subsp bovis AF2122/97
caacuggugggccaucgucag

SEQ ID NO: 1131495 - RNA, 14 nt, Mycobacterium bovis subsp bovis AF2122/97
caacuuacgcgacg

SEQ ID NO: 1131496 - RNA, 14 nt, Mycobacterium bovis subsp bovis AF2122/97
caagcacggcgucg

SEQ ID NO: 1131497 - RNA, 14 nt, Mycobacterium bovis subsp bovis AF2122/97
caagcacgguggcc

SEQ ID NO: 1131498 - RNA, 21 nt, Mycobacterium bovis subsp bovis AF2122/97
caagcacgguggccgagccgc

SEQ ID NO: 1131499 - RNA, 23 nt, Mycobacterium bovis subsp bovis AF2122/97
caagcacgguggccgagccgcgg

SEQ ID NO: 1131500 - RNA, 20 nt, Mycobacterium bovis subsp bovis AF2122/97
caagcacuaaucggccacuu

SEQ ID NO: 1131501 - RNA, 17 nt, Mycobacterium bovis subsp bovis AF2122/97
caagcagucgguauagc

SEQ ID NO: 1131502 - RNA, 21 nt, Mycobacterium bovis subsp bovis AF2122/97
caagcacauuauucuucgcgg

SEQ ID NO: 1131503 - RNA, 12 nt, Mycobacterium bovis subsp bovis AF2122/97
caagcagcgcga

SEQ ID NO: 1131504 - RNA, 21 nt, Mycobacterium bovis subsp bovis AF2122/97
caagcccaaaaagaccgccgc

SEQ ID NO: 1131505 - RNA, 23 nt, Mycobacterium bovis subsp bovis AF2122/97
caagcccaaaaagaccgccgcug

SEQ ID NO: 1131506 - RNA, 22 nt, Mycobacterium bovis subsp bovis AF2122/97
caagccaaccagcccggccgcc

SEQ ID NO: 1131507 - RNA, 17 nt, Mycobacterium bovis subsp bovis AF2122/97
caagcauuuccgcgaag

SEQ ID NO: 1131508 - RNA, 20 nt, Mycobacterium bovis subsp bovis AF2122/97
caagauggcccgucgugacc

SEQ ID NO: 1131509 - RNA, 14 nt, Mycobacterium bovis subsp bovis AF2122/97
caagaucggcagcg

SEQ ID NO: 1131510 - RNA, 12 nt, Mycobacterium bovis subsp bovis AF2122/97
caagaugaucgc

SEQ ID NO: 1131511 - RNA, 17 nt, Mycobacterium bovis subsp bovis AF2122/97
caagauccgccacgcuc

SEQ ID NO: 1131512 - RNA, 14 nt, Mycobacterium bovis subsp bovis AF2122/97
caagauugaacgag

SEQ ID NO: 1131513 - RNA, 14 nt, Mycobacterium bovis subsp bovis AF2122/97
caagcaaccggugc

SEQ ID NO: 1131514 - RNA, 15 nt, Mycobacterium bovis subsp bovis AF2122/97
caagaaggagaucga

SEQ ID NO: 1131515 - RNA, 17 nt, Mycobacterium bovis subsp bovis AF2122/97
caagaaggccagcgcgc

SEQ ID NO: 1131516 - RNA, 19 nt, Mycobacterium bovis subsp bovis AF2122/97
caagaaggccagcgcgccc

SEQ ID NO: 1131517 - RNA, 14 nt, Mycobacterium bovis subsp bovis AF2122/97
caagaaccacgacg

SEQ ID NO: 1131518 - RNA, 15 nt, Mycobacterium bovis subsp bovis AF2122/97
caagaaccacgacgu

SEQ ID NO: 1131519 - RNA, 13 nt, Mycobacterium bovis subsp bovis AF2122/97
caagaaucaccgg

SEQ ID NO: 1131520 - RNA, 16 nt, Mycobacterium bovis subsp bovis AF2122/97
caagaaucaccggcaa

SEQ ID NO: 1131521 - RNA, 14 nt, Mycobacterium bovis subsp bovis AF2122/97
caacuuggcggcca

SEQ ID NO: 1131522 - RNA, 21 nt, Mycobacterium bovis subsp bovis AF2122/97
caacuuggggucguucgccga

SEQ ID NO: 1131523 - RNA, 22 nt, Mycobacterium bovis subsp bovis AF2122/97
caagcgaugucccaucgcgucg

SEQ ID NO: 1131524 - RNA, 19 nt, Mycobacterium bovis subsp bovis AF2122/97
caagccauucacgagccgc

SEQ ID NO: 1131525 - RNA, 16 nt, Mycobacterium bovis subsp bovis AF2122/97
caagccgacaucggcg

SEQ ID NO: 1131526 - RNA, 15 nt, Mycobacterium bovis subsp bovis AF2122/97
caagcgcagacacga

SEQ ID NO: 1131527 - RNA, 23 nt, Mycobacterium bovis subsp bovis AF2122/97
caagcgcagccuggucgcgcagc

SEQ ID NO: 1131528 - RNA, 21 nt, Mycobacterium bovis subsp bovis AF2122/97
caagcgccgcgcuugcgaucg

SEQ ID NO: 1131529 - RNA, 23 nt, Mycobacterium bovis subsp bovis AF2122/97
caagcggguuguggcacccggcu

SEQ ID NO: 1131530 - RNA, 22 nt, Mycobacterium bovis subsp bovis AF2122/97
caagcggguuguggcacccggc

SEQ ID NO: 1131531 - RNA, 13 nt, Mycobacterium bovis subsp bovis AF2122/97
caagcgcggcgaa

SEQ ID NO: 1131532 - RNA, 13 nt, Mycobacterium bovis subsp bovis AF2122/97
caagcggccgcgg

SEQ ID NO: 1131533 - RNA, 23 nt, Mycobacterium bovis subsp bovis AF2122/97
caagcggacccgaccgucgucgu

SEQ ID NO: 1131534 - RNA, 15 nt, Mycobacterium bovis subsp bovis AF2122/97
caagguggcaugcga

SEQ ID NO: 1131535 - RNA, 15 nt, Mycobacterium bovis subsp bovis AF2122/97
caaggugcgccgcca

SEQ ID NO: 1131536 - RNA, 21 nt, Mycobacterium bovis subsp bovis AF2122/97
caagguccgcacgaucugcag

SEQ ID NO: 1131537 - RNA, 14 nt, Mycobacterium bovis subsp bovis AF2122/97
caaggucggccagg

SEQ ID NO: 1131538 - RNA, 15 nt, Mycobacterium bovis subsp bovis AF2122/97
caaggucggcgaucg

SEQ ID NO: 1131539 - RNA, 17 nt, Mycobacterium bovis subsp bovis AF2122/97
caagucggcgcuggccg

SEQ ID NO: 1131540 - RNA, 22 nt, Mycobacterium bovis subsp bovis AF2122/97
caagucgacgguggcgccgucg

SEQ ID NO: 1131541 - RNA, 24 nt, Mycobacterium bovis subsp bovis AF2122/97
caagguggcaugcgacagaugccg

SEQ ID NO: 1131542 - RNA, 14 nt, Mycobacterium bovis subsp bovis AF2122/97
caagguggccacca

SEQ ID NO: 1131543 - RNA, 15 nt, Mycobacterium bovis subsp bovis AF2122/97
caagguauggccgga

SEQ ID NO: 1131544 - RNA, 18 nt, Mycobacterium bovis subsp bovis AF2122/97
caaggguuggccgauaaa

SEQ ID NO: 1131545 - RNA, 16 nt, Mycobacterium bovis subsp bovis AF2122/97
caaggguggugacgcc

SEQ ID NO: 1131546 - RNA, 18 nt, Mycobacterium bovis subsp bovis AF2122/97
caaggguucaggucgggg

SEQ ID NO: 1131547 - RNA, 15 nt, Mycobacterium bovis subsp bovis AF2122/97
caagucucccggccg

SEQ ID NO: 1131548 - RNA, 22 nt, Mycobacterium bovis subsp bovis AF2122/97
caagucucccggccgcacccgu

SEQ ID NO: 1131549 - RNA, 17 nt, Mycobacterium bovis subsp bovis AF2122/97
caagucugugcucacgg

SEQ ID NO: 1131550 - RNA, 20 nt, Mycobacterium bovis subsp bovis AF2122/97
caagucugugcucacggcgg

SEQ ID NO: 1131551 - RNA, 13 nt, Mycobacterium bovis subsp bovis AF2122/97
caagugcccggcc

SEQ ID NO: 1131552 - RNA, 14 nt, Mycobacterium bovis subsp bovis AF2122/97
caagugccggcgcg

SEQ ID NO: 1131553 - RNA, 15 nt, Mycobacterium bovis subsp bovis AF2122/97
caagugccggcgcgg

SEQ ID NO: 1131554 - RNA, 19 nt, Mycobacterium bovis subsp bovis AF2122/97
caagugcgguccggcuucg

SEQ ID NO: 1131555 - RNA, 23 nt, Mycobacterium bovis subsp bovis AF2122/97
caagugcgguccggcuucggcga

SEQ ID NO: 1131556 - RNA, 15 nt, Mycobacterium bovis subsp bovis AF2122/97
caagugcuuccggcc

SEQ ID NO: 1131557 - RNA, 15 nt, Mycobacterium bovis subsp bovis AF2122/97
caaguggccagcgcc

SEQ ID NO: 1131558 - RNA, 17 nt, Mycobacterium bovis subsp bovis AF2122/97
caagugggugccggcac

SEQ ID NO: 1131559 - RNA, 19 nt, Mycobacterium bovis subsp bovis AF2122/97
caaguggugguaggccggg

SEQ ID NO: 1131560 - RNA, 22 nt, Mycobacterium bovis subsp bovis AF2122/97
caaguucacccaucaucgccac

SEQ ID NO: 1131561 - RNA, 19 nt, Mycobacterium bovis subsp bovis AF2122/97
caaguucgccagcaacguc

SEQ ID NO: 1131562 - RNA, 20 nt, Mycobacterium bovis subsp bovis AF2122/97
caaguucgccgauaucgcag

SEQ ID NO: 1131563 - RNA, 17 nt, Mycobacterium bovis subsp bovis AF2122/97
caaguugagcagcuugg

SEQ ID NO: 1131564 - RNA, 21 nt, Mycobacterium bovis subsp bovis AF2122/97
augcgggccgccaggcggccg

SEQ ID NO: 1131565 - RNA, 18 nt, Mycobacterium bovis subsp bovis AF2122/97
augcgggccuccugcugg

SEQ ID NO: 1131566 - RNA, 19 nt, Mycobacterium bovis subsp bovis AF2122/97
augcgggcgaucucgaugu

SEQ ID NO: 1131567 - RNA, 13 nt, Mycobacterium bovis subsp bovis AF2122/97
augcgggccauca

SEQ ID NO: 1131568 - RNA, 17 nt, Mycobacterium bovis subsp bovis AF2122/97
augcucagcaucgucga

SEQ ID NO: 1131569 - RNA, 21 nt, Mycobacterium bovis subsp bovis AF2122/97
augcucgagugggugaggcca

SEQ ID NO: 1131570 - RNA, 14 nt, Mycobacterium bovis subsp bovis AF2122/97
augcgggcagcgau

SEQ ID NO: 1131571 - RNA, 18 nt, Mycobacterium bovis subsp bovis AF2122/97
augcggcgcagcgacgcg

SEQ ID NO: 1131572 - RNA, 14 nt, Mycobacterium bovis subsp bovis AF2122/97
augcggcgucgaac

SEQ ID NO: 1131573 - RNA, 22 nt, Mycobacterium bovis subsp bovis AF2122/97
augcggccggauguugaccggc

SEQ ID NO: 1131574 - RNA, 23 nt, Mycobacterium bovis subsp bovis AF2122/97
augcggcggcgcucgucgaucuc

SEQ ID NO: 1131575 - RNA, 19 nt, Mycobacterium bovis subsp bovis AF2122/97
augcgcgucucgagcgcgc

SEQ ID NO: 1131576 - RNA, 14 nt, Mycobacterium bovis subsp bovis AF2122/97
augcgcguccccag

SEQ ID NO: 1131577 - RNA, 13 nt, Mycobacterium bovis subsp bovis AF2122/97
augcggccggaug

SEQ ID NO: 1131578 - RNA, 16 nt, Mycobacterium bovis subsp bovis AF2122/97
augcggcccggguggc

SEQ ID NO: 1131579 - RNA, 12 nt, Mycobacterium bovis subsp bovis AF2122/97
augcgccgccca

SEQ ID NO: 1131580 - RNA, 17 nt, Mycobacterium bovis subsp bovis AF2122/97
augcgccgcacggcgac

SEQ ID NO: 1131581 - RNA, 11 nt, Mycobacterium bovis subsp bovis AF2122/97
augcgccgaaa

SEQ ID NO: 1131582 - RNA, 16 nt, Mycobacterium bovis subsp bovis AF2122/97
augcgccaacccggcc

SEQ ID NO: 1131583 - RNA, 17 nt, Mycobacterium bovis subsp bovis AF2122/97
augcgccagcgagcgca

SEQ ID NO: 1131584 - RNA, 15 nt, Mycobacterium bovis subsp bovis AF2122/97
augcgagcgcgccgg

SEQ ID NO: 1131585 - RNA, 18 nt, Mycobacterium bovis subsp bovis AF2122/97
augcgagcgcgccggcca

SEQ ID NO: 1131586 - RNA, 18 nt, Mycobacterium bovis subsp bovis AF2122/97
augcgaaggcaucgcgga

SEQ ID NO: 1131587 - RNA, 12 nt, Mycobacterium bovis subsp bovis AF2122/97
augcgcagugca

SEQ ID NO: 1131588 - RNA, 23 nt, Mycobacterium bovis subsp bovis AF2122/97
augcgauaacccgcaucggaauc

SEQ ID NO: 1131589 - RNA, 21 nt, Mycobacterium bovis subsp bovis AF2122/97
augcgacccgcagaccgccac

SEQ ID NO: 1131590 - RNA, 11 nt, Mycobacterium bovis subsp bovis AF2122/97
augcgaccgcc

SEQ ID NO: 1131591 - RNA, 19 nt, Mycobacterium bovis subsp bovis AF2122/97
augcgacagaugccgggcu

SEQ ID NO: 1131592 - RNA, 19 nt, Mycobacterium bovis subsp bovis AF2122/97
augcgacgaaccucggcgg

SEQ ID NO: 1131593 - RNA, 16 nt, Mycobacterium bovis subsp bovis AF2122/97
augccggccgcggggc

SEQ ID NO: 1131594 - RNA, 19 nt, Mycobacterium bovis subsp bovis AF2122/97
augccgggauugccgucgg

SEQ ID NO: 1131595 - RNA, 16 nt, Mycobacterium bovis subsp bovis AF2122/97
augccuugaaacggug

SEQ ID NO: 1131596 - RNA, 23 nt, Mycobacterium bovis subsp bovis AF2122/97
augccggcgaacucgcgccgagc

SEQ ID NO: 1131597 - RNA, 19 nt, Mycobacterium bovis subsp bovis AF2122/97
augccggcgaaggccagca

SEQ ID NO: 1131598 - RNA, 13 nt, Mycobacterium bovis subsp bovis AF2122/97
augccgccggccc

SEQ ID NO: 1131599 - RNA, 17 nt, Mycobacterium bovis subsp bovis AF2122/97
augccgccggccccgcc

SEQ ID NO: 1131600 - RNA, 15 nt, Mycobacterium bovis subsp bovis AF2122/97
augccgccggcgggc

SEQ ID NO: 1131601 - RNA, 12 nt, Mycobacterium bovis subsp bovis AF2122/97
augccgccgacg

SEQ ID NO: 1131602 - RNA, 17 nt, Mycobacterium bovis subsp bovis AF2122/97
augccgccgacgggaac

SEQ ID NO: 1131603 - RNA, 17 nt, Mycobacterium bovis subsp bovis AF2122/97
augccgcccgcgccgcc

SEQ ID NO: 1131604 - RNA, 20 nt, Mycobacterium bovis subsp bovis AF2122/97
augccgcccgcgccgccgga

SEQ ID NO: 1131605 - RNA, 15 nt, Mycobacterium bovis subsp bovis AF2122/97
augccgcccaucacc

SEQ ID NO: 1131606 - RNA, 18 nt, Mycobacterium bovis subsp bovis AF2122/97
augccgcccagcgaccgc

SEQ ID NO: 1131607 - RNA, 19 nt, Mycobacterium bovis subsp bovis AF2122/97
augccgcccagcgaccgcu

SEQ ID NO: 1131608 - RNA, 20 nt, Mycobacterium bovis subsp bovis AF2122/97
augccgaccggcacccgcgg

SEQ ID NO: 1131609 - RNA, 22 nt, Mycobacterium bovis subsp bovis AF2122/97
augccgaccggcacccgcggcg

SEQ ID NO: 1131610 - RNA, 16 nt, Mycobacterium bovis subsp bovis AF2122/97
augcccggcaucgcga

SEQ ID NO: 1131611 - RNA, 20 nt, Mycobacterium bovis subsp bovis AF2122/97
augcccuccucgaccgcggc

SEQ ID NO: 1131612 - RNA, 16 nt, Mycobacterium bovis subsp bovis AF2122/97
augcccuuggccagca

SEQ ID NO: 1131613 - RNA, 16 nt, Mycobacterium bovis subsp bovis AF2122/97
augcccuggggguggc

SEQ ID NO: 1131614 - RNA, 15 nt, Mycobacterium bovis subsp bovis AF2122/97
augcccuuggccagc

SEQ ID NO: 1131615 - RNA, 15 nt, Mycobacterium bovis subsp bovis AF2122/97
augcccgcaccgcgu

SEQ ID NO: 1131616 - RNA, 19 nt, Mycobacterium bovis subsp bovis AF2122/97
augcccgguuucuucuuca

SEQ ID NO: 1131617 - RNA, 16 nt, Mycobacterium bovis subsp bovis AF2122/97
augccacagcggcgau

SEQ ID NO: 1131618 - RNA, 14 nt, Mycobacterium bovis subsp bovis AF2122/97
augccacaucguuc

SEQ ID NO: 1131619 - RNA, 16 nt, Mycobacterium bovis subsp bovis AF2122/97
augccaccgcggccgc

SEQ ID NO: 1131620 - RNA, 13 nt, Mycobacterium bovis subsp bovis AF2122/97
augccaacgguag

SEQ ID NO: 1131621 - RNA, 17 nt, Mycobacterium bovis subsp bovis AF2122/97
augcauggcuugcucug

SEQ ID NO: 1131622 - RNA, 16 nt, Mycobacterium bovis subsp bovis AF2122/97
augccagccacgaacu

SEQ ID NO: 1131623 - RNA, 17 nt, Mycobacterium bovis subsp bovis AF2122/97
augccagcggcacaccc

SEQ ID NO: 1131624 - RNA, 16 nt, Mycobacterium bovis subsp bovis AF2122/97
augcccagcgccgaau

SEQ ID NO: 1131625 - RNA, 15 nt, Mycobacterium bovis subsp bovis AF2122/97
augcccauccggccg

SEQ ID NO: 1131626 - RNA, 21 nt, Mycobacterium bovis subsp bovis AF2122/97
augcccauccggccgucgggc

SEQ ID NO: 1131627 - RNA, 20 nt, Mycobacterium bovis subsp bovis AF2122/97
augccccacggugcggugau

SEQ ID NO: 1131628 - RNA, 21 nt, Mycobacterium bovis subsp bovis AF2122/97
augccauagaugcccgcgauc

SEQ ID NO: 1131629 - RNA, 15 nt, Mycobacterium bovis subsp bovis AF2122/97
augccagugacaacc

SEQ ID NO: 1131630 - RNA, 17 nt, Mycobacterium bovis subsp bovis AF2122/97
augccagugcaucgguc

SEQ ID NO: 1131631 - RNA, 14 nt, Mycobacterium bovis subsp bovis AF2122/97
augcccacgcacag

SEQ ID NO: 1131632 - RNA, 13 nt, Mycobacterium bovis subsp bovis AF2122/97
auggcgccggccg

SEQ ID NO: 1131633 - RNA, 15 nt, Mycobacterium bovis subsp bovis AF2122/97
auggcgccggccggc

SEQ ID NO: 1131634 - RNA, 18 nt, Mycobacterium bovis subsp bovis AF2122/97
auggcgcaccggcgucgg

SEQ ID NO: 1131635 - RNA, 23 nt, Mycobacterium bovis subsp bovis AF2122/97
auggccgcgcccgccucgaccgc

SEQ ID NO: 1131636 - RNA, 14 nt, Mycobacterium bovis subsp bovis AF2122/97
auggccgccgcagc

SEQ ID NO: 1131637 - RNA, 14 nt, Mycobacterium bovis subsp bovis AF2122/97
auggccgccaggcg

SEQ ID NO: 1131638 - RNA, 12 nt, Mycobacterium bovis subsp bovis AF2122/97
auggccgccgac

SEQ ID NO: 1131639 - RNA, 13 nt, Mycobacterium bovis subsp bovis AF2122/97
auggccgccgaca

SEQ ID NO: 1131640 - RNA, 14 nt, Mycobacterium bovis subsp bovis AF2122/97
auggccgccgacaa

SEQ ID NO: 1131641 - RNA, 16 nt, Mycobacterium bovis subsp bovis AF2122/97
auggccgccaccgcga

SEQ ID NO: 1131642 - RNA, 18 nt, Mycobacterium bovis subsp bovis AF2122/97
auggccgccaccgcgacg

SEQ ID NO: 1131643 - RNA, 17 nt, Mycobacterium bovis subsp bovis AF2122/97
auggccgggaacacgug

SEQ ID NO: 1131644 - RNA, 18 nt, Mycobacterium bovis subsp bovis AF2122/97
auggccguccgaccgaua

SEQ ID NO: 1131645 - RNA, 13 nt, Mycobacterium bovis subsp bovis AF2122/97
auggcaccggcgu

SEQ ID NO: 1131646 - RNA, 13 nt, Mycobacterium bovis subsp bovis AF2122/97
auggcaagccguu

SEQ ID NO: 1131647 - RNA, 13 nt, Mycobacterium bovis subsp bovis AF2122/97
auggcaagcggcc

SEQ ID NO: 1131648 - RNA, 18 nt, Mycobacterium bovis subsp bovis AF2122/97
auggcaggcgaaggcggc

SEQ ID NO: 1131649 - RNA, 22 nt, Mycobacterium bovis subsp bovis AF2122/97
auggcagcggcgguaugcucgc

SEQ ID NO: 1131650 - RNA, 19 nt, Mycobacterium bovis subsp bovis AF2122/97
auggcccggcucacagcac

SEQ ID NO: 1131651 - RNA, 13 nt, Mycobacterium bovis subsp bovis AF2122/97
auggcccugggcc

SEQ ID NO: 1131652 - RNA, 20 nt, Mycobacterium bovis subsp bovis AF2122/97
auggcccuugcucguccagg

SEQ ID NO: 1131653 - RNA, 22 nt, Mycobacterium bovis subsp bovis AF2122/97
auggcauugcgcccaccgaaac

SEQ ID NO: 1131654 - RNA, 13 nt, Mycobacterium bovis subsp bovis AF2122/97
auggaccgccgcc

SEQ ID NO: 1131655 - RNA, 17 nt, Mycobacterium bovis subsp bovis AF2122/97
auggacggcagccagcc

SEQ ID NO: 1131656 - RNA, 14 nt, Mycobacterium bovis subsp bovis AF2122/97
auggagccggugac

SEQ ID NO: 1131657 - RNA, 19 nt, Mycobacterium bovis subsp bovis AF2122/97
augcugggcccgccagccc

SEQ ID NO: 1131658 - RNA, 19 nt, Mycobacterium bovis subsp bovis AF2122/97
augcuggcgaucgcgacga

SEQ ID NO: 1131659 - RNA, 16 nt, Mycobacterium bovis subsp bovis AF2122/97
augcuggcgcagcgcc

SEQ ID NO: 1131660 - RNA, 22 nt, Mycobacterium bovis subsp bovis AF2122/97
augcuggcggccucgccggcgc

SEQ ID NO: 1131661 - RNA, 15 nt, Mycobacterium bovis subsp bovis AF2122/97
augcuggcagcucgg

SEQ ID NO: 1131662 - RNA, 18 nt, Mycobacterium bovis subsp bovis AF2122/97
augcugagcgccaggccg

SEQ ID NO: 1131663 - RNA, 24 nt, Mycobacterium bovis subsp bovis AF2122/97
augcugccggcaccaaccaccgac

SEQ ID NO: 1131664 - RNA, 15 nt, Mycobacterium bovis subsp bovis AF2122/97
augcugcguccugga

SEQ ID NO: 1131665 - RNA, 20 nt, Mycobacterium bovis subsp bovis AF2122/97
augcuggcaaaguaucgcag

SEQ ID NO: 1131666 - RNA, 16 nt, Mycobacterium bovis subsp bovis AF2122/97
augcugccgccgccgc

SEQ ID NO: 1131667 - RNA, 22 nt, Mycobacterium bovis subsp bovis AF2122/97
augcugacgaacaugccauggc

SEQ ID NO: 1131668 - RNA, 14 nt, Mycobacterium bovis subsp bovis AF2122/97
augcugacggugca

SEQ ID NO: 1131669 - RNA, 20 nt, Mycobacterium bovis subsp bovis AF2122/97
augcugacgguggggauggc

SEQ ID NO: 1131670 - RNA, 22 nt, Mycobacterium bovis subsp bovis AF2122/97
augcucgucuugggccgggaug

SEQ ID NO: 1131671 - RNA, 14 nt, Mycobacterium bovis subsp bovis AF2122/97
augcucgaucgcgu

SEQ ID NO: 1131672 - RNA, 19 nt, Mycobacterium bovis subsp bovis AF2122/97
augcucgaugcgacgaacc

SEQ ID NO: 1131673 - RNA, 24 nt, Mycobacterium bovis subsp bovis AF2122/97
auggcgucaugaacgaucggacca

SEQ ID NO: 1131674 - RNA, 19 nt, Mycobacterium bovis subsp bovis AF2122/97
auggcggugggcuuggcgc

SEQ ID NO: 1131675 - RNA, 14 nt, Mycobacterium bovis subsp bovis AF2122/97
auggcggugagcac

SEQ ID NO: 1131676 - RNA, 19 nt, Mycobacterium bovis subsp bovis AF2122/97
auggcggcucguugcgggc

SEQ ID NO: 1131677 - RNA, 23 nt, Mycobacterium bovis subsp bovis AF2122/97
auggcggcuucgacgucggcgac

SEQ ID NO: 1131678 - RNA, 12 nt, Mycobacterium bovis subsp bovis AF2122/97
auggcgcgaccg

SEQ ID NO: 1131679 - RNA, 18 nt, Mycobacterium bovis subsp bovis AF2122/97
augggguguuugucgcgg

SEQ ID NO: 1131680 - RNA, 14 nt, Mycobacterium bovis subsp bovis AF2122/97
augggucaggccga

SEQ ID NO: 1131681 - RNA, 23 nt, Mycobacterium bovis subsp bovis AF2122/97
augggugugcugccaccggccgg

SEQ ID NO: 1131682 - RNA, 13 nt, Mycobacterium bovis subsp bovis AF2122/97
augggugacccgc

SEQ ID NO: 1131683 - RNA, 18 nt, Mycobacterium bovis subsp bovis AF2122/97
augggugagcacgauauu

SEQ ID NO: 1131684 - RNA, 19 nt, Mycobacterium bovis subsp bovis AF2122/97
augggcgauuuugcgucug

SEQ ID NO: 1131685 - RNA, 19 nt, Mycobacterium bovis subsp bovis AF2122/97
augggcucacacauagcga

SEQ ID NO: 1131686 - RNA, 17 nt, Mycobacterium bovis subsp bovis AF2122/97
augggggagccggugac

SEQ ID NO: 1131687 - RNA, 14 nt, Mycobacterium bovis subsp bovis AF2122/97
auggggcagcucau

SEQ ID NO: 1131688 - RNA, 14 nt, Mycobacterium bovis subsp bovis AF2122/97
augguccgaccagc

SEQ ID NO: 1131689 - RNA, 21 nt, Mycobacterium bovis subsp bovis AF2122/97
auggucaccgucugcaccggc

SEQ ID NO: 1131690 - RNA, 13 nt, Mycobacterium bovis subsp bovis AF2122/97
auggucagcagaa

SEQ ID NO: 1131691 - RNA, 15 nt, Mycobacterium bovis subsp bovis AF2122/97
auggucagcuggccg

SEQ ID NO: 1131692 - RNA, 16 nt, Mycobacterium bovis subsp bovis AF2122/97
auggucacggcgucga

SEQ ID NO: 1131693 - RNA, 12 nt, Mycobacterium bovis subsp bovis AF2122/97
auggucaccgga

SEQ ID NO: 1131694 - RNA, 16 nt, Mycobacterium bovis subsp bovis AF2122/97
auggucaaccgcgccc

SEQ ID NO: 1131695 - RNA, 13 nt, Mycobacterium bovis subsp bovis AF2122/97
augguccggccgc

SEQ ID NO: 1131696 - RNA, 16 nt, Mycobacterium bovis subsp bovis AF2122/97
augguccgggccuauc

SEQ ID NO: 1131697 - RNA, 22 nt, Mycobacterium bovis subsp bovis AF2122/97
augguccagcacaucggcgagc

SEQ ID NO: 1131698 - RNA, 23 nt, Mycobacterium bovis subsp bovis AF2122/97
augguccagcacaucggcgagca

SEQ ID NO: 1131699 - RNA, 16 nt, Mycobacterium bovis subsp bovis AF2122/97
augguugcgacggcgu

SEQ ID NO: 1131700 - RNA, 15 nt, Mycobacterium bovis subsp bovis AF2122/97
augguuggaucgcca

SEQ ID NO: 1131701 - RNA, 19 nt, Mycobacterium bovis subsp bovis AF2122/97
auguccaggcgcgcaccac

SEQ ID NO: 1131702 - RNA, 21 nt, Mycobacterium bovis subsp bovis AF2122/97
auguccaggcgcgcaccaccg

SEQ ID NO: 1131703 - RNA, 16 nt, Mycobacterium bovis subsp bovis AF2122/97
augucagugccccgcc

SEQ ID NO: 1131704 - RNA, 17 nt, Mycobacterium bovis subsp bovis AF2122/97
augucaccugggccagc

SEQ ID NO: 1131705 - RNA, 17 nt, Mycobacterium bovis subsp bovis AF2122/97
augucaaguucgccagc

SEQ ID NO: 1131706 - RNA, 15 nt, Mycobacterium bovis subsp bovis AF2122/97
augucagcggccugc

SEQ ID NO: 1131707 - RNA, 21 nt, Mycobacterium bovis subsp bovis AF2122/97
augucaaccaagugaccggcc

SEQ ID NO: 1131708 - RNA, 19 nt, Mycobacterium bovis subsp bovis AF2122/97
auguaugacaggucacggu

SEQ ID NO: 1131709 - RNA, 18 nt, Mycobacterium bovis subsp bovis AF2122/97
aucucuaccagccgcccc

SEQ ID NO: 1131710 - RNA, 16 nt, Mycobacterium bovis subsp bovis AF2122/97
aucucugagcgggcgg

SEQ ID NO: 1131711 - RNA, 21 nt, Mycobacterium bovis subsp bovis AF2122/97
aucugaagagcggagccggcg

SEQ ID NO: 1131712 - RNA, 22 nt, Mycobacterium bovis subsp bovis AF2122/97
aucugaagagcggagccggcgc

SEQ ID NO: 1131713 - RNA, 16 nt, Mycobacterium bovis subsp bovis AF2122/97
aucugauccggugccg

SEQ ID NO: 1131714 - RNA, 22 nt, Mycobacterium bovis subsp bovis AF2122/97
aucugacgacgcgacacgccga

SEQ ID NO: 1131715 - RNA, 15 nt, Mycobacterium bovis subsp bovis AF2122/97
aucugcccggugauc

SEQ ID NO: 1131716 - RNA, 17 nt, Mycobacterium bovis subsp bovis AF2122/97
aucugcgacaagaccgg

SEQ ID NO: 1131717 - RNA, 18 nt, Mycobacterium bovis subsp bovis AF2122/97
aucugcgacaagaccggc

SEQ ID NO: 1131718 - RNA, 14 nt, Mycobacterium bovis subsp bovis AF2122/97
aucugcgccaucac

SEQ ID NO: 1131719 - RNA, 12 nt, Mycobacterium bovis subsp bovis AF2122/97
aucugccggccg

SEQ ID NO: 1131720 - RNA, 13 nt, Mycobacterium bovis subsp bovis AF2122/97
aucugccggccgg

SEQ ID NO: 1131721 - RNA, 14 nt, Mycobacterium bovis subsp bovis AF2122/97
aucugccaccgcgg

SEQ ID NO: 1131722 - RNA, 16 nt, Mycobacterium bovis subsp bovis AF2122/97
aucugccacguugauc

SEQ ID NO: 1131723 - RNA, 20 nt, Mycobacterium bovis subsp bovis AF2122/97
aucugcacauucagcgccgc

SEQ ID NO: 1131724 - RNA, 17 nt, Mycobacterium bovis subsp bovis AF2122/97
aucugcacgcgcucgcg

SEQ ID NO: 1131725 - RNA, 23 nt, Mycobacterium bovis subsp bovis AF2122/97
aucugcagcacucggugucggcc

SEQ ID NO: 1131726 - RNA, 18 nt, Mycobacterium bovis subsp bovis AF2122/97
aucuccacccgccggccg

SEQ ID NO: 1131727 - RNA, 19 nt, Mycobacterium bovis subsp bovis AF2122/97
aucucccauacgccggccg

SEQ ID NO: 1131728 - RNA, 16 nt, Mycobacterium bovis subsp bovis AF2122/97
aucuccccgaccgcgc

SEQ ID NO: 1131729 - RNA, 16 nt, Mycobacterium bovis subsp bovis AF2122/97
aucucccgaaucgugc

SEQ ID NO: 1131730 - RNA, 16 nt, Mycobacterium bovis subsp bovis AF2122/97
aucuccgccgucgcca

SEQ ID NO: 1131731 - RNA, 22 nt, Mycobacterium bovis subsp bovis AF2122/97
aucuccgccgucgccaccggua

SEQ ID NO: 1131732 - RNA, 18 nt, Mycobacterium bovis subsp bovis AF2122/97
aucuccgcgucggucagc

SEQ ID NO: 1131733 - RNA, 17 nt, Mycobacterium bovis subsp bovis AF2122/97
aucucggcguugccgcc

SEQ ID NO: 1131734 - RNA, 23 nt, Mycobacterium bovis subsp bovis AF2122/97
aucucggcggccgcgugcucgcc

SEQ ID NO: 1131735 - RNA, 15 nt, Mycobacterium bovis subsp bovis AF2122/97
aucucggcggccaac

SEQ ID NO: 1131736 - RNA, 15 nt, Mycobacterium bovis subsp bovis AF2122/97
aucucggcgaacgcg

SEQ ID NO: 1131737 - RNA, 17 nt, Mycobacterium bovis subsp bovis AF2122/97
aucucggcggccgcgug

SEQ ID NO: 1131738 - RNA, 13 nt, Mycobacterium bovis subsp bovis AF2122/97
aucucgucgaucu

SEQ ID NO: 1131739 - RNA, 18 nt, Mycobacterium bovis subsp bovis AF2122/97
aucucgucgaucucgcga

SEQ ID NO: 1131740 - RNA, 16 nt, Mycobacterium bovis subsp bovis AF2122/97
aucucggugguggcca

SEQ ID NO: 1131741 - RNA, 18 nt, Mycobacterium bovis subsp bovis AF2122/97
aucguggcgucgugcgcg

SEQ ID NO: 1131742 - RNA, 13 nt, Mycobacterium bovis subsp bovis AF2122/97
aucgugguucggc

SEQ ID NO: 1131743 - RNA, 16 nt, Mycobacterium bovis subsp bovis AF2122/97
aucgugggugccggcu

SEQ ID NO: 1131744 - RNA, 18 nt, Mycobacterium bovis subsp bovis AF2122/97
aucgugggugccggcuca

SEQ ID NO: 1131745 - RNA, 12 nt, Mycobacterium bovis subsp bovis AF2122/97
aucguggcgacc

SEQ ID NO: 1131746 - RNA, 18 nt, Mycobacterium bovis subsp bovis AF2122/97
aucgugguuuggaccgcu

SEQ ID NO: 1131747 - RNA, 16 nt, Mycobacterium bovis subsp bovis AF2122/97
aucgugcgccgacggu

SEQ ID NO: 1131748 - RNA, 14 nt, Mycobacterium bovis subsp bovis AF2122/97
aucgugccggcgaa

SEQ ID NO: 1131749 - RNA, 15 nt, Mycobacterium bovis subsp bovis AF2122/97
aucgugccggcgaac

SEQ ID NO: 1131750 - RNA, 16 nt, Mycobacterium bovis subsp bovis AF2122/97
aucgugccggcgaacc

SEQ ID NO: 1131751 - RNA, 22 nt, Mycobacterium bovis subsp bovis AF2122/97
aucuccaccggcgaucugcucg

SEQ ID NO: 1131752 - RNA, 13 nt, Mycobacterium bovis subsp bovis AF2122/97
aucuccaccgucg

SEQ ID NO: 1131753 - RNA, 20 nt, Mycobacterium bovis subsp bovis AF2122/97
aucucaccgggcccgacgac

SEQ ID NO: 1131754 - RNA, 16 nt, Mycobacterium bovis subsp bovis AF2122/97
aucgucgccgagcggg

SEQ ID NO: 1131755 - RNA, 12 nt, Mycobacterium bovis subsp bovis AF2122/97
aucgugccggcg

SEQ ID NO: 1131756 - RNA, 13 nt, Mycobacterium bovis subsp bovis AF2122/97
aucgugccggcga

SEQ ID NO: 1131757 - RNA, 14 nt, Mycobacterium bovis subsp bovis AF2122/97
aucgucggccagca

SEQ ID NO: 1131758 - RNA, 17 nt, Mycobacterium bovis subsp bovis AF2122/97
aucgucggccagcagau

SEQ ID NO: 1131759 - RNA, 19 nt, Mycobacterium bovis subsp bovis AF2122/97
aucgucgccacgaugccgg

SEQ ID NO: 1131760 - RNA, 23 nt, Mycobacterium bovis subsp bovis AF2122/97
aucgucgagcaccuugcgauugc

SEQ ID NO: 1131761 - RNA, 17 nt, Mycobacterium bovis subsp bovis AF2122/97
aucgucgagccgaucgc

SEQ ID NO: 1131762 - RNA, 20 nt, Mycobacterium bovis subsp bovis AF2122/97
aucgucgagccgaucgcccg

SEQ ID NO: 1131763 - RNA, 22 nt, Mycobacterium bovis subsp bovis AF2122/97
aucgucgauggucuccggacgc

SEQ ID NO: 1131764 - RNA, 12 nt, Mycobacterium bovis subsp bovis AF2122/97
aucguaggccgg

SEQ ID NO: 1131765 - RNA, 17 nt, Mycobacterium bovis subsp bovis AF2122/97
aucgucgacgaugucgg

SEQ ID NO: 1131766 - RNA, 17 nt, Mycobacterium bovis subsp bovis AF2122/97
aucguagguacgcaggg

SEQ ID NO: 1131767 - RNA, 17 nt, Mycobacterium bovis subsp bovis AF2122/97
aucguagccguagcggu

SEQ ID NO: 1131768 - RNA, 16 nt, Mycobacterium bovis subsp bovis AF2122/97
aucgguguggcccaac

SEQ ID NO: 1131769 - RNA, 23 nt, Mycobacterium bovis subsp bovis AF2122/97
aucgguguggcccaacaccgcca

SEQ ID NO: 1131770 - RNA, 23 nt, Mycobacterium bovis subsp bovis AF2122/97
aucgguggcgccgaacgccagca

SEQ ID NO: 1131771 - RNA, 17 nt, Mycobacterium bovis subsp bovis AF2122/97
aucggugggcgggugcg

SEQ ID NO: 1131772 - RNA, 21 nt, Mycobacterium bovis subsp bovis AF2122/97
aucgguggucguaggugacga

SEQ ID NO: 1131773 - RNA, 14 nt, Mycobacterium bovis subsp bovis AF2122/97
aucgguggccacca

SEQ ID NO: 1131774 - RNA, 19 nt, Mycobacterium bovis subsp bovis AF2122/97
aucgguggccaccaccgug

SEQ ID NO: 1131775 - RNA, 17 nt, Mycobacterium bovis subsp bovis AF2122/97
aucgguggccaucgcga

SEQ ID NO: 1131776 - RNA, 16 nt, Mycobacterium bovis subsp bovis AF2122/97
aucgguggcgccgaac

SEQ ID NO: 1131777 - RNA, 18 nt, Mycobacterium bovis subsp bovis AF2122/97
aucggugcacaacgccca

SEQ ID NO: 1131778 - RNA, 23 nt, Mycobacterium bovis subsp bovis AF2122/97
aucggugccaaaggacgacaccg

SEQ ID NO: 1131779 - RNA, 13 nt, Mycobacterium bovis subsp bovis AF2122/97
aucggugccggcc

SEQ ID NO: 1131780 - RNA, 14 nt, Mycobacterium bovis subsp bovis AF2122/97
aucggugccggccu

SEQ ID NO: 1131781 - RNA, 23 nt, Mycobacterium bovis subsp bovis AF2122/97
aucggugaugaacgacauccggc

SEQ ID NO: 1131782 - RNA, 17 nt, Mycobacterium bovis subsp bovis AF2122/97
aucgguucguagcgggc

SEQ ID NO: 1131783 - RNA, 23 nt, Mycobacterium bovis subsp bovis AF2122/97
aucgguguggacuucagcaggcc

SEQ ID NO: 1131784 - RNA, 14 nt, Mycobacterium bovis subsp bovis AF2122/97
aucgguugaccggu

SEQ ID NO: 1131785 - RNA, 16 nt, Mycobacterium bovis subsp bovis AF2122/97
aucgguugaucggcca

SEQ ID NO: 1131786 - RNA, 20 nt, Mycobacterium bovis subsp bovis AF2122/97
aucgaaccgcugcuccucgc

SEQ ID NO: 1131787 - RNA, 14 nt, Mycobacterium bovis subsp bovis AF2122/97
aucgaagaccagca

SEQ ID NO: 1131788 - RNA, 15 nt, Mycobacterium bovis subsp bovis AF2122/97
aucgaagcggcugcu

SEQ ID NO: 1131789 - RNA, 14 nt, Mycobacterium bovis subsp bovis AF2122/97
aucgaaccgcugcu

SEQ ID NO: 1131790 - RNA, 15 nt, Mycobacterium bovis subsp bovis AF2122/97
aucgaaccgcugcuc

SEQ ID NO: 1131791 - RNA, 19 nt, Mycobacterium bovis subsp bovis AF2122/97
aucgacaccgugaccgccg

SEQ ID NO: 1131792 - RNA, 14 nt, Mycobacterium bovis subsp bovis AF2122/97
aucgacagccccgc

SEQ ID NO: 1131793 - RNA, 16 nt, Mycobacterium bovis subsp bovis AF2122/97
aucgacagccccgcgg

SEQ ID NO: 1131794 - RNA, 22 nt, Mycobacterium bovis subsp bovis AF2122/97
aucgacagccccgcggccagca

SEQ ID NO: 1131795 - RNA, 20 nt, Mycobacterium bovis subsp bovis AF2122/97
aucgacacccuuaggaccca

SEQ ID NO: 1131796 - RNA, 15 nt, Mycobacterium bovis subsp bovis AF2122/97
aucgacaaucgcacg

SEQ ID NO: 1131797 - RNA, 21 nt, Mycobacterium bovis subsp bovis AF2122/97
aucgaagcggcugcugcgcgg

SEQ ID NO: 1131798 - RNA, 21 nt, Mycobacterium bovis subsp bovis AF2122/97
aucgaauuccagccagccgcc

SEQ ID NO: 1131799 - RNA, 22 nt, Mycobacterium bovis subsp bovis AF2122/97
aucgaauugcguucgccgcccg

SEQ ID NO: 1131800 - RNA, 13 nt, Mycobacterium bovis subsp bovis AF2122/97
aucgggcccagca

SEQ ID NO: 1131801 - RNA, 19 nt, Mycobacterium bovis subsp bovis AF2122/97
aucgggcccaccgcugcgg

SEQ ID NO: 1131802 - RNA, 15 nt, Mycobacterium bovis subsp bovis AF2122/97
aucgggccgccgagc

SEQ ID NO: 1131803 - RNA, 19 nt, Mycobacterium bovis subsp bovis AF2122/97
aucgggcccccuggaucgc

SEQ ID NO: 1131804 - RNA, 20 nt, Mycobacterium bovis subsp bovis AF2122/97
aucgggcccccuggaucgcg

SEQ ID NO: 1131805 - RNA, 18 nt, Mycobacterium bovis subsp bovis AF2122/97
aucgggagccgcacccga

SEQ ID NO: 1131806 - RNA, 13 nt, Mycobacterium bovis subsp bovis AF2122/97
aucgggagcggcu

SEQ ID NO: 1131807 - RNA, 17 nt, Mycobacterium bovis subsp bovis AF2122/97
aucgggagcggcugcgg

SEQ ID NO: 1131808 - RNA, 19 nt, Mycobacterium bovis subsp bovis AF2122/97
aucgggaucugcgccgcgc

SEQ ID NO: 1131809 - RNA, 22 nt, Mycobacterium bovis subsp bovis AF2122/97
aucgggaucugcgccgcgcgcg

SEQ ID NO: 1131810 - RNA, 22 nt, Mycobacterium bovis subsp bovis AF2122/97
aucgggcgagcucgucgagcgc

SEQ ID NO: 1131811 - RNA, 17 nt, Mycobacterium bovis subsp bovis AF2122/97
aucgggcccuccggcgc

SEQ ID NO: 1131812 - RNA, 14 nt, Mycobacterium bovis subsp bovis AF2122/97
aucgggcgagcucg

SEQ ID NO: 1131813 - RNA, 16 nt, Mycobacterium bovis subsp bovis AF2122/97
aucgggcucagcggcg

SEQ ID NO: 1131814 - RNA, 18 nt, Mycobacterium bovis subsp bovis AF2122/97
aucgggcucagcggcgac

SEQ ID NO: 1131815 - RNA, 20 nt, Mycobacterium bovis subsp bovis AF2122/97
aucggugaaucgucugacga

SEQ ID NO: 1131816 - RNA, 16 nt, Mycobacterium bovis subsp bovis AF2122/97
aucggugaccguggcg

SEQ ID NO: 1131817 - RNA, 22 nt, Mycobacterium bovis subsp bovis AF2122/97
aucggugaucaaaccggcggcg

SEQ ID NO: 1131818 - RNA, 13 nt, Mycobacterium bovis subsp bovis AF2122/97
aucgggccggcgc

SEQ ID NO: 1131819 - RNA, 14 nt, Mycobacterium bovis subsp bovis AF2122/97
aucggucaccgcgg

SEQ ID NO: 1131820 - RNA, 18 nt, Mycobacterium bovis subsp bovis AF2122/97
aucggucauguccguccg

SEQ ID NO: 1131821 - RNA, 12 nt, Mycobacterium bovis subsp bovis AF2122/97
aucggucgacga

SEQ ID NO: 1131822 - RNA, 12 nt, Mycobacterium bovis subsp bovis AF2122/97
aucggucgaucg

SEQ ID NO: 1131823 - RNA, 20 nt, Mycobacterium bovis subsp bovis AF2122/97
augcagggcccgcaacaucg

SEQ ID NO: 1131824 - RNA, 24 nt, Mycobacterium bovis subsp bovis AF2122/97
augcagggcccgcaacaucggguc

SEQ ID NO: 1131825 - RNA, 16 nt, Mycobacterium bovis subsp bovis AF2122/97
augcagugacagugcg

SEQ ID NO: 1131826 - RNA, 21 nt, Mycobacterium bovis subsp bovis AF2122/97
augcacgucaucggcuggccg

SEQ ID NO: 1131827 - RNA, 17 nt, Mycobacterium bovis subsp bovis AF2122/97
augcacgcccaggcgac

SEQ ID NO: 1131828 - RNA, 23 nt, Mycobacterium bovis subsp bovis AF2122/97
augcacgcccaggcgaccgcuga

SEQ ID NO: 1131829 - RNA, 14 nt, Mycobacterium bovis subsp bovis AF2122/97
augcacgaucgcca

SEQ ID NO: 1131830 - RNA, 22 nt, Mycobacterium bovis subsp bovis AF2122/97
augcaagucaaacgccgucacg

SEQ ID NO: 1131831 - RNA, 22 nt, Mycobacterium bovis subsp bovis AF2122/97
augcaccguuguaugcugcgcg

SEQ ID NO: 1131832 - RNA, 15 nt, Mycobacterium bovis subsp bovis AF2122/97
augcaccgaugccga

SEQ ID NO: 1131833 - RNA, 15 nt, Mycobacterium bovis subsp bovis AF2122/97
augcacccgcaccgg

SEQ ID NO: 1131834 - RNA, 18 nt, Mycobacterium bovis subsp bovis AF2122/97
augcacccgcaccgguga

SEQ ID NO: 1131835 - RNA, 12 nt, Mycobacterium bovis subsp bovis AF2122/97
augcacccggua

SEQ ID NO: 1131836 - RNA, 14 nt, Mycobacterium bovis subsp bovis AF2122/97
augacgcccagggc

SEQ ID NO: 1131837 - RNA, 16 nt, Mycobacterium bovis subsp bovis AF2122/97
augacgccgucagcgg

SEQ ID NO: 1131838 - RNA, 16 nt, Mycobacterium bovis subsp bovis AF2122/97
augagcgccacgccga

SEQ ID NO: 1131839 - RNA, 12 nt, Mycobacterium bovis subsp bovis AF2122/97
augagcucggcc

SEQ ID NO: 1131840 - RNA, 14 nt, Mycobacterium bovis subsp bovis AF2122/97
augagcucggccau

SEQ ID NO: 1131841 - RNA, 23 nt, Mycobacterium bovis subsp bovis AF2122/97
augagcgugccgcagcggcggca

SEQ ID NO: 1131842 - RNA, 13 nt, Mycobacterium bovis subsp bovis AF2122/97
augagcgcucggg

SEQ ID NO: 1131843 - RNA, 21 nt, Mycobacterium bovis subsp bovis AF2122/97
augagccggucuugcaucgcc

SEQ ID NO: 1131844 - RNA, 15 nt, Mycobacterium bovis subsp bovis AF2122/97
augauucagccggcu

SEQ ID NO: 1131845 - RNA, 19 nt, Mycobacterium bovis subsp bovis AF2122/97
augauucggcacgccgggc

SEQ ID NO: 1131846 - RNA, 23 nt, Mycobacterium bovis subsp bovis AF2122/97
augauguggugugccugcgucuc

SEQ ID NO: 1131847 - RNA, 16 nt, Mycobacterium bovis subsp bovis AF2122/97
augcaacacaccgcgg

SEQ ID NO: 1131848 - RNA, 16 nt, Mycobacterium bovis subsp bovis AF2122/97
augcaacuccucgacc

SEQ ID NO: 1131849 - RNA, 19 nt, Mycobacterium bovis subsp bovis AF2122/97
augcaacuccucgaccgug

SEQ ID NO: 1131850 - RNA, 16 nt, Mycobacterium bovis subsp bovis AF2122/97
augcaacucggcagau

SEQ ID NO: 1131851 - RNA, 20 nt, Mycobacterium bovis subsp bovis AF2122/97
augauugccaggaccgcgcc

SEQ ID NO: 1131852 - RNA, 19 nt, Mycobacterium bovis subsp bovis AF2122/97
augauuucgucgaucggcu

SEQ ID NO: 1131853 - RNA, 12 nt, Mycobacterium bovis subsp bovis AF2122/97
augaagccguug

SEQ ID NO: 1131854 - RNA, 12 nt, Mycobacterium bovis subsp bovis AF2122/97
augaagccaccc

SEQ ID NO: 1131855 - RNA, 20 nt, Mycobacterium bovis subsp bovis AF2122/97
augaacgcaagcagcgcgau

SEQ ID NO: 1131856 - RNA, 16 nt, Mycobacterium bovis subsp bovis AF2122/97
augaacuucccacccg

SEQ ID NO: 1131857 - RNA, 14 nt, Mycobacterium bovis subsp bovis AF2122/97
augacaaaccugca

SEQ ID NO: 1131858 - RNA, 22 nt, Mycobacterium bovis subsp bovis AF2122/97
augacaaaccugcaugcccaga

SEQ ID NO: 1131859 - RNA, 16 nt, Mycobacterium bovis subsp bovis AF2122/97
augaagcucgaccgcc

SEQ ID NO: 1131860 - RNA, 23 nt, Mycobacterium bovis subsp bovis AF2122/97
augaaggagaucccccaggcgaa

SEQ ID NO: 1131861 - RNA, 15 nt, Mycobacterium bovis subsp bovis AF2122/97
augaaggccggcgac

SEQ ID NO: 1131862 - RNA, 18 nt, Mycobacterium bovis subsp bovis AF2122/97
augaccuucccgucgacg

SEQ ID NO: 1131863 - RNA, 14 nt, Mycobacterium bovis subsp bovis AF2122/97
augaccuggccgcc

SEQ ID NO: 1131864 - RNA, 21 nt, Mycobacterium bovis subsp bovis AF2122/97
augaccuguagaucagcagcg

SEQ ID NO: 1131865 - RNA, 16 nt, Mycobacterium bovis subsp bovis AF2122/97
augacgaagugcaggu

SEQ ID NO: 1131866 - RNA, 14 nt, Mycobacterium bovis subsp bovis AF2122/97
augacgaucggcgg

SEQ ID NO: 1131867 - RNA, 22 nt, Mycobacterium bovis subsp bovis AF2122/97
augacgaucggcggcgcgccga

SEQ ID NO: 1131868 - RNA, 17 nt, Mycobacterium bovis subsp bovis AF2122/97
augacgaugccgccgaa

SEQ ID NO: 1131869 - RNA, 20 nt, Mycobacterium bovis subsp bovis AF2122/97
augacgauggccgccgcgag

SEQ ID NO: 1131870 - RNA, 19 nt, Mycobacterium bovis subsp bovis AF2122/97
augacgaugguguacugcu

SEQ ID NO: 1131871 - RNA, 16 nt, Mycobacterium bovis subsp bovis AF2122/97
augacaccgaccgggu

SEQ ID NO: 1131872 - RNA, 13 nt, Mycobacterium bovis subsp bovis AF2122/97
aucuugucgaucu

SEQ ID NO: 1131873 - RNA, 15 nt, Mycobacterium bovis subsp bovis AF2122/97
aucuggccggcggug

SEQ ID NO: 1131874 - RNA, 19 nt, Mycobacterium bovis subsp bovis AF2122/97
aucuggccgaacgacgggu

SEQ ID NO: 1131875 - RNA, 15 nt, Mycobacterium bovis subsp bovis AF2122/97
aucuggcgcugcugg

SEQ ID NO: 1131876 - RNA, 21 nt, Mycobacterium bovis subsp bovis AF2122/97
aucuggcgcugcuggcagacc

SEQ ID NO: 1131877 - RNA, 17 nt, Mycobacterium bovis subsp bovis AF2122/97
aucugguaagucagcuc

SEQ ID NO: 1131878 - RNA, 23 nt, Mycobacterium bovis subsp bovis AF2122/97
aucugguaagucagcucgaucac

SEQ ID NO: 1131879 - RNA, 20 nt, Mycobacterium bovis subsp bovis AF2122/97
aucugggcuuucgcgugcgg

SEQ ID NO: 1131880 - RNA, 18 nt, Mycobacterium bovis subsp bovis AF2122/97
aucuggggguagccgccg

SEQ ID NO: 1131881 - RNA, 22 nt, Mycobacterium bovis subsp bovis AF2122/97
aucuggggguagccgccggcgc

SEQ ID NO: 1131882 - RNA, 21 nt, Mycobacterium bovis subsp bovis AF2122/97
aucuggguccgucgagucgcc

SEQ ID NO: 1131883 - RNA, 19 nt, Mycobacterium bovis subsp bovis AF2122/97
aucuuggcgcccgccggca

SEQ ID NO: 1131884 - RNA, 13 nt, Mycobacterium bovis subsp bovis AF2122/97
aucuuggccagca

SEQ ID NO: 1131885 - RNA, 20 nt, Mycobacterium bovis subsp bovis AF2122/97
aucuucuucagguagcggcc

SEQ ID NO: 1131886 - RNA, 14 nt, Mycobacterium bovis subsp bovis AF2122/97
aaacuauugcaccg

SEQ ID NO: 1131887 - RNA, 12 nt, Mycobacterium bovis subsp bovis AF2122/97
auucccgcccag

SEQ ID NO: 1131888 - RNA, 19 nt, Mycobacterium bovis subsp bovis AF2122/97
auucagcgguuggacaacg

SEQ ID NO: 1131889 - RNA, 22 nt, Mycobacterium bovis subsp bovis AF2122/97
auucacgcucggcguccgccca

SEQ ID NO: 1131890 - RNA, 24 nt, Mycobacterium bovis subsp bovis AF2122/97
auuccagcgcguaguccgcauccg

SEQ ID NO: 1131891 - RNA, 20 nt, Mycobacterium bovis subsp bovis AF2122/97
auuccagccccccggcgacg

SEQ ID NO: 1131892 - RNA, 14 nt, Mycobacterium bovis subsp bovis AF2122/97
auuccaccgccgac

SEQ ID NO: 1131893 - RNA, 20 nt, Mycobacterium bovis subsp bovis AF2122/97
auuccaccgccgacgcccga

SEQ ID NO: 1131894 - RNA, 19 nt, Mycobacterium bovis subsp bovis AF2122/97
auucgacugcaacucuucc

SEQ ID NO: 1131895 - RNA, 21 nt, Mycobacterium bovis subsp bovis AF2122/97
auucgacuucggggucaccgg

SEQ ID NO: 1131896 - RNA, 22 nt, Mycobacterium bovis subsp bovis AF2122/97
auucgaccucaauuggcucggc

SEQ ID NO: 1131897 - RNA, 19 nt, Mycobacterium bovis subsp bovis AF2122/97
auuccggcgcggccggccg

SEQ ID NO: 1131898 - RNA, 22 nt, Mycobacterium bovis subsp bovis AF2122/97
auuccggcggagcgggccagca

SEQ ID NO: 1131899 - RNA, 21 nt, Mycobacterium bovis subsp bovis AF2122/97
auuccggcggccacgccggcg

SEQ ID NO: 1131900 - RNA, 22 nt, Mycobacterium bovis subsp bovis AF2122/97
auuccgcucacgaagaccgcgu

SEQ ID NO: 1131901 - RNA, 21 nt, Mycobacterium bovis subsp bovis AF2122/97
auuccggugugcuugcucggg

SEQ ID NO: 1131902 - RNA, 12 nt, Mycobacterium bovis subsp bovis AF2122/97
auuccgggucgg

SEQ ID NO: 1131903 - RNA, 21 nt, Mycobacterium bovis subsp bovis AF2122/97
auuccgggucggcgaacgccg

SEQ ID NO: 1131904 - RNA, 17 nt, Mycobacterium bovis subsp bovis AF2122/97
auuaccggcacgccggc

SEQ ID NO: 1131905 - RNA, 12 nt, Mycobacterium bovis subsp bovis AF2122/97
auuacggugauc

SEQ ID NO: 1131906 - RNA, 16 nt, Mycobacterium bovis subsp bovis AF2122/97
auuacggugaucgccg

SEQ ID NO: 1131907 - RNA, 13 nt, Mycobacterium bovis subsp bovis AF2122/97
augucgaugccgu

SEQ ID NO: 1131908 - RNA, 12 nt, Mycobacterium bovis subsp bovis AF2122/97
augucgaugccg

SEQ ID NO: 1131909 - RNA, 18 nt, Mycobacterium bovis subsp bovis AF2122/97
augucgagcccgucgagu

SEQ ID NO: 1131910 - RNA, 14 nt, Mycobacterium bovis subsp bovis AF2122/97
augucgacgucgcg

SEQ ID NO: 1131911 - RNA, 21 nt, Mycobacterium bovis subsp bovis AF2122/97
augucgagcacaccgucgucg

SEQ ID NO: 1131912 - RNA, 14 nt, Mycobacterium bovis subsp bovis AF2122/97
augucgagcacgcc

SEQ ID NO: 1131913 - RNA, 13 nt, Mycobacterium bovis subsp bovis AF2122/97
augucgacgacaa

SEQ ID NO: 1131914 - RNA, 14 nt, Mycobacterium bovis subsp bovis AF2122/97
augucgaugccgug

SEQ ID NO: 1131915 - RNA, 18 nt, Mycobacterium bovis subsp bovis AF2122/97
augucggcagggccccca

SEQ ID NO: 1131916 - RNA, 17 nt, Mycobacterium bovis subsp bovis AF2122/97
augucggccacccggac

SEQ ID NO: 1131917 - RNA, 14 nt, Mycobacterium bovis subsp bovis AF2122/97
augucggccaccgg

SEQ ID NO: 1131918 - RNA, 17 nt, Mycobacterium bovis subsp bovis AF2122/97
augucgcugccgccgcc

SEQ ID NO: 1131919 - RNA, 19 nt, Mycobacterium bovis subsp bovis AF2122/97
auugcgcugcaccggguca

SEQ ID NO: 1131920 - RNA, 20 nt, Mycobacterium bovis subsp bovis AF2122/97
auugcggcgcgggugcggau

SEQ ID NO: 1131921 - RNA, 15 nt, Mycobacterium bovis subsp bovis AF2122/97
auugcggccgccgag

SEQ ID NO: 1131922 - RNA, 22 nt, Mycobacterium bovis subsp bovis AF2122/97
auugcgccgagcuggcaacgcc

SEQ ID NO: 1131923 - RNA, 17 nt, Mycobacterium bovis subsp bovis AF2122/97
auuggcccaccgccguu

SEQ ID NO: 1131924 - RNA, 23 nt, Mycobacterium bovis subsp bovis AF2122/97
auuggcccgaguuggcgaagccc

SEQ ID NO: 1131925 - RNA, 23 nt, Mycobacterium bovis subsp bovis AF2122/97
auuggccaaccccauggccagcg

SEQ ID NO: 1131926 - RNA, 21 nt, Mycobacterium bovis subsp bovis AF2122/97
auuggccaggucggccaccgu

SEQ ID NO: 1131927 - RNA, 21 nt, Mycobacterium bovis subsp bovis AF2122/97
auuggcaggcauggcgccguu

SEQ ID NO: 1131928 - RNA, 14 nt, Mycobacterium bovis subsp bovis AF2122/97
auugcguucgccgc

SEQ ID NO: 1131929 - RNA, 16 nt, Mycobacterium bovis subsp bovis AF2122/97
auugcguucgccgccc

SEQ ID NO: 1131930 - RNA, 13 nt, Mycobacterium bovis subsp bovis AF2122/97
auuggcgccgccg

SEQ ID NO: 1131931 - RNA, 15 nt, Mycobacterium bovis subsp bovis AF2122/97
auuggcgccgccgau

SEQ ID NO: 1131932 - RNA, 16 nt, Mycobacterium bovis subsp bovis AF2122/97
auuggcgccgccgauc

SEQ ID NO: 1131933 - RNA, 14 nt, Mycobacterium bovis subsp bovis AF2122/97
auuggcgucgucgc

SEQ ID NO: 1131934 - RNA, 21 nt, Mycobacterium bovis subsp bovis AF2122/97
auuggcgccgucaccgaucga

SEQ ID NO: 1131935 - RNA, 13 nt, Mycobacterium bovis subsp bovis AF2122/97
auuggcgccgaug

SEQ ID NO: 1131936 - RNA, 17 nt, Mycobacterium bovis subsp bovis AF2122/97
auugggaguccggccga

SEQ ID NO: 1131937 - RNA, 17 nt, Mycobacterium bovis subsp bovis AF2122/97
auuggcugcgccgauac

SEQ ID NO: 1131938 - RNA, 16 nt, Mycobacterium bovis subsp bovis AF2122/97
auuggcugggucguca

SEQ ID NO: 1131939 - RNA, 21 nt, Mycobacterium bovis subsp bovis AF2122/97
auugugcggccccgucgccga

SEQ ID NO: 1131940 - RNA, 18 nt, Mycobacterium bovis subsp bovis AF2122/97
auugccauacagcacccc

SEQ ID NO: 1131941 - RNA, 22 nt, Mycobacterium bovis subsp bovis AF2122/97
auugccaccagaaacaccgacg

SEQ ID NO: 1131942 - RNA, 23 nt, Mycobacterium bovis subsp bovis AF2122/97
auugccaccagaaacaccgacga

SEQ ID NO: 1131943 - RNA, 14 nt, Mycobacterium bovis subsp bovis AF2122/97
auucucggccggcg

SEQ ID NO: 1131944 - RNA, 17 nt, Mycobacterium bovis subsp bovis AF2122/97
auugcccgacgaugcgg

SEQ ID NO: 1131945 - RNA, 22 nt, Mycobacterium bovis subsp bovis AF2122/97
auugcccgacgaugcgggcgau

SEQ ID NO: 1131946 - RNA, 13 nt, Mycobacterium bovis subsp bovis AF2122/97
auugcccgagccc

SEQ ID NO: 1131947 - RNA, 18 nt, Mycobacterium bovis subsp bovis AF2122/97
auugccgccagcccagcc

SEQ ID NO: 1131948 - RNA, 16 nt, Mycobacterium bovis subsp bovis AF2122/97
auugccgccgccggga

SEQ ID NO: 1131949 - RNA, 21 nt, Mycobacterium bovis subsp bovis AF2122/97
auugcgcaaauaggacugcgc

SEQ ID NO: 1131950 - RNA, 21 nt, Mycobacterium bovis subsp bovis AF2122/97
auugcgcccagcgacccggcc

SEQ ID NO: 1131951 - RNA, 13 nt, Mycobacterium bovis subsp bovis AF2122/97
auugccgccggcg

SEQ ID NO: 1131952 - RNA, 16 nt, Mycobacterium bovis subsp bovis AF2122/97
auugccgccgucgccg

SEQ ID NO: 1131953 - RNA, 19 nt, Mycobacterium bovis subsp bovis AF2122/97
auugccgccgucgccgccg

SEQ ID NO: 1131954 - RNA, 15 nt, Mycobacterium bovis subsp bovis AF2122/97
auucgcccgcucgcg

SEQ ID NO: 1131955 - RNA, 17 nt, Mycobacterium bovis subsp bovis AF2122/97
auucgcggcagccggcg

SEQ ID NO: 1131956 - RNA, 21 nt, Mycobacterium bovis subsp bovis AF2122/97
auucguacagugucugccaug

SEQ ID NO: 1131957 - RNA, 21 nt, Mycobacterium bovis subsp bovis AF2122/97
auucguaucccgcaaaccggu

SEQ ID NO: 1131958 - RNA, 18 nt, Mycobacterium bovis subsp bovis AF2122/97
auucguggagccggccgu

SEQ ID NO: 1131959 - RNA, 17 nt, Mycobacterium bovis subsp bovis AF2122/97
auuucgaucacaucguu

SEQ ID NO: 1131960 - RNA, 12 nt, Mycobacterium bovis subsp bovis AF2122/97
auuucgagcucg

SEQ ID NO: 1131961 - RNA, 22 nt, Mycobacterium bovis subsp bovis AF2122/97
auuucgacacgaaggucgcggu

SEQ ID NO: 1131962 - RNA, 20 nt, Mycobacterium bovis subsp bovis AF2122/97
auuucgguaauggccgccgg

SEQ ID NO: 1131963 - RNA, 16 nt, Mycobacterium bovis subsp bovis AF2122/97
auuucggcggcgauga

SEQ ID NO: 1131964 - RNA, 13 nt, Mycobacterium bovis subsp bovis AF2122/97
auuucgucgaucg

SEQ ID NO: 1131965 - RNA, 16 nt, Mycobacterium bovis subsp bovis AF2122/97
caaaaucgcggccaca

SEQ ID NO: 1131966 - RNA, 22 nt, Mycobacterium bovis subsp bovis AF2122/97
caaaaucgucagcgccgccgga

SEQ ID NO: 1131967 - RNA, 18 nt, Mycobacterium bovis subsp bovis AF2122/97
caaaauggccaccggcgg

SEQ ID NO: 1131968 - RNA, 16 nt, Mycobacterium bovis subsp bovis AF2122/97
caaaagggcggcagcg

SEQ ID NO: 1131969 - RNA, 22 nt, Mycobacterium bovis subsp bovis AF2122/97
caaaaucgcacgguuugcgguu

SEQ ID NO: 1131970 - RNA, 15 nt, Mycobacterium bovis subsp bovis AF2122/97
caaaaucgcggccac

SEQ ID NO: 1131971 - RNA, 15 nt, Mycobacterium bovis subsp bovis AF2122/97
caaacaucgcaccca

SEQ ID NO: 1131972 - RNA, 18 nt, Mycobacterium bovis subsp bovis AF2122/97
caaacauacgccaccccg

SEQ ID NO: 1131973 - RNA, 15 nt, Mycobacterium bovis subsp bovis AF2122/97
caaacaccuccagga

SEQ ID NO: 1131974 - RNA, 20 nt, Mycobacterium bovis subsp bovis AF2122/97
caaaauugcuuggccgcgca

SEQ ID NO: 1131975 - RNA, 21 nt, Mycobacterium bovis subsp bovis AF2122/97
caaaccgaucaauccgcccuu

SEQ ID NO: 1131976 - RNA, 20 nt, Mycobacterium bovis subsp bovis AF2122/97
caaacgacucgcgguggccg

SEQ ID NO: 1131977 - RNA, 21 nt, Mycobacterium bovis subsp bovis AF2122/97
caaacgacucgcgguggccga

SEQ ID NO: 1131978 - RNA, 17 nt, Mycobacterium bovis subsp bovis AF2122/97
caaacccaacaccagca

SEQ ID NO: 1131979 - RNA, 15 nt, Mycobacterium bovis subsp bovis AF2122/97
caaacccagcgacgc

SEQ ID NO: 1131980 - RNA, 17 nt, Mycobacterium bovis subsp bovis AF2122/97
caaacccaugucggcgc

SEQ ID NO: 1131981 - RNA, 21 nt, Mycobacterium bovis subsp bovis AF2122/97
caaacccggcgggcccgccgg

SEQ ID NO: 1131982 - RNA, 18 nt, Mycobacterium bovis subsp bovis AF2122/97
caaaccauugcgccugaa

SEQ ID NO: 1131983 - RNA, 20 nt, Mycobacterium bovis subsp bovis AF2122/97
caaacguguugaccgggucg

SEQ ID NO: 1131984 - RNA, 17 nt, Mycobacterium bovis subsp bovis AF2122/97
caaacuauugcaccguc

SEQ ID NO: 1131985 - RNA, 16 nt, Mycobacterium bovis subsp bovis AF2122/97
caaacugggcaccggc

SEQ ID NO: 1131986 - RNA, 16 nt, Mycobacterium bovis subsp bovis AF2122/97
caaacgccgcccgccg

SEQ ID NO: 1131987 - RNA, 22 nt, Mycobacterium bovis subsp bovis AF2122/97
caaacgccgcccgccggugauc

SEQ ID NO: 1131988 - RNA, 19 nt, Mycobacterium bovis subsp bovis AF2122/97
caaacgccgucacggcagu

SEQ ID NO: 1131989 - RNA, 18 nt, Mycobacterium bovis subsp bovis AF2122/97
caaacggaauguagccga

SEQ ID NO: 1131990 - RNA, 22 nt, Mycobacterium bovis subsp bovis AF2122/97
caaacggcuuggcugccuccau

SEQ ID NO: 1131991 - RNA, 17 nt, Mycobacterium bovis subsp bovis AF2122/97
caaacggcgugucggug

SEQ ID NO: 1131992 - RNA, 20 nt, Mycobacterium bovis subsp bovis AF2122/97
caaaucaagcacagcccggc

SEQ ID NO: 1131993 - RNA, 21 nt, Mycobacterium bovis subsp bovis AF2122/97
caaaucaagcacagcccggcu

SEQ ID NO: 1131994 - RNA, 22 nt, Mycobacterium bovis subsp bovis AF2122/97
caaaucaagcacagcccggcua

SEQ ID NO: 1131995 - RNA, 16 nt, Mycobacterium bovis subsp bovis AF2122/97
caaaggugcacugccg

SEQ ID NO: 1131996 - RNA, 16 nt, Mycobacterium bovis subsp bovis AF2122/97
caaacuucgcgcacgc

SEQ ID NO: 1131997 - RNA, 16 nt, Mycobacterium bovis subsp bovis AF2122/97
caaaggauucgcgcga

SEQ ID NO: 1131998 - RNA, 22 nt, Mycobacterium bovis subsp bovis AF2122/97
caaaggccccggugacgccguc

SEQ ID NO: 1131999 - RNA, 18 nt, Mycobacterium bovis subsp bovis AF2122/97
caaaggacgacaccgcga

SEQ ID NO: 1132000 - RNA, 20 nt, Mycobacterium bovis subsp bovis AF2122/97
caaaggcuguaacacccggc

SEQ ID NO: 1132001 - RNA, 12 nt, Mycobacterium bovis subsp bovis AF2122/97
caacaccgcacc

SEQ ID NO: 1132002 - RNA, 24 nt, Mycobacterium bovis subsp bovis AF2122/97
caacacagaacucaccgacggaug

SEQ ID NO: 1132003 - RNA, 22 nt, Mycobacterium bovis subsp bovis AF2122/97
caacaccgccaacuccucagcc

SEQ ID NO: 1132004 - RNA, 14 nt, Mycobacterium bovis subsp bovis AF2122/97
caacaccgccagca

SEQ ID NO: 1132005 - RNA, 13 nt, Mycobacterium bovis subsp bovis AF2122/97
caacacgucgagc

SEQ ID NO: 1132006 - RNA, 12 nt, Mycobacterium bovis subsp bovis AF2122/97
caacacgggcag

SEQ ID NO: 1132007 - RNA, 13 nt, Mycobacterium bovis subsp bovis AF2122/97
caacacgggcagc

SEQ ID NO: 1132008 - RNA, 16 nt, Mycobacterium bovis subsp bovis AF2122/97
caacacgggcgccgga

SEQ ID NO: 1132009 - RNA, 20 nt, Mycobacterium bovis subsp bovis AF2122/97
caacacuggggccccgggaa

SEQ ID NO: 1132010 - RNA, 16 nt, Mycobacterium bovis subsp bovis AF2122/97
caacaccccgagccgc

SEQ ID NO: 1132011 - RNA, 15 nt, Mycobacterium bovis subsp bovis AF2122/97
caacacccggccgac

SEQ ID NO: 1132012 - RNA, 17 nt, Mycobacterium bovis subsp bovis AF2122/97
caacacccggccgaccu

SEQ ID NO: 1132013 - RNA, 13 nt, Mycobacterium bovis subsp bovis AF2122/97
caacaccaccagc

SEQ ID NO: 1132014 - RNA, 14 nt, Mycobacterium bovis subsp bovis AF2122/97
caacaccaccagca

SEQ ID NO: 1132015 - RNA, 23 nt, Mycobacterium bovis subsp bovis AF2122/97
caacaccaggucauugccggcga

SEQ ID NO: 1132016 - RNA, 17 nt, Mycobacterium bovis subsp bovis AF2122/97
caacaccaacgacagcg

SEQ ID NO: 1132017 - RNA, 15 nt, Mycobacterium bovis subsp bovis AF2122/97
caacacagccgucgc

SEQ ID NO: 1132018 - RNA, 16 nt, Mycobacterium bovis subsp bovis AF2122/97
caacacagccgucgca

SEQ ID NO: 1132019 - RNA, 16 nt, Mycobacterium bovis subsp bovis AF2122/97
caacaccacggugccg

SEQ ID NO: 1132020 - RNA, 22 nt, Mycobacterium bovis subsp bovis AF2122/97
caacaccacggugccgacgaug

SEQ ID NO: 1132021 - RNA, 15 nt, Mycobacterium bovis subsp bovis AF2122/97
caacaccagccgguc

SEQ ID NO: 1132022 - RNA, 20 nt, Mycobacterium bovis subsp bovis AF2122/97
caacaccagccggucgucgc

SEQ ID NO: 1132023 - RNA, 16 nt, Mycobacterium bovis subsp bovis AF2122/97
caaaacggucgaccgu

SEQ ID NO: 1132024 - RNA, 19 nt, Mycobacterium bovis subsp bovis AF2122/97
caaaacgagcuuccacgcc

SEQ ID NO: 1132025 - RNA, 20 nt, Mycobacterium bovis subsp bovis AF2122/97
caaaacauaucggugccgga

SEQ ID NO: 1132026 - RNA, 19 nt, Mycobacterium bovis subsp bovis AF2122/97
caaaaaguagcugcggucg

SEQ ID NO: 1132027 - RNA, 18 nt, Mycobacterium bovis subsp bovis AF2122/97
caaaaacgcugccgccgu

SEQ ID NO: 1132028 - RNA, 21 nt, Mycobacterium bovis subsp bovis AF2122/97
auuuugccggauucuccgccc

SEQ ID NO: 1132029 - RNA, 20 nt, Mycobacterium bovis subsp bovis AF2122/97
auuuugcgucugcucggcgg

SEQ ID NO: 1132030 - RNA, 12 nt, Mycobacterium bovis subsp bovis AF2122/97
auuuugcgucug

SEQ ID NO: 1132031 - RNA, 16 nt, Mycobacterium bovis subsp bovis AF2122/97
auuuggccgauguugu

SEQ ID NO: 1132032 - RNA, 21 nt, Mycobacterium bovis subsp bovis AF2122/97
auuuguugcugcugccguggc

SEQ ID NO: 1132033 - RNA, 13 nt, Mycobacterium bovis subsp bovis AF2122/97
auuugaugagcaa

SEQ ID NO: 1132034 - RNA, 16 nt, Mycobacterium bovis subsp bovis AF2122/97
cagccggcuugggcgg

SEQ ID NO: 1132035 - RNA, 17 nt, Mycobacterium bovis subsp bovis AF2122/97
cagccggcuugggcggu

SEQ ID NO: 1132036 - RNA, 21 nt, Mycobacterium bovis subsp bovis AF2122/97
cagccgggagucgucggcaug

SEQ ID NO: 1132037 - RNA, 13 nt, Mycobacterium bovis subsp bovis AF2122/97
cagccgggcacca

SEQ ID NO: 1132038 - RNA, 17 nt, Mycobacterium bovis subsp bovis AF2122/97
cagccgggcgucgcugg

SEQ ID NO: 1132039 - RNA, 17 nt, Mycobacterium bovis subsp bovis AF2122/97
cagccgguccagcagcu

SEQ ID NO: 1132040 - RNA, 20 nt, Mycobacterium bovis subsp bovis AF2122/97
cagccgggugccggcauaga

SEQ ID NO: 1132041 - RNA, 14 nt, Mycobacterium bovis subsp bovis AF2122/97
cagccggugccgcc

SEQ ID NO: 1132042 - RNA, 22 nt, Mycobacterium bovis subsp bovis AF2122/97
cagccggucuuggacagcagca

SEQ ID NO: 1132043 - RNA, 17 nt, Mycobacterium bovis subsp bovis AF2122/97
cagccgguagccgggca

SEQ ID NO: 1132044 - RNA, 20 nt, Mycobacterium bovis subsp bovis AF2122/97
cagccgguggucugcgcggu

SEQ ID NO: 1132045 - RNA, 15 nt, Mycobacterium bovis subsp bovis AF2122/97
cagccgucaccgcga

SEQ ID NO: 1132046 - RNA, 16 nt, Mycobacterium bovis subsp bovis AF2122/97
cagccgucaccgcgac

SEQ ID NO: 1132047 - RNA, 16 nt, Mycobacterium bovis subsp bovis AF2122/97
cagccgguuaauggaa

SEQ ID NO: 1132048 - RNA, 20 nt, Mycobacterium bovis subsp bovis AF2122/97
cagccgguuggcugccggca

SEQ ID NO: 1132049 - RNA, 15 nt, Mycobacterium bovis subsp bovis AF2122/97
cagccguacgccgua

SEQ ID NO: 1132050 - RNA, 16 nt, Mycobacterium bovis subsp bovis AF2122/97
cagccgcugcguagug

SEQ ID NO: 1132051 - RNA, 17 nt, Mycobacterium bovis subsp bovis AF2122/97
cagccgcuuggcgcggc

SEQ ID NO: 1132052 - RNA, 15 nt, Mycobacterium bovis subsp bovis AF2122/97
cagccggaccgcgac

SEQ ID NO: 1132053 - RNA, 16 nt, Mycobacterium bovis subsp bovis AF2122/97
cagccggaccgcgacg

SEQ ID NO: 1132054 - RNA, 23 nt, Mycobacterium bovis subsp bovis AF2122/97
cagccggaccgcgacggcgccgg

SEQ ID NO: 1132055 - RNA, 22 nt, Mycobacterium bovis subsp bovis AF2122/97
cagccggauaaucauccgagcg

SEQ ID NO: 1132056 - RNA, 16 nt, Mycobacterium bovis subsp bovis AF2122/97
cagccgcucgacggcc

SEQ ID NO: 1132057 - RNA, 18 nt, Mycobacterium bovis subsp bovis AF2122/97
cagccgcucgacggcccg

SEQ ID NO: 1132058 - RNA, 12 nt, Mycobacterium bovis subsp bovis AF2122/97
cagccgcucgca

SEQ ID NO: 1132059 - RNA, 18 nt, Mycobacterium bovis subsp bovis AF2122/97
cagccgcucgcacagccg

SEQ ID NO: 1132060 - RNA, 22 nt, Mycobacterium bovis subsp bovis AF2122/97
cagccgcugaucugccgccgcg

SEQ ID NO: 1132061 - RNA, 16 nt, Mycobacterium bovis subsp bovis AF2122/97
cagccgccagcccguc

SEQ ID NO: 1132062 - RNA, 21 nt, Mycobacterium bovis subsp bovis AF2122/97
cagccgcacgguucggguggu

SEQ ID NO: 1132063 - RNA, 12 nt, Mycobacterium bovis subsp bovis AF2122/97
cagccgcaccag

SEQ ID NO: 1132064 - RNA, 22 nt, Mycobacterium bovis subsp bovis AF2122/97
cagccgcaccaguggcgcccau

SEQ ID NO: 1132065 - RNA, 13 nt, Mycobacterium bovis subsp bovis AF2122/97
cagccgcaccccg

SEQ ID NO: 1132066 - RNA, 20 nt, Mycobacterium bovis subsp bovis AF2122/97
cagccgcaccccgcccgacg

SEQ ID NO: 1132067 - RNA, 16 nt, Mycobacterium bovis subsp bovis AF2122/97
cagccgcagcaccucg

SEQ ID NO: 1132068 - RNA, 13 nt, Mycobacterium bovis subsp bovis AF2122/97
cagccgcagcggc

SEQ ID NO: 1132069 - RNA, 20 nt, Mycobacterium bovis subsp bovis AF2122/97
cagcccguccaggcgcugca

SEQ ID NO: 1132070 - RNA, 22 nt, Mycobacterium bovis subsp bovis AF2122/97
cagcccguccaggcgcugcagc

SEQ ID NO: 1132071 - RNA, 13 nt, Mycobacterium bovis subsp bovis AF2122/97
cagcccguccggc

SEQ ID NO: 1132072 - RNA, 14 nt, Mycobacterium bovis subsp bovis AF2122/97
cagcccggugaugg

SEQ ID NO: 1132073 - RNA, 14 nt, Mycobacterium bovis subsp bovis AF2122/97
cagcccggucaugg

SEQ ID NO: 1132074 - RNA, 16 nt, Mycobacterium bovis subsp bovis AF2122/97
cagcccggucaugguc

SEQ ID NO: 1132075 - RNA, 13 nt, Mycobacterium bovis subsp bovis AF2122/97
cagcccgggcagc

SEQ ID NO: 1132076 - RNA, 18 nt, Mycobacterium bovis subsp bovis AF2122/97
cagcccgggcagcaccag

SEQ ID NO: 1132077 - RNA, 13 nt, Mycobacterium bovis subsp bovis AF2122/97
cagcccggcguug

SEQ ID NO: 1132078 - RNA, 18 nt, Mycobacterium bovis subsp bovis AF2122/97
cagcccgucggcgccgaa

SEQ ID NO: 1132079 - RNA, 14 nt, Mycobacterium bovis subsp bovis AF2122/97
cagcccgucggcgc

SEQ ID NO: 1132080 - RNA, 23 nt, Mycobacterium bovis subsp bovis AF2122/97
cagcccucugguggcgcugaagc

SEQ ID NO: 1132081 - RNA, 14 nt, Mycobacterium bovis subsp bovis AF2122/97
cagcccugcgcagc

SEQ ID NO: 1132082 - RNA, 19 nt, Mycobacterium bovis subsp bovis AF2122/97
cagcccuguuugacugcga

SEQ ID NO: 1132083 - RNA, 21 nt, Mycobacterium bovis subsp bovis AF2122/97
cagcccuucagcgaagccggg

SEQ ID NO: 1132084 - RNA, 15 nt, Mycobacterium bovis subsp bovis AF2122/97
cagcccuuggcgcgc

SEQ ID NO: 1132085 - RNA, 15 nt, Mycobacterium bovis subsp bovis AF2122/97
cagccgaugcucguc

SEQ ID NO: 1132086 - RNA, 24 nt, Mycobacterium bovis subsp bovis AF2122/97
cagccgcaacaccccccguccacc

SEQ ID NO: 1132087 - RNA, 19 nt, Mycobacterium bovis subsp bovis AF2122/97
cagccgauccgaucgcaga

SEQ ID NO: 1132088 - RNA, 14 nt, Mycobacterium bovis subsp bovis AF2122/97
cagccgaagccgaa

SEQ ID NO: 1132089 - RNA, 17 nt, Mycobacterium bovis subsp bovis AF2122/97
cagccgaaccggcacca

SEQ ID NO: 1132090 - RNA, 16 nt, Mycobacterium bovis subsp bovis AF2122/97
cagccgaagaaccggu

SEQ ID NO: 1132091 - RNA, 15 nt, Mycobacterium bovis subsp bovis AF2122/97
cagcccgacgcccga

SEQ ID NO: 1132092 - RNA, 20 nt, Mycobacterium bovis subsp bovis AF2122/97
cagcccgaacucguuggcga

SEQ ID NO: 1132093 - RNA, 22 nt, Mycobacterium bovis subsp bovis AF2122/97
cagcccgaacucguuggcgaac

SEQ ID NO: 1132094 - RNA, 13 nt, Mycobacterium bovis subsp bovis AF2122/97
cagcccgacaccg

SEQ ID NO: 1132095 - RNA, 17 nt, Mycobacterium bovis subsp bovis AF2122/97
cagcccgacaccgaucg

SEQ ID NO: 1132096 - RNA, 23 nt, Mycobacterium bovis subsp bovis AF2122/97
cagcccgacaccguccagcagcu

SEQ ID NO: 1132097 - RNA, 20 nt, Mycobacterium bovis subsp bovis AF2122/97
cagcccgacaguggucccgg

SEQ ID NO: 1132098 - RNA, 16 nt, Mycobacterium bovis subsp bovis AF2122/97
cagcccgacgcccgac

SEQ ID NO: 1132099 - RNA, 22 nt, Mycobacterium bovis subsp bovis AF2122/97
cagcccgagcucgggugcgaac

SEQ ID NO: 1132100 - RNA, 16 nt, Mycobacterium bovis subsp bovis AF2122/97
cagcccgauacgggug

SEQ ID NO: 1132101 - RNA, 12 nt, Mycobacterium bovis subsp bovis AF2122/97
cagcccggcgac

SEQ ID NO: 1132102 - RNA, 18 nt, Mycobacterium bovis subsp bovis AF2122/97
cagcccggccuugccgcc

SEQ ID NO: 1132103 - RNA, 23 nt, Mycobacterium bovis subsp bovis AF2122/97
cagcccggccuugccgccggccc

SEQ ID NO: 1132104 - RNA, 12 nt, Mycobacterium bovis subsp bovis AF2122/97
cagcccggcgaa

SEQ ID NO: 1132105 - RNA, 16 nt, Mycobacterium bovis subsp bovis AF2122/97
cagcccggcgacgacc

SEQ ID NO: 1132106 - RNA, 13 nt, Mycobacterium bovis subsp bovis AF2122/97
cagcccggcgacg

SEQ ID NO: 1132107 - RNA, 14 nt, Mycobacterium bovis subsp bovis AF2122/97
cagcccggcgacga

SEQ ID NO: 1132108 - RNA, 20 nt, Mycobacterium bovis subsp bovis AF2122/97
cagcccggcgacgacccggg

SEQ ID NO: 1132109 - RNA, 16 nt, Mycobacterium bovis subsp bovis AF2122/97
cagcccggcgcuuccg

SEQ ID NO: 1132110 - RNA, 15 nt, Mycobacterium bovis subsp bovis AF2122/97
cagcccggcgcgccg

SEQ ID NO: 1132111 - RNA, 16 nt, Mycobacterium bovis subsp bovis AF2122/97
cagcccggcgcgccga

SEQ ID NO: 1132112 - RNA, 13 nt, Mycobacterium bovis subsp bovis AF2122/97
cagccacgccacg

SEQ ID NO: 1132113 - RNA, 18 nt, Mycobacterium bovis subsp bovis AF2122/97
cagccacgcugucccgcg

SEQ ID NO: 1132114 - RNA, 20 nt, Mycobacterium bovis subsp bovis AF2122/97
cagccacguuacgcucgcgg

SEQ ID NO: 1132115 - RNA, 22 nt, Mycobacterium bovis subsp bovis AF2122/97
cagccacggguagcugccgcgg

SEQ ID NO: 1132116 - RNA, 23 nt, Mycobacterium bovis subsp bovis AF2122/97
cagccacggguagcugccgcggc

SEQ ID NO: 1132117 - RNA, 13 nt, Mycobacterium bovis subsp bovis AF2122/97
cagccccugccga

SEQ ID NO: 1132118 - RNA, 18 nt, Mycobacterium bovis subsp bovis AF2122/97
cagccaccgggcgugcgg

SEQ ID NO: 1132119 - RNA, 22 nt, Mycobacterium bovis subsp bovis AF2122/97
cagccacgaacugaucgaccgc

SEQ ID NO: 1132120 - RNA, 22 nt, Mycobacterium bovis subsp bovis AF2122/97
cagccaccugccgacucaucgg

SEQ ID NO: 1132121 - RNA, 20 nt, Mycobacterium bovis subsp bovis AF2122/97
cagccaccgucaugccgacg

SEQ ID NO: 1132122 - RNA, 16 nt, Mycobacterium bovis subsp bovis AF2122/97
cagccaacucaggccg

SEQ ID NO: 1132123 - RNA, 12 nt, Mycobacterium bovis subsp bovis AF2122/97
cagccaccagcc

SEQ ID NO: 1132124 - RNA, 19 nt, Mycobacterium bovis subsp bovis AF2122/97
cagccaccagcgacgacca

SEQ ID NO: 1132125 - RNA, 20 nt, Mycobacterium bovis subsp bovis AF2122/97
cagcgaaggcgccgaacacc

SEQ ID NO: 1132126 - RNA, 16 nt, Mycobacterium bovis subsp bovis AF2122/97
cagcgaauccaggccg

SEQ ID NO: 1132127 - RNA, 13 nt, Mycobacterium bovis subsp bovis AF2122/97
cagcgacggcagc

SEQ ID NO: 1132128 - RNA, 18 nt, Mycobacterium bovis subsp bovis AF2122/97
cagcgacuccagcgcccg

SEQ ID NO: 1132129 - RNA, 13 nt, Mycobacterium bovis subsp bovis AF2122/97
cagcgacuccacc

SEQ ID NO: 1132130 - RNA, 14 nt, Mycobacterium bovis subsp bovis AF2122/97
cagcgacggccgcc

SEQ ID NO: 1132131 - RNA, 16 nt, Mycobacterium bovis subsp bovis AF2122/97
cagcgacggccgccag

SEQ ID NO: 1132132 - RNA, 16 nt, Mycobacterium bovis subsp bovis AF2122/97
cagcgacgcugccgcc

SEQ ID NO: 1132133 - RNA, 17 nt, Mycobacterium bovis subsp bovis AF2122/97
cagcgacgcugccgcca

SEQ ID NO: 1132134 - RNA, 18 nt, Mycobacterium bovis subsp bovis AF2122/97
cagcgacgcugccgccag

SEQ ID NO: 1132135 - RNA, 21 nt, Mycobacterium bovis subsp bovis AF2122/97
cagcgacgcggucaucgagcu

SEQ ID NO: 1132136 - RNA, 18 nt, Mycobacterium bovis subsp bovis AF2122/97
cagcgacgcggucaucga

SEQ ID NO: 1132137 - RNA, 15 nt, Mycobacterium bovis subsp bovis AF2122/97
cagcgaaccggcugg

SEQ ID NO: 1132138 - RNA, 15 nt, Mycobacterium bovis subsp bovis AF2122/97
cagccguucgcagcu

SEQ ID NO: 1132139 - RNA, 16 nt, Mycobacterium bovis subsp bovis AF2122/97
cagccguggcgcgacg

SEQ ID NO: 1132140 - RNA, 17 nt, Mycobacterium bovis subsp bovis AF2122/97
cagccguggcggcgggc

SEQ ID NO: 1132141 - RNA, 15 nt, Mycobacterium bovis subsp bovis AF2122/97
cagcgaacggccagg

SEQ ID NO: 1132142 - RNA, 17 nt, Mycobacterium bovis subsp bovis AF2122/97
cagcgaacggccaggac

SEQ ID NO: 1132143 - RNA, 16 nt, Mycobacterium bovis subsp bovis AF2122/97
cagcgaaggcgccgaa

SEQ ID NO: 1132144 - RNA, 14 nt, Mycobacterium bovis subsp bovis AF2122/97
cagcgaagccgggu

SEQ ID NO: 1132145 - RNA, 21 nt, Mycobacterium bovis subsp bovis AF2122/97
cagccgugcuuguugcgcgac

SEQ ID NO: 1132146 - RNA, 22 nt, Mycobacterium bovis subsp bovis AF2122/97
cagccgugcuuguugcgcgacg

SEQ ID NO: 1132147 - RNA, 19 nt, Mycobacterium bovis subsp bovis AF2122/97
cagccgugcgggccggucg

SEQ ID NO: 1132148 - RNA, 23 nt, Mycobacterium bovis subsp bovis AF2122/97
cagccgugcgggccggucgugcc

SEQ ID NO: 1132149 - RNA, 16 nt, Mycobacterium bovis subsp bovis AF2122/97
cagccgugcgggccgg

SEQ ID NO: 1132150 - RNA, 13 nt, Mycobacterium bovis subsp bovis AF2122/97
cagccgugccggu

SEQ ID NO: 1132151 - RNA, 12 nt, Mycobacterium bovis subsp bovis AF2122/97
cagccgugccgu

SEQ ID NO: 1132152 - RNA, 20 nt, Mycobacterium bovis subsp bovis AF2122/97
cagccgucggcgcugcgcgc

SEQ ID NO: 1132153 - RNA, 18 nt, Mycobacterium bovis subsp bovis AF2122/97
cagccgucgucagguggc

SEQ ID NO: 1132154 - RNA, 16 nt, Mycobacterium bovis subsp bovis AF2122/97
cagcgaguaccaggac

SEQ ID NO: 1132155 - RNA, 23 nt, Mycobacterium bovis subsp bovis AF2122/97
cagcgaguccucgagugccgccg

SEQ ID NO: 1132156 - RNA, 14 nt, Mycobacterium bovis subsp bovis AF2122/97
cagcgagucgacgu

SEQ ID NO: 1132157 - RNA, 15 nt, Mycobacterium bovis subsp bovis AF2122/97
cagcgagucgacguc

SEQ ID NO: 1132158 - RNA, 17 nt, Mycobacterium bovis subsp bovis AF2122/97
cagcgagucgacgucga

SEQ ID NO: 1132159 - RNA, 23 nt, Mycobacterium bovis subsp bovis AF2122/97
cagcgauauccacaauccgcucg

SEQ ID NO: 1132160 - RNA, 17 nt, Mycobacterium bovis subsp bovis AF2122/97
cagcgcaccggugaugg

SEQ ID NO: 1132161 - RNA, 16 nt, Mycobacterium bovis subsp bovis AF2122/97
cagcgcaccggcguuc

SEQ ID NO: 1132162 - RNA, 22 nt, Mycobacterium bovis subsp bovis AF2122/97
cagcgcaccaacucucgcggga

SEQ ID NO: 1132163 - RNA, 22 nt, Mycobacterium bovis subsp bovis AF2122/97
cagcgcaccggcguucaccugc

SEQ ID NO: 1132164 - RNA, 15 nt, Mycobacterium bovis subsp bovis AF2122/97
cagcgcacgauuucg

SEQ ID NO: 1132165 - RNA, 21 nt, Mycobacterium bovis subsp bovis AF2122/97
cagcgcacgauuucgagcgcu

SEQ ID NO: 1132166 - RNA, 21 nt, Mycobacterium bovis subsp bovis AF2122/97
cagcgcaccggugauggugac

SEQ ID NO: 1132167 - RNA, 21 nt, Mycobacterium bovis subsp bovis AF2122/97
cagcgcacgauagccaccgac

SEQ ID NO: 1132168 - RNA, 16 nt, Mycobacterium bovis subsp bovis AF2122/97
cagcgcacgcagccga

SEQ ID NO: 1132169 - RNA, 15 nt, Mycobacterium bovis subsp bovis AF2122/97
cagcgcacgcucggc

SEQ ID NO: 1132170 - RNA, 18 nt, Mycobacterium bovis subsp bovis AF2122/97
cagcgcacgcucggcacg

SEQ ID NO: 1132171 - RNA, 19 nt, Mycobacterium bovis subsp bovis AF2122/97
cagcgcacggaccaucgcc

SEQ ID NO: 1132172 - RNA, 21 nt, Mycobacterium bovis subsp bovis AF2122/97
cagcgcacggaccaucgccag

SEQ ID NO: 1132173 - RNA, 13 nt, Mycobacterium bovis subsp bovis AF2122/97
cagcgcaccggcg

SEQ ID NO: 1132174 - RNA, 16 nt, Mycobacterium bovis subsp bovis AF2122/97
cagcgcaacggccagc

SEQ ID NO: 1132175 - RNA, 22 nt, Mycobacterium bovis subsp bovis AF2122/97
cagcgcaaugcaucgcggcggc

SEQ ID NO: 1132176 - RNA, 16 nt, Mycobacterium bovis subsp bovis AF2122/97
cagcgccuugacgcca

SEQ ID NO: 1132177 - RNA, 17 nt, Mycobacterium bovis subsp bovis AF2122/97
cagcgccuugcgggccu

SEQ ID NO: 1132178 - RNA, 21 nt, Mycobacterium bovis subsp bovis AF2122/97
cagcgccuugcgggccuggug

SEQ ID NO: 1132179 - RNA, 15 nt, Mycobacterium bovis subsp bovis AF2122/97
cagcgccugcgccca

SEQ ID NO: 1132180 - RNA, 17 nt, Mycobacterium bovis subsp bovis AF2122/97
cagcgccugcggcagca

SEQ ID NO: 1132181 - RNA, 21 nt, Mycobacterium bovis subsp bovis AF2122/97
cagcgccgagagcaccgcucg

SEQ ID NO: 1132182 - RNA, 21 nt, Mycobacterium bovis subsp bovis AF2122/97
cagcgccucgauccgcaucau

SEQ ID NO: 1132183 - RNA, 18 nt, Mycobacterium bovis subsp bovis AF2122/97
cagcgccgcaguggaugc

SEQ ID NO: 1132184 - RNA, 14 nt, Mycobacterium bovis subsp bovis AF2122/97
cagcgccgcacccg

SEQ ID NO: 1132185 - RNA, 20 nt, Mycobacterium bovis subsp bovis AF2122/97
cagcgccgcacccgcucccg

SEQ ID NO: 1132186 - RNA, 19 nt, Mycobacterium bovis subsp bovis AF2122/97
cagcgccucggcaucgccg

SEQ ID NO: 1132187 - RNA, 21 nt, Mycobacterium bovis subsp bovis AF2122/97
cagcgccucggcaucgccgcg

SEQ ID NO: 1132188 - RNA, 16 nt, Mycobacterium bovis subsp bovis AF2122/97
cagcgccucggcaucg

SEQ ID NO: 1132189 - RNA, 15 nt, Mycobacterium bovis subsp bovis AF2122/97
cagcgcccggucacg

SEQ ID NO: 1132190 - RNA, 16 nt, Mycobacterium bovis subsp bovis AF2122/97
cagcgcccggucacgc

SEQ ID NO: 1132191 - RNA, 13 nt, Mycobacterium bovis subsp bovis AF2122/97
cagcgccgacccg

SEQ ID NO: 1132192 - RNA, 19 nt, Mycobacterium bovis subsp bovis AF2122/97
cagcgccgacagccgaucc

SEQ ID NO: 1132193 - RNA, 17 nt, Mycobacterium bovis subsp bovis AF2122/97
cagcgcccggcccgcca

SEQ ID NO: 1132194 - RNA, 16 nt, Mycobacterium bovis subsp bovis AF2122/97
cagcgcccgucgcugg

SEQ ID NO: 1132195 - RNA, 20 nt, Mycobacterium bovis subsp bovis AF2122/97
cagcgcccgucgcugggagg

SEQ ID NO: 1132196 - RNA, 17 nt, Mycobacterium bovis subsp bovis AF2122/97
cagcgccgacagccgau

SEQ ID NO: 1132197 - RNA, 13 nt, Mycobacterium bovis subsp bovis AF2122/97
cagcgcccccgga

SEQ ID NO: 1132198 - RNA, 14 nt, Mycobacterium bovis subsp bovis AF2122/97
cagcgccaggccgu

SEQ ID NO: 1132199 - RNA, 14 nt, Mycobacterium bovis subsp bovis AF2122/97
cagcgcccccagca

SEQ ID NO: 1132200 - RNA, 19 nt, Mycobacterium bovis subsp bovis AF2122/97
cagcgcccagaucgccgag

SEQ ID NO: 1132201 - RNA, 18 nt, Mycobacterium bovis subsp bovis AF2122/97
cagcgcccgccggcauag

SEQ ID NO: 1132202 - RNA, 19 nt, Mycobacterium bovis subsp bovis AF2122/97
cagcgcccgccggcauaga

SEQ ID NO: 1132203 - RNA, 12 nt, Mycobacterium bovis subsp bovis AF2122/97
cagcgcccgccg

SEQ ID NO: 1132204 - RNA, 17 nt, Mycobacterium bovis subsp bovis AF2122/97
cagcgcccgcgcggcca

SEQ ID NO: 1132205 - RNA, 13 nt, Mycobacterium bovis subsp bovis AF2122/97
cagcgccagcgag

SEQ ID NO: 1132206 - RNA, 18 nt, Mycobacterium bovis subsp bovis AF2122/97
cagcgcagcaucgucgcc

SEQ ID NO: 1132207 - RNA, 15 nt, Mycobacterium bovis subsp bovis AF2122/97
cagcgcagcagcggc

SEQ ID NO: 1132208 - RNA, 15 nt, Mycobacterium bovis subsp bovis AF2122/97
cagcgcacuggccgc

SEQ ID NO: 1132209 - RNA, 19 nt, Mycobacterium bovis subsp bovis AF2122/97
cagcgcacuacucgaacaa

SEQ ID NO: 1132210 - RNA, 20 nt, Mycobacterium bovis subsp bovis AF2122/97
cagcgcacuacucgaacaac

SEQ ID NO: 1132211 - RNA, 20 nt, Mycobacterium bovis subsp bovis AF2122/97
cagcgcaguaacgucgucgc

SEQ ID NO: 1132212 - RNA, 20 nt, Mycobacterium bovis subsp bovis AF2122/97
cagcgcagcaacugggcggc

SEQ ID NO: 1132213 - RNA, 18 nt, Mycobacterium bovis subsp bovis AF2122/97
cagcgcaggguucgucgg

SEQ ID NO: 1132214 - RNA, 23 nt, Mycobacterium bovis subsp bovis AF2122/97
cagcgcagucugauuccacauca

SEQ ID NO: 1132215 - RNA, 17 nt, Mycobacterium bovis subsp bovis AF2122/97
cagcgcagugccuccga

SEQ ID NO: 1132216 - RNA, 14 nt, Mycobacterium bovis subsp bovis AF2122/97
cagcgccacgucca

SEQ ID NO: 1132217 - RNA, 12 nt, Mycobacterium bovis subsp bovis AF2122/97
cagcgccacugg

SEQ ID NO: 1132218 - RNA, 14 nt, Mycobacterium bovis subsp bovis AF2122/97
cagcgccagcagcu

SEQ ID NO: 1132219 - RNA, 23 nt, Mycobacterium bovis subsp bovis AF2122/97
cagcgcgaucaccgagucgacgg

SEQ ID NO: 1132220 - RNA, 14 nt, Mycobacterium bovis subsp bovis AF2122/97
cagcgcgcgccgca

SEQ ID NO: 1132221 - RNA, 21 nt, Mycobacterium bovis subsp bovis AF2122/97
cagcgcgcccgcggccgccag

SEQ ID NO: 1132222 - RNA, 13 nt, Mycobacterium bovis subsp bovis AF2122/97
cagcgcgccggcg

SEQ ID NO: 1132223 - RNA, 16 nt, Mycobacterium bovis subsp bovis AF2122/97
cagcgcgcgccgcugg

SEQ ID NO: 1132224 - RNA, 20 nt, Mycobacterium bovis subsp bovis AF2122/97
cagcgcgcgccgcuggguga

SEQ ID NO: 1132225 - RNA, 13 nt, Mycobacterium bovis subsp bovis AF2122/97
cagcgcgcggguu

SEQ ID NO: 1132226 - RNA, 20 nt, Mycobacterium bovis subsp bovis AF2122/97
cagcgcggccacccgcgacg

SEQ ID NO: 1132227 - RNA, 13 nt, Mycobacterium bovis subsp bovis AF2122/97
cagcgcggccaga

SEQ ID NO: 1132228 - RNA, 13 nt, Mycobacterium bovis subsp bovis AF2122/97
cagcgcggccagu

SEQ ID NO: 1132229 - RNA, 20 nt, Mycobacterium bovis subsp bovis AF2122/97
cagcgcggccauuagcagca

SEQ ID NO: 1132230 - RNA, 22 nt, Mycobacterium bovis subsp bovis AF2122/97
cagcgcggcaaaguuggccgcc

SEQ ID NO: 1132231 - RNA, 19 nt, Mycobacterium bovis subsp bovis AF2122/97
cagcgcggcaacuccgguc

SEQ ID NO: 1132232 - RNA, 23 nt, Mycobacterium bovis subsp bovis AF2122/97
cagcgcggcacggugugcggcau

SEQ ID NO: 1132233 - RNA, 14 nt, Mycobacterium bovis subsp bovis AF2122/97
cagcgcgcugcagu

SEQ ID NO: 1132234 - RNA, 19 nt, Mycobacterium bovis subsp bovis AF2122/97
cagcgcgaacgccugcugg

SEQ ID NO: 1132235 - RNA, 15 nt, Mycobacterium bovis subsp bovis AF2122/97
cagcgcgaacaccau

SEQ ID NO: 1132236 - RNA, 18 nt, Mycobacterium bovis subsp bovis AF2122/97
cagcgcgaaggucagcga

SEQ ID NO: 1132237 - RNA, 23 nt, Mycobacterium bovis subsp bovis AF2122/97
cagcgcgacccguagcuuggcga

SEQ ID NO: 1132238 - RNA, 15 nt, Mycobacterium bovis subsp bovis AF2122/97
cagcgcgacguccac

SEQ ID NO: 1132239 - RNA, 12 nt, Mycobacterium bovis subsp bovis AF2122/97
cagcgcgacggu

SEQ ID NO: 1132240 - RNA, 11 nt, Mycobacterium bovis subsp bovis AF2122/97
cagcgcgacgu

SEQ ID NO: 1132241 - RNA, 16 nt, Mycobacterium bovis subsp bovis AF2122/97
cagcgcgcacacggcu

SEQ ID NO: 1132242 - RNA, 12 nt, Mycobacterium bovis subsp bovis AF2122/97
cagcgcgccacc

SEQ ID NO: 1132243 - RNA, 16 nt, Mycobacterium bovis subsp bovis AF2122/97
cagcgcgccacccagc

SEQ ID NO: 1132244 - RNA, 17 nt, Mycobacterium bovis subsp bovis AF2122/97
cagcgcgccacccagca

SEQ ID NO: 1132245 - RNA, 13 nt, Mycobacterium bovis subsp bovis AF2122/97
cagcgcgaucgau

SEQ ID NO: 1132246 - RNA, 14 nt, Mycobacterium bovis subsp bovis AF2122/97
cagcgcgaugucgc

SEQ ID NO: 1132247 - RNA, 18 nt, Mycobacterium bovis subsp bovis AF2122/97
cagcgcgaugucgccggc

SEQ ID NO: 1132248 - RNA, 19 nt, Mycobacterium bovis subsp bovis AF2122/97
cagcgcgaucugcucgccc

SEQ ID NO: 1132249 - RNA, 20 nt, Mycobacterium bovis subsp bovis AF2122/97
cagcgcgaucugcucgcccc

SEQ ID NO: 1132250 - RNA, 13 nt, Mycobacterium bovis subsp bovis AF2122/97
cagcgcgaucacc

SEQ ID NO: 1132251 - RNA, 22 nt, Mycobacterium bovis subsp bovis AF2122/97
cagcgcgacaaaguucgacgag

SEQ ID NO: 1132252 - RNA, 22 nt, Mycobacterium bovis subsp bovis AF2122/97
cagcgcgaggcucguggcgacg

SEQ ID NO: 1132253 - RNA, 22 nt, Mycobacterium bovis subsp bovis AF2122/97
cagcgcgacguccaccagccgg

SEQ ID NO: 1132254 - RNA, 23 nt, Mycobacterium bovis subsp bovis AF2122/97
cagcgcgacguccaccagccggu

SEQ ID NO: 1132255 - RNA, 20 nt, Mycobacterium bovis subsp bovis AF2122/97
cagcgcgguggucagcaccg

SEQ ID NO: 1132256 - RNA, 19 nt, Mycobacterium bovis subsp bovis AF2122/97
cagcgcguagccaaugccc

SEQ ID NO: 1132257 - RNA, 18 nt, Mycobacterium bovis subsp bovis AF2122/97
cagcgcggcgucgccuug

SEQ ID NO: 1132258 - RNA, 19 nt, Mycobacterium bovis subsp bovis AF2122/97
cagcgcgggacacgucgcg

SEQ ID NO: 1132259 - RNA, 16 nt, Mycobacterium bovis subsp bovis AF2122/97
cagcgcggcggcaucu

SEQ ID NO: 1132260 - RNA, 16 nt, Mycobacterium bovis subsp bovis AF2122/97
cagcgcggcuggggcc

SEQ ID NO: 1132261 - RNA, 12 nt, Mycobacterium bovis subsp bovis AF2122/97
cagcgcggcgca

SEQ ID NO: 1132262 - RNA, 18 nt, Mycobacterium bovis subsp bovis AF2122/97
cagcgcggcgagggcggu

SEQ ID NO: 1132263 - RNA, 21 nt, Mycobacterium bovis subsp bovis AF2122/97
cagcgcggcgcccuggccgcc

SEQ ID NO: 1132264 - RNA, 14 nt, Mycobacterium bovis subsp bovis AF2122/97
cagcgcggcgcgca

SEQ ID NO: 1132265 - RNA, 16 nt, Mycobacterium bovis subsp bovis AF2122/97
cagcgcggccgggcgc

SEQ ID NO: 1132266 - RNA, 20 nt, Mycobacterium bovis subsp bovis AF2122/97
cagcgcggccgggcgcccuu

SEQ ID NO: 1132267 - RNA, 23 nt, Mycobacterium bovis subsp bovis AF2122/97
cagcgcggccggaauacccggcc

SEQ ID NO: 1132268 - RNA, 12 nt, Mycobacterium bovis subsp bovis AF2122/97
cagcgcggcccc

SEQ ID NO: 1132269 - RNA, 16 nt, Mycobacterium bovis subsp bovis AF2122/97
cagcgcugggcccagg

SEQ ID NO: 1132270 - RNA, 17 nt, Mycobacterium bovis subsp bovis AF2122/97
cagcgcuucacgggccg

SEQ ID NO: 1132271 - RNA, 18 nt, Mycobacterium bovis subsp bovis AF2122/97
cagcgcuucacgggccgu

SEQ ID NO: 1132272 - RNA, 19 nt, Mycobacterium bovis subsp bovis AF2122/97
cagcgcugucguaccgcgg

SEQ ID NO: 1132273 - RNA, 15 nt, Mycobacterium bovis subsp bovis AF2122/97
cagcgcugaccggcu

SEQ ID NO: 1132274 - RNA, 15 nt, Mycobacterium bovis subsp bovis AF2122/97
cagcgcugccaccgc

SEQ ID NO: 1132275 - RNA, 16 nt, Mycobacterium bovis subsp bovis AF2122/97
cagcgcugccaccgcg

SEQ ID NO: 1132276 - RNA, 17 nt, Mycobacterium bovis subsp bovis AF2122/97
cagcgcugccaccgcgg

SEQ ID NO: 1132277 - RNA, 18 nt, Mycobacterium bovis subsp bovis AF2122/97
cagcgcugccaccgcggu

SEQ ID NO: 1132278 - RNA, 14 nt, Mycobacterium bovis subsp bovis AF2122/97
cagcgcugcgaugg

SEQ ID NO: 1132279 - RNA, 14 nt, Mycobacterium bovis subsp bovis AF2122/97
cagcgcuggcaggc

SEQ ID NO: 1132280 - RNA, 16 nt, Mycobacterium bovis subsp bovis AF2122/97
cagcgcuggcaggccg

SEQ ID NO: 1132281 - RNA, 17 nt, Mycobacterium bovis subsp bovis AF2122/97
cagcgcuggcaggccgg

SEQ ID NO: 1132282 - RNA, 22 nt, Mycobacterium bovis subsp bovis AF2122/97
cagcggaaccgagggccgucac

SEQ ID NO: 1132283 - RNA, 17 nt, Mycobacterium bovis subsp bovis AF2122/97
cagcgcuucgucggccg

SEQ ID NO: 1132284 - RNA, 19 nt, Mycobacterium bovis subsp bovis AF2122/97
cagcgcuucgucggccggc

SEQ ID NO: 1132285 - RNA, 14 nt, Mycobacterium bovis subsp bovis AF2122/97
cagcgcuucgucgg

SEQ ID NO: 1132286 - RNA, 16 nt, Mycobacterium bovis subsp bovis AF2122/97
cagcgcuucgucggcc

SEQ ID NO: 1132287 - RNA, 21 nt, Mycobacterium bovis subsp bovis AF2122/97
cagcgcuucacgggccgucca

SEQ ID NO: 1132288 - RNA, 19 nt, Mycobacterium bovis subsp bovis AF2122/97
cagcgcucucauagcgacg

SEQ ID NO: 1132289 - RNA, 15 nt, Mycobacterium bovis subsp bovis AF2122/97
cagcgcuccagccgc

SEQ ID NO: 1132290 - RNA, 18 nt, Mycobacterium bovis subsp bovis AF2122/97
cagcgcuccagccgcgcg

SEQ ID NO: 1132291 - RNA, 17 nt, Mycobacterium bovis subsp bovis AF2122/97
cagcgcuccagcacccg

SEQ ID NO: 1132292 - RNA, 20 nt, Mycobacterium bovis subsp bovis AF2122/97
cagcgcuagccgggcgcgcc

SEQ ID NO: 1132293 - RNA, 14 nt, Mycobacterium bovis subsp bovis AF2122/97
cagcgcucaccggc

SEQ ID NO: 1132294 - RNA, 15 nt, Mycobacterium bovis subsp bovis AF2122/97
cagcgcucaccggcg

SEQ ID NO: 1132295 - RNA, 16 nt, Mycobacterium bovis subsp bovis AF2122/97
cagcgcucaccggcgu

SEQ ID NO: 1132296 - RNA, 17 nt, Mycobacterium bovis subsp bovis AF2122/97
cagcgcgucggagccgg

SEQ ID NO: 1132297 - RNA, 23 nt, Mycobacterium bovis subsp bovis AF2122/97
cagcgcgguguagagcgcaccgc

SEQ ID NO: 1132298 - RNA, 15 nt, Mycobacterium bovis subsp bovis AF2122/97
cagcgcgucguccag

SEQ ID NO: 1132299 - RNA, 15 nt, Mycobacterium bovis subsp bovis AF2122/97
cagcgcguuggcgag

SEQ ID NO: 1132300 - RNA, 19 nt, Mycobacterium bovis subsp bovis AF2122/97
cagcgcgugcuguggaugc

SEQ ID NO: 1132301 - RNA, 19 nt, Mycobacterium bovis subsp bovis AF2122/97
cagcgcgugguaccgcuug

SEQ ID NO: 1132302 - RNA, 18 nt, Mycobacterium bovis subsp bovis AF2122/97
cagcgguugaugcggccg

SEQ ID NO: 1132303 - RNA, 20 nt, Mycobacterium bovis subsp bovis AF2122/97
cagcgguuuuaggcagccca

SEQ ID NO: 1132304 - RNA, 13 nt, Mycobacterium bovis subsp bovis AF2122/97
cagcgguucggug

SEQ ID NO: 1132305 - RNA, 18 nt, Mycobacterium bovis subsp bovis AF2122/97
cagcgguucggugaucgg

SEQ ID NO: 1132306 - RNA, 19 nt, Mycobacterium bovis subsp bovis AF2122/97
cagcgguucggugaucggg

SEQ ID NO: 1132307 - RNA, 13 nt, Mycobacterium bovis subsp bovis AF2122/97
cagcggucggcgg

SEQ ID NO: 1132308 - RNA, 14 nt, Mycobacterium bovis subsp bovis AF2122/97
cagcggucggcggu

SEQ ID NO: 1132309 - RNA, 15 nt, Mycobacterium bovis subsp bovis AF2122/97
cagcggugcagcccg

SEQ ID NO: 1132310 - RNA, 17 nt, Mycobacterium bovis subsp bovis AF2122/97
cagcggugcgcgguugu

SEQ ID NO: 1132311 - RNA, 15 nt, Mycobacterium bovis subsp bovis AF2122/97
cagcgguggaccacc

SEQ ID NO: 1132312 - RNA, 17 nt, Mycobacterium bovis subsp bovis AF2122/97
cagcgguggucggcgcg

SEQ ID NO: 1132313 - RNA, 22 nt, Mycobacterium bovis subsp bovis AF2122/97
cagcgguguagccggcgccgcc

SEQ ID NO: 1132314 - RNA, 23 nt, Mycobacterium bovis subsp bovis AF2122/97
cagcgguguagccggcgccgccg

SEQ ID NO: 1132315 - RNA, 15 nt, Mycobacterium bovis subsp bovis AF2122/97
cagcgguccgccgcc

SEQ ID NO: 1132316 - RNA, 17 nt, Mycobacterium bovis subsp bovis AF2122/97
cagcgguccagccaccg

SEQ ID NO: 1132317 - RNA, 14 nt, Mycobacterium bovis subsp bovis AF2122/97
cagcggucggcgac

SEQ ID NO: 1132318 - RNA, 16 nt, Mycobacterium bovis subsp bovis AF2122/97
cagcggucggcgacca

SEQ ID NO: 1132319 - RNA, 19 nt, Mycobacterium bovis subsp bovis AF2122/97
cagcgugaucugcagggcc

SEQ ID NO: 1132320 - RNA, 16 nt, Mycobacterium bovis subsp bovis AF2122/97
cagcgugcacacccgc

SEQ ID NO: 1132321 - RNA, 17 nt, Mycobacterium bovis subsp bovis AF2122/97
cagcgugcacacccgca

SEQ ID NO: 1132322 - RNA, 14 nt, Mycobacterium bovis subsp bovis AF2122/97
cagcgugcccgcca

SEQ ID NO: 1132323 - RNA, 15 nt, Mycobacterium bovis subsp bovis AF2122/97
cagcgugcccgccac

SEQ ID NO: 1132324 - RNA, 17 nt, Mycobacterium bovis subsp bovis AF2122/97
cagcgugcccgccaccg

SEQ ID NO: 1132325 - RNA, 18 nt, Mycobacterium bovis subsp bovis AF2122/97
cagcgugcccgccaccgg

SEQ ID NO: 1132326 - RNA, 18 nt, Mycobacterium bovis subsp bovis AF2122/97
cagcgucgcuaucgugcg

SEQ ID NO: 1132327 - RNA, 18 nt, Mycobacterium bovis subsp bovis AF2122/97
cagcgucgucgacgacaa

SEQ ID NO: 1132328 - RNA, 14 nt, Mycobacterium bovis subsp bovis AF2122/97
cagcgucgcggcca

SEQ ID NO: 1132329 - RNA, 17 nt, Mycobacterium bovis subsp bovis AF2122/97
cagcgucgcggccacgg

SEQ ID NO: 1132330 - RNA, 12 nt, Mycobacterium bovis subsp bovis AF2122/97
cagcgggcgaug

SEQ ID NO: 1132331 - RNA, 19 nt, Mycobacterium bovis subsp bovis AF2122/97
cagcgggcgaugagcgcga

SEQ ID NO: 1132332 - RNA, 21 nt, Mycobacterium bovis subsp bovis AF2122/97
cagcgggcauaacccgcaccg

SEQ ID NO: 1132333 - RNA, 22 nt, Mycobacterium bovis subsp bovis AF2122/97
cagcgggcauaacccgcaccgg

SEQ ID NO: 1132334 - RNA, 15 nt, Mycobacterium bovis subsp bovis AF2122/97
cagcgggcaucgcga

SEQ ID NO: 1132335 - RNA, 23 nt, Mycobacterium bovis subsp bovis AF2122/97
cagcggguucaacgcgcgcacgc

SEQ ID NO: 1132336 - RNA, 21 nt, Mycobacterium bovis subsp bovis AF2122/97
cagcgggcggugucgucaucg

SEQ ID NO: 1132337 - RNA, 22 nt, Mycobacterium bovis subsp bovis AF2122/97
cagcgggcggugucgucaucgg

SEQ ID NO: 1132338 - RNA, 16 nt, Mycobacterium bovis subsp bovis AF2122/97
cagcgguagccgagcu

SEQ ID NO: 1132339 - RNA, 15 nt, Mycobacterium bovis subsp bovis AF2122/97
cagcggcgcucggcg

SEQ ID NO: 1132340 - RNA, 17 nt, Mycobacterium bovis subsp bovis AF2122/97
cagcggcgcucggcgcc

SEQ ID NO: 1132341 - RNA, 23 nt, Mycobacterium bovis subsp bovis AF2122/97
cagcggcggcaacgguggcaacg

SEQ ID NO: 1132342 - RNA, 22 nt, Mycobacterium bovis subsp bovis AF2122/97
cagcggcgccaguauggccgcc

SEQ ID NO: 1132343 - RNA, 20 nt, Mycobacterium bovis subsp bovis AF2122/97
cagcggcggaaggacggcag

SEQ ID NO: 1132344 - RNA, 16 nt, Mycobacterium bovis subsp bovis AF2122/97
cagcgggcacgccgcc

SEQ ID NO: 1132345 - RNA, 17 nt, Mycobacterium bovis subsp bovis AF2122/97
cagcgggcacgccgccg

SEQ ID NO: 1132346 - RNA, 18 nt, Mycobacterium bovis subsp bovis AF2122/97
cagcgggcacgccgccga

SEQ ID NO: 1132347 - RNA, 17 nt, Mycobacterium bovis subsp bovis AF2122/97
cagcgggcagcaggcga

SEQ ID NO: 1132348 - RNA, 14 nt, Mycobacterium bovis subsp bovis AF2122/97
cagcgggacugcgg

SEQ ID NO: 1132349 - RNA, 19 nt, Mycobacterium bovis subsp bovis AF2122/97
cagcgggcagcaggcgaug

SEQ ID NO: 1132350 - RNA, 21 nt, Mycobacterium bovis subsp bovis AF2122/97
cagcgggacauccagugcggu

SEQ ID NO: 1132351 - RNA, 22 nt, Mycobacterium bovis subsp bovis AF2122/97
cagcggcaggaagaaaccgcag

SEQ ID NO: 1132352 - RNA, 21 nt, Mycobacterium bovis subsp bovis AF2122/97
cagcggcaguuccugacgcca

SEQ ID NO: 1132353 - RNA, 22 nt, Mycobacterium bovis subsp bovis AF2122/97
cagcggcauauggauguuggug

SEQ ID NO: 1132354 - RNA, 17 nt, Mycobacterium bovis subsp bovis AF2122/97
cagcggcaucggccagc

SEQ ID NO: 1132355 - RNA, 18 nt, Mycobacterium bovis subsp bovis AF2122/97
cagcggcaucggccagcc

SEQ ID NO: 1132356 - RNA, 16 nt, Mycobacterium bovis subsp bovis AF2122/97
cagcggcaccgcgccg

SEQ ID NO: 1132357 - RNA, 17 nt, Mycobacterium bovis subsp bovis AF2122/97
cagcggcaccgcgccgg

SEQ ID NO: 1132358 - RNA, 18 nt, Mycobacterium bovis subsp bovis AF2122/97
cagcggcaccgcgccggc

SEQ ID NO: 1132359 - RNA, 15 nt, Mycobacterium bovis subsp bovis AF2122/97
cagcggcaccgcggc

SEQ ID NO: 1132360 - RNA, 18 nt, Mycobacterium bovis subsp bovis AF2122/97
cagcggcaccgcggccag

SEQ ID NO: 1132361 - RNA, 21 nt, Mycobacterium bovis subsp bovis AF2122/97
cagcggcaccgcggccagcgg

SEQ ID NO: 1132362 - RNA, 13 nt, Mycobacterium bovis subsp bovis AF2122/97
cagcggcaccgcg

SEQ ID NO: 1132363 - RNA, 15 nt, Mycobacterium bovis subsp bovis AF2122/97
cagcggcaccgcgcc

SEQ ID NO: 1132364 - RNA, 19 nt, Mycobacterium bovis subsp bovis AF2122/97
cagcggcacacccaucacc

SEQ ID NO: 1132365 - RNA, 23 nt, Mycobacterium bovis subsp bovis AF2122/97
cagcggcacacccaucaccgcca

SEQ ID NO: 1132366 - RNA, 21 nt, Mycobacterium bovis subsp bovis AF2122/97
cagcggaccgcugccugccgc

SEQ ID NO: 1132367 - RNA, 19 nt, Mycobacterium bovis subsp bovis AF2122/97
cagcggaacugggccccca

SEQ ID NO: 1132368 - RNA, 21 nt, Mycobacterium bovis subsp bovis AF2122/97
cagcggaacugggcccccaau

SEQ ID NO: 1132369 - RNA, 16 nt, Mycobacterium bovis subsp bovis AF2122/97
cagcggaaucaccgaa

SEQ ID NO: 1132370 - RNA, 18 nt, Mycobacterium bovis subsp bovis AF2122/97
cagcggagccacucggcc

SEQ ID NO: 1132371 - RNA, 15 nt, Mycobacterium bovis subsp bovis AF2122/97
cagcggaucgcauuu

SEQ ID NO: 1132372 - RNA, 19 nt, Mycobacterium bovis subsp bovis AF2122/97
cagcggaucgucguuguca

SEQ ID NO: 1132373 - RNA, 18 nt, Mycobacterium bovis subsp bovis AF2122/97
cagcggauuugccccguu

SEQ ID NO: 1132374 - RNA, 20 nt, Mycobacterium bovis subsp bovis AF2122/97
cagcggagccacucggcccg

SEQ ID NO: 1132375 - RNA, 16 nt, Mycobacterium bovis subsp bovis AF2122/97
cagcggcaacgaucga

SEQ ID NO: 1132376 - RNA, 19 nt, Mycobacterium bovis subsp bovis AF2122/97
cagcggcaauggccagcac

SEQ ID NO: 1132377 - RNA, 13 nt, Mycobacterium bovis subsp bovis AF2122/97
cagcggccgaccg

SEQ ID NO: 1132378 - RNA, 21 nt, Mycobacterium bovis subsp bovis AF2122/97
cagcggccugaccggcucgcc

SEQ ID NO: 1132379 - RNA, 19 nt, Mycobacterium bovis subsp bovis AF2122/97
cagcggccagcccagccgg

SEQ ID NO: 1132380 - RNA, 13 nt, Mycobacterium bovis subsp bovis AF2122/97
cagcggccuccgg

SEQ ID NO: 1132381 - RNA, 15 nt, Mycobacterium bovis subsp bovis AF2122/97
cagcggccuccgggc

SEQ ID NO: 1132382 - RNA, 19 nt, Mycobacterium bovis subsp bovis AF2122/97
cagcggccugaccggcucg

SEQ ID NO: 1132383 - RNA, 18 nt, Mycobacterium bovis subsp bovis AF2122/97
cagcggcgauugauccgg

SEQ ID NO: 1132384 - RNA, 15 nt, Mycobacterium bovis subsp bovis AF2122/97
cagcggcgaucaggc

SEQ ID NO: 1132385 - RNA, 14 nt, Mycobacterium bovis subsp bovis AF2122/97
cagcggcgaucgga

SEQ ID NO: 1132386 - RNA, 15 nt, Mycobacterium bovis subsp bovis AF2122/97
cagcggcgaucggag

SEQ ID NO: 1132387 - RNA, 16 nt, Mycobacterium bovis subsp bovis AF2122/97
cagcggcgacaugauc

SEQ ID NO: 1132388 - RNA, 12 nt, Mycobacterium bovis subsp bovis AF2122/97
cagcggcgaccg

SEQ ID NO: 1132389 - RNA, 18 nt, Mycobacterium bovis subsp bovis AF2122/97
cagcggcgaguuggccgu

SEQ ID NO: 1132390 - RNA, 23 nt, Mycobacterium bovis subsp bovis AF2122/97
cagcggcgcgcugcacggaaucg

SEQ ID NO: 1132391 - RNA, 19 nt, Mycobacterium bovis subsp bovis AF2122/97
cagcggcgauugauccggu

SEQ ID NO: 1132392 - RNA, 16 nt, Mycobacterium bovis subsp bovis AF2122/97
cagcggcgcauaggcg

SEQ ID NO: 1132393 - RNA, 17 nt, Mycobacterium bovis subsp bovis AF2122/97
cagcggcgcauaggcgg

SEQ ID NO: 1132394 - RNA, 23 nt, Mycobacterium bovis subsp bovis AF2122/97
cagcggcgcauaggcggccaucg

SEQ ID NO: 1132395 - RNA, 12 nt, Mycobacterium bovis subsp bovis AF2122/97
cagcggccgacc

SEQ ID NO: 1132396 - RNA, 15 nt, Mycobacterium bovis subsp bovis AF2122/97
cagcggccgggcggc

SEQ ID NO: 1132397 - RNA, 14 nt, Mycobacterium bovis subsp bovis AF2122/97
cagcggccgaccgc

SEQ ID NO: 1132398 - RNA, 15 nt, Mycobacterium bovis subsp bovis AF2122/97
cagcggccgaccgcg

SEQ ID NO: 1132399 - RNA, 20 nt, Mycobacterium bovis subsp bovis AF2122/97
cagcggccgaccgcgacccg

SEQ ID NO: 1132400 - RNA, 22 nt, Mycobacterium bovis subsp bovis AF2122/97
cagcggccgaccgcgacccggc

SEQ ID NO: 1132401 - RNA, 14 nt, Mycobacterium bovis subsp bovis AF2122/97
cagcggccgccgcg

SEQ ID NO: 1132402 - RNA, 11 nt, Mycobacterium bovis subsp bovis AF2122/97
cagcggccgcg

SEQ ID NO: 1132403 - RNA, 23 nt, Mycobacterium bovis subsp bovis AF2122/97
cagcggccauaucgcccaccacg

SEQ ID NO: 1132404 - RNA, 16 nt, Mycobacterium bovis subsp bovis AF2122/97
cagcggccauaucgcc

SEQ ID NO: 1132405 - RNA, 18 nt, Mycobacterium bovis subsp bovis AF2122/97
cagcggcauugccagccg

SEQ ID NO: 1132406 - RNA, 14 nt, Mycobacterium bovis subsp bovis AF2122/97
cagcggccaaccca

SEQ ID NO: 1132407 - RNA, 14 nt, Mycobacterium bovis subsp bovis AF2122/97
cagcggcagcaccg

SEQ ID NO: 1132408 - RNA, 14 nt, Mycobacterium bovis subsp bovis AF2122/97
cagcggccagccca

SEQ ID NO: 1132409 - RNA, 12 nt, Mycobacterium bovis subsp bovis AF2122/97
cagcggccaccg

SEQ ID NO: 1132410 - RNA, 13 nt, Mycobacterium bovis subsp bovis AF2122/97
cagcggccaccga

SEQ ID NO: 1132411 - RNA, 16 nt, Mycobacterium bovis subsp bovis AF2122/97
cacugccaucgcggcg

SEQ ID NO: 1132412 - RNA, 18 nt, Mycobacterium bovis subsp bovis AF2122/97
cacugccaucgcggcguu

SEQ ID NO: 1132413 - RNA, 13 nt, Mycobacterium bovis subsp bovis AF2122/97
cacugccaccgcg

SEQ ID NO: 1132414 - RNA, 16 nt, Mycobacterium bovis subsp bovis AF2122/97
cacugccaccgcgagg

SEQ ID NO: 1132415 - RNA, 12 nt, Mycobacterium bovis subsp bovis AF2122/97
cacugcagcgcc

SEQ ID NO: 1132416 - RNA, 16 nt, Mycobacterium bovis subsp bovis AF2122/97
cacugcacggagccgc

SEQ ID NO: 1132417 - RNA, 18 nt, Mycobacterium bovis subsp bovis AF2122/97
cacugcacggagccgccg

SEQ ID NO: 1132418 - RNA, 15 nt, Mycobacterium bovis subsp bovis AF2122/97
cacugcacccgaucg

SEQ ID NO: 1132419 - RNA, 23 nt, Mycobacterium bovis subsp bovis AF2122/97
cacugcggcgcugggacggucgc

SEQ ID NO: 1132420 - RNA, 11 nt, Mycobacterium bovis subsp bovis AF2122/97
cacugcugcgg

SEQ ID NO: 1132421 - RNA, 22 nt, Mycobacterium bovis subsp bovis AF2122/97
cacugcuggucagguaucgggg

SEQ ID NO: 1132422 - RNA, 22 nt, Mycobacterium bovis subsp bovis AF2122/97
cacugcguuccaucgccgacgc

SEQ ID NO: 1132423 - RNA, 12 nt, Mycobacterium bovis subsp bovis AF2122/97
cacugcggccag

SEQ ID NO: 1132424 - RNA, 18 nt, Mycobacterium bovis subsp bovis AF2122/97
cacugcggccugcucgac

SEQ ID NO: 1132425 - RNA, 14 nt, Mycobacterium bovis subsp bovis AF2122/97
cacugcgccggccg

SEQ ID NO: 1132426 - RNA, 16 nt, Mycobacterium bovis subsp bovis AF2122/97
cacugcgccggccggc

SEQ ID NO: 1132427 - RNA, 15 nt, Mycobacterium bovis subsp bovis AF2122/97
cacuccacgaucggc

SEQ ID NO: 1132428 - RNA, 22 nt, Mycobacterium bovis subsp bovis AF2122/97
cacuccaaauggugagcucgcg

SEQ ID NO: 1132429 - RNA, 19 nt, Mycobacterium bovis subsp bovis AF2122/97
cacucaucggugugcaucg

SEQ ID NO: 1132430 - RNA, 17 nt, Mycobacterium bovis subsp bovis AF2122/97
cacuccagcagcucgcc

SEQ ID NO: 1132431 - RNA, 15 nt, Mycobacterium bovis subsp bovis AF2122/97
cacuccaugauccag

SEQ ID NO: 1132432 - RNA, 13 nt, Mycobacterium bovis subsp bovis AF2122/97
cacuccagcggcg

SEQ ID NO: 1132433 - RNA, 16 nt, Mycobacterium bovis subsp bovis AF2122/97
cacucccagccaaccc

SEQ ID NO: 1132434 - RNA, 15 nt, Mycobacterium bovis subsp bovis AF2122/97
cacucccgagccaca

SEQ ID NO: 1132435 - RNA, 23 nt, Mycobacterium bovis subsp bovis AF2122/97
cacucccccacacacccgacacg

SEQ ID NO: 1132436 - RNA, 23 nt, Mycobacterium bovis subsp bovis AF2122/97
cacuccgccaacaucuccgcguc

SEQ ID NO: 1132437 - RNA, 16 nt, Mycobacterium bovis subsp bovis AF2122/97
cacucccggcucggcc

SEQ ID NO: 1132438 - RNA, 22 nt, Mycobacterium bovis subsp bovis AF2122/97
cacuccgggcucggcgucgccg

SEQ ID NO: 1132439 - RNA, 23 nt, Mycobacterium bovis subsp bovis AF2122/97
cacuccgguggccaacaccgcca

SEQ ID NO: 1132440 - RNA, 16 nt, Mycobacterium bovis subsp bovis AF2122/97
cacuccggcgacgauc

SEQ ID NO: 1132441 - RNA, 13 nt, Mycobacterium bovis subsp bovis AF2122/97
cacuccggcguug

SEQ ID NO: 1132442 - RNA, 23 nt, Mycobacterium bovis subsp bovis AF2122/97
cacuccuagccaacgagcgcgcu

SEQ ID NO: 1132443 - RNA, 17 nt, Mycobacterium bovis subsp bovis AF2122/97
cacuccugagaugcggc

SEQ ID NO: 1132444 - RNA, 13 nt, Mycobacterium bovis subsp bovis AF2122/97
cacuccugcacac

SEQ ID NO: 1132445 - RNA, 18 nt, Mycobacterium bovis subsp bovis AF2122/97
cacuccugcaccaucggu

SEQ ID NO: 1132446 - RNA, 18 nt, Mycobacterium bovis subsp bovis AF2122/97
cacucgaccaggaccggc

SEQ ID NO: 1132447 - RNA, 19 nt, Mycobacterium bovis subsp bovis AF2122/97
cacguugcagcucgauccg

SEQ ID NO: 1132448 - RNA, 20 nt, Mycobacterium bovis subsp bovis AF2122/97
cacguugcagcucgauccgc

SEQ ID NO: 1132449 - RNA, 19 nt, Mycobacterium bovis subsp bovis AF2122/97
cacgcgcaguuuggcggcg

SEQ ID NO: 1132450 - RNA, 17 nt, Mycobacterium bovis subsp bovis AF2122/97
cacguugauucgggagg

SEQ ID NO: 1132451 - RNA, 20 nt, Mycobacterium bovis subsp bovis AF2122/97
cacguugaugaugccggcgu

SEQ ID NO: 1132452 - RNA, 14 nt, Mycobacterium bovis subsp bovis AF2122/97
cacguugacgucca

SEQ ID NO: 1132453 - RNA, 15 nt, Mycobacterium bovis subsp bovis AF2122/97
cacgcgauggccauc

SEQ ID NO: 1132454 - RNA, 20 nt, Mycobacterium bovis subsp bovis AF2122/97
cacgcgauggccaucaucga

SEQ ID NO: 1132455 - RNA, 23 nt, Mycobacterium bovis subsp bovis AF2122/97
cacgcgaaaugccugcgcgaugc

SEQ ID NO: 1132456 - RNA, 20 nt, Mycobacterium bovis subsp bovis AF2122/97
cacgcgaccaccgccgagcc

SEQ ID NO: 1132457 - RNA, 21 nt, Mycobacterium bovis subsp bovis AF2122/97
cacguugccgaucccggcgag

SEQ ID NO: 1132458 - RNA, 22 nt, Mycobacterium bovis subsp bovis AF2122/97
cacguuggcggccagcgcaccg

SEQ ID NO: 1132459 - RNA, 17 nt, Mycobacterium bovis subsp bovis AF2122/97
cacguuggcggccagcg

SEQ ID NO: 1132460 - RNA, 17 nt, Mycobacterium bovis subsp bovis AF2122/97
cacguuguucaccgacg

SEQ ID NO: 1132461 - RNA, 20 nt, Mycobacterium bovis subsp bovis AF2122/97
cacguuguucaccgacgcga

SEQ ID NO: 1132462 - RNA, 17 nt, Mycobacterium bovis subsp bovis AF2122/97
cacuaggaagguggccc

SEQ ID NO: 1132463 - RNA, 17 nt, Mycobacterium bovis subsp bovis AF2122/97
cacucaacgaccuggga

SEQ ID NO: 1132464 - RNA, 18 nt, Mycobacterium bovis subsp bovis AF2122/97
cacucagcccgacaccga

SEQ ID NO: 1132465 - RNA, 22 nt, Mycobacterium bovis subsp bovis AF2122/97
cacucagcccgacaccgaucgg

SEQ ID NO: 1132466 - RNA, 23 nt, Mycobacterium bovis subsp bovis AF2122/97
cacucagcaggggaucguccggc

SEQ ID NO: 1132467 - RNA, 14 nt, Mycobacterium bovis subsp bovis AF2122/97
cacuucggcgucca

SEQ ID NO: 1132468 - RNA, 21 nt, Mycobacterium bovis subsp bovis AF2122/97
cacuugaaauugagccggccc

SEQ ID NO: 1132469 - RNA, 18 nt, Mycobacterium bovis subsp bovis AF2122/97
cacuugaucgacggccau

SEQ ID NO: 1132470 - RNA, 19 nt, Mycobacterium bovis subsp bovis AF2122/97
cacuugauguucgacgggc

SEQ ID NO: 1132471 - RNA, 16 nt, Mycobacterium bovis subsp bovis AF2122/97
cacuugcagcacaacg

SEQ ID NO: 1132472 - RNA, 20 nt, Mycobacterium bovis subsp bovis AF2122/97
cacuugcagcacaacgucuu

SEQ ID NO: 1132473 - RNA, 20 nt, Mycobacterium bovis subsp bovis AF2122/97
cacuugcucggugagccucu

SEQ ID NO: 1132474 - RNA, 14 nt, Mycobacterium bovis subsp bovis AF2122/97
cacuugcccgucgg

SEQ ID NO: 1132475 - RNA, 15 nt, Mycobacterium bovis subsp bovis AF2122/97
cacuuggacgaacac

SEQ ID NO: 1132476 - RNA, 16 nt, Mycobacterium bovis subsp bovis AF2122/97
cacuuggaugcgaccc

SEQ ID NO: 1132477 - RNA, 19 nt, Mycobacterium bovis subsp bovis AF2122/97
cacuggcacacggucaccg

SEQ ID NO: 1132478 - RNA, 22 nt, Mycobacterium bovis subsp bovis AF2122/97
cacuggcacacggucaccggca

SEQ ID NO: 1132479 - RNA, 17 nt, Mycobacterium bovis subsp bovis AF2122/97
cacuggauggcucgccg

SEQ ID NO: 1132480 - RNA, 19 nt, Mycobacterium bovis subsp bovis AF2122/97
cacuucacgaguagcgguu

SEQ ID NO: 1132481 - RNA, 18 nt, Mycobacterium bovis subsp bovis AF2122/97
cacuucauggggcuaugg

SEQ ID NO: 1132482 - RNA, 17 nt, Mycobacterium bovis subsp bovis AF2122/97
cacuuccagcccggcaa

SEQ ID NO: 1132483 - RNA, 18 nt, Mycobacterium bovis subsp bovis AF2122/97
cacuuccggauucggacu

SEQ ID NO: 1132484 - RNA, 16 nt, Mycobacterium bovis subsp bovis AF2122/97
cacuucccaggauccg

SEQ ID NO: 1132485 - RNA, 14 nt, Mycobacterium bovis subsp bovis AF2122/97
cacuuccggcgugg

SEQ ID NO: 1132486 - RNA, 18 nt, Mycobacterium bovis subsp bovis AF2122/97
cagaagaagaugaucgcg

SEQ ID NO: 1132487 - RNA, 15 nt, Mycobacterium bovis subsp bovis AF2122/97
cagaacggcgaucac

SEQ ID NO: 1132488 - RNA, 23 nt, Mycobacterium bovis subsp bovis AF2122/97
cagaauccggcaaccaccggccg

SEQ ID NO: 1132489 - RNA, 14 nt, Mycobacterium bovis subsp bovis AF2122/97
cagaauccggucgg

SEQ ID NO: 1132490 - RNA, 16 nt, Mycobacterium bovis subsp bovis AF2122/97
cagaauccggucggcc

SEQ ID NO: 1132491 - RNA, 18 nt, Mycobacterium bovis subsp bovis AF2122/97
cagaaucgcauugggcgg

SEQ ID NO: 1132492 - RNA, 21 nt, Mycobacterium bovis subsp bovis AF2122/97
cagaagaccuggcggugccgg

SEQ ID NO: 1132493 - RNA, 16 nt, Mycobacterium bovis subsp bovis AF2122/97
cagaacgguggcgcgg

SEQ ID NO: 1132494 - RNA, 23 nt, Mycobacterium bovis subsp bovis AF2122/97
cagaacgguggcgcggugccggc

SEQ ID NO: 1132495 - RNA, 22 nt, Mycobacterium bovis subsp bovis AF2122/97
cagaacgcaucggucccacugc

SEQ ID NO: 1132496 - RNA, 22 nt, Mycobacterium bovis subsp bovis AF2122/97
cagaacgccguccacgccgacg

SEQ ID NO: 1132497 - RNA, 14 nt, Mycobacterium bovis subsp bovis AF2122/97
cagaacaugccgga

SEQ ID NO: 1132498 - RNA, 19 nt, Mycobacterium bovis subsp bovis AF2122/97
cagaaccgccaacauuggu

SEQ ID NO: 1132499 - RNA, 20 nt, Mycobacterium bovis subsp bovis AF2122/97
cagaacaguaucgccggagu

SEQ ID NO: 1132500 - RNA, 14 nt, Mycobacterium bovis subsp bovis AF2122/97
cagaacaccaccgc

SEQ ID NO: 1132501 - RNA, 22 nt, Mycobacterium bovis subsp bovis AF2122/97
cacuuuccgaggagggccgcga

SEQ ID NO: 1132502 - RNA, 21 nt, Mycobacterium bovis subsp bovis AF2122/97
cacuuuguagcccgcgaucuc

SEQ ID NO: 1132503 - RNA, 18 nt, Mycobacterium bovis subsp bovis AF2122/97
cagaucguccaccgccga

SEQ ID NO: 1132504 - RNA, 17 nt, Mycobacterium bovis subsp bovis AF2122/97
cagaucgucacucccga

SEQ ID NO: 1132505 - RNA, 21 nt, Mycobacterium bovis subsp bovis AF2122/97
cagaucgguugaucggccacg

SEQ ID NO: 1132506 - RNA, 19 nt, Mycobacterium bovis subsp bovis AF2122/97
cagaucgcuaggaccgcgg

SEQ ID NO: 1132507 - RNA, 18 nt, Mycobacterium bovis subsp bovis AF2122/97
cagaucgcgguccgagcg

SEQ ID NO: 1132508 - RNA, 19 nt, Mycobacterium bovis subsp bovis AF2122/97
cagaucuugugccaggcgu

SEQ ID NO: 1132509 - RNA, 16 nt, Mycobacterium bovis subsp bovis AF2122/97
cagaugaaggugacga

SEQ ID NO: 1132510 - RNA, 24 nt, Mycobacterium bovis subsp bovis AF2122/97
cagaucuguacggaucaggcccgg

SEQ ID NO: 1132511 - RNA, 17 nt, Mycobacterium bovis subsp bovis AF2122/97
cagaucuggguucccga

SEQ ID NO: 1132512 - RNA, 20 nt, Mycobacterium bovis subsp bovis AF2122/97
cagaucguuccaggccgcgu

SEQ ID NO: 1132513 - RNA, 18 nt, Mycobacterium bovis subsp bovis AF2122/97
cagauccgccccguaauc

SEQ ID NO: 1132514 - RNA, 14 nt, Mycobacterium bovis subsp bovis AF2122/97
cagaucccgccgcg

SEQ ID NO: 1132515 - RNA, 17 nt, Mycobacterium bovis subsp bovis AF2122/97
cagauccccgccaccga

SEQ ID NO: 1132516 - RNA, 18 nt, Mycobacterium bovis subsp bovis AF2122/97
cagaucaggguggcgcgg

SEQ ID NO: 1132517 - RNA, 23 nt, Mycobacterium bovis subsp bovis AF2122/97
cagaucgcacaccaacaccgcgg

SEQ ID NO: 1132518 - RNA, 14 nt, Mycobacterium bovis subsp bovis AF2122/97
cagauccuggccgg

SEQ ID NO: 1132519 - RNA, 21 nt, Mycobacterium bovis subsp bovis AF2122/97
cagauccuucaacuuacgcga

SEQ ID NO: 1132520 - RNA, 21 nt, Mycobacterium bovis subsp bovis AF2122/97
cagagcguacaggucggccca

SEQ ID NO: 1132521 - RNA, 20 nt, Mycobacterium bovis subsp bovis AF2122/97
cagagcgucgaacacgucgg

SEQ ID NO: 1132522 - RNA, 21 nt, Mycobacterium bovis subsp bovis AF2122/97
cagagcguuccgcucgaaucg

SEQ ID NO: 1132523 - RNA, 15 nt, Mycobacterium bovis subsp bovis AF2122/97
cagagcuucgccgcg

SEQ ID NO: 1132524 - RNA, 14 nt, Mycobacterium bovis subsp bovis AF2122/97
cagaggacccgugc

SEQ ID NO: 1132525 - RNA, 17 nt, Mycobacterium bovis subsp bovis AF2122/97
cagaggcggcuggcggu

SEQ ID NO: 1132526 - RNA, 16 nt, Mycobacterium bovis subsp bovis AF2122/97
cagaggucacgcagca

SEQ ID NO: 1132527 - RNA, 17 nt, Mycobacterium bovis subsp bovis AF2122/97
cagaggucgagcgccuu

SEQ ID NO: 1132528 - RNA, 14 nt, Mycobacterium bovis subsp bovis AF2122/97
cagagucaccgcgc

SEQ ID NO: 1132529 - RNA, 16 nt, Mycobacterium bovis subsp bovis AF2122/97
cagagucgcacugcgc

SEQ ID NO: 1132530 - RNA, 19 nt, Mycobacterium bovis subsp bovis AF2122/97
cagaguucccgaaacccga

SEQ ID NO: 1132531 - RNA, 12 nt, Mycobacterium bovis subsp bovis AF2122/97
cagagucgcccg

SEQ ID NO: 1132532 - RNA, 20 nt, Mycobacterium bovis subsp bovis AF2122/97
cagaguuugcgaugcccacg

SEQ ID NO: 1132533 - RNA, 15 nt, Mycobacterium bovis subsp bovis AF2122/97
cagaucaggacgcga

SEQ ID NO: 1132534 - RNA, 13 nt, Mycobacterium bovis subsp bovis AF2122/97
cagaucagcaccg

SEQ ID NO: 1132535 - RNA, 14 nt, Mycobacterium bovis subsp bovis AF2122/97
cagaucaccgccag

SEQ ID NO: 1132536 - RNA, 21 nt, Mycobacterium bovis subsp bovis AF2122/97
cagauauuccucgucggucac

SEQ ID NO: 1132537 - RNA, 19 nt, Mycobacterium bovis subsp bovis AF2122/97
cagacguaaaagcccccgc

SEQ ID NO: 1132538 - RNA, 20 nt, Mycobacterium bovis subsp bovis AF2122/97
cagacguaaaagcccccgca

SEQ ID NO: 1132539 - RNA, 23 nt, Mycobacterium bovis subsp bovis AF2122/97
cagacguaaaagcccccgcacgc

SEQ ID NO: 1132540 - RNA, 21 nt, Mycobacterium bovis subsp bovis AF2122/97
cagacgcauaagcccccgaca

SEQ ID NO: 1132541 - RNA, 22 nt, Mycobacterium bovis subsp bovis AF2122/97
cagacgcauaagcccccgacac

SEQ ID NO: 1132542 - RNA, 19 nt, Mycobacterium bovis subsp bovis AF2122/97
cagacgcauaagcccccgc

SEQ ID NO: 1132543 - RNA, 20 nt, Mycobacterium bovis subsp bovis AF2122/97
cagacgcauaagcccccgca

SEQ ID NO: 1132544 - RNA, 22 nt, Mycobacterium bovis subsp bovis AF2122/97
cagacgcauaagcccccgcacg

SEQ ID NO: 1132545 - RNA, 20 nt, Mycobacterium bovis subsp bovis AF2122/97
cagacgcagagucgcacugc

SEQ ID NO: 1132546 - RNA, 19 nt, Mycobacterium bovis subsp bovis AF2122/97
cagacggugcagcuccccg

SEQ ID NO: 1132547 - RNA, 21 nt, Mycobacterium bovis subsp bovis AF2122/97
cagacggugcagcuccccgcc

SEQ ID NO: 1132548 - RNA, 14 nt, Mycobacterium bovis subsp bovis AF2122/97
cagacucgauaugc

SEQ ID NO: 1132549 - RNA, 13 nt, Mycobacterium bovis subsp bovis AF2122/97
cagacuccggugu

SEQ ID NO: 1132550 - RNA, 14 nt, Mycobacterium bovis subsp bovis AF2122/97
cagacucgcggucg

SEQ ID NO: 1132551 - RNA, 17 nt, Mycobacterium bovis subsp bovis AF2122/97
cagagacaugccggcga

SEQ ID NO: 1132552 - RNA, 23 nt, Mycobacterium bovis subsp bovis AF2122/97
cagagcgcugguuggccugccgu

SEQ ID NO: 1132553 - RNA, 18 nt, Mycobacterium bovis subsp bovis AF2122/97
cagaaucucgccgggcug

SEQ ID NO: 1132554 - RNA, 13 nt, Mycobacterium bovis subsp bovis AF2122/97
cagaauugccggc

SEQ ID NO: 1132555 - RNA, 19 nt, Mycobacterium bovis subsp bovis AF2122/97
cagacaacgccgucgaugu

SEQ ID NO: 1132556 - RNA, 15 nt, Mycobacterium bovis subsp bovis AF2122/97
cagaauuccggcgga

SEQ ID NO: 1132557 - RNA, 17 nt, Mycobacterium bovis subsp bovis AF2122/97
cagacaauccgccgccg

SEQ ID NO: 1132558 - RNA, 16 nt, Mycobacterium bovis subsp bovis AF2122/97
cagacacugcugcggc

SEQ ID NO: 1132559 - RNA, 23 nt, Mycobacterium bovis subsp bovis AF2122/97
cagacacugcugcggcagcgcgg

SEQ ID NO: 1132560 - RNA, 19 nt, Mycobacterium bovis subsp bovis AF2122/97
cagacacagaaucgcccau

SEQ ID NO: 1132561 - RNA, 20 nt, Mycobacterium bovis subsp bovis AF2122/97
cagacacagaaucgcccauu

SEQ ID NO: 1132562 - RNA, 14 nt, Mycobacterium bovis subsp bovis AF2122/97
cagacacuggccgu

SEQ ID NO: 1132563 - RNA, 20 nt, Mycobacterium bovis subsp bovis AF2122/97
cagacacuggccgucggcgu

SEQ ID NO: 1132564 - RNA, 20 nt, Mycobacterium bovis subsp bovis AF2122/97
cagacaggauugccgagcgu

SEQ ID NO: 1132565 - RNA, 20 nt, Mycobacterium bovis subsp bovis AF2122/97
cagacaucagugcgccggcg

SEQ ID NO: 1132566 - RNA, 14 nt, Mycobacterium bovis subsp bovis AF2122/97
cagacaucgcgacg

SEQ ID NO: 1132567 - RNA, 15 nt, Mycobacterium bovis subsp bovis AF2122/97
cagacaucgcgacga

SEQ ID NO: 1132568 - RNA, 21 nt, Mycobacterium bovis subsp bovis AF2122/97
cagacgcaaaauccccucgca

SEQ ID NO: 1132569 - RNA, 20 nt, Mycobacterium bovis subsp bovis AF2122/97
cagacgcaaaagccaccgca

SEQ ID NO: 1132570 - RNA, 22 nt, Mycobacterium bovis subsp bovis AF2122/97
cagacgcaaaagccaccgcacg

SEQ ID NO: 1132571 - RNA, 15 nt, Mycobacterium bovis subsp bovis AF2122/97
cagacgauucggcgg

SEQ ID NO: 1132572 - RNA, 18 nt, Mycobacterium bovis subsp bovis AF2122/97
cagacgcaaaaucgcacg

SEQ ID NO: 1132573 - RNA, 19 nt, Mycobacterium bovis subsp bovis AF2122/97
cagacgcaaaaucgcccaa

SEQ ID NO: 1132574 - RNA, 18 nt, Mycobacterium bovis subsp bovis AF2122/97
cagacgcagaagccccca

SEQ ID NO: 1132575 - RNA, 19 nt, Mycobacterium bovis subsp bovis AF2122/97
cagacgcagaagcccccaa

SEQ ID NO: 1132576 - RNA, 20 nt, Mycobacterium bovis subsp bovis AF2122/97
cagacgcagaagcccccaaa

SEQ ID NO: 1132577 - RNA, 18 nt, Mycobacterium bovis subsp bovis AF2122/97
cagacgcaauagccauca

SEQ ID NO: 1132578 - RNA, 19 nt, Mycobacterium bovis subsp bovis AF2122/97
cagacgcagaaucgcacgc

SEQ ID NO: 1132579 - RNA, 15 nt, Mycobacterium bovis subsp bovis AF2122/97
cagacgcagagucgc

SEQ ID NO: 1132580 - RNA, 19 nt, Mycobacterium bovis subsp bovis AF2122/97
cagacgcagaaucgcauga

SEQ ID NO: 1132581 - RNA, 20 nt, Mycobacterium bovis subsp bovis AF2122/97
cagacgcagaaucgcccaau

SEQ ID NO: 1132582 - RNA, 17 nt, Mycobacterium bovis subsp bovis AF2122/97
cagcacccgcucggccg

SEQ ID NO: 1132583 - RNA, 14 nt, Mycobacterium bovis subsp bovis AF2122/97
cagcacccgcucca

SEQ ID NO: 1132584 - RNA, 23 nt, Mycobacterium bovis subsp bovis AF2122/97
cagcacccgcuccagcucggcgg

SEQ ID NO: 1132585 - RNA, 12 nt, Mycobacterium bovis subsp bovis AF2122/97
cagcacccggcu

SEQ ID NO: 1132586 - RNA, 15 nt, Mycobacterium bovis subsp bovis AF2122/97
cagcacccggcuucg

SEQ ID NO: 1132587 - RNA, 16 nt, Mycobacterium bovis subsp bovis AF2122/97
cagcacccgggccacg

SEQ ID NO: 1132588 - RNA, 22 nt, Mycobacterium bovis subsp bovis AF2122/97
cagcacccgggccacgucgagc

SEQ ID NO: 1132589 - RNA, 13 nt, Mycobacterium bovis subsp bovis AF2122/97
cagcacccgcacg

SEQ ID NO: 1132590 - RNA, 17 nt, Mycobacterium bovis subsp bovis AF2122/97
cagcacccgagcgaugc

SEQ ID NO: 1132591 - RNA, 22 nt, Mycobacterium bovis subsp bovis AF2122/97
cagcaauuuuccgucgauggac

SEQ ID NO: 1132592 - RNA, 15 nt, Mycobacterium bovis subsp bovis AF2122/97
cagcacccauacggc

SEQ ID NO: 1132593 - RNA, 19 nt, Mycobacterium bovis subsp bovis AF2122/97
cagcaccccauggccaccg

SEQ ID NO: 1132594 - RNA, 15 nt, Mycobacterium bovis subsp bovis AF2122/97
cagcaccaugcucgg

SEQ ID NO: 1132595 - RNA, 18 nt, Mycobacterium bovis subsp bovis AF2122/97
cagcaccaugcucggaaa

SEQ ID NO: 1132596 - RNA, 16 nt, Mycobacterium bovis subsp bovis AF2122/97
cagcacccagacgaug

SEQ ID NO: 1132597 - RNA, 18 nt, Mycobacterium bovis subsp bovis AF2122/97
cagcacccagacgauggc

SEQ ID NO: 1132598 - RNA, 14 nt, Mycobacterium bovis subsp bovis AF2122/97
cagcaccgccggug

SEQ ID NO: 1132599 - RNA, 17 nt, Mycobacterium bovis subsp bovis AF2122/97
cagcaccgccgcugcca

SEQ ID NO: 1132600 - RNA, 12 nt, Mycobacterium bovis subsp bovis AF2122/97
cagcaccgccgg

SEQ ID NO: 1132601 - RNA, 17 nt, Mycobacterium bovis subsp bovis AF2122/97
cagcaccgccggcgacg

SEQ ID NO: 1132602 - RNA, 14 nt, Mycobacterium bovis subsp bovis AF2122/97
cagcaccgccgcgc

SEQ ID NO: 1132603 - RNA, 15 nt, Mycobacterium bovis subsp bovis AF2122/97
cagcaccgccgcgcc

SEQ ID NO: 1132604 - RNA, 18 nt, Mycobacterium bovis subsp bovis AF2122/97
cagcaccgccgcgccggc

SEQ ID NO: 1132605 - RNA, 20 nt, Mycobacterium bovis subsp bovis AF2122/97
cagcaccgccgcgccggcgg

SEQ ID NO: 1132606 - RNA, 22 nt, Mycobacterium bovis subsp bovis AF2122/97
cagcaccgccgcgccggcggcc

SEQ ID NO: 1132607 - RNA, 14 nt, Mycobacterium bovis subsp bovis AF2122/97
cagcaccgcgacga

SEQ ID NO: 1132608 - RNA, 15 nt, Mycobacterium bovis subsp bovis AF2122/97
cagcaccgcgacgac

SEQ ID NO: 1132609 - RNA, 12 nt, Mycobacterium bovis subsp bovis AF2122/97
cagcaccgcuac

SEQ ID NO: 1132610 - RNA, 16 nt, Mycobacterium bovis subsp bovis AF2122/97
cagcaccgcuggcagc

SEQ ID NO: 1132611 - RNA, 11 nt, Mycobacterium bovis subsp bovis AF2122/97
cagcaccgccg

SEQ ID NO: 1132612 - RNA, 18 nt, Mycobacterium bovis subsp bovis AF2122/97
cagcaccgaacccgccac

SEQ ID NO: 1132613 - RNA, 19 nt, Mycobacterium bovis subsp bovis AF2122/97
cagcaccgaacccgccacc

SEQ ID NO: 1132614 - RNA, 19 nt, Mycobacterium bovis subsp bovis AF2122/97
cagcacccgcucggccgcc

SEQ ID NO: 1132615 - RNA, 13 nt, Mycobacterium bovis subsp bovis AF2122/97
cagcaccgacggc

SEQ ID NO: 1132616 - RNA, 12 nt, Mycobacterium bovis subsp bovis AF2122/97
cagcaccggcgc

SEQ ID NO: 1132617 - RNA, 16 nt, Mycobacterium bovis subsp bovis AF2122/97
cagcaccgcgacgacg

SEQ ID NO: 1132618 - RNA, 13 nt, Mycobacterium bovis subsp bovis AF2122/97
cagcaccggaucg

SEQ ID NO: 1132619 - RNA, 18 nt, Mycobacterium bovis subsp bovis AF2122/97
cagcaccgcuggcagcga

SEQ ID NO: 1132620 - RNA, 20 nt, Mycobacterium bovis subsp bovis AF2122/97
cagcaccgcuggcagcgacu

SEQ ID NO: 1132621 - RNA, 20 nt, Mycobacterium bovis subsp bovis AF2122/97
cagcaccucgucgaucgccg

SEQ ID NO: 1132622 - RNA, 22 nt, Mycobacterium bovis subsp bovis AF2122/97
cagcacgaccugguuauucgac

SEQ ID NO: 1132623 - RNA, 15 nt, Mycobacterium bovis subsp bovis AF2122/97
cagcacgacgacaac

SEQ ID NO: 1132624 - RNA, 13 nt, Mycobacterium bovis subsp bovis AF2122/97
cagcaccugccgu

SEQ ID NO: 1132625 - RNA, 22 nt, Mycobacterium bovis subsp bovis AF2122/97
cagcaccugccguuccggcugc

SEQ ID NO: 1132626 - RNA, 13 nt, Mycobacterium bovis subsp bovis AF2122/97
cagcacgccgggu

SEQ ID NO: 1132627 - RNA, 14 nt, Mycobacterium bovis subsp bovis AF2122/97
cagcacgccgggug

SEQ ID NO: 1132628 - RNA, 19 nt, Mycobacterium bovis subsp bovis AF2122/97
cagcacgccgggugccgcc

SEQ ID NO: 1132629 - RNA, 15 nt, Mycobacterium bovis subsp bovis AF2122/97
cagcacgccguccag

SEQ ID NO: 1132630 - RNA, 19 nt, Mycobacterium bovis subsp bovis AF2122/97
cagcacgccguccagguuc

SEQ ID NO: 1132631 - RNA, 13 nt, Mycobacterium bovis subsp bovis AF2122/97
cagcacgcucgug

SEQ ID NO: 1132632 - RNA, 16 nt, Mycobacterium bovis subsp bovis AF2122/97
cagcacugcggcagcg

SEQ ID NO: 1132633 - RNA, 20 nt, Mycobacterium bovis subsp bovis AF2122/97
cagaugcgaaggcaucgcgg

SEQ ID NO: 1132634 - RNA, 18 nt, Mycobacterium bovis subsp bovis AF2122/97
cagauggcauugcgccca

SEQ ID NO: 1132635 - RNA, 23 nt, Mycobacterium bovis subsp bovis AF2122/97
cagauggcgaggucggugagguc

SEQ ID NO: 1132636 - RNA, 22 nt, Mycobacterium bovis subsp bovis AF2122/97
cagauggcauugcgcccaccga

SEQ ID NO: 1132637 - RNA, 17 nt, Mycobacterium bovis subsp bovis AF2122/97
cagaugcauccagcugc

SEQ ID NO: 1132638 - RNA, 14 nt, Mycobacterium bovis subsp bovis AF2122/97
cagaugcaccucgc

SEQ ID NO: 1132639 - RNA, 19 nt, Mycobacterium bovis subsp bovis AF2122/97
cagaugcgaaagugguggc

SEQ ID NO: 1132640 - RNA, 15 nt, Mycobacterium bovis subsp bovis AF2122/97
cagaugaugccaccc

SEQ ID NO: 1132641 - RNA, 19 nt, Mycobacterium bovis subsp bovis AF2122/97
cagaugaaggugacgacga

SEQ ID NO: 1132642 - RNA, 23 nt, Mycobacterium bovis subsp bovis AF2122/97
cagaugaauugccgggcgcacgc

SEQ ID NO: 1132643 - RNA, 18 nt, Mycobacterium bovis subsp bovis AF2122/97
cagauuucugggagccgg

SEQ ID NO: 1132644 - RNA, 23 nt, Mycobacterium bovis subsp bovis AF2122/97
cagauucggugccagcaggccga

SEQ ID NO: 1132645 - RNA, 14 nt, Mycobacterium bovis subsp bovis AF2122/97
cagauuccugauga

SEQ ID NO: 1132646 - RNA, 16 nt, Mycobacterium bovis subsp bovis AF2122/97
cagauggucacccacg

SEQ ID NO: 1132647 - RNA, 14 nt, Mycobacterium bovis subsp bovis AF2122/97
cagaugggcgucgg

SEQ ID NO: 1132648 - RNA, 18 nt, Mycobacterium bovis subsp bovis AF2122/97
cagaugggcgucggucac

SEQ ID NO: 1132649 - RNA, 13 nt, Mycobacterium bovis subsp bovis AF2122/97
cagauggcggccg

SEQ ID NO: 1132650 - RNA, 23 nt, Mycobacterium bovis subsp bovis AF2122/97
cagauggcucucggugguccagc

SEQ ID NO: 1132651 - RNA, 22 nt, Mycobacterium bovis subsp bovis AF2122/97
cagauggucggucgcuucagcg

SEQ ID NO: 1132652 - RNA, 20 nt, Mycobacterium bovis subsp bovis AF2122/97
cagaugguuggaucgccacc

SEQ ID NO: 1132653 - RNA, 22 nt, Mycobacterium bovis subsp bovis AF2122/97
cagaugguuggaucgccaccgg

SEQ ID NO: 1132654 - RNA, 21 nt, Mycobacterium bovis subsp bovis AF2122/97
cagauguccgacgcaccaacg

SEQ ID NO: 1132655 - RNA, 16 nt, Mycobacterium bovis subsp bovis AF2122/97
cagcaaguacgcgucg

SEQ ID NO: 1132656 - RNA, 18 nt, Mycobacterium bovis subsp bovis AF2122/97
cagcaaguacgcgucggu

SEQ ID NO: 1132657 - RNA, 14 nt, Mycobacterium bovis subsp bovis AF2122/97
cagcaaggccagca

SEQ ID NO: 1132658 - RNA, 22 nt, Mycobacterium bovis subsp bovis AF2122/97
cagcaauaccugagcgcgcgcg

SEQ ID NO: 1132659 - RNA, 20 nt, Mycobacterium bovis subsp bovis AF2122/97
cagcaauacggcggcgccgc

SEQ ID NO: 1132660 - RNA, 17 nt, Mycobacterium bovis subsp bovis AF2122/97
cagcaaguucgucggga

SEQ ID NO: 1132661 - RNA, 20 nt, Mycobacterium bovis subsp bovis AF2122/97
cagcaaguucgucgggaucg

SEQ ID NO: 1132662 - RNA, 16 nt, Mycobacterium bovis subsp bovis AF2122/97
cagcaaguucgucggg

SEQ ID NO: 1132663 - RNA, 15 nt, Mycobacterium bovis subsp bovis AF2122/97
cagcaaugcccgcac

SEQ ID NO: 1132664 - RNA, 14 nt, Mycobacterium bovis subsp bovis AF2122/97
cagcaacagcgagc

SEQ ID NO: 1132665 - RNA, 17 nt, Mycobacterium bovis subsp bovis AF2122/97
cagcaacgucacgucga

SEQ ID NO: 1132666 - RNA, 12 nt, Mycobacterium bovis subsp bovis AF2122/97
cagcaacucgac

SEQ ID NO: 1132667 - RNA, 22 nt, Mycobacterium bovis subsp bovis AF2122/97
cagcaacucggccacggcgucg

SEQ ID NO: 1132668 - RNA, 20 nt, Mycobacterium bovis subsp bovis AF2122/97
cagcaacugccgcacccggu

SEQ ID NO: 1132669 - RNA, 16 nt, Mycobacterium bovis subsp bovis AF2122/97
cagcaacugggcggcc

SEQ ID NO: 1132670 - RNA, 17 nt, Mycobacterium bovis subsp bovis AF2122/97
cagcaacugggcggccu

SEQ ID NO: 1132671 - RNA, 22 nt, Mycobacterium bovis subsp bovis AF2122/97
cagcaaaacccgcuccaccccu

SEQ ID NO: 1132672 - RNA, 19 nt, Mycobacterium bovis subsp bovis AF2122/97
cagauugccugggcggccg

SEQ ID NO: 1132673 - RNA, 16 nt, Mycobacterium bovis subsp bovis AF2122/97
cagcaaaaaccagcgu

SEQ ID NO: 1132674 - RNA, 22 nt, Mycobacterium bovis subsp bovis AF2122/97
cagcagaauccugcgcugcacc

SEQ ID NO: 1132675 - RNA, 15 nt, Mycobacterium bovis subsp bovis AF2122/97
cagcagaaacaucga

SEQ ID NO: 1132676 - RNA, 18 nt, Mycobacterium bovis subsp bovis AF2122/97
cagcacuuccaagccgac

SEQ ID NO: 1132677 - RNA, 18 nt, Mycobacterium bovis subsp bovis AF2122/97
cagcacuuggacccggcc

SEQ ID NO: 1132678 - RNA, 13 nt, Mycobacterium bovis subsp bovis AF2122/97
cagcagacgacga

SEQ ID NO: 1132679 - RNA, 20 nt, Mycobacterium bovis subsp bovis AF2122/97
cagcagacccgguggcgugg

SEQ ID NO: 1132680 - RNA, 14 nt, Mycobacterium bovis subsp bovis AF2122/97
cagcagagcggcac

SEQ ID NO: 1132681 - RNA, 15 nt, Mycobacterium bovis subsp bovis AF2122/97
cagcagagcggcacg

SEQ ID NO: 1132682 - RNA, 20 nt, Mycobacterium bovis subsp bovis AF2122/97
cagcagagcggcacgcacgc

SEQ ID NO: 1132683 - RNA, 18 nt, Mycobacterium bovis subsp bovis AF2122/97
cagcagcacuccggcgac

SEQ ID NO: 1132684 - RNA, 14 nt, Mycobacterium bovis subsp bovis AF2122/97
cagcagcaccugca

SEQ ID NO: 1132685 - RNA, 16 nt, Mycobacterium bovis subsp bovis AF2122/97
cagcagcaccgcgacc

SEQ ID NO: 1132686 - RNA, 17 nt, Mycobacterium bovis subsp bovis AF2122/97
cagcagcaccgcgacca

SEQ ID NO: 1132687 - RNA, 13 nt, Mycobacterium bovis subsp bovis AF2122/97
cagcagcggcgac

SEQ ID NO: 1132688 - RNA, 20 nt, Mycobacterium bovis subsp bovis AF2122/97
cagcagcggcggaaggacgg

SEQ ID NO: 1132689 - RNA, 14 nt, Mycobacterium bovis subsp bovis AF2122/97
cagcagcggcggcg

SEQ ID NO: 1132690 - RNA, 21 nt, Mycobacterium bovis subsp bovis AF2122/97
cagcagcggcggcgacgagcg

SEQ ID NO: 1132691 - RNA, 11 nt, Mycobacterium bovis subsp bovis AF2122/97
cagcagcgcgc

SEQ ID NO: 1132692 - RNA, 19 nt, Mycobacterium bovis subsp bovis AF2122/97
cagcagcgcgcggguuacc

SEQ ID NO: 1132693 - RNA, 13 nt, Mycobacterium bovis subsp bovis AF2122/97
cagcagcgcgacg

SEQ ID NO: 1132694 - RNA, 20 nt, Mycobacterium bovis subsp bovis AF2122/97
cagcagcagauccuggccgg

SEQ ID NO: 1132695 - RNA, 13 nt, Mycobacterium bovis subsp bovis AF2122/97
cagcagcagaugc

SEQ ID NO: 1132696 - RNA, 15 nt, Mycobacterium bovis subsp bovis AF2122/97
cagcaggaccaacgc

SEQ ID NO: 1132697 - RNA, 17 nt, Mycobacterium bovis subsp bovis AF2122/97
cagcaggaucggcagca

SEQ ID NO: 1132698 - RNA, 23 nt, Mycobacterium bovis subsp bovis AF2122/97
cagcaggcauucccgcggcaacg

SEQ ID NO: 1132699 - RNA, 16 nt, Mycobacterium bovis subsp bovis AF2122/97
cagcaggcccacccgg

SEQ ID NO: 1132700 - RNA, 19 nt, Mycobacterium bovis subsp bovis AF2122/97
cagcaggcccagcggaucg

SEQ ID NO: 1132701 - RNA, 19 nt, Mycobacterium bovis subsp bovis AF2122/97
cagcaggcccuggccaccc

SEQ ID NO: 1132702 - RNA, 22 nt, Mycobacterium bovis subsp bovis AF2122/97
cagcaggcccuggccacccaga

SEQ ID NO: 1132703 - RNA, 20 nt, Mycobacterium bovis subsp bovis AF2122/97
cagcagcucguugaugcggc

SEQ ID NO: 1132704 - RNA, 21 nt, Mycobacterium bovis subsp bovis AF2122/97
cagcagcugaaaauaggccgg

SEQ ID NO: 1132705 - RNA, 19 nt, Mycobacterium bovis subsp bovis AF2122/97
cagcagcuugacaucgguc

SEQ ID NO: 1132706 - RNA, 20 nt, Mycobacterium bovis subsp bovis AF2122/97
cagcagcuugacaucgguca

SEQ ID NO: 1132707 - RNA, 21 nt, Mycobacterium bovis subsp bovis AF2122/97
cagcagcuugacccacauucc

SEQ ID NO: 1132708 - RNA, 13 nt, Mycobacterium bovis subsp bovis AF2122/97
cagcaggagauca

SEQ ID NO: 1132709 - RNA, 17 nt, Mycobacterium bovis subsp bovis AF2122/97
cagcagcucggccgagg

SEQ ID NO: 1132710 - RNA, 23 nt, Mycobacterium bovis subsp bovis AF2122/97
cagcagcgguugaugcggccgcg

SEQ ID NO: 1132711 - RNA, 16 nt, Mycobacterium bovis subsp bovis AF2122/97
cagcagcucggggcga

SEQ ID NO: 1132712 - RNA, 13 nt, Mycobacterium bovis subsp bovis AF2122/97
cagcagcugcgau

SEQ ID NO: 1132713 - RNA, 19 nt, Mycobacterium bovis subsp bovis AF2122/97
cagcagcucguugaugcgg

SEQ ID NO: 1132714 - RNA, 15 nt, Mycobacterium bovis subsp bovis AF2122/97
cagcagcgucaucag

SEQ ID NO: 1132715 - RNA, 13 nt, Mycobacterium bovis subsp bovis AF2122/97
cagcagcgucggu

SEQ ID NO: 1132716 - RNA, 15 nt, Mycobacterium bovis subsp bovis AF2122/97
cagcagcgucggugc

SEQ ID NO: 1132717 - RNA, 21 nt, Mycobacterium bovis subsp bovis AF2122/97
cagcagcgucggugccaccac

SEQ ID NO: 1132718 - RNA, 20 nt, Mycobacterium bovis subsp bovis AF2122/97
cagcagcgugaccaccgccg

SEQ ID NO: 1132719 - RNA, 14 nt, Mycobacterium bovis subsp bovis AF2122/97
cagcagcgggccga

SEQ ID NO: 1132720 - RNA, 22 nt, Mycobacterium bovis subsp bovis AF2122/97
cagcagcgggccgaagccccga

SEQ ID NO: 1132721 - RNA, 14 nt, Mycobacterium bovis subsp bovis AF2122/97
cagcagcgggcgcg

SEQ ID NO: 1132722 - RNA, 20 nt, Mycobacterium bovis subsp bovis AF2122/97
cagcagcguugacggcuucg

SEQ ID NO: 1132723 - RNA, 19 nt, Mycobacterium bovis subsp bovis AF2122/97
cagcaucaguuugacgccg

SEQ ID NO: 1132724 - RNA, 19 nt, Mycobacterium bovis subsp bovis AF2122/97
cagcaguuggucgcggucc

SEQ ID NO: 1132725 - RNA, 23 nt, Mycobacterium bovis subsp bovis AF2122/97
cagcaguucgccgcgcagcgugc

SEQ ID NO: 1132726 - RNA, 14 nt, Mycobacterium bovis subsp bovis AF2122/97
cagcaguucggcga

SEQ ID NO: 1132727 - RNA, 15 nt, Mycobacterium bovis subsp bovis AF2122/97
cagcaguucggcgau

SEQ ID NO: 1132728 - RNA, 13 nt, Mycobacterium bovis subsp bovis AF2122/97
cagcagugcgggg

SEQ ID NO: 1132729 - RNA, 15 nt, Mycobacterium bovis subsp bovis AF2122/97
cagcagggcgcgcau

SEQ ID NO: 1132730 - RNA, 22 nt, Mycobacterium bovis subsp bovis AF2122/97
cagcagggcuucgugcaccaca

SEQ ID NO: 1132731 - RNA, 16 nt, Mycobacterium bovis subsp bovis AF2122/97
cagcaggggacgacca

SEQ ID NO: 1132732 - RNA, 16 nt, Mycobacterium bovis subsp bovis AF2122/97
cagcaggggacgggcg

SEQ ID NO: 1132733 - RNA, 20 nt, Mycobacterium bovis subsp bovis AF2122/97
cagcaggggacgggcggcca

SEQ ID NO: 1132734 - RNA, 17 nt, Mycobacterium bovis subsp bovis AF2122/97
cagcagggccaccacca

SEQ ID NO: 1132735 - RNA, 19 nt, Mycobacterium bovis subsp bovis AF2122/97
cagcagggccaccaccacg

SEQ ID NO: 1132736 - RNA, 18 nt, Mycobacterium bovis subsp bovis AF2122/97
cagcagggccagaccgaa

SEQ ID NO: 1132737 - RNA, 14 nt, Mycobacterium bovis subsp bovis AF2122/97
cagcaggccgcgcu

SEQ ID NO: 1132738 - RNA, 18 nt, Mycobacterium bovis subsp bovis AF2122/97
cagcaggccgcgcucguc

SEQ ID NO: 1132739 - RNA, 17 nt, Mycobacterium bovis subsp bovis AF2122/97
cagcauggcccuggcga

SEQ ID NO: 1132740 - RNA, 22 nt, Mycobacterium bovis subsp bovis AF2122/97
cagcaucggcaccccggccacu

SEQ ID NO: 1132741 - RNA, 16 nt, Mycobacterium bovis subsp bovis AF2122/97
cagcaugccuucggcc

SEQ ID NO: 1132742 - RNA, 13 nt, Mycobacterium bovis subsp bovis AF2122/97
cagcauccuucgc

SEQ ID NO: 1132743 - RNA, 21 nt, Mycobacterium bovis subsp bovis AF2122/97
cagcaucgagcaguggccgcc

SEQ ID NO: 1132744 - RNA, 22 nt, Mycobacterium bovis subsp bovis AF2122/97
cagcaucgagcaguggccgccg

SEQ ID NO: 1132745 - RNA, 22 nt, Mycobacterium bovis subsp bovis AF2122/97
cagcaugucucgggcgcgggug

SEQ ID NO: 1132746 - RNA, 22 nt, Mycobacterium bovis subsp bovis AF2122/97
cagcauguggccgccgucgacg

SEQ ID NO: 1132747 - RNA, 22 nt, Mycobacterium bovis subsp bovis AF2122/97
cagcaugguccacagccggcgg

SEQ ID NO: 1132748 - RNA, 18 nt, Mycobacterium bovis subsp bovis AF2122/97
cagcauggugcggcggcg

SEQ ID NO: 1132749 - RNA, 17 nt, Mycobacterium bovis subsp bovis AF2122/97
cagcaugguggacgagg

SEQ ID NO: 1132750 - RNA, 21 nt, Mycobacterium bovis subsp bovis AF2122/97
cagcaugguggacgaggcggu

SEQ ID NO: 1132751 - RNA, 23 nt, Mycobacterium bovis subsp bovis AF2122/97
cagcaugguggacgaggcggucg

SEQ ID NO: 1132752 - RNA, 21 nt, Mycobacterium bovis subsp bovis AF2122/97
cagcaugguuagcggugaugg

SEQ ID NO: 1132753 - RNA, 18 nt, Mycobacterium bovis subsp bovis AF2122/97
cagccaaaaacgcugccg

SEQ ID NO: 1132754 - RNA, 21 nt, Mycobacterium bovis subsp bovis AF2122/97
cagcauuagccaggcccggcu

SEQ ID NO: 1132755 - RNA, 18 nt, Mycobacterium bovis subsp bovis AF2122/97
cagcauucucgccgacgg

SEQ ID NO: 1132756 - RNA, 20 nt, Mycobacterium bovis subsp bovis AF2122/97
cagggcccugcuggcccaac

SEQ ID NO: 1132757 - RNA, 16 nt, Mycobacterium bovis subsp bovis AF2122/97
cagggccuccacccgc

SEQ ID NO: 1132758 - RNA, 20 nt, Mycobacterium bovis subsp bovis AF2122/97
cagggccuccacccgccacg

SEQ ID NO: 1132759 - RNA, 14 nt, Mycobacterium bovis subsp bovis AF2122/97
cagggccgccgaag

SEQ ID NO: 1132760 - RNA, 13 nt, Mycobacterium bovis subsp bovis AF2122/97
cagggccgccgcg

SEQ ID NO: 1132761 - RNA, 12 nt, Mycobacterium bovis subsp bovis AF2122/97
cagggccggcac

SEQ ID NO: 1132762 - RNA, 14 nt, Mycobacterium bovis subsp bovis AF2122/97
cagggccuucgggc

SEQ ID NO: 1132763 - RNA, 19 nt, Mycobacterium bovis subsp bovis AF2122/97
cagggccuugaucggcaca

SEQ ID NO: 1132764 - RNA, 22 nt, Mycobacterium bovis subsp bovis AF2122/97
cagggccuguucgagaucgccg

SEQ ID NO: 1132765 - RNA, 21 nt, Mycobacterium bovis subsp bovis AF2122/97
cagggcgacgagaucugcgau

SEQ ID NO: 1132766 - RNA, 12 nt, Mycobacterium bovis subsp bovis AF2122/97
cagggcgccacg

SEQ ID NO: 1132767 - RNA, 21 nt, Mycobacterium bovis subsp bovis AF2122/97
cagggcggcgaccucggcggc

SEQ ID NO: 1132768 - RNA, 17 nt, Mycobacterium bovis subsp bovis AF2122/97
cagggcggugcucuucg

SEQ ID NO: 1132769 - RNA, 17 nt, Mycobacterium bovis subsp bovis AF2122/97
cagggcgguggccaccc

SEQ ID NO: 1132770 - RNA, 22 nt, Mycobacterium bovis subsp bovis AF2122/97
cagggcgcgcaucugcucggca

SEQ ID NO: 1132771 - RNA, 17 nt, Mycobacterium bovis subsp bovis AF2122/97
cagggcggccuccccga

SEQ ID NO: 1132772 - RNA, 17 nt, Mycobacterium bovis subsp bovis AF2122/97
cagggcggcaacggcgg

SEQ ID NO: 1132773 - RNA, 18 nt, Mycobacterium bovis subsp bovis AF2122/97
cagggcggcaacggcggc

SEQ ID NO: 1132774 - RNA, 20 nt, Mycobacterium bovis subsp bovis AF2122/97
cagggcggcaacggcggcaa

SEQ ID NO: 1132775 - RNA, 23 nt, Mycobacterium bovis subsp bovis AF2122/97
caggggguggugucgcggccgcc

SEQ ID NO: 1132776 - RNA, 16 nt, Mycobacterium bovis subsp bovis AF2122/97
caggguauccacgccg

SEQ ID NO: 1132777 - RNA, 16 nt, Mycobacterium bovis subsp bovis AF2122/97
cagggggcgugccgcc

SEQ ID NO: 1132778 - RNA, 14 nt, Mycobacterium bovis subsp bovis AF2122/97
caggggcagcgcgg

SEQ ID NO: 1132779 - RNA, 17 nt, Mycobacterium bovis subsp bovis AF2122/97
caggggccagcgcgcca

SEQ ID NO: 1132780 - RNA, 12 nt, Mycobacterium bovis subsp bovis AF2122/97
caggggcgcagc

SEQ ID NO: 1132781 - RNA, 17 nt, Mycobacterium bovis subsp bovis AF2122/97
caggggcgcagcgcggc

SEQ ID NO: 1132782 - RNA, 15 nt, Mycobacterium bovis subsp bovis AF2122/97
cagggcgucgaccgc

SEQ ID NO: 1132783 - RNA, 21 nt, Mycobacterium bovis subsp bovis AF2122/97
cagggcgguggccacccggcc

SEQ ID NO: 1132784 - RNA, 23 nt, Mycobacterium bovis subsp bovis AF2122/97
cagggcgguggccacccggccgc

SEQ ID NO: 1132785 - RNA, 17 nt, Mycobacterium bovis subsp bovis AF2122/97
cagggcgucggcgaauu

SEQ ID NO: 1132786 - RNA, 15 nt, Mycobacterium bovis subsp bovis AF2122/97
cagggcgucggcgac

SEQ ID NO: 1132787 - RNA, 14 nt, Mycobacterium bovis subsp bovis AF2122/97
cagggcucgcucgc

SEQ ID NO: 1132788 - RNA, 15 nt, Mycobacterium bovis subsp bovis AF2122/97
cagggcucgcucgcc

SEQ ID NO: 1132789 - RNA, 12 nt, Mycobacterium bovis subsp bovis AF2122/97
cagggcgucggc

SEQ ID NO: 1132790 - RNA, 23 nt, Mycobacterium bovis subsp bovis AF2122/97
caggggaguugcuugcagggcca

SEQ ID NO: 1132791 - RNA, 18 nt, Mycobacterium bovis subsp bovis AF2122/97
caggggaucguccggccg

SEQ ID NO: 1132792 - RNA, 18 nt, Mycobacterium bovis subsp bovis AF2122/97
caggggaccgcggcgcgu

SEQ ID NO: 1132793 - RNA, 13 nt, Mycobacterium bovis subsp bovis AF2122/97
caggggacgacca

SEQ ID NO: 1132794 - RNA, 18 nt, Mycobacterium bovis subsp bovis AF2122/97
caggggacgaccaugccg

SEQ ID NO: 1132795 - RNA, 12 nt, Mycobacterium bovis subsp bovis AF2122/97
cagggcucggcg

SEQ ID NO: 1132796 - RNA, 14 nt, Mycobacterium bovis subsp bovis AF2122/97
cagggcucggcggc

SEQ ID NO: 1132797 - RNA, 17 nt, Mycobacterium bovis subsp bovis AF2122/97
cagggcucggcggcccg

SEQ ID NO: 1132798 - RNA, 14 nt, Mycobacterium bovis subsp bovis AF2122/97
cagggcugccgguu

SEQ ID NO: 1132799 - RNA, 13 nt, Mycobacterium bovis subsp bovis AF2122/97
cagggcugcgaug

SEQ ID NO: 1132800 - RNA, 13 nt, Mycobacterium bovis subsp bovis AF2122/97
caggucgaugcgg

SEQ ID NO: 1132801 - RNA, 13 nt, Mycobacterium bovis subsp bovis AF2122/97
caggucggccgcc

SEQ ID NO: 1132802 - RNA, 15 nt, Mycobacterium bovis subsp bovis AF2122/97
caggucgagcaccgg

SEQ ID NO: 1132803 - RNA, 16 nt, Mycobacterium bovis subsp bovis AF2122/97
caggucgagcaccggc

SEQ ID NO: 1132804 - RNA, 18 nt, Mycobacterium bovis subsp bovis AF2122/97
caggucgacggccacggu

SEQ ID NO: 1132805 - RNA, 16 nt, Mycobacterium bovis subsp bovis AF2122/97
caggucgacaccgcgg

SEQ ID NO: 1132806 - RNA, 20 nt, Mycobacterium bovis subsp bovis AF2122/97
caggucgacauaggccaccu

SEQ ID NO: 1132807 - RNA, 18 nt, Mycobacterium bovis subsp bovis AF2122/97
cagguccgccggugccgc

SEQ ID NO: 1132808 - RNA, 20 nt, Mycobacterium bovis subsp bovis AF2122/97
cagguccgccggugccgccg

SEQ ID NO: 1132809 - RNA, 23 nt, Mycobacterium bovis subsp bovis AF2122/97
cagguccgccggugccgccgucg

SEQ ID NO: 1132810 - RNA, 21 nt, Mycobacterium bovis subsp bovis AF2122/97
cagguccccgacaacggcggc

SEQ ID NO: 1132811 - RNA, 14 nt, Mycobacterium bovis subsp bovis AF2122/97
cagguccgcggccg

SEQ ID NO: 1132812 - RNA, 16 nt, Mycobacterium bovis subsp bovis AF2122/97
cagguccgcggccgcg

SEQ ID NO: 1132813 - RNA, 19 nt, Mycobacterium bovis subsp bovis AF2122/97
cagguccgcgugcugccgu

SEQ ID NO: 1132814 - RNA, 18 nt, Mycobacterium bovis subsp bovis AF2122/97
cagguccugcgccgcacg

SEQ ID NO: 1132815 - RNA, 23 nt, Mycobacterium bovis subsp bovis AF2122/97
cagguccuaggugugcgacgacg

SEQ ID NO: 1132816 - RNA, 22 nt, Mycobacterium bovis subsp bovis AF2122/97
cagguagaccggaaaccacagc

SEQ ID NO: 1132817 - RNA, 19 nt, Mycobacterium bovis subsp bovis AF2122/97
cagguccaccgcugccggc

SEQ ID NO: 1132818 - RNA, 23 nt, Mycobacterium bovis subsp bovis AF2122/97
cagggugggcgacgucaucgccg

SEQ ID NO: 1132819 - RNA, 21 nt, Mycobacterium bovis subsp bovis AF2122/97
caggguggcccggggacgggu

SEQ ID NO: 1132820 - RNA, 24 nt, Mycobacterium bovis subsp bovis AF2122/97
cagggugucgacaaccgcugccgc

SEQ ID NO: 1132821 - RNA, 13 nt, Mycobacterium bovis subsp bovis AF2122/97
cagggugucacgc

SEQ ID NO: 1132822 - RNA, 23 nt, Mycobacterium bovis subsp bovis AF2122/97
cagguacgccucgacagcggcaa

SEQ ID NO: 1132823 - RNA, 18 nt, Mycobacterium bovis subsp bovis AF2122/97
caggguucgucgggacgc

SEQ ID NO: 1132824 - RNA, 21 nt, Mycobacterium bovis subsp bovis AF2122/97
caggguucgucgggacgccgc

SEQ ID NO: 1132825 - RNA, 23 nt, Mycobacterium bovis subsp bovis AF2122/97
caggguucgucgggacgccgccc

SEQ ID NO: 1132826 - RNA, 16 nt, Mycobacterium bovis subsp bovis AF2122/97
cagguaccaccgcggu

SEQ ID NO: 1132827 - RNA, 20 nt, Mycobacterium bovis subsp bovis AF2122/97
cagguacggcgggcggccgc

SEQ ID NO: 1132828 - RNA, 20 nt, Mycobacterium bovis subsp bovis AF2122/97
cagguacucaguguuccgcc

SEQ ID NO: 1132829 - RNA, 18 nt, Mycobacterium bovis subsp bovis AF2122/97
cagguacuccccguugcc

SEQ ID NO: 1132830 - RNA, 17 nt, Mycobacterium bovis subsp bovis AF2122/97
cagggucccgccgccug

SEQ ID NO: 1132831 - RNA, 16 nt, Mycobacterium bovis subsp bovis AF2122/97
cagggucugugcaugc

SEQ ID NO: 1132832 - RNA, 15 nt, Mycobacterium bovis subsp bovis AF2122/97
cagggucugcgccgc

SEQ ID NO: 1132833 - RNA, 16 nt, Mycobacterium bovis subsp bovis AF2122/97
cagggucugcgccgcc

SEQ ID NO: 1132834 - RNA, 19 nt, Mycobacterium bovis subsp bovis AF2122/97
cagggucugcgccgccggc

SEQ ID NO: 1132835 - RNA, 13 nt, Mycobacterium bovis subsp bovis AF2122/97
caggguggcgacg

SEQ ID NO: 1132836 - RNA, 23 nt, Mycobacterium bovis subsp bovis AF2122/97
caggguggcgacgucaaacgcaa

SEQ ID NO: 1132837 - RNA, 21 nt, Mycobacterium bovis subsp bovis AF2122/97
cagggucgaguucgcagucga

SEQ ID NO: 1132838 - RNA, 14 nt, Mycobacterium bovis subsp bovis AF2122/97
cagggucacggucg

SEQ ID NO: 1132839 - RNA, 23 nt, Mycobacterium bovis subsp bovis AF2122/97
cagggguggcgcgggccggcgac

SEQ ID NO: 1132840 - RNA, 14 nt, Mycobacterium bovis subsp bovis AF2122/97
cagggucagcgccg

SEQ ID NO: 1132841 - RNA, 16 nt, Mycobacterium bovis subsp bovis AF2122/97
cagggucagcgccgcg

SEQ ID NO: 1132842 - RNA, 14 nt, Mycobacterium bovis subsp bovis AF2122/97
caggucggccaccg

SEQ ID NO: 1132843 - RNA, 22 nt, Mycobacterium bovis subsp bovis AF2122/97
caggucggcgaugaugacggcg

SEQ ID NO: 1132844 - RNA, 14 nt, Mycobacterium bovis subsp bovis AF2122/97
caggucgggcagca

SEQ ID NO: 1132845 - RNA, 22 nt, Mycobacterium bovis subsp bovis AF2122/97
caggugcuguuugguugcgcca

SEQ ID NO: 1132846 - RNA, 19 nt, Mycobacterium bovis subsp bovis AF2122/97
cagguggccgucgccgaag

SEQ ID NO: 1132847 - RNA, 13 nt, Mycobacterium bovis subsp bovis AF2122/97
caggugggcagca

SEQ ID NO: 1132848 - RNA, 17 nt, Mycobacterium bovis subsp bovis AF2122/97
cagguucuugaccagca

SEQ ID NO: 1132849 - RNA, 17 nt, Mycobacterium bovis subsp bovis AF2122/97
cagguggcgcggacccg

SEQ ID NO: 1132850 - RNA, 15 nt, Mycobacterium bovis subsp bovis AF2122/97
caggugggcguuggc

SEQ ID NO: 1132851 - RNA, 22 nt, Mycobacterium bovis subsp bovis AF2122/97
caggugggcguuggcgacgaag

SEQ ID NO: 1132852 - RNA, 21 nt, Mycobacterium bovis subsp bovis AF2122/97
cagguucaugcaaaagccgcg

SEQ ID NO: 1132853 - RNA, 20 nt, Mycobacterium bovis subsp bovis AF2122/97
caggugggcagcaggcccac

SEQ ID NO: 1132854 - RNA, 15 nt, Mycobacterium bovis subsp bovis AF2122/97
cagguuccgcacgau

SEQ ID NO: 1132855 - RNA, 19 nt, Mycobacterium bovis subsp bovis AF2122/97
cagguuccgcacgaucggg

SEQ ID NO: 1132856 - RNA, 16 nt, Mycobacterium bovis subsp bovis AF2122/97
cagguuccgcugucga

SEQ ID NO: 1132857 - RNA, 18 nt, Mycobacterium bovis subsp bovis AF2122/97
caguagcagcggcucggc

SEQ ID NO: 1132858 - RNA, 20 nt, Mycobacterium bovis subsp bovis AF2122/97
caguagcugcucaucgcgcc

SEQ ID NO: 1132859 - RNA, 16 nt, Mycobacterium bovis subsp bovis AF2122/97
caguagcuguggcccg

SEQ ID NO: 1132860 - RNA, 22 nt, Mycobacterium bovis subsp bovis AF2122/97
caguaggccuccgcugccgccc

SEQ ID NO: 1132861 - RNA, 16 nt, Mycobacterium bovis subsp bovis AF2122/97
caguaucgaggccgac

SEQ ID NO: 1132862 - RNA, 18 nt, Mycobacterium bovis subsp bovis AF2122/97
caguaucgaggccgacga

SEQ ID NO: 1132863 - RNA, 21 nt, Mycobacterium bovis subsp bovis AF2122/97
caguaggugucgggcucgcau

SEQ ID NO: 1132864 - RNA, 21 nt, Mycobacterium bovis subsp bovis AF2122/97
caguaguagcgcaaccgcgcu

SEQ ID NO: 1132865 - RNA, 18 nt, Mycobacterium bovis subsp bovis AF2122/97
caguagccggugccggcg

SEQ ID NO: 1132866 - RNA, 17 nt, Mycobacterium bovis subsp bovis AF2122/97
caguagccacgcccaca

SEQ ID NO: 1132867 - RNA, 21 nt, Mycobacterium bovis subsp bovis AF2122/97
caguagaucgccucgacgcgg

SEQ ID NO: 1132868 - RNA, 18 nt, Mycobacterium bovis subsp bovis AF2122/97
cagguuggccccggcccg

SEQ ID NO: 1132869 - RNA, 15 nt, Mycobacterium bovis subsp bovis AF2122/97
caguacgguccggcg

SEQ ID NO: 1132870 - RNA, 22 nt, Mycobacterium bovis subsp bovis AF2122/97
caguacggugguaagacgccga

SEQ ID NO: 1132871 - RNA, 14 nt, Mycobacterium bovis subsp bovis AF2122/97
cagguuggcaagca

SEQ ID NO: 1132872 - RNA, 23 nt, Mycobacterium bovis subsp bovis AF2122/97
cagguuggcaagcacggcgucga

SEQ ID NO: 1132873 - RNA, 22 nt, Mycobacterium bovis subsp bovis AF2122/97
cagguuggcacgcugucgaucu

SEQ ID NO: 1132874 - RNA, 16 nt, Mycobacterium bovis subsp bovis AF2122/97
cagguuggccaccgcc

SEQ ID NO: 1132875 - RNA, 17 nt, Mycobacterium bovis subsp bovis AF2122/97
cagguuggccaccgccc

SEQ ID NO: 1132876 - RNA, 20 nt, Mycobacterium bovis subsp bovis AF2122/97
cagguugguaauccgggcaa

SEQ ID NO: 1132877 - RNA, 23 nt, Mycobacterium bovis subsp bovis AF2122/97
cagguuggugcucagcggcucgc

SEQ ID NO: 1132878 - RNA, 17 nt, Mycobacterium bovis subsp bovis AF2122/97
cagguuguaguccgcgc

SEQ ID NO: 1132879 - RNA, 18 nt, Mycobacterium bovis subsp bovis AF2122/97
cagguuguaguccgcgcc

SEQ ID NO: 1132880 - RNA, 20 nt, Mycobacterium bovis subsp bovis AF2122/97
caguaccgucaucgcggugu

SEQ ID NO: 1132881 - RNA, 13 nt, Mycobacterium bovis subsp bovis AF2122/97
cagucgccggccg

SEQ ID NO: 1132882 - RNA, 11 nt, Mycobacterium bovis subsp bovis AF2122/97
cagucggugca

SEQ ID NO: 1132883 - RNA, 12 nt, Mycobacterium bovis subsp bovis AF2122/97
cagucggugcgg

SEQ ID NO: 1132884 - RNA, 20 nt, Mycobacterium bovis subsp bovis AF2122/97
cagucgcagccaggcacguc

SEQ ID NO: 1132885 - RNA, 20 nt, Mycobacterium bovis subsp bovis AF2122/97
cagucgagugaagccgacau

SEQ ID NO: 1132886 - RNA, 18 nt, Mycobacterium bovis subsp bovis AF2122/97
cagucgauguccugccgu

SEQ ID NO: 1132887 - RNA, 18 nt, Mycobacterium bovis subsp bovis AF2122/97
cagucgcacggugccgcc

SEQ ID NO: 1132888 - RNA, 14 nt, Mycobacterium bovis subsp bovis AF2122/97
cagucgcagccagg

SEQ ID NO: 1132889 - RNA, 14 nt, Mycobacterium bovis subsp bovis AF2122/97
cagucgagcaccug

SEQ ID NO: 1132890 - RNA, 18 nt, Mycobacterium bovis subsp bovis AF2122/97
cagucgagcaccugccga

SEQ ID NO: 1132891 - RNA, 19 nt, Mycobacterium bovis subsp bovis AF2122/97
cagucgagcaucucgucgg

SEQ ID NO: 1132892 - RNA, 12 nt, Mycobacterium bovis subsp bovis AF2122/97
cagucgaucgcg

SEQ ID NO: 1132893 - RNA, 15 nt, Mycobacterium bovis subsp bovis AF2122/97
cagucgaucgcggcc

SEQ ID NO: 1132894 - RNA, 19 nt, Mycobacterium bovis subsp bovis AF2122/97
cagucgaucgcggcccgca

SEQ ID NO: 1132895 - RNA, 21 nt, Mycobacterium bovis subsp bovis AF2122/97
cagucauguccauagccggca

SEQ ID NO: 1132896 - RNA, 15 nt, Mycobacterium bovis subsp bovis AF2122/97
caguccaccgcgcgg

SEQ ID NO: 1132897 - RNA, 17 nt, Mycobacterium bovis subsp bovis AF2122/97
caguccacgagcacggg

SEQ ID NO: 1132898 - RNA, 15 nt, Mycobacterium bovis subsp bovis AF2122/97
caguccagccgggug

SEQ ID NO: 1132899 - RNA, 14 nt, Mycobacterium bovis subsp bovis AF2122/97
caguccagcgggca

SEQ ID NO: 1132900 - RNA, 21 nt, Mycobacterium bovis subsp bovis AF2122/97
caguccagcgcgccacccagc

SEQ ID NO: 1132901 - RNA, 18 nt, Mycobacterium bovis subsp bovis AF2122/97
cagucccaggugcuggua

SEQ ID NO: 1132902 - RNA, 16 nt, Mycobacterium bovis subsp bovis AF2122/97
caguccccgccggccu

SEQ ID NO: 1132903 - RNA, 12 nt, Mycobacterium bovis subsp bovis AF2122/97
cagucccccgcu

SEQ ID NO: 1132904 - RNA, 21 nt, Mycobacterium bovis subsp bovis AF2122/97
cagucaacagggccaggacaa

SEQ ID NO: 1132905 - RNA, 16 nt, Mycobacterium bovis subsp bovis AF2122/97
cagucacggaccgcuu

SEQ ID NO: 1132906 - RNA, 17 nt, Mycobacterium bovis subsp bovis AF2122/97
cagucaggaaaccggcg

SEQ ID NO: 1132907 - RNA, 16 nt, Mycobacterium bovis subsp bovis AF2122/97
cagucagcuccgcgca

SEQ ID NO: 1132908 - RNA, 23 nt, Mycobacterium bovis subsp bovis AF2122/97
cagugcgcggaucaacaggccgg

SEQ ID NO: 1132909 - RNA, 17 nt, Mycobacterium bovis subsp bovis AF2122/97
cagugcggucccgacca

SEQ ID NO: 1132910 - RNA, 13 nt, Mycobacterium bovis subsp bovis AF2122/97
cagugcgggcggc

SEQ ID NO: 1132911 - RNA, 15 nt, Mycobacterium bovis subsp bovis AF2122/97
cagugcgggcggcgu

SEQ ID NO: 1132912 - RNA, 23 nt, Mycobacterium bovis subsp bovis AF2122/97
cagugcggccuuggcgacgucgc

SEQ ID NO: 1132913 - RNA, 22 nt, Mycobacterium bovis subsp bovis AF2122/97
cagugcgcagaacaccaccgcc

SEQ ID NO: 1132914 - RNA, 15 nt, Mycobacterium bovis subsp bovis AF2122/97
cagugcgcagcccgc

SEQ ID NO: 1132915 - RNA, 15 nt, Mycobacterium bovis subsp bovis AF2122/97
cagugccaccugggc

SEQ ID NO: 1132916 - RNA, 18 nt, Mycobacterium bovis subsp bovis AF2122/97
cagugccacgccugagcc

SEQ ID NO: 1132917 - RNA, 16 nt, Mycobacterium bovis subsp bovis AF2122/97
cagugccaaagcggca

SEQ ID NO: 1132918 - RNA, 19 nt, Mycobacterium bovis subsp bovis AF2122/97
cagugcaucgaucaccgcu

SEQ ID NO: 1132919 - RNA, 23 nt, Mycobacterium bovis subsp bovis AF2122/97
cagugcaucggucagcgccgacu

SEQ ID NO: 1132920 - RNA, 18 nt, Mycobacterium bovis subsp bovis AF2122/97
cagugcaggcggccgcca

SEQ ID NO: 1132921 - RNA, 17 nt, Mycobacterium bovis subsp bovis AF2122/97
cagugcagcaacacgau

SEQ ID NO: 1132922 - RNA, 17 nt, Mycobacterium bovis subsp bovis AF2122/97
cagugcagcgaucccgg

SEQ ID NO: 1132923 - RNA, 13 nt, Mycobacterium bovis subsp bovis AF2122/97
cagugcaccgcgu

SEQ ID NO: 1132924 - RNA, 19 nt, Mycobacterium bovis subsp bovis AF2122/97
cagugcauacgguugaugc

SEQ ID NO: 1132925 - RNA, 18 nt, Mycobacterium bovis subsp bovis AF2122/97
cagugcaucgaucaccgc

SEQ ID NO: 1132926 - RNA, 20 nt, Mycobacterium bovis subsp bovis AF2122/97
cagucgucgcgcucgacaaa

SEQ ID NO: 1132927 - RNA, 17 nt, Mycobacterium bovis subsp bovis AF2122/97
cagucugggcgaucgcu

SEQ ID NO: 1132928 - RNA, 22 nt, Mycobacterium bovis subsp bovis AF2122/97
cagucugggcgaucgcuucgca

SEQ ID NO: 1132929 - RNA, 12 nt, Mycobacterium bovis subsp bovis AF2122/97
cagugauucggc

SEQ ID NO: 1132930 - RNA, 22 nt, Mycobacterium bovis subsp bovis AF2122/97
cagugauucggccugagcggcc

SEQ ID NO: 1132931 - RNA, 20 nt, Mycobacterium bovis subsp bovis AF2122/97
cagugcaagaccgcaucggc

SEQ ID NO: 1132932 - RNA, 22 nt, Mycobacterium bovis subsp bovis AF2122/97
cagucuuguugcuuugcuggcg

SEQ ID NO: 1132933 - RNA, 14 nt, Mycobacterium bovis subsp bovis AF2122/97
cagugaaaccaccg

SEQ ID NO: 1132934 - RNA, 17 nt, Mycobacterium bovis subsp bovis AF2122/97
cagugaaaccaccggcc

SEQ ID NO: 1132935 - RNA, 15 nt, Mycobacterium bovis subsp bovis AF2122/97
cagugaugcgccccg

SEQ ID NO: 1132936 - RNA, 21 nt, Mycobacterium bovis subsp bovis AF2122/97
caggcgccgucucgcggugcg

SEQ ID NO: 1132937 - RNA, 14 nt, Mycobacterium bovis subsp bovis AF2122/97
caggcggacgccgc

SEQ ID NO: 1132938 - RNA, 15 nt, Mycobacterium bovis subsp bovis AF2122/97
caggcggacgccgcg

SEQ ID NO: 1132939 - RNA, 18 nt, Mycobacterium bovis subsp bovis AF2122/97
caggcggacgccgcgccg

SEQ ID NO: 1132940 - RNA, 16 nt, Mycobacterium bovis subsp bovis AF2122/97
caggcgcgaucgcgcc

SEQ ID NO: 1132941 - RNA, 17 nt, Mycobacterium bovis subsp bovis AF2122/97
caggcgcgaucgcgccc

SEQ ID NO: 1132942 - RNA, 18 nt, Mycobacterium bovis subsp bovis AF2122/97
caggcgcgaucgcucauu

SEQ ID NO: 1132943 - RNA, 11 nt, Mycobacterium bovis subsp bovis AF2122/97
caggcggcagg

SEQ ID NO: 1132944 - RNA, 13 nt, Mycobacterium bovis subsp bovis AF2122/97
caggcggcggccu

SEQ ID NO: 1132945 - RNA, 23 nt, Mycobacterium bovis subsp bovis AF2122/97
caggcggcucaaccucuggcggc

SEQ ID NO: 1132946 - RNA, 13 nt, Mycobacterium bovis subsp bovis AF2122/97
caggcggccgcca

SEQ ID NO: 1132947 - RNA, 13 nt, Mycobacterium bovis subsp bovis AF2122/97
caggcggccgccg

SEQ ID NO: 1132948 - RNA, 14 nt, Mycobacterium bovis subsp bovis AF2122/97
caggcggccgccgg

SEQ ID NO: 1132949 - RNA, 12 nt, Mycobacterium bovis subsp bovis AF2122/97
caggcggcaggu

SEQ ID NO: 1132950 - RNA, 16 nt, Mycobacterium bovis subsp bovis AF2122/97
caggcggcagguucga

SEQ ID NO: 1132951 - RNA, 14 nt, Mycobacterium bovis subsp bovis AF2122/97
caggcgcaccaggc

SEQ ID NO: 1132952 - RNA, 17 nt, Mycobacterium bovis subsp bovis AF2122/97
caggcgcaccaggcggc

SEQ ID NO: 1132953 - RNA, 17 nt, Mycobacterium bovis subsp bovis AF2122/97
caggcgauugcccgcgc

SEQ ID NO: 1132954 - RNA, 22 nt, Mycobacterium bovis subsp bovis AF2122/97
caggccucgcaccggauccacg

SEQ ID NO: 1132955 - RNA, 17 nt, Mycobacterium bovis subsp bovis AF2122/97
caggccuagcgcggcga

SEQ ID NO: 1132956 - RNA, 22 nt, Mycobacterium bovis subsp bovis AF2122/97
caggccuagcgcggcgacgauu

SEQ ID NO: 1132957 - RNA, 17 nt, Mycobacterium bovis subsp bovis AF2122/97
caggccuaggucgacgc

SEQ ID NO: 1132958 - RNA, 14 nt, Mycobacterium bovis subsp bovis AF2122/97
caggccucggcgcc

SEQ ID NO: 1132959 - RNA, 18 nt, Mycobacterium bovis subsp bovis AF2122/97
caggccgucguugccggc

SEQ ID NO: 1132960 - RNA, 19 nt, Mycobacterium bovis subsp bovis AF2122/97
caggccgucguugccggcg

SEQ ID NO: 1132961 - RNA, 15 nt, Mycobacterium bovis subsp bovis AF2122/97
caggccgucgggggu

SEQ ID NO: 1132962 - RNA, 23 nt, Mycobacterium bovis subsp bovis AF2122/97
caggccggccaccaguccgaugg

SEQ ID NO: 1132963 - RNA, 14 nt, Mycobacterium bovis subsp bovis AF2122/97
caggccggccaccg

SEQ ID NO: 1132964 - RNA, 21 nt, Mycobacterium bovis subsp bovis AF2122/97
caggccuccaaaaucgcggcc

SEQ ID NO: 1132965 - RNA, 19 nt, Mycobacterium bovis subsp bovis AF2122/97
caggccuccaagcccgccg

SEQ ID NO: 1132966 - RNA, 20 nt, Mycobacterium bovis subsp bovis AF2122/97
caggccuccaagcccgccgg

SEQ ID NO: 1132967 - RNA, 21 nt, Mycobacterium bovis subsp bovis AF2122/97
caggccuccaagcccgccgga

SEQ ID NO: 1132968 - RNA, 13 nt, Mycobacterium bovis subsp bovis AF2122/97
caggccgcgucga

SEQ ID NO: 1132969 - RNA, 20 nt, Mycobacterium bovis subsp bovis AF2122/97
caggccgcugacacccgcca

SEQ ID NO: 1132970 - RNA, 14 nt, Mycobacterium bovis subsp bovis AF2122/97
caggccggccacca

SEQ ID NO: 1132971 - RNA, 13 nt, Mycobacterium bovis subsp bovis AF2122/97
caggccggccacc

SEQ ID NO: 1132972 - RNA, 15 nt, Mycobacterium bovis subsp bovis AF2122/97
caggccggcccgcaa

SEQ ID NO: 1132973 - RNA, 13 nt, Mycobacterium bovis subsp bovis AF2122/97
caggccggccgcg

SEQ ID NO: 1132974 - RNA, 17 nt, Mycobacterium bovis subsp bovis AF2122/97
caggccgcuugccccgc

SEQ ID NO: 1132975 - RNA, 21 nt, Mycobacterium bovis subsp bovis AF2122/97
caggcguccaucgccaccgcg

SEQ ID NO: 1132976 - RNA, 23 nt, Mycobacterium bovis subsp bovis AF2122/97
caggcgucccagccgaucacggg

SEQ ID NO: 1132977 - RNA, 20 nt, Mycobacterium bovis subsp bovis AF2122/97
caggcguagguccuugucgg

SEQ ID NO: 1132978 - RNA, 18 nt, Mycobacterium bovis subsp bovis AF2122/97
caggcguccaucgccacc

SEQ ID NO: 1132979 - RNA, 16 nt, Mycobacterium bovis subsp bovis AF2122/97
caggcgucccgcccgg

SEQ ID NO: 1132980 - RNA, 19 nt, Mycobacterium bovis subsp bovis AF2122/97
caggcggugaacaccgccu

SEQ ID NO: 1132981 - RNA, 15 nt, Mycobacterium bovis subsp bovis AF2122/97
caggcgggcggcacc

SEQ ID NO: 1132982 - RNA, 20 nt, Mycobacterium bovis subsp bovis AF2122/97
caggcgggaacgaucgauga

SEQ ID NO: 1132983 - RNA, 16 nt, Mycobacterium bovis subsp bovis AF2122/97
caggcggcuggcccgc

SEQ ID NO: 1132984 - RNA, 18 nt, Mycobacterium bovis subsp bovis AF2122/97
cagggaucaccccggccg

SEQ ID NO: 1132985 - RNA, 15 nt, Mycobacterium bovis subsp bovis AF2122/97
cagggccccaccgag

SEQ ID NO: 1132986 - RNA, 19 nt, Mycobacterium bovis subsp bovis AF2122/97
cagggccgcucgccucgau

SEQ ID NO: 1132987 - RNA, 13 nt, Mycobacterium bovis subsp bovis AF2122/97
cagggccgccgcu

SEQ ID NO: 1132988 - RNA, 18 nt, Mycobacterium bovis subsp bovis AF2122/97
cagggccgccgcugccgc

SEQ ID NO: 1132989 - RNA, 19 nt, Mycobacterium bovis subsp bovis AF2122/97
cagggccgccgcugccgcc

SEQ ID NO: 1132990 - RNA, 18 nt, Mycobacterium bovis subsp bovis AF2122/97
cagggcccuagccggcgc

SEQ ID NO: 1132991 - RNA, 17 nt, Mycobacterium bovis subsp bovis AF2122/97
cagggcagcccggcgau

SEQ ID NO: 1132992 - RNA, 16 nt, Mycobacterium bovis subsp bovis AF2122/97
cagggcacguggcggu

SEQ ID NO: 1132993 - RNA, 15 nt, Mycobacterium bovis subsp bovis AF2122/97
cagggcacguucggc

SEQ ID NO: 1132994 - RNA, 18 nt, Mycobacterium bovis subsp bovis AF2122/97
cagggcagcggccagggc

SEQ ID NO: 1132995 - RNA, 20 nt, Mycobacterium bovis subsp bovis AF2122/97
cagggcaacggccgcuagcg

SEQ ID NO: 1132996 - RNA, 21 nt, Mycobacterium bovis subsp bovis AF2122/97
cagggaucuagaggcggcccc

SEQ ID NO: 1132997 - RNA, 12 nt, Mycobacterium bovis subsp bovis AF2122/97
caggcuucuggg

SEQ ID NO: 1132998 - RNA, 18 nt, Mycobacterium bovis subsp bovis AF2122/97
caggcuuccagccacagc

SEQ ID NO: 1132999 - RNA, 21 nt, Mycobacterium bovis subsp bovis AF2122/97
caggcugguccgggugccggu

SEQ ID NO: 1133000 - RNA, 16 nt, Mycobacterium bovis subsp bovis AF2122/97
caggcuguggccagca

SEQ ID NO: 1133001 - RNA, 15 nt, Mycobacterium bovis subsp bovis AF2122/97
cagggagugccgcac

SEQ ID NO: 1133002 - RNA, 22 nt, Mycobacterium bovis subsp bovis AF2122/97
caggcuugacugcacaccaccg

SEQ ID NO: 1133003 - RNA, 15 nt, Mycobacterium bovis subsp bovis AF2122/97
cagggaggucgccgc

SEQ ID NO: 1133004 - RNA, 19 nt, Mycobacterium bovis subsp bovis AF2122/97
cagggaggucgccgcaucg

SEQ ID NO: 1133005 - RNA, 17 nt, Mycobacterium bovis subsp bovis AF2122/97
caggcuguccagcagcg

SEQ ID NO: 1133006 - RNA, 14 nt, Mycobacterium bovis subsp bovis AF2122/97
caggcuguccgacu

SEQ ID NO: 1133007 - RNA, 19 nt, Mycobacterium bovis subsp bovis AF2122/97
caggcugucgagucggucc

SEQ ID NO: 1133008 - RNA, 20 nt, Mycobacterium bovis subsp bovis AF2122/97
caggccccacuggugcagcg

SEQ ID NO: 1133009 - RNA, 16 nt, Mycobacterium bovis subsp bovis AF2122/97
caggccccgggaacgc

SEQ ID NO: 1133010 - RNA, 20 nt, Mycobacterium bovis subsp bovis AF2122/97
caggccccggugccgaccgg

SEQ ID NO: 1133011 - RNA, 15 nt, Mycobacterium bovis subsp bovis AF2122/97
caggcccgacggcgc

SEQ ID NO: 1133012 - RNA, 19 nt, Mycobacterium bovis subsp bovis AF2122/97
caggccgacaaugucggcg

SEQ ID NO: 1133013 - RNA, 11 nt, Mycobacterium bovis subsp bovis AF2122/97
caggccgacac

SEQ ID NO: 1133014 - RNA, 14 nt, Mycobacterium bovis subsp bovis AF2122/97
caggccgacgucga

SEQ ID NO: 1133015 - RNA, 19 nt, Mycobacterium bovis subsp bovis AF2122/97
caggccgaagacgugccgg

SEQ ID NO: 1133016 - RNA, 19 nt, Mycobacterium bovis subsp bovis AF2122/97
caggccgcgcgacaacccg

SEQ ID NO: 1133017 - RNA, 20 nt, Mycobacterium bovis subsp bovis AF2122/97
caggccgcgcgacaacccgg

SEQ ID NO: 1133018 - RNA, 14 nt, Mycobacterium bovis subsp bovis AF2122/97
caggccgcgcgcac

SEQ ID NO: 1133019 - RNA, 16 nt, Mycobacterium bovis subsp bovis AF2122/97
caggccgcgcgcaccg

SEQ ID NO: 1133020 - RNA, 22 nt, Mycobacterium bovis subsp bovis AF2122/97
caggccgaccauaaaacucggg

SEQ ID NO: 1133021 - RNA, 14 nt, Mycobacterium bovis subsp bovis AF2122/97
caggccgaccgcgc

SEQ ID NO: 1133022 - RNA, 21 nt, Mycobacterium bovis subsp bovis AF2122/97
caggccgccaccgucaccgcc

SEQ ID NO: 1133023 - RNA, 22 nt, Mycobacterium bovis subsp bovis AF2122/97
caggccgccaccgucaccgccg

SEQ ID NO: 1133024 - RNA, 13 nt, Mycobacterium bovis subsp bovis AF2122/97
caggccgccgcca

SEQ ID NO: 1133025 - RNA, 14 nt, Mycobacterium bovis subsp bovis AF2122/97
caggccgccggcca

SEQ ID NO: 1133026 - RNA, 12 nt, Mycobacterium bovis subsp bovis AF2122/97
caggccgccgcg

SEQ ID NO: 1133027 - RNA, 16 nt, Mycobacterium bovis subsp bovis AF2122/97
caggcagcuccgccgc

SEQ ID NO: 1133028 - RNA, 16 nt, Mycobacterium bovis subsp bovis AF2122/97
caggcagcucggcaac

SEQ ID NO: 1133029 - RNA, 18 nt, Mycobacterium bovis subsp bovis AF2122/97
caggcagggcagcccggc

SEQ ID NO: 1133030 - RNA, 21 nt, Mycobacterium bovis subsp bovis AF2122/97
caggcagggcagcccggcgau

SEQ ID NO: 1133031 - RNA, 23 nt, Mycobacterium bovis subsp bovis AF2122/97
caggcaucggugagcccguugac

SEQ ID NO: 1133032 - RNA, 15 nt, Mycobacterium bovis subsp bovis AF2122/97
caggcaucguccgcc

SEQ ID NO: 1133033 - RNA, 15 nt, Mycobacterium bovis subsp bovis AF2122/97
caggccagugccacc

SEQ ID NO: 1133034 - RNA, 19 nt, Mycobacterium bovis subsp bovis AF2122/97
caggcaguccaccgcgcgg

SEQ ID NO: 1133035 - RNA, 23 nt, Mycobacterium bovis subsp bovis AF2122/97
caggcaguccaccgcgcggcgca

SEQ ID NO: 1133036 - RNA, 19 nt, Mycobacterium bovis subsp bovis AF2122/97
caggcccacggcgaccagg

SEQ ID NO: 1133037 - RNA, 20 nt, Mycobacterium bovis subsp bovis AF2122/97
caggcccauacgugccgccg

SEQ ID NO: 1133038 - RNA, 14 nt, Mycobacterium bovis subsp bovis AF2122/97
caggcccauggcag

SEQ ID NO: 1133039 - RNA, 18 nt, Mycobacterium bovis subsp bovis AF2122/97
caggcccauggcagcccg

SEQ ID NO: 1133040 - RNA, 16 nt, Mycobacterium bovis subsp bovis AF2122/97
caggcccaucucgggc

SEQ ID NO: 1133041 - RNA, 13 nt, Mycobacterium bovis subsp bovis AF2122/97
caggcccagcuag

SEQ ID NO: 1133042 - RNA, 18 nt, Mycobacterium bovis subsp bovis AF2122/97
caggcacguccgaucggc

SEQ ID NO: 1133043 - RNA, 17 nt, Mycobacterium bovis subsp bovis AF2122/97
caggauucggcggucgc

SEQ ID NO: 1133044 - RNA, 17 nt, Mycobacterium bovis subsp bovis AF2122/97
caggauuggccgcugca

SEQ ID NO: 1133045 - RNA, 16 nt, Mycobacterium bovis subsp bovis AF2122/97
caggcacuccagcggc

SEQ ID NO: 1133046 - RNA, 13 nt, Mycobacterium bovis subsp bovis AF2122/97
caggaucgccgcu

SEQ ID NO: 1133047 - RNA, 16 nt, Mycobacterium bovis subsp bovis AF2122/97
caggauucccagucgc

SEQ ID NO: 1133048 - RNA, 22 nt, Mycobacterium bovis subsp bovis AF2122/97
caggauucccagucgcggcgcg

SEQ ID NO: 1133049 - RNA, 15 nt, Mycobacterium bovis subsp bovis AF2122/97
caggaucccgguggc

SEQ ID NO: 1133050 - RNA, 17 nt, Mycobacterium bovis subsp bovis AF2122/97
caggaucacgccgccgg

SEQ ID NO: 1133051 - RNA, 17 nt, Mycobacterium bovis subsp bovis AF2122/97
caggaucaaccggcccu

SEQ ID NO: 1133052 - RNA, 17 nt, Mycobacterium bovis subsp bovis AF2122/97
caggacgcugccggugu

SEQ ID NO: 1133053 - RNA, 23 nt, Mycobacterium bovis subsp bovis AF2122/97
cagcguguggagcucgcggcgca

SEQ ID NO: 1133054 - RNA, 18 nt, Mycobacterium bovis subsp bovis AF2122/97
cagcguguugcguucggu

SEQ ID NO: 1133055 - RNA, 20 nt, Mycobacterium bovis subsp bovis AF2122/97
cagcguggcgcccgugccgc

SEQ ID NO: 1133056 - RNA, 15 nt, Mycobacterium bovis subsp bovis AF2122/97
cagcguggggccgcc

SEQ ID NO: 1133057 - RNA, 18 nt, Mycobacterium bovis subsp bovis AF2122/97
cagcguggggccgccacc

SEQ ID NO: 1133058 - RNA, 12 nt, Mycobacterium bovis subsp bovis AF2122/97
cagcgugcgaug

SEQ ID NO: 1133059 - RNA, 19 nt, Mycobacterium bovis subsp bovis AF2122/97
cagcgugcgcuggcugaca

SEQ ID NO: 1133060 - RNA, 16 nt, Mycobacterium bovis subsp bovis AF2122/97
cagcguggacgcccgc

SEQ ID NO: 1133061 - RNA, 21 nt, Mycobacterium bovis subsp bovis AF2122/97
cagcguggacgcccgcccgca

SEQ ID NO: 1133062 - RNA, 20 nt, Mycobacterium bovis subsp bovis AF2122/97
cagcguggagcgcaaguuga

SEQ ID NO: 1133063 - RNA, 22 nt, Mycobacterium bovis subsp bovis AF2122/97
caggacgacgccgacgaugacg

SEQ ID NO: 1133064 - RNA, 20 nt, Mycobacterium bovis subsp bovis AF2122/97
caggacgaacgcuggcggcg

SEQ ID NO: 1133065 - RNA, 15 nt, Mycobacterium bovis subsp bovis AF2122/97
caggacgcgaucggc

SEQ ID NO: 1133066 - RNA, 22 nt, Mycobacterium bovis subsp bovis AF2122/97
caggacgacuggaaggcgggca

SEQ ID NO: 1133067 - RNA, 17 nt, Mycobacterium bovis subsp bovis AF2122/97
caggaccgggaucguca

SEQ ID NO: 1133068 - RNA, 17 nt, Mycobacterium bovis subsp bovis AF2122/97
cagcguuaggucgccgg

SEQ ID NO: 1133069 - RNA, 18 nt, Mycobacterium bovis subsp bovis AF2122/97
caggaccgggaucgucag

SEQ ID NO: 1133070 - RNA, 17 nt, Mycobacterium bovis subsp bovis AF2122/97
caggacggcuaccaccg

SEQ ID NO: 1133071 - RNA, 16 nt, Mycobacterium bovis subsp bovis AF2122/97
caggacggaucgucgu

SEQ ID NO: 1133072 - RNA, 14 nt, Mycobacterium bovis subsp bovis AF2122/97
caggacgcugccgg

SEQ ID NO: 1133073 - RNA, 15 nt, Mycobacterium bovis subsp bovis AF2122/97
caggacgcugccggu

SEQ ID NO: 1133074 - RNA, 15 nt, Mycobacterium bovis subsp bovis AF2122/97
caggagcgcggcccg

SEQ ID NO: 1133075 - RNA, 16 nt, Mycobacterium bovis subsp bovis AF2122/97
caggagcgcggcccgc

SEQ ID NO: 1133076 - RNA, 23 nt, Mycobacterium bovis subsp bovis AF2122/97
caggagcgcggcccgccucggcg

SEQ ID NO: 1133077 - RNA, 16 nt, Mycobacterium bovis subsp bovis AF2122/97
caggagcggauagcgg

SEQ ID NO: 1133078 - RNA, 14 nt, Mycobacterium bovis subsp bovis AF2122/97
caggagcgugucgg

SEQ ID NO: 1133079 - RNA, 15 nt, Mycobacterium bovis subsp bovis AF2122/97
caggagcgugucggc

SEQ ID NO: 1133080 - RNA, 15 nt, Mycobacterium bovis subsp bovis AF2122/97
caucgacgcggccaa

SEQ ID NO: 1133081 - RNA, 15 nt, Mycobacterium bovis subsp bovis AF2122/97
cauccuccucgucga

SEQ ID NO: 1133082 - RNA, 19 nt, Mycobacterium bovis subsp bovis AF2122/97
caucgacgagccgcggucg

SEQ ID NO: 1133083 - RNA, 23 nt, Mycobacterium bovis subsp bovis AF2122/97
caucgacgagccgcggucggcgu

SEQ ID NO: 1133084 - RNA, 21 nt, Mycobacterium bovis subsp bovis AF2122/97
cauccuccucgucgacgucgg

SEQ ID NO: 1133085 - RNA, 17 nt, Mycobacterium bovis subsp bovis AF2122/97
cauccuccugcgccgca

SEQ ID NO: 1133086 - RNA, 13 nt, Mycobacterium bovis subsp bovis AF2122/97
caucgaccguccg

SEQ ID NO: 1133087 - RNA, 14 nt, Mycobacterium bovis subsp bovis AF2122/97
caucgaccguccgg

SEQ ID NO: 1133088 - RNA, 14 nt, Mycobacterium bovis subsp bovis AF2122/97
caucgaccuggcca

SEQ ID NO: 1133089 - RNA, 15 nt, Mycobacterium bovis subsp bovis AF2122/97
caucgaccuggccac

SEQ ID NO: 1133090 - RNA, 18 nt, Mycobacterium bovis subsp bovis AF2122/97
caucgacugccagcgccg

SEQ ID NO: 1133091 - RNA, 14 nt, Mycobacterium bovis subsp bovis AF2122/97
caucgagaucgccg

SEQ ID NO: 1133092 - RNA, 17 nt, Mycobacterium bovis subsp bovis AF2122/97
caucgagaucgccguug

SEQ ID NO: 1133093 - RNA, 19 nt, Mycobacterium bovis subsp bovis AF2122/97
caucgagcaccuccacugg

SEQ ID NO: 1133094 - RNA, 15 nt, Mycobacterium bovis subsp bovis AF2122/97
caucgagacgagcca

SEQ ID NO: 1133095 - RNA, 14 nt, Mycobacterium bovis subsp bovis AF2122/97
caucgagacgcacg

SEQ ID NO: 1133096 - RNA, 16 nt, Mycobacterium bovis subsp bovis AF2122/97
caucgccuccagccgg

SEQ ID NO: 1133097 - RNA, 18 nt, Mycobacterium bovis subsp bovis AF2122/97
caucgccuccagccggcg

SEQ ID NO: 1133098 - RNA, 22 nt, Mycobacterium bovis subsp bovis AF2122/97
caucgccuccagccggcgaaug

SEQ ID NO: 1133099 - RNA, 16 nt, Mycobacterium bovis subsp bovis AF2122/97
caucgccuccaggcgc

SEQ ID NO: 1133100 - RNA, 20 nt, Mycobacterium bovis subsp bovis AF2122/97
caucgccuccucgacgucgg

SEQ ID NO: 1133101 - RNA, 12 nt, Mycobacterium bovis subsp bovis AF2122/97
caucgccggcgc

SEQ ID NO: 1133102 - RNA, 14 nt, Mycobacterium bovis subsp bovis AF2122/97
caucgccgcuggcc

SEQ ID NO: 1133103 - RNA, 15 nt, Mycobacterium bovis subsp bovis AF2122/97
caucgccgcuggcca

SEQ ID NO: 1133104 - RNA, 13 nt, Mycobacterium bovis subsp bovis AF2122/97
caucgccggaguc

SEQ ID NO: 1133105 - RNA, 14 nt, Mycobacterium bovis subsp bovis AF2122/97
caucgccggcacgg

SEQ ID NO: 1133106 - RNA, 19 nt, Mycobacterium bovis subsp bovis AF2122/97
caucgccggcacggugaac

SEQ ID NO: 1133107 - RNA, 20 nt, Mycobacterium bovis subsp bovis AF2122/97
caucgacugccagcgccgcg

SEQ ID NO: 1133108 - RNA, 21 nt, Mycobacterium bovis subsp bovis AF2122/97
caucgccagcaucagcccggc

SEQ ID NO: 1133109 - RNA, 13 nt, Mycobacterium bovis subsp bovis AF2122/97
caucgccagcgcc

SEQ ID NO: 1133110 - RNA, 16 nt, Mycobacterium bovis subsp bovis AF2122/97
caucgccagcgccggc

SEQ ID NO: 1133111 - RNA, 18 nt, Mycobacterium bovis subsp bovis AF2122/97
caucgccagcgccggcca

SEQ ID NO: 1133112 - RNA, 21 nt, Mycobacterium bovis subsp bovis AF2122/97
caucgccagcgccggccaggc

SEQ ID NO: 1133113 - RNA, 12 nt, Mycobacterium bovis subsp bovis AF2122/97
caucgccaggcc

SEQ ID NO: 1133114 - RNA, 13 nt, Mycobacterium bovis subsp bovis AF2122/97
caucgccagcggc

SEQ ID NO: 1133115 - RNA, 12 nt, Mycobacterium bovis subsp bovis AF2122/97
caucgccagcgc

SEQ ID NO: 1133116 - RNA, 17 nt, Mycobacterium bovis subsp bovis AF2122/97
caucgccaugauggaca

SEQ ID NO: 1133117 - RNA, 19 nt, Mycobacterium bovis subsp bovis AF2122/97
caucgccauaccggccgcc

SEQ ID NO: 1133118 - RNA, 23 nt, Mycobacterium bovis subsp bovis AF2122/97
caucgccauaggagaacuccggg

SEQ ID NO: 1133119 - RNA, 17 nt, Mycobacterium bovis subsp bovis AF2122/97
caucgccauaccggccg

SEQ ID NO: 1133120 - RNA, 20 nt, Mycobacterium bovis subsp bovis AF2122/97
caucgcgggcgugccgacca

SEQ ID NO: 1133121 - RNA, 22 nt, Mycobacterium bovis subsp bovis AF2122/97
caucgcgggcgugccgaccagc

SEQ ID NO: 1133122 - RNA, 20 nt, Mycobacterium bovis subsp bovis AF2122/97
caucgcggaagcgggcgaug

SEQ ID NO: 1133123 - RNA, 23 nt, Mycobacterium bovis subsp bovis AF2122/97
caucgcggcguugugaccgccga

SEQ ID NO: 1133124 - RNA, 14 nt, Mycobacterium bovis subsp bovis AF2122/97
caucgcgggugauc

SEQ ID NO: 1133125 - RNA, 13 nt, Mycobacterium bovis subsp bovis AF2122/97
caucgcggccgcu

SEQ ID NO: 1133126 - RNA, 14 nt, Mycobacterium bovis subsp bovis AF2122/97
caucgcggcaucga

SEQ ID NO: 1133127 - RNA, 16 nt, Mycobacterium bovis subsp bovis AF2122/97
caucgcgcugcggccc

SEQ ID NO: 1133128 - RNA, 16 nt, Mycobacterium bovis subsp bovis AF2122/97
caucgcgucggcgaug

SEQ ID NO: 1133129 - RNA, 23 nt, Mycobacterium bovis subsp bovis AF2122/97
caucgccucggcguaggcgaugg

SEQ ID NO: 1133130 - RNA, 19 nt, Mycobacterium bovis subsp bovis AF2122/97
caucgccggcgcgccgaug

SEQ ID NO: 1133131 - RNA, 19 nt, Mycobacterium bovis subsp bovis AF2122/97
caucgccgguaugccgaac

SEQ ID NO: 1133132 - RNA, 23 nt, Mycobacterium bovis subsp bovis AF2122/97
caucgccucggcgcugcgcaccg

SEQ ID NO: 1133133 - RNA, 14 nt, Mycobacterium bovis subsp bovis AF2122/97
caucgccucgagga

SEQ ID NO: 1133134 - RNA, 18 nt, Mycobacterium bovis subsp bovis AF2122/97
caucgccgcuggccagca

SEQ ID NO: 1133135 - RNA, 22 nt, Mycobacterium bovis subsp bovis AF2122/97
caucgccuggaugccgaucggg

SEQ ID NO: 1133136 - RNA, 23 nt, Mycobacterium bovis subsp bovis AF2122/97
caucgcgaaaccggaccugaccg

SEQ ID NO: 1133137 - RNA, 19 nt, Mycobacterium bovis subsp bovis AF2122/97
caucgccuugcccagcgac

SEQ ID NO: 1133138 - RNA, 16 nt, Mycobacterium bovis subsp bovis AF2122/97
caucgcgaacucgggc

SEQ ID NO: 1133139 - RNA, 16 nt, Mycobacterium bovis subsp bovis AF2122/97
caucgcgcgccgaccg

SEQ ID NO: 1133140 - RNA, 18 nt, Mycobacterium bovis subsp bovis AF2122/97
caucgcgauuccggcggc

SEQ ID NO: 1133141 - RNA, 19 nt, Mycobacterium bovis subsp bovis AF2122/97
caucgcgauuccggcggcc

SEQ ID NO: 1133142 - RNA, 17 nt, Mycobacterium bovis subsp bovis AF2122/97
caucgcgcaaccgggcg

SEQ ID NO: 1133143 - RNA, 17 nt, Mycobacterium bovis subsp bovis AF2122/97
caucgcgagcugcgacg

SEQ ID NO: 1133144 - RNA, 14 nt, Mycobacterium bovis subsp bovis AF2122/97
caucgcgaucgggg

SEQ ID NO: 1133145 - RNA, 19 nt, Mycobacterium bovis subsp bovis AF2122/97
caucgcgaucggggcgacg

SEQ ID NO: 1133146 - RNA, 13 nt, Mycobacterium bovis subsp bovis AF2122/97
caucgcgacggcc

SEQ ID NO: 1133147 - RNA, 15 nt, Mycobacterium bovis subsp bovis AF2122/97
caucgcgacggcccg

SEQ ID NO: 1133148 - RNA, 18 nt, Mycobacterium bovis subsp bovis AF2122/97
caucgcgacggcccgauc

SEQ ID NO: 1133149 - RNA, 18 nt, Mycobacterium bovis subsp bovis AF2122/97
caucgcgacuagacgccg

SEQ ID NO: 1133150 - RNA, 19 nt, Mycobacterium bovis subsp bovis AF2122/97
caucgcgacuagacgccgc

SEQ ID NO: 1133151 - RNA, 20 nt, Mycobacterium bovis subsp bovis AF2122/97
caucgcgacuagacgccgcc

SEQ ID NO: 1133152 - RNA, 21 nt, Mycobacterium bovis subsp bovis AF2122/97
caucgcgacuagacgccgccg

SEQ ID NO: 1133153 - RNA, 21 nt, Mycobacterium bovis subsp bovis AF2122/97
caucgcgagaaggugcugcgc

SEQ ID NO: 1133154 - RNA, 18 nt, Mycobacterium bovis subsp bovis AF2122/97
cauccgguggugcucguc

SEQ ID NO: 1133155 - RNA, 21 nt, Mycobacterium bovis subsp bovis AF2122/97
cauccgguggugcucgucggu

SEQ ID NO: 1133156 - RNA, 17 nt, Mycobacterium bovis subsp bovis AF2122/97
cauccgguucgccgccg

SEQ ID NO: 1133157 - RNA, 16 nt, Mycobacterium bovis subsp bovis AF2122/97
cauccggucucggccg

SEQ ID NO: 1133158 - RNA, 19 nt, Mycobacterium bovis subsp bovis AF2122/97
cauccgguuuggucgccgc

SEQ ID NO: 1133159 - RNA, 22 nt, Mycobacterium bovis subsp bovis AF2122/97
cauccgguuuggucgccgcguc

SEQ ID NO: 1133160 - RNA, 19 nt, Mycobacterium bovis subsp bovis AF2122/97
cauccgucaaguggcaacc

SEQ ID NO: 1133161 - RNA, 20 nt, Mycobacterium bovis subsp bovis AF2122/97
cauccgugaaucgagcaccg

SEQ ID NO: 1133162 - RNA, 23 nt, Mycobacterium bovis subsp bovis AF2122/97
cauccggucgaugucagccacca

SEQ ID NO: 1133163 - RNA, 17 nt, Mycobacterium bovis subsp bovis AF2122/97
cauccgggcucgcaugu

SEQ ID NO: 1133164 - RNA, 15 nt, Mycobacterium bovis subsp bovis AF2122/97
cauccgggccgcggc

SEQ ID NO: 1133165 - RNA, 16 nt, Mycobacterium bovis subsp bovis AF2122/97
cauccgggccgcggcc

SEQ ID NO: 1133166 - RNA, 20 nt, Mycobacterium bovis subsp bovis AF2122/97
cauccgggccgagcgcacca

SEQ ID NO: 1133167 - RNA, 18 nt, Mycobacterium bovis subsp bovis AF2122/97
caucccuuucgcgccgcg

SEQ ID NO: 1133168 - RNA, 17 nt, Mycobacterium bovis subsp bovis AF2122/97
caucccugacgaagguc

SEQ ID NO: 1133169 - RNA, 17 nt, Mycobacterium bovis subsp bovis AF2122/97
cauccgacaagcugucg

SEQ ID NO: 1133170 - RNA, 20 nt, Mycobacterium bovis subsp bovis AF2122/97
cauccgagcgggaacgagcc

SEQ ID NO: 1133171 - RNA, 15 nt, Mycobacterium bovis subsp bovis AF2122/97
caucccgggcagucc

SEQ ID NO: 1133172 - RNA, 14 nt, Mycobacterium bovis subsp bovis AF2122/97
caucccggccucca

SEQ ID NO: 1133173 - RNA, 15 nt, Mycobacterium bovis subsp bovis AF2122/97
caucccggcgccgcg

SEQ ID NO: 1133174 - RNA, 18 nt, Mycobacterium bovis subsp bovis AF2122/97
caucccggugucgaugcg

SEQ ID NO: 1133175 - RNA, 22 nt, Mycobacterium bovis subsp bovis AF2122/97
caucccggugucgaugcgcagc

SEQ ID NO: 1133176 - RNA, 19 nt, Mycobacterium bovis subsp bovis AF2122/97
caucccgguuccggcgauc

SEQ ID NO: 1133177 - RNA, 12 nt, Mycobacterium bovis subsp bovis AF2122/97
cauccgaucacg

SEQ ID NO: 1133178 - RNA, 14 nt, Mycobacterium bovis subsp bovis AF2122/97
cauccgaucacgac

SEQ ID NO: 1133179 - RNA, 15 nt, Mycobacterium bovis subsp bovis AF2122/97
cauccgaucgccgcg

SEQ ID NO: 1133180 - RNA, 15 nt, Mycobacterium bovis subsp bovis AF2122/97
cauccgauggcccgg

SEQ ID NO: 1133181 - RNA, 21 nt, Mycobacterium bovis subsp bovis AF2122/97
cauccgccccgcccgcaccca

SEQ ID NO: 1133182 - RNA, 21 nt, Mycobacterium bovis subsp bovis AF2122/97
cauccagcugcugccgauaca

SEQ ID NO: 1133183 - RNA, 14 nt, Mycobacterium bovis subsp bovis AF2122/97
cauccagcugcugc

SEQ ID NO: 1133184 - RNA, 16 nt, Mycobacterium bovis subsp bovis AF2122/97
cauccagcgcuucggc

SEQ ID NO: 1133185 - RNA, 23 nt, Mycobacterium bovis subsp bovis AF2122/97
caucaggucggcgaacaaccgcc

SEQ ID NO: 1133186 - RNA, 13 nt, Mycobacterium bovis subsp bovis AF2122/97
cauccaucgccag

SEQ ID NO: 1133187 - RNA, 19 nt, Mycobacterium bovis subsp bovis AF2122/97
cauccauguugaccucgcg

SEQ ID NO: 1133188 - RNA, 21 nt, Mycobacterium bovis subsp bovis AF2122/97
caucagggccuuggcgggauc

SEQ ID NO: 1133189 - RNA, 18 nt, Mycobacterium bovis subsp bovis AF2122/97
caucaggccgcgcggacc

SEQ ID NO: 1133190 - RNA, 22 nt, Mycobacterium bovis subsp bovis AF2122/97
caucagcuuuugcaccggaccg

SEQ ID NO: 1133191 - RNA, 17 nt, Mycobacterium bovis subsp bovis AF2122/97
caucagccgcaccagug

SEQ ID NO: 1133192 - RNA, 14 nt, Mycobacterium bovis subsp bovis AF2122/97
caucagcgacagcg

SEQ ID NO: 1133193 - RNA, 13 nt, Mycobacterium bovis subsp bovis AF2122/97
caucagcgcgacc

SEQ ID NO: 1133194 - RNA, 18 nt, Mycobacterium bovis subsp bovis AF2122/97
caucagcucgaugccgug

SEQ ID NO: 1133195 - RNA, 14 nt, Mycobacterium bovis subsp bovis AF2122/97
caucagcggcgcca

SEQ ID NO: 1133196 - RNA, 16 nt, Mycobacterium bovis subsp bovis AF2122/97
caucagcggcgccgca

SEQ ID NO: 1133197 - RNA, 21 nt, Mycobacterium bovis subsp bovis AF2122/97
caucaccggugcgcuggaggc

SEQ ID NO: 1133198 - RNA, 15 nt, Mycobacterium bovis subsp bovis AF2122/97
caucaccggcggccc

SEQ ID NO: 1133199 - RNA, 16 nt, Mycobacterium bovis subsp bovis AF2122/97
caucaccggcggcccc

SEQ ID NO: 1133200 - RNA, 12 nt, Mycobacterium bovis subsp bovis AF2122/97
caucaccggcgc

SEQ ID NO: 1133201 - RNA, 18 nt, Mycobacterium bovis subsp bovis AF2122/97
caucaccggcgcaccguc

SEQ ID NO: 1133202 - RNA, 16 nt, Mycobacterium bovis subsp bovis AF2122/97
caucaccacggccgcc

SEQ ID NO: 1133203 - RNA, 17 nt, Mycobacterium bovis subsp bovis AF2122/97
caucaccaccggcaccg

SEQ ID NO: 1133204 - RNA, 16 nt, Mycobacterium bovis subsp bovis AF2122/97
caucaccacuggcggu

SEQ ID NO: 1133205 - RNA, 15 nt, Mycobacterium bovis subsp bovis AF2122/97
caucaccaccggcac

SEQ ID NO: 1133206 - RNA, 17 nt, Mycobacterium bovis subsp bovis AF2122/97
caucaccacaccggcag

SEQ ID NO: 1133207 - RNA, 19 nt, Mycobacterium bovis subsp bovis AF2122/97
caucaccacaccggcagcu

SEQ ID NO: 1133208 - RNA, 16 nt, Mycobacterium bovis subsp bovis AF2122/97
caucaccaccgcacgg

SEQ ID NO: 1133209 - RNA, 15 nt, Mycobacterium bovis subsp bovis AF2122/97
caucaccaccgccgg

SEQ ID NO: 1133210 - RNA, 19 nt, Mycobacterium bovis subsp bovis AF2122/97
caucaccucgaugccgccc

SEQ ID NO: 1133211 - RNA, 20 nt, Mycobacterium bovis subsp bovis AF2122/97
caucacggucagccguacgc

SEQ ID NO: 1133212 - RNA, 15 nt, Mycobacterium bovis subsp bovis AF2122/97
caucacggaccaggc

SEQ ID NO: 1133213 - RNA, 14 nt, Mycobacterium bovis subsp bovis AF2122/97
caucagcacgguga

SEQ ID NO: 1133214 - RNA, 14 nt, Mycobacterium bovis subsp bovis AF2122/97
caucagcccggcgc

SEQ ID NO: 1133215 - RNA, 15 nt, Mycobacterium bovis subsp bovis AF2122/97
caucagcccggcgcg

SEQ ID NO: 1133216 - RNA, 17 nt, Mycobacterium bovis subsp bovis AF2122/97
caucagcccggcgcgcc

SEQ ID NO: 1133217 - RNA, 17 nt, Mycobacterium bovis subsp bovis AF2122/97
caucagauucgcgcugg

SEQ ID NO: 1133218 - RNA, 16 nt, Mycobacterium bovis subsp bovis AF2122/97
caucagagacagcagc

SEQ ID NO: 1133219 - RNA, 17 nt, Mycobacterium bovis subsp bovis AF2122/97
caucagagacagcagcg

SEQ ID NO: 1133220 - RNA, 16 nt, Mycobacterium bovis subsp bovis AF2122/97
caucagaucgccgacu

SEQ ID NO: 1133221 - RNA, 19 nt, Mycobacterium bovis subsp bovis AF2122/97
caucacgguggccgcacga

SEQ ID NO: 1133222 - RNA, 16 nt, Mycobacterium bovis subsp bovis AF2122/97
caucacguccgcggug

SEQ ID NO: 1133223 - RNA, 20 nt, Mycobacterium bovis subsp bovis AF2122/97
caucagaaucaggcucgccg

SEQ ID NO: 1133224 - RNA, 16 nt, Mycobacterium bovis subsp bovis AF2122/97
cauagccguugcgggc

SEQ ID NO: 1133225 - RNA, 15 nt, Mycobacterium bovis subsp bovis AF2122/97
cauagccgcgacccg

SEQ ID NO: 1133226 - RNA, 17 nt, Mycobacterium bovis subsp bovis AF2122/97
cauagauacagucgacc

SEQ ID NO: 1133227 - RNA, 17 nt, Mycobacterium bovis subsp bovis AF2122/97
cauagcaauccgcacag

SEQ ID NO: 1133228 - RNA, 14 nt, Mycobacterium bovis subsp bovis AF2122/97
cauagagcggcacc

SEQ ID NO: 1133229 - RNA, 19 nt, Mycobacterium bovis subsp bovis AF2122/97
cauagaccucgccggugac

SEQ ID NO: 1133230 - RNA, 20 nt, Mycobacterium bovis subsp bovis AF2122/97
cauagaccucgccggugacg

SEQ ID NO: 1133231 - RNA, 22 nt, Mycobacterium bovis subsp bovis AF2122/97
cauauucuuggucgaggucggc

SEQ ID NO: 1133232 - RNA, 14 nt, Mycobacterium bovis subsp bovis AF2122/97
caucacauccacgc

SEQ ID NO: 1133233 - RNA, 14 nt, Mycobacterium bovis subsp bovis AF2122/97
cauaccggccgcca

SEQ ID NO: 1133234 - RNA, 18 nt, Mycobacterium bovis subsp bovis AF2122/97
cauaccggccgccaucau

SEQ ID NO: 1133235 - RNA, 16 nt, Mycobacterium bovis subsp bovis AF2122/97
cauaccguucacccag

SEQ ID NO: 1133236 - RNA, 11 nt, Mycobacterium bovis subsp bovis AF2122/97
cauaccggcgc

SEQ ID NO: 1133237 - RNA, 23 nt, Mycobacterium bovis subsp bovis AF2122/97
cauacgccaaguacgcgaccgcg

SEQ ID NO: 1133238 - RNA, 14 nt, Mycobacterium bovis subsp bovis AF2122/97
cauacgccggccgc

SEQ ID NO: 1133239 - RNA, 15 nt, Mycobacterium bovis subsp bovis AF2122/97
cauacgccggccgcg

SEQ ID NO: 1133240 - RNA, 16 nt, Mycobacterium bovis subsp bovis AF2122/97
cauacgauuucgacga

SEQ ID NO: 1133241 - RNA, 20 nt, Mycobacterium bovis subsp bovis AF2122/97
cauacuaauggcgccaccgg

SEQ ID NO: 1133242 - RNA, 21 nt, Mycobacterium bovis subsp bovis AF2122/97
cauacggaagggcccggugug

SEQ ID NO: 1133243 - RNA, 21 nt, Mycobacterium bovis subsp bovis AF2122/97
cauacgucggggccgcacugu

SEQ ID NO: 1133244 - RNA, 19 nt, Mycobacterium bovis subsp bovis AF2122/97
cauacgugccgccgauguc

SEQ ID NO: 1133245 - RNA, 16 nt, Mycobacterium bovis subsp bovis AF2122/97
cauagaacucgccgcu

SEQ ID NO: 1133246 - RNA, 17 nt, Mycobacterium bovis subsp bovis AF2122/97
cauagaacucgccgcug

SEQ ID NO: 1133247 - RNA, 20 nt, Mycobacterium bovis subsp bovis AF2122/97
cauagaaauacaggcccggc

SEQ ID NO: 1133248 - RNA, 21 nt, Mycobacterium bovis subsp bovis AF2122/97
cauacuggcgguccgaugcgc

SEQ ID NO: 1133249 - RNA, 16 nt, Mycobacterium bovis subsp bovis AF2122/97
cauacuugcgccgacu

SEQ ID NO: 1133250 - RNA, 12 nt, Mycobacterium bovis subsp bovis AF2122/97
cauacucggcgg

SEQ ID NO: 1133251 - RNA, 19 nt, Mycobacterium bovis subsp bovis AF2122/97
cauacucuuugugcccaau

SEQ ID NO: 1133252 - RNA, 19 nt, Mycobacterium bovis subsp bovis AF2122/97
caguguggcgaugaccacg

SEQ ID NO: 1133253 - RNA, 19 nt, Mycobacterium bovis subsp bovis AF2122/97
cagugugaagaccaccgcc

SEQ ID NO: 1133254 - RNA, 22 nt, Mycobacterium bovis subsp bovis AF2122/97
cagugugcgguuggaucggcgg

SEQ ID NO: 1133255 - RNA, 14 nt, Mycobacterium bovis subsp bovis AF2122/97
caguguggugcggc

SEQ ID NO: 1133256 - RNA, 17 nt, Mycobacterium bovis subsp bovis AF2122/97
caguguugcgcugcggc

SEQ ID NO: 1133257 - RNA, 18 nt, Mycobacterium bovis subsp bovis AF2122/97
caguguugcgcugcggcc

SEQ ID NO: 1133258 - RNA, 22 nt, Mycobacterium bovis subsp bovis AF2122/97
caguguugcgcugcggccagcg

SEQ ID NO: 1133259 - RNA, 15 nt, Mycobacterium bovis subsp bovis AF2122/97
cauaacaccggguag

SEQ ID NO: 1133260 - RNA, 17 nt, Mycobacterium bovis subsp bovis AF2122/97
caguguugcaguggcga

SEQ ID NO: 1133261 - RNA, 22 nt, Mycobacterium bovis subsp bovis AF2122/97
cagugucgauagcccgccaccc

SEQ ID NO: 1133262 - RNA, 23 nt, Mycobacterium bovis subsp bovis AF2122/97
cagugucagcaagaucggcagcg

SEQ ID NO: 1133263 - RNA, 17 nt, Mycobacterium bovis subsp bovis AF2122/97
cagugucguggucgugg

SEQ ID NO: 1133264 - RNA, 20 nt, Mycobacterium bovis subsp bovis AF2122/97
caguggaguauccggcagac

SEQ ID NO: 1133265 - RNA, 15 nt, Mycobacterium bovis subsp bovis AF2122/97
caguggauccggcag

SEQ ID NO: 1133266 - RNA, 15 nt, Mycobacterium bovis subsp bovis AF2122/97
caguguacaccgcgc

SEQ ID NO: 1133267 - RNA, 20 nt, Mycobacterium bovis subsp bovis AF2122/97
cagugcugcaccgauucggg

SEQ ID NO: 1133268 - RNA, 15 nt, Mycobacterium bovis subsp bovis AF2122/97
cagugcugcagaccc

SEQ ID NO: 1133269 - RNA, 18 nt, Mycobacterium bovis subsp bovis AF2122/97
cauaacgcgaacccgcga

SEQ ID NO: 1133270 - RNA, 20 nt, Mycobacterium bovis subsp bovis AF2122/97
cauaacgcgaacccgcgagg

SEQ ID NO: 1133271 - RNA, 16 nt, Mycobacterium bovis subsp bovis AF2122/97
cauaaccggcgcgccc

SEQ ID NO: 1133272 - RNA, 15 nt, Mycobacterium bovis subsp bovis AF2122/97
cauaacccgcaccgg

SEQ ID NO: 1133273 - RNA, 12 nt, Mycobacterium bovis subsp bovis AF2122/97
cauaacagcugg

SEQ ID NO: 1133274 - RNA, 16 nt, Mycobacterium bovis subsp bovis AF2122/97
cauaacccuggccggu

SEQ ID NO: 1133275 - RNA, 18 nt, Mycobacterium bovis subsp bovis AF2122/97
cauaacccuggccggugc

SEQ ID NO: 1133276 - RNA, 20 nt, Mycobacterium bovis subsp bovis AF2122/97
caucgucgucgcugccgcca

SEQ ID NO: 1133277 - RNA, 13 nt, Mycobacterium bovis subsp bovis AF2122/97
caucgucggcaac

SEQ ID NO: 1133278 - RNA, 17 nt, Mycobacterium bovis subsp bovis AF2122/97
caucgucggcgggcggc

SEQ ID NO: 1133279 - RNA, 20 nt, Mycobacterium bovis subsp bovis AF2122/97
caucgucggcgggcggcagc

SEQ ID NO: 1133280 - RNA, 21 nt, Mycobacterium bovis subsp bovis AF2122/97
caucgucgccacgaugccggc

SEQ ID NO: 1133281 - RNA, 13 nt, Mycobacterium bovis subsp bovis AF2122/97
caucgucgaagac

SEQ ID NO: 1133282 - RNA, 14 nt, Mycobacterium bovis subsp bovis AF2122/97
caucgucgaagacc

SEQ ID NO: 1133283 - RNA, 17 nt, Mycobacterium bovis subsp bovis AF2122/97
caucgucgccagggccg

SEQ ID NO: 1133284 - RNA, 23 nt, Mycobacterium bovis subsp bovis AF2122/97
caucgucgccagggccgccgaag

SEQ ID NO: 1133285 - RNA, 15 nt, Mycobacterium bovis subsp bovis AF2122/97
caucgucgccgagcg

SEQ ID NO: 1133286 - RNA, 12 nt, Mycobacterium bovis subsp bovis AF2122/97
caucgucgccgc

SEQ ID NO: 1133287 - RNA, 16 nt, Mycobacterium bovis subsp bovis AF2122/97
caucgucgcgacgacg

SEQ ID NO: 1133288 - RNA, 15 nt, Mycobacterium bovis subsp bovis AF2122/97
caucgucgcgccgcg

SEQ ID NO: 1133289 - RNA, 15 nt, Mycobacterium bovis subsp bovis AF2122/97
caucgucagcgacca

SEQ ID NO: 1133290 - RNA, 20 nt, Mycobacterium bovis subsp bovis AF2122/97
caucgguugacccggcagcc

SEQ ID NO: 1133291 - RNA, 19 nt, Mycobacterium bovis subsp bovis AF2122/97
caucgucaggaaccaccca

SEQ ID NO: 1133292 - RNA, 16 nt, Mycobacterium bovis subsp bovis AF2122/97
caucgucacugccacc

SEQ ID NO: 1133293 - RNA, 18 nt, Mycobacterium bovis subsp bovis AF2122/97
caucgucaucgacgagcg

SEQ ID NO: 1133294 - RNA, 21 nt, Mycobacterium bovis subsp bovis AF2122/97
caucguccacgcagaggcggc

SEQ ID NO: 1133295 - RNA, 15 nt, Mycobacterium bovis subsp bovis AF2122/97
caucguccgccgggc

SEQ ID NO: 1133296 - RNA, 22 nt, Mycobacterium bovis subsp bovis AF2122/97
caucguccgugguuugcgucag

SEQ ID NO: 1133297 - RNA, 18 nt, Mycobacterium bovis subsp bovis AF2122/97
caucguucugacggcuug

SEQ ID NO: 1133298 - RNA, 18 nt, Mycobacterium bovis subsp bovis AF2122/97
caucguucaugaucggca

SEQ ID NO: 1133299 - RNA, 21 nt, Mycobacterium bovis subsp bovis AF2122/97
caucguuggccgggcacgcga

SEQ ID NO: 1133300 - RNA, 15 nt, Mycobacterium bovis subsp bovis AF2122/97
caucguugucauaga

SEQ ID NO: 1133301 - RNA, 19 nt, Mycobacterium bovis subsp bovis AF2122/97
caucguuguugaccaccac

SEQ ID NO: 1133302 - RNA, 22 nt, Mycobacterium bovis subsp bovis AF2122/97
caucuagguucaguuccaccgc

SEQ ID NO: 1133303 - RNA, 23 nt, Mycobacterium bovis subsp bovis AF2122/97
caucuagguucaguuccaccgcg

SEQ ID NO: 1133304 - RNA, 17 nt, Mycobacterium bovis subsp bovis AF2122/97
caucuaccagcucaccc

SEQ ID NO: 1133305 - RNA, 22 nt, Mycobacterium bovis subsp bovis AF2122/97
caucugcgggucggcaucggag

SEQ ID NO: 1133306 - RNA, 22 nt, Mycobacterium bovis subsp bovis AF2122/97
caucugcgggacgucgucguug

SEQ ID NO: 1133307 - RNA, 13 nt, Mycobacterium bovis subsp bovis AF2122/97
caucugccggucg

SEQ ID NO: 1133308 - RNA, 22 nt, Mycobacterium bovis subsp bovis AF2122/97
caucugaggcuuccagcucggg

SEQ ID NO: 1133309 - RNA, 24 nt, Mycobacterium bovis subsp bovis AF2122/97
caucugccaaucugcacgcgcucg

SEQ ID NO: 1133310 - RNA, 15 nt, Mycobacterium bovis subsp bovis AF2122/97
caucucgucgaucuc

SEQ ID NO: 1133311 - RNA, 19 nt, Mycobacterium bovis subsp bovis AF2122/97
caucucggucagaugcgcg

SEQ ID NO: 1133312 - RNA, 21 nt, Mycobacterium bovis subsp bovis AF2122/97
caucucgucgucgcggccgcu

SEQ ID NO: 1133313 - RNA, 15 nt, Mycobacterium bovis subsp bovis AF2122/97
caucucgucgucggg

SEQ ID NO: 1133314 - RNA, 14 nt, Mycobacterium bovis subsp bovis AF2122/97
caucucgcaccgcg

SEQ ID NO: 1133315 - RNA, 16 nt, Mycobacterium bovis subsp bovis AF2122/97
caucucgcaccgcgcc

SEQ ID NO: 1133316 - RNA, 13 nt, Mycobacterium bovis subsp bovis AF2122/97
caucuccgccguc

SEQ ID NO: 1133317 - RNA, 21 nt, Mycobacterium bovis subsp bovis AF2122/97
caucuccgccgucgccaccgg

SEQ ID NO: 1133318 - RNA, 16 nt, Mycobacterium bovis subsp bovis AF2122/97
caucuccgucggccag

SEQ ID NO: 1133319 - RNA, 19 nt, Mycobacterium bovis subsp bovis AF2122/97
caucuccaccgucgccgcc

SEQ ID NO: 1133320 - RNA, 20 nt, Mycobacterium bovis subsp bovis AF2122/97
caucuccaccgucgccgccg

SEQ ID NO: 1133321 - RNA, 15 nt, Mycobacterium bovis subsp bovis AF2122/97
caucucccgaccgcc

SEQ ID NO: 1133322 - RNA, 14 nt, Mycobacterium bovis subsp bovis AF2122/97
caucucaccgggcc

SEQ ID NO: 1133323 - RNA, 22 nt, Mycobacterium bovis subsp bovis AF2122/97
caucucaccgggcccgacgacg

SEQ ID NO: 1133324 - RNA, 20 nt, Mycobacterium bovis subsp bovis AF2122/97
caucgggaccggggacgcgc

SEQ ID NO: 1133325 - RNA, 14 nt, Mycobacterium bovis subsp bovis AF2122/97
caucggcggcgucg

SEQ ID NO: 1133326 - RNA, 19 nt, Mycobacterium bovis subsp bovis AF2122/97
caucggcuaggccggccgg

SEQ ID NO: 1133327 - RNA, 17 nt, Mycobacterium bovis subsp bovis AF2122/97
caucggcggcgucgacg

SEQ ID NO: 1133328 - RNA, 18 nt, Mycobacterium bovis subsp bovis AF2122/97
caucggcggggcccacac

SEQ ID NO: 1133329 - RNA, 13 nt, Mycobacterium bovis subsp bovis AF2122/97
caucgggcgccca

SEQ ID NO: 1133330 - RNA, 15 nt, Mycobacterium bovis subsp bovis AF2122/97
caucgggccgccgag

SEQ ID NO: 1133331 - RNA, 20 nt, Mycobacterium bovis subsp bovis AF2122/97
caucgggccgguggacgugc

SEQ ID NO: 1133332 - RNA, 17 nt, Mycobacterium bovis subsp bovis AF2122/97
caucgggguggccacca

SEQ ID NO: 1133333 - RNA, 12 nt, Mycobacterium bovis subsp bovis AF2122/97
caucgggcgcgg

SEQ ID NO: 1133334 - RNA, 12 nt, Mycobacterium bovis subsp bovis AF2122/97
caucgggccaca

SEQ ID NO: 1133335 - RNA, 14 nt, Mycobacterium bovis subsp bovis AF2122/97
caucgggagccgca

SEQ ID NO: 1133336 - RNA, 14 nt, Mycobacterium bovis subsp bovis AF2122/97
caucggcuggccgc

SEQ ID NO: 1133337 - RNA, 16 nt, Mycobacterium bovis subsp bovis AF2122/97
caucgggauggacacc

SEQ ID NO: 1133338 - RNA, 11 nt, Mycobacterium bovis subsp bovis AF2122/97
caucggugauc

SEQ ID NO: 1133339 - RNA, 20 nt, Mycobacterium bovis subsp bovis AF2122/97
caucggugaucaaaccggcg

SEQ ID NO: 1133340 - RNA, 21 nt, Mycobacterium bovis subsp bovis AF2122/97
caucggugaucaaaccggcgg

SEQ ID NO: 1133341 - RNA, 17 nt, Mycobacterium bovis subsp bovis AF2122/97
caucggucaccgcggca

SEQ ID NO: 1133342 - RNA, 18 nt, Mycobacterium bovis subsp bovis AF2122/97
caucggucagcgccgacu

SEQ ID NO: 1133343 - RNA, 17 nt, Mycobacterium bovis subsp bovis AF2122/97
caucgguccaaagcacg

SEQ ID NO: 1133344 - RNA, 17 nt, Mycobacterium bovis subsp bovis AF2122/97
caucggucccacugccg

SEQ ID NO: 1133345 - RNA, 20 nt, Mycobacterium bovis subsp bovis AF2122/97
caucggucccacugccggug

SEQ ID NO: 1133346 - RNA, 17 nt, Mycobacterium bovis subsp bovis AF2122/97
caucgggauggacacca

SEQ ID NO: 1133347 - RNA, 14 nt, Mycobacterium bovis subsp bovis AF2122/97
caucggguggcgag

SEQ ID NO: 1133348 - RNA, 17 nt, Mycobacterium bovis subsp bovis AF2122/97
caucggguggcgaggca

SEQ ID NO: 1133349 - RNA, 23 nt, Mycobacterium bovis subsp bovis AF2122/97
caucggguucuucaacuccggga

SEQ ID NO: 1133350 - RNA, 23 nt, Mycobacterium bovis subsp bovis AF2122/97
caucgggucacccccggccagcg

SEQ ID NO: 1133351 - RNA, 20 nt, Mycobacterium bovis subsp bovis AF2122/97
caucgguaucgagggcagcc

SEQ ID NO: 1133352 - RNA, 12 nt, Mycobacterium bovis subsp bovis AF2122/97
caucgguugacc

SEQ ID NO: 1133353 - RNA, 16 nt, Mycobacterium bovis subsp bovis AF2122/97
caucgguugacccggc

SEQ ID NO: 1133354 - RNA, 14 nt, Mycobacterium bovis subsp bovis AF2122/97
caucguaggccggc

SEQ ID NO: 1133355 - RNA, 20 nt, Mycobacterium bovis subsp bovis AF2122/97
caucgguggcgccgaacgcc

SEQ ID NO: 1133356 - RNA, 13 nt, Mycobacterium bovis subsp bovis AF2122/97
caucgguggcggc

SEQ ID NO: 1133357 - RNA, 18 nt, Mycobacterium bovis subsp bovis AF2122/97
caucggugcagcccgccg

SEQ ID NO: 1133358 - RNA, 20 nt, Mycobacterium bovis subsp bovis AF2122/97
caucggugcgguucgcugcg

SEQ ID NO: 1133359 - RNA, 21 nt, Mycobacterium bovis subsp bovis AF2122/97
caucggcgaggccucggcggc

SEQ ID NO: 1133360 - RNA, 23 nt, Mycobacterium bovis subsp bovis AF2122/97
caucggcgaggccucggcggccg

SEQ ID NO: 1133361 - RNA, 19 nt, Mycobacterium bovis subsp bovis AF2122/97
caucggccuguucgccguc

SEQ ID NO: 1133362 - RNA, 21 nt, Mycobacterium bovis subsp bovis AF2122/97
caucggccuguucgccgucgc

SEQ ID NO: 1133363 - RNA, 15 nt, Mycobacterium bovis subsp bovis AF2122/97
caucggcgaacaacc

SEQ ID NO: 1133364 - RNA, 18 nt, Mycobacterium bovis subsp bovis AF2122/97
caucggcgacaggagacg

SEQ ID NO: 1133365 - RNA, 17 nt, Mycobacterium bovis subsp bovis AF2122/97
caucggcgcuggcaggc

SEQ ID NO: 1133366 - RNA, 18 nt, Mycobacterium bovis subsp bovis AF2122/97
caucggcgcuggcaggcu

SEQ ID NO: 1133367 - RNA, 17 nt, Mycobacterium bovis subsp bovis AF2122/97
caucggcggagucgacg

SEQ ID NO: 1133368 - RNA, 19 nt, Mycobacterium bovis subsp bovis AF2122/97
caucggcggagucgacggu

SEQ ID NO: 1133369 - RNA, 21 nt, Mycobacterium bovis subsp bovis AF2122/97
caucggcggcaacggcggauc

SEQ ID NO: 1133370 - RNA, 22 nt, Mycobacterium bovis subsp bovis AF2122/97
caucggcggcaaggguggugac

SEQ ID NO: 1133371 - RNA, 19 nt, Mycobacterium bovis subsp bovis AF2122/97
caucggcgaccgccugcgc

SEQ ID NO: 1133372 - RNA, 12 nt, Mycobacterium bovis subsp bovis AF2122/97
caucggccaccu

SEQ ID NO: 1133373 - RNA, 20 nt, Mycobacterium bovis subsp bovis AF2122/97
caucggccaccuguuggcau

SEQ ID NO: 1133374 - RNA, 15 nt, Mycobacterium bovis subsp bovis AF2122/97
caucggccagcagcg

SEQ ID NO: 1133375 - RNA, 18 nt, Mycobacterium bovis subsp bovis AF2122/97
caucggcaucgacugcca

SEQ ID NO: 1133376 - RNA, 22 nt, Mycobacterium bovis subsp bovis AF2122/97
caucggccgcggucggccacca

SEQ ID NO: 1133377 - RNA, 18 nt, Mycobacterium bovis subsp bovis AF2122/97
caucggccggcgucagcc

SEQ ID NO: 1133378 - RNA, 21 nt, Mycobacterium bovis subsp bovis AF2122/97
caucggccggguuaucggcag

SEQ ID NO: 1133379 - RNA, 20 nt, Mycobacterium bovis subsp bovis AF2122/97
caucggccucugaccagccg

SEQ ID NO: 1133380 - RNA, 16 nt, Mycobacterium bovis subsp bovis AF2122/97
caucggcccgaucacc

SEQ ID NO: 1133381 - RNA, 22 nt, Mycobacterium bovis subsp bovis AF2122/97
caucggaggaaccccgcgcggu

SEQ ID NO: 1133382 - RNA, 13 nt, Mycobacterium bovis subsp bovis AF2122/97
caucggaaucgcg

SEQ ID NO: 1133383 - RNA, 14 nt, Mycobacterium bovis subsp bovis AF2122/97
caucggacagcgcc

SEQ ID NO: 1133384 - RNA, 19 nt, Mycobacterium bovis subsp bovis AF2122/97
caucggcacaggcggccag

SEQ ID NO: 1133385 - RNA, 14 nt, Mycobacterium bovis subsp bovis AF2122/97
caucggcaccagcg

SEQ ID NO: 1133386 - RNA, 11 nt, Mycobacterium bovis subsp bovis AF2122/97
caucggcaccc

SEQ ID NO: 1133387 - RNA, 18 nt, Mycobacterium bovis subsp bovis AF2122/97
caucggcaccccggccac

SEQ ID NO: 1133388 - RNA, 21 nt, Mycobacterium bovis subsp bovis AF2122/97
caucggcagcagcgcaacggc

SEQ ID NO: 1133389 - RNA, 13 nt, Mycobacterium bovis subsp bovis AF2122/97
caucggcaccguc

SEQ ID NO: 1133390 - RNA, 14 nt, Mycobacterium bovis subsp bovis AF2122/97
caucggauggcccc

SEQ ID NO: 1133391 - RNA, 23 nt, Mycobacterium bovis subsp bovis AF2122/97
caucgcuuggccuaugcugcccg

SEQ ID NO: 1133392 - RNA, 18 nt, Mycobacterium bovis subsp bovis AF2122/97
caugaucugccaccgcgg

SEQ ID NO: 1133393 - RNA, 14 nt, Mycobacterium bovis subsp bovis AF2122/97
caugaucacaccga

SEQ ID NO: 1133394 - RNA, 15 nt, Mycobacterium bovis subsp bovis AF2122/97
caugaugccggacgc

SEQ ID NO: 1133395 - RNA, 20 nt, Mycobacterium bovis subsp bovis AF2122/97
caugaugccuaccgggcccg

SEQ ID NO: 1133396 - RNA, 19 nt, Mycobacterium bovis subsp bovis AF2122/97
caugauguagcggcguucc

SEQ ID NO: 1133397 - RNA, 13 nt, Mycobacterium bovis subsp bovis AF2122/97
caugaugaccggc

SEQ ID NO: 1133398 - RNA, 16 nt, Mycobacterium bovis subsp bovis AF2122/97
caugcagaucucacgg

SEQ ID NO: 1133399 - RNA, 23 nt, Mycobacterium bovis subsp bovis AF2122/97
caugcacgucaucggcuggccgc

SEQ ID NO: 1133400 - RNA, 18 nt, Mycobacterium bovis subsp bovis AF2122/97
caugcagcgcgucgccga

SEQ ID NO: 1133401 - RNA, 23 nt, Mycobacterium bovis subsp bovis AF2122/97
caugccaagcuccaaccaugcgg

SEQ ID NO: 1133402 - RNA, 14 nt, Mycobacterium bovis subsp bovis AF2122/97
caugccacagcggc

SEQ ID NO: 1133403 - RNA, 15 nt, Mycobacterium bovis subsp bovis AF2122/97
caugcaacacaccgc

SEQ ID NO: 1133404 - RNA, 13 nt, Mycobacterium bovis subsp bovis AF2122/97
caugcacgccgua

SEQ ID NO: 1133405 - RNA, 12 nt, Mycobacterium bovis subsp bovis AF2122/97
caugcacggccg

SEQ ID NO: 1133406 - RNA, 15 nt, Mycobacterium bovis subsp bovis AF2122/97
caugcaaugcuggcg

SEQ ID NO: 1133407 - RNA, 14 nt, Mycobacterium bovis subsp bovis AF2122/97
caugcaacacaccg

SEQ ID NO: 1133408 - RNA, 15 nt, Mycobacterium bovis subsp bovis AF2122/97
caugauucgcugcgc

SEQ ID NO: 1133409 - RNA, 15 nt, Mycobacterium bovis subsp bovis AF2122/97
caugauuggcucggg

SEQ ID NO: 1133410 - RNA, 17 nt, Mycobacterium bovis subsp bovis AF2122/97
caugcccgacgagucgc

SEQ ID NO: 1133411 - RNA, 17 nt, Mycobacterium bovis subsp bovis AF2122/97
caugcccacgcugccgc

SEQ ID NO: 1133412 - RNA, 24 nt, Mycobacterium bovis subsp bovis AF2122/97
caugccauggcccgugcgguuguu

SEQ ID NO: 1133413 - RNA, 20 nt, Mycobacterium bovis subsp bovis AF2122/97
caugccauagaugcccgcga

SEQ ID NO: 1133414 - RNA, 16 nt, Mycobacterium bovis subsp bovis AF2122/97
caugccgacccgggcg

SEQ ID NO: 1133415 - RNA, 16 nt, Mycobacterium bovis subsp bovis AF2122/97
caugcccugcgcucgg

SEQ ID NO: 1133416 - RNA, 21 nt, Mycobacterium bovis subsp bovis AF2122/97
caugcccuggaccagcgggcg

SEQ ID NO: 1133417 - RNA, 22 nt, Mycobacterium bovis subsp bovis AF2122/97
caugcccuggaccagcgggcgg

SEQ ID NO: 1133418 - RNA, 15 nt, Mycobacterium bovis subsp bovis AF2122/97
caugccccgaccgcg

SEQ ID NO: 1133419 - RNA, 16 nt, Mycobacterium bovis subsp bovis AF2122/97
caugcccggacgaugg

SEQ ID NO: 1133420 - RNA, 21 nt, Mycobacterium bovis subsp bovis AF2122/97
caugcccggacgauggcgucg

SEQ ID NO: 1133421 - RNA, 20 nt, Mycobacterium bovis subsp bovis AF2122/97
caugcccgacgagucgccgc

SEQ ID NO: 1133422 - RNA, 17 nt, Mycobacterium bovis subsp bovis AF2122/97
caugcccgcacgcucgg

SEQ ID NO: 1133423 - RNA, 19 nt, Mycobacterium bovis subsp bovis AF2122/97
caugcccgcacgcucggcg

SEQ ID NO: 1133424 - RNA, 14 nt, Mycobacterium bovis subsp bovis AF2122/97
caugccgcggcgga

SEQ ID NO: 1133425 - RNA, 15 nt, Mycobacterium bovis subsp bovis AF2122/97
caugccggcgugcgg

SEQ ID NO: 1133426 - RNA, 19 nt, Mycobacterium bovis subsp bovis AF2122/97
caugccgggauugccgucg

SEQ ID NO: 1133427 - RNA, 13 nt, Mycobacterium bovis subsp bovis AF2122/97
caugccgccgaag

SEQ ID NO: 1133428 - RNA, 12 nt, Mycobacterium bovis subsp bovis AF2122/97
caugccgcucgg

SEQ ID NO: 1133429 - RNA, 17 nt, Mycobacterium bovis subsp bovis AF2122/97
caugccgcucggcaacc

SEQ ID NO: 1133430 - RNA, 21 nt, Mycobacterium bovis subsp bovis AF2122/97
caugccggcgaacucgcgccg

SEQ ID NO: 1133431 - RNA, 15 nt, Mycobacterium bovis subsp bovis AF2122/97
caugccggcgcacca

SEQ ID NO: 1133432 - RNA, 19 nt, Mycobacterium bovis subsp bovis AF2122/97
caugccgcccaucaccccg

SEQ ID NO: 1133433 - RNA, 15 nt, Mycobacterium bovis subsp bovis AF2122/97
caugccgcccgcgcc

SEQ ID NO: 1133434 - RNA, 19 nt, Mycobacterium bovis subsp bovis AF2122/97
caugccgcccgcgccgccg

SEQ ID NO: 1133435 - RNA, 20 nt, Mycobacterium bovis subsp bovis AF2122/97
caugccgcccgcgccgccgg

SEQ ID NO: 1133436 - RNA, 21 nt, Mycobacterium bovis subsp bovis AF2122/97
caugccgcccgcgccgccgga

SEQ ID NO: 1133437 - RNA, 13 nt, Mycobacterium bovis subsp bovis AF2122/97
caugccgaucggc

SEQ ID NO: 1133438 - RNA, 16 nt, Mycobacterium bovis subsp bovis AF2122/97
caugccgaucggccug

SEQ ID NO: 1133439 - RNA, 19 nt, Mycobacterium bovis subsp bovis AF2122/97
caugccgccaugcgcacca

SEQ ID NO: 1133440 - RNA, 20 nt, Mycobacterium bovis subsp bovis AF2122/97
caucuucgcgcagccgccgc

SEQ ID NO: 1133441 - RNA, 19 nt, Mycobacterium bovis subsp bovis AF2122/97
caucuucggacgccagcuc

SEQ ID NO: 1133442 - RNA, 18 nt, Mycobacterium bovis subsp bovis AF2122/97
caucuucaccacgccgua

SEQ ID NO: 1133443 - RNA, 12 nt, Mycobacterium bovis subsp bovis AF2122/97
caucuggccggc

SEQ ID NO: 1133444 - RNA, 22 nt, Mycobacterium bovis subsp bovis AF2122/97
caucuggggguagccgccggcg

SEQ ID NO: 1133445 - RNA, 22 nt, Mycobacterium bovis subsp bovis AF2122/97
caucugcuguggaucgacaccg

SEQ ID NO: 1133446 - RNA, 22 nt, Mycobacterium bovis subsp bovis AF2122/97
caucuguuccgugccagcugcc

SEQ ID NO: 1133447 - RNA, 17 nt, Mycobacterium bovis subsp bovis AF2122/97
caugaacaucggccggg

SEQ ID NO: 1133448 - RNA, 14 nt, Mycobacterium bovis subsp bovis AF2122/97
caugaaccggucga

SEQ ID NO: 1133449 - RNA, 18 nt, Mycobacterium bovis subsp bovis AF2122/97
caugaacgaucggaccac

SEQ ID NO: 1133450 - RNA, 14 nt, Mycobacterium bovis subsp bovis AF2122/97
caucuugucgaucu

SEQ ID NO: 1133451 - RNA, 14 nt, Mycobacterium bovis subsp bovis AF2122/97
caucuugccaccgc

SEQ ID NO: 1133452 - RNA, 15 nt, Mycobacterium bovis subsp bovis AF2122/97
caucuugcggcagcg

SEQ ID NO: 1133453 - RNA, 12 nt, Mycobacterium bovis subsp bovis AF2122/97
caugagccggcg

SEQ ID NO: 1133454 - RNA, 15 nt, Mycobacterium bovis subsp bovis AF2122/97
caugagcgcgcccaa

SEQ ID NO: 1133455 - RNA, 23 nt, Mycobacterium bovis subsp bovis AF2122/97
caugagcguucagcacggugggc

SEQ ID NO: 1133456 - RNA, 18 nt, Mycobacterium bovis subsp bovis AF2122/97
caugagggcaucgagacg

SEQ ID NO: 1133457 - RNA, 19 nt, Mycobacterium bovis subsp bovis AF2122/97
caugagguaggucgccgcc

SEQ ID NO: 1133458 - RNA, 16 nt, Mycobacterium bovis subsp bovis AF2122/97
caugacgaucgcggcg

SEQ ID NO: 1133459 - RNA, 13 nt, Mycobacterium bovis subsp bovis AF2122/97
caugacgccggcg

SEQ ID NO: 1133460 - RNA, 13 nt, Mycobacterium bovis subsp bovis AF2122/97
caugacgaucgcg

SEQ ID NO: 1133461 - RNA, 14 nt, Mycobacterium bovis subsp bovis AF2122/97
caugacgaucgcgg

SEQ ID NO: 1133462 - RNA, 15 nt, Mycobacterium bovis subsp bovis AF2122/97
caugaccggccgcca

SEQ ID NO: 1133463 - RNA, 16 nt, Mycobacterium bovis subsp bovis AF2122/97
caugacagccccgccg

SEQ ID NO: 1133464 - RNA, 17 nt, Mycobacterium bovis subsp bovis AF2122/97
caugacagccccgccgc

SEQ ID NO: 1133465 - RNA, 23 nt, Mycobacterium bovis subsp bovis AF2122/97
caugaaggagaucccccaggcga

SEQ ID NO: 1133466 - RNA, 18 nt, Mycobacterium bovis subsp bovis AF2122/97
caugaacugcucgccgag

SEQ ID NO: 1133467 - RNA, 18 nt, Mycobacterium bovis subsp bovis AF2122/97
caugaacgcaagcagcgc

SEQ ID NO: 1133468 - RNA, 22 nt, Mycobacterium bovis subsp bovis AF2122/97
caugaagccguugccgccacgg

SEQ ID NO: 1133469 - RNA, 14 nt, Mycobacterium bovis subsp bovis AF2122/97
caugacaccggcca

SEQ ID NO: 1133470 - RNA, 17 nt, Mycobacterium bovis subsp bovis AF2122/97
caugacaccggccacca

SEQ ID NO: 1133471 - RNA, 15 nt, Mycobacterium bovis subsp bovis AF2122/97
ccaaucgucggccag

SEQ ID NO: 1133472 - RNA, 17 nt, Mycobacterium bovis subsp bovis AF2122/97
ccaaucgucggccagca

SEQ ID NO: 1133473 - RNA, 18 nt, Mycobacterium bovis subsp bovis AF2122/97
ccaaucgucggccagcag

SEQ ID NO: 1133474 - RNA, 17 nt, Mycobacterium bovis subsp bovis AF2122/97
ccaaucgggaucgcugc

SEQ ID NO: 1133475 - RNA, 15 nt, Mycobacterium bovis subsp bovis AF2122/97
ccaaucggguccacg

SEQ ID NO: 1133476 - RNA, 19 nt, Mycobacterium bovis subsp bovis AF2122/97
ccaaucuucucgagccgcc

SEQ ID NO: 1133477 - RNA, 20 nt, Mycobacterium bovis subsp bovis AF2122/97
ccaauccggcugcgguaauc

SEQ ID NO: 1133478 - RNA, 14 nt, Mycobacterium bovis subsp bovis AF2122/97
ccaauccggcggcg

SEQ ID NO: 1133479 - RNA, 16 nt, Mycobacterium bovis subsp bovis AF2122/97
ccaauccggcggcgac

SEQ ID NO: 1133480 - RNA, 20 nt, Mycobacterium bovis subsp bovis AF2122/97
ccaauccggcggcgacgugu

SEQ ID NO: 1133481 - RNA, 20 nt, Mycobacterium bovis subsp bovis AF2122/97
ccaauccacgguugccggcg

SEQ ID NO: 1133482 - RNA, 15 nt, Mycobacterium bovis subsp bovis AF2122/97
ccaagguggcggcca

SEQ ID NO: 1133483 - RNA, 22 nt, Mycobacterium bovis subsp bovis AF2122/97
ccaagguggcggccaguucggc

SEQ ID NO: 1133484 - RNA, 18 nt, Mycobacterium bovis subsp bovis AF2122/97
ccaaggucuucaggccgc

SEQ ID NO: 1133485 - RNA, 20 nt, Mycobacterium bovis subsp bovis AF2122/97
ccaagguguggccuugcguc

SEQ ID NO: 1133486 - RNA, 17 nt, Mycobacterium bovis subsp bovis AF2122/97
ccaaguacgcgaccgcg

SEQ ID NO: 1133487 - RNA, 18 nt, Mycobacterium bovis subsp bovis AF2122/97
ccaaguacgcgaccgcga

SEQ ID NO: 1133488 - RNA, 21 nt, Mycobacterium bovis subsp bovis AF2122/97
ccaagucagaacggcggcagc

SEQ ID NO: 1133489 - RNA, 15 nt, Mycobacterium bovis subsp bovis AF2122/97
ccaagucggagcggg

SEQ ID NO: 1133490 - RNA, 18 nt, Mycobacterium bovis subsp bovis AF2122/97
ccaaguccuccacggcgg

SEQ ID NO: 1133491 - RNA, 18 nt, Mycobacterium bovis subsp bovis AF2122/97
ccaagucgacgguggcgc

SEQ ID NO: 1133492 - RNA, 23 nt, Mycobacterium bovis subsp bovis AF2122/97
ccaagucgacgguggcgccgucg

SEQ ID NO: 1133493 - RNA, 13 nt, Mycobacterium bovis subsp bovis AF2122/97
ccaagugaccggc

SEQ ID NO: 1133494 - RNA, 19 nt, Mycobacterium bovis subsp bovis AF2122/97
ccaagugaccggccugcga

SEQ ID NO: 1133495 - RNA, 13 nt, Mycobacterium bovis subsp bovis AF2122/97
ccaaucagcccgc

SEQ ID NO: 1133496 - RNA, 19 nt, Mycobacterium bovis subsp bovis AF2122/97
ccaaggcucagcagcgccg

SEQ ID NO: 1133497 - RNA, 14 nt, Mycobacterium bovis subsp bovis AF2122/97
ccaaggcgaugguc

SEQ ID NO: 1133498 - RNA, 12 nt, Mycobacterium bovis subsp bovis AF2122/97
ccaagcagcugg

SEQ ID NO: 1133499 - RNA, 14 nt, Mycobacterium bovis subsp bovis AF2122/97
ccacaacucggcau

SEQ ID NO: 1133500 - RNA, 14 nt, Mycobacterium bovis subsp bovis AF2122/97
ccacaacggcggcg

SEQ ID NO: 1133501 - RNA, 15 nt, Mycobacterium bovis subsp bovis AF2122/97
ccacaagcgauggca

SEQ ID NO: 1133502 - RNA, 15 nt, Mycobacterium bovis subsp bovis AF2122/97
ccacaaguagccgac

SEQ ID NO: 1133503 - RNA, 15 nt, Mycobacterium bovis subsp bovis AF2122/97
ccacaauccgcucgg

SEQ ID NO: 1133504 - RNA, 17 nt, Mycobacterium bovis subsp bovis AF2122/97
ccacaauccgcucgguc

SEQ ID NO: 1133505 - RNA, 13 nt, Mycobacterium bovis subsp bovis AF2122/97
ccacaaucgcaga

SEQ ID NO: 1133506 - RNA, 16 nt, Mycobacterium bovis subsp bovis AF2122/97
ccacaaucagcccgac

SEQ ID NO: 1133507 - RNA, 12 nt, Mycobacterium bovis subsp bovis AF2122/97
ccaaugccgcgg

SEQ ID NO: 1133508 - RNA, 18 nt, Mycobacterium bovis subsp bovis AF2122/97
ccaaugccgcggaggcgg

SEQ ID NO: 1133509 - RNA, 18 nt, Mycobacterium bovis subsp bovis AF2122/97
ccaaugcgauucugcguc

SEQ ID NO: 1133510 - RNA, 19 nt, Mycobacterium bovis subsp bovis AF2122/97
ccacaacccgcuuggcaau

SEQ ID NO: 1133511 - RNA, 18 nt, Mycobacterium bovis subsp bovis AF2122/97
ccacaaccgugagcacca

SEQ ID NO: 1133512 - RNA, 18 nt, Mycobacterium bovis subsp bovis AF2122/97
ccaaugacgucgcggauu

SEQ ID NO: 1133513 - RNA, 13 nt, Mycobacterium bovis subsp bovis AF2122/97
ccaaugacgucgg

SEQ ID NO: 1133514 - RNA, 15 nt, Mycobacterium bovis subsp bovis AF2122/97
ccaaugccaccgcgg

SEQ ID NO: 1133515 - RNA, 19 nt, Mycobacterium bovis subsp bovis AF2122/97
ccaaugccaccgcggccgc

SEQ ID NO: 1133516 - RNA, 22 nt, Mycobacterium bovis subsp bovis AF2122/97
ccaaugauucggcacgccgggc

SEQ ID NO: 1133517 - RNA, 23 nt, Mycobacterium bovis subsp bovis AF2122/97
aaagccucucuucccaaccgccc

SEQ ID NO: 1133518 - RNA, 21 nt, Mycobacterium bovis subsp bovis AF2122/97
caugccggucauccgggcgac

SEQ ID NO: 1133519 - RNA, 12 nt, Mycobacterium bovis subsp bovis AF2122/97
caugccgcccau

SEQ ID NO: 1133520 - RNA, 20 nt, Mycobacterium bovis subsp bovis AF2122/97
caugccgggauugccgucgg

SEQ ID NO: 1133521 - RNA, 13 nt, Mycobacterium bovis subsp bovis AF2122/97
caugccgguguug

SEQ ID NO: 1133522 - RNA, 21 nt, Mycobacterium bovis subsp bovis AF2122/97
caugccgucggguaggccgcc

SEQ ID NO: 1133523 - RNA, 14 nt, Mycobacterium bovis subsp bovis AF2122/97
caugccgucgucgg

SEQ ID NO: 1133524 - RNA, 19 nt, Mycobacterium bovis subsp bovis AF2122/97
caugccgugugugcgaucc

SEQ ID NO: 1133525 - RNA, 20 nt, Mycobacterium bovis subsp bovis AF2122/97
caugccgugugugcgaucca

SEQ ID NO: 1133526 - RNA, 16 nt, Mycobacterium bovis subsp bovis AF2122/97
ccaaaggacgacaccg

SEQ ID NO: 1133527 - RNA, 21 nt, Mycobacterium bovis subsp bovis AF2122/97
caugccguugauaaaaaccug

SEQ ID NO: 1133528 - RNA, 21 nt, Mycobacterium bovis subsp bovis AF2122/97
ccaacauguugucgucgccgc

SEQ ID NO: 1133529 - RNA, 16 nt, Mycobacterium bovis subsp bovis AF2122/97
ccaacagggcgccgac

SEQ ID NO: 1133530 - RNA, 18 nt, Mycobacterium bovis subsp bovis AF2122/97
ccaacagucgcagcacgg

SEQ ID NO: 1133531 - RNA, 19 nt, Mycobacterium bovis subsp bovis AF2122/97
ccaacagucgcagcacggc

SEQ ID NO: 1133532 - RNA, 22 nt, Mycobacterium bovis subsp bovis AF2122/97
ccaaccaugcgguuagcagccg

SEQ ID NO: 1133533 - RNA, 20 nt, Mycobacterium bovis subsp bovis AF2122/97
ccaaccagugcagcucgaua

SEQ ID NO: 1133534 - RNA, 23 nt, Mycobacterium bovis subsp bovis AF2122/97
ccaaccaugcugucggugccguc

SEQ ID NO: 1133535 - RNA, 20 nt, Mycobacterium bovis subsp bovis AF2122/97
ccaacccacucgcagcagca

SEQ ID NO: 1133536 - RNA, 20 nt, Mycobacterium bovis subsp bovis AF2122/97
ccaacccaggguggcgacgu

SEQ ID NO: 1133537 - RNA, 16 nt, Mycobacterium bovis subsp bovis AF2122/97
ccaaccaggccgcgac

SEQ ID NO: 1133538 - RNA, 17 nt, Mycobacterium bovis subsp bovis AF2122/97
ccaaccagugcagcucg

SEQ ID NO: 1133539 - RNA, 22 nt, Mycobacterium bovis subsp bovis AF2122/97
ccaaccacuuuccggccgaugc

SEQ ID NO: 1133540 - RNA, 13 nt, Mycobacterium bovis subsp bovis AF2122/97
ccaaccagcacca

SEQ ID NO: 1133541 - RNA, 18 nt, Mycobacterium bovis subsp bovis AF2122/97
ccaaauccggugcccgca

SEQ ID NO: 1133542 - RNA, 17 nt, Mycobacterium bovis subsp bovis AF2122/97
ccaacagcaacccgccg

SEQ ID NO: 1133543 - RNA, 13 nt, Mycobacterium bovis subsp bovis AF2122/97
ccaaaucggcauc

SEQ ID NO: 1133544 - RNA, 19 nt, Mycobacterium bovis subsp bovis AF2122/97
ccaaaucggcaucggcgac

SEQ ID NO: 1133545 - RNA, 13 nt, Mycobacterium bovis subsp bovis AF2122/97
ccaaaucggccaa

SEQ ID NO: 1133546 - RNA, 16 nt, Mycobacterium bovis subsp bovis AF2122/97
ccaacgugacgccggc

SEQ ID NO: 1133547 - RNA, 20 nt, Mycobacterium bovis subsp bovis AF2122/97
ccaacgugacgccggccagu

SEQ ID NO: 1133548 - RNA, 20 nt, Mycobacterium bovis subsp bovis AF2122/97
ccaacggugcucguguuguu

SEQ ID NO: 1133549 - RNA, 19 nt, Mycobacterium bovis subsp bovis AF2122/97
ccaacgucgccaggucauc

SEQ ID NO: 1133550 - RNA, 18 nt, Mycobacterium bovis subsp bovis AF2122/97
ccaacggcuccgggcgcu

SEQ ID NO: 1133551 - RNA, 21 nt, Mycobacterium bovis subsp bovis AF2122/97
ccaacggcuccgggcgcucgg

SEQ ID NO: 1133552 - RNA, 16 nt, Mycobacterium bovis subsp bovis AF2122/97
ccaagacgucggcgug

SEQ ID NO: 1133553 - RNA, 21 nt, Mycobacterium bovis subsp bovis AF2122/97
ccaagacuucuccgcguccgc

SEQ ID NO: 1133554 - RNA, 21 nt, Mycobacterium bovis subsp bovis AF2122/97
ccaagaaagacgcuguccagg

SEQ ID NO: 1133555 - RNA, 15 nt, Mycobacterium bovis subsp bovis AF2122/97
ccaacuuggcggcca

SEQ ID NO: 1133556 - RNA, 14 nt, Mycobacterium bovis subsp bovis AF2122/97
ccaagacaccggcc

SEQ ID NO: 1133557 - RNA, 18 nt, Mycobacterium bovis subsp bovis AF2122/97
ccaagaucggguggcggg

SEQ ID NO: 1133558 - RNA, 15 nt, Mycobacterium bovis subsp bovis AF2122/97
ccaagaugccgcccc

SEQ ID NO: 1133559 - RNA, 22 nt, Mycobacterium bovis subsp bovis AF2122/97
ccaacgcgauguccagguggcg

SEQ ID NO: 1133560 - RNA, 13 nt, Mycobacterium bovis subsp bovis AF2122/97
ccaacgccacggc

SEQ ID NO: 1133561 - RNA, 23 nt, Mycobacterium bovis subsp bovis AF2122/97
ccaacgccaaaacggucgaccgu

SEQ ID NO: 1133562 - RNA, 23 nt, Mycobacterium bovis subsp bovis AF2122/97
ccaacgcgggaacgaugccgccg

SEQ ID NO: 1133563 - RNA, 16 nt, Mycobacterium bovis subsp bovis AF2122/97
ccaacgcgggugccgg

SEQ ID NO: 1133564 - RNA, 20 nt, Mycobacterium bovis subsp bovis AF2122/97
ccaacgcgguaaagccccgc

SEQ ID NO: 1133565 - RNA, 19 nt, Mycobacterium bovis subsp bovis AF2122/97
ccaacgcggugggcacagc

SEQ ID NO: 1133566 - RNA, 13 nt, Mycobacterium bovis subsp bovis AF2122/97
ccaacgcggcgcg

SEQ ID NO: 1133567 - RNA, 17 nt, Mycobacterium bovis subsp bovis AF2122/97
ccaacgcggcgcgagcc

SEQ ID NO: 1133568 - RNA, 22 nt, Mycobacterium bovis subsp bovis AF2122/97
ccaacgacucacccacccgcac

SEQ ID NO: 1133569 - RNA, 14 nt, Mycobacterium bovis subsp bovis AF2122/97
ccaacgagcgcgcu

SEQ ID NO: 1133570 - RNA, 16 nt, Mycobacterium bovis subsp bovis AF2122/97
ccaacgagcgcgcugc

SEQ ID NO: 1133571 - RNA, 18 nt, Mycobacterium bovis subsp bovis AF2122/97
ccaacgcaacacgggcgc

SEQ ID NO: 1133572 - RNA, 21 nt, Mycobacterium bovis subsp bovis AF2122/97
ccaacgcagaucaggguggcg

SEQ ID NO: 1133573 - RNA, 23 nt, Mycobacterium bovis subsp bovis AF2122/97
ccaaccucggaucgccaggccgu

SEQ ID NO: 1133574 - RNA, 13 nt, Mycobacterium bovis subsp bovis AF2122/97
ccaaccugcgcgg

SEQ ID NO: 1133575 - RNA, 15 nt, Mycobacterium bovis subsp bovis AF2122/97
ccaaccugcgcggcg

SEQ ID NO: 1133576 - RNA, 13 nt, Mycobacterium bovis subsp bovis AF2122/97
ccaacgacagcga

SEQ ID NO: 1133577 - RNA, 15 nt, Mycobacterium bovis subsp bovis AF2122/97
ccaacgacagcgacg

SEQ ID NO: 1133578 - RNA, 13 nt, Mycobacterium bovis subsp bovis AF2122/97
ccaacgacaggug

SEQ ID NO: 1133579 - RNA, 12 nt, Mycobacterium bovis subsp bovis AF2122/97
ccaacgacauga

SEQ ID NO: 1133580 - RNA, 19 nt, Mycobacterium bovis subsp bovis AF2122/97
ccaacgaccaccaccaacg

SEQ ID NO: 1133581 - RNA, 12 nt, Mycobacterium bovis subsp bovis AF2122/97
ccaacgaccucc

SEQ ID NO: 1133582 - RNA, 18 nt, Mycobacterium bovis subsp bovis AF2122/97
ccacccgcggugccugca

SEQ ID NO: 1133583 - RNA, 14 nt, Mycobacterium bovis subsp bovis AF2122/97
ccacccgccgccgc

SEQ ID NO: 1133584 - RNA, 17 nt, Mycobacterium bovis subsp bovis AF2122/97
ccacccgccgccgcccg

SEQ ID NO: 1133585 - RNA, 19 nt, Mycobacterium bovis subsp bovis AF2122/97
ccacccgggugggccagug

SEQ ID NO: 1133586 - RNA, 15 nt, Mycobacterium bovis subsp bovis AF2122/97
ccacccggccgcgcg

SEQ ID NO: 1133587 - RNA, 21 nt, Mycobacterium bovis subsp bovis AF2122/97
ccacccggcauugagccgggc

SEQ ID NO: 1133588 - RNA, 13 nt, Mycobacterium bovis subsp bovis AF2122/97
ccacccggccagg

SEQ ID NO: 1133589 - RNA, 16 nt, Mycobacterium bovis subsp bovis AF2122/97
ccacccggcgggcggu

SEQ ID NO: 1133590 - RNA, 17 nt, Mycobacterium bovis subsp bovis AF2122/97
ccaccaucccgcucagc

SEQ ID NO: 1133591 - RNA, 16 nt, Mycobacterium bovis subsp bovis AF2122/97
ccaccaguuccggggu

SEQ ID NO: 1133592 - RNA, 13 nt, Mycobacterium bovis subsp bovis AF2122/97
ccaccagugcccc

SEQ ID NO: 1133593 - RNA, 19 nt, Mycobacterium bovis subsp bovis AF2122/97
ccaccaguaccaccggcac

SEQ ID NO: 1133594 - RNA, 17 nt, Mycobacterium bovis subsp bovis AF2122/97
ccaccaggugccgugau

SEQ ID NO: 1133595 - RNA, 20 nt, Mycobacterium bovis subsp bovis AF2122/97
ccaccaggugcgcacaggug

SEQ ID NO: 1133596 - RNA, 12 nt, Mycobacterium bovis subsp bovis AF2122/97
ccaccaggucgg

SEQ ID NO: 1133597 - RNA, 14 nt, Mycobacterium bovis subsp bovis AF2122/97
ccaccagcggcaua

SEQ ID NO: 1133598 - RNA, 12 nt, Mycobacterium bovis subsp bovis AF2122/97
ccaccaggucga

SEQ ID NO: 1133599 - RNA, 22 nt, Mycobacterium bovis subsp bovis AF2122/97
ccaccagcggcggcaacggugg

SEQ ID NO: 1133600 - RNA, 13 nt, Mycobacterium bovis subsp bovis AF2122/97
ccaccagccgggc

SEQ ID NO: 1133601 - RNA, 13 nt, Mycobacterium bovis subsp bovis AF2122/97
ccaccacgcgacg

SEQ ID NO: 1133602 - RNA, 14 nt, Mycobacterium bovis subsp bovis AF2122/97
ccaccacugcgccc

SEQ ID NO: 1133603 - RNA, 19 nt, Mycobacterium bovis subsp bovis AF2122/97
ccaccacugcgcccgccac

SEQ ID NO: 1133604 - RNA, 15 nt, Mycobacterium bovis subsp bovis AF2122/97
ccaccagccgguagc

SEQ ID NO: 1133605 - RNA, 21 nt, Mycobacterium bovis subsp bovis AF2122/97
ccaccagccgguuggcugccg

SEQ ID NO: 1133606 - RNA, 14 nt, Mycobacterium bovis subsp bovis AF2122/97
ccaccagcgacgac

SEQ ID NO: 1133607 - RNA, 18 nt, Mycobacterium bovis subsp bovis AF2122/97
ccaccagcgacgaccaca

SEQ ID NO: 1133608 - RNA, 14 nt, Mycobacterium bovis subsp bovis AF2122/97
ccaccagcgagccg

SEQ ID NO: 1133609 - RNA, 14 nt, Mycobacterium bovis subsp bovis AF2122/97
ccaccagcgccgac

SEQ ID NO: 1133610 - RNA, 14 nt, Mycobacterium bovis subsp bovis AF2122/97
ccaccagcgcccgg

SEQ ID NO: 1133611 - RNA, 16 nt, Mycobacterium bovis subsp bovis AF2122/97
ccaccagcgcccggcc

SEQ ID NO: 1133612 - RNA, 15 nt, Mycobacterium bovis subsp bovis AF2122/97
ccaccagcgcccguc

SEQ ID NO: 1133613 - RNA, 18 nt, Mycobacterium bovis subsp bovis AF2122/97
ccaccacuucggcgccgc

SEQ ID NO: 1133614 - RNA, 21 nt, Mycobacterium bovis subsp bovis AF2122/97
ccaccacuucggcgccgcgcc

SEQ ID NO: 1133615 - RNA, 23 nt, Mycobacterium bovis subsp bovis AF2122/97
ccaccacuucggcgccgcgccgu

SEQ ID NO: 1133616 - RNA, 22 nt, Mycobacterium bovis subsp bovis AF2122/97
ccaccacuaggucgccggccac

SEQ ID NO: 1133617 - RNA, 14 nt, Mycobacterium bovis subsp bovis AF2122/97
ccaccacggccaga

SEQ ID NO: 1133618 - RNA, 18 nt, Mycobacterium bovis subsp bovis AF2122/97
ccaccacaugcgagucgc

SEQ ID NO: 1133619 - RNA, 14 nt, Mycobacterium bovis subsp bovis AF2122/97
ccaccaagcucggc

SEQ ID NO: 1133620 - RNA, 20 nt, Mycobacterium bovis subsp bovis AF2122/97
ccaccaagcucggccagcac

SEQ ID NO: 1133621 - RNA, 15 nt, Mycobacterium bovis subsp bovis AF2122/97
ccaccacaccggagc

SEQ ID NO: 1133622 - RNA, 13 nt, Mycobacterium bovis subsp bovis AF2122/97
ccacacucagcac

SEQ ID NO: 1133623 - RNA, 22 nt, Mycobacterium bovis subsp bovis AF2122/97
ccacacucccgcgcccgacgca

SEQ ID NO: 1133624 - RNA, 20 nt, Mycobacterium bovis subsp bovis AF2122/97
ccacacggggccgccagcug

SEQ ID NO: 1133625 - RNA, 14 nt, Mycobacterium bovis subsp bovis AF2122/97
ccacacggugcgau

SEQ ID NO: 1133626 - RNA, 15 nt, Mycobacterium bovis subsp bovis AF2122/97
ccacagacugcgcgg

SEQ ID NO: 1133627 - RNA, 22 nt, Mycobacterium bovis subsp bovis AF2122/97
ccacacggugcgauuccgcguc

SEQ ID NO: 1133628 - RNA, 22 nt, Mycobacterium bovis subsp bovis AF2122/97
ccacaccuucgggggcgcgcgg

SEQ ID NO: 1133629 - RNA, 15 nt, Mycobacterium bovis subsp bovis AF2122/97
ccacaccuuggccgc

SEQ ID NO: 1133630 - RNA, 20 nt, Mycobacterium bovis subsp bovis AF2122/97
ccacacgcccucgacgccgc

SEQ ID NO: 1133631 - RNA, 23 nt, Mycobacterium bovis subsp bovis AF2122/97
ccacacgcccucgacgccgcgca

SEQ ID NO: 1133632 - RNA, 17 nt, Mycobacterium bovis subsp bovis AF2122/97
ccacaccggggcggccg

SEQ ID NO: 1133633 - RNA, 19 nt, Mycobacterium bovis subsp bovis AF2122/97
ccacaccgugaccagccgg

SEQ ID NO: 1133634 - RNA, 18 nt, Mycobacterium bovis subsp bovis AF2122/97
ccacauuggcgaucagca

SEQ ID NO: 1133635 - RNA, 22 nt, Mycobacterium bovis subsp bovis AF2122/97
ccacauuggcgaucagcagccg

SEQ ID NO: 1133636 - RNA, 14 nt, Mycobacterium bovis subsp bovis AF2122/97
ccacagcacccacg

SEQ ID NO: 1133637 - RNA, 22 nt, Mycobacterium bovis subsp bovis AF2122/97
ccacaccuuggccgccggccgc

SEQ ID NO: 1133638 - RNA, 20 nt, Mycobacterium bovis subsp bovis AF2122/97
ccacauuggugauggccgac

SEQ ID NO: 1133639 - RNA, 13 nt, Mycobacterium bovis subsp bovis AF2122/97
ccaccaacucggc

SEQ ID NO: 1133640 - RNA, 22 nt, Mycobacterium bovis subsp bovis AF2122/97
ccaccaacgagucagugccauc

SEQ ID NO: 1133641 - RNA, 19 nt, Mycobacterium bovis subsp bovis AF2122/97
ccaccaagcucgcaaccga

SEQ ID NO: 1133642 - RNA, 19 nt, Mycobacterium bovis subsp bovis AF2122/97
ccaccaaccucaucgcggu

SEQ ID NO: 1133643 - RNA, 23 nt, Mycobacterium bovis subsp bovis AF2122/97
ccaccaaccucaucgcggucgcc

SEQ ID NO: 1133644 - RNA, 15 nt, Mycobacterium bovis subsp bovis AF2122/97
ccaccgcggcggcgg

SEQ ID NO: 1133645 - RNA, 14 nt, Mycobacterium bovis subsp bovis AF2122/97
ccaccgcggccgcg

SEQ ID NO: 1133646 - RNA, 14 nt, Mycobacterium bovis subsp bovis AF2122/97
ccaccgcgcaggug

SEQ ID NO: 1133647 - RNA, 15 nt, Mycobacterium bovis subsp bovis AF2122/97
ccaccgcgcaggugc

SEQ ID NO: 1133648 - RNA, 18 nt, Mycobacterium bovis subsp bovis AF2122/97
ccaccgcgcggcgcagca

SEQ ID NO: 1133649 - RNA, 13 nt, Mycobacterium bovis subsp bovis AF2122/97
ccaccgcugucga

SEQ ID NO: 1133650 - RNA, 14 nt, Mycobacterium bovis subsp bovis AF2122/97
ccaccgcugccggc

SEQ ID NO: 1133651 - RNA, 19 nt, Mycobacterium bovis subsp bovis AF2122/97
ccaccgcugccggcacgca

SEQ ID NO: 1133652 - RNA, 16 nt, Mycobacterium bovis subsp bovis AF2122/97
ccaccgcugccggcgc

SEQ ID NO: 1133653 - RNA, 22 nt, Mycobacterium bovis subsp bovis AF2122/97
ccaccgcugcggcaccacccgg

SEQ ID NO: 1133654 - RNA, 16 nt, Mycobacterium bovis subsp bovis AF2122/97
ccaccgcuggcccggc

SEQ ID NO: 1133655 - RNA, 18 nt, Mycobacterium bovis subsp bovis AF2122/97
ccaccgcguuggccacac

SEQ ID NO: 1133656 - RNA, 18 nt, Mycobacterium bovis subsp bovis AF2122/97
ccaccgcggucagcucgg

SEQ ID NO: 1133657 - RNA, 20 nt, Mycobacterium bovis subsp bovis AF2122/97
ccaccgcucgucguccggcc

SEQ ID NO: 1133658 - RNA, 14 nt, Mycobacterium bovis subsp bovis AF2122/97
ccaccgcggucacc

SEQ ID NO: 1133659 - RNA, 19 nt, Mycobacterium bovis subsp bovis AF2122/97
ccaccgcgggcggcaucgc

SEQ ID NO: 1133660 - RNA, 17 nt, Mycobacterium bovis subsp bovis AF2122/97
ccaccgcgucgggccgc

SEQ ID NO: 1133661 - RNA, 18 nt, Mycobacterium bovis subsp bovis AF2122/97
ccaccgcgucgggccgca

SEQ ID NO: 1133662 - RNA, 21 nt, Mycobacterium bovis subsp bovis AF2122/97
ccaccgccgaacagugucgau

SEQ ID NO: 1133663 - RNA, 14 nt, Mycobacterium bovis subsp bovis AF2122/97
ccaccgcccgcacg

SEQ ID NO: 1133664 - RNA, 12 nt, Mycobacterium bovis subsp bovis AF2122/97
ccaccgccgaca

SEQ ID NO: 1133665 - RNA, 19 nt, Mycobacterium bovis subsp bovis AF2122/97
ccaccgccgacaggccggc

SEQ ID NO: 1133666 - RNA, 14 nt, Mycobacterium bovis subsp bovis AF2122/97
ccaccgccgccgaa

SEQ ID NO: 1133667 - RNA, 13 nt, Mycobacterium bovis subsp bovis AF2122/97
ccaccgccgccgc

SEQ ID NO: 1133668 - RNA, 22 nt, Mycobacterium bovis subsp bovis AF2122/97
ccaccgccgccgccaccggcgc

SEQ ID NO: 1133669 - RNA, 22 nt, Mycobacterium bovis subsp bovis AF2122/97
ccaccgccgccgccgacgccgc

SEQ ID NO: 1133670 - RNA, 13 nt, Mycobacterium bovis subsp bovis AF2122/97
ccaccgccgcacg

SEQ ID NO: 1133671 - RNA, 23 nt, Mycobacterium bovis subsp bovis AF2122/97
ccaccgccgacaggccggccacc

SEQ ID NO: 1133672 - RNA, 14 nt, Mycobacterium bovis subsp bovis AF2122/97
ccaccgccgacgcc

SEQ ID NO: 1133673 - RNA, 23 nt, Mycobacterium bovis subsp bovis AF2122/97
ccaccgccgagaugcuggucggc

SEQ ID NO: 1133674 - RNA, 13 nt, Mycobacterium bovis subsp bovis AF2122/97
ccaccgccgcugc

SEQ ID NO: 1133675 - RNA, 16 nt, Mycobacterium bovis subsp bovis AF2122/97
ccaccgccgcugccgg

SEQ ID NO: 1133676 - RNA, 13 nt, Mycobacterium bovis subsp bovis AF2122/97
ccaccgccggcag

SEQ ID NO: 1133677 - RNA, 16 nt, Mycobacterium bovis subsp bovis AF2122/97
ccaccgccgccugccc

SEQ ID NO: 1133678 - RNA, 19 nt, Mycobacterium bovis subsp bovis AF2122/97
ccaccgccgccugcccggc

SEQ ID NO: 1133679 - RNA, 14 nt, Mycobacterium bovis subsp bovis AF2122/97
ccaccgccgcgcgg

SEQ ID NO: 1133680 - RNA, 20 nt, Mycobacterium bovis subsp bovis AF2122/97
ccaccgccguugggccgcgc

SEQ ID NO: 1133681 - RNA, 21 nt, Mycobacterium bovis subsp bovis AF2122/97
ccaccgccguugggccgcgcc

SEQ ID NO: 1133682 - RNA, 20 nt, Mycobacterium bovis subsp bovis AF2122/97
ccaccgccuggaucagcgcg

SEQ ID NO: 1133683 - RNA, 16 nt, Mycobacterium bovis subsp bovis AF2122/97
ccaccgccugggcggc

SEQ ID NO: 1133684 - RNA, 18 nt, Mycobacterium bovis subsp bovis AF2122/97
ccaccgccugggcggcca

SEQ ID NO: 1133685 - RNA, 21 nt, Mycobacterium bovis subsp bovis AF2122/97
ccaccgccugggcggccagca

SEQ ID NO: 1133686 - RNA, 22 nt, Mycobacterium bovis subsp bovis AF2122/97
ccaccgccugggcggccagcac

SEQ ID NO: 1133687 - RNA, 16 nt, Mycobacterium bovis subsp bovis AF2122/97
ccaccgcgaccucgcg

SEQ ID NO: 1133688 - RNA, 24 nt, Mycobacterium bovis subsp bovis AF2122/97
ccaccgcgaugccccacggugcgg

SEQ ID NO: 1133689 - RNA, 16 nt, Mycobacterium bovis subsp bovis AF2122/97
ccaccgauacccccgg

SEQ ID NO: 1133690 - RNA, 20 nt, Mycobacterium bovis subsp bovis AF2122/97
ccaccgauaccgucagcgcc

SEQ ID NO: 1133691 - RNA, 17 nt, Mycobacterium bovis subsp bovis AF2122/97
ccaccgauauggccggg

SEQ ID NO: 1133692 - RNA, 16 nt, Mycobacterium bovis subsp bovis AF2122/97
ccacccgucggcccgc

SEQ ID NO: 1133693 - RNA, 18 nt, Mycobacterium bovis subsp bovis AF2122/97
ccaccgccaccacgguca

SEQ ID NO: 1133694 - RNA, 15 nt, Mycobacterium bovis subsp bovis AF2122/97
ccaccgcacaucguc

SEQ ID NO: 1133695 - RNA, 15 nt, Mycobacterium bovis subsp bovis AF2122/97
ccaccgcaccugcga

SEQ ID NO: 1133696 - RNA, 17 nt, Mycobacterium bovis subsp bovis AF2122/97
ccaccgcacgcuggcgg

SEQ ID NO: 1133697 - RNA, 23 nt, Mycobacterium bovis subsp bovis AF2122/97
ccaccgcagacgugguagccggc

SEQ ID NO: 1133698 - RNA, 17 nt, Mycobacterium bovis subsp bovis AF2122/97
ccaccgcccacagcaac

SEQ ID NO: 1133699 - RNA, 14 nt, Mycobacterium bovis subsp bovis AF2122/97
aaagcugucgaccg

SEQ ID NO: 1133700 - RNA, 17 nt, Mycobacterium bovis subsp bovis AF2122/97
aaaggacggccggccgc

SEQ ID NO: 1133701 - RNA, 16 nt, Mycobacterium bovis subsp bovis AF2122/97
ccacucccgccccgcu

SEQ ID NO: 1133702 - RNA, 15 nt, Mycobacterium bovis subsp bovis AF2122/97
ccacgugaucgacga

SEQ ID NO: 1133703 - RNA, 16 nt, Mycobacterium bovis subsp bovis AF2122/97
ccacuccaggagccga

SEQ ID NO: 1133704 - RNA, 17 nt, Mycobacterium bovis subsp bovis AF2122/97
ccacuccagcagcucgc

SEQ ID NO: 1133705 - RNA, 18 nt, Mycobacterium bovis subsp bovis AF2122/97
ccacuccagcagcucgcc

SEQ ID NO: 1133706 - RNA, 13 nt, Mycobacterium bovis subsp bovis AF2122/97
ccacgugcgccac

SEQ ID NO: 1133707 - RNA, 15 nt, Mycobacterium bovis subsp bovis AF2122/97
ccacguggggccggg

SEQ ID NO: 1133708 - RNA, 13 nt, Mycobacterium bovis subsp bovis AF2122/97
ccacugcggcaug

SEQ ID NO: 1133709 - RNA, 17 nt, Mycobacterium bovis subsp bovis AF2122/97
ccacugcggcauggcag

SEQ ID NO: 1133710 - RNA, 18 nt, Mycobacterium bovis subsp bovis AF2122/97
ccacugccguugccgccg

SEQ ID NO: 1133711 - RNA, 21 nt, Mycobacterium bovis subsp bovis AF2122/97
ccacucgggacuucccgcgag

SEQ ID NO: 1133712 - RNA, 14 nt, Mycobacterium bovis subsp bovis AF2122/97
ccacuccgugcuuc

SEQ ID NO: 1133713 - RNA, 14 nt, Mycobacterium bovis subsp bovis AF2122/97
ccacucgcccgcug

SEQ ID NO: 1133714 - RNA, 14 nt, Mycobacterium bovis subsp bovis AF2122/97
ccacucgccgcgac

SEQ ID NO: 1133715 - RNA, 15 nt, Mycobacterium bovis subsp bovis AF2122/97
ccacucgccggcgga

SEQ ID NO: 1133716 - RNA, 17 nt, Mycobacterium bovis subsp bovis AF2122/97
ccacucgccggcggacg

SEQ ID NO: 1133717 - RNA, 22 nt, Mycobacterium bovis subsp bovis AF2122/97
ccacucgccggcggacgcccgg

SEQ ID NO: 1133718 - RNA, 22 nt, Mycobacterium bovis subsp bovis AF2122/97
ccacucgcgcacauaggcgauc

SEQ ID NO: 1133719 - RNA, 21 nt, Mycobacterium bovis subsp bovis AF2122/97
ccagaaccuggagccgugcgg

SEQ ID NO: 1133720 - RNA, 20 nt, Mycobacterium bovis subsp bovis AF2122/97
ccacuucagaucggcgaauc

SEQ ID NO: 1133721 - RNA, 18 nt, Mycobacterium bovis subsp bovis AF2122/97
ccacuucagcacccggcu

SEQ ID NO: 1133722 - RNA, 18 nt, Mycobacterium bovis subsp bovis AF2122/97
ccacuguagggccgguga

SEQ ID NO: 1133723 - RNA, 18 nt, Mycobacterium bovis subsp bovis AF2122/97
ccacuguuggugccgcca

SEQ ID NO: 1133724 - RNA, 13 nt, Mycobacterium bovis subsp bovis AF2122/97
ccacugggccggu

SEQ ID NO: 1133725 - RNA, 21 nt, Mycobacterium bovis subsp bovis AF2122/97
ccacuggacucuucagcuacc

SEQ ID NO: 1133726 - RNA, 21 nt, Mycobacterium bovis subsp bovis AF2122/97
ccacuggugaucugguccggc

SEQ ID NO: 1133727 - RNA, 15 nt, Mycobacterium bovis subsp bovis AF2122/97
ccacuggugcagcgc

SEQ ID NO: 1133728 - RNA, 20 nt, Mycobacterium bovis subsp bovis AF2122/97
ccacugcguuccaucgccga

SEQ ID NO: 1133729 - RNA, 23 nt, Mycobacterium bovis subsp bovis AF2122/97
ccacugcucgauguccucgaucc

SEQ ID NO: 1133730 - RNA, 12 nt, Mycobacterium bovis subsp bovis AF2122/97
ccacuggcacac

SEQ ID NO: 1133731 - RNA, 15 nt, Mycobacterium bovis subsp bovis AF2122/97
ccacgucuccugugg

SEQ ID NO: 1133732 - RNA, 14 nt, Mycobacterium bovis subsp bovis AF2122/97
ccacgucucgauca

SEQ ID NO: 1133733 - RNA, 17 nt, Mycobacterium bovis subsp bovis AF2122/97
ccacgucucgcgaggug

SEQ ID NO: 1133734 - RNA, 13 nt, Mycobacterium bovis subsp bovis AF2122/97
ccacgucgcggcg

SEQ ID NO: 1133735 - RNA, 12 nt, Mycobacterium bovis subsp bovis AF2122/97
ccacgucggcga

SEQ ID NO: 1133736 - RNA, 16 nt, Mycobacterium bovis subsp bovis AF2122/97
ccacggucgaccagga

SEQ ID NO: 1133737 - RNA, 21 nt, Mycobacterium bovis subsp bovis AF2122/97
ccacggucgccgaccacucga

SEQ ID NO: 1133738 - RNA, 13 nt, Mycobacterium bovis subsp bovis AF2122/97
ccacggcgcagua

SEQ ID NO: 1133739 - RNA, 15 nt, Mycobacterium bovis subsp bovis AF2122/97
ccacggucagccagg

SEQ ID NO: 1133740 - RNA, 21 nt, Mycobacterium bovis subsp bovis AF2122/97
ccacggucauugggugucaau

SEQ ID NO: 1133741 - RNA, 20 nt, Mycobacterium bovis subsp bovis AF2122/97
ccacggugacccugguggug

SEQ ID NO: 1133742 - RNA, 18 nt, Mycobacterium bovis subsp bovis AF2122/97
ccacggucaagccggcgc

SEQ ID NO: 1133743 - RNA, 21 nt, Mycobacterium bovis subsp bovis AF2122/97
ccacggucaagccggcgcccg

SEQ ID NO: 1133744 - RNA, 17 nt, Mycobacterium bovis subsp bovis AF2122/97
ccacggguagcugccgc

SEQ ID NO: 1133745 - RNA, 17 nt, Mycobacterium bovis subsp bovis AF2122/97
ccacggcgaccacgccg

SEQ ID NO: 1133746 - RNA, 18 nt, Mycobacterium bovis subsp bovis AF2122/97
ccacggcgaccacgccgc

SEQ ID NO: 1133747 - RNA, 20 nt, Mycobacterium bovis subsp bovis AF2122/97
ccacggcgaccacgccgccg

SEQ ID NO: 1133748 - RNA, 17 nt, Mycobacterium bovis subsp bovis AF2122/97
ccacggcgauccggucg

SEQ ID NO: 1133749 - RNA, 15 nt, Mycobacterium bovis subsp bovis AF2122/97
ccacggcgcgcgcgc

SEQ ID NO: 1133750 - RNA, 17 nt, Mycobacterium bovis subsp bovis AF2122/97
ccacggcgcgcgcgccg

SEQ ID NO: 1133751 - RNA, 20 nt, Mycobacterium bovis subsp bovis AF2122/97
ccacgggcggccaccgcacg

SEQ ID NO: 1133752 - RNA, 21 nt, Mycobacterium bovis subsp bovis AF2122/97
ccacgggcggccaccgcacgc

SEQ ID NO: 1133753 - RNA, 13 nt, Mycobacterium bovis subsp bovis AF2122/97
ccacgggcggcca

SEQ ID NO: 1133754 - RNA, 16 nt, Mycobacterium bovis subsp bovis AF2122/97
ccacgggcggccaccg

SEQ ID NO: 1133755 - RNA, 21 nt, Mycobacterium bovis subsp bovis AF2122/97
ccacggggauuggcgacgucg

SEQ ID NO: 1133756 - RNA, 15 nt, Mycobacterium bovis subsp bovis AF2122/97
ccacggccggccgcu

SEQ ID NO: 1133757 - RNA, 20 nt, Mycobacterium bovis subsp bovis AF2122/97
ccacggccaggucgacgggc

SEQ ID NO: 1133758 - RNA, 23 nt, Mycobacterium bovis subsp bovis AF2122/97
ccagaucgcacaccaacaccgcg

SEQ ID NO: 1133759 - RNA, 14 nt, Mycobacterium bovis subsp bovis AF2122/97
ccagauccacgccg

SEQ ID NO: 1133760 - RNA, 20 nt, Mycobacterium bovis subsp bovis AF2122/97
ccagaucgcgguccgagcgg

SEQ ID NO: 1133761 - RNA, 21 nt, Mycobacterium bovis subsp bovis AF2122/97
ccagaucgcgguccgagcggc

SEQ ID NO: 1133762 - RNA, 21 nt, Mycobacterium bovis subsp bovis AF2122/97
ccagaucgcuaggaccgcggu

SEQ ID NO: 1133763 - RNA, 19 nt, Mycobacterium bovis subsp bovis AF2122/97
ccagaucguuccaggccgc

SEQ ID NO: 1133764 - RNA, 19 nt, Mycobacterium bovis subsp bovis AF2122/97
ccagaucgguugaucggcc

SEQ ID NO: 1133765 - RNA, 21 nt, Mycobacterium bovis subsp bovis AF2122/97
ccagaucgguugaucggccac

SEQ ID NO: 1133766 - RNA, 15 nt, Mycobacterium bovis subsp bovis AF2122/97
ccagaucucgcgcgc

SEQ ID NO: 1133767 - RNA, 19 nt, Mycobacterium bovis subsp bovis AF2122/97
ccagaacgguggcgcggug

SEQ ID NO: 1133768 - RNA, 13 nt, Mycobacterium bovis subsp bovis AF2122/97
ccagaacguggcc

SEQ ID NO: 1133769 - RNA, 21 nt, Mycobacterium bovis subsp bovis AF2122/97
ccagaagacgaauuggcccga

SEQ ID NO: 1133770 - RNA, 17 nt, Mycobacterium bovis subsp bovis AF2122/97
ccagaacggcgucgaau

SEQ ID NO: 1133771 - RNA, 17 nt, Mycobacterium bovis subsp bovis AF2122/97
ccagaaguaggcgaccg

SEQ ID NO: 1133772 - RNA, 21 nt, Mycobacterium bovis subsp bovis AF2122/97
ccagaaguaggcgaccgccau

SEQ ID NO: 1133773 - RNA, 22 nt, Mycobacterium bovis subsp bovis AF2122/97
ccagaaguagguuuucggcggc

SEQ ID NO: 1133774 - RNA, 17 nt, Mycobacterium bovis subsp bovis AF2122/97
ccagaaggccgcaccgc

SEQ ID NO: 1133775 - RNA, 12 nt, Mycobacterium bovis subsp bovis AF2122/97
ccagacgauggc

SEQ ID NO: 1133776 - RNA, 17 nt, Mycobacterium bovis subsp bovis AF2122/97
ccagcacccggcuucgc

SEQ ID NO: 1133777 - RNA, 23 nt, Mycobacterium bovis subsp bovis AF2122/97
ccagcacccggcuucgccgcgcu

SEQ ID NO: 1133778 - RNA, 19 nt, Mycobacterium bovis subsp bovis AF2122/97
ccagcacccgcucggccgc

SEQ ID NO: 1133779 - RNA, 13 nt, Mycobacterium bovis subsp bovis AF2122/97
ccagcaccagggc

SEQ ID NO: 1133780 - RNA, 18 nt, Mycobacterium bovis subsp bovis AF2122/97
ccagcacccccugcaccg

SEQ ID NO: 1133781 - RNA, 12 nt, Mycobacterium bovis subsp bovis AF2122/97
ccagcaccccga

SEQ ID NO: 1133782 - RNA, 20 nt, Mycobacterium bovis subsp bovis AF2122/97
ccagcaccccgaucuggcgu

SEQ ID NO: 1133783 - RNA, 15 nt, Mycobacterium bovis subsp bovis AF2122/97
ccagcaacagcccga

SEQ ID NO: 1133784 - RNA, 17 nt, Mycobacterium bovis subsp bovis AF2122/97
ccagcaaccgcucggcg

SEQ ID NO: 1133785 - RNA, 18 nt, Mycobacterium bovis subsp bovis AF2122/97
ccagcaccagcgucgcgg

SEQ ID NO: 1133786 - RNA, 16 nt, Mycobacterium bovis subsp bovis AF2122/97
ccagcaccagcacggc

SEQ ID NO: 1133787 - RNA, 20 nt, Mycobacterium bovis subsp bovis AF2122/97
ccagaugaggacgguucauc

SEQ ID NO: 1133788 - RNA, 15 nt, Mycobacterium bovis subsp bovis AF2122/97
ccagauggcucucgg

SEQ ID NO: 1133789 - RNA, 15 nt, Mycobacterium bovis subsp bovis AF2122/97
ccagauucgccgccc

SEQ ID NO: 1133790 - RNA, 18 nt, Mycobacterium bovis subsp bovis AF2122/97
ccagauucgccgcccaga

SEQ ID NO: 1133791 - RNA, 20 nt, Mycobacterium bovis subsp bovis AF2122/97
ccaccgucaugccgacgaca

SEQ ID NO: 1133792 - RNA, 15 nt, Mycobacterium bovis subsp bovis AF2122/97
ccaccgucgcugccc

SEQ ID NO: 1133793 - RNA, 17 nt, Mycobacterium bovis subsp bovis AF2122/97
ccaccgucuccggcgcc

SEQ ID NO: 1133794 - RNA, 21 nt, Mycobacterium bovis subsp bovis AF2122/97
ccaccgucauggcgggugcgg

SEQ ID NO: 1133795 - RNA, 23 nt, Mycobacterium bovis subsp bovis AF2122/97
ccaccgucuccggcgccaccgcc

SEQ ID NO: 1133796 - RNA, 16 nt, Mycobacterium bovis subsp bovis AF2122/97
ccaccgugccgggcga

SEQ ID NO: 1133797 - RNA, 16 nt, Mycobacterium bovis subsp bovis AF2122/97
ccaccucgccggccgu

SEQ ID NO: 1133798 - RNA, 20 nt, Mycobacterium bovis subsp bovis AF2122/97
ccaccuuggcugggcccgcc

SEQ ID NO: 1133799 - RNA, 20 nt, Mycobacterium bovis subsp bovis AF2122/97
ccaccuuggucuucgccguc

SEQ ID NO: 1133800 - RNA, 15 nt, Mycobacterium bovis subsp bovis AF2122/97
ccacgaacgcgcgca

SEQ ID NO: 1133801 - RNA, 17 nt, Mycobacterium bovis subsp bovis AF2122/97
ccacgaacacguucggg

SEQ ID NO: 1133802 - RNA, 14 nt, Mycobacterium bovis subsp bovis AF2122/97
ccacgacagcagag

SEQ ID NO: 1133803 - RNA, 21 nt, Mycobacterium bovis subsp bovis AF2122/97
ccacgacguucgacgacagca

SEQ ID NO: 1133804 - RNA, 19 nt, Mycobacterium bovis subsp bovis AF2122/97
ccacgacguugcgaggccg

SEQ ID NO: 1133805 - RNA, 13 nt, Mycobacterium bovis subsp bovis AF2122/97
ccaccgucgccgc

SEQ ID NO: 1133806 - RNA, 15 nt, Mycobacterium bovis subsp bovis AF2122/97
ccaccgucgccgccg

SEQ ID NO: 1133807 - RNA, 16 nt, Mycobacterium bovis subsp bovis AF2122/97
ccaccgucgccgccgg

SEQ ID NO: 1133808 - RNA, 14 nt, Mycobacterium bovis subsp bovis AF2122/97
ccaccgucgccgua

SEQ ID NO: 1133809 - RNA, 16 nt, Mycobacterium bovis subsp bovis AF2122/97
ccaccgucgccguaca

SEQ ID NO: 1133810 - RNA, 17 nt, Mycobacterium bovis subsp bovis AF2122/97
ccaccgucgcggcggca

SEQ ID NO: 1133811 - RNA, 15 nt, Mycobacterium bovis subsp bovis AF2122/97
ccaccgucacccccg

SEQ ID NO: 1133812 - RNA, 19 nt, Mycobacterium bovis subsp bovis AF2122/97
ccaccgucacccccgauac

SEQ ID NO: 1133813 - RNA, 15 nt, Mycobacterium bovis subsp bovis AF2122/97
ccaccgucaccgccg

SEQ ID NO: 1133814 - RNA, 16 nt, Mycobacterium bovis subsp bovis AF2122/97
ccaccgucaccgccgg

SEQ ID NO: 1133815 - RNA, 19 nt, Mycobacterium bovis subsp bovis AF2122/97
ccaccggcgccuccggcac

SEQ ID NO: 1133816 - RNA, 17 nt, Mycobacterium bovis subsp bovis AF2122/97
ccaccggcgccguguca

SEQ ID NO: 1133817 - RNA, 18 nt, Mycobacterium bovis subsp bovis AF2122/97
aaaggcuuccgcgugcga

SEQ ID NO: 1133818 - RNA, 14 nt, Mycobacterium bovis subsp bovis AF2122/97
aaaggucggccugc

SEQ ID NO: 1133819 - RNA, 14 nt, Mycobacterium bovis subsp bovis AF2122/97
ccaccggcacccgc

SEQ ID NO: 1133820 - RNA, 15 nt, Mycobacterium bovis subsp bovis AF2122/97
ccaccggcaccgccu

SEQ ID NO: 1133821 - RNA, 21 nt, Mycobacterium bovis subsp bovis AF2122/97
ccaccggcaccgccugcgccg

SEQ ID NO: 1133822 - RNA, 16 nt, Mycobacterium bovis subsp bovis AF2122/97
ccaccggcaccggccg

SEQ ID NO: 1133823 - RNA, 16 nt, Mycobacterium bovis subsp bovis AF2122/97
ccaccggccccaccga

SEQ ID NO: 1133824 - RNA, 18 nt, Mycobacterium bovis subsp bovis AF2122/97
ccaccggccccaccggca

SEQ ID NO: 1133825 - RNA, 19 nt, Mycobacterium bovis subsp bovis AF2122/97
ccaccggcagaugagucaa

SEQ ID NO: 1133826 - RNA, 12 nt, Mycobacterium bovis subsp bovis AF2122/97
ccaccggcaccc

SEQ ID NO: 1133827 - RNA, 15 nt, Mycobacterium bovis subsp bovis AF2122/97
ccaccggcacccccg

SEQ ID NO: 1133828 - RNA, 21 nt, Mycobacterium bovis subsp bovis AF2122/97
ccaccggcacccccgucgcca

SEQ ID NO: 1133829 - RNA, 20 nt, Mycobacterium bovis subsp bovis AF2122/97
ccaccggaccgaccaccgcg

SEQ ID NO: 1133830 - RNA, 15 nt, Mycobacterium bovis subsp bovis AF2122/97
ccaccggaucgucga

SEQ ID NO: 1133831 - RNA, 21 nt, Mycobacterium bovis subsp bovis AF2122/97
ccaccggaucgucgaacagca

SEQ ID NO: 1133832 - RNA, 21 nt, Mycobacterium bovis subsp bovis AF2122/97
ccaccggaauacgcgccgccg

SEQ ID NO: 1133833 - RNA, 18 nt, Mycobacterium bovis subsp bovis AF2122/97
ccaccggaccaccgccga

SEQ ID NO: 1133834 - RNA, 19 nt, Mycobacterium bovis subsp bovis AF2122/97
ccaccggaccaccgccgaa

SEQ ID NO: 1133835 - RNA, 15 nt, Mycobacterium bovis subsp bovis AF2122/97
ccaccggcccucgcc

SEQ ID NO: 1133836 - RNA, 14 nt, Mycobacterium bovis subsp bovis AF2122/97
ccaccggccgcgca

SEQ ID NO: 1133837 - RNA, 13 nt, Mycobacterium bovis subsp bovis AF2122/97
ccaccggccacca

SEQ ID NO: 1133838 - RNA, 12 nt, Mycobacterium bovis subsp bovis AF2122/97
ccaccggccagu

SEQ ID NO: 1133839 - RNA, 18 nt, Mycobacterium bovis subsp bovis AF2122/97
aaaggcgacucggugcgg

SEQ ID NO: 1133840 - RNA, 19 nt, Mycobacterium bovis subsp bovis AF2122/97
ccaccggcgccaccggcgc

SEQ ID NO: 1133841 - RNA, 17 nt, Mycobacterium bovis subsp bovis AF2122/97
ccaccggcgccgcccgc

SEQ ID NO: 1133842 - RNA, 15 nt, Mycobacterium bovis subsp bovis AF2122/97
ccaccggcgccgccg

SEQ ID NO: 1133843 - RNA, 18 nt, Mycobacterium bovis subsp bovis AF2122/97
ccaccggcgccgccggca

SEQ ID NO: 1133844 - RNA, 19 nt, Mycobacterium bovis subsp bovis AF2122/97
ccacgcucgggcgcgcucg

SEQ ID NO: 1133845 - RNA, 19 nt, Mycobacterium bovis subsp bovis AF2122/97
ccacgcucggugcugcgcc

SEQ ID NO: 1133846 - RNA, 16 nt, Mycobacterium bovis subsp bovis AF2122/97
ccacgcuccccagcga

SEQ ID NO: 1133847 - RNA, 22 nt, Mycobacterium bovis subsp bovis AF2122/97
ccacgcgcagaaagucgcgcgc

SEQ ID NO: 1133848 - RNA, 13 nt, Mycobacterium bovis subsp bovis AF2122/97
ccacgcgcccgca

SEQ ID NO: 1133849 - RNA, 15 nt, Mycobacterium bovis subsp bovis AF2122/97
ccacgcgccgcacau

SEQ ID NO: 1133850 - RNA, 20 nt, Mycobacterium bovis subsp bovis AF2122/97
ccacggaucgcggcggcgug

SEQ ID NO: 1133851 - RNA, 16 nt, Mycobacterium bovis subsp bovis AF2122/97
ccacggaccagcgccg

SEQ ID NO: 1133852 - RNA, 16 nt, Mycobacterium bovis subsp bovis AF2122/97
ccacggcaccgaucaa

SEQ ID NO: 1133853 - RNA, 13 nt, Mycobacterium bovis subsp bovis AF2122/97
ccacggcaagcca

SEQ ID NO: 1133854 - RNA, 23 nt, Mycobacterium bovis subsp bovis AF2122/97
ccacggcaagccaaccagcccgg

SEQ ID NO: 1133855 - RNA, 22 nt, Mycobacterium bovis subsp bovis AF2122/97
ccacggcaagcgugacccgccg

SEQ ID NO: 1133856 - RNA, 14 nt, Mycobacterium bovis subsp bovis AF2122/97
ccacggcagcgccg

SEQ ID NO: 1133857 - RNA, 17 nt, Mycobacterium bovis subsp bovis AF2122/97
ccacggcaucggccacc

SEQ ID NO: 1133858 - RNA, 16 nt, Mycobacterium bovis subsp bovis AF2122/97
ccacggcauucgaccu

SEQ ID NO: 1133859 - RNA, 15 nt, Mycobacterium bovis subsp bovis AF2122/97
ccacgcuggcgcccc

SEQ ID NO: 1133860 - RNA, 14 nt, Mycobacterium bovis subsp bovis AF2122/97
ccacgcuggcgcgu

SEQ ID NO: 1133861 - RNA, 18 nt, Mycobacterium bovis subsp bovis AF2122/97
ccacgcugucccgcgggc

SEQ ID NO: 1133862 - RNA, 19 nt, Mycobacterium bovis subsp bovis AF2122/97
ccacgcuucuuccgcgcgc

SEQ ID NO: 1133863 - RNA, 18 nt, Mycobacterium bovis subsp bovis AF2122/97
ccacgcgcucggugccgc

SEQ ID NO: 1133864 - RNA, 21 nt, Mycobacterium bovis subsp bovis AF2122/97
ccacgcugcccacgggccggc

SEQ ID NO: 1133865 - RNA, 17 nt, Mycobacterium bovis subsp bovis AF2122/97
ccacgccaccgcgguca

SEQ ID NO: 1133866 - RNA, 14 nt, Mycobacterium bovis subsp bovis AF2122/97
ccacgccagcgcga

SEQ ID NO: 1133867 - RNA, 15 nt, Mycobacterium bovis subsp bovis AF2122/97
ccacgccagcccguc

SEQ ID NO: 1133868 - RNA, 13 nt, Mycobacterium bovis subsp bovis AF2122/97
ccacgccaccgcg

SEQ ID NO: 1133869 - RNA, 15 nt, Mycobacterium bovis subsp bovis AF2122/97
ccacgccaccgcggu

SEQ ID NO: 1133870 - RNA, 21 nt, Mycobacterium bovis subsp bovis AF2122/97
ccacgcccaauguccaggcgc

SEQ ID NO: 1133871 - RNA, 17 nt, Mycobacterium bovis subsp bovis AF2122/97
ccacgcccacaggggca

SEQ ID NO: 1133872 - RNA, 23 nt, Mycobacterium bovis subsp bovis AF2122/97
ccacgcccacaggggcagcgcgg

SEQ ID NO: 1133873 - RNA, 21 nt, Mycobacterium bovis subsp bovis AF2122/97
ccacgcccagcgcccgcgcgg

SEQ ID NO: 1133874 - RNA, 20 nt, Mycobacterium bovis subsp bovis AF2122/97
ccacgcagaggcggcuggcg

SEQ ID NO: 1133875 - RNA, 18 nt, Mycobacterium bovis subsp bovis AF2122/97
ccacgcaugcgcgcgccg

SEQ ID NO: 1133876 - RNA, 21 nt, Mycobacterium bovis subsp bovis AF2122/97
ccacgcaugcgcgcgccggug

SEQ ID NO: 1133877 - RNA, 13 nt, Mycobacterium bovis subsp bovis AF2122/97
ccacgcacccggc

SEQ ID NO: 1133878 - RNA, 17 nt, Mycobacterium bovis subsp bovis AF2122/97
ccacgauuugguagcgg

SEQ ID NO: 1133879 - RNA, 21 nt, Mycobacterium bovis subsp bovis AF2122/97
ccacgauuugguagcggaucg

SEQ ID NO: 1133880 - RNA, 20 nt, Mycobacterium bovis subsp bovis AF2122/97
ccacgcaaaguucgucacca

SEQ ID NO: 1133881 - RNA, 13 nt, Mycobacterium bovis subsp bovis AF2122/97
ccacgaugccggc

SEQ ID NO: 1133882 - RNA, 20 nt, Mycobacterium bovis subsp bovis AF2122/97
ccacgaugcgcacaccgacc

SEQ ID NO: 1133883 - RNA, 14 nt, Mycobacterium bovis subsp bovis AF2122/97
ccacgaugucgucg

SEQ ID NO: 1133884 - RNA, 23 nt, Mycobacterium bovis subsp bovis AF2122/97
ccacgaugaccaugaugaccggc

SEQ ID NO: 1133885 - RNA, 23 nt, Mycobacterium bovis subsp bovis AF2122/97
ccacgaugaucagggucagcgcc

SEQ ID NO: 1133886 - RNA, 18 nt, Mycobacterium bovis subsp bovis AF2122/97
ccacgaugaucccaagcg

SEQ ID NO: 1133887 - RNA, 22 nt, Mycobacterium bovis subsp bovis AF2122/97
ccacgaugaucuugccgcggcg

SEQ ID NO: 1133888 - RNA, 16 nt, Mycobacterium bovis subsp bovis AF2122/97
ccacgaucggcccagc

SEQ ID NO: 1133889 - RNA, 20 nt, Mycobacterium bovis subsp bovis AF2122/97
ccaggcgcgcaccaccgcgg

SEQ ID NO: 1133890 - RNA, 23 nt, Mycobacterium bovis subsp bovis AF2122/97
ccaggcgcgacguagacgacguc

SEQ ID NO: 1133891 - RNA, 13 nt, Mycobacterium bovis subsp bovis AF2122/97
ccaggcgcgccgc

SEQ ID NO: 1133892 - RNA, 13 nt, Mycobacterium bovis subsp bovis AF2122/97
ccaggcguucgac

SEQ ID NO: 1133893 - RNA, 14 nt, Mycobacterium bovis subsp bovis AF2122/97
ccaggcgcucauca

SEQ ID NO: 1133894 - RNA, 21 nt, Mycobacterium bovis subsp bovis AF2122/97
ccaggcgcucagcgcggccac

SEQ ID NO: 1133895 - RNA, 17 nt, Mycobacterium bovis subsp bovis AF2122/97
ccaggcgcucagcgcgg

SEQ ID NO: 1133896 - RNA, 12 nt, Mycobacterium bovis subsp bovis AF2122/97
ccaggcgcggcg

SEQ ID NO: 1133897 - RNA, 17 nt, Mycobacterium bovis subsp bovis AF2122/97
ccagggcacguggcggu

SEQ ID NO: 1133898 - RNA, 19 nt, Mycobacterium bovis subsp bovis AF2122/97
ccagggcacguucggcgca

SEQ ID NO: 1133899 - RNA, 20 nt, Mycobacterium bovis subsp bovis AF2122/97
ccagggcacguucggcgcac

SEQ ID NO: 1133900 - RNA, 19 nt, Mycobacterium bovis subsp bovis AF2122/97
ccaggcugaagaacgcguc

SEQ ID NO: 1133901 - RNA, 22 nt, Mycobacterium bovis subsp bovis AF2122/97
ccaggcuaauagcucgccggcg

SEQ ID NO: 1133902 - RNA, 18 nt, Mycobacterium bovis subsp bovis AF2122/97
ccaggcuauggugccggu

SEQ ID NO: 1133903 - RNA, 16 nt, Mycobacterium bovis subsp bovis AF2122/97
ccaggcuccggccggc

SEQ ID NO: 1133904 - RNA, 21 nt, Mycobacterium bovis subsp bovis AF2122/97
ccaggcuccggccggccagca

SEQ ID NO: 1133905 - RNA, 13 nt, Mycobacterium bovis subsp bovis AF2122/97
ccaggccggcagc

SEQ ID NO: 1133906 - RNA, 14 nt, Mycobacterium bovis subsp bovis AF2122/97
ccaggccggcccgc

SEQ ID NO: 1133907 - RNA, 15 nt, Mycobacterium bovis subsp bovis AF2122/97
ccaggccggugacgg

SEQ ID NO: 1133908 - RNA, 20 nt, Mycobacterium bovis subsp bovis AF2122/97
ccaggccguagcccacgacg

SEQ ID NO: 1133909 - RNA, 22 nt, Mycobacterium bovis subsp bovis AF2122/97
ccaggccguagcccacgacgaa

SEQ ID NO: 1133910 - RNA, 19 nt, Mycobacterium bovis subsp bovis AF2122/97
ccaggccgucguugccggc

SEQ ID NO: 1133911 - RNA, 22 nt, Mycobacterium bovis subsp bovis AF2122/97
ccaggccgucguugccggcgac

SEQ ID NO: 1133912 - RNA, 17 nt, Mycobacterium bovis subsp bovis AF2122/97
ccaggccguacgacggc

SEQ ID NO: 1133913 - RNA, 19 nt, Mycobacterium bovis subsp bovis AF2122/97
ccaggccguaguggccggc

SEQ ID NO: 1133914 - RNA, 16 nt, Mycobacterium bovis subsp bovis AF2122/97
ccaggccucgcaccgg

SEQ ID NO: 1133915 - RNA, 14 nt, Mycobacterium bovis subsp bovis AF2122/97
ccaggcacguccga

SEQ ID NO: 1133916 - RNA, 23 nt, Mycobacterium bovis subsp bovis AF2122/97
ccaggcacguccgaucggcgcgc

SEQ ID NO: 1133917 - RNA, 17 nt, Mycobacterium bovis subsp bovis AF2122/97
ccaggcacuccagcggc

SEQ ID NO: 1133918 - RNA, 13 nt, Mycobacterium bovis subsp bovis AF2122/97
ccaggccgcgcga

SEQ ID NO: 1133919 - RNA, 14 nt, Mycobacterium bovis subsp bovis AF2122/97
ccaggccgcgcgac

SEQ ID NO: 1133920 - RNA, 22 nt, Mycobacterium bovis subsp bovis AF2122/97
ccaggucgccuuucauagcuga

SEQ ID NO: 1133921 - RNA, 16 nt, Mycobacterium bovis subsp bovis AF2122/97
ccaggucggccaccgu

SEQ ID NO: 1133922 - RNA, 13 nt, Mycobacterium bovis subsp bovis AF2122/97
ccaggucggccac

SEQ ID NO: 1133923 - RNA, 14 nt, Mycobacterium bovis subsp bovis AF2122/97
ccaggucggucauc

SEQ ID NO: 1133924 - RNA, 18 nt, Mycobacterium bovis subsp bovis AF2122/97
ccaggucggugacgaaga

SEQ ID NO: 1133925 - RNA, 23 nt, Mycobacterium bovis subsp bovis AF2122/97
ccaggucggugugcaucgccggc

SEQ ID NO: 1133926 - RNA, 22 nt, Mycobacterium bovis subsp bovis AF2122/97
ccagguggaccggccuggcucg

SEQ ID NO: 1133927 - RNA, 12 nt, Mycobacterium bovis subsp bovis AF2122/97
ccaggucggcga

SEQ ID NO: 1133928 - RNA, 20 nt, Mycobacterium bovis subsp bovis AF2122/97
ccagguggccgcucuccacc

SEQ ID NO: 1133929 - RNA, 21 nt, Mycobacterium bovis subsp bovis AF2122/97
ccaggucgcgauagccgccgc

SEQ ID NO: 1133930 - RNA, 14 nt, Mycobacterium bovis subsp bovis AF2122/97
ccagguggccaggc

SEQ ID NO: 1133931 - RNA, 20 nt, Mycobacterium bovis subsp bovis AF2122/97
ccaggugucgucgaucgcgg

SEQ ID NO: 1133932 - RNA, 21 nt, Mycobacterium bovis subsp bovis AF2122/97
ccaggugucgucgaucgcgga

SEQ ID NO: 1133933 - RNA, 14 nt, Mycobacterium bovis subsp bovis AF2122/97
ccaguaccaccggc

SEQ ID NO: 1133934 - RNA, 21 nt, Mycobacterium bovis subsp bovis AF2122/97
ccaguaccaccggcaccggcc

SEQ ID NO: 1133935 - RNA, 22 nt, Mycobacterium bovis subsp bovis AF2122/97
ccaguaccacuguuacggccac

SEQ ID NO: 1133936 - RNA, 14 nt, Mycobacterium bovis subsp bovis AF2122/97
ccagguguugacga

SEQ ID NO: 1133937 - RNA, 18 nt, Mycobacterium bovis subsp bovis AF2122/97
ccaguaccgucaucgcgg

SEQ ID NO: 1133938 - RNA, 19 nt, Mycobacterium bovis subsp bovis AF2122/97
ccagggcgguggccacccg

SEQ ID NO: 1133939 - RNA, 21 nt, Mycobacterium bovis subsp bovis AF2122/97
ccagggcucggcggcccggcc

SEQ ID NO: 1133940 - RNA, 17 nt, Mycobacterium bovis subsp bovis AF2122/97
ccagguaauugccgacc

SEQ ID NO: 1133941 - RNA, 23 nt, Mycobacterium bovis subsp bovis AF2122/97
ccagguacucaguguuccgccac

SEQ ID NO: 1133942 - RNA, 15 nt, Mycobacterium bovis subsp bovis AF2122/97
ccaggucagccgcgc

SEQ ID NO: 1133943 - RNA, 17 nt, Mycobacterium bovis subsp bovis AF2122/97
ccaggucagccgcgcgg

SEQ ID NO: 1133944 - RNA, 22 nt, Mycobacterium bovis subsp bovis AF2122/97
ccaggucauauugugggugcga

SEQ ID NO: 1133945 - RNA, 15 nt, Mycobacterium bovis subsp bovis AF2122/97
ccagguagugcacac

SEQ ID NO: 1133946 - RNA, 16 nt, Mycobacterium bovis subsp bovis AF2122/97
ccagguauguccgcca

SEQ ID NO: 1133947 - RNA, 18 nt, Mycobacterium bovis subsp bovis AF2122/97
ccagggcggcauccccag

SEQ ID NO: 1133948 - RNA, 15 nt, Mycobacterium bovis subsp bovis AF2122/97
ccagggccuucgggc

SEQ ID NO: 1133949 - RNA, 13 nt, Mycobacterium bovis subsp bovis AF2122/97
ccagggccgccgc

SEQ ID NO: 1133950 - RNA, 13 nt, Mycobacterium bovis subsp bovis AF2122/97
ccagggccaccgc

SEQ ID NO: 1133951 - RNA, 14 nt, Mycobacterium bovis subsp bovis AF2122/97
ccagggccaccgcg

SEQ ID NO: 1133952 - RNA, 15 nt, Mycobacterium bovis subsp bovis AF2122/97
ccagggccaccgcgc

SEQ ID NO: 1133953 - RNA, 17 nt, Mycobacterium bovis subsp bovis AF2122/97
ccagggccaccgcgccg

SEQ ID NO: 1133954 - RNA, 17 nt, Mycobacterium bovis subsp bovis AF2122/97
ccagggcagcggccagg

SEQ ID NO: 1133955 - RNA, 14 nt, Mycobacterium bovis subsp bovis AF2122/97
ccagggcagugcga

SEQ ID NO: 1133956 - RNA, 14 nt, Mycobacterium bovis subsp bovis AF2122/97
ccaggaagucccgg

SEQ ID NO: 1133957 - RNA, 23 nt, Mycobacterium bovis subsp bovis AF2122/97
ccaggaaugucuccaguagccgg

SEQ ID NO: 1133958 - RNA, 20 nt, Mycobacterium bovis subsp bovis AF2122/97
ccaggaauuccccaccgucg

SEQ ID NO: 1133959 - RNA, 18 nt, Mycobacterium bovis subsp bovis AF2122/97
ccaggacagcagccgccg

SEQ ID NO: 1133960 - RNA, 19 nt, Mycobacterium bovis subsp bovis AF2122/97
ccaggacagcagccgccgg

SEQ ID NO: 1133961 - RNA, 14 nt, Mycobacterium bovis subsp bovis AF2122/97
ccaggaccggcugc

SEQ ID NO: 1133962 - RNA, 16 nt, Mycobacterium bovis subsp bovis AF2122/97
ccaggaccggcugcag

SEQ ID NO: 1133963 - RNA, 20 nt, Mycobacterium bovis subsp bovis AF2122/97
ccaggaaguagaugagcaga

SEQ ID NO: 1133964 - RNA, 17 nt, Mycobacterium bovis subsp bovis AF2122/97
ccaggaaggcgacgccg

SEQ ID NO: 1133965 - RNA, 16 nt, Mycobacterium bovis subsp bovis AF2122/97
ccaggaacucggccca

SEQ ID NO: 1133966 - RNA, 14 nt, Mycobacterium bovis subsp bovis AF2122/97
ccagcuugcgccgc

SEQ ID NO: 1133967 - RNA, 20 nt, Mycobacterium bovis subsp bovis AF2122/97
ccagcuuggagaggcggugc

SEQ ID NO: 1133968 - RNA, 17 nt, Mycobacterium bovis subsp bovis AF2122/97
ccagcuuguagcgcucg

SEQ ID NO: 1133969 - RNA, 15 nt, Mycobacterium bovis subsp bovis AF2122/97
ccaggaacccgugga

SEQ ID NO: 1133970 - RNA, 14 nt, Mycobacterium bovis subsp bovis AF2122/97
ccaggaaccgcagu

SEQ ID NO: 1133971 - RNA, 21 nt, Mycobacterium bovis subsp bovis AF2122/97
ccagcuugaccgaccacgcga

SEQ ID NO: 1133972 - RNA, 20 nt, Mycobacterium bovis subsp bovis AF2122/97
ccagcuugcggugaucccac

SEQ ID NO: 1133973 - RNA, 16 nt, Mycobacterium bovis subsp bovis AF2122/97
ccagcuucccgcuggu

SEQ ID NO: 1133974 - RNA, 17 nt, Mycobacterium bovis subsp bovis AF2122/97
ccagcuucggcuggcgu

SEQ ID NO: 1133975 - RNA, 16 nt, Mycobacterium bovis subsp bovis AF2122/97
ccaggcaaccggucag

SEQ ID NO: 1133976 - RNA, 17 nt, Mycobacterium bovis subsp bovis AF2122/97
ccaggcaaccggucagc

SEQ ID NO: 1133977 - RNA, 17 nt, Mycobacterium bovis subsp bovis AF2122/97
ccaggaucagcccggac

SEQ ID NO: 1133978 - RNA, 18 nt, Mycobacterium bovis subsp bovis AF2122/97
ccaggaucgcguggcgca

SEQ ID NO: 1133979 - RNA, 19 nt, Mycobacterium bovis subsp bovis AF2122/97
ccaggaucgcuacgucgac

SEQ ID NO: 1133980 - RNA, 14 nt, Mycobacterium bovis subsp bovis AF2122/97
ccaggaucgcggcg

SEQ ID NO: 1133981 - RNA, 15 nt, Mycobacterium bovis subsp bovis AF2122/97
ccaggaucgcggcgc

SEQ ID NO: 1133982 - RNA, 12 nt, Mycobacterium bovis subsp bovis AF2122/97
ccaggaucgcgu

SEQ ID NO: 1133983 - RNA, 13 nt, Mycobacterium bovis subsp bovis AF2122/97
ccaggaucgccgc

SEQ ID NO: 1133984 - RNA, 23 nt, Mycobacterium bovis subsp bovis AF2122/97
ccaggauccgaccccgcgccgac

SEQ ID NO: 1133985 - RNA, 12 nt, Mycobacterium bovis subsp bovis AF2122/97
ccaggaccgcgc

SEQ ID NO: 1133986 - RNA, 21 nt, Mycobacterium bovis subsp bovis AF2122/97
ccaggacggcuaccaccgcac

SEQ ID NO: 1133987 - RNA, 14 nt, Mycobacterium bovis subsp bovis AF2122/97
ccaggacggucgcc

SEQ ID NO: 1133988 - RNA, 17 nt, Mycobacterium bovis subsp bovis AF2122/97
ccaggacgacgccgacg

SEQ ID NO: 1133989 - RNA, 19 nt, Mycobacterium bovis subsp bovis AF2122/97
ccaggacgacgccgacgau

SEQ ID NO: 1133990 - RNA, 16 nt, Mycobacterium bovis subsp bovis AF2122/97
ccaggacuccggccgc

SEQ ID NO: 1133991 - RNA, 22 nt, Mycobacterium bovis subsp bovis AF2122/97
ccaggacuccggccgcacgccg

SEQ ID NO: 1133992 - RNA, 18 nt, Mycobacterium bovis subsp bovis AF2122/97
ccaggacuggcaccgcca

SEQ ID NO: 1133993 - RNA, 18 nt, Mycobacterium bovis subsp bovis AF2122/97
ccaggagagaucgucgac

SEQ ID NO: 1133994 - RNA, 21 nt, Mycobacterium bovis subsp bovis AF2122/97
ccaggagcaccucgaagugca

SEQ ID NO: 1133995 - RNA, 22 nt, Mycobacterium bovis subsp bovis AF2122/97
ccaggagccuccagcgcaccgg

SEQ ID NO: 1133996 - RNA, 17 nt, Mycobacterium bovis subsp bovis AF2122/97
ccaggagcgcggcccgc

SEQ ID NO: 1133997 - RNA, 20 nt, Mycobacterium bovis subsp bovis AF2122/97
ccaggagcgugucggccggc

SEQ ID NO: 1133998 - RNA, 22 nt, Mycobacterium bovis subsp bovis AF2122/97
ccaggagugcgggcaugccggc

SEQ ID NO: 1133999 - RNA, 13 nt, Mycobacterium bovis subsp bovis AF2122/97
ccagcuggccggg

SEQ ID NO: 1134000 - RNA, 22 nt, Mycobacterium bovis subsp bovis AF2122/97
ccagcuggccgggugcgugcgc

SEQ ID NO: 1134001 - RNA, 16 nt, Mycobacterium bovis subsp bovis AF2122/97
ccagcuguccucgcgg

SEQ ID NO: 1134002 - RNA, 16 nt, Mycobacterium bovis subsp bovis AF2122/97
ccagcugucgggcagc

SEQ ID NO: 1134003 - RNA, 19 nt, Mycobacterium bovis subsp bovis AF2122/97
ccagcugcggcuccggcgg

SEQ ID NO: 1134004 - RNA, 15 nt, Mycobacterium bovis subsp bovis AF2122/97
ccagcugcgcgaugu

SEQ ID NO: 1134005 - RNA, 15 nt, Mycobacterium bovis subsp bovis AF2122/97
ccagcugccggcgac

SEQ ID NO: 1134006 - RNA, 12 nt, Mycobacterium bovis subsp bovis AF2122/97
ccagcugcgagu

SEQ ID NO: 1134007 - RNA, 14 nt, Mycobacterium bovis subsp bovis AF2122/97
ccagcugcgagucg

SEQ ID NO: 1134008 - RNA, 16 nt, Mycobacterium bovis subsp bovis AF2122/97
ccagcucggcggcagc

SEQ ID NO: 1134009 - RNA, 14 nt, Mycobacterium bovis subsp bovis AF2122/97
ccagcucggcgggc

SEQ ID NO: 1134010 - RNA, 15 nt, Mycobacterium bovis subsp bovis AF2122/97
ccagcucggcgggcu

SEQ ID NO: 1134011 - RNA, 19 nt, Mycobacterium bovis subsp bovis AF2122/97
ccagcucgggggcgccggc

SEQ ID NO: 1134012 - RNA, 14 nt, Mycobacterium bovis subsp bovis AF2122/97
ccagcugagccguc

SEQ ID NO: 1134013 - RNA, 17 nt, Mycobacterium bovis subsp bovis AF2122/97
ccagcugagcggccggc

SEQ ID NO: 1134014 - RNA, 21 nt, Mycobacterium bovis subsp bovis AF2122/97
ccagcugagcggccggcaugc

SEQ ID NO: 1134015 - RNA, 14 nt, Mycobacterium bovis subsp bovis AF2122/97
ccagcugcccgacg

SEQ ID NO: 1134016 - RNA, 13 nt, Mycobacterium bovis subsp bovis AF2122/97
ccagcuccgccug

SEQ ID NO: 1134017 - RNA, 20 nt, Mycobacterium bovis subsp bovis AF2122/97
ccagcucccgggcggcggcc

SEQ ID NO: 1134018 - RNA, 20 nt, Mycobacterium bovis subsp bovis AF2122/97
ccagcuccgggucgacgacg

SEQ ID NO: 1134019 - RNA, 20 nt, Mycobacterium bovis subsp bovis AF2122/97
ccagcuccucagccaccgcg

SEQ ID NO: 1134020 - RNA, 20 nt, Mycobacterium bovis subsp bovis AF2122/97
ccagcucgaacagguuggcc

SEQ ID NO: 1134021 - RNA, 16 nt, Mycobacterium bovis subsp bovis AF2122/97
ccagcucgcggugggc

SEQ ID NO: 1134022 - RNA, 12 nt, Mycobacterium bovis subsp bovis AF2122/97
ccagcucggcac

SEQ ID NO: 1134023 - RNA, 17 nt, Mycobacterium bovis subsp bovis AF2122/97
ccagcucggcacccgcc

SEQ ID NO: 1134024 - RNA, 13 nt, Mycobacterium bovis subsp bovis AF2122/97
ccagcucggccag

SEQ ID NO: 1134025 - RNA, 16 nt, Mycobacterium bovis subsp bovis AF2122/97
ccagcucacgaugucg

SEQ ID NO: 1134026 - RNA, 23 nt, Mycobacterium bovis subsp bovis AF2122/97
ccagcucacccggagcacccggg

SEQ ID NO: 1134027 - RNA, 14 nt, Mycobacterium bovis subsp bovis AF2122/97
ccagcucacccugc

SEQ ID NO: 1134028 - RNA, 15 nt, Mycobacterium bovis subsp bovis AF2122/97
ccagcuccacaagua

SEQ ID NO: 1134029 - RNA, 14 nt, Mycobacterium bovis subsp bovis AF2122/97
ccagcguucccgcc

SEQ ID NO: 1134030 - RNA, 15 nt, Mycobacterium bovis subsp bovis AF2122/97
ccagcguucccgccg

SEQ ID NO: 1134031 - RNA, 17 nt, Mycobacterium bovis subsp bovis AF2122/97
ccagcguucccgccggc

SEQ ID NO: 1134032 - RNA, 18 nt, Mycobacterium bovis subsp bovis AF2122/97
ccagcguucccgccggcu

SEQ ID NO: 1134033 - RNA, 16 nt, Mycobacterium bovis subsp bovis AF2122/97
ccagcgugucccaacg

SEQ ID NO: 1134034 - RNA, 14 nt, Mycobacterium bovis subsp bovis AF2122/97
ccagcguuggcggc

SEQ ID NO: 1134035 - RNA, 19 nt, Mycobacterium bovis subsp bovis AF2122/97
ccagcguuggcggcgaucc

SEQ ID NO: 1134036 - RNA, 20 nt, Mycobacterium bovis subsp bovis AF2122/97
ccagcguugucggguggcug

SEQ ID NO: 1134037 - RNA, 15 nt, Mycobacterium bovis subsp bovis AF2122/97
ccagcuagguccgaa

SEQ ID NO: 1134038 - RNA, 22 nt, Mycobacterium bovis subsp bovis AF2122/97
ccagcuauugcuauuccgcggc

SEQ ID NO: 1134039 - RNA, 14 nt, Mycobacterium bovis subsp bovis AF2122/97
ccagccggccgcga

SEQ ID NO: 1134040 - RNA, 15 nt, Mycobacterium bovis subsp bovis AF2122/97
ccagccggccgcgac

SEQ ID NO: 1134041 - RNA, 13 nt, Mycobacterium bovis subsp bovis AF2122/97
ccagccggcgcac

SEQ ID NO: 1134042 - RNA, 13 nt, Mycobacterium bovis subsp bovis AF2122/97
ccagccgcgccag

SEQ ID NO: 1134043 - RNA, 22 nt, Mycobacterium bovis subsp bovis AF2122/97
ccagccggcgagaaacacgaca

SEQ ID NO: 1134044 - RNA, 23 nt, Mycobacterium bovis subsp bovis AF2122/97
ccagccggcgagaaacacgacag

SEQ ID NO: 1134045 - RNA, 11 nt, Mycobacterium bovis subsp bovis AF2122/97
ccagccggcgc

SEQ ID NO: 1134046 - RNA, 15 nt, Mycobacterium bovis subsp bovis AF2122/97
ccagccggcgcgccg

SEQ ID NO: 1134047 - RNA, 18 nt, Mycobacterium bovis subsp bovis AF2122/97
ccagcgaaccgacccggc

SEQ ID NO: 1134048 - RNA, 23 nt, Mycobacterium bovis subsp bovis AF2122/97
ccagccgguccagacccagcucg

SEQ ID NO: 1134049 - RNA, 15 nt, Mycobacterium bovis subsp bovis AF2122/97
ccagcgaaucacccg

SEQ ID NO: 1134050 - RNA, 18 nt, Mycobacterium bovis subsp bovis AF2122/97
ccagcgaauccaggccgu

SEQ ID NO: 1134051 - RNA, 20 nt, Mycobacterium bovis subsp bovis AF2122/97
ccagcgacgcggccagcggc

SEQ ID NO: 1134052 - RNA, 17 nt, Mycobacterium bovis subsp bovis AF2122/97
ccagcgacgcggucauc

SEQ ID NO: 1134053 - RNA, 19 nt, Mycobacterium bovis subsp bovis AF2122/97
ccagcgacgccaugucgau

SEQ ID NO: 1134054 - RNA, 13 nt, Mycobacterium bovis subsp bovis AF2122/97
ccagcgaccaggu

SEQ ID NO: 1134055 - RNA, 15 nt, Mycobacterium bovis subsp bovis AF2122/97
ccagcgaccaggucg

SEQ ID NO: 1134056 - RNA, 19 nt, Mycobacterium bovis subsp bovis AF2122/97
ccagcgaccaggucgccag

SEQ ID NO: 1134057 - RNA, 20 nt, Mycobacterium bovis subsp bovis AF2122/97
ccagcgaccaggucgccagc

SEQ ID NO: 1134058 - RNA, 13 nt, Mycobacterium bovis subsp bovis AF2122/97
ccagcgacccggc

SEQ ID NO: 1134059 - RNA, 20 nt, Mycobacterium bovis subsp bovis AF2122/97
ccagcgacccggccagcggc

SEQ ID NO: 1134060 - RNA, 14 nt, Mycobacterium bovis subsp bovis AF2122/97
ccagcgagaucagc

SEQ ID NO: 1134061 - RNA, 14 nt, Mycobacterium bovis subsp bovis AF2122/97
ccagcgacaacacc

SEQ ID NO: 1134062 - RNA, 13 nt, Mycobacterium bovis subsp bovis AF2122/97
ccagcgcagcagc

SEQ ID NO: 1134063 - RNA, 16 nt, Mycobacterium bovis subsp bovis AF2122/97
ccagcgcacgcucggc

SEQ ID NO: 1134064 - RNA, 20 nt, Mycobacterium bovis subsp bovis AF2122/97
ccagcgcacggaccaucgcc

SEQ ID NO: 1134065 - RNA, 14 nt, Mycobacterium bovis subsp bovis AF2122/97
ccagcgcagcaccg

SEQ ID NO: 1134066 - RNA, 12 nt, Mycobacterium bovis subsp bovis AF2122/97
ccagcgcaccgc

SEQ ID NO: 1134067 - RNA, 14 nt, Mycobacterium bovis subsp bovis AF2122/97
ccagcgcaccggcg

SEQ ID NO: 1134068 - RNA, 13 nt, Mycobacterium bovis subsp bovis AF2122/97
ccagcgcaccgcc

SEQ ID NO: 1134069 - RNA, 19 nt, Mycobacterium bovis subsp bovis AF2122/97
ccagccccgcgcccacccc

SEQ ID NO: 1134070 - RNA, 22 nt, Mycobacterium bovis subsp bovis AF2122/97
ccagccccgcgcccaccccggc

SEQ ID NO: 1134071 - RNA, 14 nt, Mycobacterium bovis subsp bovis AF2122/97
ccagccccgcuggu

SEQ ID NO: 1134072 - RNA, 17 nt, Mycobacterium bovis subsp bovis AF2122/97
ccagccccgcuggucga

SEQ ID NO: 1134073 - RNA, 19 nt, Mycobacterium bovis subsp bovis AF2122/97
ccagcccgacagcagguug

SEQ ID NO: 1134074 - RNA, 21 nt, Mycobacterium bovis subsp bovis AF2122/97
ccagcccgaugaucccgccac

SEQ ID NO: 1134075 - RNA, 14 nt, Mycobacterium bovis subsp bovis AF2122/97
ccagcccgcccaga

SEQ ID NO: 1134076 - RNA, 13 nt, Mycobacterium bovis subsp bovis AF2122/97
ccagcccggaacc

SEQ ID NO: 1134077 - RNA, 20 nt, Mycobacterium bovis subsp bovis AF2122/97
ccagcccggaacccgagccg

SEQ ID NO: 1134078 - RNA, 15 nt, Mycobacterium bovis subsp bovis AF2122/97
ccagcccggcccagu

SEQ ID NO: 1134079 - RNA, 20 nt, Mycobacterium bovis subsp bovis AF2122/97
ccagccgcgaaauuacuucg

SEQ ID NO: 1134080 - RNA, 14 nt, Mycobacterium bovis subsp bovis AF2122/97
ccagccgcgagccg

SEQ ID NO: 1134081 - RNA, 13 nt, Mycobacterium bovis subsp bovis AF2122/97
ccagccgccccgg

SEQ ID NO: 1134082 - RNA, 12 nt, Mycobacterium bovis subsp bovis AF2122/97
ccagccggccgc

SEQ ID NO: 1134083 - RNA, 19 nt, Mycobacterium bovis subsp bovis AF2122/97
ccagcccggcggcggucac

SEQ ID NO: 1134084 - RNA, 12 nt, Mycobacterium bovis subsp bovis AF2122/97
ccagccgcacgg

SEQ ID NO: 1134085 - RNA, 16 nt, Mycobacterium bovis subsp bovis AF2122/97
ccagccgcagcaccuc

SEQ ID NO: 1134086 - RNA, 13 nt, Mycobacterium bovis subsp bovis AF2122/97
ccagccgaucauc

SEQ ID NO: 1134087 - RNA, 12 nt, Mycobacterium bovis subsp bovis AF2122/97
ccagccgaucau

SEQ ID NO: 1134088 - RNA, 19 nt, Mycobacterium bovis subsp bovis AF2122/97
ccagcaucaguuugacgcc

SEQ ID NO: 1134089 - RNA, 19 nt, Mycobacterium bovis subsp bovis AF2122/97
ccagcaguacaccgcccgg

SEQ ID NO: 1134090 - RNA, 19 nt, Mycobacterium bovis subsp bovis AF2122/97
ccagcaggucgucggcguc

SEQ ID NO: 1134091 - RNA, 17 nt, Mycobacterium bovis subsp bovis AF2122/97
ccagcaccucggccagc

SEQ ID NO: 1134092 - RNA, 17 nt, Mycobacterium bovis subsp bovis AF2122/97
ccagcaguucgccgcgc

SEQ ID NO: 1134093 - RNA, 19 nt, Mycobacterium bovis subsp bovis AF2122/97
ccagcaguucgccgcgcag

SEQ ID NO: 1134094 - RNA, 14 nt, Mycobacterium bovis subsp bovis AF2122/97
ccagcacgacugca

SEQ ID NO: 1134095 - RNA, 16 nt, Mycobacterium bovis subsp bovis AF2122/97
ccagcagguccgcggc

SEQ ID NO: 1134096 - RNA, 19 nt, Mycobacterium bovis subsp bovis AF2122/97
ccagcagguccgcggccgc

SEQ ID NO: 1134097 - RNA, 21 nt, Mycobacterium bovis subsp bovis AF2122/97
ccagcagguauuugccgugcu

SEQ ID NO: 1134098 - RNA, 15 nt, Mycobacterium bovis subsp bovis AF2122/97
ccagcacccgcgcga

SEQ ID NO: 1134099 - RNA, 22 nt, Mycobacterium bovis subsp bovis AF2122/97
ccagcacccgcuccagcucggc

SEQ ID NO: 1134100 - RNA, 22 nt, Mycobacterium bovis subsp bovis AF2122/97
ccagcaccuagucgcggccgug

SEQ ID NO: 1134101 - RNA, 14 nt, Mycobacterium bovis subsp bovis AF2122/97
ccagcccagccgcc

SEQ ID NO: 1134102 - RNA, 14 nt, Mycobacterium bovis subsp bovis AF2122/97
ccagcccaggccuu

SEQ ID NO: 1134103 - RNA, 15 nt, Mycobacterium bovis subsp bovis AF2122/97
ccagcccaccggcgc

SEQ ID NO: 1134104 - RNA, 17 nt, Mycobacterium bovis subsp bovis AF2122/97
ccagcccaccggcgccg

SEQ ID NO: 1134105 - RNA, 18 nt, Mycobacterium bovis subsp bovis AF2122/97
ccagcccaccggcgccgc

SEQ ID NO: 1134106 - RNA, 23 nt, Mycobacterium bovis subsp bovis AF2122/97
ccagcccagauccagcaacgcgg

SEQ ID NO: 1134107 - RNA, 20 nt, Mycobacterium bovis subsp bovis AF2122/97
ccagcccaacucggccagcu

SEQ ID NO: 1134108 - RNA, 17 nt, Mycobacterium bovis subsp bovis AF2122/97
ccagccccacccgccgc

SEQ ID NO: 1134109 - RNA, 19 nt, Mycobacterium bovis subsp bovis AF2122/97
ccagccccacccgccgccg

SEQ ID NO: 1134110 - RNA, 21 nt, Mycobacterium bovis subsp bovis AF2122/97
ccagcccaugucgagcacgcc

SEQ ID NO: 1134111 - RNA, 13 nt, Mycobacterium bovis subsp bovis AF2122/97
ccagccccaaccc

SEQ ID NO: 1134112 - RNA, 23 nt, Mycobacterium bovis subsp bovis AF2122/97
ccagccccaacccuaaaccagcc

SEQ ID NO: 1134113 - RNA, 18 nt, Mycobacterium bovis subsp bovis AF2122/97
ccagcccaucccgauccu

SEQ ID NO: 1134114 - RNA, 21 nt, Mycobacterium bovis subsp bovis AF2122/97
ccagccauagugcggcagcgg

SEQ ID NO: 1134115 - RNA, 20 nt, Mycobacterium bovis subsp bovis AF2122/97
ccagccacugacggcuucca

SEQ ID NO: 1134116 - RNA, 17 nt, Mycobacterium bovis subsp bovis AF2122/97
ccagccauggcagcgcc

SEQ ID NO: 1134117 - RNA, 14 nt, Mycobacterium bovis subsp bovis AF2122/97
ccagccauggccgc

SEQ ID NO: 1134118 - RNA, 13 nt, Mycobacterium bovis subsp bovis AF2122/97
ccagccaugcucg

SEQ ID NO: 1134119 - RNA, 13 nt, Mycobacterium bovis subsp bovis AF2122/97
ccagccauggcag

SEQ ID NO: 1134120 - RNA, 19 nt, Mycobacterium bovis subsp bovis AF2122/97
ccagccacgccagccaggc

SEQ ID NO: 1134121 - RNA, 11 nt, Mycobacterium bovis subsp bovis AF2122/97
ccagccaccga

SEQ ID NO: 1134122 - RNA, 20 nt, Mycobacterium bovis subsp bovis AF2122/97
ccagccaccgaucgacugca

SEQ ID NO: 1134123 - RNA, 13 nt, Mycobacterium bovis subsp bovis AF2122/97
ccagccacagccg

SEQ ID NO: 1134124 - RNA, 15 nt, Mycobacterium bovis subsp bovis AF2122/97
ccagccacagccgac

SEQ ID NO: 1134125 - RNA, 15 nt, Mycobacterium bovis subsp bovis AF2122/97
ccagccacagcccgg

SEQ ID NO: 1134126 - RNA, 16 nt, Mycobacterium bovis subsp bovis AF2122/97
ccagccacagcccggc

SEQ ID NO: 1134127 - RNA, 14 nt, Mycobacterium bovis subsp bovis AF2122/97
ccagccaacgcguc

SEQ ID NO: 1134128 - RNA, 16 nt, Mycobacterium bovis subsp bovis AF2122/97
ccagccaaccguccgg

SEQ ID NO: 1134129 - RNA, 22 nt, Mycobacterium bovis subsp bovis AF2122/97
ccagccaaccguccggggccgc

SEQ ID NO: 1134130 - RNA, 19 nt, Mycobacterium bovis subsp bovis AF2122/97
ccagcaucgagcaguggcc

SEQ ID NO: 1134131 - RNA, 21 nt, Mycobacterium bovis subsp bovis AF2122/97
ccagcaucgagcaguggccgc

SEQ ID NO: 1134132 - RNA, 20 nt, Mycobacterium bovis subsp bovis AF2122/97
ccagcauucucgccgacggc

SEQ ID NO: 1134133 - RNA, 20 nt, Mycobacterium bovis subsp bovis AF2122/97
ccagccaaaucagccaggcg

SEQ ID NO: 1134134 - RNA, 15 nt, Mycobacterium bovis subsp bovis AF2122/97
ccagcgcggugucgg

SEQ ID NO: 1134135 - RNA, 20 nt, Mycobacterium bovis subsp bovis AF2122/97
ccagcgcgguguagagcgca

SEQ ID NO: 1134136 - RNA, 13 nt, Mycobacterium bovis subsp bovis AF2122/97
ccagcgcggcguc

SEQ ID NO: 1134137 - RNA, 15 nt, Mycobacterium bovis subsp bovis AF2122/97
ccagcgcgccguaga

SEQ ID NO: 1134138 - RNA, 16 nt, Mycobacterium bovis subsp bovis AF2122/97
ccagcgcggcgcgcgg

SEQ ID NO: 1134139 - RNA, 12 nt, Mycobacterium bovis subsp bovis AF2122/97
ccagcgcgccga

SEQ ID NO: 1134140 - RNA, 19 nt, Mycobacterium bovis subsp bovis AF2122/97
ccagcgcccccagcagcug

SEQ ID NO: 1134141 - RNA, 20 nt, Mycobacterium bovis subsp bovis AF2122/97
ccagcgccagugccucgcgg

SEQ ID NO: 1134142 - RNA, 16 nt, Mycobacterium bovis subsp bovis AF2122/97
ccagcgcccgcgcggc

SEQ ID NO: 1134143 - RNA, 14 nt, Mycobacterium bovis subsp bovis AF2122/97
ccagcgcccgccgg

SEQ ID NO: 1134144 - RNA, 15 nt, Mycobacterium bovis subsp bovis AF2122/97
ccagcgcccgccggc

SEQ ID NO: 1134145 - RNA, 11 nt, Mycobacterium bovis subsp bovis AF2122/97
ccagcgccgac

SEQ ID NO: 1134146 - RNA, 17 nt, Mycobacterium bovis subsp bovis AF2122/97
ccagcgccgacccguac

SEQ ID NO: 1134147 - RNA, 17 nt, Mycobacterium bovis subsp bovis AF2122/97
ccagcgcgccacgagca

SEQ ID NO: 1134148 - RNA, 19 nt, Mycobacterium bovis subsp bovis AF2122/97
ccagcgcgcccgcggccgc

SEQ ID NO: 1134149 - RNA, 21 nt, Mycobacterium bovis subsp bovis AF2122/97
ccagcgcgcccgcggccgcca

SEQ ID NO: 1134150 - RNA, 13 nt, Mycobacterium bovis subsp bovis AF2122/97
ccagcgccgcagu

SEQ ID NO: 1134151 - RNA, 21 nt, Mycobacterium bovis subsp bovis AF2122/97
ccagcgccgccaccgaagccg

SEQ ID NO: 1134152 - RNA, 12 nt, Mycobacterium bovis subsp bovis AF2122/97
ccagcgccgcac

SEQ ID NO: 1134153 - RNA, 14 nt, Mycobacterium bovis subsp bovis AF2122/97
ccagcgccgcacag

SEQ ID NO: 1134154 - RNA, 16 nt, Mycobacterium bovis subsp bovis AF2122/97
ccagcgccgcacccgc

SEQ ID NO: 1134155 - RNA, 14 nt, Mycobacterium bovis subsp bovis AF2122/97
ccagcggccgccgc

SEQ ID NO: 1134156 - RNA, 18 nt, Mycobacterium bovis subsp bovis AF2122/97
ccagcggccgccgcggcu

SEQ ID NO: 1134157 - RNA, 23 nt, Mycobacterium bovis subsp bovis AF2122/97
ccagcggcgaaggucuggccugc

SEQ ID NO: 1134158 - RNA, 18 nt, Mycobacterium bovis subsp bovis AF2122/97
ccagcggcccgucaccgc

SEQ ID NO: 1134159 - RNA, 20 nt, Mycobacterium bovis subsp bovis AF2122/97
ccagcggcccgucaccgcgg

SEQ ID NO: 1134160 - RNA, 21 nt, Mycobacterium bovis subsp bovis AF2122/97
ccagcggcccgucaccgcggg

SEQ ID NO: 1134161 - RNA, 23 nt, Mycobacterium bovis subsp bovis AF2122/97
ccagcggcccgucaccgcgggca

SEQ ID NO: 1134162 - RNA, 13 nt, Mycobacterium bovis subsp bovis AF2122/97
ccagcggcgccac

SEQ ID NO: 1134163 - RNA, 13 nt, Mycobacterium bovis subsp bovis AF2122/97
ccagcggcgcgac

SEQ ID NO: 1134164 - RNA, 21 nt, Mycobacterium bovis subsp bovis AF2122/97
ccagcggccgaccgcgacccg

SEQ ID NO: 1134165 - RNA, 17 nt, Mycobacterium bovis subsp bovis AF2122/97
ccagcggcggcaacggu

SEQ ID NO: 1134166 - RNA, 19 nt, Mycobacterium bovis subsp bovis AF2122/97
ccagcggcggcaacggugg

SEQ ID NO: 1134167 - RNA, 23 nt, Mycobacterium bovis subsp bovis AF2122/97
ccagcggcugcccaucggugauc

SEQ ID NO: 1134168 - RNA, 22 nt, Mycobacterium bovis subsp bovis AF2122/97
ccagcgcguaguccgcauccgc

SEQ ID NO: 1134169 - RNA, 14 nt, Mycobacterium bovis subsp bovis AF2122/97
ccagcggaucgaca

SEQ ID NO: 1134170 - RNA, 17 nt, Mycobacterium bovis subsp bovis AF2122/97
ccagcggcaauggccag

SEQ ID NO: 1134171 - RNA, 18 nt, Mycobacterium bovis subsp bovis AF2122/97
ccagcggcacacccauca

SEQ ID NO: 1134172 - RNA, 20 nt, Mycobacterium bovis subsp bovis AF2122/97
ccagcggcacacccaucacc

SEQ ID NO: 1134173 - RNA, 14 nt, Mycobacterium bovis subsp bovis AF2122/97
ccagcggcaccgcg

SEQ ID NO: 1134174 - RNA, 15 nt, Mycobacterium bovis subsp bovis AF2122/97
ccagcggcaccgcgc

SEQ ID NO: 1134175 - RNA, 16 nt, Mycobacterium bovis subsp bovis AF2122/97
ccagcggcaccgcgga

SEQ ID NO: 1134176 - RNA, 17 nt, Mycobacterium bovis subsp bovis AF2122/97
ccagcggcaccgcggau

SEQ ID NO: 1134177 - RNA, 18 nt, Mycobacterium bovis subsp bovis AF2122/97
ccagcggcaccgcggcca

SEQ ID NO: 1134178 - RNA, 20 nt, Mycobacterium bovis subsp bovis AF2122/97
ccagcggcaccgcggccagc

SEQ ID NO: 1134179 - RNA, 22 nt, Mycobacterium bovis subsp bovis AF2122/97
ccagcgguucggugaucgggca

SEQ ID NO: 1134180 - RNA, 23 nt, Mycobacterium bovis subsp bovis AF2122/97
ccagcgguugacccucgggucgu

SEQ ID NO: 1134181 - RNA, 22 nt, Mycobacterium bovis subsp bovis AF2122/97
ccagcgucagcuguuugccggc

SEQ ID NO: 1134182 - RNA, 17 nt, Mycobacterium bovis subsp bovis AF2122/97
ccagcgguuuccgcacg

SEQ ID NO: 1134183 - RNA, 14 nt, Mycobacterium bovis subsp bovis AF2122/97
ccagcgucgccgcc

SEQ ID NO: 1134184 - RNA, 15 nt, Mycobacterium bovis subsp bovis AF2122/97
ccagcgucgccgcca

SEQ ID NO: 1134185 - RNA, 18 nt, Mycobacterium bovis subsp bovis AF2122/97
ccagcgucgccgccaggu

SEQ ID NO: 1134186 - RNA, 14 nt, Mycobacterium bovis subsp bovis AF2122/97
ccagcgucgcacgc

SEQ ID NO: 1134187 - RNA, 18 nt, Mycobacterium bovis subsp bovis AF2122/97
ccagcgucgcacgcgcgc

SEQ ID NO: 1134188 - RNA, 20 nt, Mycobacterium bovis subsp bovis AF2122/97
ccagcguccauggucgcgcc

SEQ ID NO: 1134189 - RNA, 22 nt, Mycobacterium bovis subsp bovis AF2122/97
ccagcguccaacccaggguggc

SEQ ID NO: 1134190 - RNA, 15 nt, Mycobacterium bovis subsp bovis AF2122/97
ccagcguccagccgc

SEQ ID NO: 1134191 - RNA, 14 nt, Mycobacterium bovis subsp bovis AF2122/97
ccagcgggucgcgg

SEQ ID NO: 1134192 - RNA, 18 nt, Mycobacterium bovis subsp bovis AF2122/97
ccagcgggucgcgggugc

SEQ ID NO: 1134193 - RNA, 21 nt, Mycobacterium bovis subsp bovis AF2122/97
ccagcgggucggcggugccgu

SEQ ID NO: 1134194 - RNA, 13 nt, Mycobacterium bovis subsp bovis AF2122/97
ccagcggggucuu

SEQ ID NO: 1134195 - RNA, 14 nt, Mycobacterium bovis subsp bovis AF2122/97
ccagcggucggcgg

SEQ ID NO: 1134196 - RNA, 23 nt, Mycobacterium bovis subsp bovis AF2122/97
ccagcgguaucccccagccgcgg

SEQ ID NO: 1134197 - RNA, 24 nt, Mycobacterium bovis subsp bovis AF2122/97
ccagcggucggcgaccaccagcgc

SEQ ID NO: 1134198 - RNA, 24 nt, Mycobacterium bovis subsp bovis AF2122/97
ccagcgguaaugccagcggcacac

SEQ ID NO: 1134199 - RNA, 14 nt, Mycobacterium bovis subsp bovis AF2122/97
ccagcgggcaucgc

SEQ ID NO: 1134200 - RNA, 23 nt, Mycobacterium bovis subsp bovis AF2122/97
ccagcgggacaaaaucagcagcc

SEQ ID NO: 1134201 - RNA, 21 nt, Mycobacterium bovis subsp bovis AF2122/97
ccagcgugaacugagggcgga

SEQ ID NO: 1134202 - RNA, 15 nt, Mycobacterium bovis subsp bovis AF2122/97
ccagcgugcccgcca

SEQ ID NO: 1134203 - RNA, 21 nt, Mycobacterium bovis subsp bovis AF2122/97
ccagcgugcccgccaccggcg

SEQ ID NO: 1134204 - RNA, 19 nt, Mycobacterium bovis subsp bovis AF2122/97
ccagcguguagcgaugccg

SEQ ID NO: 1134205 - RNA, 17 nt, Mycobacterium bovis subsp bovis AF2122/97
ccagcguguggagcucg

SEQ ID NO: 1134206 - RNA, 14 nt, Mycobacterium bovis subsp bovis AF2122/97
aaauccgccgggcg

SEQ ID NO: 1134207 - RNA, 13 nt, Mycobacterium bovis subsp bovis AF2122/97
aaauccagcagcc

SEQ ID NO: 1134208 - RNA, 20 nt, Mycobacterium bovis subsp bovis AF2122/97
cccgcacgcacggcgugucg

SEQ ID NO: 1134209 - RNA, 14 nt, Mycobacterium bovis subsp bovis AF2122/97
cccgcacgaagccg

SEQ ID NO: 1134210 - RNA, 13 nt, Mycobacterium bovis subsp bovis AF2122/97
cccgcacgcucgg

SEQ ID NO: 1134211 - RNA, 17 nt, Mycobacterium bovis subsp bovis AF2122/97
cccgcacguucacgcgc

SEQ ID NO: 1134212 - RNA, 22 nt, Mycobacterium bovis subsp bovis AF2122/97
cccgcacguucacgcgcggauc

SEQ ID NO: 1134213 - RNA, 19 nt, Mycobacterium bovis subsp bovis AF2122/97
cccgcacguuggcggccag

SEQ ID NO: 1134214 - RNA, 20 nt, Mycobacterium bovis subsp bovis AF2122/97
cccgcacuccacgaucggcc

SEQ ID NO: 1134215 - RNA, 17 nt, Mycobacterium bovis subsp bovis AF2122/97
cccgcaccccggccgcg

SEQ ID NO: 1134216 - RNA, 13 nt, Mycobacterium bovis subsp bovis AF2122/97
cccgcaccggggu

SEQ ID NO: 1134217 - RNA, 12 nt, Mycobacterium bovis subsp bovis AF2122/97
cccgcaccggug

SEQ ID NO: 1134218 - RNA, 16 nt, Mycobacterium bovis subsp bovis AF2122/97
cccgcaccggugacgc

SEQ ID NO: 1134219 - RNA, 13 nt, Mycobacterium bovis subsp bovis AF2122/97
cccgcaccgcggu

SEQ ID NO: 1134220 - RNA, 21 nt, Mycobacterium bovis subsp bovis AF2122/97
cccgcaucggaaucgcgagcu

SEQ ID NO: 1134221 - RNA, 16 nt, Mycobacterium bovis subsp bovis AF2122/97
cccgcaucggcacgcc

SEQ ID NO: 1134222 - RNA, 18 nt, Mycobacterium bovis subsp bovis AF2122/97
cccgcaucggcacgccau

SEQ ID NO: 1134223 - RNA, 14 nt, Mycobacterium bovis subsp bovis AF2122/97
cccgcaugccggcg

SEQ ID NO: 1134224 - RNA, 14 nt, Mycobacterium bovis subsp bovis AF2122/97
cccgcaugacgccg

SEQ ID NO: 1134225 - RNA, 16 nt, Mycobacterium bovis subsp bovis AF2122/97
cccgcauggcagcggc

SEQ ID NO: 1134226 - RNA, 19 nt, Mycobacterium bovis subsp bovis AF2122/97
cccgcauggcagcggcggu

SEQ ID NO: 1134227 - RNA, 23 nt, Mycobacterium bovis subsp bovis AF2122/97
cccgcagaauccggcaaccaccg

SEQ ID NO: 1134228 - RNA, 14 nt, Mycobacterium bovis subsp bovis AF2122/97
cccgcacgcucggc

SEQ ID NO: 1134229 - RNA, 17 nt, Mycobacterium bovis subsp bovis AF2122/97
cccgcagcccgccgggc

SEQ ID NO: 1134230 - RNA, 14 nt, Mycobacterium bovis subsp bovis AF2122/97
cccgcagaccgcca

SEQ ID NO: 1134231 - RNA, 16 nt, Mycobacterium bovis subsp bovis AF2122/97
cccgcaucgcggcauc

SEQ ID NO: 1134232 - RNA, 13 nt, Mycobacterium bovis subsp bovis AF2122/97
cccgaucgcgcca

SEQ ID NO: 1134233 - RNA, 14 nt, Mycobacterium bovis subsp bovis AF2122/97
cccgaucggccacc

SEQ ID NO: 1134234 - RNA, 20 nt, Mycobacterium bovis subsp bovis AF2122/97
cccgaucggccaccaucgcc

SEQ ID NO: 1134235 - RNA, 18 nt, Mycobacterium bovis subsp bovis AF2122/97
cccgaucucugcggcggu

SEQ ID NO: 1134236 - RNA, 14 nt, Mycobacterium bovis subsp bovis AF2122/97
cccgaucggugacg

SEQ ID NO: 1134237 - RNA, 19 nt, Mycobacterium bovis subsp bovis AF2122/97
cccgaguuugcgauaccca

SEQ ID NO: 1134238 - RNA, 22 nt, Mycobacterium bovis subsp bovis AF2122/97
cccgaguuugcgauacccaccg

SEQ ID NO: 1134239 - RNA, 18 nt, Mycobacterium bovis subsp bovis AF2122/97
cccgaguugaaggugccg

SEQ ID NO: 1134240 - RNA, 21 nt, Mycobacterium bovis subsp bovis AF2122/97
cccgaguugaaggugccggcg

SEQ ID NO: 1134241 - RNA, 16 nt, Mycobacterium bovis subsp bovis AF2122/97
cccgauaacaaggccg

SEQ ID NO: 1134242 - RNA, 19 nt, Mycobacterium bovis subsp bovis AF2122/97
cccgauaacaaggccgccg

SEQ ID NO: 1134243 - RNA, 13 nt, Mycobacterium bovis subsp bovis AF2122/97
cccgauacccggu

SEQ ID NO: 1134244 - RNA, 14 nt, Mycobacterium bovis subsp bovis AF2122/97
cccgauacccggug

SEQ ID NO: 1134245 - RNA, 13 nt, Mycobacterium bovis subsp bovis AF2122/97
cccgauacggccg

SEQ ID NO: 1134246 - RNA, 15 nt, Mycobacterium bovis subsp bovis AF2122/97
cccgauacggccggc

SEQ ID NO: 1134247 - RNA, 23 nt, Mycobacterium bovis subsp bovis AF2122/97
cccgaugaggacauccggcgccg

SEQ ID NO: 1134248 - RNA, 16 nt, Mycobacterium bovis subsp bovis AF2122/97
cccgaugaucccgcca

SEQ ID NO: 1134249 - RNA, 17 nt, Mycobacterium bovis subsp bovis AF2122/97
cccgauggcgucgccgg

SEQ ID NO: 1134250 - RNA, 22 nt, Mycobacterium bovis subsp bovis AF2122/97
cccgauggcgucgccggccccg

SEQ ID NO: 1134251 - RNA, 21 nt, Mycobacterium bovis subsp bovis AF2122/97
cccgaugguacccgcgccgcg

SEQ ID NO: 1134252 - RNA, 13 nt, Mycobacterium bovis subsp bovis AF2122/97
cccgauggugccg

SEQ ID NO: 1134253 - RNA, 20 nt, Mycobacterium bovis subsp bovis AF2122/97
cccgauggugccgacccgcc

SEQ ID NO: 1134254 - RNA, 13 nt, Mycobacterium bovis subsp bovis AF2122/97
cccgccgcgugcu

SEQ ID NO: 1134255 - RNA, 16 nt, Mycobacterium bovis subsp bovis AF2122/97
cccgccgcgcccggcg

SEQ ID NO: 1134256 - RNA, 22 nt, Mycobacterium bovis subsp bovis AF2122/97
cccgcccuggcaacgacacgcc

SEQ ID NO: 1134257 - RNA, 19 nt, Mycobacterium bovis subsp bovis AF2122/97
cccgcccuugccgccagcc

SEQ ID NO: 1134258 - RNA, 12 nt, Mycobacterium bovis subsp bovis AF2122/97
cccgccgcgccc

SEQ ID NO: 1134259 - RNA, 22 nt, Mycobacterium bovis subsp bovis AF2122/97
cccgcgaauacgaggacgacga

SEQ ID NO: 1134260 - RNA, 16 nt, Mycobacterium bovis subsp bovis AF2122/97
cccgccggcuccgcca

SEQ ID NO: 1134261 - RNA, 12 nt, Mycobacterium bovis subsp bovis AF2122/97
cccgccggcgcc

SEQ ID NO: 1134262 - RNA, 17 nt, Mycobacterium bovis subsp bovis AF2122/97
cccgccggauucgcccg

SEQ ID NO: 1134263 - RNA, 16 nt, Mycobacterium bovis subsp bovis AF2122/97
cccgccggauccgcca

SEQ ID NO: 1134264 - RNA, 19 nt, Mycobacterium bovis subsp bovis AF2122/97
cccgccggaacugcgcaac

SEQ ID NO: 1134265 - RNA, 12 nt, Mycobacterium bovis subsp bovis AF2122/97
cccgccggccgc

SEQ ID NO: 1134266 - RNA, 13 nt, Mycobacterium bovis subsp bovis AF2122/97
cccgccggccccg

SEQ ID NO: 1134267 - RNA, 21 nt, Mycobacterium bovis subsp bovis AF2122/97
cccgccggccccgccggcccc

SEQ ID NO: 1134268 - RNA, 12 nt, Mycobacterium bovis subsp bovis AF2122/97
cccgccggcacg

SEQ ID NO: 1134269 - RNA, 20 nt, Mycobacterium bovis subsp bovis AF2122/97
cccgcauugccgucgggguc

SEQ ID NO: 1134270 - RNA, 21 nt, Mycobacterium bovis subsp bovis AF2122/97
cccgcauugccaacgcccacg

SEQ ID NO: 1134271 - RNA, 22 nt, Mycobacterium bovis subsp bovis AF2122/97
cccgcauugccaacgcccacgu

SEQ ID NO: 1134272 - RNA, 14 nt, Mycobacterium bovis subsp bovis AF2122/97
cccgcauugccguc

SEQ ID NO: 1134273 - RNA, 21 nt, Mycobacterium bovis subsp bovis AF2122/97
cccgccaacgccaaaacgguc

SEQ ID NO: 1134274 - RNA, 13 nt, Mycobacterium bovis subsp bovis AF2122/97
cccgccacgccga

SEQ ID NO: 1134275 - RNA, 18 nt, Mycobacterium bovis subsp bovis AF2122/97
cccgccaccgaacgcacc

SEQ ID NO: 1134276 - RNA, 12 nt, Mycobacterium bovis subsp bovis AF2122/97
cccgccaccgcg

SEQ ID NO: 1134277 - RNA, 14 nt, Mycobacterium bovis subsp bovis AF2122/97
cccgccaccggagg

SEQ ID NO: 1134278 - RNA, 17 nt, Mycobacterium bovis subsp bovis AF2122/97
cccgccaccggcgcgac

SEQ ID NO: 1134279 - RNA, 14 nt, Mycobacterium bovis subsp bovis AF2122/97
cccgcccuugccgc

SEQ ID NO: 1134280 - RNA, 13 nt, Mycobacterium bovis subsp bovis AF2122/97
cccgcccgagccg

SEQ ID NO: 1134281 - RNA, 15 nt, Mycobacterium bovis subsp bovis AF2122/97
cccgcccgcacgacg

SEQ ID NO: 1134282 - RNA, 22 nt, Mycobacterium bovis subsp bovis AF2122/97
cccgcccggaacggguuggcga

SEQ ID NO: 1134283 - RNA, 12 nt, Mycobacterium bovis subsp bovis AF2122/97
cccgccccgacc

SEQ ID NO: 1134284 - RNA, 22 nt, Mycobacterium bovis subsp bovis AF2122/97
cccgcgcuugauccacccgacg

SEQ ID NO: 1134285 - RNA, 16 nt, Mycobacterium bovis subsp bovis AF2122/97
cccgcggacagcccgg

SEQ ID NO: 1134286 - RNA, 13 nt, Mycobacterium bovis subsp bovis AF2122/97
cccgcggaccgca

SEQ ID NO: 1134287 - RNA, 23 nt, Mycobacterium bovis subsp bovis AF2122/97
cccgcggaccgcaacgacggccg

SEQ ID NO: 1134288 - RNA, 14 nt, Mycobacterium bovis subsp bovis AF2122/97
cccgcgcugagcac

SEQ ID NO: 1134289 - RNA, 15 nt, Mycobacterium bovis subsp bovis AF2122/97
cccgcggacgugccg

SEQ ID NO: 1134290 - RNA, 15 nt, Mycobacterium bovis subsp bovis AF2122/97
cccgcggccgggccg

SEQ ID NO: 1134291 - RNA, 11 nt, Mycobacterium bovis subsp bovis AF2122/97
cccgcggcggu

SEQ ID NO: 1134292 - RNA, 12 nt, Mycobacterium bovis subsp bovis AF2122/97
cccgcggcgaac

SEQ ID NO: 1134293 - RNA, 14 nt, Mycobacterium bovis subsp bovis AF2122/97
cccgcgggaucagc

SEQ ID NO: 1134294 - RNA, 16 nt, Mycobacterium bovis subsp bovis AF2122/97
cccgcgggggcggccg

SEQ ID NO: 1134295 - RNA, 21 nt, Mycobacterium bovis subsp bovis AF2122/97
cccgcggugacgagcacaugc

SEQ ID NO: 1134296 - RNA, 13 nt, Mycobacterium bovis subsp bovis AF2122/97
cccgcggugacgc

SEQ ID NO: 1134297 - RNA, 17 nt, Mycobacterium bovis subsp bovis AF2122/97
cccgcgguagccgaccg

SEQ ID NO: 1134298 - RNA, 19 nt, Mycobacterium bovis subsp bovis AF2122/97
cccgcggucgaucaggccg

SEQ ID NO: 1134299 - RNA, 13 nt, Mycobacterium bovis subsp bovis AF2122/97
cccgcggccgcca

SEQ ID NO: 1134300 - RNA, 22 nt, Mycobacterium bovis subsp bovis AF2122/97
cccgcgagguugaccaccagcg

SEQ ID NO: 1134301 - RNA, 23 nt, Mycobacterium bovis subsp bovis AF2122/97
cccgcgagguugaccaccagcgu

SEQ ID NO: 1134302 - RNA, 23 nt, Mycobacterium bovis subsp bovis AF2122/97
cccgcgagaucgggccggccgcc

SEQ ID NO: 1134303 - RNA, 18 nt, Mycobacterium bovis subsp bovis AF2122/97
cccgcgagcagcccggcg

SEQ ID NO: 1134304 - RNA, 16 nt, Mycobacterium bovis subsp bovis AF2122/97
cccgcgcagcgguccg

SEQ ID NO: 1134305 - RNA, 18 nt, Mycobacterium bovis subsp bovis AF2122/97
cccgcgcagcgguccgcc

SEQ ID NO: 1134306 - RNA, 18 nt, Mycobacterium bovis subsp bovis AF2122/97
cccgcgccaccgauaccg

SEQ ID NO: 1134307 - RNA, 18 nt, Mycobacterium bovis subsp bovis AF2122/97
cccgcgcguucggcgagc

SEQ ID NO: 1134308 - RNA, 23 nt, Mycobacterium bovis subsp bovis AF2122/97
cccgcgcgucgcccagugcgcaa

SEQ ID NO: 1134309 - RNA, 18 nt, Mycobacterium bovis subsp bovis AF2122/97
cccgcgcgguggcggucg

SEQ ID NO: 1134310 - RNA, 21 nt, Mycobacterium bovis subsp bovis AF2122/97
cccgcgcgguggcggucgcca

SEQ ID NO: 1134311 - RNA, 17 nt, Mycobacterium bovis subsp bovis AF2122/97
cccgcgcguacccgauc

SEQ ID NO: 1134312 - RNA, 18 nt, Mycobacterium bovis subsp bovis AF2122/97
cccgcgcucgcacccgcu

SEQ ID NO: 1134313 - RNA, 16 nt, Mycobacterium bovis subsp bovis AF2122/97
cccgcgcgggcggauc

SEQ ID NO: 1134314 - RNA, 22 nt, Mycobacterium bovis subsp bovis AF2122/97
cccgcgccaccucccacgccgc

SEQ ID NO: 1134315 - RNA, 19 nt, Mycobacterium bovis subsp bovis AF2122/97
cccgcgcgccagcucggcg

SEQ ID NO: 1134316 - RNA, 14 nt, Mycobacterium bovis subsp bovis AF2122/97
cccgcgcgccggcg

SEQ ID NO: 1134317 - RNA, 12 nt, Mycobacterium bovis subsp bovis AF2122/97
cccgcgcgcuga

SEQ ID NO: 1134318 - RNA, 15 nt, Mycobacterium bovis subsp bovis AF2122/97
cccggacccaccaau

SEQ ID NO: 1134319 - RNA, 14 nt, Mycobacterium bovis subsp bovis AF2122/97
cccggaccaucgcc

SEQ ID NO: 1134320 - RNA, 12 nt, Mycobacterium bovis subsp bovis AF2122/97
cccggauccguc

SEQ ID NO: 1134321 - RNA, 22 nt, Mycobacterium bovis subsp bovis AF2122/97
cccggaugccgaccuagcucgc

SEQ ID NO: 1134322 - RNA, 14 nt, Mycobacterium bovis subsp bovis AF2122/97
cccggaugcgaugc

SEQ ID NO: 1134323 - RNA, 18 nt, Mycobacterium bovis subsp bovis AF2122/97
cccggaauauggcggccg

SEQ ID NO: 1134324 - RNA, 18 nt, Mycobacterium bovis subsp bovis AF2122/97
cccggacagggcggcgag

SEQ ID NO: 1134325 - RNA, 21 nt, Mycobacterium bovis subsp bovis AF2122/97
cccggacagggugggggcauc

SEQ ID NO: 1134326 - RNA, 20 nt, Mycobacterium bovis subsp bovis AF2122/97
cccggaacccgagccgguaa

SEQ ID NO: 1134327 - RNA, 17 nt, Mycobacterium bovis subsp bovis AF2122/97
cccggaagcgccggccc

SEQ ID NO: 1134328 - RNA, 17 nt, Mycobacterium bovis subsp bovis AF2122/97
cccgcucgaucggcagc

SEQ ID NO: 1134329 - RNA, 18 nt, Mycobacterium bovis subsp bovis AF2122/97
cccgcucgaucugcccgg

SEQ ID NO: 1134330 - RNA, 12 nt, Mycobacterium bovis subsp bovis AF2122/97
cccgcucgaugu

SEQ ID NO: 1134331 - RNA, 13 nt, Mycobacterium bovis subsp bovis AF2122/97
cccgcucggccgc

SEQ ID NO: 1134332 - RNA, 14 nt, Mycobacterium bovis subsp bovis AF2122/97
cccgcucggccgcc

SEQ ID NO: 1134333 - RNA, 14 nt, Mycobacterium bovis subsp bovis AF2122/97
cccgcucggccguc

SEQ ID NO: 1134334 - RNA, 21 nt, Mycobacterium bovis subsp bovis AF2122/97
cccgcucgcccgccgccacca

SEQ ID NO: 1134335 - RNA, 15 nt, Mycobacterium bovis subsp bovis AF2122/97
cccgcucgcggcgac

SEQ ID NO: 1134336 - RNA, 23 nt, Mycobacterium bovis subsp bovis AF2122/97
cccgcugagcacucaugaugccg

SEQ ID NO: 1134337 - RNA, 19 nt, Mycobacterium bovis subsp bovis AF2122/97
cccgcucggcgcgcggguu

SEQ ID NO: 1134338 - RNA, 12 nt, Mycobacterium bovis subsp bovis AF2122/97
cccgcucgucgg

SEQ ID NO: 1134339 - RNA, 14 nt, Mycobacterium bovis subsp bovis AF2122/97
cccgcugcacgccg

SEQ ID NO: 1134340 - RNA, 23 nt, Mycobacterium bovis subsp bovis AF2122/97
cccgcugccauugccugggcgac

SEQ ID NO: 1134341 - RNA, 22 nt, Mycobacterium bovis subsp bovis AF2122/97
cccgcugcgagaucgcggcgac

SEQ ID NO: 1134342 - RNA, 21 nt, Mycobacterium bovis subsp bovis AF2122/97
cccggaacgaaugucaccccg

SEQ ID NO: 1134343 - RNA, 17 nt, Mycobacterium bovis subsp bovis AF2122/97
cccggaaccagccgcgg

SEQ ID NO: 1134344 - RNA, 17 nt, Mycobacterium bovis subsp bovis AF2122/97
cccgcuuuuucccggcg

SEQ ID NO: 1134345 - RNA, 23 nt, Mycobacterium bovis subsp bovis AF2122/97
cccgcuuuuucccggcggcgcgc

SEQ ID NO: 1134346 - RNA, 22 nt, Mycobacterium bovis subsp bovis AF2122/97
cccggaaaaauuucuucgccga

SEQ ID NO: 1134347 - RNA, 16 nt, Mycobacterium bovis subsp bovis AF2122/97
cccgagcucaccgcac

SEQ ID NO: 1134348 - RNA, 17 nt, Mycobacterium bovis subsp bovis AF2122/97
cccgagcucaccgcaca

SEQ ID NO: 1134349 - RNA, 12 nt, Mycobacterium bovis subsp bovis AF2122/97
cccgagcucgaa

SEQ ID NO: 1134350 - RNA, 19 nt, Mycobacterium bovis subsp bovis AF2122/97
cccgagcggcugagccgca

SEQ ID NO: 1134351 - RNA, 18 nt, Mycobacterium bovis subsp bovis AF2122/97
cccgagccgguaaccgcg

SEQ ID NO: 1134352 - RNA, 15 nt, Mycobacterium bovis subsp bovis AF2122/97
cccgagccggugcca

SEQ ID NO: 1134353 - RNA, 20 nt, Mycobacterium bovis subsp bovis AF2122/97
cccgagccggugccacugcc

SEQ ID NO: 1134354 - RNA, 14 nt, Mycobacterium bovis subsp bovis AF2122/97
cccgagcgcgcgcu

SEQ ID NO: 1134355 - RNA, 16 nt, Mycobacterium bovis subsp bovis AF2122/97
cccgagcgcgcgcugu

SEQ ID NO: 1134356 - RNA, 21 nt, Mycobacterium bovis subsp bovis AF2122/97
cccgagcgcucgaucacggcg

SEQ ID NO: 1134357 - RNA, 20 nt, Mycobacterium bovis subsp bovis AF2122/97
cccgagcggagccgccgacu

SEQ ID NO: 1134358 - RNA, 18 nt, Mycobacterium bovis subsp bovis AF2122/97
cccgagcccgcugcgccg

SEQ ID NO: 1134359 - RNA, 13 nt, Mycobacterium bovis subsp bovis AF2122/97
cccgagcccguca

SEQ ID NO: 1134360 - RNA, 16 nt, Mycobacterium bovis subsp bovis AF2122/97
cccgagccaucaccgc

SEQ ID NO: 1134361 - RNA, 15 nt, Mycobacterium bovis subsp bovis AF2122/97
cccgagcccagcgcc

SEQ ID NO: 1134362 - RNA, 18 nt, Mycobacterium bovis subsp bovis AF2122/97
cccgaggcgagacgcucc

SEQ ID NO: 1134363 - RNA, 13 nt, Mycobacterium bovis subsp bovis AF2122/97
cccgaggcucggg

SEQ ID NO: 1134364 - RNA, 15 nt, Mycobacterium bovis subsp bovis AF2122/97
cccgaggcucgugcg

SEQ ID NO: 1134365 - RNA, 22 nt, Mycobacterium bovis subsp bovis AF2122/97
cccgagggcagagcggcaguca

SEQ ID NO: 1134366 - RNA, 14 nt, Mycobacterium bovis subsp bovis AF2122/97
cccgagggcggcag

SEQ ID NO: 1134367 - RNA, 15 nt, Mycobacterium bovis subsp bovis AF2122/97
cccgagggcggcagc

SEQ ID NO: 1134368 - RNA, 20 nt, Mycobacterium bovis subsp bovis AF2122/97
cccgaggggagugucagcgc

SEQ ID NO: 1134369 - RNA, 16 nt, Mycobacterium bovis subsp bovis AF2122/97
cccgaguuaccgguga

SEQ ID NO: 1134370 - RNA, 20 nt, Mycobacterium bovis subsp bovis AF2122/97
cccgacaauggcgccagccg

SEQ ID NO: 1134371 - RNA, 15 nt, Mycobacterium bovis subsp bovis AF2122/97
cccgaauggcaucag

SEQ ID NO: 1134372 - RNA, 20 nt, Mycobacterium bovis subsp bovis AF2122/97
cccgaauucccuacgccgcc

SEQ ID NO: 1134373 - RNA, 17 nt, Mycobacterium bovis subsp bovis AF2122/97
cccgacauacgucgggg

SEQ ID NO: 1134374 - RNA, 20 nt, Mycobacterium bovis subsp bovis AF2122/97
cccgacauacgucggggccg

SEQ ID NO: 1134375 - RNA, 18 nt, Mycobacterium bovis subsp bovis AF2122/97
cccgaccacugaucggca

SEQ ID NO: 1134376 - RNA, 16 nt, Mycobacterium bovis subsp bovis AF2122/97
cccgacaacgcugggc

SEQ ID NO: 1134377 - RNA, 16 nt, Mycobacterium bovis subsp bovis AF2122/97
cccgacacggcggcug

SEQ ID NO: 1134378 - RNA, 22 nt, Mycobacterium bovis subsp bovis AF2122/97
cccgacagauggucacccacgu

SEQ ID NO: 1134379 - RNA, 13 nt, Mycobacterium bovis subsp bovis AF2122/97
cccgagaucaccg

SEQ ID NO: 1134380 - RNA, 15 nt, Mycobacterium bovis subsp bovis AF2122/97
cccgaccgccaccgc

SEQ ID NO: 1134381 - RNA, 18 nt, Mycobacterium bovis subsp bovis AF2122/97
cccgagaucaccgguacg

SEQ ID NO: 1134382 - RNA, 15 nt, Mycobacterium bovis subsp bovis AF2122/97
cccgacccgccgacg

SEQ ID NO: 1134383 - RNA, 15 nt, Mycobacterium bovis subsp bovis AF2122/97
cccgacccgccgaug

SEQ ID NO: 1134384 - RNA, 20 nt, Mycobacterium bovis subsp bovis AF2122/97
cccgacccaucaccagcggc

SEQ ID NO: 1134385 - RNA, 20 nt, Mycobacterium bovis subsp bovis AF2122/97
ccccguugacccagaccggc

SEQ ID NO: 1134386 - RNA, 14 nt, Mycobacterium bovis subsp bovis AF2122/97
ccccguucgccagg

SEQ ID NO: 1134387 - RNA, 18 nt, Mycobacterium bovis subsp bovis AF2122/97
ccccguucgccaggccgu

SEQ ID NO: 1134388 - RNA, 13 nt, Mycobacterium bovis subsp bovis AF2122/97
ccccgucgcuggc

SEQ ID NO: 1134389 - RNA, 18 nt, Mycobacterium bovis subsp bovis AF2122/97
ccccuggccgccggcgcc

SEQ ID NO: 1134390 - RNA, 21 nt, Mycobacterium bovis subsp bovis AF2122/97
ccccugggcggauggccucga

SEQ ID NO: 1134391 - RNA, 13 nt, Mycobacterium bovis subsp bovis AF2122/97
ccccuugaccgcu

SEQ ID NO: 1134392 - RNA, 21 nt, Mycobacterium bovis subsp bovis AF2122/97
cccgaaaccuguaccgccacg

SEQ ID NO: 1134393 - RNA, 21 nt, Mycobacterium bovis subsp bovis AF2122/97
ccccuggccagcagagcggca

SEQ ID NO: 1134394 - RNA, 16 nt, Mycobacterium bovis subsp bovis AF2122/97
ccccugucaacgccgc

SEQ ID NO: 1134395 - RNA, 18 nt, Mycobacterium bovis subsp bovis AF2122/97
ccccgucagcgggcagca

SEQ ID NO: 1134396 - RNA, 20 nt, Mycobacterium bovis subsp bovis AF2122/97
ccccguaggugcacaacccg

SEQ ID NO: 1134397 - RNA, 15 nt, Mycobacterium bovis subsp bovis AF2122/97
ccccggucggcgacg

SEQ ID NO: 1134398 - RNA, 13 nt, Mycobacterium bovis subsp bovis AF2122/97
ccccguaggcgcc

SEQ ID NO: 1134399 - RNA, 14 nt, Mycobacterium bovis subsp bovis AF2122/97
ccccgucgaucagc

SEQ ID NO: 1134400 - RNA, 14 nt, Mycobacterium bovis subsp bovis AF2122/97
ccccgucgccaccg

SEQ ID NO: 1134401 - RNA, 17 nt, Mycobacterium bovis subsp bovis AF2122/97
ccccggcugccagcgcc

SEQ ID NO: 1134402 - RNA, 14 nt, Mycobacterium bovis subsp bovis AF2122/97
ccccgguagccccg

SEQ ID NO: 1134403 - RNA, 24 nt, Mycobacterium bovis subsp bovis AF2122/97
ccccggucaggacggcacccgacu

SEQ ID NO: 1134404 - RNA, 18 nt, Mycobacterium bovis subsp bovis AF2122/97
ccccggucgaggucggcg

SEQ ID NO: 1134405 - RNA, 15 nt, Mycobacterium bovis subsp bovis AF2122/97
ccccggucggcccgc

SEQ ID NO: 1134406 - RNA, 16 nt, Mycobacterium bovis subsp bovis AF2122/97
ccccggucggcccgcg

SEQ ID NO: 1134407 - RNA, 13 nt, Mycobacterium bovis subsp bovis AF2122/97
ccccggucggcga

SEQ ID NO: 1134408 - RNA, 16 nt, Mycobacterium bovis subsp bovis AF2122/97
ccccggucccgccgac

SEQ ID NO: 1134409 - RNA, 11 nt, Mycobacterium bovis subsp bovis AF2122/97
ccccgggcggu

SEQ ID NO: 1134410 - RNA, 12 nt, Mycobacterium bovis subsp bovis AF2122/97
ccccgggcccgc

SEQ ID NO: 1134411 - RNA, 13 nt, Mycobacterium bovis subsp bovis AF2122/97
ccccggcucggcc

SEQ ID NO: 1134412 - RNA, 18 nt, Mycobacterium bovis subsp bovis AF2122/97
ccccggcucucuucgcgc

SEQ ID NO: 1134413 - RNA, 11 nt, Mycobacterium bovis subsp bovis AF2122/97
ccccggcaccg

SEQ ID NO: 1134414 - RNA, 22 nt, Mycobacterium bovis subsp bovis AF2122/97
ccccggcaccgccggcuccgcc

SEQ ID NO: 1134415 - RNA, 15 nt, Mycobacterium bovis subsp bovis AF2122/97
ccccgcuccgcgccg

SEQ ID NO: 1134416 - RNA, 16 nt, Mycobacterium bovis subsp bovis AF2122/97
ccccgccagcggcagc

SEQ ID NO: 1134417 - RNA, 23 nt, Mycobacterium bovis subsp bovis AF2122/97
ccccgcguguccuuugccaccuc

SEQ ID NO: 1134418 - RNA, 14 nt, Mycobacterium bovis subsp bovis AF2122/97
ccccgcuacgcgcg

SEQ ID NO: 1134419 - RNA, 18 nt, Mycobacterium bovis subsp bovis AF2122/97
cccccaccagggacgaug

SEQ ID NO: 1134420 - RNA, 22 nt, Mycobacterium bovis subsp bovis AF2122/97
cccccagacaauccgccgccgg

SEQ ID NO: 1134421 - RNA, 13 nt, Mycobacterium bovis subsp bovis AF2122/97
ccccgaucagcac

SEQ ID NO: 1134422 - RNA, 14 nt, Mycobacterium bovis subsp bovis AF2122/97
ccccgaucaggccg

SEQ ID NO: 1134423 - RNA, 15 nt, Mycobacterium bovis subsp bovis AF2122/97
ccccgaucaucgacg

SEQ ID NO: 1134424 - RNA, 15 nt, Mycobacterium bovis subsp bovis AF2122/97
cccccagcgcccgcc

SEQ ID NO: 1134425 - RNA, 15 nt, Mycobacterium bovis subsp bovis AF2122/97
ccccgauccgccacg

SEQ ID NO: 1134426 - RNA, 18 nt, Mycobacterium bovis subsp bovis AF2122/97
ccccgcacggaaggucga

SEQ ID NO: 1134427 - RNA, 20 nt, Mycobacterium bovis subsp bovis AF2122/97
ccccgcacggaaggucgaca

SEQ ID NO: 1134428 - RNA, 15 nt, Mycobacterium bovis subsp bovis AF2122/97
ccccgccaccucgcc

SEQ ID NO: 1134429 - RNA, 15 nt, Mycobacterium bovis subsp bovis AF2122/97
ccccgcaucgcccaa

SEQ ID NO: 1134430 - RNA, 15 nt, Mycobacterium bovis subsp bovis AF2122/97
ccccgccgagcaccg

SEQ ID NO: 1134431 - RNA, 14 nt, Mycobacterium bovis subsp bovis AF2122/97
ccccgccgaucacc

SEQ ID NO: 1134432 - RNA, 23 nt, Mycobacterium bovis subsp bovis AF2122/97
ccccgcgguagccgaccgaccgc

SEQ ID NO: 1134433 - RNA, 13 nt, Mycobacterium bovis subsp bovis AF2122/97
ccccgccaggauc

SEQ ID NO: 1134434 - RNA, 19 nt, Mycobacterium bovis subsp bovis AF2122/97
ccccauugccgucgcgguc

SEQ ID NO: 1134435 - RNA, 12 nt, Mycobacterium bovis subsp bovis AF2122/97
ccccauugccgc

SEQ ID NO: 1134436 - RNA, 15 nt, Mycobacterium bovis subsp bovis AF2122/97
ccccauggccaccga

SEQ ID NO: 1134437 - RNA, 15 nt, Mycobacterium bovis subsp bovis AF2122/97
ccccauggccagcgc

SEQ ID NO: 1134438 - RNA, 20 nt, Mycobacterium bovis subsp bovis AF2122/97
ccccaugcgccagcgagcgc

SEQ ID NO: 1134439 - RNA, 19 nt, Mycobacterium bovis subsp bovis AF2122/97
ccccaugaccgggaggcgg

SEQ ID NO: 1134440 - RNA, 18 nt, Mycobacterium bovis subsp bovis AF2122/97
ccccaugccgaccggcac

SEQ ID NO: 1134441 - RNA, 13 nt, Mycobacterium bovis subsp bovis AF2122/97
ccccagcuuggcg

SEQ ID NO: 1134442 - RNA, 16 nt, Mycobacterium bovis subsp bovis AF2122/97
ccccagcggccaccga

SEQ ID NO: 1134443 - RNA, 19 nt, Mycobacterium bovis subsp bovis AF2122/97
ccccagcguucccgccggc

SEQ ID NO: 1134444 - RNA, 18 nt, Mycobacterium bovis subsp bovis AF2122/97
ccccaucaccaccggcac

SEQ ID NO: 1134445 - RNA, 15 nt, Mycobacterium bovis subsp bovis AF2122/97
ccccagcguucccgc

SEQ ID NO: 1134446 - RNA, 11 nt, Mycobacterium bovis subsp bovis AF2122/97
ccccacccgcg

SEQ ID NO: 1134447 - RNA, 15 nt, Mycobacterium bovis subsp bovis AF2122/97
ccccacauggcccgg

SEQ ID NO: 1134448 - RNA, 20 nt, Mycobacterium bovis subsp bovis AF2122/97
ccccacacgaagugggucaa

SEQ ID NO: 1134449 - RNA, 13 nt, Mycobacterium bovis subsp bovis AF2122/97
ccccacccgcggc

SEQ ID NO: 1134450 - RNA, 17 nt, Mycobacterium bovis subsp bovis AF2122/97
ccccagcaguucgccgc

SEQ ID NO: 1134451 - RNA, 21 nt, Mycobacterium bovis subsp bovis AF2122/97
ccccagccgcggcgccuccgc

SEQ ID NO: 1134452 - RNA, 15 nt, Mycobacterium bovis subsp bovis AF2122/97
ccccagcgccgccgc

SEQ ID NO: 1134453 - RNA, 19 nt, Mycobacterium bovis subsp bovis AF2122/97
ccccaauugaacgcaccaa

SEQ ID NO: 1134454 - RNA, 14 nt, Mycobacterium bovis subsp bovis AF2122/97
ccccaaaccggcgg

SEQ ID NO: 1134455 - RNA, 23 nt, Mycobacterium bovis subsp bovis AF2122/97
ccccaagcgccugagcggccucg

SEQ ID NO: 1134456 - RNA, 18 nt, Mycobacterium bovis subsp bovis AF2122/97
ccccaagcgugcugccgc

SEQ ID NO: 1134457 - RNA, 19 nt, Mycobacterium bovis subsp bovis AF2122/97
cccagacaauccgccgccg

SEQ ID NO: 1134458 - RNA, 14 nt, Mycobacterium bovis subsp bovis AF2122/97
cccagacaccggcu

SEQ ID NO: 1134459 - RNA, 22 nt, Mycobacterium bovis subsp bovis AF2122/97
cccagaaguagguuuucggcgg

SEQ ID NO: 1134460 - RNA, 16 nt, Mycobacterium bovis subsp bovis AF2122/97
cccacggugucccgcg

SEQ ID NO: 1134461 - RNA, 21 nt, Mycobacterium bovis subsp bovis AF2122/97
cccacguugaugaugccggcg

SEQ ID NO: 1134462 - RNA, 22 nt, Mycobacterium bovis subsp bovis AF2122/97
cccacguugcugaugcccuugc

SEQ ID NO: 1134463 - RNA, 12 nt, Mycobacterium bovis subsp bovis AF2122/97
cccacguuggcc

SEQ ID NO: 1134464 - RNA, 13 nt, Mycobacterium bovis subsp bovis AF2122/97
cccacggcgggcg

SEQ ID NO: 1134465 - RNA, 14 nt, Mycobacterium bovis subsp bovis AF2122/97
cccacggccggccg

SEQ ID NO: 1134466 - RNA, 20 nt, Mycobacterium bovis subsp bovis AF2122/97
cccacggccggccgcugcca

SEQ ID NO: 1134467 - RNA, 14 nt, Mycobacterium bovis subsp bovis AF2122/97
cccacgggccggcc

SEQ ID NO: 1134468 - RNA, 15 nt, Mycobacterium bovis subsp bovis AF2122/97
cccacgggccggccg

SEQ ID NO: 1134469 - RNA, 19 nt, Mycobacterium bovis subsp bovis AF2122/97
cccacgggccggccgagcg

SEQ ID NO: 1134470 - RNA, 22 nt, Mycobacterium bovis subsp bovis AF2122/97
cccacgcgcagaaagucgcgcg

SEQ ID NO: 1134471 - RNA, 16 nt, Mycobacterium bovis subsp bovis AF2122/97
cccacgccgguggcac

SEQ ID NO: 1134472 - RNA, 21 nt, Mycobacterium bovis subsp bovis AF2122/97
cccaccgacagccccaucacc

SEQ ID NO: 1134473 - RNA, 14 nt, Mycobacterium bovis subsp bovis AF2122/97
cccacggcagcgcc

SEQ ID NO: 1134474 - RNA, 17 nt, Mycobacterium bovis subsp bovis AF2122/97
cccacccgcaccaccgg

SEQ ID NO: 1134475 - RNA, 14 nt, Mycobacterium bovis subsp bovis AF2122/97
cccacccgcaccgc

SEQ ID NO: 1134476 - RNA, 13 nt, Mycobacterium bovis subsp bovis AF2122/97
cccaccgaaaccg

SEQ ID NO: 1134477 - RNA, 13 nt, Mycobacterium bovis subsp bovis AF2122/97
cccacccgcugcg

SEQ ID NO: 1134478 - RNA, 19 nt, Mycobacterium bovis subsp bovis AF2122/97
cccaccgaaaccggucagc

SEQ ID NO: 1134479 - RNA, 13 nt, Mycobacterium bovis subsp bovis AF2122/97
cccaccggcgccg

SEQ ID NO: 1134480 - RNA, 16 nt, Mycobacterium bovis subsp bovis AF2122/97
cccaccggcgccgccg

SEQ ID NO: 1134481 - RNA, 19 nt, Mycobacterium bovis subsp bovis AF2122/97
cccaccggcuaugcuggcg

SEQ ID NO: 1134482 - RNA, 15 nt, Mycobacterium bovis subsp bovis AF2122/97
cccaccggccggugc

SEQ ID NO: 1134483 - RNA, 22 nt, Mycobacterium bovis subsp bovis AF2122/97
cccaccgcaacgcuucggcagc

SEQ ID NO: 1134484 - RNA, 12 nt, Mycobacterium bovis subsp bovis AF2122/97
cccaccgcugcg

SEQ ID NO: 1134485 - RNA, 16 nt, Mycobacterium bovis subsp bovis AF2122/97
cccaccgcugcggcac

SEQ ID NO: 1134486 - RNA, 12 nt, Mycobacterium bovis subsp bovis AF2122/97
cccaccggccac

SEQ ID NO: 1134487 - RNA, 13 nt, Mycobacterium bovis subsp bovis AF2122/97
cccaccggccacc

SEQ ID NO: 1134488 - RNA, 13 nt, Mycobacterium bovis subsp bovis AF2122/97
cccaccggccacu

SEQ ID NO: 1134489 - RNA, 12 nt, Mycobacterium bovis subsp bovis AF2122/97
cccaccggcccg

SEQ ID NO: 1134490 - RNA, 22 nt, Mycobacterium bovis subsp bovis AF2122/97
cccaccagugcaucgaucaccg

SEQ ID NO: 1134491 - RNA, 16 nt, Mycobacterium bovis subsp bovis AF2122/97
cccaccagcgcagccg

SEQ ID NO: 1134492 - RNA, 15 nt, Mycobacterium bovis subsp bovis AF2122/97
cccaccagcggcggc

SEQ ID NO: 1134493 - RNA, 16 nt, Mycobacterium bovis subsp bovis AF2122/97
cccaccagcggcggcc

SEQ ID NO: 1134494 - RNA, 16 nt, Mycobacterium bovis subsp bovis AF2122/97
cccacccauggccucc

SEQ ID NO: 1134495 - RNA, 18 nt, Mycobacterium bovis subsp bovis AF2122/97
cccaccauucgcgggccg

SEQ ID NO: 1134496 - RNA, 22 nt, Mycobacterium bovis subsp bovis AF2122/97
cccaccauucgcgggccgaggc

SEQ ID NO: 1134497 - RNA, 23 nt, Mycobacterium bovis subsp bovis AF2122/97
cccaccauucgcgggccgaggcc

SEQ ID NO: 1134498 - RNA, 20 nt, Mycobacterium bovis subsp bovis AF2122/97
cccacccgcggcgccguugc

SEQ ID NO: 1134499 - RNA, 20 nt, Mycobacterium bovis subsp bovis AF2122/97
cccaccccccagcgccgccg

SEQ ID NO: 1134500 - RNA, 15 nt, Mycobacterium bovis subsp bovis AF2122/97
cccaccaccgacagc

SEQ ID NO: 1134501 - RNA, 19 nt, Mycobacterium bovis subsp bovis AF2122/97
cccacaugacgaucgcggc

SEQ ID NO: 1134502 - RNA, 14 nt, Mycobacterium bovis subsp bovis AF2122/97
cccaccaccaccgc

SEQ ID NO: 1134503 - RNA, 16 nt, Mycobacterium bovis subsp bovis AF2122/97
cccaccacacagccgc

SEQ ID NO: 1134504 - RNA, 22 nt, Mycobacterium bovis subsp bovis AF2122/97
cccaccacacagccgcgcugcg

SEQ ID NO: 1134505 - RNA, 21 nt, Mycobacterium bovis subsp bovis AF2122/97
cccaacggugggugggcgccg

SEQ ID NO: 1134506 - RNA, 23 nt, Mycobacterium bovis subsp bovis AF2122/97
cccaacggugggugggcgccgca

SEQ ID NO: 1134507 - RNA, 19 nt, Mycobacterium bovis subsp bovis AF2122/97
cccaacugcgaaacgccac

SEQ ID NO: 1134508 - RNA, 22 nt, Mycobacterium bovis subsp bovis AF2122/97
cccaacugcgaaacgccaccgu

SEQ ID NO: 1134509 - RNA, 18 nt, Mycobacterium bovis subsp bovis AF2122/97
cccacaugacgaucgcgg

SEQ ID NO: 1134510 - RNA, 17 nt, Mycobacterium bovis subsp bovis AF2122/97
cccacauccaucgccag

SEQ ID NO: 1134511 - RNA, 19 nt, Mycobacterium bovis subsp bovis AF2122/97
cccaacgagaugugagcac

SEQ ID NO: 1134512 - RNA, 23 nt, Mycobacterium bovis subsp bovis AF2122/97
cccaacccuaaaccagccaccac

SEQ ID NO: 1134513 - RNA, 13 nt, Mycobacterium bovis subsp bovis AF2122/97
cccaaccgaaccg

SEQ ID NO: 1134514 - RNA, 17 nt, Mycobacterium bovis subsp bovis AF2122/97
cccaaccgcgccaccuc

SEQ ID NO: 1134515 - RNA, 18 nt, Mycobacterium bovis subsp bovis AF2122/97
cccaaccgcgccaccucc

SEQ ID NO: 1134516 - RNA, 14 nt, Mycobacterium bovis subsp bovis AF2122/97
cccaacgucgccag

SEQ ID NO: 1134517 - RNA, 19 nt, Mycobacterium bovis subsp bovis AF2122/97
cccaacgcccgggcgaauc

SEQ ID NO: 1134518 - RNA, 23 nt, Mycobacterium bovis subsp bovis AF2122/97
ccauuucgagcucgaagcccgga

SEQ ID NO: 1134519 - RNA, 12 nt, Mycobacterium bovis subsp bovis AF2122/97
cccaacccggau

SEQ ID NO: 1134520 - RNA, 17 nt, Mycobacterium bovis subsp bovis AF2122/97
cccaacaucccggaccg

SEQ ID NO: 1134521 - RNA, 12 nt, Mycobacterium bovis subsp bovis AF2122/97
cccaacaggcgg

SEQ ID NO: 1134522 - RNA, 13 nt, Mycobacterium bovis subsp bovis AF2122/97
cccaacagggcgg

SEQ ID NO: 1134523 - RNA, 17 nt, Mycobacterium bovis subsp bovis AF2122/97
cccaacacagccgucgc

SEQ ID NO: 1134524 - RNA, 15 nt, Mycobacterium bovis subsp bovis AF2122/97
cccaacaccgcgccg

SEQ ID NO: 1134525 - RNA, 13 nt, Mycobacterium bovis subsp bovis AF2122/97
cccaacagcaacc

SEQ ID NO: 1134526 - RNA, 19 nt, Mycobacterium bovis subsp bovis AF2122/97
cccaacagcccaccggugc

SEQ ID NO: 1134527 - RNA, 13 nt, Mycobacterium bovis subsp bovis AF2122/97
cccaaaaacggca

SEQ ID NO: 1134528 - RNA, 15 nt, Mycobacterium bovis subsp bovis AF2122/97
cccaaaccggcccgc

SEQ ID NO: 1134529 - RNA, 21 nt, Mycobacterium bovis subsp bovis AF2122/97
cccaaaccggcccgcagcagc

SEQ ID NO: 1134530 - RNA, 20 nt, Mycobacterium bovis subsp bovis AF2122/97
ccagucgccccaagcgccug

SEQ ID NO: 1134531 - RNA, 15 nt, Mycobacterium bovis subsp bovis AF2122/97
ccagucgauucggcc

SEQ ID NO: 1134532 - RNA, 13 nt, Mycobacterium bovis subsp bovis AF2122/97
ccaugcgaccggc

SEQ ID NO: 1134533 - RNA, 18 nt, Mycobacterium bovis subsp bovis AF2122/97
ccaugcgaccggcaacgc

SEQ ID NO: 1134534 - RNA, 17 nt, Mycobacterium bovis subsp bovis AF2122/97
ccagucgaaucgucauc

SEQ ID NO: 1134535 - RNA, 18 nt, Mycobacterium bovis subsp bovis AF2122/97
ccagucgagcaccugccg

SEQ ID NO: 1134536 - RNA, 19 nt, Mycobacterium bovis subsp bovis AF2122/97
ccagucgagcaccugccga

SEQ ID NO: 1134537 - RNA, 20 nt, Mycobacterium bovis subsp bovis AF2122/97
ccagucgaucgcggcccgca

SEQ ID NO: 1134538 - RNA, 18 nt, Mycobacterium bovis subsp bovis AF2122/97
ccagucgaagaagacccg

SEQ ID NO: 1134539 - RNA, 14 nt, Mycobacterium bovis subsp bovis AF2122/97
ccagucgaagaaga

SEQ ID NO: 1134540 - RNA, 15 nt, Mycobacterium bovis subsp bovis AF2122/97
ccagucgaagaagac

SEQ ID NO: 1134541 - RNA, 17 nt, Mycobacterium bovis subsp bovis AF2122/97
ccaguccggacggcagc

SEQ ID NO: 1134542 - RNA, 14 nt, Mycobacterium bovis subsp bovis AF2122/97
ccaguagaucgcga

SEQ ID NO: 1134543 - RNA, 22 nt, Mycobacterium bovis subsp bovis AF2122/97
ccaguaccgucaucgcggugug

SEQ ID NO: 1134544 - RNA, 14 nt, Mycobacterium bovis subsp bovis AF2122/97
aaauccuucggcgu

SEQ ID NO: 1134545 - RNA, 21 nt, Mycobacterium bovis subsp bovis AF2122/97
ccaugcgggugucgggcagca

SEQ ID NO: 1134546 - RNA, 12 nt, Mycobacterium bovis subsp bovis AF2122/97
ccaugcgccaac

SEQ ID NO: 1134547 - RNA, 16 nt, Mycobacterium bovis subsp bovis AF2122/97
ccaugcgccaacccgg

SEQ ID NO: 1134548 - RNA, 21 nt, Mycobacterium bovis subsp bovis AF2122/97
ccaugcgccaacccggccaaa

SEQ ID NO: 1134549 - RNA, 23 nt, Mycobacterium bovis subsp bovis AF2122/97
ccagucgccgaaagggucgacgu

SEQ ID NO: 1134550 - RNA, 15 nt, Mycobacterium bovis subsp bovis AF2122/97
ccaugcgccacgcca

SEQ ID NO: 1134551 - RNA, 13 nt, Mycobacterium bovis subsp bovis AF2122/97
ccauugcccgacg

SEQ ID NO: 1134552 - RNA, 20 nt, Mycobacterium bovis subsp bovis AF2122/97
ccauugccgccggugccgcc

SEQ ID NO: 1134553 - RNA, 15 nt, Mycobacterium bovis subsp bovis AF2122/97
ccauugccgccgucg

SEQ ID NO: 1134554 - RNA, 18 nt, Mycobacterium bovis subsp bovis AF2122/97
ccauugccgccgucgccg

SEQ ID NO: 1134555 - RNA, 16 nt, Mycobacterium bovis subsp bovis AF2122/97
ccauugccucccgcgc

SEQ ID NO: 1134556 - RNA, 19 nt, Mycobacterium bovis subsp bovis AF2122/97
ccauuguuccguccccgac

SEQ ID NO: 1134557 - RNA, 20 nt, Mycobacterium bovis subsp bovis AF2122/97
ccauuguuccguccccgacg

SEQ ID NO: 1134558 - RNA, 14 nt, Mycobacterium bovis subsp bovis AF2122/97
ccauugacgccguu

SEQ ID NO: 1134559 - RNA, 23 nt, Mycobacterium bovis subsp bovis AF2122/97
ccauugacguagaccgucgaucc

SEQ ID NO: 1134560 - RNA, 16 nt, Mycobacterium bovis subsp bovis AF2122/97
ccauucggcgagaaca

SEQ ID NO: 1134561 - RNA, 22 nt, Mycobacterium bovis subsp bovis AF2122/97
ccauucgcgggccgaggccguc

SEQ ID NO: 1134562 - RNA, 20 nt, Mycobacterium bovis subsp bovis AF2122/97
ccauucgcgguccaucagca

SEQ ID NO: 1134563 - RNA, 17 nt, Mycobacterium bovis subsp bovis AF2122/97
aaaucgaugaccgucgc

SEQ ID NO: 1134564 - RNA, 21 nt, Mycobacterium bovis subsp bovis AF2122/97
aaaucgaucguguacugcucc

SEQ ID NO: 1134565 - RNA, 16 nt, Mycobacterium bovis subsp bovis AF2122/97
aaaucgacagcagcgc

SEQ ID NO: 1134566 - RNA, 21 nt, Mycobacterium bovis subsp bovis AF2122/97
ccauguuuugcugcaugccga

SEQ ID NO: 1134567 - RNA, 22 nt, Mycobacterium bovis subsp bovis AF2122/97
cccaggugacgcccgcuccgcg

SEQ ID NO: 1134568 - RNA, 13 nt, Mycobacterium bovis subsp bovis AF2122/97
cccaggugggccg

SEQ ID NO: 1134569 - RNA, 20 nt, Mycobacterium bovis subsp bovis AF2122/97
cccagguguguggcggcguc

SEQ ID NO: 1134570 - RNA, 18 nt, Mycobacterium bovis subsp bovis AF2122/97
cccaggugggcagcaggc

SEQ ID NO: 1134571 - RNA, 21 nt, Mycobacterium bovis subsp bovis AF2122/97
cccagguugccuuggcggcca

SEQ ID NO: 1134572 - RNA, 21 nt, Mycobacterium bovis subsp bovis AF2122/97
cccagggggcgugccgccgca

SEQ ID NO: 1134573 - RNA, 19 nt, Mycobacterium bovis subsp bovis AF2122/97
cccaggucaacgacguuga

SEQ ID NO: 1134574 - RNA, 18 nt, Mycobacterium bovis subsp bovis AF2122/97
cccaggucgaugcgggcg

SEQ ID NO: 1134575 - RNA, 20 nt, Mycobacterium bovis subsp bovis AF2122/97
cccaggucgaugcgggcgac

SEQ ID NO: 1134576 - RNA, 14 nt, Mycobacterium bovis subsp bovis AF2122/97
cccagggcucggcg

SEQ ID NO: 1134577 - RNA, 18 nt, Mycobacterium bovis subsp bovis AF2122/97
cccagggcucggcggccc

SEQ ID NO: 1134578 - RNA, 15 nt, Mycobacterium bovis subsp bovis AF2122/97
cccagggcgucggcg

SEQ ID NO: 1134579 - RNA, 15 nt, Mycobacterium bovis subsp bovis AF2122/97
cccaggcucgcaccg

SEQ ID NO: 1134580 - RNA, 23 nt, Mycobacterium bovis subsp bovis AF2122/97
cccagcugucauccccggccagc

SEQ ID NO: 1134581 - RNA, 18 nt, Mycobacterium bovis subsp bovis AF2122/97
cccagcuuucgcgucacc

SEQ ID NO: 1134582 - RNA, 17 nt, Mycobacterium bovis subsp bovis AF2122/97
cccagcugcggucgcgg

SEQ ID NO: 1134583 - RNA, 16 nt, Mycobacterium bovis subsp bovis AF2122/97
cccagcucgucgacgu

SEQ ID NO: 1134584 - RNA, 18 nt, Mycobacterium bovis subsp bovis AF2122/97
cccagcucgucgacgucg

SEQ ID NO: 1134585 - RNA, 15 nt, Mycobacterium bovis subsp bovis AF2122/97
cccagcucgcgcacc

SEQ ID NO: 1134586 - RNA, 21 nt, Mycobacterium bovis subsp bovis AF2122/97
cccagcgugucuugucgcgca

SEQ ID NO: 1134587 - RNA, 22 nt, Mycobacterium bovis subsp bovis AF2122/97
cccagcgugucuugucgcgcag

SEQ ID NO: 1134588 - RNA, 15 nt, Mycobacterium bovis subsp bovis AF2122/97
cccagcgugcccgcc

SEQ ID NO: 1134589 - RNA, 19 nt, Mycobacterium bovis subsp bovis AF2122/97
cccagcgggucgcgggugc

SEQ ID NO: 1134590 - RNA, 20 nt, Mycobacterium bovis subsp bovis AF2122/97
cccagcgguagccgagcucg

SEQ ID NO: 1134591 - RNA, 14 nt, Mycobacterium bovis subsp bovis AF2122/97
cccagcggccgcga

SEQ ID NO: 1134592 - RNA, 21 nt, Mycobacterium bovis subsp bovis AF2122/97
cccagcggcgccacguggucg

SEQ ID NO: 1134593 - RNA, 14 nt, Mycobacterium bovis subsp bovis AF2122/97
cccagcgcggcaac

SEQ ID NO: 1134594 - RNA, 20 nt, Mycobacterium bovis subsp bovis AF2122/97
cccagcaucuuuggcggccg

SEQ ID NO: 1134595 - RNA, 19 nt, Mycobacterium bovis subsp bovis AF2122/97
cccagcagggugugcgucu

SEQ ID NO: 1134596 - RNA, 22 nt, Mycobacterium bovis subsp bovis AF2122/97
cccagcagguuuucgaucuggc

SEQ ID NO: 1134597 - RNA, 15 nt, Mycobacterium bovis subsp bovis AF2122/97
cccagcaggcccuug

SEQ ID NO: 1134598 - RNA, 17 nt, Mycobacterium bovis subsp bovis AF2122/97
cccagauauugaaccgg

SEQ ID NO: 1134599 - RNA, 14 nt, Mycobacterium bovis subsp bovis AF2122/97
cccagcagcgcgac

SEQ ID NO: 1134600 - RNA, 15 nt, Mycobacterium bovis subsp bovis AF2122/97
cccagcagcgcgacg

SEQ ID NO: 1134601 - RNA, 18 nt, Mycobacterium bovis subsp bovis AF2122/97
cccagaccgccgacgccg

SEQ ID NO: 1134602 - RNA, 15 nt, Mycobacterium bovis subsp bovis AF2122/97
cccagaccggcggcu

SEQ ID NO: 1134603 - RNA, 19 nt, Mycobacterium bovis subsp bovis AF2122/97
cccagagccgcugcggcac

SEQ ID NO: 1134604 - RNA, 16 nt, Mycobacterium bovis subsp bovis AF2122/97
cccaugucggcgcgcc

SEQ ID NO: 1134605 - RNA, 12 nt, Mycobacterium bovis subsp bovis AF2122/97
cccaugucggug

SEQ ID NO: 1134606 - RNA, 14 nt, Mycobacterium bovis subsp bovis AF2122/97
cccaugcggcaggu

SEQ ID NO: 1134607 - RNA, 20 nt, Mycobacterium bovis subsp bovis AF2122/97
cccaugcggcaggugcccau

SEQ ID NO: 1134608 - RNA, 16 nt, Mycobacterium bovis subsp bovis AF2122/97
cccaugcaacacaccg

SEQ ID NO: 1134609 - RNA, 18 nt, Mycobacterium bovis subsp bovis AF2122/97
cccaugcaacacaccgcg

SEQ ID NO: 1134610 - RNA, 14 nt, Mycobacterium bovis subsp bovis AF2122/97
cccaugcagcggcg

SEQ ID NO: 1134611 - RNA, 15 nt, Mycobacterium bovis subsp bovis AF2122/97
cccaugcccggcggg

SEQ ID NO: 1134612 - RNA, 15 nt, Mycobacterium bovis subsp bovis AF2122/97
cccauuucggcccga

SEQ ID NO: 1134613 - RNA, 21 nt, Mycobacterium bovis subsp bovis AF2122/97
cccauuuaaacgggccggugc

SEQ ID NO: 1134614 - RNA, 19 nt, Mycobacterium bovis subsp bovis AF2122/97
cccauuggccagguggcga

SEQ ID NO: 1134615 - RNA, 21 nt, Mycobacterium bovis subsp bovis AF2122/97
cccauuggguaaccagcgcca

SEQ ID NO: 1134616 - RNA, 14 nt, Mycobacterium bovis subsp bovis AF2122/97
cccauucggcggcg

SEQ ID NO: 1134617 - RNA, 14 nt, Mycobacterium bovis subsp bovis AF2122/97
cccauugccgccgu

SEQ ID NO: 1134618 - RNA, 20 nt, Mycobacterium bovis subsp bovis AF2122/97
cccauucaucuugcggcagc

SEQ ID NO: 1134619 - RNA, 16 nt, Mycobacterium bovis subsp bovis AF2122/97
cccauucucggccggc

SEQ ID NO: 1134620 - RNA, 19 nt, Mycobacterium bovis subsp bovis AF2122/97
cccaucccaugucgaggaa

SEQ ID NO: 1134621 - RNA, 14 nt, Mycobacterium bovis subsp bovis AF2122/97
cccaucgccacacc

SEQ ID NO: 1134622 - RNA, 16 nt, Mycobacterium bovis subsp bovis AF2122/97
cccaucgccacaccca

SEQ ID NO: 1134623 - RNA, 16 nt, Mycobacterium bovis subsp bovis AF2122/97
cccaucgaaaaaccuc

SEQ ID NO: 1134624 - RNA, 20 nt, Mycobacterium bovis subsp bovis AF2122/97
cccaucgaaaaaccucgacg

SEQ ID NO: 1134625 - RNA, 15 nt, Mycobacterium bovis subsp bovis AF2122/97
cccaucgaccgcccg

SEQ ID NO: 1134626 - RNA, 17 nt, Mycobacterium bovis subsp bovis AF2122/97
cccaucgaccgcccgcc

SEQ ID NO: 1134627 - RNA, 20 nt, Mycobacterium bovis subsp bovis AF2122/97
cccaucgaccgcccgccagc

SEQ ID NO: 1134628 - RNA, 13 nt, Mycobacterium bovis subsp bovis AF2122/97
cccaugaucuggu

SEQ ID NO: 1134629 - RNA, 19 nt, Mycobacterium bovis subsp bovis AF2122/97
cccaucuucggacgccagc

SEQ ID NO: 1134630 - RNA, 15 nt, Mycobacterium bovis subsp bovis AF2122/97
cccaugaccggccgc

SEQ ID NO: 1134631 - RNA, 17 nt, Mycobacterium bovis subsp bovis AF2122/97
cccaucgucgagccgcc

SEQ ID NO: 1134632 - RNA, 18 nt, Mycobacterium bovis subsp bovis AF2122/97
cccaucgucgagccgcca

SEQ ID NO: 1134633 - RNA, 21 nt, Mycobacterium bovis subsp bovis AF2122/97
cccagugucagcaagaucggc

SEQ ID NO: 1134634 - RNA, 22 nt, Mycobacterium bovis subsp bovis AF2122/97
cccagugugcgguuggaucggc

SEQ ID NO: 1134635 - RNA, 15 nt, Mycobacterium bovis subsp bovis AF2122/97
cccaguguucgacga

SEQ ID NO: 1134636 - RNA, 14 nt, Mycobacterium bovis subsp bovis AF2122/97
cccagugccacgcc

SEQ ID NO: 1134637 - RNA, 22 nt, Mycobacterium bovis subsp bovis AF2122/97
cccagugcgcaacccagccgcg

SEQ ID NO: 1134638 - RNA, 19 nt, Mycobacterium bovis subsp bovis AF2122/97
cccagugcacgcucggcgc

SEQ ID NO: 1134639 - RNA, 20 nt, Mycobacterium bovis subsp bovis AF2122/97
cccagugcagacaggcggcg

SEQ ID NO: 1134640 - RNA, 14 nt, Mycobacterium bovis subsp bovis AF2122/97
cccaguccaggacg

SEQ ID NO: 1134641 - RNA, 23 nt, Mycobacterium bovis subsp bovis AF2122/97
cccaguacgaucgugagacgccg

SEQ ID NO: 1134642 - RNA, 14 nt, Mycobacterium bovis subsp bovis AF2122/97
cccaguagaucgcc

SEQ ID NO: 1134643 - RNA, 15 nt, Mycobacterium bovis subsp bovis AF2122/97
cccaucaccgccagc

SEQ ID NO: 1134644 - RNA, 22 nt, Mycobacterium bovis subsp bovis AF2122/97
cccauaucgaucggaucggcac

SEQ ID NO: 1134645 - RNA, 17 nt, Mycobacterium bovis subsp bovis AF2122/97
cccauagccgguggucg

SEQ ID NO: 1134646 - RNA, 14 nt, Mycobacterium bovis subsp bovis AF2122/97
cccaucaucgccac

SEQ ID NO: 1134647 - RNA, 16 nt, Mycobacterium bovis subsp bovis AF2122/97
cccaguugugcggcca

SEQ ID NO: 1134648 - RNA, 18 nt, Mycobacterium bovis subsp bovis AF2122/97
cccaguugugcggccagg

SEQ ID NO: 1134649 - RNA, 18 nt, Mycobacterium bovis subsp bovis AF2122/97
cccauacucggcggcuuc

SEQ ID NO: 1134650 - RNA, 12 nt, Mycobacterium bovis subsp bovis AF2122/97
cccauacgccgg

SEQ ID NO: 1134651 - RNA, 15 nt, Mycobacterium bovis subsp bovis AF2122/97
cccauaacugcggcc

SEQ ID NO: 1134652 - RNA, 17 nt, Mycobacterium bovis subsp bovis AF2122/97
cccauacgccggccgcg

SEQ ID NO: 1134653 - RNA, 16 nt, Mycobacterium bovis subsp bovis AF2122/97
cccauaccuucggcga

SEQ ID NO: 1134654 - RNA, 16 nt, Mycobacterium bovis subsp bovis AF2122/97
ccgacucggcaccgcg

SEQ ID NO: 1134655 - RNA, 17 nt, Mycobacterium bovis subsp bovis AF2122/97
ccgacucggcaccgcgg

SEQ ID NO: 1134656 - RNA, 23 nt, Mycobacterium bovis subsp bovis AF2122/97
ccgacugacagaagcgguucgca

SEQ ID NO: 1134657 - RNA, 21 nt, Mycobacterium bovis subsp bovis AF2122/97
ccgacuccugugcggagccgc

SEQ ID NO: 1134658 - RNA, 15 nt, Mycobacterium bovis subsp bovis AF2122/97
ccgacugcugaauca

SEQ ID NO: 1134659 - RNA, 15 nt, Mycobacterium bovis subsp bovis AF2122/97
ccgacuggccccgcc

SEQ ID NO: 1134660 - RNA, 18 nt, Mycobacterium bovis subsp bovis AF2122/97
ccgacugccgcgggcagc

SEQ ID NO: 1134661 - RNA, 23 nt, Mycobacterium bovis subsp bovis AF2122/97
ccgacugccguucagcggcgggu

SEQ ID NO: 1134662 - RNA, 13 nt, Mycobacterium bovis subsp bovis AF2122/97
ccgacugggcgcg

SEQ ID NO: 1134663 - RNA, 20 nt, Mycobacterium bovis subsp bovis AF2122/97
ccgacuguagaaaacccgua

SEQ ID NO: 1134664 - RNA, 17 nt, Mycobacterium bovis subsp bovis AF2122/97
ccgacuguccccguuga

SEQ ID NO: 1134665 - RNA, 21 nt, Mycobacterium bovis subsp bovis AF2122/97
ccgacuguccccguugagaua

SEQ ID NO: 1134666 - RNA, 20 nt, Mycobacterium bovis subsp bovis AF2122/97
ccgacuugauuucgaucgcg

SEQ ID NO: 1134667 - RNA, 17 nt, Mycobacterium bovis subsp bovis AF2122/97
ccgacuugacggcgggu

SEQ ID NO: 1134668 - RNA, 16 nt, Mycobacterium bovis subsp bovis AF2122/97
ccgacuuccgcgucgc

SEQ ID NO: 1134669 - RNA, 21 nt, Mycobacterium bovis subsp bovis AF2122/97
ccgacuuccgcgucgccggcc

SEQ ID NO: 1134670 - RNA, 12 nt, Mycobacterium bovis subsp bovis AF2122/97
ccgacuucggaa

SEQ ID NO: 1134671 - RNA, 23 nt, Mycobacterium bovis subsp bovis AF2122/97
ccgacuuggugaccccguaggcg

SEQ ID NO: 1134672 - RNA, 14 nt, Mycobacterium bovis subsp bovis AF2122/97
ccgacuuggugacc

SEQ ID NO: 1134673 - RNA, 21 nt, Mycobacterium bovis subsp bovis AF2122/97
ccgacuuugagucguuggacg

SEQ ID NO: 1134674 - RNA, 23 nt, Mycobacterium bovis subsp bovis AF2122/97
ccgacuuugagucguuggacggc

SEQ ID NO: 1134675 - RNA, 13 nt, Mycobacterium bovis subsp bovis AF2122/97
ccgacuuuggcca

SEQ ID NO: 1134676 - RNA, 14 nt, Mycobacterium bovis subsp bovis AF2122/97
ccgagaaagugcag

SEQ ID NO: 1134677 - RNA, 15 nt, Mycobacterium bovis subsp bovis AF2122/97
ccgacgucggugacc

SEQ ID NO: 1134678 - RNA, 21 nt, Mycobacterium bovis subsp bovis AF2122/97
ccgacgucaggcagcuccgcc

SEQ ID NO: 1134679 - RNA, 21 nt, Mycobacterium bovis subsp bovis AF2122/97
ccgacguggaugguggugccg

SEQ ID NO: 1134680 - RNA, 18 nt, Mycobacterium bovis subsp bovis AF2122/97
ccgacguggccagcccgc

SEQ ID NO: 1134681 - RNA, 21 nt, Mycobacterium bovis subsp bovis AF2122/97
ccgacguggccagcccgccca

SEQ ID NO: 1134682 - RNA, 18 nt, Mycobacterium bovis subsp bovis AF2122/97
ccgacuccccgccgggca

SEQ ID NO: 1134683 - RNA, 16 nt, Mycobacterium bovis subsp bovis AF2122/97
ccgacucaucggccgc

SEQ ID NO: 1134684 - RNA, 18 nt, Mycobacterium bovis subsp bovis AF2122/97
ccgacucaggucggugcg

SEQ ID NO: 1134685 - RNA, 24 nt, Mycobacterium bovis subsp bovis AF2122/97
ccgacucaggucggugcggucauc

SEQ ID NO: 1134686 - RNA, 19 nt, Mycobacterium bovis subsp bovis AF2122/97
ccgacucaucggccgcggu

SEQ ID NO: 1134687 - RNA, 15 nt, Mycobacterium bovis subsp bovis AF2122/97
ccgacuaucggccgc

SEQ ID NO: 1134688 - RNA, 16 nt, Mycobacterium bovis subsp bovis AF2122/97
ccgacuaucggccgcc

SEQ ID NO: 1134689 - RNA, 21 nt, Mycobacterium bovis subsp bovis AF2122/97
ccgacuaucggccgccggauc

SEQ ID NO: 1134690 - RNA, 15 nt, Mycobacterium bovis subsp bovis AF2122/97
ccgacgucgccgacg

SEQ ID NO: 1134691 - RNA, 18 nt, Mycobacterium bovis subsp bovis AF2122/97
ccgacgucgccgacgguu

SEQ ID NO: 1134692 - RNA, 13 nt, Mycobacterium bovis subsp bovis AF2122/97
ccgacguugaagc

SEQ ID NO: 1134693 - RNA, 21 nt, Mycobacterium bovis subsp bovis AF2122/97
ccgacguugccgaagccggau

SEQ ID NO: 1134694 - RNA, 19 nt, Mycobacterium bovis subsp bovis AF2122/97
ccgagaugaugcugccggc

SEQ ID NO: 1134695 - RNA, 20 nt, Mycobacterium bovis subsp bovis AF2122/97
ccgagaucaugccggcgaac

SEQ ID NO: 1134696 - RNA, 16 nt, Mycobacterium bovis subsp bovis AF2122/97
ccgagaucgucgcgac

SEQ ID NO: 1134697 - RNA, 17 nt, Mycobacterium bovis subsp bovis AF2122/97
ccgagaucgcgugcgac

SEQ ID NO: 1134698 - RNA, 16 nt, Mycobacterium bovis subsp bovis AF2122/97
ccgagauccguccgcu

SEQ ID NO: 1134699 - RNA, 18 nt, Mycobacterium bovis subsp bovis AF2122/97
ccgagauccguccgcugg

SEQ ID NO: 1134700 - RNA, 14 nt, Mycobacterium bovis subsp bovis AF2122/97
ccgagaucgacauc

SEQ ID NO: 1134701 - RNA, 18 nt, Mycobacterium bovis subsp bovis AF2122/97
ccgagaucccagcgggac

SEQ ID NO: 1134702 - RNA, 18 nt, Mycobacterium bovis subsp bovis AF2122/97
ccgagaucaugccggcga

SEQ ID NO: 1134703 - RNA, 18 nt, Mycobacterium bovis subsp bovis AF2122/97
ccgagaucaccgguacgc

SEQ ID NO: 1134704 - RNA, 15 nt, Mycobacterium bovis subsp bovis AF2122/97
ccgagcaaggggauc

SEQ ID NO: 1134705 - RNA, 20 nt, Mycobacterium bovis subsp bovis AF2122/97
ccgagcacaggaucacccac

SEQ ID NO: 1134706 - RNA, 15 nt, Mycobacterium bovis subsp bovis AF2122/97
ccgagcaacaccguc

SEQ ID NO: 1134707 - RNA, 17 nt, Mycobacterium bovis subsp bovis AF2122/97
ccgagcaacaccgucgg

SEQ ID NO: 1134708 - RNA, 15 nt, Mycobacterium bovis subsp bovis AF2122/97
ccgagcaacggcggc

SEQ ID NO: 1134709 - RNA, 15 nt, Mycobacterium bovis subsp bovis AF2122/97
ccgagauggcgauca

SEQ ID NO: 1134710 - RNA, 17 nt, Mycobacterium bovis subsp bovis AF2122/97
ccgagagcagccagcca

SEQ ID NO: 1134711 - RNA, 17 nt, Mycobacterium bovis subsp bovis AF2122/97
ccgagaugcuggucggc

SEQ ID NO: 1134712 - RNA, 23 nt, Mycobacterium bovis subsp bovis AF2122/97
ccgagauugggcugggauagcgc

SEQ ID NO: 1134713 - RNA, 22 nt, Mycobacterium bovis subsp bovis AF2122/97
ccgagcaaacauccacccgcgg

SEQ ID NO: 1134714 - RNA, 13 nt, Mycobacterium bovis subsp bovis AF2122/97
ccgagacgucggc

SEQ ID NO: 1134715 - RNA, 15 nt, Mycobacterium bovis subsp bovis AF2122/97
ccgagacgucggcgu

SEQ ID NO: 1134716 - RNA, 20 nt, Mycobacterium bovis subsp bovis AF2122/97
ccgagacggcgucgggccgu

SEQ ID NO: 1134717 - RNA, 17 nt, Mycobacterium bovis subsp bovis AF2122/97
ccgagacgccccauucg

SEQ ID NO: 1134718 - RNA, 23 nt, Mycobacterium bovis subsp bovis AF2122/97
ccgagacgaccuccucgaugacc

SEQ ID NO: 1134719 - RNA, 19 nt, Mycobacterium bovis subsp bovis AF2122/97
ccgagacuugcuggcccgc

SEQ ID NO: 1134720 - RNA, 15 nt, Mycobacterium bovis subsp bovis AF2122/97
ccgagagcaccgcuc

SEQ ID NO: 1134721 - RNA, 18 nt, Mycobacterium bovis subsp bovis AF2122/97
ccgagauagggccgcguc

SEQ ID NO: 1134722 - RNA, 14 nt, Mycobacterium bovis subsp bovis AF2122/97
ccgagaucaccgcc

SEQ ID NO: 1134723 - RNA, 16 nt, Mycobacterium bovis subsp bovis AF2122/97
ccgagaucaccgccac

SEQ ID NO: 1134724 - RNA, 13 nt, Mycobacterium bovis subsp bovis AF2122/97
ccgagagcagcca

SEQ ID NO: 1134725 - RNA, 16 nt, Mycobacterium bovis subsp bovis AF2122/97
ccgagagcagccagcc

SEQ ID NO: 1134726 - RNA, 14 nt, Mycobacterium bovis subsp bovis AF2122/97
ccgagaccacgcgc

SEQ ID NO: 1134727 - RNA, 16 nt, Mycobacterium bovis subsp bovis AF2122/97
ccgagaccacgcgcgu

SEQ ID NO: 1134728 - RNA, 18 nt, Mycobacterium bovis subsp bovis AF2122/97
ccgagaccgccgcugccg

SEQ ID NO: 1134729 - RNA, 22 nt, Mycobacterium bovis subsp bovis AF2122/97
ccgagaccgccgcugccgccga

SEQ ID NO: 1134730 - RNA, 13 nt, Mycobacterium bovis subsp bovis AF2122/97
ccgagaccgcgug

SEQ ID NO: 1134731 - RNA, 22 nt, Mycobacterium bovis subsp bovis AF2122/97
ccgagaccgcgugcucgagcac

SEQ ID NO: 1134732 - RNA, 14 nt, Mycobacterium bovis subsp bovis AF2122/97
ccgagaccgcgugg

SEQ ID NO: 1134733 - RNA, 19 nt, Mycobacterium bovis subsp bovis AF2122/97
ccgagaacaccacgcaguc

SEQ ID NO: 1134734 - RNA, 14 nt, Mycobacterium bovis subsp bovis AF2122/97
ccgagaacaccggc

SEQ ID NO: 1134735 - RNA, 20 nt, Mycobacterium bovis subsp bovis AF2122/97
ccgagaacgauguccgcgcg

SEQ ID NO: 1134736 - RNA, 20 nt, Mycobacterium bovis subsp bovis AF2122/97
ccgagaacgcccgagugacc

SEQ ID NO: 1134737 - RNA, 20 nt, Mycobacterium bovis subsp bovis AF2122/97
ccgagaauuccccagccgca

SEQ ID NO: 1134738 - RNA, 18 nt, Mycobacterium bovis subsp bovis AF2122/97
ccgagaacugcucgaucc

SEQ ID NO: 1134739 - RNA, 17 nt, Mycobacterium bovis subsp bovis AF2122/97
ccgacggcgccccgcgc

SEQ ID NO: 1134740 - RNA, 14 nt, Mycobacterium bovis subsp bovis AF2122/97
ccgacggcgcccgc

SEQ ID NO: 1134741 - RNA, 21 nt, Mycobacterium bovis subsp bovis AF2122/97
ccgacggcgcccgcccgagcc

SEQ ID NO: 1134742 - RNA, 12 nt, Mycobacterium bovis subsp bovis AF2122/97
ccgacggcgccg

SEQ ID NO: 1134743 - RNA, 15 nt, Mycobacterium bovis subsp bovis AF2122/97
ccgacggccgcggcg

SEQ ID NO: 1134744 - RNA, 16 nt, Mycobacterium bovis subsp bovis AF2122/97
ccgacggccgcggcgu

SEQ ID NO: 1134745 - RNA, 13 nt, Mycobacterium bovis subsp bovis AF2122/97
ccgacggcgacca

SEQ ID NO: 1134746 - RNA, 21 nt, Mycobacterium bovis subsp bovis AF2122/97
ccgacggcgaccaccgcggcu

SEQ ID NO: 1134747 - RNA, 20 nt, Mycobacterium bovis subsp bovis AF2122/97
ccgacgggauauccggucgc

SEQ ID NO: 1134748 - RNA, 23 nt, Mycobacterium bovis subsp bovis AF2122/97
ccgacgggauauccggucgcucc

SEQ ID NO: 1134749 - RNA, 19 nt, Mycobacterium bovis subsp bovis AF2122/97
ccgacggcggauaaccggc

SEQ ID NO: 1134750 - RNA, 23 nt, Mycobacterium bovis subsp bovis AF2122/97
ccgacggcgggcgaucuuggcga

SEQ ID NO: 1134751 - RNA, 15 nt, Mycobacterium bovis subsp bovis AF2122/97
ccgacgggacaaccc

SEQ ID NO: 1134752 - RNA, 17 nt, Mycobacterium bovis subsp bovis AF2122/97
ccgacgggacaacccgu

SEQ ID NO: 1134753 - RNA, 22 nt, Mycobacterium bovis subsp bovis AF2122/97
ccgacggggauggagccgguga

SEQ ID NO: 1134754 - RNA, 13 nt, Mycobacterium bovis subsp bovis AF2122/97
ccgacgggccguc

SEQ ID NO: 1134755 - RNA, 19 nt, Mycobacterium bovis subsp bovis AF2122/97
ccgacgggccgucgccguc

SEQ ID NO: 1134756 - RNA, 14 nt, Mycobacterium bovis subsp bovis AF2122/97
ccgacgggcgcaac

SEQ ID NO: 1134757 - RNA, 12 nt, Mycobacterium bovis subsp bovis AF2122/97
ccgacgggugcg

SEQ ID NO: 1134758 - RNA, 15 nt, Mycobacterium bovis subsp bovis AF2122/97
ccgacgggugcgcgg

SEQ ID NO: 1134759 - RNA, 17 nt, Mycobacterium bovis subsp bovis AF2122/97
ccgacggcgccgaaccc

SEQ ID NO: 1134760 - RNA, 21 nt, Mycobacterium bovis subsp bovis AF2122/97
ccgacgggccacgaugcgcac

SEQ ID NO: 1134761 - RNA, 20 nt, Mycobacterium bovis subsp bovis AF2122/97
ccgacguacaggacgguuga

SEQ ID NO: 1134762 - RNA, 16 nt, Mycobacterium bovis subsp bovis AF2122/97
ccgacgucaggcagcu

SEQ ID NO: 1134763 - RNA, 18 nt, Mycobacterium bovis subsp bovis AF2122/97
ccgacguauagaccaggu

SEQ ID NO: 1134764 - RNA, 22 nt, Mycobacterium bovis subsp bovis AF2122/97
ccgacggcaucaacgcgggcgc

SEQ ID NO: 1134765 - RNA, 14 nt, Mycobacterium bovis subsp bovis AF2122/97
ccgacgcgcucggc

SEQ ID NO: 1134766 - RNA, 15 nt, Mycobacterium bovis subsp bovis AF2122/97
ccgacggcaagggca

SEQ ID NO: 1134767 - RNA, 13 nt, Mycobacterium bovis subsp bovis AF2122/97
ccgacggccagca

SEQ ID NO: 1134768 - RNA, 17 nt, Mycobacterium bovis subsp bovis AF2122/97
ccgacggccagcaagac

SEQ ID NO: 1134769 - RNA, 14 nt, Mycobacterium bovis subsp bovis AF2122/97
ccgacggcccggug

SEQ ID NO: 1134770 - RNA, 16 nt, Mycobacterium bovis subsp bovis AF2122/97
ccgacggaucgcccug

SEQ ID NO: 1134771 - RNA, 22 nt, Mycobacterium bovis subsp bovis AF2122/97
ccgacggacuccggccggccua

SEQ ID NO: 1134772 - RNA, 18 nt, Mycobacterium bovis subsp bovis AF2122/97
ccgacggacuucccgcgc

SEQ ID NO: 1134773 - RNA, 20 nt, Mycobacterium bovis subsp bovis AF2122/97
ccgacggacuucccgcgcga

SEQ ID NO: 1134774 - RNA, 15 nt, Mycobacterium bovis subsp bovis AF2122/97
ccgacggacuccggc

SEQ ID NO: 1134775 - RNA, 17 nt, Mycobacterium bovis subsp bovis AF2122/97
ccgacgcgucggcgacg

SEQ ID NO: 1134776 - RNA, 16 nt, Mycobacterium bovis subsp bovis AF2122/97
ccgacgcuaagucccc

SEQ ID NO: 1134777 - RNA, 18 nt, Mycobacterium bovis subsp bovis AF2122/97
ccgacgcuaaguccccgc

SEQ ID NO: 1134778 - RNA, 16 nt, Mycobacterium bovis subsp bovis AF2122/97
ccgacgcgucggcgac

SEQ ID NO: 1134779 - RNA, 13 nt, Mycobacterium bovis subsp bovis AF2122/97
ccgacgcguccgg

SEQ ID NO: 1134780 - RNA, 14 nt, Mycobacterium bovis subsp bovis AF2122/97
ccgacgcguccggu

SEQ ID NO: 1134781 - RNA, 18 nt, Mycobacterium bovis subsp bovis AF2122/97
ccgacgcguccggugcac

SEQ ID NO: 1134782 - RNA, 19 nt, Mycobacterium bovis subsp bovis AF2122/97
ccgacgcguccggugcacc

SEQ ID NO: 1134783 - RNA, 16 nt, Mycobacterium bovis subsp bovis AF2122/97
ccgacgcggucggcgg

SEQ ID NO: 1134784 - RNA, 20 nt, Mycobacterium bovis subsp bovis AF2122/97
ccgacgcggucggcggccgc

SEQ ID NO: 1134785 - RNA, 13 nt, Mycobacterium bovis subsp bovis AF2122/97
ccgacgcgggccg

SEQ ID NO: 1134786 - RNA, 14 nt, Mycobacterium bovis subsp bovis AF2122/97
ccgacgcgggccgc

SEQ ID NO: 1134787 - RNA, 13 nt, Mycobacterium bovis subsp bovis AF2122/97
ccgacgccaccgc

SEQ ID NO: 1134788 - RNA, 15 nt, Mycobacterium bovis subsp bovis AF2122/97
ccgacgccaccgcca

SEQ ID NO: 1134789 - RNA, 21 nt, Mycobacterium bovis subsp bovis AF2122/97
ccgacgccagcugcccgacgu

SEQ ID NO: 1134790 - RNA, 16 nt, Mycobacterium bovis subsp bovis AF2122/97
ccgacgccauuggccu

SEQ ID NO: 1134791 - RNA, 19 nt, Mycobacterium bovis subsp bovis AF2122/97
ccgacgccagaacguggcc

SEQ ID NO: 1134792 - RNA, 17 nt, Mycobacterium bovis subsp bovis AF2122/97
ccgacgccaacgccagc

SEQ ID NO: 1134793 - RNA, 21 nt, Mycobacterium bovis subsp bovis AF2122/97
ccgacgccaacgccagcgggu

SEQ ID NO: 1134794 - RNA, 14 nt, Mycobacterium bovis subsp bovis AF2122/97
ccgacgccgccagg

SEQ ID NO: 1134795 - RNA, 22 nt, Mycobacterium bovis subsp bovis AF2122/97
ccgacgccgccagguccgccgg

SEQ ID NO: 1134796 - RNA, 14 nt, Mycobacterium bovis subsp bovis AF2122/97
ccgacgccccgauc

SEQ ID NO: 1134797 - RNA, 17 nt, Mycobacterium bovis subsp bovis AF2122/97
ccgacgccccgaucggc

SEQ ID NO: 1134798 - RNA, 20 nt, Mycobacterium bovis subsp bovis AF2122/97
ccgacgccccgaucggccac

SEQ ID NO: 1134799 - RNA, 14 nt, Mycobacterium bovis subsp bovis AF2122/97
ccgacgccgccggc

SEQ ID NO: 1134800 - RNA, 15 nt, Mycobacterium bovis subsp bovis AF2122/97
ccgacgccgccggca

SEQ ID NO: 1134801 - RNA, 19 nt, Mycobacterium bovis subsp bovis AF2122/97
ccgacgccgccggccccgc

SEQ ID NO: 1134802 - RNA, 19 nt, Mycobacterium bovis subsp bovis AF2122/97
ccgacgccgccggcgccac

SEQ ID NO: 1134803 - RNA, 16 nt, Mycobacterium bovis subsp bovis AF2122/97
ccgacgccgucgagca

SEQ ID NO: 1134804 - RNA, 17 nt, Mycobacterium bovis subsp bovis AF2122/97
ccgacgccggugucggc

SEQ ID NO: 1134805 - RNA, 18 nt, Mycobacterium bovis subsp bovis AF2122/97
ccgacgccggugucggcu

SEQ ID NO: 1134806 - RNA, 11 nt, Mycobacterium bovis subsp bovis AF2122/97
ccgacgccggu

SEQ ID NO: 1134807 - RNA, 16 nt, Mycobacterium bovis subsp bovis AF2122/97
ccgacgccgguggcag

SEQ ID NO: 1134808 - RNA, 15 nt, Mycobacterium bovis subsp bovis AF2122/97
ccgacgaugcgggcg

SEQ ID NO: 1134809 - RNA, 18 nt, Mycobacterium bovis subsp bovis AF2122/97
ccgacgaucgacgccgcc

SEQ ID NO: 1134810 - RNA, 20 nt, Mycobacterium bovis subsp bovis AF2122/97
ccgacgaucgacgccgccac

SEQ ID NO: 1134811 - RNA, 22 nt, Mycobacterium bovis subsp bovis AF2122/97
ccgacgcagcuugcccgacggc

SEQ ID NO: 1134812 - RNA, 21 nt, Mycobacterium bovis subsp bovis AF2122/97
ccgacgcaggugaacgccggu

SEQ ID NO: 1134813 - RNA, 21 nt, Mycobacterium bovis subsp bovis AF2122/97
ccgacgaucgacgccgccacc

SEQ ID NO: 1134814 - RNA, 14 nt, Mycobacterium bovis subsp bovis AF2122/97
ccgacgcaccaacg

SEQ ID NO: 1134815 - RNA, 20 nt, Mycobacterium bovis subsp bovis AF2122/97
ccgacgcaccucgguggcug

SEQ ID NO: 1134816 - RNA, 21 nt, Mycobacterium bovis subsp bovis AF2122/97
ccgacgcagaacggcguugcg

SEQ ID NO: 1134817 - RNA, 17 nt, Mycobacterium bovis subsp bovis AF2122/97
ccgacgaggacgucacc

SEQ ID NO: 1134818 - RNA, 20 nt, Mycobacterium bovis subsp bovis AF2122/97
ccgacgagauugccgggccg

SEQ ID NO: 1134819 - RNA, 21 nt, Mycobacterium bovis subsp bovis AF2122/97
ccgacgagauugccgggccgc

SEQ ID NO: 1134820 - RNA, 18 nt, Mycobacterium bovis subsp bovis AF2122/97
ccgacgacuccggcaagc

SEQ ID NO: 1134821 - RNA, 18 nt, Mycobacterium bovis subsp bovis AF2122/97
ccgacgagauacggccac

SEQ ID NO: 1134822 - RNA, 15 nt, Mycobacterium bovis subsp bovis AF2122/97
ccgacgagucgccgc

SEQ ID NO: 1134823 - RNA, 19 nt, Mycobacterium bovis subsp bovis AF2122/97
ccgacgagucgccgcgggc

SEQ ID NO: 1134824 - RNA, 20 nt, Mycobacterium bovis subsp bovis AF2122/97
ccgacgagucgccgcgggca

SEQ ID NO: 1134825 - RNA, 21 nt, Mycobacterium bovis subsp bovis AF2122/97
ccgacgagucgccgcgggcag

SEQ ID NO: 1134826 - RNA, 20 nt, Mycobacterium bovis subsp bovis AF2122/97
ccgacgaggggcgcgggugg

SEQ ID NO: 1134827 - RNA, 19 nt, Mycobacterium bovis subsp bovis AF2122/97
ccgacgaucauauggccgc

SEQ ID NO: 1134828 - RNA, 17 nt, Mycobacterium bovis subsp bovis AF2122/97
ccgacgaucgacgccgc

SEQ ID NO: 1134829 - RNA, 17 nt, Mycobacterium bovis subsp bovis AF2122/97
ccgaccgauacaccgac

SEQ ID NO: 1134830 - RNA, 22 nt, Mycobacterium bovis subsp bovis AF2122/97
ccgaccgauacaccgacgggau

SEQ ID NO: 1134831 - RNA, 23 nt, Mycobacterium bovis subsp bovis AF2122/97
ccgaccgauacaccgacgggaua

SEQ ID NO: 1134832 - RNA, 15 nt, Mycobacterium bovis subsp bovis AF2122/97
ccgaccgaccgcacg

SEQ ID NO: 1134833 - RNA, 17 nt, Mycobacterium bovis subsp bovis AF2122/97
ccgacccgggggcgccc

SEQ ID NO: 1134834 - RNA, 18 nt, Mycobacterium bovis subsp bovis AF2122/97
ccgacccgggggcgcccg

SEQ ID NO: 1134835 - RNA, 16 nt, Mycobacterium bovis subsp bovis AF2122/97
ccgaccgaaucagcac

SEQ ID NO: 1134836 - RNA, 18 nt, Mycobacterium bovis subsp bovis AF2122/97
ccgaccgaaucagcacgg

SEQ ID NO: 1134837 - RNA, 15 nt, Mycobacterium bovis subsp bovis AF2122/97
ccgacccugcugcag

SEQ ID NO: 1134838 - RNA, 18 nt, Mycobacterium bovis subsp bovis AF2122/97
ccgacccugcugcagggc

SEQ ID NO: 1134839 - RNA, 20 nt, Mycobacterium bovis subsp bovis AF2122/97
ccgacccguaccagcccguc

SEQ ID NO: 1134840 - RNA, 22 nt, Mycobacterium bovis subsp bovis AF2122/97
ccgacccgggcgagcgcggccu

SEQ ID NO: 1134841 - RNA, 18 nt, Mycobacterium bovis subsp bovis AF2122/97
ccgacccggccgcugacg

SEQ ID NO: 1134842 - RNA, 12 nt, Mycobacterium bovis subsp bovis AF2122/97
ccgacccgcgcg

SEQ ID NO: 1134843 - RNA, 13 nt, Mycobacterium bovis subsp bovis AF2122/97
ccgacccgcgcgc

SEQ ID NO: 1134844 - RNA, 15 nt, Mycobacterium bovis subsp bovis AF2122/97
ccgacccgcgcgccg

SEQ ID NO: 1134845 - RNA, 19 nt, Mycobacterium bovis subsp bovis AF2122/97
ccgacccgcgcgccggcga

SEQ ID NO: 1134846 - RNA, 21 nt, Mycobacterium bovis subsp bovis AF2122/97
ccgacccgccgacgccgccgg

SEQ ID NO: 1134847 - RNA, 13 nt, Mycobacterium bovis subsp bovis AF2122/97
ccgacccgccgcg

SEQ ID NO: 1134848 - RNA, 18 nt, Mycobacterium bovis subsp bovis AF2122/97
ccgacccgccgcgcccgg

SEQ ID NO: 1134849 - RNA, 23 nt, Mycobacterium bovis subsp bovis AF2122/97
ccgacccgccgcgcccggcgcaa

SEQ ID NO: 1134850 - RNA, 22 nt, Mycobacterium bovis subsp bovis AF2122/97
ccgacccgaugcgucucgcgcg

SEQ ID NO: 1134851 - RNA, 19 nt, Mycobacterium bovis subsp bovis AF2122/97
ccgaccaugguagcgcccc

SEQ ID NO: 1134852 - RNA, 17 nt, Mycobacterium bovis subsp bovis AF2122/97
ccgacccaucaccagcg

SEQ ID NO: 1134853 - RNA, 18 nt, Mycobacterium bovis subsp bovis AF2122/97
ccgacccaucaccagcgg

SEQ ID NO: 1134854 - RNA, 24 nt, Mycobacterium bovis subsp bovis AF2122/97
ccgacccaucaccagcggcugcag

SEQ ID NO: 1134855 - RNA, 15 nt, Mycobacterium bovis subsp bovis AF2122/97
ccgaccccgcgccga

SEQ ID NO: 1134856 - RNA, 15 nt, Mycobacterium bovis subsp bovis AF2122/97
ccgaccccgccgagc

SEQ ID NO: 1134857 - RNA, 17 nt, Mycobacterium bovis subsp bovis AF2122/97
ccgaccaacgcggugug

SEQ ID NO: 1134858 - RNA, 18 nt, Mycobacterium bovis subsp bovis AF2122/97
ccgaccaccucagcugcg

SEQ ID NO: 1134859 - RNA, 14 nt, Mycobacterium bovis subsp bovis AF2122/97
ccgaccaccgcgaa

SEQ ID NO: 1134860 - RNA, 16 nt, Mycobacterium bovis subsp bovis AF2122/97
ccgaccaccucagcug

SEQ ID NO: 1134861 - RNA, 21 nt, Mycobacterium bovis subsp bovis AF2122/97
ccgaccacuccacgcagcccg

SEQ ID NO: 1134862 - RNA, 20 nt, Mycobacterium bovis subsp bovis AF2122/97
ccgaccagagcuucgccgcg

SEQ ID NO: 1134863 - RNA, 14 nt, Mycobacterium bovis subsp bovis AF2122/97
ccgaccagcacccg

SEQ ID NO: 1134864 - RNA, 12 nt, Mycobacterium bovis subsp bovis AF2122/97
ccgaccagccgu

SEQ ID NO: 1134865 - RNA, 19 nt, Mycobacterium bovis subsp bovis AF2122/97
ccgaccagcggccgaccgc

SEQ ID NO: 1134866 - RNA, 22 nt, Mycobacterium bovis subsp bovis AF2122/97
ccgaccagcggccgaccgcgac

SEQ ID NO: 1134867 - RNA, 16 nt, Mycobacterium bovis subsp bovis AF2122/97
ccgaccagcgcgcugc

SEQ ID NO: 1134868 - RNA, 22 nt, Mycobacterium bovis subsp bovis AF2122/97
ccgaccagcgcgcugcgcgacu

SEQ ID NO: 1134869 - RNA, 16 nt, Mycobacterium bovis subsp bovis AF2122/97
ccgaccagucgacguc

SEQ ID NO: 1134870 - RNA, 16 nt, Mycobacterium bovis subsp bovis AF2122/97
ccgaccaucgggacgc

SEQ ID NO: 1134871 - RNA, 19 nt, Mycobacterium bovis subsp bovis AF2122/97
ccgaccuguaugccgcggu

SEQ ID NO: 1134872 - RNA, 19 nt, Mycobacterium bovis subsp bovis AF2122/97
ccgaccucguucgucacca

SEQ ID NO: 1134873 - RNA, 14 nt, Mycobacterium bovis subsp bovis AF2122/97
ccgaccucgccgcg

SEQ ID NO: 1134874 - RNA, 15 nt, Mycobacterium bovis subsp bovis AF2122/97
ccgaccucggcaacg

SEQ ID NO: 1134875 - RNA, 18 nt, Mycobacterium bovis subsp bovis AF2122/97
ccgaccucugcguccagc

SEQ ID NO: 1134876 - RNA, 14 nt, Mycobacterium bovis subsp bovis AF2122/97
ccgaccugcaagac

SEQ ID NO: 1134877 - RNA, 17 nt, Mycobacterium bovis subsp bovis AF2122/97
ccgaccuuuugcggcaa

SEQ ID NO: 1134878 - RNA, 19 nt, Mycobacterium bovis subsp bovis AF2122/97
ccgaccuuuugcggcaagc

SEQ ID NO: 1134879 - RNA, 22 nt, Mycobacterium bovis subsp bovis AF2122/97
ccgaccuuccguuggcggcucg

SEQ ID NO: 1134880 - RNA, 16 nt, Mycobacterium bovis subsp bovis AF2122/97
ccgaccuucggcccgc

SEQ ID NO: 1134881 - RNA, 20 nt, Mycobacterium bovis subsp bovis AF2122/97
ccgacgaacaguugcggcug

SEQ ID NO: 1134882 - RNA, 14 nt, Mycobacterium bovis subsp bovis AF2122/97
ccgacgaccagcag

SEQ ID NO: 1134883 - RNA, 16 nt, Mycobacterium bovis subsp bovis AF2122/97
ccgacgacggcgacgg

SEQ ID NO: 1134884 - RNA, 19 nt, Mycobacterium bovis subsp bovis AF2122/97
ccgacgacgggguuguggu

SEQ ID NO: 1134885 - RNA, 12 nt, Mycobacterium bovis subsp bovis AF2122/97
ccgacgacguau

SEQ ID NO: 1134886 - RNA, 16 nt, Mycobacterium bovis subsp bovis AF2122/97
ccgacgacggcaccga

SEQ ID NO: 1134887 - RNA, 15 nt, Mycobacterium bovis subsp bovis AF2122/97
ccgaccgccaccgcc

SEQ ID NO: 1134888 - RNA, 22 nt, Mycobacterium bovis subsp bovis AF2122/97
ccgaccgauggcucaccagcuc

SEQ ID NO: 1134889 - RNA, 13 nt, Mycobacterium bovis subsp bovis AF2122/97
ccgaccgcaccgu

SEQ ID NO: 1134890 - RNA, 11 nt, Mycobacterium bovis subsp bovis AF2122/97
ccgaccgccga

SEQ ID NO: 1134891 - RNA, 21 nt, Mycobacterium bovis subsp bovis AF2122/97
ccgaccgcgggucgugccagc

SEQ ID NO: 1134892 - RNA, 19 nt, Mycobacterium bovis subsp bovis AF2122/97
ccgaccgcguacaggccgg

SEQ ID NO: 1134893 - RNA, 20 nt, Mycobacterium bovis subsp bovis AF2122/97
ccgaccgcguacaggccggc

SEQ ID NO: 1134894 - RNA, 24 nt, Mycobacterium bovis subsp bovis AF2122/97
ccgaccgccaccgccagcgucgac

SEQ ID NO: 1134895 - RNA, 21 nt, Mycobacterium bovis subsp bovis AF2122/97
ccgaccgcaugaucgcaccga

SEQ ID NO: 1134896 - RNA, 13 nt, Mycobacterium bovis subsp bovis AF2122/97
ccgaccgcgccgc

SEQ ID NO: 1134897 - RNA, 14 nt, Mycobacterium bovis subsp bovis AF2122/97
ccgaccgcgccgca

SEQ ID NO: 1134898 - RNA, 16 nt, Mycobacterium bovis subsp bovis AF2122/97
ccgaccgcgccgcauc

SEQ ID NO: 1134899 - RNA, 20 nt, Mycobacterium bovis subsp bovis AF2122/97
ccgaccgguggcaccggcgg

SEQ ID NO: 1134900 - RNA, 13 nt, Mycobacterium bovis subsp bovis AF2122/97
ccgaccgguggcg

SEQ ID NO: 1134901 - RNA, 13 nt, Mycobacterium bovis subsp bovis AF2122/97
ccgaccggccacg

SEQ ID NO: 1134902 - RNA, 21 nt, Mycobacterium bovis subsp bovis AF2122/97
ccgaccggcccgcauccgcac

SEQ ID NO: 1134903 - RNA, 13 nt, Mycobacterium bovis subsp bovis AF2122/97
ccgaccggcaccc

SEQ ID NO: 1134904 - RNA, 22 nt, Mycobacterium bovis subsp bovis AF2122/97
ccgaccgggucgcaaccgccgc

SEQ ID NO: 1134905 - RNA, 17 nt, Mycobacterium bovis subsp bovis AF2122/97
ccgaccgucgucgugca

SEQ ID NO: 1134906 - RNA, 23 nt, Mycobacterium bovis subsp bovis AF2122/97
ccgaccgucgucgugcaggcgca

SEQ ID NO: 1134907 - RNA, 19 nt, Mycobacterium bovis subsp bovis AF2122/97
ccgaccgugaucagcgcgu

SEQ ID NO: 1134908 - RNA, 19 nt, Mycobacterium bovis subsp bovis AF2122/97
ccgaccguuucuccgccgc

SEQ ID NO: 1134909 - RNA, 15 nt, Mycobacterium bovis subsp bovis AF2122/97
ccgaccuaccgucga

SEQ ID NO: 1134910 - RNA, 17 nt, Mycobacterium bovis subsp bovis AF2122/97
ccgaccuaccgucgacc

SEQ ID NO: 1134911 - RNA, 16 nt, Mycobacterium bovis subsp bovis AF2122/97
ccgaccuagcucgcgg

SEQ ID NO: 1134912 - RNA, 18 nt, Mycobacterium bovis subsp bovis AF2122/97
ccgacacucaaccugaac

SEQ ID NO: 1134913 - RNA, 21 nt, Mycobacterium bovis subsp bovis AF2122/97
ccgacacucaaccugaaccgg

SEQ ID NO: 1134914 - RNA, 20 nt, Mycobacterium bovis subsp bovis AF2122/97
ccgacacugggaucccgacg

SEQ ID NO: 1134915 - RNA, 20 nt, Mycobacterium bovis subsp bovis AF2122/97
ccgacagccgauccgaucgc

SEQ ID NO: 1134916 - RNA, 19 nt, Mycobacterium bovis subsp bovis AF2122/97
ccgacagcagguugccgaa

SEQ ID NO: 1134917 - RNA, 19 nt, Mycobacterium bovis subsp bovis AF2122/97
ccgacagcaguuucaccuu

SEQ ID NO: 1134918 - RNA, 14 nt, Mycobacterium bovis subsp bovis AF2122/97
ccgacagccaccgc

SEQ ID NO: 1134919 - RNA, 20 nt, Mycobacterium bovis subsp bovis AF2122/97
ccgacagcgccuuguuggcg

SEQ ID NO: 1134920 - RNA, 13 nt, Mycobacterium bovis subsp bovis AF2122/97
ccgacaggccggc

SEQ ID NO: 1134921 - RNA, 16 nt, Mycobacterium bovis subsp bovis AF2122/97
ccgacaguccgcgccg

SEQ ID NO: 1134922 - RNA, 18 nt, Mycobacterium bovis subsp bovis AF2122/97
ccgacaguccgcgccggc

SEQ ID NO: 1134923 - RNA, 19 nt, Mycobacterium bovis subsp bovis AF2122/97
ccgacaguccgcgccggcg

SEQ ID NO: 1134924 - RNA, 20 nt, Mycobacterium bovis subsp bovis AF2122/97
ccgacaguccgcgccggcgg

SEQ ID NO: 1134925 - RNA, 16 nt, Mycobacterium bovis subsp bovis AF2122/97
ccgacaggugcucguc

SEQ ID NO: 1134926 - RNA, 21 nt, Mycobacterium bovis subsp bovis AF2122/97
ccgacagggccuugaucggca

SEQ ID NO: 1134927 - RNA, 13 nt, Mycobacterium bovis subsp bovis AF2122/97
ccgaccacauucc

SEQ ID NO: 1134928 - RNA, 15 nt, Mycobacterium bovis subsp bovis AF2122/97
ccgacaugcgccgag

SEQ ID NO: 1134929 - RNA, 16 nt, Mycobacterium bovis subsp bovis AF2122/97
ccgaccacccggaugg

SEQ ID NO: 1134930 - RNA, 16 nt, Mycobacterium bovis subsp bovis AF2122/97
ccgaccaccgccgggc

SEQ ID NO: 1134931 - RNA, 13 nt, Mycobacterium bovis subsp bovis AF2122/97
ccgaccaccgcga

SEQ ID NO: 1134932 - RNA, 18 nt, Mycobacterium bovis subsp bovis AF2122/97
ccgacaugaaccggucga

SEQ ID NO: 1134933 - RNA, 19 nt, Mycobacterium bovis subsp bovis AF2122/97
ccgacaguggucccgguga

SEQ ID NO: 1134934 - RNA, 18 nt, Mycobacterium bovis subsp bovis AF2122/97
ccgacaguugugcguacu

SEQ ID NO: 1134935 - RNA, 18 nt, Mycobacterium bovis subsp bovis AF2122/97
ccgacaguuuaccgugcc

SEQ ID NO: 1134936 - RNA, 19 nt, Mycobacterium bovis subsp bovis AF2122/97
ccgacaguuuaccgugccg

SEQ ID NO: 1134937 - RNA, 21 nt, Mycobacterium bovis subsp bovis AF2122/97
ccgacaguuuaccgugccgcc

SEQ ID NO: 1134938 - RNA, 23 nt, Mycobacterium bovis subsp bovis AF2122/97
ccgacaucgcugcgacuggccgu

SEQ ID NO: 1134939 - RNA, 16 nt, Mycobacterium bovis subsp bovis AF2122/97
ccgacaucggcggccc

SEQ ID NO: 1134940 - RNA, 18 nt, Mycobacterium bovis subsp bovis AF2122/97
ccgacaucccaacccaug

SEQ ID NO: 1134941 - RNA, 23 nt, Mycobacterium bovis subsp bovis AF2122/97
ccgacaccgugucgccggcgaag

SEQ ID NO: 1134942 - RNA, 17 nt, Mycobacterium bovis subsp bovis AF2122/97
ccgacacggugcugccg

SEQ ID NO: 1134943 - RNA, 17 nt, Mycobacterium bovis subsp bovis AF2122/97
ccgacacgccgaugccg

SEQ ID NO: 1134944 - RNA, 16 nt, Mycobacterium bovis subsp bovis AF2122/97
ccgacacgccguuggg

SEQ ID NO: 1134945 - RNA, 15 nt, Mycobacterium bovis subsp bovis AF2122/97
ccgacacggcggcug

SEQ ID NO: 1134946 - RNA, 22 nt, Mycobacterium bovis subsp bovis AF2122/97
ccgacacggcucgccggcucgg

SEQ ID NO: 1134947 - RNA, 13 nt, Mycobacterium bovis subsp bovis AF2122/97
ccgacaccgucca

SEQ ID NO: 1134948 - RNA, 15 nt, Mycobacterium bovis subsp bovis AF2122/97
ccgacaccguccagc

SEQ ID NO: 1134949 - RNA, 15 nt, Mycobacterium bovis subsp bovis AF2122/97
ccgacaccgugccgc

SEQ ID NO: 1134950 - RNA, 12 nt, Mycobacterium bovis subsp bovis AF2122/97
ccgacaccggcg

SEQ ID NO: 1134951 - RNA, 14 nt, Mycobacterium bovis subsp bovis AF2122/97
ccgacaccggcuga

SEQ ID NO: 1134952 - RNA, 11 nt, Mycobacterium bovis subsp bovis AF2122/97
ccgacaccggc

SEQ ID NO: 1134953 - RNA, 14 nt, Mycobacterium bovis subsp bovis AF2122/97
ccgacaccggccgc

SEQ ID NO: 1134954 - RNA, 17 nt, Mycobacterium bovis subsp bovis AF2122/97
ccgacaccggccgcgac

SEQ ID NO: 1134955 - RNA, 18 nt, Mycobacterium bovis subsp bovis AF2122/97
ccgacaccggccgcgacg

SEQ ID NO: 1134956 - RNA, 23 nt, Mycobacterium bovis subsp bovis AF2122/97
ccgacaccgccccgccgcgacgg

SEQ ID NO: 1134957 - RNA, 12 nt, Mycobacterium bovis subsp bovis AF2122/97
ccgacacccgua

SEQ ID NO: 1134958 - RNA, 21 nt, Mycobacterium bovis subsp bovis AF2122/97
ccgacaauggcgccagccgac

SEQ ID NO: 1134959 - RNA, 22 nt, Mycobacterium bovis subsp bovis AF2122/97
ccgacacccucgggcaacucgg

SEQ ID NO: 1134960 - RNA, 18 nt, Mycobacterium bovis subsp bovis AF2122/97
ccgacaagaauggccgcc

SEQ ID NO: 1134961 - RNA, 19 nt, Mycobacterium bovis subsp bovis AF2122/97
ccgacaagcugucggcgac

SEQ ID NO: 1134962 - RNA, 18 nt, Mycobacterium bovis subsp bovis AF2122/97
ccgacaccacggaccagc

SEQ ID NO: 1134963 - RNA, 22 nt, Mycobacterium bovis subsp bovis AF2122/97
ccgacaccacggaccagcgccg

SEQ ID NO: 1134964 - RNA, 17 nt, Mycobacterium bovis subsp bovis AF2122/97
ccgacacagcggcgggu

SEQ ID NO: 1134965 - RNA, 22 nt, Mycobacterium bovis subsp bovis AF2122/97
ccgacaccaccagguccacccc

SEQ ID NO: 1134966 - RNA, 16 nt, Mycobacterium bovis subsp bovis AF2122/97
ccgacaccaccggcgc

SEQ ID NO: 1134967 - RNA, 18 nt, Mycobacterium bovis subsp bovis AF2122/97
ccgacaccaccggcgccg

SEQ ID NO: 1134968 - RNA, 18 nt, Mycobacterium bovis subsp bovis AF2122/97
ccgaauuacgcaccgagg

SEQ ID NO: 1134969 - RNA, 18 nt, Mycobacterium bovis subsp bovis AF2122/97
ccgaaugccaccucgacg

SEQ ID NO: 1134970 - RNA, 15 nt, Mycobacterium bovis subsp bovis AF2122/97
ccgaauggccgaucc

SEQ ID NO: 1134971 - RNA, 12 nt, Mycobacterium bovis subsp bovis AF2122/97
ccgaauggccgc

SEQ ID NO: 1134972 - RNA, 13 nt, Mycobacterium bovis subsp bovis AF2122/97
ccgaauggccgcc

SEQ ID NO: 1134973 - RNA, 18 nt, Mycobacterium bovis subsp bovis AF2122/97
ccgaauuccucaaggucg

SEQ ID NO: 1134974 - RNA, 17 nt, Mycobacterium bovis subsp bovis AF2122/97
ccgacaacccggccggg

SEQ ID NO: 1134975 - RNA, 20 nt, Mycobacterium bovis subsp bovis AF2122/97
ccgacaaccuuggcgacugu

SEQ ID NO: 1134976 - RNA, 17 nt, Mycobacterium bovis subsp bovis AF2122/97
ccgaauuugucggcgaa

SEQ ID NO: 1134977 - RNA, 18 nt, Mycobacterium bovis subsp bovis AF2122/97
ccgaauuugucggcgaag

SEQ ID NO: 1134978 - RNA, 19 nt, Mycobacterium bovis subsp bovis AF2122/97
ccgacaacgacgucgccga

SEQ ID NO: 1134979 - RNA, 22 nt, Mycobacterium bovis subsp bovis AF2122/97
ccgacaacgacgucgccgaccc

SEQ ID NO: 1134980 - RNA, 21 nt, Mycobacterium bovis subsp bovis AF2122/97
ccgacaacgcugggcggcuac

SEQ ID NO: 1134981 - RNA, 17 nt, Mycobacterium bovis subsp bovis AF2122/97
ccgacaacggcggcaug

SEQ ID NO: 1134982 - RNA, 22 nt, Mycobacterium bovis subsp bovis AF2122/97
ccgaaucgugcggcgaccguca

SEQ ID NO: 1134983 - RNA, 15 nt, Mycobacterium bovis subsp bovis AF2122/97
ccgaaucugccggcc

SEQ ID NO: 1134984 - RNA, 17 nt, Mycobacterium bovis subsp bovis AF2122/97
ccgaaucggcaccgugc

SEQ ID NO: 1134985 - RNA, 17 nt, Mycobacterium bovis subsp bovis AF2122/97
ccgaaucgggucggccg

SEQ ID NO: 1134986 - RNA, 14 nt, Mycobacterium bovis subsp bovis AF2122/97
ccgaauccaucgag

SEQ ID NO: 1134987 - RNA, 17 nt, Mycobacterium bovis subsp bovis AF2122/97
ccgaauaccgccgcgca

SEQ ID NO: 1134988 - RNA, 17 nt, Mycobacterium bovis subsp bovis AF2122/97
ccgaauaccgguggcag

SEQ ID NO: 1134989 - RNA, 13 nt, Mycobacterium bovis subsp bovis AF2122/97
cccgggccgccgc

SEQ ID NO: 1134990 - RNA, 15 nt, Mycobacterium bovis subsp bovis AF2122/97
cccgggccgccgcga

SEQ ID NO: 1134991 - RNA, 21 nt, Mycobacterium bovis subsp bovis AF2122/97
cccggcuucuugaccacgaac

SEQ ID NO: 1134992 - RNA, 16 nt, Mycobacterium bovis subsp bovis AF2122/97
cccgggcgccgaucac

SEQ ID NO: 1134993 - RNA, 14 nt, Mycobacterium bovis subsp bovis AF2122/97
cccggcuggggccg

SEQ ID NO: 1134994 - RNA, 15 nt, Mycobacterium bovis subsp bovis AF2122/97
cccggcuggucaccc

SEQ ID NO: 1134995 - RNA, 14 nt, Mycobacterium bovis subsp bovis AF2122/97
cccggcugucgguc

SEQ ID NO: 1134996 - RNA, 19 nt, Mycobacterium bovis subsp bovis AF2122/97
cccggcugccagcgccgcc

SEQ ID NO: 1134997 - RNA, 21 nt, Mycobacterium bovis subsp bovis AF2122/97
cccggcugccagcgccgccgc

SEQ ID NO: 1134998 - RNA, 20 nt, Mycobacterium bovis subsp bovis AF2122/97
cccggcucucuucgcgcgcu

SEQ ID NO: 1134999 - RNA, 19 nt, Mycobacterium bovis subsp bovis AF2122/97
cccggcgguaaagcucacc

SEQ ID NO: 1135000 - RNA, 12 nt, Mycobacterium bovis subsp bovis AF2122/97
cccggcggcgcg

SEQ ID NO: 1135001 - RNA, 21 nt, Mycobacterium bovis subsp bovis AF2122/97
cccggcggugccgucagcggc

SEQ ID NO: 1135002 - RNA, 21 nt, Mycobacterium bovis subsp bovis AF2122/97
cccggcggugugcgcauggug

SEQ ID NO: 1135003 - RNA, 20 nt, Mycobacterium bovis subsp bovis AF2122/97
cccggcggcguccaucgcgc

SEQ ID NO: 1135004 - RNA, 22 nt, Mycobacterium bovis subsp bovis AF2122/97
cccggcggcccgauagaucgcg

SEQ ID NO: 1135005 - RNA, 21 nt, Mycobacterium bovis subsp bovis AF2122/97
cccggauuccucgucaccgcg

SEQ ID NO: 1135006 - RNA, 14 nt, Mycobacterium bovis subsp bovis AF2122/97
cccggcaagcgcag

SEQ ID NO: 1135007 - RNA, 13 nt, Mycobacterium bovis subsp bovis AF2122/97
cccgggcugccgc

SEQ ID NO: 1135008 - RNA, 14 nt, Mycobacterium bovis subsp bovis AF2122/97
cccgggcugccgcc

SEQ ID NO: 1135009 - RNA, 12 nt, Mycobacterium bovis subsp bovis AF2122/97
cccgggcguggg

SEQ ID NO: 1135010 - RNA, 18 nt, Mycobacterium bovis subsp bovis AF2122/97
cccgggcgugggugucgg

SEQ ID NO: 1135011 - RNA, 13 nt, Mycobacterium bovis subsp bovis AF2122/97
cccgggcucggcg

SEQ ID NO: 1135012 - RNA, 22 nt, Mycobacterium bovis subsp bovis AF2122/97
cccgggcucugcugccagccga

SEQ ID NO: 1135013 - RNA, 22 nt, Mycobacterium bovis subsp bovis AF2122/97
cccgggcggcgucggugagcgc

SEQ ID NO: 1135014 - RNA, 21 nt, Mycobacterium bovis subsp bovis AF2122/97
cccgggcgggagucgucgagc

SEQ ID NO: 1135015 - RNA, 18 nt, Mycobacterium bovis subsp bovis AF2122/97
cccgggcgggauccaccc

SEQ ID NO: 1135016 - RNA, 20 nt, Mycobacterium bovis subsp bovis AF2122/97
cccgggcggucgagaugucg

SEQ ID NO: 1135017 - RNA, 12 nt, Mycobacterium bovis subsp bovis AF2122/97
cccgggcggaac

SEQ ID NO: 1135018 - RNA, 19 nt, Mycobacterium bovis subsp bovis AF2122/97
cccgggcggaacgccggca

SEQ ID NO: 1135019 - RNA, 14 nt, Mycobacterium bovis subsp bovis AF2122/97
cccgggcggccagc

SEQ ID NO: 1135020 - RNA, 23 nt, Mycobacterium bovis subsp bovis AF2122/97
cccgggcggugaggcagcgaccg

SEQ ID NO: 1135021 - RNA, 18 nt, Mycobacterium bovis subsp bovis AF2122/97
cccgggcgucccaaucgg

SEQ ID NO: 1135022 - RNA, 17 nt, Mycobacterium bovis subsp bovis AF2122/97
cccggggugcccggccg

SEQ ID NO: 1135023 - RNA, 18 nt, Mycobacterium bovis subsp bovis AF2122/97
cccggggugcccggccgc

SEQ ID NO: 1135024 - RNA, 13 nt, Mycobacterium bovis subsp bovis AF2122/97
cccggggugccga

SEQ ID NO: 1135025 - RNA, 20 nt, Mycobacterium bovis subsp bovis AF2122/97
cccgggggaagcgccaaacc

SEQ ID NO: 1135026 - RNA, 19 nt, Mycobacterium bovis subsp bovis AF2122/97
cccgggucuccggcgcacc

SEQ ID NO: 1135027 - RNA, 12 nt, Mycobacterium bovis subsp bovis AF2122/97
cccggguggccc

SEQ ID NO: 1135028 - RNA, 13 nt, Mycobacterium bovis subsp bovis AF2122/97
cccgggucggccg

SEQ ID NO: 1135029 - RNA, 15 nt, Mycobacterium bovis subsp bovis AF2122/97
cccgguaguccgcgc

SEQ ID NO: 1135030 - RNA, 18 nt, Mycobacterium bovis subsp bovis AF2122/97
cccgguaucgucccggcg

SEQ ID NO: 1135031 - RNA, 20 nt, Mycobacterium bovis subsp bovis AF2122/97
cccgguaugcgcguccccag

SEQ ID NO: 1135032 - RNA, 13 nt, Mycobacterium bovis subsp bovis AF2122/97
cccggguccgccg

SEQ ID NO: 1135033 - RNA, 18 nt, Mycobacterium bovis subsp bovis AF2122/97
cccgguccacgccaggag

SEQ ID NO: 1135034 - RNA, 13 nt, Mycobacterium bovis subsp bovis AF2122/97
cccgguccagccg

SEQ ID NO: 1135035 - RNA, 13 nt, Mycobacterium bovis subsp bovis AF2122/97
cccggucccgccg

SEQ ID NO: 1135036 - RNA, 20 nt, Mycobacterium bovis subsp bovis AF2122/97
cccggucccgccgaccgaca

SEQ ID NO: 1135037 - RNA, 12 nt, Mycobacterium bovis subsp bovis AF2122/97
cccggucgacgg

SEQ ID NO: 1135038 - RNA, 19 nt, Mycobacterium bovis subsp bovis AF2122/97
cccggucgacgggucggcg

SEQ ID NO: 1135039 - RNA, 20 nt, Mycobacterium bovis subsp bovis AF2122/97
cccggugagcucuucggaca

SEQ ID NO: 1135040 - RNA, 19 nt, Mycobacterium bovis subsp bovis AF2122/97
cccgguccgccauuggcgc

SEQ ID NO: 1135041 - RNA, 21 nt, Mycobacterium bovis subsp bovis AF2122/97
cccgguccgccauuggcgccg

SEQ ID NO: 1135042 - RNA, 19 nt, Mycobacterium bovis subsp bovis AF2122/97
cccggugaugaccggacgc

SEQ ID NO: 1135043 - RNA, 24 nt, Mycobacterium bovis subsp bovis AF2122/97
cccggugcaaccccaaguccagca

SEQ ID NO: 1135044 - RNA, 17 nt, Mycobacterium bovis subsp bovis AF2122/97
cccggucgacgggucgg

SEQ ID NO: 1135045 - RNA, 19 nt, Mycobacterium bovis subsp bovis AF2122/97
cccggugauccacgcucgg

SEQ ID NO: 1135046 - RNA, 22 nt, Mycobacterium bovis subsp bovis AF2122/97
cccggugccguuggagccgcca

SEQ ID NO: 1135047 - RNA, 23 nt, Mycobacterium bovis subsp bovis AF2122/97
cccggugccguuggagccgccac

SEQ ID NO: 1135048 - RNA, 19 nt, Mycobacterium bovis subsp bovis AF2122/97
cccggugcagaugcggcug

SEQ ID NO: 1135049 - RNA, 20 nt, Mycobacterium bovis subsp bovis AF2122/97
cccguguuaaagaagccuga

SEQ ID NO: 1135050 - RNA, 17 nt, Mycobacterium bovis subsp bovis AF2122/97
cccguguucgccacacc

SEQ ID NO: 1135051 - RNA, 15 nt, Mycobacterium bovis subsp bovis AF2122/97
cccgucgagccgugc

SEQ ID NO: 1135052 - RNA, 15 nt, Mycobacterium bovis subsp bovis AF2122/97
cccguucacgcucgu

SEQ ID NO: 1135053 - RNA, 19 nt, Mycobacterium bovis subsp bovis AF2122/97
cccguucagcgacggccgc

SEQ ID NO: 1135054 - RNA, 13 nt, Mycobacterium bovis subsp bovis AF2122/97
cccguuccacgau

SEQ ID NO: 1135055 - RNA, 19 nt, Mycobacterium bovis subsp bovis AF2122/97
cccguuccacgccggcauc

SEQ ID NO: 1135056 - RNA, 19 nt, Mycobacterium bovis subsp bovis AF2122/97
cccgucgaucagcggcagc

SEQ ID NO: 1135057 - RNA, 12 nt, Mycobacterium bovis subsp bovis AF2122/97
cccgucgagcag

SEQ ID NO: 1135058 - RNA, 12 nt, Mycobacterium bovis subsp bovis AF2122/97
cccguugacguu

SEQ ID NO: 1135059 - RNA, 20 nt, Mycobacterium bovis subsp bovis AF2122/97
cccguucggggccccgcggc

SEQ ID NO: 1135060 - RNA, 16 nt, Mycobacterium bovis subsp bovis AF2122/97
cccguucgccaggccg

SEQ ID NO: 1135061 - RNA, 14 nt, Mycobacterium bovis subsp bovis AF2122/97
cccguucgaacugg

SEQ ID NO: 1135062 - RNA, 17 nt, Mycobacterium bovis subsp bovis AF2122/97
cccguugccgccguugc

SEQ ID NO: 1135063 - RNA, 23 nt, Mycobacterium bovis subsp bovis AF2122/97
cccguugaucgcggacacugcga

SEQ ID NO: 1135064 - RNA, 22 nt, Mycobacterium bovis subsp bovis AF2122/97
cccguugagauaccccgagacc

SEQ ID NO: 1135065 - RNA, 14 nt, Mycobacterium bovis subsp bovis AF2122/97
cccguucuucgcga

SEQ ID NO: 1135066 - RNA, 18 nt, Mycobacterium bovis subsp bovis AF2122/97
cccguuuacggcccggca

SEQ ID NO: 1135067 - RNA, 11 nt, Mycobacterium bovis subsp bovis AF2122/97
cccguugucga

SEQ ID NO: 1135068 - RNA, 18 nt, Mycobacterium bovis subsp bovis AF2122/97
cccguugucgaccgaaac

SEQ ID NO: 1135069 - RNA, 18 nt, Mycobacterium bovis subsp bovis AF2122/97
cccguagauggugguggc

SEQ ID NO: 1135070 - RNA, 16 nt, Mycobacterium bovis subsp bovis AF2122/97
cccgguguguucggcc

SEQ ID NO: 1135071 - RNA, 23 nt, Mycobacterium bovis subsp bovis AF2122/97
cccgguguucaucacgccgccgg

SEQ ID NO: 1135072 - RNA, 19 nt, Mycobacterium bovis subsp bovis AF2122/97
cccgguguugccgugacga

SEQ ID NO: 1135073 - RNA, 19 nt, Mycobacterium bovis subsp bovis AF2122/97
cccggugcgucgugguggc

SEQ ID NO: 1135074 - RNA, 18 nt, Mycobacterium bovis subsp bovis AF2122/97
cccggugcuaaccgacgc

SEQ ID NO: 1135075 - RNA, 17 nt, Mycobacterium bovis subsp bovis AF2122/97
cccggugcucaagcgcg

SEQ ID NO: 1135076 - RNA, 23 nt, Mycobacterium bovis subsp bovis AF2122/97
cccgguguccagccacgcugucc

SEQ ID NO: 1135077 - RNA, 14 nt, Mycobacterium bovis subsp bovis AF2122/97
cccggugcggugca

SEQ ID NO: 1135078 - RNA, 13 nt, Mycobacterium bovis subsp bovis AF2122/97
cccggugggcggc

SEQ ID NO: 1135079 - RNA, 18 nt, Mycobacterium bovis subsp bovis AF2122/97
cccggugggcggcucguc

SEQ ID NO: 1135080 - RNA, 13 nt, Mycobacterium bovis subsp bovis AF2122/97
cccguaggcgccg

SEQ ID NO: 1135081 - RNA, 21 nt, Mycobacterium bovis subsp bovis AF2122/97
cccgguggaaugccaagcgcg

SEQ ID NO: 1135082 - RNA, 18 nt, Mycobacterium bovis subsp bovis AF2122/97
cccguagcugcgcagcgc

SEQ ID NO: 1135083 - RNA, 21 nt, Mycobacterium bovis subsp bovis AF2122/97
cccgguuagggcacgucgagc

SEQ ID NO: 1135084 - RNA, 20 nt, Mycobacterium bovis subsp bovis AF2122/97
cccgucacaaugcccaggcu

SEQ ID NO: 1135085 - RNA, 21 nt, Mycobacterium bovis subsp bovis AF2122/97
cccguccaacuacgccagccg

SEQ ID NO: 1135086 - RNA, 13 nt, Mycobacterium bovis subsp bovis AF2122/97
cccguccgccgca

SEQ ID NO: 1135087 - RNA, 13 nt, Mycobacterium bovis subsp bovis AF2122/97
cccguccgcgccc

SEQ ID NO: 1135088 - RNA, 19 nt, Mycobacterium bovis subsp bovis AF2122/97
cccguccgcgcccaccggc

SEQ ID NO: 1135089 - RNA, 14 nt, Mycobacterium bovis subsp bovis AF2122/97
ccgaagcggugacc

SEQ ID NO: 1135090 - RNA, 17 nt, Mycobacterium bovis subsp bovis AF2122/97
ccgaagcucaucgccgc

SEQ ID NO: 1135091 - RNA, 20 nt, Mycobacterium bovis subsp bovis AF2122/97
ccgaagcuacgucggcucgu

SEQ ID NO: 1135092 - RNA, 22 nt, Mycobacterium bovis subsp bovis AF2122/97
ccgaagcgggcccgcaggucgg

SEQ ID NO: 1135093 - RNA, 13 nt, Mycobacterium bovis subsp bovis AF2122/97
ccgaagccggcgc

SEQ ID NO: 1135094 - RNA, 15 nt, Mycobacterium bovis subsp bovis AF2122/97
ccgaagccggugccg

SEQ ID NO: 1135095 - RNA, 12 nt, Mycobacterium bovis subsp bovis AF2122/97
ccgaagcggcca

SEQ ID NO: 1135096 - RNA, 22 nt, Mycobacterium bovis subsp bovis AF2122/97
ccgaaggccgccacaaacccga

SEQ ID NO: 1135097 - RNA, 23 nt, Mycobacterium bovis subsp bovis AF2122/97
ccgaaggccgccaguccgaucgc

SEQ ID NO: 1135098 - RNA, 21 nt, Mycobacterium bovis subsp bovis AF2122/97
ccgaaggcggcuccaccgggc

SEQ ID NO: 1135099 - RNA, 18 nt, Mycobacterium bovis subsp bovis AF2122/97
ccgaagcucaucgccgcu

SEQ ID NO: 1135100 - RNA, 14 nt, Mycobacterium bovis subsp bovis AF2122/97
ccgaagcugcgggu

SEQ ID NO: 1135101 - RNA, 22 nt, Mycobacterium bovis subsp bovis AF2122/97
ccgaagcugcgggucagcgccg

SEQ ID NO: 1135102 - RNA, 19 nt, Mycobacterium bovis subsp bovis AF2122/97
ccgaaguacuggccgccgc

SEQ ID NO: 1135103 - RNA, 21 nt, Mycobacterium bovis subsp bovis AF2122/97
ccgaaguagaagcccaggacg

SEQ ID NO: 1135104 - RNA, 21 nt, Mycobacterium bovis subsp bovis AF2122/97
ccgaaguagccgaccggcagc

SEQ ID NO: 1135105 - RNA, 14 nt, Mycobacterium bovis subsp bovis AF2122/97
ccgaagcggccacc

SEQ ID NO: 1135106 - RNA, 16 nt, Mycobacterium bovis subsp bovis AF2122/97
ccgaaggcuugucggu

SEQ ID NO: 1135107 - RNA, 19 nt, Mycobacterium bovis subsp bovis AF2122/97
ccgaaggugggauugaagc

SEQ ID NO: 1135108 - RNA, 17 nt, Mycobacterium bovis subsp bovis AF2122/97
ccgaaguggugaccgac

SEQ ID NO: 1135109 - RNA, 19 nt, Mycobacterium bovis subsp bovis AF2122/97
ccgaaguuuuggaagcccg

SEQ ID NO: 1135110 - RNA, 16 nt, Mycobacterium bovis subsp bovis AF2122/97
ccgaauaacagcaggc

SEQ ID NO: 1135111 - RNA, 15 nt, Mycobacterium bovis subsp bovis AF2122/97
ccgaagauggccagc

SEQ ID NO: 1135112 - RNA, 18 nt, Mycobacterium bovis subsp bovis AF2122/97
ccgaagauggccagcgcg

SEQ ID NO: 1135113 - RNA, 21 nt, Mycobacterium bovis subsp bovis AF2122/97
ccgaagaugaccucggcgacg

SEQ ID NO: 1135114 - RNA, 14 nt, Mycobacterium bovis subsp bovis AF2122/97
ccgaagauggccag

SEQ ID NO: 1135115 - RNA, 15 nt, Mycobacterium bovis subsp bovis AF2122/97
ccgaagcccccgacg

SEQ ID NO: 1135116 - RNA, 15 nt, Mycobacterium bovis subsp bovis AF2122/97
ccgaagcgcgcgcgu

SEQ ID NO: 1135117 - RNA, 13 nt, Mycobacterium bovis subsp bovis AF2122/97
ccgaagcccgggg

SEQ ID NO: 1135118 - RNA, 13 nt, Mycobacterium bovis subsp bovis AF2122/97
ccgaagccgcgca

SEQ ID NO: 1135119 - RNA, 22 nt, Mycobacterium bovis subsp bovis AF2122/97
ccgaacuccuuaucgucgacgc

SEQ ID NO: 1135120 - RNA, 20 nt, Mycobacterium bovis subsp bovis AF2122/97
ccgaacuccgcggaacccag

SEQ ID NO: 1135121 - RNA, 19 nt, Mycobacterium bovis subsp bovis AF2122/97
ccgaacuccuuaucgucga

SEQ ID NO: 1135122 - RNA, 16 nt, Mycobacterium bovis subsp bovis AF2122/97
ccgaagaaggugacga

SEQ ID NO: 1135123 - RNA, 16 nt, Mycobacterium bovis subsp bovis AF2122/97
ccgaagacgugccggc

SEQ ID NO: 1135124 - RNA, 19 nt, Mycobacterium bovis subsp bovis AF2122/97
ccgaagacucgucaacgga

SEQ ID NO: 1135125 - RNA, 22 nt, Mycobacterium bovis subsp bovis AF2122/97
ccgaagagcuccgucgcggccg

SEQ ID NO: 1135126 - RNA, 23 nt, Mycobacterium bovis subsp bovis AF2122/97
ccgaacgugaacucacggcggua

SEQ ID NO: 1135127 - RNA, 18 nt, Mycobacterium bovis subsp bovis AF2122/97
ccgaacggguagacccac

SEQ ID NO: 1135128 - RNA, 22 nt, Mycobacterium bovis subsp bovis AF2122/97
ccgaacuaccgacgcaccucgg

SEQ ID NO: 1135129 - RNA, 16 nt, Mycobacterium bovis subsp bovis AF2122/97
ccgaacucaacgacac

SEQ ID NO: 1135130 - RNA, 16 nt, Mycobacterium bovis subsp bovis AF2122/97
ccgaacuggucgacgc

SEQ ID NO: 1135131 - RNA, 13 nt, Mycobacterium bovis subsp bovis AF2122/97
ccgaacgcaccga

SEQ ID NO: 1135132 - RNA, 22 nt, Mycobacterium bovis subsp bovis AF2122/97
ccgaacgcaccgaaacgccgac

SEQ ID NO: 1135133 - RNA, 17 nt, Mycobacterium bovis subsp bovis AF2122/97
ccgaacgacucgacgua

SEQ ID NO: 1135134 - RNA, 15 nt, Mycobacterium bovis subsp bovis AF2122/97
ccgaacgcaacagcc

SEQ ID NO: 1135135 - RNA, 15 nt, Mycobacterium bovis subsp bovis AF2122/97
ccgaaccugcggcag

SEQ ID NO: 1135136 - RNA, 19 nt, Mycobacterium bovis subsp bovis AF2122/97
ccgaaccugcggcagcgga

SEQ ID NO: 1135137 - RNA, 15 nt, Mycobacterium bovis subsp bovis AF2122/97
ccgaacgacccuggc

SEQ ID NO: 1135138 - RNA, 17 nt, Mycobacterium bovis subsp bovis AF2122/97
ccgaacgccucgccggc

SEQ ID NO: 1135139 - RNA, 15 nt, Mycobacterium bovis subsp bovis AF2122/97
ccgaacgcgaugcgc

SEQ ID NO: 1135140 - RNA, 14 nt, Mycobacterium bovis subsp bovis AF2122/97
ccgaacgccaccac

SEQ ID NO: 1135141 - RNA, 15 nt, Mycobacterium bovis subsp bovis AF2122/97
ccgaacgccagaccg

SEQ ID NO: 1135142 - RNA, 21 nt, Mycobacterium bovis subsp bovis AF2122/97
ccgaacggcaauucgggauag

SEQ ID NO: 1135143 - RNA, 13 nt, Mycobacterium bovis subsp bovis AF2122/97
ccgaacgcggcca

SEQ ID NO: 1135144 - RNA, 21 nt, Mycobacterium bovis subsp bovis AF2122/97
ccgaacgcggccaccgaccgc

SEQ ID NO: 1135145 - RNA, 17 nt, Mycobacterium bovis subsp bovis AF2122/97
ccgaaccgccgcugccg

SEQ ID NO: 1135146 - RNA, 22 nt, Mycobacterium bovis subsp bovis AF2122/97
ccgaaccgccgcugccgcgcgg

SEQ ID NO: 1135147 - RNA, 13 nt, Mycobacterium bovis subsp bovis AF2122/97
ccgaaccgcgcgu

SEQ ID NO: 1135148 - RNA, 15 nt, Mycobacterium bovis subsp bovis AF2122/97
ccgaacccaccacga

SEQ ID NO: 1135149 - RNA, 19 nt, Mycobacterium bovis subsp bovis AF2122/97
ccgaaccgcguuaugccag

SEQ ID NO: 1135150 - RNA, 14 nt, Mycobacterium bovis subsp bovis AF2122/97
ccgaaccggcacca

SEQ ID NO: 1135151 - RNA, 12 nt, Mycobacterium bovis subsp bovis AF2122/97
ccgaaccggcgc

SEQ ID NO: 1135152 - RNA, 14 nt, Mycobacterium bovis subsp bovis AF2122/97
ccgaaaaacaccag

SEQ ID NO: 1135153 - RNA, 21 nt, Mycobacterium bovis subsp bovis AF2122/97
ccgaacaggaugauguuggcg

SEQ ID NO: 1135154 - RNA, 23 nt, Mycobacterium bovis subsp bovis AF2122/97
ccgaacagggaggucgccgcauc

SEQ ID NO: 1135155 - RNA, 13 nt, Mycobacterium bovis subsp bovis AF2122/97
ccgaaccaccgcg

SEQ ID NO: 1135156 - RNA, 18 nt, Mycobacterium bovis subsp bovis AF2122/97
ccgaaccaccuguccggu

SEQ ID NO: 1135157 - RNA, 16 nt, Mycobacterium bovis subsp bovis AF2122/97
ccgaacauggccagca

SEQ ID NO: 1135158 - RNA, 17 nt, Mycobacterium bovis subsp bovis AF2122/97
ccgaacagucgcagcca

SEQ ID NO: 1135159 - RNA, 14 nt, Mycobacterium bovis subsp bovis AF2122/97
ccgaacauccgccg

SEQ ID NO: 1135160 - RNA, 15 nt, Mycobacterium bovis subsp bovis AF2122/97
ccgaacauccgccgc

SEQ ID NO: 1135161 - RNA, 15 nt, Mycobacterium bovis subsp bovis AF2122/97
cccucgccggucagc

SEQ ID NO: 1135162 - RNA, 17 nt, Mycobacterium bovis subsp bovis AF2122/97
cccucgacgcgcucggg

SEQ ID NO: 1135163 - RNA, 18 nt, Mycobacterium bovis subsp bovis AF2122/97
cccucgaucacggcggcc

SEQ ID NO: 1135164 - RNA, 12 nt, Mycobacterium bovis subsp bovis AF2122/97
cccucgaucacg

SEQ ID NO: 1135165 - RNA, 13 nt, Mycobacterium bovis subsp bovis AF2122/97
cccucgcugcggu

SEQ ID NO: 1135166 - RNA, 19 nt, Mycobacterium bovis subsp bovis AF2122/97
cccuccggguauggcggcg

SEQ ID NO: 1135167 - RNA, 14 nt, Mycobacterium bovis subsp bovis AF2122/97
cccuccggcgcagc

SEQ ID NO: 1135168 - RNA, 20 nt, Mycobacterium bovis subsp bovis AF2122/97
cccuccgggcccaucgcccg

SEQ ID NO: 1135169 - RNA, 14 nt, Mycobacterium bovis subsp bovis AF2122/97
cccugcgcggccac

SEQ ID NO: 1135170 - RNA, 15 nt, Mycobacterium bovis subsp bovis AF2122/97
cccugcgcggccacc

SEQ ID NO: 1135171 - RNA, 17 nt, Mycobacterium bovis subsp bovis AF2122/97
cccugcuggugucggcu

SEQ ID NO: 1135172 - RNA, 16 nt, Mycobacterium bovis subsp bovis AF2122/97
cccugcuugcaggcga

SEQ ID NO: 1135173 - RNA, 21 nt, Mycobacterium bovis subsp bovis AF2122/97
cccucgcuaauugcggccgcc

SEQ ID NO: 1135174 - RNA, 16 nt, Mycobacterium bovis subsp bovis AF2122/97
cccugcccggcccgcc

SEQ ID NO: 1135175 - RNA, 13 nt, Mycobacterium bovis subsp bovis AF2122/97
cccugccggcagc

SEQ ID NO: 1135176 - RNA, 15 nt, Mycobacterium bovis subsp bovis AF2122/97
cccuggccagcccga

SEQ ID NO: 1135177 - RNA, 15 nt, Mycobacterium bovis subsp bovis AF2122/97
cccuggacgucggcg

SEQ ID NO: 1135178 - RNA, 16 nt, Mycobacterium bovis subsp bovis AF2122/97
cccuggaucgcgcccu

SEQ ID NO: 1135179 - RNA, 15 nt, Mycobacterium bovis subsp bovis AF2122/97
cccuggccgccggcg

SEQ ID NO: 1135180 - RNA, 15 nt, Mycobacterium bovis subsp bovis AF2122/97
cccuggauggcgccc

SEQ ID NO: 1135181 - RNA, 12 nt, Mycobacterium bovis subsp bovis AF2122/97
cccuggccgccg

SEQ ID NO: 1135182 - RNA, 14 nt, Mycobacterium bovis subsp bovis AF2122/97
cccuggcgauuucg

SEQ ID NO: 1135183 - RNA, 22 nt, Mycobacterium bovis subsp bovis AF2122/97
cccuggccgucccaccagccga

SEQ ID NO: 1135184 - RNA, 15 nt, Mycobacterium bovis subsp bovis AF2122/97
cccuugccgcccgcu

SEQ ID NO: 1135185 - RNA, 18 nt, Mycobacterium bovis subsp bovis AF2122/97
cccuugacggugagaucg

SEQ ID NO: 1135186 - RNA, 18 nt, Mycobacterium bovis subsp bovis AF2122/97
cccuuuggguagcaaacc

SEQ ID NO: 1135187 - RNA, 14 nt, Mycobacterium bovis subsp bovis AF2122/97
cccuugucggucga

SEQ ID NO: 1135188 - RNA, 14 nt, Mycobacterium bovis subsp bovis AF2122/97
cgagcaugcccagc

SEQ ID NO: 1135189 - RNA, 15 nt, Mycobacterium bovis subsp bovis AF2122/97
cgagccacccaccga

SEQ ID NO: 1135190 - RNA, 16 nt, Mycobacterium bovis subsp bovis AF2122/97
cgagccacagcgucga

SEQ ID NO: 1135191 - RNA, 17 nt, Mycobacterium bovis subsp bovis AF2122/97
cgagccaccaccgccga

SEQ ID NO: 1135192 - RNA, 21 nt, Mycobacterium bovis subsp bovis AF2122/97
cgagccaaacuacccgcccac

SEQ ID NO: 1135193 - RNA, 23 nt, Mycobacterium bovis subsp bovis AF2122/97
cgagccaaacuacccgcccacgg

SEQ ID NO: 1135194 - RNA, 15 nt, Mycobacterium bovis subsp bovis AF2122/97
cgagcaucucgucgg

SEQ ID NO: 1135195 - RNA, 20 nt, Mycobacterium bovis subsp bovis AF2122/97
cgagcaucuucgcgcagccg

SEQ ID NO: 1135196 - RNA, 22 nt, Mycobacterium bovis subsp bovis AF2122/97
cgagcaucuucgcgcagccgcc

SEQ ID NO: 1135197 - RNA, 16 nt, Mycobacterium bovis subsp bovis AF2122/97
cgagcaucucgacauc

SEQ ID NO: 1135198 - RNA, 16 nt, Mycobacterium bovis subsp bovis AF2122/97
cgagcaucucgucggu

SEQ ID NO: 1135199 - RNA, 17 nt, Mycobacterium bovis subsp bovis AF2122/97
cgagcaucucgucggug

SEQ ID NO: 1135200 - RNA, 15 nt, Mycobacterium bovis subsp bovis AF2122/97
cgagcaucgacgaac

SEQ ID NO: 1135201 - RNA, 23 nt, Mycobacterium bovis subsp bovis AF2122/97
cgagcagcuccuugaggucaccc

SEQ ID NO: 1135202 - RNA, 23 nt, Mycobacterium bovis subsp bovis AF2122/97
cgagcaggauaaacccggcgagg

SEQ ID NO: 1135203 - RNA, 15 nt, Mycobacterium bovis subsp bovis AF2122/97
cgagcaggccgccca

SEQ ID NO: 1135204 - RNA, 16 nt, Mycobacterium bovis subsp bovis AF2122/97
cgagcaggccgcccag

SEQ ID NO: 1135205 - RNA, 19 nt, Mycobacterium bovis subsp bovis AF2122/97
cgagcaggaugcgaucguc

SEQ ID NO: 1135206 - RNA, 18 nt, Mycobacterium bovis subsp bovis AF2122/97
cgagcaggcuggcugcca

SEQ ID NO: 1135207 - RNA, 17 nt, Mycobacterium bovis subsp bovis AF2122/97
cgagcagggccggcacc

SEQ ID NO: 1135208 - RNA, 16 nt, Mycobacterium bovis subsp bovis AF2122/97
cgagcagggcgucgac

SEQ ID NO: 1135209 - RNA, 21 nt, Mycobacterium bovis subsp bovis AF2122/97
cgagcagggcgucgaccgcgg

SEQ ID NO: 1135210 - RNA, 20 nt, Mycobacterium bovis subsp bovis AF2122/97
cgagcagguguugcacgagc

SEQ ID NO: 1135211 - RNA, 22 nt, Mycobacterium bovis subsp bovis AF2122/97
cgagcagguguugcacgagcau

SEQ ID NO: 1135212 - RNA, 17 nt, Mycobacterium bovis subsp bovis AF2122/97
cgagcagugccucggcg

SEQ ID NO: 1135213 - RNA, 18 nt, Mycobacterium bovis subsp bovis AF2122/97
cgagcagugccucggcga

SEQ ID NO: 1135214 - RNA, 16 nt, Mycobacterium bovis subsp bovis AF2122/97
cgagcaguggccgccg

SEQ ID NO: 1135215 - RNA, 17 nt, Mycobacterium bovis subsp bovis AF2122/97
cgagcaguggccgccgg

SEQ ID NO: 1135216 - RNA, 18 nt, Mycobacterium bovis subsp bovis AF2122/97
cgagcaguuccagcucgc

SEQ ID NO: 1135217 - RNA, 22 nt, Mycobacterium bovis subsp bovis AF2122/97
cgagcaguuccagcucgcggug

SEQ ID NO: 1135218 - RNA, 23 nt, Mycobacterium bovis subsp bovis AF2122/97
cgagcaguuccagcucgcggugg

SEQ ID NO: 1135219 - RNA, 16 nt, Mycobacterium bovis subsp bovis AF2122/97
cgagcaucagauucgc

SEQ ID NO: 1135220 - RNA, 18 nt, Mycobacterium bovis subsp bovis AF2122/97
cgagcccgaaggcggcuc

SEQ ID NO: 1135221 - RNA, 16 nt, Mycobacterium bovis subsp bovis AF2122/97
cgagcccgcugcgccg

SEQ ID NO: 1135222 - RNA, 20 nt, Mycobacterium bovis subsp bovis AF2122/97
cgagcccgaucgcggcccgg

SEQ ID NO: 1135223 - RNA, 14 nt, Mycobacterium bovis subsp bovis AF2122/97
cgagcccuccaggg

SEQ ID NO: 1135224 - RNA, 14 nt, Mycobacterium bovis subsp bovis AF2122/97
cgagcccgggccgu

SEQ ID NO: 1135225 - RNA, 20 nt, Mycobacterium bovis subsp bovis AF2122/97
cgagcccguccucgucggug

SEQ ID NO: 1135226 - RNA, 23 nt, Mycobacterium bovis subsp bovis AF2122/97
cgagcccguccucgucggugugc

SEQ ID NO: 1135227 - RNA, 15 nt, Mycobacterium bovis subsp bovis AF2122/97
cgagcccgucgauca

SEQ ID NO: 1135228 - RNA, 14 nt, Mycobacterium bovis subsp bovis AF2122/97
cgagccgaccgcgg

SEQ ID NO: 1135229 - RNA, 15 nt, Mycobacterium bovis subsp bovis AF2122/97
cgagccgacccgacg

SEQ ID NO: 1135230 - RNA, 17 nt, Mycobacterium bovis subsp bovis AF2122/97
cgagccgacccgacgcu

SEQ ID NO: 1135231 - RNA, 23 nt, Mycobacterium bovis subsp bovis AF2122/97
cgagccgacccgacgcuggucgg

SEQ ID NO: 1135232 - RNA, 13 nt, Mycobacterium bovis subsp bovis AF2122/97
cgagccgaucugc

SEQ ID NO: 1135233 - RNA, 17 nt, Mycobacterium bovis subsp bovis AF2122/97
cgagccgaucugcuguc

SEQ ID NO: 1135234 - RNA, 13 nt, Mycobacterium bovis subsp bovis AF2122/97
cgagccgcacagc

SEQ ID NO: 1135235 - RNA, 16 nt, Mycobacterium bovis subsp bovis AF2122/97
cgagccgcagcucgcc

SEQ ID NO: 1135236 - RNA, 17 nt, Mycobacterium bovis subsp bovis AF2122/97
cgagccgcagcucgccg

SEQ ID NO: 1135237 - RNA, 14 nt, Mycobacterium bovis subsp bovis AF2122/97
cgagcccgaaccac

SEQ ID NO: 1135238 - RNA, 21 nt, Mycobacterium bovis subsp bovis AF2122/97
cgagcccgaugguggugccga

SEQ ID NO: 1135239 - RNA, 22 nt, Mycobacterium bovis subsp bovis AF2122/97
cgagcccgaugguggugccgac

SEQ ID NO: 1135240 - RNA, 18 nt, Mycobacterium bovis subsp bovis AF2122/97
cgagcccagcugcgccga

SEQ ID NO: 1135241 - RNA, 20 nt, Mycobacterium bovis subsp bovis AF2122/97
cgagcccagcugcgccgaac

SEQ ID NO: 1135242 - RNA, 16 nt, Mycobacterium bovis subsp bovis AF2122/97
cgagcccaccgucgca

SEQ ID NO: 1135243 - RNA, 16 nt, Mycobacterium bovis subsp bovis AF2122/97
cgagccaucaccgcaa

SEQ ID NO: 1135244 - RNA, 18 nt, Mycobacterium bovis subsp bovis AF2122/97
cgagcccagccgggcacc

SEQ ID NO: 1135245 - RNA, 19 nt, Mycobacterium bovis subsp bovis AF2122/97
cgagccacgccagcgucga

SEQ ID NO: 1135246 - RNA, 15 nt, Mycobacterium bovis subsp bovis AF2122/97
cgagccagcacccgc

SEQ ID NO: 1135247 - RNA, 19 nt, Mycobacterium bovis subsp bovis AF2122/97
cgagccagggaggggccgu

SEQ ID NO: 1135248 - RNA, 18 nt, Mycobacterium bovis subsp bovis AF2122/97
cgagccagcuccggcgcu

SEQ ID NO: 1135249 - RNA, 18 nt, Mycobacterium bovis subsp bovis AF2122/97
cgagccaguccuccacuu

SEQ ID NO: 1135250 - RNA, 22 nt, Mycobacterium bovis subsp bovis AF2122/97
cgagcaccucgaaggcccgcug

SEQ ID NO: 1135251 - RNA, 14 nt, Mycobacterium bovis subsp bovis AF2122/97
cgagcaccucggcc

SEQ ID NO: 1135252 - RNA, 21 nt, Mycobacterium bovis subsp bovis AF2122/97
cgagcaccucggccucgucgu

SEQ ID NO: 1135253 - RNA, 22 nt, Mycobacterium bovis subsp bovis AF2122/97
cgagcaacucguccagcagugc

SEQ ID NO: 1135254 - RNA, 22 nt, Mycobacterium bovis subsp bovis AF2122/97
cgagcaacugcucgacgaggcc

SEQ ID NO: 1135255 - RNA, 21 nt, Mycobacterium bovis subsp bovis AF2122/97
cgagcaacucguccagcagug

SEQ ID NO: 1135256 - RNA, 20 nt, Mycobacterium bovis subsp bovis AF2122/97
cgagcaacggcggcaggccg

SEQ ID NO: 1135257 - RNA, 14 nt, Mycobacterium bovis subsp bovis AF2122/97
cgagcaacgggcga

SEQ ID NO: 1135258 - RNA, 17 nt, Mycobacterium bovis subsp bovis AF2122/97
cgagcaacaccagggcc

SEQ ID NO: 1135259 - RNA, 21 nt, Mycobacterium bovis subsp bovis AF2122/97
cgagcaacaccgucggcagca

SEQ ID NO: 1135260 - RNA, 23 nt, Mycobacterium bovis subsp bovis AF2122/97
cgagcaacaccgucggcagcagc

SEQ ID NO: 1135261 - RNA, 17 nt, Mycobacterium bovis subsp bovis AF2122/97
cgagaugcugcacccgg

SEQ ID NO: 1135262 - RNA, 18 nt, Mycobacterium bovis subsp bovis AF2122/97
cgagaugugagcacaccg

SEQ ID NO: 1135263 - RNA, 21 nt, Mycobacterium bovis subsp bovis AF2122/97
cgagaugugagcacaccgaca

SEQ ID NO: 1135264 - RNA, 21 nt, Mycobacterium bovis subsp bovis AF2122/97
cgagauucuccugaguugcgg

SEQ ID NO: 1135265 - RNA, 15 nt, Mycobacterium bovis subsp bovis AF2122/97
cgagaugccggcgag

SEQ ID NO: 1135266 - RNA, 14 nt, Mycobacterium bovis subsp bovis AF2122/97
cgagcacucggcca

SEQ ID NO: 1135267 - RNA, 15 nt, Mycobacterium bovis subsp bovis AF2122/97
cgagcacgucgggga

SEQ ID NO: 1135268 - RNA, 20 nt, Mycobacterium bovis subsp bovis AF2122/97
cgagcacgcugcugcgggug

SEQ ID NO: 1135269 - RNA, 19 nt, Mycobacterium bovis subsp bovis AF2122/97
cgagcacgucacgcgcggc

SEQ ID NO: 1135270 - RNA, 21 nt, Mycobacterium bovis subsp bovis AF2122/97
cgagcacggguagcguccagg

SEQ ID NO: 1135271 - RNA, 20 nt, Mycobacterium bovis subsp bovis AF2122/97
cgagcacggugagccggugg

SEQ ID NO: 1135272 - RNA, 21 nt, Mycobacterium bovis subsp bovis AF2122/97
cgagcacggugagccgguggc

SEQ ID NO: 1135273 - RNA, 14 nt, Mycobacterium bovis subsp bovis AF2122/97
cgagcacgucacgc

SEQ ID NO: 1135274 - RNA, 14 nt, Mycobacterium bovis subsp bovis AF2122/97
cgagcacgccgacc

SEQ ID NO: 1135275 - RNA, 20 nt, Mycobacterium bovis subsp bovis AF2122/97
cgagcacgccgagcccgccg

SEQ ID NO: 1135276 - RNA, 21 nt, Mycobacterium bovis subsp bovis AF2122/97
cgagcacgccgagcccgccgg

SEQ ID NO: 1135277 - RNA, 18 nt, Mycobacterium bovis subsp bovis AF2122/97
cgagcaccugaccguuga

SEQ ID NO: 1135278 - RNA, 19 nt, Mycobacterium bovis subsp bovis AF2122/97
cgagcacgaugucgaugcc

SEQ ID NO: 1135279 - RNA, 22 nt, Mycobacterium bovis subsp bovis AF2122/97
cgagcacgcgggcacugguggc

SEQ ID NO: 1135280 - RNA, 16 nt, Mycobacterium bovis subsp bovis AF2122/97
cgagcacgcugcugcg

SEQ ID NO: 1135281 - RNA, 20 nt, Mycobacterium bovis subsp bovis AF2122/97
cgagcagacgcaaaagcccc

SEQ ID NO: 1135282 - RNA, 21 nt, Mycobacterium bovis subsp bovis AF2122/97
cgagcagacgcaaaagccccc

SEQ ID NO: 1135283 - RNA, 19 nt, Mycobacterium bovis subsp bovis AF2122/97
cgagcagacgcaaaaucgc

SEQ ID NO: 1135284 - RNA, 20 nt, Mycobacterium bovis subsp bovis AF2122/97
cgagcacucggccacgacga

SEQ ID NO: 1135285 - RNA, 22 nt, Mycobacterium bovis subsp bovis AF2122/97
cgagcacucggccacgacgacu

SEQ ID NO: 1135286 - RNA, 19 nt, Mycobacterium bovis subsp bovis AF2122/97
cgagcagacgcuaaagccc

SEQ ID NO: 1135287 - RNA, 19 nt, Mycobacterium bovis subsp bovis AF2122/97
cgagcagacguaaaagccc

SEQ ID NO: 1135288 - RNA, 20 nt, Mycobacterium bovis subsp bovis AF2122/97
cgagcagacguaaaagcccc

SEQ ID NO: 1135289 - RNA, 21 nt, Mycobacterium bovis subsp bovis AF2122/97
cgagcagacguaaaagccccc

SEQ ID NO: 1135290 - RNA, 22 nt, Mycobacterium bovis subsp bovis AF2122/97
cgagcagacguaaaagcccccg

SEQ ID NO: 1135291 - RNA, 20 nt, Mycobacterium bovis subsp bovis AF2122/97
cgagcagacgcagaaucgca

SEQ ID NO: 1135292 - RNA, 20 nt, Mycobacterium bovis subsp bovis AF2122/97
cgagcagacgcagaaucgcc

SEQ ID NO: 1135293 - RNA, 20 nt, Mycobacterium bovis subsp bovis AF2122/97
cgagcagacacagaaucgca

SEQ ID NO: 1135294 - RNA, 20 nt, Mycobacterium bovis subsp bovis AF2122/97
cgagcagacacagaaucgcc

SEQ ID NO: 1135295 - RNA, 20 nt, Mycobacterium bovis subsp bovis AF2122/97
cgagcagacgcaaaaucgcc

SEQ ID NO: 1135296 - RNA, 18 nt, Mycobacterium bovis subsp bovis AF2122/97
cgagcagacgcagaaucg

SEQ ID NO: 1135297 - RNA, 14 nt, Mycobacterium bovis subsp bovis AF2122/97
cgagcagcuagccc

SEQ ID NO: 1135298 - RNA, 21 nt, Mycobacterium bovis subsp bovis AF2122/97
cgagcagcuagcccggcagca

SEQ ID NO: 1135299 - RNA, 22 nt, Mycobacterium bovis subsp bovis AF2122/97
cgagcagcuccuugaggucacc

SEQ ID NO: 1135300 - RNA, 16 nt, Mycobacterium bovis subsp bovis AF2122/97
cgagcagccgcgacau

SEQ ID NO: 1135301 - RNA, 22 nt, Mycobacterium bovis subsp bovis AF2122/97
cgagcagccgaugcugcgggcg

SEQ ID NO: 1135302 - RNA, 16 nt, Mycobacterium bovis subsp bovis AF2122/97
cgagcagcgcgccguu

SEQ ID NO: 1135303 - RNA, 17 nt, Mycobacterium bovis subsp bovis AF2122/97
cgagcagcgccacccgc

SEQ ID NO: 1135304 - RNA, 22 nt, Mycobacterium bovis subsp bovis AF2122/97
cgagcagcgccacccgcgucag

SEQ ID NO: 1135305 - RNA, 15 nt, Mycobacterium bovis subsp bovis AF2122/97
cgagcagccgaugcu

SEQ ID NO: 1135306 - RNA, 14 nt, Mycobacterium bovis subsp bovis AF2122/97
cgagcagcccggcg

SEQ ID NO: 1135307 - RNA, 17 nt, Mycobacterium bovis subsp bovis AF2122/97
cgagcagauggugaacg

SEQ ID NO: 1135308 - RNA, 13 nt, Mycobacterium bovis subsp bovis AF2122/97
cgagcagcacagc

SEQ ID NO: 1135309 - RNA, 22 nt, Mycobacterium bovis subsp bovis AF2122/97
aacacccuugcccacggcgacc

SEQ ID NO: 1135310 - RNA, 14 nt, Mycobacterium bovis subsp bovis AF2122/97
aacaccccgggcgc

SEQ ID NO: 1135311 - RNA, 18 nt, Mycobacterium bovis subsp bovis AF2122/97
aacacccgaagccggcgc

SEQ ID NO: 1135312 - RNA, 21 nt, Mycobacterium bovis subsp bovis AF2122/97
aacacauccaguaaccguccg

SEQ ID NO: 1135313 - RNA, 14 nt, Mycobacterium bovis subsp bovis AF2122/97
cgagcagacgccgc

SEQ ID NO: 1135314 - RNA, 20 nt, Mycobacterium bovis subsp bovis AF2122/97
cgagcagacgcagagucgca

SEQ ID NO: 1135315 - RNA, 14 nt, Mycobacterium bovis subsp bovis AF2122/97
cgagcagauacucc

SEQ ID NO: 1135316 - RNA, 16 nt, Mycobacterium bovis subsp bovis AF2122/97
cgagcagauacuccgc

SEQ ID NO: 1135317 - RNA, 20 nt, Mycobacterium bovis subsp bovis AF2122/97
aacacaugcaagucgaacgg

SEQ ID NO: 1135318 - RNA, 11 nt, Mycobacterium bovis subsp bovis AF2122/97
aacaccaacca

SEQ ID NO: 1135319 - RNA, 21 nt, Mycobacterium bovis subsp bovis AF2122/97
cgagcagagaacuccgccacc

SEQ ID NO: 1135320 - RNA, 16 nt, Mycobacterium bovis subsp bovis AF2122/97
cgacuccccgccgggc

SEQ ID NO: 1135321 - RNA, 22 nt, Mycobacterium bovis subsp bovis AF2122/97
cgacucaucggccgcggucggc

SEQ ID NO: 1135322 - RNA, 23 nt, Mycobacterium bovis subsp bovis AF2122/97
cgacucaucggccgcggucggcc

SEQ ID NO: 1135323 - RNA, 21 nt, Mycobacterium bovis subsp bovis AF2122/97
cgacuccagcaccagcacggc

SEQ ID NO: 1135324 - RNA, 14 nt, Mycobacterium bovis subsp bovis AF2122/97
cgacucaucggccg

SEQ ID NO: 1135325 - RNA, 15 nt, Mycobacterium bovis subsp bovis AF2122/97
cgacucaucggccgc

SEQ ID NO: 1135326 - RNA, 21 nt, Mycobacterium bovis subsp bovis AF2122/97
cgacucaucggccgcggucgg

SEQ ID NO: 1135327 - RNA, 24 nt, Mycobacterium bovis subsp bovis AF2122/97
cgacuccuauugcagcacaacgga

SEQ ID NO: 1135328 - RNA, 15 nt, Mycobacterium bovis subsp bovis AF2122/97
cgacuccgcguagag

SEQ ID NO: 1135329 - RNA, 19 nt, Mycobacterium bovis subsp bovis AF2122/97
cgacuccggcaagcacacc

SEQ ID NO: 1135330 - RNA, 21 nt, Mycobacterium bovis subsp bovis AF2122/97
cgacuccggcaagcacaccgc

SEQ ID NO: 1135331 - RNA, 20 nt, Mycobacterium bovis subsp bovis AF2122/97
cgacuccggcaggcccgacg

SEQ ID NO: 1135332 - RNA, 16 nt, Mycobacterium bovis subsp bovis AF2122/97
cgacuccuggcgaaug

SEQ ID NO: 1135333 - RNA, 15 nt, Mycobacterium bovis subsp bovis AF2122/97
cgacuucggcgucgg

SEQ ID NO: 1135334 - RNA, 18 nt, Mycobacterium bovis subsp bovis AF2122/97
cgacuucuaugacgaccg

SEQ ID NO: 1135335 - RNA, 19 nt, Mycobacterium bovis subsp bovis AF2122/97
cgacuucuucgcgcaacca

SEQ ID NO: 1135336 - RNA, 21 nt, Mycobacterium bovis subsp bovis AF2122/97
cgacuucuucgcgcaaccagc

SEQ ID NO: 1135337 - RNA, 16 nt, Mycobacterium bovis subsp bovis AF2122/97
cgacuugacggcgggu

SEQ ID NO: 1135338 - RNA, 17 nt, Mycobacterium bovis subsp bovis AF2122/97
cgacuucagcaacgcau

SEQ ID NO: 1135339 - RNA, 18 nt, Mycobacterium bovis subsp bovis AF2122/97
cgacuucauagcgccgga

SEQ ID NO: 1135340 - RNA, 14 nt, Mycobacterium bovis subsp bovis AF2122/97
cgacuucgacgaca

SEQ ID NO: 1135341 - RNA, 17 nt, Mycobacterium bovis subsp bovis AF2122/97
cgacuugccuagcgcgg

SEQ ID NO: 1135342 - RNA, 20 nt, Mycobacterium bovis subsp bovis AF2122/97
cgacuuggauggccgaaccc

SEQ ID NO: 1135343 - RNA, 18 nt, Mycobacterium bovis subsp bovis AF2122/97
cgacuugcggugcucacc

SEQ ID NO: 1135344 - RNA, 12 nt, Mycobacterium bovis subsp bovis AF2122/97
cgacuugccgcc

SEQ ID NO: 1135345 - RNA, 18 nt, Mycobacterium bovis subsp bovis AF2122/97
cgacuugauuucgaucgc

SEQ ID NO: 1135346 - RNA, 20 nt, Mycobacterium bovis subsp bovis AF2122/97
cgacuugauuucgaucgcgg

SEQ ID NO: 1135347 - RNA, 22 nt, Mycobacterium bovis subsp bovis AF2122/97
cgacuugcaggcgucccagccg

SEQ ID NO: 1135348 - RNA, 12 nt, Mycobacterium bovis subsp bovis AF2122/97
cgacuugucgcc

SEQ ID NO: 1135349 - RNA, 19 nt, Mycobacterium bovis subsp bovis AF2122/97
cgacuuggugacaccgagg

SEQ ID NO: 1135350 - RNA, 18 nt, Mycobacterium bovis subsp bovis AF2122/97
cgacuuguugggcgcgaa

SEQ ID NO: 1135351 - RNA, 13 nt, Mycobacterium bovis subsp bovis AF2122/97
cgagaaagugcag

SEQ ID NO: 1135352 - RNA, 15 nt, Mycobacterium bovis subsp bovis AF2122/97
cgagaacaccacgca

SEQ ID NO: 1135353 - RNA, 23 nt, Mycobacterium bovis subsp bovis AF2122/97
cgagaacaccggccaacagucgc

SEQ ID NO: 1135354 - RNA, 14 nt, Mycobacterium bovis subsp bovis AF2122/97
cgagaacgaugucc

SEQ ID NO: 1135355 - RNA, 19 nt, Mycobacterium bovis subsp bovis AF2122/97
cgagaacgauguccgcgcg

SEQ ID NO: 1135356 - RNA, 22 nt, Mycobacterium bovis subsp bovis AF2122/97
cgagaacgauguccgcgcgaac

SEQ ID NO: 1135357 - RNA, 23 nt, Mycobacterium bovis subsp bovis AF2122/97
cgagaaaaugacccacacaccga

SEQ ID NO: 1135358 - RNA, 12 nt, Mycobacterium bovis subsp bovis AF2122/97
cgagaccccgac

SEQ ID NO: 1135359 - RNA, 21 nt, Mycobacterium bovis subsp bovis AF2122/97
cgagaccacuuagcuggcggg

SEQ ID NO: 1135360 - RNA, 15 nt, Mycobacterium bovis subsp bovis AF2122/97
cgagaccgccgcugc

SEQ ID NO: 1135361 - RNA, 18 nt, Mycobacterium bovis subsp bovis AF2122/97
cgagaccgccgcugccgc

SEQ ID NO: 1135362 - RNA, 17 nt, Mycobacterium bovis subsp bovis AF2122/97
cgagaccgcgugcucga

SEQ ID NO: 1135363 - RNA, 17 nt, Mycobacterium bovis subsp bovis AF2122/97
cgagacgcacggccacc

SEQ ID NO: 1135364 - RNA, 22 nt, Mycobacterium bovis subsp bovis AF2122/97
cgagacgaccuccucgaugacc

SEQ ID NO: 1135365 - RNA, 18 nt, Mycobacterium bovis subsp bovis AF2122/97
cgagacgaaccgccgacg

SEQ ID NO: 1135366 - RNA, 21 nt, Mycobacterium bovis subsp bovis AF2122/97
cgagaccucucugcgccaggc

SEQ ID NO: 1135367 - RNA, 21 nt, Mycobacterium bovis subsp bovis AF2122/97
cgagaccgaaacuugcucacc

SEQ ID NO: 1135368 - RNA, 15 nt, Mycobacterium bovis subsp bovis AF2122/97
cgagagcgcuguccc

SEQ ID NO: 1135369 - RNA, 20 nt, Mycobacterium bovis subsp bovis AF2122/97
cgagagcggcuccgggacgg

SEQ ID NO: 1135370 - RNA, 12 nt, Mycobacterium bovis subsp bovis AF2122/97
cgagacgcucca

SEQ ID NO: 1135371 - RNA, 18 nt, Mycobacterium bovis subsp bovis AF2122/97
cgagacgcuuuccgccgc

SEQ ID NO: 1135372 - RNA, 20 nt, Mycobacterium bovis subsp bovis AF2122/97
cgagacgcuuuccgccgcac

SEQ ID NO: 1135373 - RNA, 18 nt, Mycobacterium bovis subsp bovis AF2122/97
cgagacgcaugucgggcc

SEQ ID NO: 1135374 - RNA, 23 nt, Mycobacterium bovis subsp bovis AF2122/97
cgagaucggacagguaacgcggu

SEQ ID NO: 1135375 - RNA, 15 nt, Mycobacterium bovis subsp bovis AF2122/97
cgagauagccgacgu

SEQ ID NO: 1135376 - RNA, 20 nt, Mycobacterium bovis subsp bovis AF2122/97
cgagauagccgacgucgccg

SEQ ID NO: 1135377 - RNA, 15 nt, Mycobacterium bovis subsp bovis AF2122/97
cgagauacggccacc

SEQ ID NO: 1135378 - RNA, 16 nt, Mycobacterium bovis subsp bovis AF2122/97
cgagauacggccacca

SEQ ID NO: 1135379 - RNA, 15 nt, Mycobacterium bovis subsp bovis AF2122/97
cgagauaaccaccau

SEQ ID NO: 1135380 - RNA, 20 nt, Mycobacterium bovis subsp bovis AF2122/97
cgagaugccaucggugauga

SEQ ID NO: 1135381 - RNA, 19 nt, Mycobacterium bovis subsp bovis AF2122/97
cgagaugcggaccacaccg

SEQ ID NO: 1135382 - RNA, 14 nt, Mycobacterium bovis subsp bovis AF2122/97
cgagaugccaucgg

SEQ ID NO: 1135383 - RNA, 23 nt, Mycobacterium bovis subsp bovis AF2122/97
cgagaucuuuucaccaccucggu

SEQ ID NO: 1135384 - RNA, 18 nt, Mycobacterium bovis subsp bovis AF2122/97
cgagaucucacgugcccg

SEQ ID NO: 1135385 - RNA, 21 nt, Mycobacterium bovis subsp bovis AF2122/97
cgagaucucacgugcccgcgc

SEQ ID NO: 1135386 - RNA, 22 nt, Mycobacterium bovis subsp bovis AF2122/97
cgagaucucacgugcccgcgcg

SEQ ID NO: 1135387 - RNA, 16 nt, Mycobacterium bovis subsp bovis AF2122/97
cgagaucugcgauggg

SEQ ID NO: 1135388 - RNA, 13 nt, Mycobacterium bovis subsp bovis AF2122/97
cgagaucgucgcg

SEQ ID NO: 1135389 - RNA, 13 nt, Mycobacterium bovis subsp bovis AF2122/97
cgacgucgccgac

SEQ ID NO: 1135390 - RNA, 16 nt, Mycobacterium bovis subsp bovis AF2122/97
cgacgucgccgacccg

SEQ ID NO: 1135391 - RNA, 15 nt, Mycobacterium bovis subsp bovis AF2122/97
cgacgucgccgccgc

SEQ ID NO: 1135392 - RNA, 14 nt, Mycobacterium bovis subsp bovis AF2122/97
cgacgucgccggac

SEQ ID NO: 1135393 - RNA, 15 nt, Mycobacterium bovis subsp bovis AF2122/97
cgacgucgccggacg

SEQ ID NO: 1135394 - RNA, 16 nt, Mycobacterium bovis subsp bovis AF2122/97
cgacgucgcgcaucgc

SEQ ID NO: 1135395 - RNA, 21 nt, Mycobacterium bovis subsp bovis AF2122/97
cgacgucgacgccggccagcg

SEQ ID NO: 1135396 - RNA, 14 nt, Mycobacterium bovis subsp bovis AF2122/97
cgacgucggcaucg

SEQ ID NO: 1135397 - RNA, 14 nt, Mycobacterium bovis subsp bovis AF2122/97
cgacgucggccgca

SEQ ID NO: 1135398 - RNA, 18 nt, Mycobacterium bovis subsp bovis AF2122/97
cgacgucggccgcaucgc

SEQ ID NO: 1135399 - RNA, 14 nt, Mycobacterium bovis subsp bovis AF2122/97
cgacgucgcgggug

SEQ ID NO: 1135400 - RNA, 23 nt, Mycobacterium bovis subsp bovis AF2122/97
cgacgucgcgggugaugacgccg

SEQ ID NO: 1135401 - RNA, 19 nt, Mycobacterium bovis subsp bovis AF2122/97
cgacgucgcuagaucccag

SEQ ID NO: 1135402 - RNA, 18 nt, Mycobacterium bovis subsp bovis AF2122/97
cgacgucgauuucggcga

SEQ ID NO: 1135403 - RNA, 17 nt, Mycobacterium bovis subsp bovis AF2122/97
cgacgucggccguuucc

SEQ ID NO: 1135404 - RNA, 12 nt, Mycobacterium bovis subsp bovis AF2122/97
cgacgucggcga

SEQ ID NO: 1135405 - RNA, 15 nt, Mycobacterium bovis subsp bovis AF2122/97
cgacgucggcgagca

SEQ ID NO: 1135406 - RNA, 19 nt, Mycobacterium bovis subsp bovis AF2122/97
cgacgucgguaagcgccaa

SEQ ID NO: 1135407 - RNA, 14 nt, Mycobacterium bovis subsp bovis AF2122/97
cgacgucggugacc

SEQ ID NO: 1135408 - RNA, 19 nt, Mycobacterium bovis subsp bovis AF2122/97
cgacgucgggcauggcggc

SEQ ID NO: 1135409 - RNA, 14 nt, Mycobacterium bovis subsp bovis AF2122/97
cgacgucggcggug

SEQ ID NO: 1135410 - RNA, 22 nt, Mycobacterium bovis subsp bovis AF2122/97
cgacgucguagaccuccagugc

SEQ ID NO: 1135411 - RNA, 14 nt, Mycobacterium bovis subsp bovis AF2122/97
cgacgcggcgucgg

SEQ ID NO: 1135412 - RNA, 17 nt, Mycobacterium bovis subsp bovis AF2122/97
cgacgcggccagcggca

SEQ ID NO: 1135413 - RNA, 15 nt, Mycobacterium bovis subsp bovis AF2122/97
cgacgcggccggccg

SEQ ID NO: 1135414 - RNA, 22 nt, Mycobacterium bovis subsp bovis AF2122/97
cgacgcggggcucaaccccguc

SEQ ID NO: 1135415 - RNA, 15 nt, Mycobacterium bovis subsp bovis AF2122/97
cgacgcggucaucga

SEQ ID NO: 1135416 - RNA, 16 nt, Mycobacterium bovis subsp bovis AF2122/97
cgacgcggucggcggc

SEQ ID NO: 1135417 - RNA, 15 nt, Mycobacterium bovis subsp bovis AF2122/97
cgacgcgucggcgac

SEQ ID NO: 1135418 - RNA, 16 nt, Mycobacterium bovis subsp bovis AF2122/97
cgacgcgucguggucg

SEQ ID NO: 1135419 - RNA, 18 nt, Mycobacterium bovis subsp bovis AF2122/97
cgacgcgucguggucggc

SEQ ID NO: 1135420 - RNA, 20 nt, Mycobacterium bovis subsp bovis AF2122/97
cgacgcgucguggucggcga

SEQ ID NO: 1135421 - RNA, 15 nt, Mycobacterium bovis subsp bovis AF2122/97
cgacgcguggcaucc

SEQ ID NO: 1135422 - RNA, 21 nt, Mycobacterium bovis subsp bovis AF2122/97
cgacgcgucggcgacgcggag

SEQ ID NO: 1135423 - RNA, 17 nt, Mycobacterium bovis subsp bovis AF2122/97
cgacgcgugucugggac

SEQ ID NO: 1135424 - RNA, 16 nt, Mycobacterium bovis subsp bovis AF2122/97
cgacgcuaaguccccg

SEQ ID NO: 1135425 - RNA, 14 nt, Mycobacterium bovis subsp bovis AF2122/97
cgacgcuaccgccg

SEQ ID NO: 1135426 - RNA, 15 nt, Mycobacterium bovis subsp bovis AF2122/97
cgacgcuaccgccgg

SEQ ID NO: 1135427 - RNA, 15 nt, Mycobacterium bovis subsp bovis AF2122/97
cgacgcucgcugcag

SEQ ID NO: 1135428 - RNA, 21 nt, Mycobacterium bovis subsp bovis AF2122/97
cgacgcguucgagugcggucg

SEQ ID NO: 1135429 - RNA, 22 nt, Mycobacterium bovis subsp bovis AF2122/97
cgacgugauggugacuucggug

SEQ ID NO: 1135430 - RNA, 17 nt, Mycobacterium bovis subsp bovis AF2122/97
cgacgucuuugacgaac

SEQ ID NO: 1135431 - RNA, 18 nt, Mycobacterium bovis subsp bovis AF2122/97
cgacgugcgucggcccgg

SEQ ID NO: 1135432 - RNA, 14 nt, Mycobacterium bovis subsp bovis AF2122/97
cgacgucguuacug

SEQ ID NO: 1135433 - RNA, 20 nt, Mycobacterium bovis subsp bovis AF2122/97
cgacgucguucuuugucggg

SEQ ID NO: 1135434 - RNA, 21 nt, Mycobacterium bovis subsp bovis AF2122/97
cgacgucguucuuugucggga

SEQ ID NO: 1135435 - RNA, 22 nt, Mycobacterium bovis subsp bovis AF2122/97
cgacgucgcuguaggccagccc

SEQ ID NO: 1135436 - RNA, 20 nt, Mycobacterium bovis subsp bovis AF2122/97
cgacgucuaggccaaacccc

SEQ ID NO: 1135437 - RNA, 17 nt, Mycobacterium bovis subsp bovis AF2122/97
cgacgucgucgccgccg

SEQ ID NO: 1135438 - RNA, 18 nt, Mycobacterium bovis subsp bovis AF2122/97
cgacgucgucgccgccga

SEQ ID NO: 1135439 - RNA, 19 nt, Mycobacterium bovis subsp bovis AF2122/97
cgacgucgucgccgccgaa

SEQ ID NO: 1135440 - RNA, 22 nt, Mycobacterium bovis subsp bovis AF2122/97
cgacgucgucgccgccgaaaac

SEQ ID NO: 1135441 - RNA, 12 nt, Mycobacterium bovis subsp bovis AF2122/97
cgacgucgucgu

SEQ ID NO: 1135442 - RNA, 15 nt, Mycobacterium bovis subsp bovis AF2122/97
cgacgucugguuggc

SEQ ID NO: 1135443 - RNA, 19 nt, Mycobacterium bovis subsp bovis AF2122/97
cgacgucugccaggcgcag

SEQ ID NO: 1135444 - RNA, 14 nt, Mycobacterium bovis subsp bovis AF2122/97
cgacgucugccauc

SEQ ID NO: 1135445 - RNA, 21 nt, Mycobacterium bovis subsp bovis AF2122/97
cgacgugaaugguggugucgg

SEQ ID NO: 1135446 - RNA, 13 nt, Mycobacterium bovis subsp bovis AF2122/97
cgacgugaccagc

SEQ ID NO: 1135447 - RNA, 14 nt, Mycobacterium bovis subsp bovis AF2122/97
cgacgugaccagcu

SEQ ID NO: 1135448 - RNA, 13 nt, Mycobacterium bovis subsp bovis AF2122/97
cgacgugaccggc

SEQ ID NO: 1135449 - RNA, 15 nt, Mycobacterium bovis subsp bovis AF2122/97
cgacgugaccggcaa

SEQ ID NO: 1135450 - RNA, 18 nt, Mycobacterium bovis subsp bovis AF2122/97
cgacgugaccggcaaugc

SEQ ID NO: 1135451 - RNA, 20 nt, Mycobacterium bovis subsp bovis AF2122/97
cgacgugaccggcaaugcca

SEQ ID NO: 1135452 - RNA, 16 nt, Mycobacterium bovis subsp bovis AF2122/97
cgacguugaagccgcc

SEQ ID NO: 1135453 - RNA, 17 nt, Mycobacterium bovis subsp bovis AF2122/97
cgacgugaucgcggucc

SEQ ID NO: 1135454 - RNA, 18 nt, Mycobacterium bovis subsp bovis AF2122/97
cgacguucgguggcgaug

SEQ ID NO: 1135455 - RNA, 14 nt, Mycobacterium bovis subsp bovis AF2122/97
cgacguucguaccg

SEQ ID NO: 1135456 - RNA, 14 nt, Mycobacterium bovis subsp bovis AF2122/97
cgacucagcccggc

SEQ ID NO: 1135457 - RNA, 22 nt, Mycobacterium bovis subsp bovis AF2122/97
cgacucagcccggcacugaccg

SEQ ID NO: 1135458 - RNA, 13 nt, Mycobacterium bovis subsp bovis AF2122/97
cgacucaggucgg

SEQ ID NO: 1135459 - RNA, 23 nt, Mycobacterium bovis subsp bovis AF2122/97
cgacucaggucggugcggucauc

SEQ ID NO: 1135460 - RNA, 14 nt, Mycobacterium bovis subsp bovis AF2122/97
cgacguucgguggc

SEQ ID NO: 1135461 - RNA, 22 nt, Mycobacterium bovis subsp bovis AF2122/97
cgacguucaucuucaccacgcc

SEQ ID NO: 1135462 - RNA, 15 nt, Mycobacterium bovis subsp bovis AF2122/97
cgacguucgacgaca

SEQ ID NO: 1135463 - RNA, 17 nt, Mycobacterium bovis subsp bovis AF2122/97
cgacguucgacgacagc

SEQ ID NO: 1135464 - RNA, 20 nt, Mycobacterium bovis subsp bovis AF2122/97
cgacguggaacugcagcggc

SEQ ID NO: 1135465 - RNA, 13 nt, Mycobacterium bovis subsp bovis AF2122/97
cgacguggcgccg

SEQ ID NO: 1135466 - RNA, 15 nt, Mycobacterium bovis subsp bovis AF2122/97
cgacguggcgccgac

SEQ ID NO: 1135467 - RNA, 20 nt, Mycobacterium bovis subsp bovis AF2122/97
cgacguggcgccgacaggug

SEQ ID NO: 1135468 - RNA, 23 nt, Mycobacterium bovis subsp bovis AF2122/97
cgacguggcugcguucgccggaa

SEQ ID NO: 1135469 - RNA, 19 nt, Mycobacterium bovis subsp bovis AF2122/97
cgacguguugcacguacgg

SEQ ID NO: 1135470 - RNA, 14 nt, Mycobacterium bovis subsp bovis AF2122/97
cgaggucgaaccgc

SEQ ID NO: 1135471 - RNA, 16 nt, Mycobacterium bovis subsp bovis AF2122/97
cgaggucgaaccgccg

SEQ ID NO: 1135472 - RNA, 17 nt, Mycobacterium bovis subsp bovis AF2122/97
cgagguccucgucgucg

SEQ ID NO: 1135473 - RNA, 18 nt, Mycobacterium bovis subsp bovis AF2122/97
cgaggucgagcgccgcgg

SEQ ID NO: 1135474 - RNA, 12 nt, Mycobacterium bovis subsp bovis AF2122/97
cgaggucggcgg

SEQ ID NO: 1135475 - RNA, 15 nt, Mycobacterium bovis subsp bovis AF2122/97
cgaggucggcggcgc

SEQ ID NO: 1135476 - RNA, 23 nt, Mycobacterium bovis subsp bovis AF2122/97
cgaggucgcggucuuugagccgg

SEQ ID NO: 1135477 - RNA, 18 nt, Mycobacterium bovis subsp bovis AF2122/97
cgagguucaaagcagcgc

SEQ ID NO: 1135478 - RNA, 22 nt, Mycobacterium bovis subsp bovis AF2122/97
cgagguucaaagcagcgcacca

SEQ ID NO: 1135479 - RNA, 23 nt, Mycobacterium bovis subsp bovis AF2122/97
cgagguggucacgcagucgggca

SEQ ID NO: 1135480 - RNA, 23 nt, Mycobacterium bovis subsp bovis AF2122/97
cgagguguagcccuccgagcaca

SEQ ID NO: 1135481 - RNA, 17 nt, Mycobacterium bovis subsp bovis AF2122/97
cgaggucgguucggccg

SEQ ID NO: 1135482 - RNA, 22 nt, Mycobacterium bovis subsp bovis AF2122/97
cgaggucgguucggccggagcc

SEQ ID NO: 1135483 - RNA, 22 nt, Mycobacterium bovis subsp bovis AF2122/97
cgaggucuccggugcgcagcca

SEQ ID NO: 1135484 - RNA, 14 nt, Mycobacterium bovis subsp bovis AF2122/97
cgaggucugcggcc

SEQ ID NO: 1135485 - RNA, 15 nt, Mycobacterium bovis subsp bovis AF2122/97
cgagguggcgggcga

SEQ ID NO: 1135486 - RNA, 19 nt, Mycobacterium bovis subsp bovis AF2122/97
cgagguggcgggcgaugcg

SEQ ID NO: 1135487 - RNA, 22 nt, Mycobacterium bovis subsp bovis AF2122/97
cgaguaccagcccaccggcgcc

SEQ ID NO: 1135488 - RNA, 14 nt, Mycobacterium bovis subsp bovis AF2122/97
cgaguaccaggacg

SEQ ID NO: 1135489 - RNA, 16 nt, Mycobacterium bovis subsp bovis AF2122/97
cgaguacccaaccggu

SEQ ID NO: 1135490 - RNA, 22 nt, Mycobacterium bovis subsp bovis AF2122/97
cgagguuggcguugguggucgg

SEQ ID NO: 1135491 - RNA, 20 nt, Mycobacterium bovis subsp bovis AF2122/97
cgagguuccacuuggucacc

SEQ ID NO: 1135492 - RNA, 12 nt, Mycobacterium bovis subsp bovis AF2122/97
cgaguccggcaa

SEQ ID NO: 1135493 - RNA, 11 nt, Mycobacterium bovis subsp bovis AF2122/97
cgaguccgcgg

SEQ ID NO: 1135494 - RNA, 21 nt, Mycobacterium bovis subsp bovis AF2122/97
cgaguccguacuugccaccca

SEQ ID NO: 1135495 - RNA, 19 nt, Mycobacterium bovis subsp bovis AF2122/97
cgaguccguacuugccacc

SEQ ID NO: 1135496 - RNA, 21 nt, Mycobacterium bovis subsp bovis AF2122/97
cgaguccucgagugccgccgu

SEQ ID NO: 1135497 - RNA, 18 nt, Mycobacterium bovis subsp bovis AF2122/97
cgagucgaaaccgcccgu

SEQ ID NO: 1135498 - RNA, 16 nt, Mycobacterium bovis subsp bovis AF2122/97
cgagucgaacccgcga

SEQ ID NO: 1135499 - RNA, 22 nt, Mycobacterium bovis subsp bovis AF2122/97
cgagucgaucacguggugcggc

SEQ ID NO: 1135500 - RNA, 14 nt, Mycobacterium bovis subsp bovis AF2122/97
cgagucgcacgugg

SEQ ID NO: 1135501 - RNA, 17 nt, Mycobacterium bovis subsp bovis AF2122/97
cgagucgccagaccgca

SEQ ID NO: 1135502 - RNA, 17 nt, Mycobacterium bovis subsp bovis AF2122/97
cgagucgaugaccccgg

SEQ ID NO: 1135503 - RNA, 18 nt, Mycobacterium bovis subsp bovis AF2122/97
cgagguaacgcagcggca

SEQ ID NO: 1135504 - RNA, 16 nt, Mycobacterium bovis subsp bovis AF2122/97
cgagguacagcgggca

SEQ ID NO: 1135505 - RNA, 19 nt, Mycobacterium bovis subsp bovis AF2122/97
cgagguacagcgggcacgc

SEQ ID NO: 1135506 - RNA, 17 nt, Mycobacterium bovis subsp bovis AF2122/97
cgaggcuugcggcacaa

SEQ ID NO: 1135507 - RNA, 15 nt, Mycobacterium bovis subsp bovis AF2122/97
cgagggcacggcggu

SEQ ID NO: 1135508 - RNA, 18 nt, Mycobacterium bovis subsp bovis AF2122/97
cgagggcacggcggugug

SEQ ID NO: 1135509 - RNA, 17 nt, Mycobacterium bovis subsp bovis AF2122/97
cgagguaguggucuucg

SEQ ID NO: 1135510 - RNA, 23 nt, Mycobacterium bovis subsp bovis AF2122/97
cgagguaguggucuucggaacgc

SEQ ID NO: 1135511 - RNA, 18 nt, Mycobacterium bovis subsp bovis AF2122/97
cgagguauucgcgcagca

SEQ ID NO: 1135512 - RNA, 13 nt, Mycobacterium bovis subsp bovis AF2122/97
cgaggucacccgg

SEQ ID NO: 1135513 - RNA, 17 nt, Mycobacterium bovis subsp bovis AF2122/97
cgaggucagcucccggc

SEQ ID NO: 1135514 - RNA, 19 nt, Mycobacterium bovis subsp bovis AF2122/97
cgagguccucgucggcguc

SEQ ID NO: 1135515 - RNA, 15 nt, Mycobacterium bovis subsp bovis AF2122/97
cgaggucccggccga

SEQ ID NO: 1135516 - RNA, 22 nt, Mycobacterium bovis subsp bovis AF2122/97
cgaggucccggccgagcguggc

SEQ ID NO: 1135517 - RNA, 18 nt, Mycobacterium bovis subsp bovis AF2122/97
cgaggcaaugcgagcacc

SEQ ID NO: 1135518 - RNA, 13 nt, Mycobacterium bovis subsp bovis AF2122/97
cgaggaugucgau

SEQ ID NO: 1135519 - RNA, 22 nt, Mycobacterium bovis subsp bovis AF2122/97
cgaggauguugugccgaucggc

SEQ ID NO: 1135520 - RNA, 17 nt, Mycobacterium bovis subsp bovis AF2122/97
cgaggauucauggcggc

SEQ ID NO: 1135521 - RNA, 20 nt, Mycobacterium bovis subsp bovis AF2122/97
cgaggauucauggcggcaua

SEQ ID NO: 1135522 - RNA, 18 nt, Mycobacterium bovis subsp bovis AF2122/97
cgaggcaucguccacgca

SEQ ID NO: 1135523 - RNA, 14 nt, Mycobacterium bovis subsp bovis AF2122/97
cgaggccaaacgcc

SEQ ID NO: 1135524 - RNA, 18 nt, Mycobacterium bovis subsp bovis AF2122/97
cgaggccaaguugcagcg

SEQ ID NO: 1135525 - RNA, 15 nt, Mycobacterium bovis subsp bovis AF2122/97
cgaggcagcacccgc

SEQ ID NO: 1135526 - RNA, 21 nt, Mycobacterium bovis subsp bovis AF2122/97
cgaggcagcgucgucgacgac

SEQ ID NO: 1135527 - RNA, 19 nt, Mycobacterium bovis subsp bovis AF2122/97
cgaggcuggcaucccgggc

SEQ ID NO: 1135528 - RNA, 13 nt, Mycobacterium bovis subsp bovis AF2122/97
cgaggcuguccga

SEQ ID NO: 1135529 - RNA, 19 nt, Mycobacterium bovis subsp bovis AF2122/97
cgaggcuguccgaaccgac

SEQ ID NO: 1135530 - RNA, 20 nt, Mycobacterium bovis subsp bovis AF2122/97
cgaggccacgccagcucgcc

SEQ ID NO: 1135531 - RNA, 13 nt, Mycobacterium bovis subsp bovis AF2122/97
cgaggcguucacc

SEQ ID NO: 1135532 - RNA, 14 nt, Mycobacterium bovis subsp bovis AF2122/97
cgaggcguucacca

SEQ ID NO: 1135533 - RNA, 22 nt, Mycobacterium bovis subsp bovis AF2122/97
cgaggcguucaccacgaucgcg

SEQ ID NO: 1135534 - RNA, 21 nt, Mycobacterium bovis subsp bovis AF2122/97
cgaggcucccgcaauggggcg

SEQ ID NO: 1135535 - RNA, 17 nt, Mycobacterium bovis subsp bovis AF2122/97
cgaggcucgcguggccg

SEQ ID NO: 1135536 - RNA, 20 nt, Mycobacterium bovis subsp bovis AF2122/97
cgaggcucgcguggccgccg

SEQ ID NO: 1135537 - RNA, 22 nt, Mycobacterium bovis subsp bovis AF2122/97
cgaggcucgcguggccgccggc

SEQ ID NO: 1135538 - RNA, 16 nt, Mycobacterium bovis subsp bovis AF2122/97
cgaggcucgggccgca

SEQ ID NO: 1135539 - RNA, 15 nt, Mycobacterium bovis subsp bovis AF2122/97
cgaggcucguggcga

SEQ ID NO: 1135540 - RNA, 19 nt, Mycobacterium bovis subsp bovis AF2122/97
cgaggcucguggcgacggc

SEQ ID NO: 1135541 - RNA, 18 nt, Mycobacterium bovis subsp bovis AF2122/97
cgauaucggcggcuuggc

SEQ ID NO: 1135542 - RNA, 20 nt, Mycobacterium bovis subsp bovis AF2122/97
cgauaucgaugcggcgacca

SEQ ID NO: 1135543 - RNA, 20 nt, Mycobacterium bovis subsp bovis AF2122/97
cgauaucgcccggaacgaau

SEQ ID NO: 1135544 - RNA, 18 nt, Mycobacterium bovis subsp bovis AF2122/97
cgauauggccuugcugcg

SEQ ID NO: 1135545 - RNA, 22 nt, Mycobacterium bovis subsp bovis AF2122/97
cgauaugcgugagcugcucgag

SEQ ID NO: 1135546 - RNA, 12 nt, Mycobacterium bovis subsp bovis AF2122/97
cgauaucugcca

SEQ ID NO: 1135547 - RNA, 13 nt, Mycobacterium bovis subsp bovis AF2122/97
cgauaucugccac

SEQ ID NO: 1135548 - RNA, 22 nt, Mycobacterium bovis subsp bovis AF2122/97
cgauauagccgccggugccgcc

SEQ ID NO: 1135549 - RNA, 15 nt, Mycobacterium bovis subsp bovis AF2122/97
cgauacgcgcaccgu

SEQ ID NO: 1135550 - RNA, 19 nt, Mycobacterium bovis subsp bovis AF2122/97
cgauauaggacgccgcgcc

SEQ ID NO: 1135551 - RNA, 16 nt, Mycobacterium bovis subsp bovis AF2122/97
cgauaccgccggcccc

SEQ ID NO: 1135552 - RNA, 19 nt, Mycobacterium bovis subsp bovis AF2122/97
cgauaccggcggcgagcgg

SEQ ID NO: 1135553 - RNA, 20 nt, Mycobacterium bovis subsp bovis AF2122/97
cgauaccgucagcgccgcug

SEQ ID NO: 1135554 - RNA, 20 nt, Mycobacterium bovis subsp bovis AF2122/97
cgauaccuagccccugaagg

SEQ ID NO: 1135555 - RNA, 14 nt, Mycobacterium bovis subsp bovis AF2122/97
cgauacgcgcaccg

SEQ ID NO: 1135556 - RNA, 18 nt, Mycobacterium bovis subsp bovis AF2122/97
cgauacgaagccgccgcg

SEQ ID NO: 1135557 - RNA, 21 nt, Mycobacterium bovis subsp bovis AF2122/97
cgauacgccaccggcaaucgg

SEQ ID NO: 1135558 - RNA, 20 nt, Mycobacterium bovis subsp bovis AF2122/97
cgauacagcacauccagccc

SEQ ID NO: 1135559 - RNA, 14 nt, Mycobacterium bovis subsp bovis AF2122/97
cgauacccaggaug

SEQ ID NO: 1135560 - RNA, 22 nt, Mycobacterium bovis subsp bovis AF2122/97
cgauacccaggauguguugcca

SEQ ID NO: 1135561 - RNA, 18 nt, Mycobacterium bovis subsp bovis AF2122/97
cgaguggaucauguucgg

SEQ ID NO: 1135562 - RNA, 19 nt, Mycobacterium bovis subsp bovis AF2122/97
cgagugcugucgucuuggc

SEQ ID NO: 1135563 - RNA, 22 nt, Mycobacterium bovis subsp bovis AF2122/97
cgagucgccgaggacgccggcg

SEQ ID NO: 1135564 - RNA, 16 nt, Mycobacterium bovis subsp bovis AF2122/97
cgagucgccgcgggca

SEQ ID NO: 1135565 - RNA, 20 nt, Mycobacterium bovis subsp bovis AF2122/97
cgagucgccgcgggcagcga

SEQ ID NO: 1135566 - RNA, 23 nt, Mycobacterium bovis subsp bovis AF2122/97
cgagucgcgaacucaugcccgac

SEQ ID NO: 1135567 - RNA, 23 nt, Mycobacterium bovis subsp bovis AF2122/97
cgagugcggcacgaucgccaacg

SEQ ID NO: 1135568 - RNA, 17 nt, Mycobacterium bovis subsp bovis AF2122/97
cgagugcggcgaccagg

SEQ ID NO: 1135569 - RNA, 14 nt, Mycobacterium bovis subsp bovis AF2122/97
cgaguggccgugga

SEQ ID NO: 1135570 - RNA, 15 nt, Mycobacterium bovis subsp bovis AF2122/97
cgaguggccguggau

SEQ ID NO: 1135571 - RNA, 23 nt, Mycobacterium bovis subsp bovis AF2122/97
cgaguggucccguucgcccgccc

SEQ ID NO: 1135572 - RNA, 17 nt, Mycobacterium bovis subsp bovis AF2122/97
cgagugguccggcggcc

SEQ ID NO: 1135573 - RNA, 18 nt, Mycobacterium bovis subsp bovis AF2122/97
cgagugguccggcggccg

SEQ ID NO: 1135574 - RNA, 16 nt, Mycobacterium bovis subsp bovis AF2122/97
cgagugucagcagaug

SEQ ID NO: 1135575 - RNA, 18 nt, Mycobacterium bovis subsp bovis AF2122/97
cgagugucuuagccagca

SEQ ID NO: 1135576 - RNA, 19 nt, Mycobacterium bovis subsp bovis AF2122/97
cgagugucuuagccagcag

SEQ ID NO: 1135577 - RNA, 21 nt, Mycobacterium bovis subsp bovis AF2122/97
cgagugucuuagccagcagca

SEQ ID NO: 1135578 - RNA, 15 nt, Mycobacterium bovis subsp bovis AF2122/97
cgaguucggcccgca

SEQ ID NO: 1135579 - RNA, 19 nt, Mycobacterium bovis subsp bovis AF2122/97
cgaguucgcagucgaugag

SEQ ID NO: 1135580 - RNA, 19 nt, Mycobacterium bovis subsp bovis AF2122/97
cgaguuccugcacggucaa

SEQ ID NO: 1135581 - RNA, 23 nt, Mycobacterium bovis subsp bovis AF2122/97
cgaguguggccgaaagccaggcg

SEQ ID NO: 1135582 - RNA, 14 nt, Mycobacterium bovis subsp bovis AF2122/97
cgaguuaccgguga

SEQ ID NO: 1135583 - RNA, 15 nt, Mycobacterium bovis subsp bovis AF2122/97
cgaguuggccguggc

SEQ ID NO: 1135584 - RNA, 20 nt, Mycobacterium bovis subsp bovis AF2122/97
cgaguuggccguggcgaaug

SEQ ID NO: 1135585 - RNA, 17 nt, Mycobacterium bovis subsp bovis AF2122/97
cgaguuggcgaagcccg

SEQ ID NO: 1135586 - RNA, 20 nt, Mycobacterium bovis subsp bovis AF2122/97
cgaguugcccgggucggccg

SEQ ID NO: 1135587 - RNA, 12 nt, Mycobacterium bovis subsp bovis AF2122/97
cgaguugcccgg

SEQ ID NO: 1135588 - RNA, 15 nt, Mycobacterium bovis subsp bovis AF2122/97
cgaguuaggccgcca

SEQ ID NO: 1135589 - RNA, 17 nt, Mycobacterium bovis subsp bovis AF2122/97
cgaguucguagucggca

SEQ ID NO: 1135590 - RNA, 22 nt, Mycobacterium bovis subsp bovis AF2122/97
cgaguucuggaauccggccaga

SEQ ID NO: 1135591 - RNA, 13 nt, Mycobacterium bovis subsp bovis AF2122/97
cgaguugaccgcc

SEQ ID NO: 1135592 - RNA, 22 nt, Mycobacterium bovis subsp bovis AF2122/97
cgaguuugguguagacgugcgu

SEQ ID NO: 1135593 - RNA, 19 nt, Mycobacterium bovis subsp bovis AF2122/97
cgaguuucugaagcccgac

SEQ ID NO: 1135594 - RNA, 20 nt, Mycobacterium bovis subsp bovis AF2122/97
cgaguugcucggccgaugcg

SEQ ID NO: 1135595 - RNA, 14 nt, Mycobacterium bovis subsp bovis AF2122/97
cgaguugcgcggca

SEQ ID NO: 1135596 - RNA, 17 nt, Mycobacterium bovis subsp bovis AF2122/97
cgaguuguggacgcccg

SEQ ID NO: 1135597 - RNA, 16 nt, Mycobacterium bovis subsp bovis AF2122/97
cgaguuguugcugccc

SEQ ID NO: 1135598 - RNA, 15 nt, Mycobacterium bovis subsp bovis AF2122/97
cgagcgccggccgcg

SEQ ID NO: 1135599 - RNA, 17 nt, Mycobacterium bovis subsp bovis AF2122/97
cgagcgccggccgcggc

SEQ ID NO: 1135600 - RNA, 20 nt, Mycobacterium bovis subsp bovis AF2122/97
cgagcgccucaagcucgccg

SEQ ID NO: 1135601 - RNA, 20 nt, Mycobacterium bovis subsp bovis AF2122/97
cgagcgccuugucgaucucg

SEQ ID NO: 1135602 - RNA, 21 nt, Mycobacterium bovis subsp bovis AF2122/97
cgagcgccuugucgaucucgu

SEQ ID NO: 1135603 - RNA, 17 nt, Mycobacterium bovis subsp bovis AF2122/97
cgagcgccuuuggcggu

SEQ ID NO: 1135604 - RNA, 18 nt, Mycobacterium bovis subsp bovis AF2122/97
cgagcgccuuuggcggug

SEQ ID NO: 1135605 - RNA, 22 nt, Mycobacterium bovis subsp bovis AF2122/97
cgagcgccuuuggcggugaugg

SEQ ID NO: 1135606 - RNA, 14 nt, Mycobacterium bovis subsp bovis AF2122/97
cgagcgcagcgugu

SEQ ID NO: 1135607 - RNA, 15 nt, Mycobacterium bovis subsp bovis AF2122/97
cgagcgcaccacggc

SEQ ID NO: 1135608 - RNA, 15 nt, Mycobacterium bovis subsp bovis AF2122/97
cgagcgcagcguguu

SEQ ID NO: 1135609 - RNA, 14 nt, Mycobacterium bovis subsp bovis AF2122/97
cgagcgcaucaggg

SEQ ID NO: 1135610 - RNA, 13 nt, Mycobacterium bovis subsp bovis AF2122/97
cgagcgcccuggc

SEQ ID NO: 1135611 - RNA, 14 nt, Mycobacterium bovis subsp bovis AF2122/97
cgagcgccagguca

SEQ ID NO: 1135612 - RNA, 17 nt, Mycobacterium bovis subsp bovis AF2122/97
cgagcgcccacugguga

SEQ ID NO: 1135613 - RNA, 15 nt, Mycobacterium bovis subsp bovis AF2122/97
cgagcgcaucagggu

SEQ ID NO: 1135614 - RNA, 16 nt, Mycobacterium bovis subsp bovis AF2122/97
cgagcgcaucgauggc

SEQ ID NO: 1135615 - RNA, 15 nt, Mycobacterium bovis subsp bovis AF2122/97
cgagcgcaucggcca

SEQ ID NO: 1135616 - RNA, 16 nt, Mycobacterium bovis subsp bovis AF2122/97
cgagcgcaucggccaa

SEQ ID NO: 1135617 - RNA, 21 nt, Mycobacterium bovis subsp bovis AF2122/97
cgagcgcaacucccagcacgg

SEQ ID NO: 1135618 - RNA, 14 nt, Mycobacterium bovis subsp bovis AF2122/97
cgagcgcacaccgg

SEQ ID NO: 1135619 - RNA, 18 nt, Mycobacterium bovis subsp bovis AF2122/97
cgagcgacccccagcgcc

SEQ ID NO: 1135620 - RNA, 20 nt, Mycobacterium bovis subsp bovis AF2122/97
cgagcgacccccagcgcccg

SEQ ID NO: 1135621 - RNA, 21 nt, Mycobacterium bovis subsp bovis AF2122/97
cgagcgaccgucccagcgccg

SEQ ID NO: 1135622 - RNA, 12 nt, Mycobacterium bovis subsp bovis AF2122/97
cgagcgaugcga

SEQ ID NO: 1135623 - RNA, 16 nt, Mycobacterium bovis subsp bovis AF2122/97
cgagcgaugcgaccga

SEQ ID NO: 1135624 - RNA, 16 nt, Mycobacterium bovis subsp bovis AF2122/97
cgagcgauacgucguc

SEQ ID NO: 1135625 - RNA, 21 nt, Mycobacterium bovis subsp bovis AF2122/97
cgagcgauacgucgucagcca

SEQ ID NO: 1135626 - RNA, 22 nt, Mycobacterium bovis subsp bovis AF2122/97
cgagccucgcucuccauggccg

SEQ ID NO: 1135627 - RNA, 22 nt, Mycobacterium bovis subsp bovis AF2122/97
cgagccugauaaagcccggcgg

SEQ ID NO: 1135628 - RNA, 23 nt, Mycobacterium bovis subsp bovis AF2122/97
cgagccugauaaagcccggcggc

SEQ ID NO: 1135629 - RNA, 13 nt, Mycobacterium bovis subsp bovis AF2122/97
cgagcgaaccgaa

SEQ ID NO: 1135630 - RNA, 17 nt, Mycobacterium bovis subsp bovis AF2122/97
cgagcgacccccagcgc

SEQ ID NO: 1135631 - RNA, 16 nt, Mycobacterium bovis subsp bovis AF2122/97
cgagccggcucagacg

SEQ ID NO: 1135632 - RNA, 13 nt, Mycobacterium bovis subsp bovis AF2122/97
cgagccggcggcc

SEQ ID NO: 1135633 - RNA, 22 nt, Mycobacterium bovis subsp bovis AF2122/97
cgagccggcggccuugcgggcu

SEQ ID NO: 1135634 - RNA, 12 nt, Mycobacterium bovis subsp bovis AF2122/97
cgagccggcgcc

SEQ ID NO: 1135635 - RNA, 17 nt, Mycobacterium bovis subsp bovis AF2122/97
cgagccggcgccggguc

SEQ ID NO: 1135636 - RNA, 23 nt, Mycobacterium bovis subsp bovis AF2122/97
cgagccggggaacgugaccccca

SEQ ID NO: 1135637 - RNA, 21 nt, Mycobacterium bovis subsp bovis AF2122/97
cgagccgguauacccggcccc

SEQ ID NO: 1135638 - RNA, 13 nt, Mycobacterium bovis subsp bovis AF2122/97
cgagccgguaacc

SEQ ID NO: 1135639 - RNA, 21 nt, Mycobacterium bovis subsp bovis AF2122/97
cgagccguccaagccagcguu

SEQ ID NO: 1135640 - RNA, 12 nt, Mycobacterium bovis subsp bovis AF2122/97
cgagccgcggca

SEQ ID NO: 1135641 - RNA, 14 nt, Mycobacterium bovis subsp bovis AF2122/97
cgagccgaccggcg

SEQ ID NO: 1135642 - RNA, 21 nt, Mycobacterium bovis subsp bovis AF2122/97
cgagccgcgcccaaugcgggc

SEQ ID NO: 1135643 - RNA, 14 nt, Mycobacterium bovis subsp bovis AF2122/97
cgagccgcggucgg

SEQ ID NO: 1135644 - RNA, 18 nt, Mycobacterium bovis subsp bovis AF2122/97
cgagccgcggucggcgug

SEQ ID NO: 1135645 - RNA, 20 nt, Mycobacterium bovis subsp bovis AF2122/97
cgagccgcgugggccgcugc

SEQ ID NO: 1135646 - RNA, 15 nt, Mycobacterium bovis subsp bovis AF2122/97
cgagccgcuaggacg

SEQ ID NO: 1135647 - RNA, 14 nt, Mycobacterium bovis subsp bovis AF2122/97
cgagccgcugcgac

SEQ ID NO: 1135648 - RNA, 13 nt, Mycobacterium bovis subsp bovis AF2122/97
cgagccggcacgc

SEQ ID NO: 1135649 - RNA, 20 nt, Mycobacterium bovis subsp bovis AF2122/97
cgagccgcuaggacggcgcg

SEQ ID NO: 1135650 - RNA, 21 nt, Mycobacterium bovis subsp bovis AF2122/97
cgagccgcuaggacggcgcga

SEQ ID NO: 1135651 - RNA, 17 nt, Mycobacterium bovis subsp bovis AF2122/97
cgagccgcacgaugccg

SEQ ID NO: 1135652 - RNA, 14 nt, Mycobacterium bovis subsp bovis AF2122/97
cgagccgccaccgu

SEQ ID NO: 1135653 - RNA, 16 nt, Mycobacterium bovis subsp bovis AF2122/97
cgagcgcgcguagcgg

SEQ ID NO: 1135654 - RNA, 19 nt, Mycobacterium bovis subsp bovis AF2122/97
cgagcgcgaugcagugcga

SEQ ID NO: 1135655 - RNA, 19 nt, Mycobacterium bovis subsp bovis AF2122/97
cgagcgcgccguugccgcc

SEQ ID NO: 1135656 - RNA, 15 nt, Mycobacterium bovis subsp bovis AF2122/97
cgagcgcgccggcca

SEQ ID NO: 1135657 - RNA, 23 nt, Mycobacterium bovis subsp bovis AF2122/97
cgagcgcgccggcucuccgguga

SEQ ID NO: 1135658 - RNA, 14 nt, Mycobacterium bovis subsp bovis AF2122/97
cgagcgcgccguug

SEQ ID NO: 1135659 - RNA, 13 nt, Mycobacterium bovis subsp bovis AF2122/97
cgagcgcggcggc

SEQ ID NO: 1135660 - RNA, 19 nt, Mycobacterium bovis subsp bovis AF2122/97
cgagcgcgucggucaccga

SEQ ID NO: 1135661 - RNA, 16 nt, Mycobacterium bovis subsp bovis AF2122/97
cgagcgcggcgaucga

SEQ ID NO: 1135662 - RNA, 16 nt, Mycobacterium bovis subsp bovis AF2122/97
cgagcgcggugccgcc

SEQ ID NO: 1135663 - RNA, 18 nt, Mycobacterium bovis subsp bovis AF2122/97
cgagcgcuaucaccgccu

SEQ ID NO: 1135664 - RNA, 14 nt, Mycobacterium bovis subsp bovis AF2122/97
cgagcgcucgauca

SEQ ID NO: 1135665 - RNA, 13 nt, Mycobacterium bovis subsp bovis AF2122/97
cgagcgcggccug

SEQ ID NO: 1135666 - RNA, 20 nt, Mycobacterium bovis subsp bovis AF2122/97
cgagcgcuucgucgccgaac

SEQ ID NO: 1135667 - RNA, 18 nt, Mycobacterium bovis subsp bovis AF2122/97
cgagcggagacuccagca

SEQ ID NO: 1135668 - RNA, 21 nt, Mycobacterium bovis subsp bovis AF2122/97
cgagcggacagggagcaaacg

SEQ ID NO: 1135669 - RNA, 15 nt, Mycobacterium bovis subsp bovis AF2122/97
cgagcggaccaccgc

SEQ ID NO: 1135670 - RNA, 16 nt, Mycobacterium bovis subsp bovis AF2122/97
cgagcggaccaccgcu

SEQ ID NO: 1135671 - RNA, 15 nt, Mycobacterium bovis subsp bovis AF2122/97
cgagcggagccgccg

SEQ ID NO: 1135672 - RNA, 16 nt, Mycobacterium bovis subsp bovis AF2122/97
cgagcggagccgccga

SEQ ID NO: 1135673 - RNA, 17 nt, Mycobacterium bovis subsp bovis AF2122/97
cgagcggcugagccgca

SEQ ID NO: 1135674 - RNA, 19 nt, Mycobacterium bovis subsp bovis AF2122/97
cgagcgugcgcugguggcg

SEQ ID NO: 1135675 - RNA, 21 nt, Mycobacterium bovis subsp bovis AF2122/97
cgagcgugcgcugguggcggc

SEQ ID NO: 1135676 - RNA, 23 nt, Mycobacterium bovis subsp bovis AF2122/97
cgagcgugcgcugguggcggcga

SEQ ID NO: 1135677 - RNA, 15 nt, Mycobacterium bovis subsp bovis AF2122/97
cgagcguggcaacga

SEQ ID NO: 1135678 - RNA, 13 nt, Mycobacterium bovis subsp bovis AF2122/97
cgagcguggccaa

SEQ ID NO: 1135679 - RNA, 20 nt, Mycobacterium bovis subsp bovis AF2122/97
cgagcguggccaauccggcg

SEQ ID NO: 1135680 - RNA, 21 nt, Mycobacterium bovis subsp bovis AF2122/97
cgagcguggccaauccggcgg

SEQ ID NO: 1135681 - RNA, 22 nt, Mycobacterium bovis subsp bovis AF2122/97
cgagcguggccaauccggcggc

SEQ ID NO: 1135682 - RNA, 14 nt, Mycobacterium bovis subsp bovis AF2122/97
cgagcguggcguug

SEQ ID NO: 1135683 - RNA, 16 nt, Mycobacterium bovis subsp bovis AF2122/97
cgagcguggcguuggc

SEQ ID NO: 1135684 - RNA, 13 nt, Mycobacterium bovis subsp bovis AF2122/97
cgagcucaccgca

SEQ ID NO: 1135685 - RNA, 23 nt, Mycobacterium bovis subsp bovis AF2122/97
cgagcucaccgcacaccugcgcg

SEQ ID NO: 1135686 - RNA, 19 nt, Mycobacterium bovis subsp bovis AF2122/97
cgagcuacgacgagugguc

SEQ ID NO: 1135687 - RNA, 21 nt, Mycobacterium bovis subsp bovis AF2122/97
cgagcucaccaaggucggcga

SEQ ID NO: 1135688 - RNA, 18 nt, Mycobacterium bovis subsp bovis AF2122/97
cgagcguuggcuucuucg

SEQ ID NO: 1135689 - RNA, 19 nt, Mycobacterium bovis subsp bovis AF2122/97
cgagcggcccuucaccagc

SEQ ID NO: 1135690 - RNA, 13 nt, Mycobacterium bovis subsp bovis AF2122/97
cgagcggccgcgc

SEQ ID NO: 1135691 - RNA, 14 nt, Mycobacterium bovis subsp bovis AF2122/97
cgagcggccgcgcg

SEQ ID NO: 1135692 - RNA, 15 nt, Mycobacterium bovis subsp bovis AF2122/97
cgagcggccgcgcgc

SEQ ID NO: 1135693 - RNA, 16 nt, Mycobacterium bovis subsp bovis AF2122/97
cgagcggccgcgcgca

SEQ ID NO: 1135694 - RNA, 20 nt, Mycobacterium bovis subsp bovis AF2122/97
cgagcggcaccaaugcggug

SEQ ID NO: 1135695 - RNA, 21 nt, Mycobacterium bovis subsp bovis AF2122/97
cgagcggcaucggucaccgcg

SEQ ID NO: 1135696 - RNA, 21 nt, Mycobacterium bovis subsp bovis AF2122/97
cgagcgggaacgagccacgcc

SEQ ID NO: 1135697 - RNA, 18 nt, Mycobacterium bovis subsp bovis AF2122/97
cgagcgggaucgggcccu

SEQ ID NO: 1135698 - RNA, 21 nt, Mycobacterium bovis subsp bovis AF2122/97
cgagcgggaucgggcccuccg

SEQ ID NO: 1135699 - RNA, 19 nt, Mycobacterium bovis subsp bovis AF2122/97
cgaggaugccgaaccgcgc

SEQ ID NO: 1135700 - RNA, 21 nt, Mycobacterium bovis subsp bovis AF2122/97
cgaggaugcugagcgccaggc

SEQ ID NO: 1135701 - RNA, 17 nt, Mycobacterium bovis subsp bovis AF2122/97
cgaggaccugcucgggc

SEQ ID NO: 1135702 - RNA, 23 nt, Mycobacterium bovis subsp bovis AF2122/97
cgaggacggcuugagccgcagca

SEQ ID NO: 1135703 - RNA, 21 nt, Mycobacterium bovis subsp bovis AF2122/97
cgaggaccucgucaccgguca

SEQ ID NO: 1135704 - RNA, 12 nt, Mycobacterium bovis subsp bovis AF2122/97
cgaggacgacga

SEQ ID NO: 1135705 - RNA, 21 nt, Mycobacterium bovis subsp bovis AF2122/97
cgaggacggcuugagccgcag

SEQ ID NO: 1135706 - RNA, 15 nt, Mycobacterium bovis subsp bovis AF2122/97
cgaggacgccggcgc

SEQ ID NO: 1135707 - RNA, 16 nt, Mycobacterium bovis subsp bovis AF2122/97
cgaggacgccggcgcc

SEQ ID NO: 1135708 - RNA, 18 nt, Mycobacterium bovis subsp bovis AF2122/97
cgaggacgccggcgccgc

SEQ ID NO: 1135709 - RNA, 19 nt, Mycobacterium bovis subsp bovis AF2122/97
cgaggacgccggcgccgcc

SEQ ID NO: 1135710 - RNA, 23 nt, Mycobacterium bovis subsp bovis AF2122/97
cgaggaaguccagcuggccgggu

SEQ ID NO: 1135711 - RNA, 23 nt, Mycobacterium bovis subsp bovis AF2122/97
cgagcugguagguuacgccgggg

SEQ ID NO: 1135712 - RNA, 20 nt, Mycobacterium bovis subsp bovis AF2122/97
cgaggaauuccgcuaccgca

SEQ ID NO: 1135713 - RNA, 22 nt, Mycobacterium bovis subsp bovis AF2122/97
cgaggaauacucucgcgacauc

SEQ ID NO: 1135714 - RNA, 17 nt, Mycobacterium bovis subsp bovis AF2122/97
cgaggacaagcccgcug

SEQ ID NO: 1135715 - RNA, 22 nt, Mycobacterium bovis subsp bovis AF2122/97
cgaggacaagcccgcugccauc

SEQ ID NO: 1135716 - RNA, 17 nt, Mycobacterium bovis subsp bovis AF2122/97
cgaggaacgccggggcg

SEQ ID NO: 1135717 - RNA, 17 nt, Mycobacterium bovis subsp bovis AF2122/97
cgagcuggcaacgccgc

SEQ ID NO: 1135718 - RNA, 19 nt, Mycobacterium bovis subsp bovis AF2122/97
cgagcugguaaacgggugg

SEQ ID NO: 1135719 - RNA, 21 nt, Mycobacterium bovis subsp bovis AF2122/97
cgagcuggccgucagcgucgg

SEQ ID NO: 1135720 - RNA, 14 nt, Mycobacterium bovis subsp bovis AF2122/97
cgagcuggcgaccu

SEQ ID NO: 1135721 - RNA, 19 nt, Mycobacterium bovis subsp bovis AF2122/97
cgagcuggcaacgccgcgc

SEQ ID NO: 1135722 - RNA, 21 nt, Mycobacterium bovis subsp bovis AF2122/97
cgagcuggcaacgccgcgccg

SEQ ID NO: 1135723 - RNA, 14 nt, Mycobacterium bovis subsp bovis AF2122/97
cgagcuggcguucc

SEQ ID NO: 1135724 - RNA, 17 nt, Mycobacterium bovis subsp bovis AF2122/97
cgagcugcgacgaugcc

SEQ ID NO: 1135725 - RNA, 20 nt, Mycobacterium bovis subsp bovis AF2122/97
cgagcugcgacgaugccgcc

SEQ ID NO: 1135726 - RNA, 22 nt, Mycobacterium bovis subsp bovis AF2122/97
cgagcugcgacgaugccgccug

SEQ ID NO: 1135727 - RNA, 13 nt, Mycobacterium bovis subsp bovis AF2122/97
cgagcugccaggc

SEQ ID NO: 1135728 - RNA, 14 nt, Mycobacterium bovis subsp bovis AF2122/97
cgagcugccaggcc

SEQ ID NO: 1135729 - RNA, 13 nt, Mycobacterium bovis subsp bovis AF2122/97
cgagcucgccgca

SEQ ID NO: 1135730 - RNA, 17 nt, Mycobacterium bovis subsp bovis AF2122/97
cgagcucgccgcagcgu

SEQ ID NO: 1135731 - RNA, 15 nt, Mycobacterium bovis subsp bovis AF2122/97
cgagcucgaagcccg

SEQ ID NO: 1135732 - RNA, 13 nt, Mycobacterium bovis subsp bovis AF2122/97
cgagcuccgcggc

SEQ ID NO: 1135733 - RNA, 15 nt, Mycobacterium bovis subsp bovis AF2122/97
cgagcuccgcggcga

SEQ ID NO: 1135734 - RNA, 22 nt, Mycobacterium bovis subsp bovis AF2122/97
cgagcuccuccaccaacucgac

SEQ ID NO: 1135735 - RNA, 23 nt, Mycobacterium bovis subsp bovis AF2122/97
cgaccagccgaucaucaccggca

SEQ ID NO: 1135736 - RNA, 14 nt, Mycobacterium bovis subsp bovis AF2122/97
cgaccagccguggu

SEQ ID NO: 1135737 - RNA, 18 nt, Mycobacterium bovis subsp bovis AF2122/97
cgaccagccccgcugguc

SEQ ID NO: 1135738 - RNA, 17 nt, Mycobacterium bovis subsp bovis AF2122/97
cgaccagccgaucauca

SEQ ID NO: 1135739 - RNA, 15 nt, Mycobacterium bovis subsp bovis AF2122/97
cgaccagccgagcga

SEQ ID NO: 1135740 - RNA, 23 nt, Mycobacterium bovis subsp bovis AF2122/97
cgacaguugugcguacugguccg

SEQ ID NO: 1135741 - RNA, 22 nt, Mycobacterium bovis subsp bovis AF2122/97
cgacaguuuaccgugccgcccg

SEQ ID NO: 1135742 - RNA, 23 nt, Mycobacterium bovis subsp bovis AF2122/97
cgacaguuuaccgugccgcccgg

SEQ ID NO: 1135743 - RNA, 19 nt, Mycobacterium bovis subsp bovis AF2122/97
cgacagugugaagaccacc

SEQ ID NO: 1135744 - RNA, 22 nt, Mycobacterium bovis subsp bovis AF2122/97
cgacagugugaagaccaccgcc

SEQ ID NO: 1135745 - RNA, 18 nt, Mycobacterium bovis subsp bovis AF2122/97
cgacagugugaagaccac

SEQ ID NO: 1135746 - RNA, 22 nt, Mycobacterium bovis subsp bovis AF2122/97
cgacaguugcgccagcguuagg

SEQ ID NO: 1135747 - RNA, 13 nt, Mycobacterium bovis subsp bovis AF2122/97
cgaccagcagacc

SEQ ID NO: 1135748 - RNA, 12 nt, Mycobacterium bovis subsp bovis AF2122/97
cgaccagcagau

SEQ ID NO: 1135749 - RNA, 13 nt, Mycobacterium bovis subsp bovis AF2122/97
cgaccagcagauc

SEQ ID NO: 1135750 - RNA, 23 nt, Mycobacterium bovis subsp bovis AF2122/97
cgaccagcagauccaggcgucgg

SEQ ID NO: 1135751 - RNA, 21 nt, Mycobacterium bovis subsp bovis AF2122/97
cgaccagggccgccgcugccg

SEQ ID NO: 1135752 - RNA, 15 nt, Mycobacterium bovis subsp bovis AF2122/97
cgaccagggcggugc

SEQ ID NO: 1135753 - RNA, 16 nt, Mycobacterium bovis subsp bovis AF2122/97
cgaccagggcggugcu

SEQ ID NO: 1135754 - RNA, 17 nt, Mycobacterium bovis subsp bovis AF2122/97
cgaccaggccacugccg

SEQ ID NO: 1135755 - RNA, 14 nt, Mycobacterium bovis subsp bovis AF2122/97
cgaccagggccgcc

SEQ ID NO: 1135756 - RNA, 18 nt, Mycobacterium bovis subsp bovis AF2122/97
cgaccagggccgccgcug

SEQ ID NO: 1135757 - RNA, 15 nt, Mycobacterium bovis subsp bovis AF2122/97
cgaccaggucgccag

SEQ ID NO: 1135758 - RNA, 19 nt, Mycobacterium bovis subsp bovis AF2122/97
cgaccaggucgccagcucg

SEQ ID NO: 1135759 - RNA, 23 nt, Mycobacterium bovis subsp bovis AF2122/97
cgaccaggaccggcugcaggugc

SEQ ID NO: 1135760 - RNA, 13 nt, Mycobacterium bovis subsp bovis AF2122/97
cgacccgccgcgc

SEQ ID NO: 1135761 - RNA, 14 nt, Mycobacterium bovis subsp bovis AF2122/97
cgacccgccgcgcc

SEQ ID NO: 1135762 - RNA, 18 nt, Mycobacterium bovis subsp bovis AF2122/97
cgacccgccgcgcccggc

SEQ ID NO: 1135763 - RNA, 20 nt, Mycobacterium bovis subsp bovis AF2122/97
cgacccgccgcgcccggcgc

SEQ ID NO: 1135764 - RNA, 13 nt, Mycobacterium bovis subsp bovis AF2122/97
cgaccccggcccc

SEQ ID NO: 1135765 - RNA, 23 nt, Mycobacterium bovis subsp bovis AF2122/97
cgaccccggccccgacggucaac

SEQ ID NO: 1135766 - RNA, 20 nt, Mycobacterium bovis subsp bovis AF2122/97
cgacccgccuguaccggcgu

SEQ ID NO: 1135767 - RNA, 16 nt, Mycobacterium bovis subsp bovis AF2122/97
cgaccccgcgccgaca

SEQ ID NO: 1135768 - RNA, 16 nt, Mycobacterium bovis subsp bovis AF2122/97
cgacccgcgcgccggc

SEQ ID NO: 1135769 - RNA, 20 nt, Mycobacterium bovis subsp bovis AF2122/97
cgacccgcgcgccggcgacc

SEQ ID NO: 1135770 - RNA, 14 nt, Mycobacterium bovis subsp bovis AF2122/97
cgaccccggaguug

SEQ ID NO: 1135771 - RNA, 21 nt, Mycobacterium bovis subsp bovis AF2122/97
cgacccgcgcgccggcgaccc

SEQ ID NO: 1135772 - RNA, 19 nt, Mycobacterium bovis subsp bovis AF2122/97
cgacccggaccugggcgac

SEQ ID NO: 1135773 - RNA, 13 nt, Mycobacterium bovis subsp bovis AF2122/97
cgacccgggccgc

SEQ ID NO: 1135774 - RNA, 14 nt, Mycobacterium bovis subsp bovis AF2122/97
cgacccggccgaug

SEQ ID NO: 1135775 - RNA, 18 nt, Mycobacterium bovis subsp bovis AF2122/97
cgacccggccagcggcag

SEQ ID NO: 1135776 - RNA, 17 nt, Mycobacterium bovis subsp bovis AF2122/97
cgacccggcccagcgcc

SEQ ID NO: 1135777 - RNA, 23 nt, Mycobacterium bovis subsp bovis AF2122/97
cgacccuacuuccucgacgagca

SEQ ID NO: 1135778 - RNA, 15 nt, Mycobacterium bovis subsp bovis AF2122/97
cgacccuccagcacg

SEQ ID NO: 1135779 - RNA, 22 nt, Mycobacterium bovis subsp bovis AF2122/97
cgacccgggaaggaaccgggca

SEQ ID NO: 1135780 - RNA, 16 nt, Mycobacterium bovis subsp bovis AF2122/97
cgacccguucucggug

SEQ ID NO: 1135781 - RNA, 17 nt, Mycobacterium bovis subsp bovis AF2122/97
cgaccaucaucucggug

SEQ ID NO: 1135782 - RNA, 20 nt, Mycobacterium bovis subsp bovis AF2122/97
cgaccccgccgagcgguugc

SEQ ID NO: 1135783 - RNA, 15 nt, Mycobacterium bovis subsp bovis AF2122/97
cgaccccgccgagcg

SEQ ID NO: 1135784 - RNA, 18 nt, Mycobacterium bovis subsp bovis AF2122/97
cgacccccagcgcccgcc

SEQ ID NO: 1135785 - RNA, 21 nt, Mycobacterium bovis subsp bovis AF2122/97
cgacccccgaucaggccgacg

SEQ ID NO: 1135786 - RNA, 19 nt, Mycobacterium bovis subsp bovis AF2122/97
cgacccagcgguugacccu

SEQ ID NO: 1135787 - RNA, 15 nt, Mycobacterium bovis subsp bovis AF2122/97
cgaccccacacgccg

SEQ ID NO: 1135788 - RNA, 17 nt, Mycobacterium bovis subsp bovis AF2122/97
cgacccaucaccagcgg

SEQ ID NO: 1135789 - RNA, 17 nt, Mycobacterium bovis subsp bovis AF2122/97
cgaccauauucagcucg

SEQ ID NO: 1135790 - RNA, 21 nt, Mycobacterium bovis subsp bovis AF2122/97
cgaccauacccgcgcgcacca

SEQ ID NO: 1135791 - RNA, 17 nt, Mycobacterium bovis subsp bovis AF2122/97
cgaccgguacccguagc

SEQ ID NO: 1135792 - RNA, 20 nt, Mycobacterium bovis subsp bovis AF2122/97
cgaccgggucgcaaccgccg

SEQ ID NO: 1135793 - RNA, 22 nt, Mycobacterium bovis subsp bovis AF2122/97
cgaccggguccggcguacgccg

SEQ ID NO: 1135794 - RNA, 19 nt, Mycobacterium bovis subsp bovis AF2122/97
cgaccgggucgcaaccgcc

SEQ ID NO: 1135795 - RNA, 22 nt, Mycobacterium bovis subsp bovis AF2122/97
cgaccgggcucuggccaguccg

SEQ ID NO: 1135796 - RNA, 14 nt, Mycobacterium bovis subsp bovis AF2122/97
cgaccggucgguga

SEQ ID NO: 1135797 - RNA, 21 nt, Mycobacterium bovis subsp bovis AF2122/97
cgaccgucgucgugcaggcgc

SEQ ID NO: 1135798 - RNA, 14 nt, Mycobacterium bovis subsp bovis AF2122/97
cgaccgucucggug

SEQ ID NO: 1135799 - RNA, 16 nt, Mycobacterium bovis subsp bovis AF2122/97
cgaccucacgaaucgc

SEQ ID NO: 1135800 - RNA, 20 nt, Mycobacterium bovis subsp bovis AF2122/97
cgaccuagucaccuugaccg

SEQ ID NO: 1135801 - RNA, 17 nt, Mycobacterium bovis subsp bovis AF2122/97
cgaccucacccacccgc

SEQ ID NO: 1135802 - RNA, 15 nt, Mycobacterium bovis subsp bovis AF2122/97
cgaccucacugcggc

SEQ ID NO: 1135803 - RNA, 18 nt, Mycobacterium bovis subsp bovis AF2122/97
cgaccuccaccaaugcuc

SEQ ID NO: 1135804 - RNA, 16 nt, Mycobacterium bovis subsp bovis AF2122/97
cgaccggggaucgggg

SEQ ID NO: 1135805 - RNA, 21 nt, Mycobacterium bovis subsp bovis AF2122/97
cgaccgugcugggcgccgcgc

SEQ ID NO: 1135806 - RNA, 20 nt, Mycobacterium bovis subsp bovis AF2122/97
cgaccguggcugcgcucgcc

SEQ ID NO: 1135807 - RNA, 21 nt, Mycobacterium bovis subsp bovis AF2122/97
cgaccgugguggucgggcgca

SEQ ID NO: 1135808 - RNA, 13 nt, Mycobacterium bovis subsp bovis AF2122/97
cgaccgugucacc

SEQ ID NO: 1135809 - RNA, 20 nt, Mycobacterium bovis subsp bovis AF2122/97
cgaccuagcagcgcugcgau

SEQ ID NO: 1135810 - RNA, 14 nt, Mycobacterium bovis subsp bovis AF2122/97
cgaccuagcucgcg

SEQ ID NO: 1135811 - RNA, 16 nt, Mycobacterium bovis subsp bovis AF2122/97
cgaccgcggccccgcc

SEQ ID NO: 1135812 - RNA, 20 nt, Mycobacterium bovis subsp bovis AF2122/97
cgaccgcggccccgccguug

SEQ ID NO: 1135813 - RNA, 14 nt, Mycobacterium bovis subsp bovis AF2122/97
cgaccgcggcccgg

SEQ ID NO: 1135814 - RNA, 21 nt, Mycobacterium bovis subsp bovis AF2122/97
cgaccgcggcccggacgucgg

SEQ ID NO: 1135815 - RNA, 15 nt, Mycobacterium bovis subsp bovis AF2122/97
cgaccgcgcggcacu

SEQ ID NO: 1135816 - RNA, 14 nt, Mycobacterium bovis subsp bovis AF2122/97
cgaccgcgcucacc

SEQ ID NO: 1135817 - RNA, 22 nt, Mycobacterium bovis subsp bovis AF2122/97
cgaccgcgcucaccggggccgu

SEQ ID NO: 1135818 - RNA, 18 nt, Mycobacterium bovis subsp bovis AF2122/97
cgaccgcgggccgacgca

SEQ ID NO: 1135819 - RNA, 19 nt, Mycobacterium bovis subsp bovis AF2122/97
cgaccgcgggccgacgcag

SEQ ID NO: 1135820 - RNA, 20 nt, Mycobacterium bovis subsp bovis AF2122/97
cgaccggcgggaugcgcgcc

SEQ ID NO: 1135821 - RNA, 12 nt, Mycobacterium bovis subsp bovis AF2122/97
cgaccggcguug

SEQ ID NO: 1135822 - RNA, 22 nt, Mycobacterium bovis subsp bovis AF2122/97
cgaccggcguugcguagacgaa

SEQ ID NO: 1135823 - RNA, 16 nt, Mycobacterium bovis subsp bovis AF2122/97
cgaccggcuaccggcg

SEQ ID NO: 1135824 - RNA, 18 nt, Mycobacterium bovis subsp bovis AF2122/97
cgaccggcuugcccuccg

SEQ ID NO: 1135825 - RNA, 21 nt, Mycobacterium bovis subsp bovis AF2122/97
cgaccggcucggaaaccgccc

SEQ ID NO: 1135826 - RNA, 24 nt, Mycobacterium bovis subsp bovis AF2122/97
cgaccgggaucggcuccgccgcgg

SEQ ID NO: 1135827 - RNA, 21 nt, Mycobacterium bovis subsp bovis AF2122/97
cgaccgggaaccacggucagc

SEQ ID NO: 1135828 - RNA, 16 nt, Mycobacterium bovis subsp bovis AF2122/97
cgaccgccaccgccag

SEQ ID NO: 1135829 - RNA, 15 nt, Mycobacterium bovis subsp bovis AF2122/97
cgaccgccagcccgg

SEQ ID NO: 1135830 - RNA, 22 nt, Mycobacterium bovis subsp bovis AF2122/97
cgaccgccagccgcgagccggu

SEQ ID NO: 1135831 - RNA, 12 nt, Mycobacterium bovis subsp bovis AF2122/97
cgaccgccagcg

SEQ ID NO: 1135832 - RNA, 17 nt, Mycobacterium bovis subsp bovis AF2122/97
cgaccgccagcguggag

SEQ ID NO: 1135833 - RNA, 15 nt, Mycobacterium bovis subsp bovis AF2122/97
cgaccgcaccgugcc

SEQ ID NO: 1135834 - RNA, 16 nt, Mycobacterium bovis subsp bovis AF2122/97
cgaccgcacgaccagc

SEQ ID NO: 1135835 - RNA, 14 nt, Mycobacterium bovis subsp bovis AF2122/97
cgaccgaccagccg

SEQ ID NO: 1135836 - RNA, 17 nt, Mycobacterium bovis subsp bovis AF2122/97
cgaccgauagcuggccg

SEQ ID NO: 1135837 - RNA, 15 nt, Mycobacterium bovis subsp bovis AF2122/97
cgaccgaucggcgcg

SEQ ID NO: 1135838 - RNA, 20 nt, Mycobacterium bovis subsp bovis AF2122/97
cgaccgaucggcgcgucgau

SEQ ID NO: 1135839 - RNA, 22 nt, Mycobacterium bovis subsp bovis AF2122/97
cgaccgaugaucucacccagcu

SEQ ID NO: 1135840 - RNA, 13 nt, Mycobacterium bovis subsp bovis AF2122/97
cgaccgcccgcca

SEQ ID NO: 1135841 - RNA, 15 nt, Mycobacterium bovis subsp bovis AF2122/97
cgaccgcccgccaac

SEQ ID NO: 1135842 - RNA, 17 nt, Mycobacterium bovis subsp bovis AF2122/97
cgaccgcccgccagcga

SEQ ID NO: 1135843 - RNA, 21 nt, Mycobacterium bovis subsp bovis AF2122/97
cgaccgcagcuggggcggaua

SEQ ID NO: 1135844 - RNA, 16 nt, Mycobacterium bovis subsp bovis AF2122/97
cgaccgcaugaucgca

SEQ ID NO: 1135845 - RNA, 22 nt, Mycobacterium bovis subsp bovis AF2122/97
cgaccgcaugaucgcaccgagg

SEQ ID NO: 1135846 - RNA, 20 nt, Mycobacterium bovis subsp bovis AF2122/97
cgaccgccaucacgaccagg

SEQ ID NO: 1135847 - RNA, 16 nt, Mycobacterium bovis subsp bovis AF2122/97
cgaccgccgagcgggu

SEQ ID NO: 1135848 - RNA, 24 nt, Mycobacterium bovis subsp bovis AF2122/97
cgaccgcccuagcgagcggcacca

SEQ ID NO: 1135849 - RNA, 15 nt, Mycobacterium bovis subsp bovis AF2122/97
cgaccgccgcgagca

SEQ ID NO: 1135850 - RNA, 16 nt, Mycobacterium bovis subsp bovis AF2122/97
cgaccgacgccggugu

SEQ ID NO: 1135851 - RNA, 19 nt, Mycobacterium bovis subsp bovis AF2122/97
cgaccgauaacacccgggc

SEQ ID NO: 1135852 - RNA, 18 nt, Mycobacterium bovis subsp bovis AF2122/97
cgaccgagacggcgucgg

SEQ ID NO: 1135853 - RNA, 15 nt, Mycobacterium bovis subsp bovis AF2122/97
cgaccgaaccgucag

SEQ ID NO: 1135854 - RNA, 23 nt, Mycobacterium bovis subsp bovis AF2122/97
cgaccgaaacggggcgacguccg

SEQ ID NO: 1135855 - RNA, 16 nt, Mycobacterium bovis subsp bovis AF2122/97
cgaccgaaagccgcac

SEQ ID NO: 1135856 - RNA, 13 nt, Mycobacterium bovis subsp bovis AF2122/97
cgaccgaccgcac

SEQ ID NO: 1135857 - RNA, 12 nt, Mycobacterium bovis subsp bovis AF2122/97
cgaccgaccagc

SEQ ID NO: 1135858 - RNA, 21 nt, Mycobacterium bovis subsp bovis AF2122/97
cgaccgaaucagcacggugug

SEQ ID NO: 1135859 - RNA, 14 nt, Mycobacterium bovis subsp bovis AF2122/97
cgaccgacaccacc

SEQ ID NO: 1135860 - RNA, 16 nt, Mycobacterium bovis subsp bovis AF2122/97
cgaccgacaccaccag

SEQ ID NO: 1135861 - RNA, 24 nt, Mycobacterium bovis subsp bovis AF2122/97
cgaccucguucgucaccacgaucg

SEQ ID NO: 1135862 - RNA, 19 nt, Mycobacterium bovis subsp bovis AF2122/97
cgaccucugcacggccguc

SEQ ID NO: 1135863 - RNA, 20 nt, Mycobacterium bovis subsp bovis AF2122/97
cgaccucugcacggccguca

SEQ ID NO: 1135864 - RNA, 20 nt, Mycobacterium bovis subsp bovis AF2122/97
cgaccucgucggccgacacc

SEQ ID NO: 1135865 - RNA, 22 nt, Mycobacterium bovis subsp bovis AF2122/97
cgaccucgucggccgacaccgc

SEQ ID NO: 1135866 - RNA, 15 nt, Mycobacterium bovis subsp bovis AF2122/97
cgacgaaccccauca

SEQ ID NO: 1135867 - RNA, 23 nt, Mycobacterium bovis subsp bovis AF2122/97
cgaccugaggcaccucggccuug

SEQ ID NO: 1135868 - RNA, 14 nt, Mycobacterium bovis subsp bovis AF2122/97
cgacgaacaccagc

SEQ ID NO: 1135869 - RNA, 16 nt, Mycobacterium bovis subsp bovis AF2122/97
cgacgaaccucggcgg

SEQ ID NO: 1135870 - RNA, 20 nt, Mycobacterium bovis subsp bovis AF2122/97
cgacgaacgaaccgccgccg

SEQ ID NO: 1135871 - RNA, 23 nt, Mycobacterium bovis subsp bovis AF2122/97
cgacgaagaagaacucggcgucg

SEQ ID NO: 1135872 - RNA, 16 nt, Mycobacterium bovis subsp bovis AF2122/97
cgacgaagaucgcugc

SEQ ID NO: 1135873 - RNA, 18 nt, Mycobacterium bovis subsp bovis AF2122/97
cgacgaagaucgcugcga

SEQ ID NO: 1135874 - RNA, 21 nt, Mycobacterium bovis subsp bovis AF2122/97
cgacgaagaucuucaccggcc

SEQ ID NO: 1135875 - RNA, 13 nt, Mycobacterium bovis subsp bovis AF2122/97
cgacgaagaucgc

SEQ ID NO: 1135876 - RNA, 18 nt, Mycobacterium bovis subsp bovis AF2122/97
cgaccucgggaucggcgg

SEQ ID NO: 1135877 - RNA, 17 nt, Mycobacterium bovis subsp bovis AF2122/97
cgacgaagaucgcgugc

SEQ ID NO: 1135878 - RNA, 15 nt, Mycobacterium bovis subsp bovis AF2122/97
cgacgaaggcgacgg

SEQ ID NO: 1135879 - RNA, 14 nt, Mycobacterium bovis subsp bovis AF2122/97
cgacgacccggguc

SEQ ID NO: 1135880 - RNA, 16 nt, Mycobacterium bovis subsp bovis AF2122/97
cgacgacccgggucgg

SEQ ID NO: 1135881 - RNA, 19 nt, Mycobacterium bovis subsp bovis AF2122/97
cgacgacccgggucggcac

SEQ ID NO: 1135882 - RNA, 16 nt, Mycobacterium bovis subsp bovis AF2122/97
cgacgacccgacguag

SEQ ID NO: 1135883 - RNA, 17 nt, Mycobacterium bovis subsp bovis AF2122/97
cgacgaccucgacguug

SEQ ID NO: 1135884 - RNA, 21 nt, Mycobacterium bovis subsp bovis AF2122/97
cgacgacccgggucggcacga

SEQ ID NO: 1135885 - RNA, 20 nt, Mycobacterium bovis subsp bovis AF2122/97
cgacgaucgucuugucgccg

SEQ ID NO: 1135886 - RNA, 21 nt, Mycobacterium bovis subsp bovis AF2122/97
cgacgaucgucuugucgccga

SEQ ID NO: 1135887 - RNA, 15 nt, Mycobacterium bovis subsp bovis AF2122/97
cgacgaucgcgucgg

SEQ ID NO: 1135888 - RNA, 14 nt, Mycobacterium bovis subsp bovis AF2122/97
cgacgaugacgcgc

SEQ ID NO: 1135889 - RNA, 16 nt, Mycobacterium bovis subsp bovis AF2122/97
cgacgaugacgcgcga

SEQ ID NO: 1135890 - RNA, 12 nt, Mycobacterium bovis subsp bovis AF2122/97
cgacgaucucuc

SEQ ID NO: 1135891 - RNA, 14 nt, Mycobacterium bovis subsp bovis AF2122/97
cgacgaugaugccg

SEQ ID NO: 1135892 - RNA, 17 nt, Mycobacterium bovis subsp bovis AF2122/97
cgacgaucucgccgcca

SEQ ID NO: 1135893 - RNA, 19 nt, Mycobacterium bovis subsp bovis AF2122/97
cgacgaucucgccgccagc

SEQ ID NO: 1135894 - RNA, 23 nt, Mycobacterium bovis subsp bovis AF2122/97
cgacgaucucgccggcgaagacc

SEQ ID NO: 1135895 - RNA, 17 nt, Mycobacterium bovis subsp bovis AF2122/97
cgacgcaccucgguggc

SEQ ID NO: 1135896 - RNA, 22 nt, Mycobacterium bovis subsp bovis AF2122/97
cgacgaucugcagcacucggug

SEQ ID NO: 1135897 - RNA, 13 nt, Mycobacterium bovis subsp bovis AF2122/97
cgacgaugccggc

SEQ ID NO: 1135898 - RNA, 19 nt, Mycobacterium bovis subsp bovis AF2122/97
cgacgcaccaacgcgauca

SEQ ID NO: 1135899 - RNA, 20 nt, Mycobacterium bovis subsp bovis AF2122/97
cgacgcaccaacgcgaucag

SEQ ID NO: 1135900 - RNA, 20 nt, Mycobacterium bovis subsp bovis AF2122/97
cgacgcacugccccgcaucg

SEQ ID NO: 1135901 - RNA, 21 nt, Mycobacterium bovis subsp bovis AF2122/97
cgacgcacugccccgcaucgc

SEQ ID NO: 1135902 - RNA, 18 nt, Mycobacterium bovis subsp bovis AF2122/97
cgacgcagaccguccagc

SEQ ID NO: 1135903 - RNA, 14 nt, Mycobacterium bovis subsp bovis AF2122/97
cgacgagcccaccg

SEQ ID NO: 1135904 - RNA, 16 nt, Mycobacterium bovis subsp bovis AF2122/97
cgacgagcccaccguc

SEQ ID NO: 1135905 - RNA, 17 nt, Mycobacterium bovis subsp bovis AF2122/97
cgacgagcccaccgucg

SEQ ID NO: 1135906 - RNA, 15 nt, Mycobacterium bovis subsp bovis AF2122/97
cgacgagcaccgcgc

SEQ ID NO: 1135907 - RNA, 18 nt, Mycobacterium bovis subsp bovis AF2122/97
cgacgagcaccgcgccgc

SEQ ID NO: 1135908 - RNA, 13 nt, Mycobacterium bovis subsp bovis AF2122/97
cgacgagcagcaa

SEQ ID NO: 1135909 - RNA, 13 nt, Mycobacterium bovis subsp bovis AF2122/97
cgacgacggcacc

SEQ ID NO: 1135910 - RNA, 24 nt, Mycobacterium bovis subsp bovis AF2122/97
cgacgagccgcaaaaucgaugacg

SEQ ID NO: 1135911 - RNA, 12 nt, Mycobacterium bovis subsp bovis AF2122/97
cgacgagcgcag

SEQ ID NO: 1135912 - RNA, 15 nt, Mycobacterium bovis subsp bovis AF2122/97
cgacgagcgccucaa

SEQ ID NO: 1135913 - RNA, 18 nt, Mycobacterium bovis subsp bovis AF2122/97
cgacgagccgcggucggc

SEQ ID NO: 1135914 - RNA, 18 nt, Mycobacterium bovis subsp bovis AF2122/97
cgacgaggggcgcgggug

SEQ ID NO: 1135915 - RNA, 20 nt, Mycobacterium bovis subsp bovis AF2122/97
cgacgaucgacgccgccacc

SEQ ID NO: 1135916 - RNA, 16 nt, Mycobacterium bovis subsp bovis AF2122/97
cgacgaggacggcuug

SEQ ID NO: 1135917 - RNA, 18 nt, Mycobacterium bovis subsp bovis AF2122/97
cgacgaggaugucgauga

SEQ ID NO: 1135918 - RNA, 15 nt, Mycobacterium bovis subsp bovis AF2122/97
cgacgagggccagca

SEQ ID NO: 1135919 - RNA, 20 nt, Mycobacterium bovis subsp bovis AF2122/97
cgacgagggccagcagccgc

SEQ ID NO: 1135920 - RNA, 16 nt, Mycobacterium bovis subsp bovis AF2122/97
cgacgccaugucgaug

SEQ ID NO: 1135921 - RNA, 18 nt, Mycobacterium bovis subsp bovis AF2122/97
cgacgccaugucgauguc

SEQ ID NO: 1135922 - RNA, 13 nt, Mycobacterium bovis subsp bovis AF2122/97
cgacgcaccucgg

SEQ ID NO: 1135923 - RNA, 19 nt, Mycobacterium bovis subsp bovis AF2122/97
cgacgcaugggucauggcg

SEQ ID NO: 1135924 - RNA, 17 nt, Mycobacterium bovis subsp bovis AF2122/97
cgacgcauaaccggcgc

SEQ ID NO: 1135925 - RNA, 19 nt, Mycobacterium bovis subsp bovis AF2122/97
cgacgcagcuugcccgacg

SEQ ID NO: 1135926 - RNA, 20 nt, Mycobacterium bovis subsp bovis AF2122/97
cgacgcagcuugcccgacgg

SEQ ID NO: 1135927 - RNA, 22 nt, Mycobacterium bovis subsp bovis AF2122/97
cgacgcagcuugcccgacggcg

SEQ ID NO: 1135928 - RNA, 18 nt, Mycobacterium bovis subsp bovis AF2122/97
cgacgcaggugaacgccg

SEQ ID NO: 1135929 - RNA, 20 nt, Mycobacterium bovis subsp bovis AF2122/97
cgacgcaggugaacgccggu

SEQ ID NO: 1135930 - RNA, 21 nt, Mycobacterium bovis subsp bovis AF2122/97
cgacgcaggugaacgccggug

SEQ ID NO: 1135931 - RNA, 20 nt, Mycobacterium bovis subsp bovis AF2122/97
cgacgcccauggcgucgaac

SEQ ID NO: 1135932 - RNA, 16 nt, Mycobacterium bovis subsp bovis AF2122/97
cgacgccccgaucggc

SEQ ID NO: 1135933 - RNA, 12 nt, Mycobacterium bovis subsp bovis AF2122/97
cgacgcccgacg

SEQ ID NO: 1135934 - RNA, 18 nt, Mycobacterium bovis subsp bovis AF2122/97
cgacgcccgacgaugugc

SEQ ID NO: 1135935 - RNA, 22 nt, Mycobacterium bovis subsp bovis AF2122/97
cgacgcccgauacgccaccggc

SEQ ID NO: 1135936 - RNA, 13 nt, Mycobacterium bovis subsp bovis AF2122/97
cgacgcccgccac

SEQ ID NO: 1135937 - RNA, 14 nt, Mycobacterium bovis subsp bovis AF2122/97
cgacgcccgccacc

SEQ ID NO: 1135938 - RNA, 14 nt, Mycobacterium bovis subsp bovis AF2122/97
cgacgcccgcccug

SEQ ID NO: 1135939 - RNA, 19 nt, Mycobacterium bovis subsp bovis AF2122/97
cgacgccccgaucggccac

SEQ ID NO: 1135940 - RNA, 20 nt, Mycobacterium bovis subsp bovis AF2122/97
cgacgccccgaucggccacc

SEQ ID NO: 1135941 - RNA, 16 nt, Mycobacterium bovis subsp bovis AF2122/97
cgacgccgaucgcggc

SEQ ID NO: 1135942 - RNA, 13 nt, Mycobacterium bovis subsp bovis AF2122/97
cgacgccgaucgc

SEQ ID NO: 1135943 - RNA, 17 nt, Mycobacterium bovis subsp bovis AF2122/97
cgacgccgaccacccgg

SEQ ID NO: 1135944 - RNA, 23 nt, Mycobacterium bovis subsp bovis AF2122/97
cgacgccgagaccgccgcugccg

SEQ ID NO: 1135945 - RNA, 14 nt, Mycobacterium bovis subsp bovis AF2122/97
cgacgccgacgaug

SEQ ID NO: 1135946 - RNA, 16 nt, Mycobacterium bovis subsp bovis AF2122/97
cgacgccgacgaugac

SEQ ID NO: 1135947 - RNA, 21 nt, Mycobacterium bovis subsp bovis AF2122/97
cgacgccgacgaugacgcgcg

SEQ ID NO: 1135948 - RNA, 18 nt, Mycobacterium bovis subsp bovis AF2122/97
cgacgccgagaccgccgc

SEQ ID NO: 1135949 - RNA, 20 nt, Mycobacterium bovis subsp bovis AF2122/97
cgacgccgagaccgccgcug

SEQ ID NO: 1135950 - RNA, 21 nt, Mycobacterium bovis subsp bovis AF2122/97
cgacgccgaaaaugccgccca

SEQ ID NO: 1135951 - RNA, 12 nt, Mycobacterium bovis subsp bovis AF2122/97
cgacgccgccgg

SEQ ID NO: 1135952 - RNA, 15 nt, Mycobacterium bovis subsp bovis AF2122/97
cgacgccgccggccc

SEQ ID NO: 1135953 - RNA, 16 nt, Mycobacterium bovis subsp bovis AF2122/97
cgacgccgccggcgcc

SEQ ID NO: 1135954 - RNA, 16 nt, Mycobacterium bovis subsp bovis AF2122/97
cgacgccgcagcgucc

SEQ ID NO: 1135955 - RNA, 23 nt, Mycobacterium bovis subsp bovis AF2122/97
cgacgccgaaaaugccgcccagc

SEQ ID NO: 1135956 - RNA, 21 nt, Mycobacterium bovis subsp bovis AF2122/97
cgacgccgcucccgcacaagc

SEQ ID NO: 1135957 - RNA, 17 nt, Mycobacterium bovis subsp bovis AF2122/97
cgacgccgcgguuuucg

SEQ ID NO: 1135958 - RNA, 15 nt, Mycobacterium bovis subsp bovis AF2122/97
cgacgccgcgcagcc

SEQ ID NO: 1135959 - RNA, 16 nt, Mycobacterium bovis subsp bovis AF2122/97
cgacgccgcgcagccg

SEQ ID NO: 1135960 - RNA, 15 nt, Mycobacterium bovis subsp bovis AF2122/97
cgacgccgccacccg

SEQ ID NO: 1135961 - RNA, 16 nt, Mycobacterium bovis subsp bovis AF2122/97
cgacgccgccacccgg

SEQ ID NO: 1135962 - RNA, 14 nt, Mycobacterium bovis subsp bovis AF2122/97
cgacgcgaccgcga

SEQ ID NO: 1135963 - RNA, 21 nt, Mycobacterium bovis subsp bovis AF2122/97
cgacgcgcauucgccgggcgg

SEQ ID NO: 1135964 - RNA, 21 nt, Mycobacterium bovis subsp bovis AF2122/97
cgacgcgcgagaacacccgug

SEQ ID NO: 1135965 - RNA, 11 nt, Mycobacterium bovis subsp bovis AF2122/97
cgacgcgccgg

SEQ ID NO: 1135966 - RNA, 16 nt, Mycobacterium bovis subsp bovis AF2122/97
cgacgcgcucggcgau

SEQ ID NO: 1135967 - RNA, 15 nt, Mycobacterium bovis subsp bovis AF2122/97
cgacgcgcucggcga

SEQ ID NO: 1135968 - RNA, 19 nt, Mycobacterium bovis subsp bovis AF2122/97
cgacgcgcccgcgcgcucc

SEQ ID NO: 1135969 - RNA, 17 nt, Mycobacterium bovis subsp bovis AF2122/97
cgacgcgcggccagccc

SEQ ID NO: 1135970 - RNA, 15 nt, Mycobacterium bovis subsp bovis AF2122/97
cgacgcggcgccgcc

SEQ ID NO: 1135971 - RNA, 20 nt, Mycobacterium bovis subsp bovis AF2122/97
cgacgcggcgccgccaucaa

SEQ ID NO: 1135972 - RNA, 16 nt, Mycobacterium bovis subsp bovis AF2122/97
cgacgcggcaggccgg

SEQ ID NO: 1135973 - RNA, 15 nt, Mycobacterium bovis subsp bovis AF2122/97
cgacgccgcuggaga

SEQ ID NO: 1135974 - RNA, 13 nt, Mycobacterium bovis subsp bovis AF2122/97
cgacgccggucac

SEQ ID NO: 1135975 - RNA, 12 nt, Mycobacterium bovis subsp bovis AF2122/97
cgacgccggugc

SEQ ID NO: 1135976 - RNA, 14 nt, Mycobacterium bovis subsp bovis AF2122/97
cgacgccggugccg

SEQ ID NO: 1135977 - RNA, 14 nt, Mycobacterium bovis subsp bovis AF2122/97
cgacgccgguggca

SEQ ID NO: 1135978 - RNA, 17 nt, Mycobacterium bovis subsp bovis AF2122/97
cgacgccggccuggccg

SEQ ID NO: 1135979 - RNA, 12 nt, Mycobacterium bovis subsp bovis AF2122/97
cgacgccgcggu

SEQ ID NO: 1135980 - RNA, 23 nt, Mycobacterium bovis subsp bovis AF2122/97
cgacgccgguggcagagccgccg

SEQ ID NO: 1135981 - RNA, 22 nt, Mycobacterium bovis subsp bovis AF2122/97
cgacgccgguggggucggucug

SEQ ID NO: 1135982 - RNA, 22 nt, Mycobacterium bovis subsp bovis AF2122/97
cgacgccggugucggcuggucg

SEQ ID NO: 1135983 - RNA, 15 nt, Mycobacterium bovis subsp bovis AF2122/97
cgacgcgaacgcggc

SEQ ID NO: 1135984 - RNA, 16 nt, Mycobacterium bovis subsp bovis AF2122/97
cgacgccuuccagccc

SEQ ID NO: 1135985 - RNA, 20 nt, Mycobacterium bovis subsp bovis AF2122/97
cgacgcgacacacgccgccg

SEQ ID NO: 1135986 - RNA, 22 nt, Mycobacterium bovis subsp bovis AF2122/97
cgacgcgacacacgccgccggu

SEQ ID NO: 1135987 - RNA, 17 nt, Mycobacterium bovis subsp bovis AF2122/97
cgacgcgacacgccggc

SEQ ID NO: 1135988 - RNA, 19 nt, Mycobacterium bovis subsp bovis AF2122/97
cgacgcgacacgccggcgg

SEQ ID NO: 1135989 - RNA, 19 nt, Mycobacterium bovis subsp bovis AF2122/97
cgacagauugcucgguggu

SEQ ID NO: 1135990 - RNA, 16 nt, Mycobacterium bovis subsp bovis AF2122/97
cgacagacagcaccgc

SEQ ID NO: 1135991 - RNA, 20 nt, Mycobacterium bovis subsp bovis AF2122/97
cgacacggugcugccguugg

SEQ ID NO: 1135992 - RNA, 21 nt, Mycobacterium bovis subsp bovis AF2122/97
cgacacugggaucccgacgaa

SEQ ID NO: 1135993 - RNA, 22 nt, Mycobacterium bovis subsp bovis AF2122/97
cgacacugggaucccgacgaag

SEQ ID NO: 1135994 - RNA, 17 nt, Mycobacterium bovis subsp bovis AF2122/97
cgacacguuggcggaug

SEQ ID NO: 1135995 - RNA, 19 nt, Mycobacterium bovis subsp bovis AF2122/97
cgacacguuucacgugguc

SEQ ID NO: 1135996 - RNA, 20 nt, Mycobacterium bovis subsp bovis AF2122/97
cgacacucacgggugcuggc

SEQ ID NO: 1135997 - RNA, 15 nt, Mycobacterium bovis subsp bovis AF2122/97
cgacacggugcugcc

SEQ ID NO: 1135998 - RNA, 12 nt, Mycobacterium bovis subsp bovis AF2122/97
cgacacgccgaa

SEQ ID NO: 1135999 - RNA, 15 nt, Mycobacterium bovis subsp bovis AF2122/97
cgacacggccauccg

SEQ ID NO: 1136000 - RNA, 16 nt, Mycobacterium bovis subsp bovis AF2122/97
cgacacguugacgaug

SEQ ID NO: 1136001 - RNA, 20 nt, Mycobacterium bovis subsp bovis AF2122/97
cgacacgccgugcgugcggg

SEQ ID NO: 1136002 - RNA, 20 nt, Mycobacterium bovis subsp bovis AF2122/97
cgacacgaaggucgcggucg

SEQ ID NO: 1136003 - RNA, 17 nt, Mycobacterium bovis subsp bovis AF2122/97
cgacacgaaggucgcgg

SEQ ID NO: 1136004 - RNA, 13 nt, Mycobacterium bovis subsp bovis AF2122/97
cgacacgccagcc

SEQ ID NO: 1136005 - RNA, 20 nt, Mycobacterium bovis subsp bovis AF2122/97
cgacacgccaggugaugccg

SEQ ID NO: 1136006 - RNA, 22 nt, Mycobacterium bovis subsp bovis AF2122/97
cgacacgccaggugaugccgcc

SEQ ID NO: 1136007 - RNA, 18 nt, Mycobacterium bovis subsp bovis AF2122/97
cgacagcacccggccacc

SEQ ID NO: 1136008 - RNA, 19 nt, Mycobacterium bovis subsp bovis AF2122/97
cgacagcacccggccaccg

SEQ ID NO: 1136009 - RNA, 21 nt, Mycobacterium bovis subsp bovis AF2122/97
cgacagcacccggccaccgga

SEQ ID NO: 1136010 - RNA, 14 nt, Mycobacterium bovis subsp bovis AF2122/97
cgacagcaccgaau

SEQ ID NO: 1136011 - RNA, 21 nt, Mycobacterium bovis subsp bovis AF2122/97
cgacagcacccaaugccaccg

SEQ ID NO: 1136012 - RNA, 22 nt, Mycobacterium bovis subsp bovis AF2122/97
cgacagcacccaaugccaccgc

SEQ ID NO: 1136013 - RNA, 12 nt, Mycobacterium bovis subsp bovis AF2122/97
cgacagcagcgc

SEQ ID NO: 1136014 - RNA, 16 nt, Mycobacterium bovis subsp bovis AF2122/97
cgacagcagcgccacc

SEQ ID NO: 1136015 - RNA, 19 nt, Mycobacterium bovis subsp bovis AF2122/97
cgacagcagcgccacccgg

SEQ ID NO: 1136016 - RNA, 14 nt, Mycobacterium bovis subsp bovis AF2122/97
cgacagcagcgcga

SEQ ID NO: 1136017 - RNA, 13 nt, Mycobacterium bovis subsp bovis AF2122/97
cgacagcagcgcc

SEQ ID NO: 1136018 - RNA, 20 nt, Mycobacterium bovis subsp bovis AF2122/97
cgacagcaucacgcccacga

SEQ ID NO: 1136019 - RNA, 21 nt, Mycobacterium bovis subsp bovis AF2122/97
cgacagccaccucgacgguga

SEQ ID NO: 1136020 - RNA, 16 nt, Mycobacterium bovis subsp bovis AF2122/97
cgacagcccgccggcg

SEQ ID NO: 1136021 - RNA, 18 nt, Mycobacterium bovis subsp bovis AF2122/97
cgacagccccaucaccac

SEQ ID NO: 1136022 - RNA, 22 nt, Mycobacterium bovis subsp bovis AF2122/97
cgacagccccaucaccaccggc

SEQ ID NO: 1136023 - RNA, 17 nt, Mycobacterium bovis subsp bovis AF2122/97
cgacagccccgcggcca

SEQ ID NO: 1136024 - RNA, 19 nt, Mycobacterium bovis subsp bovis AF2122/97
cgacagcccuaucagccga

SEQ ID NO: 1136025 - RNA, 12 nt, Mycobacterium bovis subsp bovis AF2122/97
cgacagcgggcu

SEQ ID NO: 1136026 - RNA, 16 nt, Mycobacterium bovis subsp bovis AF2122/97
cgacagcgugccgaac

SEQ ID NO: 1136027 - RNA, 22 nt, Mycobacterium bovis subsp bovis AF2122/97
cgacagcucaucgauccucgcc

SEQ ID NO: 1136028 - RNA, 14 nt, Mycobacterium bovis subsp bovis AF2122/97
cgacaggacgucgg

SEQ ID NO: 1136029 - RNA, 17 nt, Mycobacterium bovis subsp bovis AF2122/97
cgacaggacgucggcga

SEQ ID NO: 1136030 - RNA, 19 nt, Mycobacterium bovis subsp bovis AF2122/97
cgacaggacgucggcgaau

SEQ ID NO: 1136031 - RNA, 17 nt, Mycobacterium bovis subsp bovis AF2122/97
cgacagcgcugggccca

SEQ ID NO: 1136032 - RNA, 20 nt, Mycobacterium bovis subsp bovis AF2122/97
cgacagcgcugggcccagga

SEQ ID NO: 1136033 - RNA, 15 nt, Mycobacterium bovis subsp bovis AF2122/97
cgacagcggcaaucg

SEQ ID NO: 1136034 - RNA, 13 nt, Mycobacterium bovis subsp bovis AF2122/97
cgacagcggcacc

SEQ ID NO: 1136035 - RNA, 16 nt, Mycobacterium bovis subsp bovis AF2122/97
cgacagcggcaccggg

SEQ ID NO: 1136036 - RNA, 17 nt, Mycobacterium bovis subsp bovis AF2122/97
cgacagcgcaguaacgu

SEQ ID NO: 1136037 - RNA, 18 nt, Mycobacterium bovis subsp bovis AF2122/97
cgacagcgccuuguuggc

SEQ ID NO: 1136038 - RNA, 20 nt, Mycobacterium bovis subsp bovis AF2122/97
cgacagcgccuuguuggcga

SEQ ID NO: 1136039 - RNA, 18 nt, Mycobacterium bovis subsp bovis AF2122/97
cgacagcgaaggcgccga

SEQ ID NO: 1136040 - RNA, 12 nt, Mycobacterium bovis subsp bovis AF2122/97
cgacagcgacgg

SEQ ID NO: 1136041 - RNA, 15 nt, Mycobacterium bovis subsp bovis AF2122/97
cgacagccguggcgc

SEQ ID NO: 1136042 - RNA, 17 nt, Mycobacterium bovis subsp bovis AF2122/97
cgacaggccggccacca

SEQ ID NO: 1136043 - RNA, 20 nt, Mycobacterium bovis subsp bovis AF2122/97
cgacagggccuugaucggca

SEQ ID NO: 1136044 - RNA, 15 nt, Mycobacterium bovis subsp bovis AF2122/97
cgacaggccaccgca

SEQ ID NO: 1136045 - RNA, 17 nt, Mycobacterium bovis subsp bovis AF2122/97
cgacaggugcucgucau

SEQ ID NO: 1136046 - RNA, 14 nt, Mycobacterium bovis subsp bovis AF2122/97
cgacaguccgcgcc

SEQ ID NO: 1136047 - RNA, 19 nt, Mycobacterium bovis subsp bovis AF2122/97
cgacaguagggucguacgu

SEQ ID NO: 1136048 - RNA, 18 nt, Mycobacterium bovis subsp bovis AF2122/97
cgacagggacccgagauc

SEQ ID NO: 1136049 - RNA, 14 nt, Mycobacterium bovis subsp bovis AF2122/97
cgacaccggccgcg

SEQ ID NO: 1136050 - RNA, 12 nt, Mycobacterium bovis subsp bovis AF2122/97
cgacaccgcccg

SEQ ID NO: 1136051 - RNA, 16 nt, Mycobacterium bovis subsp bovis AF2122/97
cgacaccgcccgaccc

SEQ ID NO: 1136052 - RNA, 20 nt, Mycobacterium bovis subsp bovis AF2122/97
cgacaccgcccgacccauca

SEQ ID NO: 1136053 - RNA, 23 nt, Mycobacterium bovis subsp bovis AF2122/97
cgacaccguaggcgaucucacgc

SEQ ID NO: 1136054 - RNA, 22 nt, Mycobacterium bovis subsp bovis AF2122/97
cgacaccggcugaccgacccgg

SEQ ID NO: 1136055 - RNA, 17 nt, Mycobacterium bovis subsp bovis AF2122/97
cgacaccuguucaccaa

SEQ ID NO: 1136056 - RNA, 23 nt, Mycobacterium bovis subsp bovis AF2122/97
cgacaccgugaccgccgcgccgg

SEQ ID NO: 1136057 - RNA, 14 nt, Mycobacterium bovis subsp bovis AF2122/97
cgacaccgugccgc

SEQ ID NO: 1136058 - RNA, 16 nt, Mycobacterium bovis subsp bovis AF2122/97
cgacaccgccaccacg

SEQ ID NO: 1136059 - RNA, 17 nt, Mycobacterium bovis subsp bovis AF2122/97
cgacaccgacucgcaau

SEQ ID NO: 1136060 - RNA, 18 nt, Mycobacterium bovis subsp bovis AF2122/97
cgacaccgagccacgacc

SEQ ID NO: 1136061 - RNA, 22 nt, Mycobacterium bovis subsp bovis AF2122/97
cgacaccgagccacgacccagc

SEQ ID NO: 1136062 - RNA, 17 nt, Mycobacterium bovis subsp bovis AF2122/97
cgacaccgacgcggucg

SEQ ID NO: 1136063 - RNA, 23 nt, Mycobacterium bovis subsp bovis AF2122/97
cgacaccgacgcggucggcggcc

SEQ ID NO: 1136064 - RNA, 15 nt, Mycobacterium bovis subsp bovis AF2122/97
cgacaccgacucgca

SEQ ID NO: 1136065 - RNA, 17 nt, Mycobacterium bovis subsp bovis AF2122/97
cgacacccauccucgcg

SEQ ID NO: 1136066 - RNA, 17 nt, Mycobacterium bovis subsp bovis AF2122/97
cgacacccgcauggcag

SEQ ID NO: 1136067 - RNA, 15 nt, Mycobacterium bovis subsp bovis AF2122/97
cgacaccccgaugcc

SEQ ID NO: 1136068 - RNA, 13 nt, Mycobacterium bovis subsp bovis AF2122/97
aacaacgcgcaac

SEQ ID NO: 1136069 - RNA, 14 nt, Mycobacterium bovis subsp bovis AF2122/97
aacaacaccaccag

SEQ ID NO: 1136070 - RNA, 13 nt, Mycobacterium bovis subsp bovis AF2122/97
aacaaaggcuugc

SEQ ID NO: 1136071 - RNA, 21 nt, Mycobacterium bovis subsp bovis AF2122/97
cgacaccauaggccgacgggu

SEQ ID NO: 1136072 - RNA, 13 nt, Mycobacterium bovis subsp bovis AF2122/97
cgacaccaccagg

SEQ ID NO: 1136073 - RNA, 17 nt, Mycobacterium bovis subsp bovis AF2122/97
cgacaccacggaccagc

SEQ ID NO: 1136074 - RNA, 15 nt, Mycobacterium bovis subsp bovis AF2122/97
cgacaccaccggcgc

SEQ ID NO: 1136075 - RNA, 11 nt, Mycobacterium bovis subsp bovis AF2122/97
cgacaccacca

SEQ ID NO: 1136076 - RNA, 14 nt, Mycobacterium bovis subsp bovis AF2122/97
cgacaauggcgcca

SEQ ID NO: 1136077 - RNA, 19 nt, Mycobacterium bovis subsp bovis AF2122/97
cgacaauggcgccagccga

SEQ ID NO: 1136078 - RNA, 21 nt, Mycobacterium bovis subsp bovis AF2122/97
cgacaaugucggcgaugcguc

SEQ ID NO: 1136079 - RNA, 16 nt, Mycobacterium bovis subsp bovis AF2122/97
cgacacagcggcgggu

SEQ ID NO: 1136080 - RNA, 17 nt, Mycobacterium bovis subsp bovis AF2122/97
cgacaaucgcacgcugc

SEQ ID NO: 1136081 - RNA, 14 nt, Mycobacterium bovis subsp bovis AF2122/97
cgacaaggucgucg

SEQ ID NO: 1136082 - RNA, 17 nt, Mycobacterium bovis subsp bovis AF2122/97
cgacaaguccgcgaugg

SEQ ID NO: 1136083 - RNA, 18 nt, Mycobacterium bovis subsp bovis AF2122/97
cgacaaguccgcgauggc

SEQ ID NO: 1136084 - RNA, 19 nt, Mycobacterium bovis subsp bovis AF2122/97
cgacaaguccgcgauggcc

SEQ ID NO: 1136085 - RNA, 13 nt, Mycobacterium bovis subsp bovis AF2122/97
cgacaagugcccg

SEQ ID NO: 1136086 - RNA, 20 nt, Mycobacterium bovis subsp bovis AF2122/97
cgacacaacgggugucggcg

SEQ ID NO: 1136087 - RNA, 17 nt, Mycobacterium bovis subsp bovis AF2122/97
cgacacaccccagcaac

SEQ ID NO: 1136088 - RNA, 14 nt, Mycobacterium bovis subsp bovis AF2122/97
cgacacacgccgcc

SEQ ID NO: 1136089 - RNA, 16 nt, Mycobacterium bovis subsp bovis AF2122/97
cgacacacgccgccgg

SEQ ID NO: 1136090 - RNA, 18 nt, Mycobacterium bovis subsp bovis AF2122/97
cgacacacgccgccggug

SEQ ID NO: 1136091 - RNA, 15 nt, Mycobacterium bovis subsp bovis AF2122/97
cgacaagccgagccc

SEQ ID NO: 1136092 - RNA, 22 nt, Mycobacterium bovis subsp bovis AF2122/97
cgacaagccgagcccgucgauc

SEQ ID NO: 1136093 - RNA, 18 nt, Mycobacterium bovis subsp bovis AF2122/97
cgacaagaccggcgggca

SEQ ID NO: 1136094 - RNA, 16 nt, Mycobacterium bovis subsp bovis AF2122/97
cgacaagcugucggcg

SEQ ID NO: 1136095 - RNA, 19 nt, Mycobacterium bovis subsp bovis AF2122/97
cgacaaggcgauugucggg

SEQ ID NO: 1136096 - RNA, 19 nt, Mycobacterium bovis subsp bovis AF2122/97
cgacaacgacugcguuccg

SEQ ID NO: 1136097 - RNA, 13 nt, Mycobacterium bovis subsp bovis AF2122/97
cgacaacgaucgc

SEQ ID NO: 1136098 - RNA, 23 nt, Mycobacterium bovis subsp bovis AF2122/97
cgacaacgccuuguuggcgcccg

SEQ ID NO: 1136099 - RNA, 14 nt, Mycobacterium bovis subsp bovis AF2122/97
cgacaacgcggcac

SEQ ID NO: 1136100 - RNA, 15 nt, Mycobacterium bovis subsp bovis AF2122/97
cgacaacgcggcacc

SEQ ID NO: 1136101 - RNA, 20 nt, Mycobacterium bovis subsp bovis AF2122/97
cgacaaccgagcugacgccg

SEQ ID NO: 1136102 - RNA, 15 nt, Mycobacterium bovis subsp bovis AF2122/97
cgacaaccggccaga

SEQ ID NO: 1136103 - RNA, 15 nt, Mycobacterium bovis subsp bovis AF2122/97
cgaauucggccggcg

SEQ ID NO: 1136104 - RNA, 17 nt, Mycobacterium bovis subsp bovis AF2122/97
cgaauucggccggcgcg

SEQ ID NO: 1136105 - RNA, 22 nt, Mycobacterium bovis subsp bovis AF2122/97
cgaauucguagggaugcggccg

SEQ ID NO: 1136106 - RNA, 17 nt, Mycobacterium bovis subsp bovis AF2122/97
cgaauuccagccagccg

SEQ ID NO: 1136107 - RNA, 15 nt, Mycobacterium bovis subsp bovis AF2122/97
cgaauugcaggacgc

SEQ ID NO: 1136108 - RNA, 18 nt, Mycobacterium bovis subsp bovis AF2122/97
cgacaacccggccgggcc

SEQ ID NO: 1136109 - RNA, 16 nt, Mycobacterium bovis subsp bovis AF2122/97
cgacaacccggcgucg

SEQ ID NO: 1136110 - RNA, 21 nt, Mycobacterium bovis subsp bovis AF2122/97
cgacaacccggcgucgacgau

SEQ ID NO: 1136111 - RNA, 20 nt, Mycobacterium bovis subsp bovis AF2122/97
cgaaggcggcuccaccgggc

SEQ ID NO: 1136112 - RNA, 17 nt, Mycobacterium bovis subsp bovis AF2122/97
cgaaggcguucgacucg

SEQ ID NO: 1136113 - RNA, 21 nt, Mycobacterium bovis subsp bovis AF2122/97
cgaaggcgacaucaccaccga

SEQ ID NO: 1136114 - RNA, 14 nt, Mycobacterium bovis subsp bovis AF2122/97
cgaaggcgccgaac

SEQ ID NO: 1136115 - RNA, 20 nt, Mycobacterium bovis subsp bovis AF2122/97
cgaaggucuccggcaagccg

SEQ ID NO: 1136116 - RNA, 21 nt, Mycobacterium bovis subsp bovis AF2122/97
cgaaggucaucaugucgaggu

SEQ ID NO: 1136117 - RNA, 19 nt, Mycobacterium bovis subsp bovis AF2122/97
cgaagggcuugucgccggc

SEQ ID NO: 1136118 - RNA, 16 nt, Mycobacterium bovis subsp bovis AF2122/97
cgaaggggugcccggc

SEQ ID NO: 1136119 - RNA, 21 nt, Mycobacterium bovis subsp bovis AF2122/97
cgaaggggugcccggcggcca

SEQ ID NO: 1136120 - RNA, 16 nt, Mycobacterium bovis subsp bovis AF2122/97
cgaaggcuugucggua

SEQ ID NO: 1136121 - RNA, 16 nt, Mycobacterium bovis subsp bovis AF2122/97
cgaagggcaccggcga

SEQ ID NO: 1136122 - RNA, 20 nt, Mycobacterium bovis subsp bovis AF2122/97
cgaagcggcugcugcgcggu

SEQ ID NO: 1136123 - RNA, 16 nt, Mycobacterium bovis subsp bovis AF2122/97
cgaagcggaccagcga

SEQ ID NO: 1136124 - RNA, 16 nt, Mycobacterium bovis subsp bovis AF2122/97
cgaagcggccaccgcc

SEQ ID NO: 1136125 - RNA, 18 nt, Mycobacterium bovis subsp bovis AF2122/97
cgaagcggccaccgccgc

SEQ ID NO: 1136126 - RNA, 20 nt, Mycobacterium bovis subsp bovis AF2122/97
cgaagcggccaccgccgccg

SEQ ID NO: 1136127 - RNA, 14 nt, Mycobacterium bovis subsp bovis AF2122/97
cgaaggccgcgcgc

SEQ ID NO: 1136128 - RNA, 17 nt, Mycobacterium bovis subsp bovis AF2122/97
cgaaggcacugcgaucg

SEQ ID NO: 1136129 - RNA, 20 nt, Mycobacterium bovis subsp bovis AF2122/97
cgaagucgaugaugcccauc

SEQ ID NO: 1136130 - RNA, 14 nt, Mycobacterium bovis subsp bovis AF2122/97
cgaagucgacgaac

SEQ ID NO: 1136131 - RNA, 17 nt, Mycobacterium bovis subsp bovis AF2122/97
cgaaguccaccacgacg

SEQ ID NO: 1136132 - RNA, 13 nt, Mycobacterium bovis subsp bovis AF2122/97
cgaaguccacgca

SEQ ID NO: 1136133 - RNA, 21 nt, Mycobacterium bovis subsp bovis AF2122/97
cgaagucuugaccgcaccggc

SEQ ID NO: 1136134 - RNA, 22 nt, Mycobacterium bovis subsp bovis AF2122/97
cgaagucuugaccgcaccggcc

SEQ ID NO: 1136135 - RNA, 14 nt, Mycobacterium bovis subsp bovis AF2122/97
cgaagugacccgaa

SEQ ID NO: 1136136 - RNA, 17 nt, Mycobacterium bovis subsp bovis AF2122/97
cgaauccagccgcgcgc

SEQ ID NO: 1136137 - RNA, 17 nt, Mycobacterium bovis subsp bovis AF2122/97
cgaaucccccggacggc

SEQ ID NO: 1136138 - RNA, 20 nt, Mycobacterium bovis subsp bovis AF2122/97
cgaauccgaucaccucggcg

SEQ ID NO: 1136139 - RNA, 16 nt, Mycobacterium bovis subsp bovis AF2122/97
cgaaucccgcgcccgg

SEQ ID NO: 1136140 - RNA, 19 nt, Mycobacterium bovis subsp bovis AF2122/97
cgaaucccgcgcccggccg

SEQ ID NO: 1136141 - RNA, 21 nt, Mycobacterium bovis subsp bovis AF2122/97
cgaaucccgcgcccggccggu

SEQ ID NO: 1136142 - RNA, 14 nt, Mycobacterium bovis subsp bovis AF2122/97
cgaauccggcgggu

SEQ ID NO: 1136143 - RNA, 23 nt, Mycobacterium bovis subsp bovis AF2122/97
cgaauccgcucgagguggucucg

SEQ ID NO: 1136144 - RNA, 14 nt, Mycobacterium bovis subsp bovis AF2122/97
cgaauccggccacu

SEQ ID NO: 1136145 - RNA, 20 nt, Mycobacterium bovis subsp bovis AF2122/97
cgaaucgcgacgcgacgguu

SEQ ID NO: 1136146 - RNA, 16 nt, Mycobacterium bovis subsp bovis AF2122/97
cgaaugcggccccgac

SEQ ID NO: 1136147 - RNA, 12 nt, Mycobacterium bovis subsp bovis AF2122/97
cgaaugcgggug

SEQ ID NO: 1136148 - RNA, 18 nt, Mycobacterium bovis subsp bovis AF2122/97
cgaaugcggguggaguug

SEQ ID NO: 1136149 - RNA, 21 nt, Mycobacterium bovis subsp bovis AF2122/97
cgaaugcggugaguccgcuga

SEQ ID NO: 1136150 - RNA, 23 nt, Mycobacterium bovis subsp bovis AF2122/97
cgaauguugcgaucugcggcgcc

SEQ ID NO: 1136151 - RNA, 19 nt, Mycobacterium bovis subsp bovis AF2122/97
cgaauuaccuugcgguucg

SEQ ID NO: 1136152 - RNA, 18 nt, Mycobacterium bovis subsp bovis AF2122/97
cgaaugcugggcccgcca

SEQ ID NO: 1136153 - RNA, 18 nt, Mycobacterium bovis subsp bovis AF2122/97
cgaaugggggcuggucgc

SEQ ID NO: 1136154 - RNA, 15 nt, Mycobacterium bovis subsp bovis AF2122/97
cgaaugucaccccgc

SEQ ID NO: 1136155 - RNA, 20 nt, Mycobacterium bovis subsp bovis AF2122/97
cgaaugucaccccgcccagc

SEQ ID NO: 1136156 - RNA, 19 nt, Mycobacterium bovis subsp bovis AF2122/97
cgaacgucgcggccagcag

SEQ ID NO: 1136157 - RNA, 18 nt, Mycobacterium bovis subsp bovis AF2122/97
cgaacgucagugccccgc

SEQ ID NO: 1136158 - RNA, 23 nt, Mycobacterium bovis subsp bovis AF2122/97
cgaacgucaaccgggcggcguuu

SEQ ID NO: 1136159 - RNA, 15 nt, Mycobacterium bovis subsp bovis AF2122/97
cgaacgugcgguggc

SEQ ID NO: 1136160 - RNA, 19 nt, Mycobacterium bovis subsp bovis AF2122/97
cgaacgugcaaccacggcg

SEQ ID NO: 1136161 - RNA, 16 nt, Mycobacterium bovis subsp bovis AF2122/97
cgaacgguugcucguc

SEQ ID NO: 1136162 - RNA, 19 nt, Mycobacterium bovis subsp bovis AF2122/97
cgaacgguugcucguccaa

SEQ ID NO: 1136163 - RNA, 15 nt, Mycobacterium bovis subsp bovis AF2122/97
ccugucaacgccgcg

SEQ ID NO: 1136164 - RNA, 20 nt, Mycobacterium bovis subsp bovis AF2122/97
ccugguugaggucacccggu

SEQ ID NO: 1136165 - RNA, 23 nt, Mycobacterium bovis subsp bovis AF2122/97
ccugguugaggucacccgguaac

SEQ ID NO: 1136166 - RNA, 18 nt, Mycobacterium bovis subsp bovis AF2122/97
ccugguuggugacguaga

SEQ ID NO: 1136167 - RNA, 19 nt, Mycobacterium bovis subsp bovis AF2122/97
cgaacuggucgacgccgag

SEQ ID NO: 1136168 - RNA, 16 nt, Mycobacterium bovis subsp bovis AF2122/97
cgaacugggcgaucga

SEQ ID NO: 1136169 - RNA, 14 nt, Mycobacterium bovis subsp bovis AF2122/97
cgaacugguuucgc

SEQ ID NO: 1136170 - RNA, 17 nt, Mycobacterium bovis subsp bovis AF2122/97
cgaacuggcugguggcg

SEQ ID NO: 1136171 - RNA, 18 nt, Mycobacterium bovis subsp bovis AF2122/97
cgaacuucgaugccgggu

SEQ ID NO: 1136172 - RNA, 13 nt, Mycobacterium bovis subsp bovis AF2122/97
cgaacuucuggua

SEQ ID NO: 1136173 - RNA, 17 nt, Mycobacterium bovis subsp bovis AF2122/97
cgaacuccccggucgcc

SEQ ID NO: 1136174 - RNA, 21 nt, Mycobacterium bovis subsp bovis AF2122/97
cgaacuccccggucgccgcgu

SEQ ID NO: 1136175 - RNA, 15 nt, Mycobacterium bovis subsp bovis AF2122/97
cgaacuccaugccgc

SEQ ID NO: 1136176 - RNA, 18 nt, Mycobacterium bovis subsp bovis AF2122/97
cgaacuccagcagcccgg

SEQ ID NO: 1136177 - RNA, 17 nt, Mycobacterium bovis subsp bovis AF2122/97
cgaacuccaucaccaca

SEQ ID NO: 1136178 - RNA, 17 nt, Mycobacterium bovis subsp bovis AF2122/97
cgaacucaccgccauga

SEQ ID NO: 1136179 - RNA, 20 nt, Mycobacterium bovis subsp bovis AF2122/97
cgaacucaucuuugacaccg

SEQ ID NO: 1136180 - RNA, 20 nt, Mycobacterium bovis subsp bovis AF2122/97
cgaacgucaccaucgggucg

SEQ ID NO: 1136181 - RNA, 21 nt, Mycobacterium bovis subsp bovis AF2122/97
cgaagaucgcgugccacagca

SEQ ID NO: 1136182 - RNA, 17 nt, Mycobacterium bovis subsp bovis AF2122/97
cgaagaucgagccgacc

SEQ ID NO: 1136183 - RNA, 22 nt, Mycobacterium bovis subsp bovis AF2122/97
cgaagaucgagccgacccgacg

SEQ ID NO: 1136184 - RNA, 15 nt, Mycobacterium bovis subsp bovis AF2122/97
cgaagaucgccuggg

SEQ ID NO: 1136185 - RNA, 13 nt, Mycobacterium bovis subsp bovis AF2122/97
cgaagcagacgaa

SEQ ID NO: 1136186 - RNA, 20 nt, Mycobacterium bovis subsp bovis AF2122/97
cgaagaugaccucggcgacg

SEQ ID NO: 1136187 - RNA, 14 nt, Mycobacterium bovis subsp bovis AF2122/97
cgaagauggccagc

SEQ ID NO: 1136188 - RNA, 15 nt, Mycobacterium bovis subsp bovis AF2122/97
cgaagcaucgcguug

SEQ ID NO: 1136189 - RNA, 15 nt, Mycobacterium bovis subsp bovis AF2122/97
cgaagcgcagcaccu

SEQ ID NO: 1136190 - RNA, 17 nt, Mycobacterium bovis subsp bovis AF2122/97
cgaagcgcccguuggcc

SEQ ID NO: 1136191 - RNA, 15 nt, Mycobacterium bovis subsp bovis AF2122/97
cgaagacgugccggc

SEQ ID NO: 1136192 - RNA, 20 nt, Mycobacterium bovis subsp bovis AF2122/97
cgaagaccucgucgcgucgc

SEQ ID NO: 1136193 - RNA, 23 nt, Mycobacterium bovis subsp bovis AF2122/97
cgaagaccuggccugcggcaggu

SEQ ID NO: 1136194 - RNA, 17 nt, Mycobacterium bovis subsp bovis AF2122/97
cgaagaccucgucgcgu

SEQ ID NO: 1136195 - RNA, 19 nt, Mycobacterium bovis subsp bovis AF2122/97
cgaacuuugucgcgcugcu

SEQ ID NO: 1136196 - RNA, 15 nt, Mycobacterium bovis subsp bovis AF2122/97
cgaagaccgccggga

SEQ ID NO: 1136197 - RNA, 20 nt, Mycobacterium bovis subsp bovis AF2122/97
cgaagaccgccuccaccgcc

SEQ ID NO: 1136198 - RNA, 18 nt, Mycobacterium bovis subsp bovis AF2122/97
cgaagaccgcgucggcgg

SEQ ID NO: 1136199 - RNA, 19 nt, Mycobacterium bovis subsp bovis AF2122/97
cgaacuuaacuacggugcc

SEQ ID NO: 1136200 - RNA, 14 nt, Mycobacterium bovis subsp bovis AF2122/97
cgaacuuugucgcg

SEQ ID NO: 1136201 - RNA, 21 nt, Mycobacterium bovis subsp bovis AF2122/97
cgaagagcuccgucgcggccg

SEQ ID NO: 1136202 - RNA, 18 nt, Mycobacterium bovis subsp bovis AF2122/97
cgaagagcuccgucgcgg

SEQ ID NO: 1136203 - RNA, 15 nt, Mycobacterium bovis subsp bovis AF2122/97
cgaagagcaccgcgc

SEQ ID NO: 1136204 - RNA, 14 nt, Mycobacterium bovis subsp bovis AF2122/97
cgaagauccagcgc

SEQ ID NO: 1136205 - RNA, 15 nt, Mycobacterium bovis subsp bovis AF2122/97
cgaagauccagcgca

SEQ ID NO: 1136206 - RNA, 17 nt, Mycobacterium bovis subsp bovis AF2122/97
cgaagauaucggcacgg

SEQ ID NO: 1136207 - RNA, 15 nt, Mycobacterium bovis subsp bovis AF2122/97
cgaagagggcgccgc

SEQ ID NO: 1136208 - RNA, 22 nt, Mycobacterium bovis subsp bovis AF2122/97
cgccaguucuaccaccuugccg

SEQ ID NO: 1136209 - RNA, 18 nt, Mycobacterium bovis subsp bovis AF2122/97
cgccaguucgcggcugcg

SEQ ID NO: 1136210 - RNA, 14 nt, Mycobacterium bovis subsp bovis AF2122/97
cgccaguuccggug

SEQ ID NO: 1136211 - RNA, 16 nt, Mycobacterium bovis subsp bovis AF2122/97
cgccaguggugcaccg

SEQ ID NO: 1136212 - RNA, 13 nt, Mycobacterium bovis subsp bovis AF2122/97
cgccaguguggug

SEQ ID NO: 1136213 - RNA, 21 nt, Mycobacterium bovis subsp bovis AF2122/97
cgccagugcuccaaaucggca

SEQ ID NO: 1136214 - RNA, 22 nt, Mycobacterium bovis subsp bovis AF2122/97
cgccaguguugcgcugcggcca

SEQ ID NO: 1136215 - RNA, 20 nt, Mycobacterium bovis subsp bovis AF2122/97
cgccagugcccgcacugccg

SEQ ID NO: 1136216 - RNA, 20 nt, Mycobacterium bovis subsp bovis AF2122/97
cgccagugccucgcgggguc

SEQ ID NO: 1136217 - RNA, 16 nt, Mycobacterium bovis subsp bovis AF2122/97
cgccagucgauucggc

SEQ ID NO: 1136218 - RNA, 20 nt, Mycobacterium bovis subsp bovis AF2122/97
cgccagucgcaggaucggcg

SEQ ID NO: 1136219 - RNA, 14 nt, Mycobacterium bovis subsp bovis AF2122/97
cgccagucccggcg

SEQ ID NO: 1136220 - RNA, 18 nt, Mycobacterium bovis subsp bovis AF2122/97
cgccagucccggcgcaca

SEQ ID NO: 1136221 - RNA, 20 nt, Mycobacterium bovis subsp bovis AF2122/97
cgccaguccgaucgccgagg

SEQ ID NO: 1136222 - RNA, 20 nt, Mycobacterium bovis subsp bovis AF2122/97
cgccaguccggacggcagcc

SEQ ID NO: 1136223 - RNA, 14 nt, Mycobacterium bovis subsp bovis AF2122/97
cgccaguagcacgu

SEQ ID NO: 1136224 - RNA, 23 nt, Mycobacterium bovis subsp bovis AF2122/97
cgccagucccacugggccggugc

SEQ ID NO: 1136225 - RNA, 14 nt, Mycobacterium bovis subsp bovis AF2122/97
cgccaguauggccg

SEQ ID NO: 1136226 - RNA, 20 nt, Mycobacterium bovis subsp bovis AF2122/97
cgccagguguucgccggaga

SEQ ID NO: 1136227 - RNA, 22 nt, Mycobacterium bovis subsp bovis AF2122/97
cgccagguguucgccggagacc

SEQ ID NO: 1136228 - RNA, 15 nt, Mycobacterium bovis subsp bovis AF2122/97
cgccagguggccgcu

SEQ ID NO: 1136229 - RNA, 16 nt, Mycobacterium bovis subsp bovis AF2122/97
cgccagguggccgcuc

SEQ ID NO: 1136230 - RNA, 15 nt, Mycobacterium bovis subsp bovis AF2122/97
cgccaggugcucguc

SEQ ID NO: 1136231 - RNA, 14 nt, Mycobacterium bovis subsp bovis AF2122/97
cgccaggucgguga

SEQ ID NO: 1136232 - RNA, 17 nt, Mycobacterium bovis subsp bovis AF2122/97
cgccaggugaugccgcc

SEQ ID NO: 1136233 - RNA, 13 nt, Mycobacterium bovis subsp bovis AF2122/97
cgccaggccgcac

SEQ ID NO: 1136234 - RNA, 15 nt, Mycobacterium bovis subsp bovis AF2122/97
cgccaggccgaccgc

SEQ ID NO: 1136235 - RNA, 17 nt, Mycobacterium bovis subsp bovis AF2122/97
cgccaggccguggcacc

SEQ ID NO: 1136236 - RNA, 13 nt, Mycobacterium bovis subsp bovis AF2122/97
cgccaggcggccg

SEQ ID NO: 1136237 - RNA, 14 nt, Mycobacterium bovis subsp bovis AF2122/97
cgccaggcggccgg

SEQ ID NO: 1136238 - RNA, 16 nt, Mycobacterium bovis subsp bovis AF2122/97
cgccaggcggccgggu

SEQ ID NO: 1136239 - RNA, 18 nt, Mycobacterium bovis subsp bovis AF2122/97
cgccagguccccgacaac

SEQ ID NO: 1136240 - RNA, 19 nt, Mycobacterium bovis subsp bovis AF2122/97
cgccaggucgaggcaggcc

SEQ ID NO: 1136241 - RNA, 11 nt, Mycobacterium bovis subsp bovis AF2122/97
cgccagggcgg

SEQ ID NO: 1136242 - RNA, 15 nt, Mycobacterium bovis subsp bovis AF2122/97
cgccagggccgccga

SEQ ID NO: 1136243 - RNA, 22 nt, Mycobacterium bovis subsp bovis AF2122/97
cgccagggcccuagccggcgcg

SEQ ID NO: 1136244 - RNA, 13 nt, Mycobacterium bovis subsp bovis AF2122/97
cgccaggcuugcg

SEQ ID NO: 1136245 - RNA, 20 nt, Mycobacterium bovis subsp bovis AF2122/97
cgccaggcuugcggcaccca

SEQ ID NO: 1136246 - RNA, 15 nt, Mycobacterium bovis subsp bovis AF2122/97
cgccagggcacgugg

SEQ ID NO: 1136247 - RNA, 16 nt, Mycobacterium bovis subsp bovis AF2122/97
cgccaggagcgcggcc

SEQ ID NO: 1136248 - RNA, 19 nt, Mycobacterium bovis subsp bovis AF2122/97
cgccaggagcgcggcccgc

SEQ ID NO: 1136249 - RNA, 14 nt, Mycobacterium bovis subsp bovis AF2122/97
cgccaggaguggcc

SEQ ID NO: 1136250 - RNA, 14 nt, Mycobacterium bovis subsp bovis AF2122/97
cgccaggaaucccu

SEQ ID NO: 1136251 - RNA, 23 nt, Mycobacterium bovis subsp bovis AF2122/97
cgccaggaaucccucggccgcag

SEQ ID NO: 1136252 - RNA, 16 nt, Mycobacterium bovis subsp bovis AF2122/97
cgccaggccgaccgcg

SEQ ID NO: 1136253 - RNA, 17 nt, Mycobacterium bovis subsp bovis AF2122/97
cgccaggccgagcccgg

SEQ ID NO: 1136254 - RNA, 18 nt, Mycobacterium bovis subsp bovis AF2122/97
cgccaggcaccacgaccg

SEQ ID NO: 1136255 - RNA, 22 nt, Mycobacterium bovis subsp bovis AF2122/97
cgccaggcaccacgaccgacac

SEQ ID NO: 1136256 - RNA, 19 nt, Mycobacterium bovis subsp bovis AF2122/97
cgccagcugggcagccaga

SEQ ID NO: 1136257 - RNA, 16 nt, Mycobacterium bovis subsp bovis AF2122/97
cgccagcuugucgggc

SEQ ID NO: 1136258 - RNA, 17 nt, Mycobacterium bovis subsp bovis AF2122/97
cgccagcuugucgggca

SEQ ID NO: 1136259 - RNA, 17 nt, Mycobacterium bovis subsp bovis AF2122/97
cgccagcucgccggccg

SEQ ID NO: 1136260 - RNA, 23 nt, Mycobacterium bovis subsp bovis AF2122/97
cgccagcuugucgggcaccgguu

SEQ ID NO: 1136261 - RNA, 18 nt, Mycobacterium bovis subsp bovis AF2122/97
cgccagcucggcggcagc

SEQ ID NO: 1136262 - RNA, 22 nt, Mycobacterium bovis subsp bovis AF2122/97
cgccagcucggcggcagcggcg

SEQ ID NO: 1136263 - RNA, 13 nt, Mycobacterium bovis subsp bovis AF2122/97
cgccagcucggca

SEQ ID NO: 1136264 - RNA, 15 nt, Mycobacterium bovis subsp bovis AF2122/97
cgccagcucggcacc

SEQ ID NO: 1136265 - RNA, 20 nt, Mycobacterium bovis subsp bovis AF2122/97
cgccagcggcagcggcgucg

SEQ ID NO: 1136266 - RNA, 19 nt, Mycobacterium bovis subsp bovis AF2122/97
cgccagcguuaggucgccg

SEQ ID NO: 1136267 - RNA, 15 nt, Mycobacterium bovis subsp bovis AF2122/97
cgccagcgucgacca

SEQ ID NO: 1136268 - RNA, 20 nt, Mycobacterium bovis subsp bovis AF2122/97
cgccagcguaaauagcgccc

SEQ ID NO: 1136269 - RNA, 12 nt, Mycobacterium bovis subsp bovis AF2122/97
cgccagcggcaa

SEQ ID NO: 1136270 - RNA, 23 nt, Mycobacterium bovis subsp bovis AF2122/97
cgccagcggcaauggccagcacc

SEQ ID NO: 1136271 - RNA, 13 nt, Mycobacterium bovis subsp bovis AF2122/97
cgccagcggcagc

SEQ ID NO: 1136272 - RNA, 23 nt, Mycobacterium bovis subsp bovis AF2122/97
cgccagcggccgcuccaccucgg

SEQ ID NO: 1136273 - RNA, 15 nt, Mycobacterium bovis subsp bovis AF2122/97
cgccagcgcgccgau

SEQ ID NO: 1136274 - RNA, 13 nt, Mycobacterium bovis subsp bovis AF2122/97
cgccagcgccggu

SEQ ID NO: 1136275 - RNA, 14 nt, Mycobacterium bovis subsp bovis AF2122/97
cgccagcgccgguc

SEQ ID NO: 1136276 - RNA, 15 nt, Mycobacterium bovis subsp bovis AF2122/97
cgccagcgccggcca

SEQ ID NO: 1136277 - RNA, 18 nt, Mycobacterium bovis subsp bovis AF2122/97
cgccagcgccggccaggc

SEQ ID NO: 1136278 - RNA, 17 nt, Mycobacterium bovis subsp bovis AF2122/97
cgccagcgccgccggcg

SEQ ID NO: 1136279 - RNA, 19 nt, Mycobacterium bovis subsp bovis AF2122/97
cgccagcgccgccggcgcc

SEQ ID NO: 1136280 - RNA, 22 nt, Mycobacterium bovis subsp bovis AF2122/97
cgccagcgccgccggcgccggc

SEQ ID NO: 1136281 - RNA, 22 nt, Mycobacterium bovis subsp bovis AF2122/97
cgccagcgcgaaccugcucggc

SEQ ID NO: 1136282 - RNA, 19 nt, Mycobacterium bovis subsp bovis AF2122/97
cgccagcgcgaccaaugcg

SEQ ID NO: 1136283 - RNA, 15 nt, Mycobacterium bovis subsp bovis AF2122/97
cgccagcgccgccgc

SEQ ID NO: 1136284 - RNA, 16 nt, Mycobacterium bovis subsp bovis AF2122/97
cgccagcgccgccgcg

SEQ ID NO: 1136285 - RNA, 16 nt, Mycobacterium bovis subsp bovis AF2122/97
cgccagcgccgccgga

SEQ ID NO: 1136286 - RNA, 16 nt, Mycobacterium bovis subsp bovis AF2122/97
cgccagcgccgccggc

SEQ ID NO: 1136287 - RNA, 14 nt, Mycobacterium bovis subsp bovis AF2122/97
cgccaugucggcca

SEQ ID NO: 1136288 - RNA, 12 nt, Mycobacterium bovis subsp bovis AF2122/97
cgccauggugaa

SEQ ID NO: 1136289 - RNA, 14 nt, Mycobacterium bovis subsp bovis AF2122/97
cgccauggcguucu

SEQ ID NO: 1136290 - RNA, 15 nt, Mycobacterium bovis subsp bovis AF2122/97
cgccauggcguucug

SEQ ID NO: 1136291 - RNA, 16 nt, Mycobacterium bovis subsp bovis AF2122/97
cgccaugucggccagg

SEQ ID NO: 1136292 - RNA, 15 nt, Mycobacterium bovis subsp bovis AF2122/97
cgccauucaucggca

SEQ ID NO: 1136293 - RNA, 14 nt, Mycobacterium bovis subsp bovis AF2122/97
cgccauugacgccg

SEQ ID NO: 1136294 - RNA, 14 nt, Mycobacterium bovis subsp bovis AF2122/97
cgccauuccagccg

SEQ ID NO: 1136295 - RNA, 18 nt, Mycobacterium bovis subsp bovis AF2122/97
cgccauuccagccggugc

SEQ ID NO: 1136296 - RNA, 19 nt, Mycobacterium bovis subsp bovis AF2122/97
cgccauuccagccggugcc

SEQ ID NO: 1136297 - RNA, 15 nt, Mycobacterium bovis subsp bovis AF2122/97
cgccauucccggugg

SEQ ID NO: 1136298 - RNA, 16 nt, Mycobacterium bovis subsp bovis AF2122/97
cgccauucaucggcau

SEQ ID NO: 1136299 - RNA, 15 nt, Mycobacterium bovis subsp bovis AF2122/97
cgccauugccgccgg

SEQ ID NO: 1136300 - RNA, 18 nt, Mycobacterium bovis subsp bovis AF2122/97
cgccauugccgccggcgc

SEQ ID NO: 1136301 - RNA, 22 nt, Mycobacterium bovis subsp bovis AF2122/97
cgccauugccgccggcgccgcc

SEQ ID NO: 1136302 - RNA, 23 nt, Mycobacterium bovis subsp bovis AF2122/97
cgccauugccauacagcaccccg

SEQ ID NO: 1136303 - RNA, 17 nt, Mycobacterium bovis subsp bovis AF2122/97
cgccauugacgccguug

SEQ ID NO: 1136304 - RNA, 18 nt, Mycobacterium bovis subsp bovis AF2122/97
cgccauugacgccguugc

SEQ ID NO: 1136305 - RNA, 12 nt, Mycobacterium bovis subsp bovis AF2122/97
cgccaugcgcac

SEQ ID NO: 1136306 - RNA, 16 nt, Mycobacterium bovis subsp bovis AF2122/97
cgccaugcgccaaccc

SEQ ID NO: 1136307 - RNA, 15 nt, Mycobacterium bovis subsp bovis AF2122/97
cgccaugcacguugc

SEQ ID NO: 1136308 - RNA, 15 nt, Mycobacterium bovis subsp bovis AF2122/97
cgcccaagccgccgg

SEQ ID NO: 1136309 - RNA, 17 nt, Mycobacterium bovis subsp bovis AF2122/97
cgcccaagcgcagccug

SEQ ID NO: 1136310 - RNA, 16 nt, Mycobacterium bovis subsp bovis AF2122/97
cgcccaacgucgccag

SEQ ID NO: 1136311 - RNA, 14 nt, Mycobacterium bovis subsp bovis AF2122/97
cgcccaacaccgcg

SEQ ID NO: 1136312 - RNA, 23 nt, Mycobacterium bovis subsp bovis AF2122/97
cgcccaacaggcgggacaaccgg

SEQ ID NO: 1136313 - RNA, 22 nt, Mycobacterium bovis subsp bovis AF2122/97
cgcccaacaacgcuucggcgug

SEQ ID NO: 1136314 - RNA, 21 nt, Mycobacterium bovis subsp bovis AF2122/97
cgcccacagcuugcccgagcc

SEQ ID NO: 1136315 - RNA, 18 nt, Mycobacterium bovis subsp bovis AF2122/97
cgcccaagguggcggcca

SEQ ID NO: 1136316 - RNA, 20 nt, Mycobacterium bovis subsp bovis AF2122/97
cgcccaagguggcggccagu

SEQ ID NO: 1136317 - RNA, 17 nt, Mycobacterium bovis subsp bovis AF2122/97
cgcccaacgucgccagg

SEQ ID NO: 1136318 - RNA, 19 nt, Mycobacterium bovis subsp bovis AF2122/97
cgcccaacgucgccagguc

SEQ ID NO: 1136319 - RNA, 23 nt, Mycobacterium bovis subsp bovis AF2122/97
cgcccaauccaccgauucggcga

SEQ ID NO: 1136320 - RNA, 22 nt, Mycobacterium bovis subsp bovis AF2122/97
cgccauuucgagggcaacggca

SEQ ID NO: 1136321 - RNA, 16 nt, Mycobacterium bovis subsp bovis AF2122/97
cgccauuggcgguggu

SEQ ID NO: 1136322 - RNA, 14 nt, Mycobacterium bovis subsp bovis AF2122/97
cgccauuggcgucc

SEQ ID NO: 1136323 - RNA, 22 nt, Mycobacterium bovis subsp bovis AF2122/97
cgccauuggcaggcauggcgcc

SEQ ID NO: 1136324 - RNA, 23 nt, Mycobacterium bovis subsp bovis AF2122/97
cgccauuggcaggcauggcgccg

SEQ ID NO: 1136325 - RNA, 23 nt, Mycobacterium bovis subsp bovis AF2122/97
cgccauuggccugucaggcggcg

SEQ ID NO: 1136326 - RNA, 17 nt, Mycobacterium bovis subsp bovis AF2122/97
cgccauuggcgccgccg

SEQ ID NO: 1136327 - RNA, 15 nt, Mycobacterium bovis subsp bovis AF2122/97
cgccauugccgccgu

SEQ ID NO: 1136328 - RNA, 15 nt, Mycobacterium bovis subsp bovis AF2122/97
cgcccaccacgcgac

SEQ ID NO: 1136329 - RNA, 14 nt, Mycobacterium bovis subsp bovis AF2122/97
cgcccaccagcggc

SEQ ID NO: 1136330 - RNA, 22 nt, Mycobacterium bovis subsp bovis AF2122/97
cgcccaccagcggcggcaacgg

SEQ ID NO: 1136331 - RNA, 17 nt, Mycobacterium bovis subsp bovis AF2122/97
cgcccaauuucgugccg

SEQ ID NO: 1136332 - RNA, 19 nt, Mycobacterium bovis subsp bovis AF2122/97
cgcccaauuucgugccgaa

SEQ ID NO: 1136333 - RNA, 20 nt, Mycobacterium bovis subsp bovis AF2122/97
cgcccaauuucgugccgaaa

SEQ ID NO: 1136334 - RNA, 23 nt, Mycobacterium bovis subsp bovis AF2122/97
cgcccaauguccaggcgcgcacc

SEQ ID NO: 1136335 - RNA, 22 nt, Mycobacterium bovis subsp bovis AF2122/97
cgcccaccacgaacacguucgg

SEQ ID NO: 1136336 - RNA, 19 nt, Mycobacterium bovis subsp bovis AF2122/97
cgcccaccacacagccgcg

SEQ ID NO: 1136337 - RNA, 18 nt, Mycobacterium bovis subsp bovis AF2122/97
cgcccaccggucgccgcg

SEQ ID NO: 1136338 - RNA, 13 nt, Mycobacterium bovis subsp bovis AF2122/97
cgcccaccgcaac

SEQ ID NO: 1136339 - RNA, 24 nt, Mycobacterium bovis subsp bovis AF2122/97
cgcccaccaugaucacaccgagcg

SEQ ID NO: 1136340 - RNA, 17 nt, Mycobacterium bovis subsp bovis AF2122/97
cgcccaccccggccgca

SEQ ID NO: 1136341 - RNA, 18 nt, Mycobacterium bovis subsp bovis AF2122/97
cgcccaccccggccgcau

SEQ ID NO: 1136342 - RNA, 17 nt, Mycobacterium bovis subsp bovis AF2122/97
cgcccacggcaccacca

SEQ ID NO: 1136343 - RNA, 23 nt, Mycobacterium bovis subsp bovis AF2122/97
cgcccacggcaccaccaagcucg

SEQ ID NO: 1136344 - RNA, 17 nt, Mycobacterium bovis subsp bovis AF2122/97
cgccaucgccaacacca

SEQ ID NO: 1136345 - RNA, 21 nt, Mycobacterium bovis subsp bovis AF2122/97
cgccauccuucggggugaaug

SEQ ID NO: 1136346 - RNA, 18 nt, Mycobacterium bovis subsp bovis AF2122/97
cgccaucgccuccagccg

SEQ ID NO: 1136347 - RNA, 22 nt, Mycobacterium bovis subsp bovis AF2122/97
cgccaucgccuccagccggcga

SEQ ID NO: 1136348 - RNA, 18 nt, Mycobacterium bovis subsp bovis AF2122/97
cgccaucgccgccggugc

SEQ ID NO: 1136349 - RNA, 19 nt, Mycobacterium bovis subsp bovis AF2122/97
cgccaucgccgccggugcc

SEQ ID NO: 1136350 - RNA, 14 nt, Mycobacterium bovis subsp bovis AF2122/97
cgccaucgccucca

SEQ ID NO: 1136351 - RNA, 16 nt, Mycobacterium bovis subsp bovis AF2122/97
cgccaucccgccgccc

SEQ ID NO: 1136352 - RNA, 16 nt, Mycobacterium bovis subsp bovis AF2122/97
cgccaugaagccgggc

SEQ ID NO: 1136353 - RNA, 18 nt, Mycobacterium bovis subsp bovis AF2122/97
cgccaugaagccgggcgc

SEQ ID NO: 1136354 - RNA, 14 nt, Mycobacterium bovis subsp bovis AF2122/97
cgccaucuucgggc

SEQ ID NO: 1136355 - RNA, 19 nt, Mycobacterium bovis subsp bovis AF2122/97
cgccaugcccucggcgccg

SEQ ID NO: 1136356 - RNA, 20 nt, Mycobacterium bovis subsp bovis AF2122/97
cgccaugcccucggcgccga

SEQ ID NO: 1136357 - RNA, 22 nt, Mycobacterium bovis subsp bovis AF2122/97
cgccaucgguugacccggcagc

SEQ ID NO: 1136358 - RNA, 14 nt, Mycobacterium bovis subsp bovis AF2122/97
cgccaucgccgcca

SEQ ID NO: 1136359 - RNA, 12 nt, Mycobacterium bovis subsp bovis AF2122/97
cgccaucacccc

SEQ ID NO: 1136360 - RNA, 15 nt, Mycobacterium bovis subsp bovis AF2122/97
cgccaucaccgccgu

SEQ ID NO: 1136361 - RNA, 18 nt, Mycobacterium bovis subsp bovis AF2122/97
cgccaucagcccggcgcg

SEQ ID NO: 1136362 - RNA, 13 nt, Mycobacterium bovis subsp bovis AF2122/97
cgccaucauggcc

SEQ ID NO: 1136363 - RNA, 16 nt, Mycobacterium bovis subsp bovis AF2122/97
cgccaucauggccgug

SEQ ID NO: 1136364 - RNA, 14 nt, Mycobacterium bovis subsp bovis AF2122/97
cgccaucauggcgg

SEQ ID NO: 1136365 - RNA, 17 nt, Mycobacterium bovis subsp bovis AF2122/97
cgccaucauggcggccc

SEQ ID NO: 1136366 - RNA, 18 nt, Mycobacterium bovis subsp bovis AF2122/97
cgccaucauggcggcccg

SEQ ID NO: 1136367 - RNA, 23 nt, Mycobacterium bovis subsp bovis AF2122/97
cgccauccccgccggcgccaccg

SEQ ID NO: 1136368 - RNA, 17 nt, Mycobacterium bovis subsp bovis AF2122/97
cgccauccaugauggcc

SEQ ID NO: 1136369 - RNA, 20 nt, Mycobacterium bovis subsp bovis AF2122/97
cgccaguuugggauccuggc

SEQ ID NO: 1136370 - RNA, 21 nt, Mycobacterium bovis subsp bovis AF2122/97
cgccaguugcguuguccacca

SEQ ID NO: 1136371 - RNA, 22 nt, Mycobacterium bovis subsp bovis AF2122/97
cgccaguugcguuguccaccau

SEQ ID NO: 1136372 - RNA, 18 nt, Mycobacterium bovis subsp bovis AF2122/97
cgccauaauauugccgcc

SEQ ID NO: 1136373 - RNA, 15 nt, Mycobacterium bovis subsp bovis AF2122/97
cgccauaacaccggg

SEQ ID NO: 1136374 - RNA, 15 nt, Mycobacterium bovis subsp bovis AF2122/97
cgccauagccgcgac

SEQ ID NO: 1136375 - RNA, 16 nt, Mycobacterium bovis subsp bovis AF2122/97
cgccauagcgggcggu

SEQ ID NO: 1136376 - RNA, 22 nt, Mycobacterium bovis subsp bovis AF2122/97
cgccauaccggcuggccaggug

SEQ ID NO: 1136377 - RNA, 23 nt, Mycobacterium bovis subsp bovis AF2122/97
cgccauaccggcuggccaggugg

SEQ ID NO: 1136378 - RNA, 13 nt, Mycobacterium bovis subsp bovis AF2122/97
cgccauacgucgc

SEQ ID NO: 1136379 - RNA, 16 nt, Mycobacterium bovis subsp bovis AF2122/97
cgccagaucaccgucg

SEQ ID NO: 1136380 - RNA, 15 nt, Mycobacterium bovis subsp bovis AF2122/97
cgccagagucggaga

SEQ ID NO: 1136381 - RNA, 17 nt, Mycobacterium bovis subsp bovis AF2122/97
cgccagaauugccggcg

SEQ ID NO: 1136382 - RNA, 13 nt, Mycobacterium bovis subsp bovis AF2122/97
cgccagaccgcac

SEQ ID NO: 1136383 - RNA, 14 nt, Mycobacterium bovis subsp bovis AF2122/97
cgccagaccgcggc

SEQ ID NO: 1136384 - RNA, 18 nt, Mycobacterium bovis subsp bovis AF2122/97
cgccagaccgcggcggcc

SEQ ID NO: 1136385 - RNA, 19 nt, Mycobacterium bovis subsp bovis AF2122/97
cgccagaccgcggcggccg

SEQ ID NO: 1136386 - RNA, 14 nt, Mycobacterium bovis subsp bovis AF2122/97
cgccagcaacgucg

SEQ ID NO: 1136387 - RNA, 16 nt, Mycobacterium bovis subsp bovis AF2122/97
cgccagcaccagcguc

SEQ ID NO: 1136388 - RNA, 17 nt, Mycobacterium bovis subsp bovis AF2122/97
cgccagcaccagcgucg

SEQ ID NO: 1136389 - RNA, 16 nt, Mycobacterium bovis subsp bovis AF2122/97
cgccagcaaugcccgc

SEQ ID NO: 1136390 - RNA, 22 nt, Mycobacterium bovis subsp bovis AF2122/97
cgccagcaaugcccgcaccgcg

SEQ ID NO: 1136391 - RNA, 14 nt, Mycobacterium bovis subsp bovis AF2122/97
cgccagcaacccug

SEQ ID NO: 1136392 - RNA, 19 nt, Mycobacterium bovis subsp bovis AF2122/97
cgccagcaacccugcggug

SEQ ID NO: 1136393 - RNA, 19 nt, Mycobacterium bovis subsp bovis AF2122/97
cgccacuugaugccgcacc

SEQ ID NO: 1136394 - RNA, 17 nt, Mycobacterium bovis subsp bovis AF2122/97
cgccacugccggcagcg

SEQ ID NO: 1136395 - RNA, 21 nt, Mycobacterium bovis subsp bovis AF2122/97
cgccacugcugggcuucgagu

SEQ ID NO: 1136396 - RNA, 18 nt, Mycobacterium bovis subsp bovis AF2122/97
cgccacugcuuccggaac

SEQ ID NO: 1136397 - RNA, 16 nt, Mycobacterium bovis subsp bovis AF2122/97
cgccacuggcgccggu

SEQ ID NO: 1136398 - RNA, 18 nt, Mycobacterium bovis subsp bovis AF2122/97
cgccacuggcgccggugc

SEQ ID NO: 1136399 - RNA, 19 nt, Mycobacterium bovis subsp bovis AF2122/97
cgccacuggcgccggugcc

SEQ ID NO: 1136400 - RNA, 21 nt, Mycobacterium bovis subsp bovis AF2122/97
cgccacgucgccggcuaccgc

SEQ ID NO: 1136401 - RNA, 22 nt, Mycobacterium bovis subsp bovis AF2122/97
cgccacgucgccggcuaccgcc

SEQ ID NO: 1136402 - RNA, 18 nt, Mycobacterium bovis subsp bovis AF2122/97
cgccacgucgccggcuac

SEQ ID NO: 1136403 - RNA, 21 nt, Mycobacterium bovis subsp bovis AF2122/97
cgccacguccaucaccggcgg

SEQ ID NO: 1136404 - RNA, 15 nt, Mycobacterium bovis subsp bovis AF2122/97
cgccacggucgccga

SEQ ID NO: 1136405 - RNA, 17 nt, Mycobacterium bovis subsp bovis AF2122/97
cgccacggcuguggccg

SEQ ID NO: 1136406 - RNA, 20 nt, Mycobacterium bovis subsp bovis AF2122/97
cgccacgguucgggcagcac

SEQ ID NO: 1136407 - RNA, 19 nt, Mycobacterium bovis subsp bovis AF2122/97
cgccacgggcggccaccgc

SEQ ID NO: 1136408 - RNA, 22 nt, Mycobacterium bovis subsp bovis AF2122/97
cgccacguccaacucggcccgg

SEQ ID NO: 1136409 - RNA, 18 nt, Mycobacterium bovis subsp bovis AF2122/97
cgccacguacuccaccgc

SEQ ID NO: 1136410 - RNA, 19 nt, Mycobacterium bovis subsp bovis AF2122/97
cgccacguacuccaccgcg

SEQ ID NO: 1136411 - RNA, 14 nt, Mycobacterium bovis subsp bovis AF2122/97
cgccagccaggcga

SEQ ID NO: 1136412 - RNA, 20 nt, Mycobacterium bovis subsp bovis AF2122/97
cgccagccaccacaucgcgg

SEQ ID NO: 1136413 - RNA, 18 nt, Mycobacterium bovis subsp bovis AF2122/97
cgccagccccagcguucc

SEQ ID NO: 1136414 - RNA, 12 nt, Mycobacterium bovis subsp bovis AF2122/97
cgccagccccgc

SEQ ID NO: 1136415 - RNA, 18 nt, Mycobacterium bovis subsp bovis AF2122/97
cgccagccccgcgcccac

SEQ ID NO: 1136416 - RNA, 20 nt, Mycobacterium bovis subsp bovis AF2122/97
cgccagccccgcgcccaccc

SEQ ID NO: 1136417 - RNA, 22 nt, Mycobacterium bovis subsp bovis AF2122/97
cgccagccccgcgcccaccccg

SEQ ID NO: 1136418 - RNA, 15 nt, Mycobacterium bovis subsp bovis AF2122/97
cgccagcccggugau

SEQ ID NO: 1136419 - RNA, 21 nt, Mycobacterium bovis subsp bovis AF2122/97
cgccagcccggugauggugcc

SEQ ID NO: 1136420 - RNA, 14 nt, Mycobacterium bovis subsp bovis AF2122/97
cgccagcccgguga

SEQ ID NO: 1136421 - RNA, 17 nt, Mycobacterium bovis subsp bovis AF2122/97
cgccagccgcgagccgg

SEQ ID NO: 1136422 - RNA, 13 nt, Mycobacterium bovis subsp bovis AF2122/97
cgccagccgaccg

SEQ ID NO: 1136423 - RNA, 12 nt, Mycobacterium bovis subsp bovis AF2122/97
cgccagccgugc

SEQ ID NO: 1136424 - RNA, 13 nt, Mycobacterium bovis subsp bovis AF2122/97
cgccagccgugcc

SEQ ID NO: 1136425 - RNA, 16 nt, Mycobacterium bovis subsp bovis AF2122/97
cgccagccggccgcga

SEQ ID NO: 1136426 - RNA, 13 nt, Mycobacterium bovis subsp bovis AF2122/97
cgccagccggcgc

SEQ ID NO: 1136427 - RNA, 14 nt, Mycobacterium bovis subsp bovis AF2122/97
cgccagccggcgca

SEQ ID NO: 1136428 - RNA, 21 nt, Mycobacterium bovis subsp bovis AF2122/97
cgccagccggcgcacucccgg

SEQ ID NO: 1136429 - RNA, 14 nt, Mycobacterium bovis subsp bovis AF2122/97
cgccagccggagcg

SEQ ID NO: 1136430 - RNA, 13 nt, Mycobacterium bovis subsp bovis AF2122/97
cgccagccgcgcu

SEQ ID NO: 1136431 - RNA, 13 nt, Mycobacterium bovis subsp bovis AF2122/97
cgccagcgccacc

SEQ ID NO: 1136432 - RNA, 21 nt, Mycobacterium bovis subsp bovis AF2122/97
cgccagcgagcauaccgccgc

SEQ ID NO: 1136433 - RNA, 19 nt, Mycobacterium bovis subsp bovis AF2122/97
cgccagcgagcauaccgcc

SEQ ID NO: 1136434 - RNA, 19 nt, Mycobacterium bovis subsp bovis AF2122/97
cgccagccuccaccagguc

SEQ ID NO: 1136435 - RNA, 20 nt, Mycobacterium bovis subsp bovis AF2122/97
cgccagccuccaccaggucg

SEQ ID NO: 1136436 - RNA, 14 nt, Mycobacterium bovis subsp bovis AF2122/97
cgccagccuccacc

SEQ ID NO: 1136437 - RNA, 24 nt, Mycobacterium bovis subsp bovis AF2122/97
cgccagccguuuuccugaucgcgc

SEQ ID NO: 1136438 - RNA, 23 nt, Mycobacterium bovis subsp bovis AF2122/97
cgccagcagcuucucguucgucg

SEQ ID NO: 1136439 - RNA, 21 nt, Mycobacterium bovis subsp bovis AF2122/97
cgccagcauugaagaagcccg

SEQ ID NO: 1136440 - RNA, 18 nt, Mycobacterium bovis subsp bovis AF2122/97
cgccagcaugacaccggc

SEQ ID NO: 1136441 - RNA, 19 nt, Mycobacterium bovis subsp bovis AF2122/97
cgccagcaugacaccggcc

SEQ ID NO: 1136442 - RNA, 23 nt, Mycobacterium bovis subsp bovis AF2122/97
cgccagcaugacaccggccacca

SEQ ID NO: 1136443 - RNA, 22 nt, Mycobacterium bovis subsp bovis AF2122/97
cgccagcaccagcgucgcggcc

SEQ ID NO: 1136444 - RNA, 14 nt, Mycobacterium bovis subsp bovis AF2122/97
cgccaccgggacga

SEQ ID NO: 1136445 - RNA, 20 nt, Mycobacterium bovis subsp bovis AF2122/97
cgccaccgguaccgaucagc

SEQ ID NO: 1136446 - RNA, 22 nt, Mycobacterium bovis subsp bovis AF2122/97
cgccaccggcaccgccugcgcc

SEQ ID NO: 1136447 - RNA, 12 nt, Mycobacterium bovis subsp bovis AF2122/97
cgccaccggcgu

SEQ ID NO: 1136448 - RNA, 14 nt, Mycobacterium bovis subsp bovis AF2122/97
cgccaccggccgcg

SEQ ID NO: 1136449 - RNA, 16 nt, Mycobacterium bovis subsp bovis AF2122/97
cgccaccggccgcggc

SEQ ID NO: 1136450 - RNA, 11 nt, Mycobacterium bovis subsp bovis AF2122/97
cgccaccggcg

SEQ ID NO: 1136451 - RNA, 13 nt, Mycobacterium bovis subsp bovis AF2122/97
cgccaccggcgcc

SEQ ID NO: 1136452 - RNA, 14 nt, Mycobacterium bovis subsp bovis AF2122/97
cgccaccggcgcca

SEQ ID NO: 1136453 - RNA, 17 nt, Mycobacterium bovis subsp bovis AF2122/97
cgccaccggcgccaccg

SEQ ID NO: 1136454 - RNA, 14 nt, Mycobacterium bovis subsp bovis AF2122/97
cgccaccggcgccg

SEQ ID NO: 1136455 - RNA, 15 nt, Mycobacterium bovis subsp bovis AF2122/97
cgccacccccaccgu

SEQ ID NO: 1136456 - RNA, 20 nt, Mycobacterium bovis subsp bovis AF2122/97
cgccacccccaccgucgcgg

SEQ ID NO: 1136457 - RNA, 14 nt, Mycobacterium bovis subsp bovis AF2122/97
cgccaccguugccg

SEQ ID NO: 1136458 - RNA, 21 nt, Mycobacterium bovis subsp bovis AF2122/97
cgccaccugacgugcggcgcg

SEQ ID NO: 1136459 - RNA, 17 nt, Mycobacterium bovis subsp bovis AF2122/97
cgccaccguuugcgcac

SEQ ID NO: 1136460 - RNA, 19 nt, Mycobacterium bovis subsp bovis AF2122/97
cgccaccgucgcugcccgc

SEQ ID NO: 1136461 - RNA, 12 nt, Mycobacterium bovis subsp bovis AF2122/97
cgccaccgucac

SEQ ID NO: 1136462 - RNA, 15 nt, Mycobacterium bovis subsp bovis AF2122/97
cgccaccgucaccgc

SEQ ID NO: 1136463 - RNA, 21 nt, Mycobacterium bovis subsp bovis AF2122/97
cgccaccgucaccgccguugc

SEQ ID NO: 1136464 - RNA, 14 nt, Mycobacterium bovis subsp bovis AF2122/97
cgccaccgucaugg

SEQ ID NO: 1136465 - RNA, 21 nt, Mycobacterium bovis subsp bovis AF2122/97
cgccaccgucauggcgggugc

SEQ ID NO: 1136466 - RNA, 23 nt, Mycobacterium bovis subsp bovis AF2122/97
cgccaccgucgcugcccgcgcgg

SEQ ID NO: 1136467 - RNA, 19 nt, Mycobacterium bovis subsp bovis AF2122/97
cgccaccgugucacgcgac

SEQ ID NO: 1136468 - RNA, 17 nt, Mycobacterium bovis subsp bovis AF2122/97
cgccaccaucguugccg

SEQ ID NO: 1136469 - RNA, 17 nt, Mycobacterium bovis subsp bovis AF2122/97
cgccaccagggcggccu

SEQ ID NO: 1136470 - RNA, 19 nt, Mycobacterium bovis subsp bovis AF2122/97
cgccaccagggcggccucc

SEQ ID NO: 1136471 - RNA, 16 nt, Mycobacterium bovis subsp bovis AF2122/97
cgccaccaucaccgcc

SEQ ID NO: 1136472 - RNA, 14 nt, Mycobacterium bovis subsp bovis AF2122/97
cgccaccagcgcga

SEQ ID NO: 1136473 - RNA, 21 nt, Mycobacterium bovis subsp bovis AF2122/97
cgccaccacgccgucgacaac

SEQ ID NO: 1136474 - RNA, 13 nt, Mycobacterium bovis subsp bovis AF2122/97
cgccaccacccgg

SEQ ID NO: 1136475 - RNA, 15 nt, Mycobacterium bovis subsp bovis AF2122/97
cgccaccagcaccgc

SEQ ID NO: 1136476 - RNA, 21 nt, Mycobacterium bovis subsp bovis AF2122/97
cgccaccagcaccgccgcugc

SEQ ID NO: 1136477 - RNA, 14 nt, Mycobacterium bovis subsp bovis AF2122/97
cgccacgccaccgc

SEQ ID NO: 1136478 - RNA, 16 nt, Mycobacterium bovis subsp bovis AF2122/97
cgccacgccaccgcgg

SEQ ID NO: 1136479 - RNA, 14 nt, Mycobacterium bovis subsp bovis AF2122/97
cgccacgcacccgg

SEQ ID NO: 1136480 - RNA, 19 nt, Mycobacterium bovis subsp bovis AF2122/97
cgccacgccgaggcguucg

SEQ ID NO: 1136481 - RNA, 13 nt, Mycobacterium bovis subsp bovis AF2122/97
cgccacgccgaag

SEQ ID NO: 1136482 - RNA, 15 nt, Mycobacterium bovis subsp bovis AF2122/97
cgccacgcccgacgc

SEQ ID NO: 1136483 - RNA, 12 nt, Mycobacterium bovis subsp bovis AF2122/97
cgccacgacgcc

SEQ ID NO: 1136484 - RNA, 14 nt, Mycobacterium bovis subsp bovis AF2122/97
cgccacgacgccca

SEQ ID NO: 1136485 - RNA, 16 nt, Mycobacterium bovis subsp bovis AF2122/97
cgccaccuuggcuggg

SEQ ID NO: 1136486 - RNA, 19 nt, Mycobacterium bovis subsp bovis AF2122/97
cgccaccuguugcccuugc

SEQ ID NO: 1136487 - RNA, 13 nt, Mycobacterium bovis subsp bovis AF2122/97
cgccacgaugacc

SEQ ID NO: 1136488 - RNA, 15 nt, Mycobacterium bovis subsp bovis AF2122/97
cgccacgaugccggc

SEQ ID NO: 1136489 - RNA, 16 nt, Mycobacterium bovis subsp bovis AF2122/97
cgccacgaugccggcu

SEQ ID NO: 1136490 - RNA, 17 nt, Mycobacterium bovis subsp bovis AF2122/97
cgccacgaugucgucga

SEQ ID NO: 1136491 - RNA, 14 nt, Mycobacterium bovis subsp bovis AF2122/97
cgccacgacgucgu

SEQ ID NO: 1136492 - RNA, 13 nt, Mycobacterium bovis subsp bovis AF2122/97
cgccacggcagcg

SEQ ID NO: 1136493 - RNA, 17 nt, Mycobacterium bovis subsp bovis AF2122/97
cgccacggcagcgccca

SEQ ID NO: 1136494 - RNA, 21 nt, Mycobacterium bovis subsp bovis AF2122/97
cgccacgcgucuucggucgcg

SEQ ID NO: 1136495 - RNA, 19 nt, Mycobacterium bovis subsp bovis AF2122/97
cgccacggacgugacgucg

SEQ ID NO: 1136496 - RNA, 15 nt, Mycobacterium bovis subsp bovis AF2122/97
cgccacggaucgcgg

SEQ ID NO: 1136497 - RNA, 15 nt, Mycobacterium bovis subsp bovis AF2122/97
cgcaggguccacacc

SEQ ID NO: 1136498 - RNA, 18 nt, Mycobacterium bovis subsp bovis AF2122/97
cgcagggucccgucaucg

SEQ ID NO: 1136499 - RNA, 17 nt, Mycobacterium bovis subsp bovis AF2122/97
cgcaggguucgucggga

SEQ ID NO: 1136500 - RNA, 22 nt, Mycobacterium bovis subsp bovis AF2122/97
cgcaggucaagaaggagaucga

SEQ ID NO: 1136501 - RNA, 18 nt, Mycobacterium bovis subsp bovis AF2122/97
cgcagguagucgacgacg

SEQ ID NO: 1136502 - RNA, 12 nt, Mycobacterium bovis subsp bovis AF2122/97
cgcagguagcgg

SEQ ID NO: 1136503 - RNA, 16 nt, Mycobacterium bovis subsp bovis AF2122/97
cgcaggucgcaccaca

SEQ ID NO: 1136504 - RNA, 21 nt, Mycobacterium bovis subsp bovis AF2122/97
cgcagguacgccucgacagcg

SEQ ID NO: 1136505 - RNA, 15 nt, Mycobacterium bovis subsp bovis AF2122/97
cgcaggucgcuggcc

SEQ ID NO: 1136506 - RNA, 16 nt, Mycobacterium bovis subsp bovis AF2122/97
cgcaggucgaucugcg

SEQ ID NO: 1136507 - RNA, 15 nt, Mycobacterium bovis subsp bovis AF2122/97
cgcaggucgaucugc

SEQ ID NO: 1136508 - RNA, 16 nt, Mycobacterium bovis subsp bovis AF2122/97
cgcauucggcgagccg

SEQ ID NO: 1136509 - RNA, 15 nt, Mycobacterium bovis subsp bovis AF2122/97
cgcauuccggcgcca

SEQ ID NO: 1136510 - RNA, 14 nt, Mycobacterium bovis subsp bovis AF2122/97
cgcauucgccgggc

SEQ ID NO: 1136511 - RNA, 22 nt, Mycobacterium bovis subsp bovis AF2122/97
cgcauuguccugaaaacaccgc

SEQ ID NO: 1136512 - RNA, 23 nt, Mycobacterium bovis subsp bovis AF2122/97
cgcauuguugaagaaagcggccg

SEQ ID NO: 1136513 - RNA, 20 nt, Mycobacterium bovis subsp bovis AF2122/97
cgcauugccgacgcgcggcc

SEQ ID NO: 1136514 - RNA, 16 nt, Mycobacterium bovis subsp bovis AF2122/97
cgcauucggacgccac

SEQ ID NO: 1136515 - RNA, 19 nt, Mycobacterium bovis subsp bovis AF2122/97
cgcauucggacgccacgga

SEQ ID NO: 1136516 - RNA, 13 nt, Mycobacterium bovis subsp bovis AF2122/97
cgcauugaacagc

SEQ ID NO: 1136517 - RNA, 14 nt, Mycobacterium bovis subsp bovis AF2122/97
cgcauugaacagcg

SEQ ID NO: 1136518 - RNA, 22 nt, Mycobacterium bovis subsp bovis AF2122/97
cgcauugaacagcggaucccgc

SEQ ID NO: 1136519 - RNA, 19 nt, Mycobacterium bovis subsp bovis AF2122/97
cgcauugacgaaacccgaa

SEQ ID NO: 1136520 - RNA, 20 nt, Mycobacterium bovis subsp bovis AF2122/97
cgcauuuguugcugcugccg

SEQ ID NO: 1136521 - RNA, 22 nt, Mycobacterium bovis subsp bovis AF2122/97
cgcauuucguugagaacaucgg

SEQ ID NO: 1136522 - RNA, 17 nt, Mycobacterium bovis subsp bovis AF2122/97
cgccaaaaacgccccgg

SEQ ID NO: 1136523 - RNA, 23 nt, Mycobacterium bovis subsp bovis AF2122/97
cgccaaaaaggaucccgccgcug

SEQ ID NO: 1136524 - RNA, 14 nt, Mycobacterium bovis subsp bovis AF2122/97
cgccaaacgcugcg

SEQ ID NO: 1136525 - RNA, 18 nt, Mycobacterium bovis subsp bovis AF2122/97
cgccaaacgcugcgcccg

SEQ ID NO: 1136526 - RNA, 23 nt, Mycobacterium bovis subsp bovis AF2122/97
cgccaaaccuggguuugcacggc

SEQ ID NO: 1136527 - RNA, 21 nt, Mycobacterium bovis subsp bovis AF2122/97
cgccaaaaguacuggcguugc

SEQ ID NO: 1136528 - RNA, 24 nt, Mycobacterium bovis subsp bovis AF2122/97
cgccaaacccaugucggcgcgccg

SEQ ID NO: 1136529 - RNA, 15 nt, Mycobacterium bovis subsp bovis AF2122/97
cgccaaguacgcgac

SEQ ID NO: 1136530 - RNA, 17 nt, Mycobacterium bovis subsp bovis AF2122/97
cgccaaguacgcgaccg

SEQ ID NO: 1136531 - RNA, 13 nt, Mycobacterium bovis subsp bovis AF2122/97
cgccaagucucgg

SEQ ID NO: 1136532 - RNA, 20 nt, Mycobacterium bovis subsp bovis AF2122/97
cgccaagggccccuccggcc

SEQ ID NO: 1136533 - RNA, 13 nt, Mycobacterium bovis subsp bovis AF2122/97
cgccaagacgucg

SEQ ID NO: 1136534 - RNA, 21 nt, Mycobacterium bovis subsp bovis AF2122/97
cgccaagacgucggcgugguc

SEQ ID NO: 1136535 - RNA, 20 nt, Mycobacterium bovis subsp bovis AF2122/97
cgccaagcucggccaccagc

SEQ ID NO: 1136536 - RNA, 20 nt, Mycobacterium bovis subsp bovis AF2122/97
cgccaacuccucagccgccu

SEQ ID NO: 1136537 - RNA, 15 nt, Mycobacterium bovis subsp bovis AF2122/97
cgccaacugcggcag

SEQ ID NO: 1136538 - RNA, 23 nt, Mycobacterium bovis subsp bovis AF2122/97
cgccaaauccggugcccgcacca

SEQ ID NO: 1136539 - RNA, 15 nt, Mycobacterium bovis subsp bovis AF2122/97
cgccaacgugacgcc

SEQ ID NO: 1136540 - RNA, 13 nt, Mycobacterium bovis subsp bovis AF2122/97
cgccaauggcgcg

SEQ ID NO: 1136541 - RNA, 23 nt, Mycobacterium bovis subsp bovis AF2122/97
cgccaauuacagcuugcgcagcc

SEQ ID NO: 1136542 - RNA, 15 nt, Mycobacterium bovis subsp bovis AF2122/97
cgccaauucagcggc

SEQ ID NO: 1136543 - RNA, 17 nt, Mycobacterium bovis subsp bovis AF2122/97
cgccaauucagcggcaa

SEQ ID NO: 1136544 - RNA, 18 nt, Mycobacterium bovis subsp bovis AF2122/97
cgccaauucagcggcaac

SEQ ID NO: 1136545 - RNA, 22 nt, Mycobacterium bovis subsp bovis AF2122/97
cgccaaucugcgcgaggggccg

SEQ ID NO: 1136546 - RNA, 15 nt, Mycobacterium bovis subsp bovis AF2122/97
cgccaaugccgcgga

SEQ ID NO: 1136547 - RNA, 18 nt, Mycobacterium bovis subsp bovis AF2122/97
cgccaaugccgcggaggc

SEQ ID NO: 1136548 - RNA, 14 nt, Mycobacterium bovis subsp bovis AF2122/97
cgccaaugcgggaa

SEQ ID NO: 1136549 - RNA, 13 nt, Mycobacterium bovis subsp bovis AF2122/97
cgccaccaccggc

SEQ ID NO: 1136550 - RNA, 15 nt, Mycobacterium bovis subsp bovis AF2122/97
cgccaccaccggcgc

SEQ ID NO: 1136551 - RNA, 20 nt, Mycobacterium bovis subsp bovis AF2122/97
cgccaccaccuccgcgucgg

SEQ ID NO: 1136552 - RNA, 16 nt, Mycobacterium bovis subsp bovis AF2122/97
cgccaccacccaacag

SEQ ID NO: 1136553 - RNA, 14 nt, Mycobacterium bovis subsp bovis AF2122/97
cgccaccacccagg

SEQ ID NO: 1136554 - RNA, 15 nt, Mycobacterium bovis subsp bovis AF2122/97
cgccaccacccaggc

SEQ ID NO: 1136555 - RNA, 21 nt, Mycobacterium bovis subsp bovis AF2122/97
cgccaaucgaguagcugaccg

SEQ ID NO: 1136556 - RNA, 23 nt, Mycobacterium bovis subsp bovis AF2122/97
cgccaaucgaguagcugaccgag

SEQ ID NO: 1136557 - RNA, 22 nt, Mycobacterium bovis subsp bovis AF2122/97
cgccaauacgugauguagcugc

SEQ ID NO: 1136558 - RNA, 13 nt, Mycobacterium bovis subsp bovis AF2122/97
cgccaaggcgaug

SEQ ID NO: 1136559 - RNA, 14 nt, Mycobacterium bovis subsp bovis AF2122/97
cgccaagugcaggg

SEQ ID NO: 1136560 - RNA, 22 nt, Mycobacterium bovis subsp bovis AF2122/97
cgcacccauuuaaacgggccgg

SEQ ID NO: 1136561 - RNA, 23 nt, Mycobacterium bovis subsp bovis AF2122/97
cgcacccaacuccaucagcgcga

SEQ ID NO: 1136562 - RNA, 14 nt, Mycobacterium bovis subsp bovis AF2122/97
cgcacccccgucga

SEQ ID NO: 1136563 - RNA, 20 nt, Mycobacterium bovis subsp bovis AF2122/97
cgcacccccgucgaucagcg

SEQ ID NO: 1136564 - RNA, 19 nt, Mycobacterium bovis subsp bovis AF2122/97
cgcaccccauacucggcgg

SEQ ID NO: 1136565 - RNA, 16 nt, Mycobacterium bovis subsp bovis AF2122/97
cgcaccaucgcggccg

SEQ ID NO: 1136566 - RNA, 17 nt, Mycobacterium bovis subsp bovis AF2122/97
cgcaccaucgcggccgc

SEQ ID NO: 1136567 - RNA, 18 nt, Mycobacterium bovis subsp bovis AF2122/97
cgcaccaucggcgaggcc

SEQ ID NO: 1136568 - RNA, 13 nt, Mycobacterium bovis subsp bovis AF2122/97
cgcacccagggcg

SEQ ID NO: 1136569 - RNA, 18 nt, Mycobacterium bovis subsp bovis AF2122/97
cgcacccaacuccaucag

SEQ ID NO: 1136570 - RNA, 20 nt, Mycobacterium bovis subsp bovis AF2122/97
cgcacccccuccgcgaugcc

SEQ ID NO: 1136571 - RNA, 12 nt, Mycobacterium bovis subsp bovis AF2122/97
cgcaccccgcuu

SEQ ID NO: 1136572 - RNA, 18 nt, Mycobacterium bovis subsp bovis AF2122/97
cgcaccccgcuugcgcgg

SEQ ID NO: 1136573 - RNA, 21 nt, Mycobacterium bovis subsp bovis AF2122/97
cgcacccgaauuugucggcga

SEQ ID NO: 1136574 - RNA, 16 nt, Mycobacterium bovis subsp bovis AF2122/97
cgcaccccggccgcgc

SEQ ID NO: 1136575 - RNA, 14 nt, Mycobacterium bovis subsp bovis AF2122/97
cgcaccccggcggc

SEQ ID NO: 1136576 - RNA, 13 nt, Mycobacterium bovis subsp bovis AF2122/97
cgcacccggccca

SEQ ID NO: 1136577 - RNA, 13 nt, Mycobacterium bovis subsp bovis AF2122/97
cgcacccggccgc

SEQ ID NO: 1136578 - RNA, 22 nt, Mycobacterium bovis subsp bovis AF2122/97
cgcacccgcgggucguccggcg

SEQ ID NO: 1136579 - RNA, 13 nt, Mycobacterium bovis subsp bovis AF2122/97
cgcacccgcucgu

SEQ ID NO: 1136580 - RNA, 21 nt, Mycobacterium bovis subsp bovis AF2122/97
cgcacccgcgggucguccggc

SEQ ID NO: 1136581 - RNA, 23 nt, Mycobacterium bovis subsp bovis AF2122/97
cgcacccguucgugagcggccag

SEQ ID NO: 1136582 - RNA, 16 nt, Mycobacterium bovis subsp bovis AF2122/97
cgcacccugcgugcgg

SEQ ID NO: 1136583 - RNA, 21 nt, Mycobacterium bovis subsp bovis AF2122/97
cgcacccuggguauccaccgc

SEQ ID NO: 1136584 - RNA, 13 nt, Mycobacterium bovis subsp bovis AF2122/97
cgcacccguccgg

SEQ ID NO: 1136585 - RNA, 15 nt, Mycobacterium bovis subsp bovis AF2122/97
cgcacccugacagcg

SEQ ID NO: 1136586 - RNA, 16 nt, Mycobacterium bovis subsp bovis AF2122/97
cgcaccgagcgagacc

SEQ ID NO: 1136587 - RNA, 15 nt, Mycobacterium bovis subsp bovis AF2122/97
cgcaccgaggccgcc

SEQ ID NO: 1136588 - RNA, 16 nt, Mycobacterium bovis subsp bovis AF2122/97
cgcaccgaggccgccg

SEQ ID NO: 1136589 - RNA, 17 nt, Mycobacterium bovis subsp bovis AF2122/97
cgcaccgaggccgccga

SEQ ID NO: 1136590 - RNA, 19 nt, Mycobacterium bovis subsp bovis AF2122/97
cgcaccgaggccgccgaga

SEQ ID NO: 1136591 - RNA, 21 nt, Mycobacterium bovis subsp bovis AF2122/97
cgcaccgaggccgccgagaug

SEQ ID NO: 1136592 - RNA, 14 nt, Mycobacterium bovis subsp bovis AF2122/97
cgcaccgaccgcac

SEQ ID NO: 1136593 - RNA, 14 nt, Mycobacterium bovis subsp bovis AF2122/97
cgcaccgccgcgcg

SEQ ID NO: 1136594 - RNA, 13 nt, Mycobacterium bovis subsp bovis AF2122/97
cgcaccgcccgcc

SEQ ID NO: 1136595 - RNA, 17 nt, Mycobacterium bovis subsp bovis AF2122/97
cgcaccgccugcucggc

SEQ ID NO: 1136596 - RNA, 15 nt, Mycobacterium bovis subsp bovis AF2122/97
cgcaccgccacccug

SEQ ID NO: 1136597 - RNA, 21 nt, Mycobacterium bovis subsp bovis AF2122/97
cgcaccgcaggguccacacca

SEQ ID NO: 1136598 - RNA, 21 nt, Mycobacterium bovis subsp bovis AF2122/97
cgcaccgcaaacucgguauau

SEQ ID NO: 1136599 - RNA, 16 nt, Mycobacterium bovis subsp bovis AF2122/97
cgcaaccggcgaucgg

SEQ ID NO: 1136600 - RNA, 21 nt, Mycobacterium bovis subsp bovis AF2122/97
cgcaaccgcgaagccgaccgu

SEQ ID NO: 1136601 - RNA, 13 nt, Mycobacterium bovis subsp bovis AF2122/97
cgcaaccggcgug

SEQ ID NO: 1136602 - RNA, 23 nt, Mycobacterium bovis subsp bovis AF2122/97
cgcaaccgguggaugaacaccuc

SEQ ID NO: 1136603 - RNA, 17 nt, Mycobacterium bovis subsp bovis AF2122/97
cgcaaccauguuaacgc

SEQ ID NO: 1136604 - RNA, 21 nt, Mycobacterium bovis subsp bovis AF2122/97
cgcaaccauguuaacgcgcgu

SEQ ID NO: 1136605 - RNA, 13 nt, Mycobacterium bovis subsp bovis AF2122/97
cgcaacccggacg

SEQ ID NO: 1136606 - RNA, 19 nt, Mycobacterium bovis subsp bovis AF2122/97
cgcaaccgagcggucgauc

SEQ ID NO: 1136607 - RNA, 20 nt, Mycobacterium bovis subsp bovis AF2122/97
cgcaaccuaaauugccgggc

SEQ ID NO: 1136608 - RNA, 17 nt, Mycobacterium bovis subsp bovis AF2122/97
cgcaaccucgccgucgu

SEQ ID NO: 1136609 - RNA, 21 nt, Mycobacterium bovis subsp bovis AF2122/97
cgcaacgauuuuagcggcugc

SEQ ID NO: 1136610 - RNA, 21 nt, Mycobacterium bovis subsp bovis AF2122/97
cgcaacgccaacacgcguugg

SEQ ID NO: 1136611 - RNA, 19 nt, Mycobacterium bovis subsp bovis AF2122/97
cgcaacgccauaccagcgu

SEQ ID NO: 1136612 - RNA, 15 nt, Mycobacterium bovis subsp bovis AF2122/97
cgcaccacgagcagc

SEQ ID NO: 1136613 - RNA, 17 nt, Mycobacterium bovis subsp bovis AF2122/97
cgcaccaccugggcggc

SEQ ID NO: 1136614 - RNA, 16 nt, Mycobacterium bovis subsp bovis AF2122/97
cgcaccaguggcgccc

SEQ ID NO: 1136615 - RNA, 17 nt, Mycobacterium bovis subsp bovis AF2122/97
cgcaccaguggcgccca

SEQ ID NO: 1136616 - RNA, 19 nt, Mycobacterium bovis subsp bovis AF2122/97
cgcaccacaccgugggcga

SEQ ID NO: 1136617 - RNA, 10 nt, Mycobacterium bovis subsp bovis AF2122/97
cgcaccaccg

SEQ ID NO: 1136618 - RNA, 14 nt, Mycobacterium bovis subsp bovis AF2122/97
cgcaccaccgagcc

SEQ ID NO: 1136619 - RNA, 16 nt, Mycobacterium bovis subsp bovis AF2122/97
cgcaccaccgagccga

SEQ ID NO: 1136620 - RNA, 12 nt, Mycobacterium bovis subsp bovis AF2122/97
cgcaccaccgcc

SEQ ID NO: 1136621 - RNA, 14 nt, Mycobacterium bovis subsp bovis AF2122/97
cgcaccaccggccc

SEQ ID NO: 1136622 - RNA, 20 nt, Mycobacterium bovis subsp bovis AF2122/97
cgcaccaccgucucgccgcg

SEQ ID NO: 1136623 - RNA, 13 nt, Mycobacterium bovis subsp bovis AF2122/97
cgcaccaccuccc

SEQ ID NO: 1136624 - RNA, 16 nt, Mycobacterium bovis subsp bovis AF2122/97
cgcaccaccgcggcgg

SEQ ID NO: 1136625 - RNA, 17 nt, Mycobacterium bovis subsp bovis AF2122/97
cgcaccaccgcggcggc

SEQ ID NO: 1136626 - RNA, 16 nt, Mycobacterium bovis subsp bovis AF2122/97
cgcaccaagacgccac

SEQ ID NO: 1136627 - RNA, 21 nt, Mycobacterium bovis subsp bovis AF2122/97
cgcaccaaggccgccugcaac

SEQ ID NO: 1136628 - RNA, 12 nt, Mycobacterium bovis subsp bovis AF2122/97
cgcaccacacca

SEQ ID NO: 1136629 - RNA, 14 nt, Mycobacterium bovis subsp bovis AF2122/97
cgcaccaagacgcc

SEQ ID NO: 1136630 - RNA, 18 nt, Mycobacterium bovis subsp bovis AF2122/97
cgcacugggugcgucgac

SEQ ID NO: 1136631 - RNA, 16 nt, Mycobacterium bovis subsp bovis AF2122/97
cgcacugggugcgucg

SEQ ID NO: 1136632 - RNA, 13 nt, Mycobacterium bovis subsp bovis AF2122/97
cgcacgguuggcg

SEQ ID NO: 1136633 - RNA, 17 nt, Mycobacterium bovis subsp bovis AF2122/97
cgcacuaccgccuuugc

SEQ ID NO: 1136634 - RNA, 15 nt, Mycobacterium bovis subsp bovis AF2122/97
cgcacugggcgauga

SEQ ID NO: 1136635 - RNA, 19 nt, Mycobacterium bovis subsp bovis AF2122/97
cgcacuggucaacacgacu

SEQ ID NO: 1136636 - RNA, 20 nt, Mycobacterium bovis subsp bovis AF2122/97
cgcacugguugggcgagacc

SEQ ID NO: 1136637 - RNA, 21 nt, Mycobacterium bovis subsp bovis AF2122/97
cgcacguucacgcgcggaucg

SEQ ID NO: 1136638 - RNA, 22 nt, Mycobacterium bovis subsp bovis AF2122/97
cgcacugccccgcaucgcccaa

SEQ ID NO: 1136639 - RNA, 14 nt, Mycobacterium bovis subsp bovis AF2122/97
cgcacugccgccgg

SEQ ID NO: 1136640 - RNA, 14 nt, Mycobacterium bovis subsp bovis AF2122/97
cgcacugccgggug

SEQ ID NO: 1136641 - RNA, 15 nt, Mycobacterium bovis subsp bovis AF2122/97
cgcacugcgccggcc

SEQ ID NO: 1136642 - RNA, 16 nt, Mycobacterium bovis subsp bovis AF2122/97
cgcacugcgccggccg

SEQ ID NO: 1136643 - RNA, 20 nt, Mycobacterium bovis subsp bovis AF2122/97
cgcacugcgccggccggcgc

SEQ ID NO: 1136644 - RNA, 15 nt, Mycobacterium bovis subsp bovis AF2122/97
cgcacgcucggcgug

SEQ ID NO: 1136645 - RNA, 22 nt, Mycobacterium bovis subsp bovis AF2122/97
cgcacgcugaguccccaggugg

SEQ ID NO: 1136646 - RNA, 18 nt, Mycobacterium bovis subsp bovis AF2122/97
cgcacgcuagccgacagc

SEQ ID NO: 1136647 - RNA, 21 nt, Mycobacterium bovis subsp bovis AF2122/97
cgcacgcucaugaccgcucgg

SEQ ID NO: 1136648 - RNA, 12 nt, Mycobacterium bovis subsp bovis AF2122/97
cgcacgcucgcc

SEQ ID NO: 1136649 - RNA, 14 nt, Mycobacterium bovis subsp bovis AF2122/97
cgcacgcucgcccu

SEQ ID NO: 1136650 - RNA, 18 nt, Mycobacterium bovis subsp bovis AF2122/97
cgcacggaaggcccggcg

SEQ ID NO: 1136651 - RNA, 14 nt, Mycobacterium bovis subsp bovis AF2122/97
cgcacggaaggucg

SEQ ID NO: 1136652 - RNA, 14 nt, Mycobacterium bovis subsp bovis AF2122/97
cgcacgcuggcggg

SEQ ID NO: 1136653 - RNA, 16 nt, Mycobacterium bovis subsp bovis AF2122/97
cgcacgcuggcgggca

SEQ ID NO: 1136654 - RNA, 18 nt, Mycobacterium bovis subsp bovis AF2122/97
cgcacggaaggucgacau

SEQ ID NO: 1136655 - RNA, 19 nt, Mycobacterium bovis subsp bovis AF2122/97
cgcacggaccaucgccagg

SEQ ID NO: 1136656 - RNA, 17 nt, Mycobacterium bovis subsp bovis AF2122/97
cgcacggaggcggacca

SEQ ID NO: 1136657 - RNA, 19 nt, Mycobacterium bovis subsp bovis AF2122/97
cgcacggcagacacgcugc

SEQ ID NO: 1136658 - RNA, 14 nt, Mycobacterium bovis subsp bovis AF2122/97
cgcacggccaccgc

SEQ ID NO: 1136659 - RNA, 15 nt, Mycobacterium bovis subsp bovis AF2122/97
cgcacggccgggucg

SEQ ID NO: 1136660 - RNA, 13 nt, Mycobacterium bovis subsp bovis AF2122/97
cgcacggugcuga

SEQ ID NO: 1136661 - RNA, 18 nt, Mycobacterium bovis subsp bovis AF2122/97
cgcacggugcugaucggu

SEQ ID NO: 1136662 - RNA, 22 nt, Mycobacterium bovis subsp bovis AF2122/97
cgcacggugcugaucgguccgg

SEQ ID NO: 1136663 - RNA, 16 nt, Mycobacterium bovis subsp bovis AF2122/97
cgcacgguucgggugg

SEQ ID NO: 1136664 - RNA, 16 nt, Mycobacterium bovis subsp bovis AF2122/97
cgcacgguugccguca

SEQ ID NO: 1136665 - RNA, 17 nt, Mycobacterium bovis subsp bovis AF2122/97
cgcacgguugccgucag

SEQ ID NO: 1136666 - RNA, 12 nt, Mycobacterium bovis subsp bovis AF2122/97
cgcacgaucugc

SEQ ID NO: 1136667 - RNA, 17 nt, Mycobacterium bovis subsp bovis AF2122/97
cgcacgauagccaccga

SEQ ID NO: 1136668 - RNA, 21 nt, Mycobacterium bovis subsp bovis AF2122/97
cgcacgauccgcacccggccg

SEQ ID NO: 1136669 - RNA, 16 nt, Mycobacterium bovis subsp bovis AF2122/97
cgcacgauggccgucg

SEQ ID NO: 1136670 - RNA, 23 nt, Mycobacterium bovis subsp bovis AF2122/97
cgcacgcaguucggucagcgccu

SEQ ID NO: 1136671 - RNA, 15 nt, Mycobacterium bovis subsp bovis AF2122/97
cgcacgccaccggga

SEQ ID NO: 1136672 - RNA, 17 nt, Mycobacterium bovis subsp bovis AF2122/97
cgcacgccaccgggacg

SEQ ID NO: 1136673 - RNA, 15 nt, Mycobacterium bovis subsp bovis AF2122/97
cgcacgccagcuugg

SEQ ID NO: 1136674 - RNA, 21 nt, Mycobacterium bovis subsp bovis AF2122/97
cgcacgccagcuuggcaaccu

SEQ ID NO: 1136675 - RNA, 20 nt, Mycobacterium bovis subsp bovis AF2122/97
cgcacgcagccccucgucgu

SEQ ID NO: 1136676 - RNA, 14 nt, Mycobacterium bovis subsp bovis AF2122/97
cgcacgcacggcgu

SEQ ID NO: 1136677 - RNA, 21 nt, Mycobacterium bovis subsp bovis AF2122/97
cgcacgcccugaagggccgcc

SEQ ID NO: 1136678 - RNA, 16 nt, Mycobacterium bovis subsp bovis AF2122/97
cgcacgccgaccagca

SEQ ID NO: 1136679 - RNA, 17 nt, Mycobacterium bovis subsp bovis AF2122/97
cgcacgcccgcacucgg

SEQ ID NO: 1136680 - RNA, 20 nt, Mycobacterium bovis subsp bovis AF2122/97
cgcacgccgaccagcacccg

SEQ ID NO: 1136681 - RNA, 21 nt, Mycobacterium bovis subsp bovis AF2122/97
cgcacgcgaaaugccugcgcg

SEQ ID NO: 1136682 - RNA, 18 nt, Mycobacterium bovis subsp bovis AF2122/97
cgcacgccgaccggcccg

SEQ ID NO: 1136683 - RNA, 16 nt, Mycobacterium bovis subsp bovis AF2122/97
cgcacgccgcgugccg

SEQ ID NO: 1136684 - RNA, 13 nt, Mycobacterium bovis subsp bovis AF2122/97
cgcacgccggcau

SEQ ID NO: 1136685 - RNA, 21 nt, Mycobacterium bovis subsp bovis AF2122/97
cgcacgcgggagguaccccca

SEQ ID NO: 1136686 - RNA, 14 nt, Mycobacterium bovis subsp bovis AF2122/97
cgcaccgcugaccg

SEQ ID NO: 1136687 - RNA, 15 nt, Mycobacterium bovis subsp bovis AF2122/97
cgcaccgcugaccgc

SEQ ID NO: 1136688 - RNA, 16 nt, Mycobacterium bovis subsp bovis AF2122/97
cgcaccgcugaccgca

SEQ ID NO: 1136689 - RNA, 20 nt, Mycobacterium bovis subsp bovis AF2122/97
cgcaccgcgguacgccgguc

SEQ ID NO: 1136690 - RNA, 16 nt, Mycobacterium bovis subsp bovis AF2122/97
cgcaccgcgguggggu

SEQ ID NO: 1136691 - RNA, 22 nt, Mycobacterium bovis subsp bovis AF2122/97
cgcaccgcgguggggucgacgc

SEQ ID NO: 1136692 - RNA, 17 nt, Mycobacterium bovis subsp bovis AF2122/97
cgcaccgcgguacgccg

SEQ ID NO: 1136693 - RNA, 22 nt, Mycobacterium bovis subsp bovis AF2122/97
cgcaccgcuguugcaucgccgc

SEQ ID NO: 1136694 - RNA, 17 nt, Mycobacterium bovis subsp bovis AF2122/97
cgcaccggagucggcgu

SEQ ID NO: 1136695 - RNA, 23 nt, Mycobacterium bovis subsp bovis AF2122/97
cgcaccggaucaccgcgcccgcc

SEQ ID NO: 1136696 - RNA, 22 nt, Mycobacterium bovis subsp bovis AF2122/97
cgcacgaacgaguccaacucgg

SEQ ID NO: 1136697 - RNA, 22 nt, Mycobacterium bovis subsp bovis AF2122/97
cgcacgaaaucagcccgcccaa

SEQ ID NO: 1136698 - RNA, 14 nt, Mycobacterium bovis subsp bovis AF2122/97
cgcaccggagucgc

SEQ ID NO: 1136699 - RNA, 12 nt, Mycobacterium bovis subsp bovis AF2122/97
cgcacgacaccu

SEQ ID NO: 1136700 - RNA, 13 nt, Mycobacterium bovis subsp bovis AF2122/97
cgcacgaccagcu

SEQ ID NO: 1136701 - RNA, 21 nt, Mycobacterium bovis subsp bovis AF2122/97
cgcacgaccagcugagcuggc

SEQ ID NO: 1136702 - RNA, 19 nt, Mycobacterium bovis subsp bovis AF2122/97
cgcacgacgaauccccgac

SEQ ID NO: 1136703 - RNA, 23 nt, Mycobacterium bovis subsp bovis AF2122/97
cgcacgacgucaaucucggucgg

SEQ ID NO: 1136704 - RNA, 14 nt, Mycobacterium bovis subsp bovis AF2122/97
cgcaggcucaccga

SEQ ID NO: 1136705 - RNA, 22 nt, Mycobacterium bovis subsp bovis AF2122/97
cgcaggcucagcugguggcggc

SEQ ID NO: 1136706 - RNA, 14 nt, Mycobacterium bovis subsp bovis AF2122/97
cgcaggccggcggc

SEQ ID NO: 1136707 - RNA, 23 nt, Mycobacterium bovis subsp bovis AF2122/97
cgcaggccuguuccauuccgguc

SEQ ID NO: 1136708 - RNA, 21 nt, Mycobacterium bovis subsp bovis AF2122/97
cgcaggaaaaccccggccacc

SEQ ID NO: 1136709 - RNA, 22 nt, Mycobacterium bovis subsp bovis AF2122/97
cgcaggaaaaccccggccacca

SEQ ID NO: 1136710 - RNA, 19 nt, Mycobacterium bovis subsp bovis AF2122/97
cgcagcggcggcaacccug

SEQ ID NO: 1136711 - RNA, 13 nt, Mycobacterium bovis subsp bovis AF2122/97
cgcagcggugagg

SEQ ID NO: 1136712 - RNA, 18 nt, Mycobacterium bovis subsp bovis AF2122/97
cgcagcggugcgcgguug

SEQ ID NO: 1136713 - RNA, 18 nt, Mycobacterium bovis subsp bovis AF2122/97
cgcagcgguggucggcgc

SEQ ID NO: 1136714 - RNA, 23 nt, Mycobacterium bovis subsp bovis AF2122/97
cgcagcgggcggugucgucaucg

SEQ ID NO: 1136715 - RNA, 16 nt, Mycobacterium bovis subsp bovis AF2122/97
cgcagcgucaucgcgu

SEQ ID NO: 1136716 - RNA, 19 nt, Mycobacterium bovis subsp bovis AF2122/97
cgcagcgccugcggcagca

SEQ ID NO: 1136717 - RNA, 15 nt, Mycobacterium bovis subsp bovis AF2122/97
cgcagcgugagugca

SEQ ID NO: 1136718 - RNA, 14 nt, Mycobacterium bovis subsp bovis AF2122/97
cgcagcgugcccag

SEQ ID NO: 1136719 - RNA, 21 nt, Mycobacterium bovis subsp bovis AF2122/97
cgcagcguguaguggcccgcg

SEQ ID NO: 1136720 - RNA, 14 nt, Mycobacterium bovis subsp bovis AF2122/97
cgcagcuaacccgc

SEQ ID NO: 1136721 - RNA, 16 nt, Mycobacterium bovis subsp bovis AF2122/97
cgcagcuaacccgcca

SEQ ID NO: 1136722 - RNA, 19 nt, Mycobacterium bovis subsp bovis AF2122/97
cgcagcuacuaccugcccg

SEQ ID NO: 1136723 - RNA, 17 nt, Mycobacterium bovis subsp bovis AF2122/97
cgcagcuauuucgcgac

SEQ ID NO: 1136724 - RNA, 23 nt, Mycobacterium bovis subsp bovis AF2122/97
cgcagcucaccgacggagaucga

SEQ ID NO: 1136725 - RNA, 18 nt, Mycobacterium bovis subsp bovis AF2122/97
cgcagcugggugcgccau

SEQ ID NO: 1136726 - RNA, 18 nt, Mycobacterium bovis subsp bovis AF2122/97
cgcagcugguagcgcacc

SEQ ID NO: 1136727 - RNA, 15 nt, Mycobacterium bovis subsp bovis AF2122/97
cgcagcugcggaucc

SEQ ID NO: 1136728 - RNA, 23 nt, Mycobacterium bovis subsp bovis AF2122/97
cgcagcugaucuuggcaagccaa

SEQ ID NO: 1136729 - RNA, 20 nt, Mycobacterium bovis subsp bovis AF2122/97
cgcagcugagccgugucaac

SEQ ID NO: 1136730 - RNA, 21 nt, Mycobacterium bovis subsp bovis AF2122/97
cgcagcucgucgugagucacc

SEQ ID NO: 1136731 - RNA, 15 nt, Mycobacterium bovis subsp bovis AF2122/97
cgcagcugacgucac

SEQ ID NO: 1136732 - RNA, 16 nt, Mycobacterium bovis subsp bovis AF2122/97
cgcagcugacgucacc

SEQ ID NO: 1136733 - RNA, 17 nt, Mycobacterium bovis subsp bovis AF2122/97
cgcagcugacgucacca

SEQ ID NO: 1136734 - RNA, 23 nt, Mycobacterium bovis subsp bovis AF2122/97
cgcagcugacgucaccacgaucg

SEQ ID NO: 1136735 - RNA, 15 nt, Mycobacterium bovis subsp bovis AF2122/97
cgcagcugagccgug

SEQ ID NO: 1136736 - RNA, 14 nt, Mycobacterium bovis subsp bovis AF2122/97
cgcagcucgccgag

SEQ ID NO: 1136737 - RNA, 17 nt, Mycobacterium bovis subsp bovis AF2122/97
cgcagcuccccgaccga

SEQ ID NO: 1136738 - RNA, 18 nt, Mycobacterium bovis subsp bovis AF2122/97
cgcagcuccucgcccaga

SEQ ID NO: 1136739 - RNA, 18 nt, Mycobacterium bovis subsp bovis AF2122/97
cgcagcuccaccgugacg

SEQ ID NO: 1136740 - RNA, 19 nt, Mycobacterium bovis subsp bovis AF2122/97
cgcagcucagcaucccggc

SEQ ID NO: 1136741 - RNA, 20 nt, Mycobacterium bovis subsp bovis AF2122/97
cgcagcuaucuccaugcucg

SEQ ID NO: 1136742 - RNA, 13 nt, Mycobacterium bovis subsp bovis AF2122/97
cgcagcgccaccc

SEQ ID NO: 1136743 - RNA, 22 nt, Mycobacterium bovis subsp bovis AF2122/97
cgcagcgccacccgaucgggcg

SEQ ID NO: 1136744 - RNA, 13 nt, Mycobacterium bovis subsp bovis AF2122/97
cgcagcgccgcca

SEQ ID NO: 1136745 - RNA, 16 nt, Mycobacterium bovis subsp bovis AF2122/97
cgcagccgcucgacgg

SEQ ID NO: 1136746 - RNA, 15 nt, Mycobacterium bovis subsp bovis AF2122/97
cgcagccgccgcgcc

SEQ ID NO: 1136747 - RNA, 19 nt, Mycobacterium bovis subsp bovis AF2122/97
cgcagccgcucgacggccc

SEQ ID NO: 1136748 - RNA, 11 nt, Mycobacterium bovis subsp bovis AF2122/97
cgcagcggcca

SEQ ID NO: 1136749 - RNA, 16 nt, Mycobacterium bovis subsp bovis AF2122/97
cgcagcgcgaucgcgg

SEQ ID NO: 1136750 - RNA, 19 nt, Mycobacterium bovis subsp bovis AF2122/97
cgcagcgccuaccagcacc

SEQ ID NO: 1136751 - RNA, 20 nt, Mycobacterium bovis subsp bovis AF2122/97
cgcagccagaucuccccgac

SEQ ID NO: 1136752 - RNA, 12 nt, Mycobacterium bovis subsp bovis AF2122/97
cgcagccagcaa

SEQ ID NO: 1136753 - RNA, 18 nt, Mycobacterium bovis subsp bovis AF2122/97
cgcagccgaucgucucgg

SEQ ID NO: 1136754 - RNA, 21 nt, Mycobacterium bovis subsp bovis AF2122/97
cgcagccgaucgucucggcca

SEQ ID NO: 1136755 - RNA, 14 nt, Mycobacterium bovis subsp bovis AF2122/97
cgcagccgaugucg

SEQ ID NO: 1136756 - RNA, 17 nt, Mycobacterium bovis subsp bovis AF2122/97
cgcagccgaugucgcgc

SEQ ID NO: 1136757 - RNA, 23 nt, Mycobacterium bovis subsp bovis AF2122/97
cgcagccagcaagucugcccgac

SEQ ID NO: 1136758 - RNA, 14 nt, Mycobacterium bovis subsp bovis AF2122/97
cgcagccgcagccg

SEQ ID NO: 1136759 - RNA, 14 nt, Mycobacterium bovis subsp bovis AF2122/97
cgcagccgcaggcc

SEQ ID NO: 1136760 - RNA, 19 nt, Mycobacterium bovis subsp bovis AF2122/97
cgcagcauccccgcagcgu

SEQ ID NO: 1136761 - RNA, 17 nt, Mycobacterium bovis subsp bovis AF2122/97
cgcagccaacgucacca

SEQ ID NO: 1136762 - RNA, 17 nt, Mycobacterium bovis subsp bovis AF2122/97
cgcagcauguggccgcc

SEQ ID NO: 1136763 - RNA, 17 nt, Mycobacterium bovis subsp bovis AF2122/97
cgcagcauggugcggcg

SEQ ID NO: 1136764 - RNA, 19 nt, Mycobacterium bovis subsp bovis AF2122/97
cgcagcauggugcggcggc

SEQ ID NO: 1136765 - RNA, 14 nt, Mycobacterium bovis subsp bovis AF2122/97
cgcagcauguccgc

SEQ ID NO: 1136766 - RNA, 21 nt, Mycobacterium bovis subsp bovis AF2122/97
cgcagcauguccgcagcggug

SEQ ID NO: 1136767 - RNA, 18 nt, Mycobacterium bovis subsp bovis AF2122/97
cgcagaacggcguugcgg

SEQ ID NO: 1136768 - RNA, 15 nt, Mycobacterium bovis subsp bovis AF2122/97
cgcagaacgaucgcg

SEQ ID NO: 1136769 - RNA, 19 nt, Mycobacterium bovis subsp bovis AF2122/97
cgcagaaaccauucggcga

SEQ ID NO: 1136770 - RNA, 14 nt, Mycobacterium bovis subsp bovis AF2122/97
cgcacuuggcugcg

SEQ ID NO: 1136771 - RNA, 15 nt, Mycobacterium bovis subsp bovis AF2122/97
cgcacuugcguggcg

SEQ ID NO: 1136772 - RNA, 16 nt, Mycobacterium bovis subsp bovis AF2122/97
cgcagaaagucgcgcg

SEQ ID NO: 1136773 - RNA, 21 nt, Mycobacterium bovis subsp bovis AF2122/97
cgcagaaagucgcgcgcgaac

SEQ ID NO: 1136774 - RNA, 17 nt, Mycobacterium bovis subsp bovis AF2122/97
cgcagcaucugcggguc

SEQ ID NO: 1136775 - RNA, 21 nt, Mycobacterium bovis subsp bovis AF2122/97
cgcagcaucugcgggucggca

SEQ ID NO: 1136776 - RNA, 19 nt, Mycobacterium bovis subsp bovis AF2122/97
cgcagcaucuccgccgguc

SEQ ID NO: 1136777 - RNA, 21 nt, Mycobacterium bovis subsp bovis AF2122/97
cgcagcaucucgucgaucucg

SEQ ID NO: 1136778 - RNA, 18 nt, Mycobacterium bovis subsp bovis AF2122/97
cgcagacaucggagauca

SEQ ID NO: 1136779 - RNA, 14 nt, Mycobacterium bovis subsp bovis AF2122/97
cgcagacacgaccc

SEQ ID NO: 1136780 - RNA, 19 nt, Mycobacterium bovis subsp bovis AF2122/97
cgcagacacgaccccgucg

SEQ ID NO: 1136781 - RNA, 20 nt, Mycobacterium bovis subsp bovis AF2122/97
cgcagacacugcugcggcag

SEQ ID NO: 1136782 - RNA, 20 nt, Mycobacterium bovis subsp bovis AF2122/97
cgcagaauccggcaaccacc

SEQ ID NO: 1136783 - RNA, 15 nt, Mycobacterium bovis subsp bovis AF2122/97
cgcagaaucgcccaa

SEQ ID NO: 1136784 - RNA, 15 nt, Mycobacterium bovis subsp bovis AF2122/97
cgauggcgcgugguc

SEQ ID NO: 1136785 - RNA, 21 nt, Mycobacterium bovis subsp bovis AF2122/97
cgauggcgcgcaacguagcca

SEQ ID NO: 1136786 - RNA, 12 nt, Mycobacterium bovis subsp bovis AF2122/97
cgauggcggcca

SEQ ID NO: 1136787 - RNA, 15 nt, Mycobacterium bovis subsp bovis AF2122/97
cgauggcggccacca

SEQ ID NO: 1136788 - RNA, 16 nt, Mycobacterium bovis subsp bovis AF2122/97
cgauggcggccaccgu

SEQ ID NO: 1136789 - RNA, 21 nt, Mycobacterium bovis subsp bovis AF2122/97
cgauggcggccaccgucagcg

SEQ ID NO: 1136790 - RNA, 15 nt, Mycobacterium bovis subsp bovis AF2122/97
cgauggcuaccccag

SEQ ID NO: 1136791 - RNA, 21 nt, Mycobacterium bovis subsp bovis AF2122/97
cgauggcggcgcguucgucgu

SEQ ID NO: 1136792 - RNA, 13 nt, Mycobacterium bovis subsp bovis AF2122/97
cgauggcggcgcg

SEQ ID NO: 1136793 - RNA, 19 nt, Mycobacterium bovis subsp bovis AF2122/97
cgauggcgguccaccggcc

SEQ ID NO: 1136794 - RNA, 17 nt, Mycobacterium bovis subsp bovis AF2122/97
cgauggcgguggcgagg

SEQ ID NO: 1136795 - RNA, 13 nt, Mycobacterium bovis subsp bovis AF2122/97
cgauggcgguggg

SEQ ID NO: 1136796 - RNA, 15 nt, Mycobacterium bovis subsp bovis AF2122/97
cgauggcgguggggc

SEQ ID NO: 1136797 - RNA, 21 nt, Mycobacterium bovis subsp bovis AF2122/97
cgauggcgguggugccgcggc

SEQ ID NO: 1136798 - RNA, 18 nt, Mycobacterium bovis subsp bovis AF2122/97
cgauggcaaacgcaccca

SEQ ID NO: 1136799 - RNA, 23 nt, Mycobacterium bovis subsp bovis AF2122/97
cgauggauuggcgucagcagcaa

SEQ ID NO: 1136800 - RNA, 17 nt, Mycobacterium bovis subsp bovis AF2122/97
cgauggccugaaauacc

SEQ ID NO: 1136801 - RNA, 16 nt, Mycobacterium bovis subsp bovis AF2122/97
cgauggcgcaccggcg

SEQ ID NO: 1136802 - RNA, 17 nt, Mycobacterium bovis subsp bovis AF2122/97
cgauggcgcaccggcgu

SEQ ID NO: 1136803 - RNA, 19 nt, Mycobacterium bovis subsp bovis AF2122/97
cgauggcgcaccggcgucg

SEQ ID NO: 1136804 - RNA, 21 nt, Mycobacterium bovis subsp bovis AF2122/97
cgauggcgauacgcgcgucgg

SEQ ID NO: 1136805 - RNA, 18 nt, Mycobacterium bovis subsp bovis AF2122/97
cgauggcgaugagguggc

SEQ ID NO: 1136806 - RNA, 16 nt, Mycobacterium bovis subsp bovis AF2122/97
cgauggccgucgauca

SEQ ID NO: 1136807 - RNA, 15 nt, Mycobacterium bovis subsp bovis AF2122/97
cgaugccgacggcgc

SEQ ID NO: 1136808 - RNA, 17 nt, Mycobacterium bovis subsp bovis AF2122/97
cgaugcgcacucccggc

SEQ ID NO: 1136809 - RNA, 20 nt, Mycobacterium bovis subsp bovis AF2122/97
cgaugcgccggaccagcucc

SEQ ID NO: 1136810 - RNA, 22 nt, Mycobacterium bovis subsp bovis AF2122/97
cgaugcaacucgaauccggccc

SEQ ID NO: 1136811 - RNA, 20 nt, Mycobacterium bovis subsp bovis AF2122/97
cgaugcaucggugcagcccg

SEQ ID NO: 1136812 - RNA, 13 nt, Mycobacterium bovis subsp bovis AF2122/97
cgaugccgaccuu

SEQ ID NO: 1136813 - RNA, 17 nt, Mycobacterium bovis subsp bovis AF2122/97
cgaugccgaagcccccg

SEQ ID NO: 1136814 - RNA, 22 nt, Mycobacterium bovis subsp bovis AF2122/97
cgaugcgcugcucacgcagcag

SEQ ID NO: 1136815 - RNA, 21 nt, Mycobacterium bovis subsp bovis AF2122/97
cgaugcgcgucucgagcgcgc

SEQ ID NO: 1136816 - RNA, 20 nt, Mycobacterium bovis subsp bovis AF2122/97
cgaugcgcgcggcgcgaucg

SEQ ID NO: 1136817 - RNA, 14 nt, Mycobacterium bovis subsp bovis AF2122/97
cgaugcgcgccccg

SEQ ID NO: 1136818 - RNA, 14 nt, Mycobacterium bovis subsp bovis AF2122/97
cgaugcgcgccgau

SEQ ID NO: 1136819 - RNA, 21 nt, Mycobacterium bovis subsp bovis AF2122/97
cgaugcuggcgaacucgaggu

SEQ ID NO: 1136820 - RNA, 15 nt, Mycobacterium bovis subsp bovis AF2122/97
cgaugcuggcggccu

SEQ ID NO: 1136821 - RNA, 17 nt, Mycobacterium bovis subsp bovis AF2122/97
cgaugcuggcggccucg

SEQ ID NO: 1136822 - RNA, 14 nt, Mycobacterium bovis subsp bovis AF2122/97
cgaugcugggcgag

SEQ ID NO: 1136823 - RNA, 13 nt, Mycobacterium bovis subsp bovis AF2122/97
cgaugcuggcggc

SEQ ID NO: 1136824 - RNA, 13 nt, Mycobacterium bovis subsp bovis AF2122/97
cgaugcugcgggc

SEQ ID NO: 1136825 - RNA, 21 nt, Mycobacterium bovis subsp bovis AF2122/97
cgaugcuggcaaaguaucgca

SEQ ID NO: 1136826 - RNA, 19 nt, Mycobacterium bovis subsp bovis AF2122/97
cgaugaucaccagucgcug

SEQ ID NO: 1136827 - RNA, 21 nt, Mycobacterium bovis subsp bovis AF2122/97
cgaugaucaccagucgcugau

SEQ ID NO: 1136828 - RNA, 22 nt, Mycobacterium bovis subsp bovis AF2122/97
cgaugagguucaucgccggcgc

SEQ ID NO: 1136829 - RNA, 15 nt, Mycobacterium bovis subsp bovis AF2122/97
cgaugaggcgcagcg

SEQ ID NO: 1136830 - RNA, 21 nt, Mycobacterium bovis subsp bovis AF2122/97
cgaugagggcuuguggugagc

SEQ ID NO: 1136831 - RNA, 17 nt, Mycobacterium bovis subsp bovis AF2122/97
cgaugacgauggccgcc

SEQ ID NO: 1136832 - RNA, 19 nt, Mycobacterium bovis subsp bovis AF2122/97
cgaugacgauggccgccgc

SEQ ID NO: 1136833 - RNA, 14 nt, Mycobacterium bovis subsp bovis AF2122/97
cgaugacgauggug

SEQ ID NO: 1136834 - RNA, 13 nt, Mycobacterium bovis subsp bovis AF2122/97
cgaugacgccauc

SEQ ID NO: 1136835 - RNA, 15 nt, Mycobacterium bovis subsp bovis AF2122/97
cgaugacgccaucga

SEQ ID NO: 1136836 - RNA, 18 nt, Mycobacterium bovis subsp bovis AF2122/97
cgaugacgccaucgaucg

SEQ ID NO: 1136837 - RNA, 19 nt, Mycobacterium bovis subsp bovis AF2122/97
cgaugacgccaucgaucga

SEQ ID NO: 1136838 - RNA, 14 nt, Mycobacterium bovis subsp bovis AF2122/97
cgaugagcggcgcg

SEQ ID NO: 1136839 - RNA, 16 nt, Mycobacterium bovis subsp bovis AF2122/97
cgaugacgaucggcgg

SEQ ID NO: 1136840 - RNA, 13 nt, Mycobacterium bovis subsp bovis AF2122/97
cgaugaccggcga

SEQ ID NO: 1136841 - RNA, 14 nt, Mycobacterium bovis subsp bovis AF2122/97
cgaugaccgucgca

SEQ ID NO: 1136842 - RNA, 19 nt, Mycobacterium bovis subsp bovis AF2122/97
cgaugaccucggcgauguc

SEQ ID NO: 1136843 - RNA, 23 nt, Mycobacterium bovis subsp bovis AF2122/97
cgaugaccugcccgucccgcucg

SEQ ID NO: 1136844 - RNA, 21 nt, Mycobacterium bovis subsp bovis AF2122/97
cgaugacgaccgaucggcgcg

SEQ ID NO: 1136845 - RNA, 18 nt, Mycobacterium bovis subsp bovis AF2122/97
cgaugacgacgccgucgg

SEQ ID NO: 1136846 - RNA, 16 nt, Mycobacterium bovis subsp bovis AF2122/97
cgaugaccuugcccac

SEQ ID NO: 1136847 - RNA, 17 nt, Mycobacterium bovis subsp bovis AF2122/97
cgaugacgaugccgccg

SEQ ID NO: 1136848 - RNA, 18 nt, Mycobacterium bovis subsp bovis AF2122/97
cgaugacgaugccgccga

SEQ ID NO: 1136849 - RNA, 13 nt, Mycobacterium bovis subsp bovis AF2122/97
cgaugacgaucgc

SEQ ID NO: 1136850 - RNA, 20 nt, Mycobacterium bovis subsp bovis AF2122/97
cgaugaggacauccggcgcc

SEQ ID NO: 1136851 - RNA, 16 nt, Mycobacterium bovis subsp bovis AF2122/97
cgaugaucccgccacc

SEQ ID NO: 1136852 - RNA, 17 nt, Mycobacterium bovis subsp bovis AF2122/97
cgaugaucccgccaccg

SEQ ID NO: 1136853 - RNA, 18 nt, Mycobacterium bovis subsp bovis AF2122/97
cgaugaucccgccaccga

SEQ ID NO: 1136854 - RNA, 20 nt, Mycobacterium bovis subsp bovis AF2122/97
cgaugaugucgagcacaccg

SEQ ID NO: 1136855 - RNA, 14 nt, Mycobacterium bovis subsp bovis AF2122/97
cgaugaugucggcc

SEQ ID NO: 1136856 - RNA, 16 nt, Mycobacterium bovis subsp bovis AF2122/97
cgaugaugucggccgc

SEQ ID NO: 1136857 - RNA, 15 nt, Mycobacterium bovis subsp bovis AF2122/97
cgaugaucgcaucga

SEQ ID NO: 1136858 - RNA, 19 nt, Mycobacterium bovis subsp bovis AF2122/97
cgaugaucgguaccgacgg

SEQ ID NO: 1136859 - RNA, 17 nt, Mycobacterium bovis subsp bovis AF2122/97
cgaugcagugcgacccg

SEQ ID NO: 1136860 - RNA, 18 nt, Mycobacterium bovis subsp bovis AF2122/97
cgaugcagugcgacccgg

SEQ ID NO: 1136861 - RNA, 21 nt, Mycobacterium bovis subsp bovis AF2122/97
cgaugcagugcgacccgggcg

SEQ ID NO: 1136862 - RNA, 14 nt, Mycobacterium bovis subsp bovis AF2122/97
cgaugccacaucgu

SEQ ID NO: 1136863 - RNA, 13 nt, Mycobacterium bovis subsp bovis AF2122/97
cgaugcagcgcgc

SEQ ID NO: 1136864 - RNA, 20 nt, Mycobacterium bovis subsp bovis AF2122/97
cgaugcacuccaugaaucgc

SEQ ID NO: 1136865 - RNA, 18 nt, Mycobacterium bovis subsp bovis AF2122/97
cgaugcaccccaugaccg

SEQ ID NO: 1136866 - RNA, 18 nt, Mycobacterium bovis subsp bovis AF2122/97
cgaugauuucgucgaucg

SEQ ID NO: 1136867 - RNA, 20 nt, Mycobacterium bovis subsp bovis AF2122/97
cgaugauuucgucgaucggc

SEQ ID NO: 1136868 - RNA, 17 nt, Mycobacterium bovis subsp bovis AF2122/97
cgaucuuggccaccgcc

SEQ ID NO: 1136869 - RNA, 12 nt, Mycobacterium bovis subsp bovis AF2122/97
cgaugaccgcgc

SEQ ID NO: 1136870 - RNA, 21 nt, Mycobacterium bovis subsp bovis AF2122/97
cgaugaccgcgcggcccgccg

SEQ ID NO: 1136871 - RNA, 14 nt, Mycobacterium bovis subsp bovis AF2122/97
cgaugaacgcguag

SEQ ID NO: 1136872 - RNA, 19 nt, Mycobacterium bovis subsp bovis AF2122/97
cgaugaacgcguagucgcg

SEQ ID NO: 1136873 - RNA, 20 nt, Mycobacterium bovis subsp bovis AF2122/97
cgaugaacgcguagucgcgg

SEQ ID NO: 1136874 - RNA, 21 nt, Mycobacterium bovis subsp bovis AF2122/97
cgaugaacgggaucgacccgc

SEQ ID NO: 1136875 - RNA, 16 nt, Mycobacterium bovis subsp bovis AF2122/97
cgaugaaccgggcagc

SEQ ID NO: 1136876 - RNA, 20 nt, Mycobacterium bovis subsp bovis AF2122/97
cgaugaacaucuggcgacga

SEQ ID NO: 1136877 - RNA, 13 nt, Mycobacterium bovis subsp bovis AF2122/97
cgaucuuggccac

SEQ ID NO: 1136878 - RNA, 16 nt, Mycobacterium bovis subsp bovis AF2122/97
cgaucuugcgacgccc

SEQ ID NO: 1136879 - RNA, 12 nt, Mycobacterium bovis subsp bovis AF2122/97
cgaucuugcgga

SEQ ID NO: 1136880 - RNA, 14 nt, Mycobacterium bovis subsp bovis AF2122/97
cgaucuucgcgcgc

SEQ ID NO: 1136881 - RNA, 17 nt, Mycobacterium bovis subsp bovis AF2122/97
cgaucugcucgccgagc

SEQ ID NO: 1136882 - RNA, 21 nt, Mycobacterium bovis subsp bovis AF2122/97
cgaucaacaacagccgcagcc

SEQ ID NO: 1136883 - RNA, 22 nt, Mycobacterium bovis subsp bovis AF2122/97
cgaucaacaacagccgcagcca

SEQ ID NO: 1136884 - RNA, 21 nt, Mycobacterium bovis subsp bovis AF2122/97
cgaucaacaccaacgacagcg

SEQ ID NO: 1136885 - RNA, 14 nt, Mycobacterium bovis subsp bovis AF2122/97
cgauauucggccau

SEQ ID NO: 1136886 - RNA, 15 nt, Mycobacterium bovis subsp bovis AF2122/97
cgauauuggacgcgc

SEQ ID NO: 1136887 - RNA, 20 nt, Mycobacterium bovis subsp bovis AF2122/97
cgauauuggacgcgcaugcc

SEQ ID NO: 1136888 - RNA, 22 nt, Mycobacterium bovis subsp bovis AF2122/97
cgauauggucaccaagacaccg

SEQ ID NO: 1136889 - RNA, 16 nt, Mycobacterium bovis subsp bovis AF2122/97
cgaucuggcagccgaa

SEQ ID NO: 1136890 - RNA, 21 nt, Mycobacterium bovis subsp bovis AF2122/97
cgaucugggcuuucagcaccg

SEQ ID NO: 1136891 - RNA, 19 nt, Mycobacterium bovis subsp bovis AF2122/97
cgaucuggucaagacccgc

SEQ ID NO: 1136892 - RNA, 16 nt, Mycobacterium bovis subsp bovis AF2122/97
cgaucugucgcgccgg

SEQ ID NO: 1136893 - RNA, 15 nt, Mycobacterium bovis subsp bovis AF2122/97
cgcaaacagauucgg

SEQ ID NO: 1136894 - RNA, 16 nt, Mycobacterium bovis subsp bovis AF2122/97
cgauugucggcaacga

SEQ ID NO: 1136895 - RNA, 21 nt, Mycobacterium bovis subsp bovis AF2122/97
cgauugucggcaacgacccgc

SEQ ID NO: 1136896 - RNA, 23 nt, Mycobacterium bovis subsp bovis AF2122/97
cgauugucggcaacgacccgccg

SEQ ID NO: 1136897 - RNA, 17 nt, Mycobacterium bovis subsp bovis AF2122/97
cgauuggugucggugca

SEQ ID NO: 1136898 - RNA, 19 nt, Mycobacterium bovis subsp bovis AF2122/97
cgauugggguauugccgga

SEQ ID NO: 1136899 - RNA, 18 nt, Mycobacterium bovis subsp bovis AF2122/97
cgauugcguagcggguca

SEQ ID NO: 1136900 - RNA, 24 nt, Mycobacterium bovis subsp bovis AF2122/97
cgauuggcaggcaaugcccgaccg

SEQ ID NO: 1136901 - RNA, 13 nt, Mycobacterium bovis subsp bovis AF2122/97
cgauuggcucgag

SEQ ID NO: 1136902 - RNA, 13 nt, Mycobacterium bovis subsp bovis AF2122/97
cgauuggcucgcc

SEQ ID NO: 1136903 - RNA, 17 nt, Mycobacterium bovis subsp bovis AF2122/97
cgauuggcucgccgaac

SEQ ID NO: 1136904 - RNA, 13 nt, Mycobacterium bovis subsp bovis AF2122/97
cgauugcccgcgc

SEQ ID NO: 1136905 - RNA, 22 nt, Mycobacterium bovis subsp bovis AF2122/97
cgcaacaugggugaugcaacgc

SEQ ID NO: 1136906 - RNA, 16 nt, Mycobacterium bovis subsp bovis AF2122/97
cgcaaccaaagcgacg

SEQ ID NO: 1136907 - RNA, 22 nt, Mycobacterium bovis subsp bovis AF2122/97
cgcaaccaaagcgacgagcagc

SEQ ID NO: 1136908 - RNA, 16 nt, Mycobacterium bovis subsp bovis AF2122/97
cgcaaccaaccgucgg

SEQ ID NO: 1136909 - RNA, 21 nt, Mycobacterium bovis subsp bovis AF2122/97
cgcaaacagauucggugccag

SEQ ID NO: 1136910 - RNA, 20 nt, Mycobacterium bovis subsp bovis AF2122/97
cgauucccgcggacagcccg

SEQ ID NO: 1136911 - RNA, 17 nt, Mycobacterium bovis subsp bovis AF2122/97
cgauuccgcgcgggaaa

SEQ ID NO: 1136912 - RNA, 20 nt, Mycobacterium bovis subsp bovis AF2122/97
cgauuccgcgucugcucgcg

SEQ ID NO: 1136913 - RNA, 19 nt, Mycobacterium bovis subsp bovis AF2122/97
cgauuccgcgucugcucgg

SEQ ID NO: 1136914 - RNA, 15 nt, Mycobacterium bovis subsp bovis AF2122/97
cgauuccggcggcca

SEQ ID NO: 1136915 - RNA, 18 nt, Mycobacterium bovis subsp bovis AF2122/97
cgauuccggcggccacgc

SEQ ID NO: 1136916 - RNA, 20 nt, Mycobacterium bovis subsp bovis AF2122/97
cgauuccggcggccacgccg

SEQ ID NO: 1136917 - RNA, 22 nt, Mycobacterium bovis subsp bovis AF2122/97
cgauucgccuagcgagcgcaca

SEQ ID NO: 1136918 - RNA, 15 nt, Mycobacterium bovis subsp bovis AF2122/97
cgauucgcggcagcc

SEQ ID NO: 1136919 - RNA, 16 nt, Mycobacterium bovis subsp bovis AF2122/97
cgauucgcggcagccg

SEQ ID NO: 1136920 - RNA, 20 nt, Mycobacterium bovis subsp bovis AF2122/97
cgauucgcggcagccggcgg

SEQ ID NO: 1136921 - RNA, 20 nt, Mycobacterium bovis subsp bovis AF2122/97
cgauuccgcgucugcucggc

SEQ ID NO: 1136922 - RNA, 16 nt, Mycobacterium bovis subsp bovis AF2122/97
cgauuccgcucguucg

SEQ ID NO: 1136923 - RNA, 18 nt, Mycobacterium bovis subsp bovis AF2122/97
cgauucgaccggugaugu

SEQ ID NO: 1136924 - RNA, 19 nt, Mycobacterium bovis subsp bovis AF2122/97
cgauucgauguccucgaca

SEQ ID NO: 1136925 - RNA, 21 nt, Mycobacterium bovis subsp bovis AF2122/97
cgauucugcguccugcucgcg

SEQ ID NO: 1136926 - RNA, 20 nt, Mycobacterium bovis subsp bovis AF2122/97
cgauucugcgucugcucgcc

SEQ ID NO: 1136927 - RNA, 15 nt, Mycobacterium bovis subsp bovis AF2122/97
cgauucucgaucugg

SEQ ID NO: 1136928 - RNA, 17 nt, Mycobacterium bovis subsp bovis AF2122/97
cgauucggcggccgugu

SEQ ID NO: 1136929 - RNA, 15 nt, Mycobacterium bovis subsp bovis AF2122/97
cgauucggccagcgc

SEQ ID NO: 1136930 - RNA, 12 nt, Mycobacterium bovis subsp bovis AF2122/97
cgauucggccca

SEQ ID NO: 1136931 - RNA, 15 nt, Mycobacterium bovis subsp bovis AF2122/97
cgauucgugucggug

SEQ ID NO: 1136932 - RNA, 19 nt, Mycobacterium bovis subsp bovis AF2122/97
cgauucugugucugcucgg

SEQ ID NO: 1136933 - RNA, 23 nt, Mycobacterium bovis subsp bovis AF2122/97
cgauucugugucugcucggcgag

SEQ ID NO: 1136934 - RNA, 15 nt, Mycobacterium bovis subsp bovis AF2122/97
cgauucuggccggau

SEQ ID NO: 1136935 - RNA, 23 nt, Mycobacterium bovis subsp bovis AF2122/97
cgauucugggcuucaucggcgau

SEQ ID NO: 1136936 - RNA, 19 nt, Mycobacterium bovis subsp bovis AF2122/97
cgauucugcgucugcucgg

SEQ ID NO: 1136937 - RNA, 19 nt, Mycobacterium bovis subsp bovis AF2122/97
cgauucugugucugcucgc

SEQ ID NO: 1136938 - RNA, 22 nt, Mycobacterium bovis subsp bovis AF2122/97
cgauguuggcagggccagcggc

SEQ ID NO: 1136939 - RNA, 16 nt, Mycobacterium bovis subsp bovis AF2122/97
cgauuaccggcacgcc

SEQ ID NO: 1136940 - RNA, 17 nt, Mycobacterium bovis subsp bovis AF2122/97
cgauuccaccgccgacg

SEQ ID NO: 1136941 - RNA, 15 nt, Mycobacterium bovis subsp bovis AF2122/97
cgauuccaugcgcga

SEQ ID NO: 1136942 - RNA, 15 nt, Mycobacterium bovis subsp bovis AF2122/97
cgauucccaaccggu

SEQ ID NO: 1136943 - RNA, 21 nt, Mycobacterium bovis subsp bovis AF2122/97
cgauuccgcccacaugcgcuc

SEQ ID NO: 1136944 - RNA, 20 nt, Mycobacterium bovis subsp bovis AF2122/97
cgauggugcucaaggcuucg

SEQ ID NO: 1136945 - RNA, 13 nt, Mycobacterium bovis subsp bovis AF2122/97
cgaugguggccgc

SEQ ID NO: 1136946 - RNA, 15 nt, Mycobacterium bovis subsp bovis AF2122/97
cgaugguggccgcca

SEQ ID NO: 1136947 - RNA, 20 nt, Mycobacterium bovis subsp bovis AF2122/97
cgauggugugcacggcuucg

SEQ ID NO: 1136948 - RNA, 18 nt, Mycobacterium bovis subsp bovis AF2122/97
cgaugguggugccaaccu

SEQ ID NO: 1136949 - RNA, 23 nt, Mycobacterium bovis subsp bovis AF2122/97
cgaugguggugccaaccugggcc

SEQ ID NO: 1136950 - RNA, 19 nt, Mycobacterium bovis subsp bovis AF2122/97
cgauggugccgacccgccg

SEQ ID NO: 1136951 - RNA, 22 nt, Mycobacterium bovis subsp bovis AF2122/97
cgauggugccgacccgccgcgc

SEQ ID NO: 1136952 - RNA, 18 nt, Mycobacterium bovis subsp bovis AF2122/97
cgauggugcgccgggcgu

SEQ ID NO: 1136953 - RNA, 21 nt, Mycobacterium bovis subsp bovis AF2122/97
cgauggugaugggggagccgg

SEQ ID NO: 1136954 - RNA, 14 nt, Mycobacterium bovis subsp bovis AF2122/97
cgauguccacgccg

SEQ ID NO: 1136955 - RNA, 22 nt, Mycobacterium bovis subsp bovis AF2122/97
cgaugucaaccaagugaccggc

SEQ ID NO: 1136956 - RNA, 11 nt, Mycobacterium bovis subsp bovis AF2122/97
cgaugucagcc

SEQ ID NO: 1136957 - RNA, 16 nt, Mycobacterium bovis subsp bovis AF2122/97
cgaugucagcggccgc

SEQ ID NO: 1136958 - RNA, 20 nt, Mycobacterium bovis subsp bovis AF2122/97
cgauguccaaugcaccguug

SEQ ID NO: 1136959 - RNA, 22 nt, Mycobacterium bovis subsp bovis AF2122/97
cgauguacugugccgcccccgg

SEQ ID NO: 1136960 - RNA, 20 nt, Mycobacterium bovis subsp bovis AF2122/97
cgaugguugccuuguucgcc

SEQ ID NO: 1136961 - RNA, 14 nt, Mycobacterium bovis subsp bovis AF2122/97
cgauguacaccggc

SEQ ID NO: 1136962 - RNA, 20 nt, Mycobacterium bovis subsp bovis AF2122/97
cgauguacaccgugcgccga

SEQ ID NO: 1136963 - RNA, 15 nt, Mycobacterium bovis subsp bovis AF2122/97
cgauguacagcggga

SEQ ID NO: 1136964 - RNA, 16 nt, Mycobacterium bovis subsp bovis AF2122/97
cgauguaccccagcgc

SEQ ID NO: 1136965 - RNA, 15 nt, Mycobacterium bovis subsp bovis AF2122/97
cgauggucucccggc

SEQ ID NO: 1136966 - RNA, 19 nt, Mycobacterium bovis subsp bovis AF2122/97
cgauggucccgagggcggc

SEQ ID NO: 1136967 - RNA, 16 nt, Mycobacterium bovis subsp bovis AF2122/97
cgaugguacccgcgcc

SEQ ID NO: 1136968 - RNA, 21 nt, Mycobacterium bovis subsp bovis AF2122/97
cgaugguacccgcgccgcgca

SEQ ID NO: 1136969 - RNA, 17 nt, Mycobacterium bovis subsp bovis AF2122/97
cgaugguaucgccgcua

SEQ ID NO: 1136970 - RNA, 17 nt, Mycobacterium bovis subsp bovis AF2122/97
cgaugguaugcccgccg

SEQ ID NO: 1136971 - RNA, 20 nt, Mycobacterium bovis subsp bovis AF2122/97
cgaugguaugcccgccguag

SEQ ID NO: 1136972 - RNA, 22 nt, Mycobacterium bovis subsp bovis AF2122/97
cgaugguaugcccgccguagac

SEQ ID NO: 1136973 - RNA, 19 nt, Mycobacterium bovis subsp bovis AF2122/97
cgauggucaaugcgcuggc

SEQ ID NO: 1136974 - RNA, 12 nt, Mycobacterium bovis subsp bovis AF2122/97
cgaugggcauca

SEQ ID NO: 1136975 - RNA, 20 nt, Mycobacterium bovis subsp bovis AF2122/97
cgaugggcccagcggccgcg

SEQ ID NO: 1136976 - RNA, 22 nt, Mycobacterium bovis subsp bovis AF2122/97
cgaugggaaccgaaucggcacc

SEQ ID NO: 1136977 - RNA, 20 nt, Mycobacterium bovis subsp bovis AF2122/97
cgauggggacggcggcgagg

SEQ ID NO: 1136978 - RNA, 23 nt, Mycobacterium bovis subsp bovis AF2122/97
cgaugggucugguguccaccgca

SEQ ID NO: 1136979 - RNA, 20 nt, Mycobacterium bovis subsp bovis AF2122/97
cgaugggaacggggugggaa

SEQ ID NO: 1136980 - RNA, 15 nt, Mycobacterium bovis subsp bovis AF2122/97
cgaugggagcccggc

SEQ ID NO: 1136981 - RNA, 16 nt, Mycobacterium bovis subsp bovis AF2122/97
cgaugggagcccggcg

SEQ ID NO: 1136982 - RNA, 17 nt, Mycobacterium bovis subsp bovis AF2122/97
cgauggcucucacgagc

SEQ ID NO: 1136983 - RNA, 18 nt, Mycobacterium bovis subsp bovis AF2122/97
cgauggcgucgccggccc

SEQ ID NO: 1136984 - RNA, 13 nt, Mycobacterium bovis subsp bovis AF2122/97
cgauggcucacau

SEQ ID NO: 1136985 - RNA, 13 nt, Mycobacterium bovis subsp bovis AF2122/97
cgauguccgcgcg

SEQ ID NO: 1136986 - RNA, 17 nt, Mycobacterium bovis subsp bovis AF2122/97
cgauguccucgacaccc

SEQ ID NO: 1136987 - RNA, 21 nt, Mycobacterium bovis subsp bovis AF2122/97
cgauguccucgagcaccgcga

SEQ ID NO: 1136988 - RNA, 16 nt, Mycobacterium bovis subsp bovis AF2122/97
cgauguccucgauccg

SEQ ID NO: 1136989 - RNA, 18 nt, Mycobacterium bovis subsp bovis AF2122/97
cgauguccgacgccaccg

SEQ ID NO: 1136990 - RNA, 15 nt, Mycobacterium bovis subsp bovis AF2122/97
cgauguccagguggc

SEQ ID NO: 1136991 - RNA, 14 nt, Mycobacterium bovis subsp bovis AF2122/97
cgaugucgacgucg

SEQ ID NO: 1136992 - RNA, 16 nt, Mycobacterium bovis subsp bovis AF2122/97
cgaugucgaagaucga

SEQ ID NO: 1136993 - RNA, 15 nt, Mycobacterium bovis subsp bovis AF2122/97
cgauguccccggcgg

SEQ ID NO: 1136994 - RNA, 13 nt, Mycobacterium bovis subsp bovis AF2122/97
cgaugucgaugcc

SEQ ID NO: 1136995 - RNA, 18 nt, Mycobacterium bovis subsp bovis AF2122/97
cgaugucgcgcauugccg

SEQ ID NO: 1136996 - RNA, 14 nt, Mycobacterium bovis subsp bovis AF2122/97
cgaugucggggccg

SEQ ID NO: 1136997 - RNA, 22 nt, Mycobacterium bovis subsp bovis AF2122/97
cgaugucggggccgucgucggu

SEQ ID NO: 1136998 - RNA, 20 nt, Mycobacterium bovis subsp bovis AF2122/97
cgaugucggcucggcccccg

SEQ ID NO: 1136999 - RNA, 21 nt, Mycobacterium bovis subsp bovis AF2122/97
cgaugucggcucggcccccga

SEQ ID NO: 1137000 - RNA, 12 nt, Mycobacterium bovis subsp bovis AF2122/97
cgaugucgaggu

SEQ ID NO: 1137001 - RNA, 15 nt, Mycobacterium bovis subsp bovis AF2122/97
cgaugucgucguugu

SEQ ID NO: 1137002 - RNA, 15 nt, Mycobacterium bovis subsp bovis AF2122/97
cgaugucgucgauga

SEQ ID NO: 1137003 - RNA, 15 nt, Mycobacterium bovis subsp bovis AF2122/97
cgaugucggucgggu

SEQ ID NO: 1137004 - RNA, 17 nt, Mycobacterium bovis subsp bovis AF2122/97
cgaugucguaccgggcg

SEQ ID NO: 1137005 - RNA, 15 nt, Mycobacterium bovis subsp bovis AF2122/97
cgaugucgucgacga

SEQ ID NO: 1137006 - RNA, 16 nt, Mycobacterium bovis subsp bovis AF2122/97
cgaugucguuggccac

SEQ ID NO: 1137007 - RNA, 14 nt, Mycobacterium bovis subsp bovis AF2122/97
cgaugugcccgcca

SEQ ID NO: 1137008 - RNA, 20 nt, Mycobacterium bovis subsp bovis AF2122/97
cgaugugccgauuggccugc

SEQ ID NO: 1137009 - RNA, 13 nt, Mycobacterium bovis subsp bovis AF2122/97
cgaugugcgccca

SEQ ID NO: 1137010 - RNA, 22 nt, Mycobacterium bovis subsp bovis AF2122/97
cgaugugcgcccaauccaccga

SEQ ID NO: 1137011 - RNA, 22 nt, Mycobacterium bovis subsp bovis AF2122/97
cgaugucgcggucgcccgcuac

SEQ ID NO: 1137012 - RNA, 15 nt, Mycobacterium bovis subsp bovis AF2122/97
cgauguucgccgcgc

SEQ ID NO: 1137013 - RNA, 20 nt, Mycobacterium bovis subsp bovis AF2122/97
cgauguggcgcuccggcgug

SEQ ID NO: 1137014 - RNA, 19 nt, Mycobacterium bovis subsp bovis AF2122/97
ccggauggccccgccaaac

SEQ ID NO: 1137015 - RNA, 23 nt, Mycobacterium bovis subsp bovis AF2122/97
ccggauggaacuggacaccgugg

SEQ ID NO: 1137016 - RNA, 19 nt, Mycobacterium bovis subsp bovis AF2122/97
ccggaugcggucccugauc

SEQ ID NO: 1137017 - RNA, 12 nt, Mycobacterium bovis subsp bovis AF2122/97
ccggaugcgcaa

SEQ ID NO: 1137018 - RNA, 23 nt, Mycobacterium bovis subsp bovis AF2122/97
ccggaucggucggcaccagguug

SEQ ID NO: 1137019 - RNA, 18 nt, Mycobacterium bovis subsp bovis AF2122/97
ccggaucugacggcgccg

SEQ ID NO: 1137020 - RNA, 18 nt, Mycobacterium bovis subsp bovis AF2122/97
ccggaugacaccgaccgg

SEQ ID NO: 1137021 - RNA, 19 nt, Mycobacterium bovis subsp bovis AF2122/97
ccggaugacaccgaccggg

SEQ ID NO: 1137022 - RNA, 19 nt, Mycobacterium bovis subsp bovis AF2122/97
ccggaugagcgaacgccag

SEQ ID NO: 1137023 - RNA, 16 nt, Mycobacterium bovis subsp bovis AF2122/97
ccggaugaugucgguc

SEQ ID NO: 1137024 - RNA, 15 nt, Mycobacterium bovis subsp bovis AF2122/97
ccggauuggcgauga

SEQ ID NO: 1137025 - RNA, 17 nt, Mycobacterium bovis subsp bovis AF2122/97
ccggcaaaggacgucga

SEQ ID NO: 1137026 - RNA, 19 nt, Mycobacterium bovis subsp bovis AF2122/97
ccggcaaaggacgucgacc

SEQ ID NO: 1137027 - RNA, 23 nt, Mycobacterium bovis subsp bovis AF2122/97
ccggauugaagucgucggccauc

SEQ ID NO: 1137028 - RNA, 15 nt, Mycobacterium bovis subsp bovis AF2122/97
ccggauucuccgccc

SEQ ID NO: 1137029 - RNA, 15 nt, Mycobacterium bovis subsp bovis AF2122/97
ccggauucgcccggg

SEQ ID NO: 1137030 - RNA, 16 nt, Mycobacterium bovis subsp bovis AF2122/97
ccggauuauucgcggu

SEQ ID NO: 1137031 - RNA, 23 nt, Mycobacterium bovis subsp bovis AF2122/97
ccggauguugaccggcucgaucu

SEQ ID NO: 1137032 - RNA, 15 nt, Mycobacterium bovis subsp bovis AF2122/97
ccggauguugaccgg

SEQ ID NO: 1137033 - RNA, 18 nt, Mycobacterium bovis subsp bovis AF2122/97
ccggauggucggccacgc

SEQ ID NO: 1137034 - RNA, 14 nt, Mycobacterium bovis subsp bovis AF2122/97
ccggaugucgacga

SEQ ID NO: 1137035 - RNA, 18 nt, Mycobacterium bovis subsp bovis AF2122/97
ccggaugucgacgagcac

SEQ ID NO: 1137036 - RNA, 21 nt, Mycobacterium bovis subsp bovis AF2122/97
ccggaugucgacgagcaccgc

SEQ ID NO: 1137037 - RNA, 23 nt, Mycobacterium bovis subsp bovis AF2122/97
ccggaugucgacgagcaccgcgc

SEQ ID NO: 1137038 - RNA, 14 nt, Mycobacterium bovis subsp bovis AF2122/97
ccggcaccacgauc

SEQ ID NO: 1137039 - RNA, 15 nt, Mycobacterium bovis subsp bovis AF2122/97
ccggcaccagcggca

SEQ ID NO: 1137040 - RNA, 12 nt, Mycobacterium bovis subsp bovis AF2122/97
ccggcaccaacg

SEQ ID NO: 1137041 - RNA, 21 nt, Mycobacterium bovis subsp bovis AF2122/97
ccggcaccaacgccaccgucg

SEQ ID NO: 1137042 - RNA, 20 nt, Mycobacterium bovis subsp bovis AF2122/97
ccggcacauugaucgacggc

SEQ ID NO: 1137043 - RNA, 23 nt, Mycobacterium bovis subsp bovis AF2122/97
ccggcacauugaucgacggccag

SEQ ID NO: 1137044 - RNA, 20 nt, Mycobacterium bovis subsp bovis AF2122/97
ccggcaauugugcugcgcgu

SEQ ID NO: 1137045 - RNA, 20 nt, Mycobacterium bovis subsp bovis AF2122/97
ccggcaagaccgaacagcgg

SEQ ID NO: 1137046 - RNA, 18 nt, Mycobacterium bovis subsp bovis AF2122/97
ccggcaauuccguuaggc

SEQ ID NO: 1137047 - RNA, 18 nt, Mycobacterium bovis subsp bovis AF2122/97
ccggcaaucggcggcacc

SEQ ID NO: 1137048 - RNA, 19 nt, Mycobacterium bovis subsp bovis AF2122/97
ccggcaaucucccgaaucg

SEQ ID NO: 1137049 - RNA, 16 nt, Mycobacterium bovis subsp bovis AF2122/97
ccggcaauaccgccag

SEQ ID NO: 1137050 - RNA, 19 nt, Mycobacterium bovis subsp bovis AF2122/97
ccggcaauaccgccagcgc

SEQ ID NO: 1137051 - RNA, 23 nt, Mycobacterium bovis subsp bovis AF2122/97
ccggcaauaccgccagcgccacc

SEQ ID NO: 1137052 - RNA, 17 nt, Mycobacterium bovis subsp bovis AF2122/97
ccggcaagcgcagacac

SEQ ID NO: 1137053 - RNA, 16 nt, Mycobacterium bovis subsp bovis AF2122/97
ccggcaagccacgccg

SEQ ID NO: 1137054 - RNA, 15 nt, Mycobacterium bovis subsp bovis AF2122/97
ccggcaagccugcgc

SEQ ID NO: 1137055 - RNA, 12 nt, Mycobacterium bovis subsp bovis AF2122/97
ccggcaagcgca

SEQ ID NO: 1137056 - RNA, 19 nt, Mycobacterium bovis subsp bovis AF2122/97
ccggcaagcacaccgccag

SEQ ID NO: 1137057 - RNA, 22 nt, Mycobacterium bovis subsp bovis AF2122/97
ccggcaagcacaccgccagcgg

SEQ ID NO: 1137058 - RNA, 18 nt, Mycobacterium bovis subsp bovis AF2122/97
ccggcaacggcgcgccga

SEQ ID NO: 1137059 - RNA, 22 nt, Mycobacterium bovis subsp bovis AF2122/97
ccggcaaccgacucgacaaggc

SEQ ID NO: 1137060 - RNA, 13 nt, Mycobacterium bovis subsp bovis AF2122/97
ccggcaacagcac

SEQ ID NO: 1137061 - RNA, 15 nt, Mycobacterium bovis subsp bovis AF2122/97
ccggcaacagcucgc

SEQ ID NO: 1137062 - RNA, 16 nt, Mycobacterium bovis subsp bovis AF2122/97
ccggcaaccaccggcc

SEQ ID NO: 1137063 - RNA, 19 nt, Mycobacterium bovis subsp bovis AF2122/97
ccggcaaccaccggccgcg

SEQ ID NO: 1137064 - RNA, 20 nt, Mycobacterium bovis subsp bovis AF2122/97
ccggcaaccaccggccgcgc

SEQ ID NO: 1137065 - RNA, 13 nt, Mycobacterium bovis subsp bovis AF2122/97
ccggcaacgcggc

SEQ ID NO: 1137066 - RNA, 14 nt, Mycobacterium bovis subsp bovis AF2122/97
ccggcaacgcggcc

SEQ ID NO: 1137067 - RNA, 12 nt, Mycobacterium bovis subsp bovis AF2122/97
ccggcaaccggg

SEQ ID NO: 1137068 - RNA, 14 nt, Mycobacterium bovis subsp bovis AF2122/97
ccggcaaccgggau

SEQ ID NO: 1137069 - RNA, 22 nt, Mycobacterium bovis subsp bovis AF2122/97
ccggcagcacguggaccggcac

SEQ ID NO: 1137070 - RNA, 13 nt, Mycobacterium bovis subsp bovis AF2122/97
ccggcagcccggc

SEQ ID NO: 1137071 - RNA, 14 nt, Mycobacterium bovis subsp bovis AF2122/97
ccggcagcccggcg

SEQ ID NO: 1137072 - RNA, 16 nt, Mycobacterium bovis subsp bovis AF2122/97
ccggcagcccggcggc

SEQ ID NO: 1137073 - RNA, 19 nt, Mycobacterium bovis subsp bovis AF2122/97
ccggcagcccggcggccgc

SEQ ID NO: 1137074 - RNA, 14 nt, Mycobacterium bovis subsp bovis AF2122/97
ccggcagcaucggc

SEQ ID NO: 1137075 - RNA, 21 nt, Mycobacterium bovis subsp bovis AF2122/97
ccggcagcaucggcaccccgg

SEQ ID NO: 1137076 - RNA, 22 nt, Mycobacterium bovis subsp bovis AF2122/97
ccggcagcaucggcaccccggc

SEQ ID NO: 1137077 - RNA, 14 nt, Mycobacterium bovis subsp bovis AF2122/97
ccggcagccagacu

SEQ ID NO: 1137078 - RNA, 19 nt, Mycobacterium bovis subsp bovis AF2122/97
ccggcagcgcccccggacu

SEQ ID NO: 1137079 - RNA, 22 nt, Mycobacterium bovis subsp bovis AF2122/97
ccggcagcgagacuucgacgcg

SEQ ID NO: 1137080 - RNA, 14 nt, Mycobacterium bovis subsp bovis AF2122/97
ccggcagcgguggc

SEQ ID NO: 1137081 - RNA, 12 nt, Mycobacterium bovis subsp bovis AF2122/97
ccggcagcggcg

SEQ ID NO: 1137082 - RNA, 14 nt, Mycobacterium bovis subsp bovis AF2122/97
ccggcagcggcgcg

SEQ ID NO: 1137083 - RNA, 16 nt, Mycobacterium bovis subsp bovis AF2122/97
ccggcagcggcgcgcu

SEQ ID NO: 1137084 - RNA, 20 nt, Mycobacterium bovis subsp bovis AF2122/97
ccggcagcuuugacgcccuc

SEQ ID NO: 1137085 - RNA, 20 nt, Mycobacterium bovis subsp bovis AF2122/97
ccggcagcagccggcgggcc

SEQ ID NO: 1137086 - RNA, 17 nt, Mycobacterium bovis subsp bovis AF2122/97
ccggcaggcccgacggc

SEQ ID NO: 1137087 - RNA, 16 nt, Mycobacterium bovis subsp bovis AF2122/97
ccggcaggccggcguc

SEQ ID NO: 1137088 - RNA, 22 nt, Mycobacterium bovis subsp bovis AF2122/97
ccggcaggcuaaucagccaggc

SEQ ID NO: 1137089 - RNA, 17 nt, Mycobacterium bovis subsp bovis AF2122/97
ccggcagguccaucugg

SEQ ID NO: 1137090 - RNA, 21 nt, Mycobacterium bovis subsp bovis AF2122/97
ccggcaggguuccggauccga

SEQ ID NO: 1137091 - RNA, 20 nt, Mycobacterium bovis subsp bovis AF2122/97
ccggcaccuccagcaccacc

SEQ ID NO: 1137092 - RNA, 18 nt, Mycobacterium bovis subsp bovis AF2122/97
ccggcacgaaucccccgg

SEQ ID NO: 1137093 - RNA, 18 nt, Mycobacterium bovis subsp bovis AF2122/97
ccggcacgaccaccggau

SEQ ID NO: 1137094 - RNA, 22 nt, Mycobacterium bovis subsp bovis AF2122/97
ccggcaccguagagcaugccgc

SEQ ID NO: 1137095 - RNA, 22 nt, Mycobacterium bovis subsp bovis AF2122/97
ccggcaccggggcugcccgcgg

SEQ ID NO: 1137096 - RNA, 21 nt, Mycobacterium bovis subsp bovis AF2122/97
ccggcaccuccagcaccaccg

SEQ ID NO: 1137097 - RNA, 22 nt, Mycobacterium bovis subsp bovis AF2122/97
ccggcaccuccagcaccaccgg

SEQ ID NO: 1137098 - RNA, 21 nt, Mycobacterium bovis subsp bovis AF2122/97
ccggcacccccgucgccaccg

SEQ ID NO: 1137099 - RNA, 19 nt, Mycobacterium bovis subsp bovis AF2122/97
ccggcaccgccugcgccgc

SEQ ID NO: 1137100 - RNA, 12 nt, Mycobacterium bovis subsp bovis AF2122/97
ccggcaccggcc

SEQ ID NO: 1137101 - RNA, 19 nt, Mycobacterium bovis subsp bovis AF2122/97
ccggcaccggccgugccgc

SEQ ID NO: 1137102 - RNA, 14 nt, Mycobacterium bovis subsp bovis AF2122/97
ccggcacccgcggc

SEQ ID NO: 1137103 - RNA, 14 nt, Mycobacterium bovis subsp bovis AF2122/97
ccggcacccgcugg

SEQ ID NO: 1137104 - RNA, 16 nt, Mycobacterium bovis subsp bovis AF2122/97
ccggcacccgcuggcg

SEQ ID NO: 1137105 - RNA, 23 nt, Mycobacterium bovis subsp bovis AF2122/97
ccggcaccccuuugacgccgagc

SEQ ID NO: 1137106 - RNA, 13 nt, Mycobacterium bovis subsp bovis AF2122/97
ccggcacccgcac

SEQ ID NO: 1137107 - RNA, 17 nt, Mycobacterium bovis subsp bovis AF2122/97
ccggcacccgcacggcc

SEQ ID NO: 1137108 - RNA, 13 nt, Mycobacterium bovis subsp bovis AF2122/97
ccggcaccgacgg

SEQ ID NO: 1137109 - RNA, 22 nt, Mycobacterium bovis subsp bovis AF2122/97
ccggcacccaguuccacccggu

SEQ ID NO: 1137110 - RNA, 12 nt, Mycobacterium bovis subsp bovis AF2122/97
ccggcaccccac

SEQ ID NO: 1137111 - RNA, 18 nt, Mycobacterium bovis subsp bovis AF2122/97
ccggcaccccacggccag

SEQ ID NO: 1137112 - RNA, 16 nt, Mycobacterium bovis subsp bovis AF2122/97
ccggcaccgccagugc

SEQ ID NO: 1137113 - RNA, 15 nt, Mycobacterium bovis subsp bovis AF2122/97
ccggcaccgcagcgg

SEQ ID NO: 1137114 - RNA, 12 nt, Mycobacterium bovis subsp bovis AF2122/97
ccggcaccgccg

SEQ ID NO: 1137115 - RNA, 16 nt, Mycobacterium bovis subsp bovis AF2122/97
ccggcaccgccgcccc

SEQ ID NO: 1137116 - RNA, 23 nt, Mycobacterium bovis subsp bovis AF2122/97
ccggcaccgccgcccccgccggc

SEQ ID NO: 1137117 - RNA, 13 nt, Mycobacterium bovis subsp bovis AF2122/97
ccggcaccgccgg

SEQ ID NO: 1137118 - RNA, 14 nt, Mycobacterium bovis subsp bovis AF2122/97
ccggcaccgccggc

SEQ ID NO: 1137119 - RNA, 16 nt, Mycobacterium bovis subsp bovis AF2122/97
ccggcaccgccggcac

SEQ ID NO: 1137120 - RNA, 21 nt, Mycobacterium bovis subsp bovis AF2122/97
ccggcaccgccggcaccgccg

SEQ ID NO: 1137121 - RNA, 16 nt, Mycobacterium bovis subsp bovis AF2122/97
ccggcaccgccggcgc

SEQ ID NO: 1137122 - RNA, 18 nt, Mycobacterium bovis subsp bovis AF2122/97
ccggcaccgccggcgcca

SEQ ID NO: 1137123 - RNA, 21 nt, Mycobacterium bovis subsp bovis AF2122/97
ccggcaccgccggcuccgccg

SEQ ID NO: 1137124 - RNA, 17 nt, Mycobacterium bovis subsp bovis AF2122/97
ccggcaccgccgguggc

SEQ ID NO: 1137125 - RNA, 13 nt, Mycobacterium bovis subsp bovis AF2122/97
ccggcacgcgcgc

SEQ ID NO: 1137126 - RNA, 16 nt, Mycobacterium bovis subsp bovis AF2122/97
ccggcacgccgaccgg

SEQ ID NO: 1137127 - RNA, 13 nt, Mycobacterium bovis subsp bovis AF2122/97
ccggcacgccggc

SEQ ID NO: 1137128 - RNA, 15 nt, Mycobacterium bovis subsp bovis AF2122/97
ccggcacgccggcgg

SEQ ID NO: 1137129 - RNA, 16 nt, Mycobacterium bovis subsp bovis AF2122/97
ccggcacgccggcggc

SEQ ID NO: 1137130 - RNA, 16 nt, Mycobacterium bovis subsp bovis AF2122/97
ccggcacgggcgggga

SEQ ID NO: 1137131 - RNA, 17 nt, Mycobacterium bovis subsp bovis AF2122/97
ccggcacgggcggggac

SEQ ID NO: 1137132 - RNA, 23 nt, Mycobacterium bovis subsp bovis AF2122/97
ccggcacgggcggggacggcggc

SEQ ID NO: 1137133 - RNA, 18 nt, Mycobacterium bovis subsp bovis AF2122/97
ccggcagaugcagcgggu

SEQ ID NO: 1137134 - RNA, 19 nt, Mycobacterium bovis subsp bovis AF2122/97
ccggcagaugcagcggguc

SEQ ID NO: 1137135 - RNA, 14 nt, Mycobacterium bovis subsp bovis AF2122/97
ccggcagaccggug

SEQ ID NO: 1137136 - RNA, 18 nt, Mycobacterium bovis subsp bovis AF2122/97
ccggcagagcacgcgcgg

SEQ ID NO: 1137137 - RNA, 20 nt, Mycobacterium bovis subsp bovis AF2122/97
ccggcagagcacgcgcggcg

SEQ ID NO: 1137138 - RNA, 16 nt, Mycobacterium bovis subsp bovis AF2122/97
ccggcacugaccgcga

SEQ ID NO: 1137139 - RNA, 17 nt, Mycobacterium bovis subsp bovis AF2122/97
ccggcacugcggccagu

SEQ ID NO: 1137140 - RNA, 16 nt, Mycobacterium bovis subsp bovis AF2122/97
ccggcacugcccagca

SEQ ID NO: 1137141 - RNA, 13 nt, Mycobacterium bovis subsp bovis AF2122/97
ccggcacugccga

SEQ ID NO: 1137142 - RNA, 16 nt, Mycobacterium bovis subsp bovis AF2122/97
ccggcacugccgagca

SEQ ID NO: 1137143 - RNA, 20 nt, Mycobacterium bovis subsp bovis AF2122/97
ccggcacugccgagcacgac

SEQ ID NO: 1137144 - RNA, 16 nt, Mycobacterium bovis subsp bovis AF2122/97
ccggcacugcggccag

SEQ ID NO: 1137145 - RNA, 15 nt, Mycobacterium bovis subsp bovis AF2122/97
ccggcccccggucga

SEQ ID NO: 1137146 - RNA, 15 nt, Mycobacterium bovis subsp bovis AF2122/97
ccggccgccaacucc

SEQ ID NO: 1137147 - RNA, 17 nt, Mycobacterium bovis subsp bovis AF2122/97
ccggccgccagcgcacg

SEQ ID NO: 1137148 - RNA, 18 nt, Mycobacterium bovis subsp bovis AF2122/97
ccggccgccagcgcgccg

SEQ ID NO: 1137149 - RNA, 13 nt, Mycobacterium bovis subsp bovis AF2122/97
ccggccgccgcgg

SEQ ID NO: 1137150 - RNA, 15 nt, Mycobacterium bovis subsp bovis AF2122/97
ccggccgccgacagg

SEQ ID NO: 1137151 - RNA, 23 nt, Mycobacterium bovis subsp bovis AF2122/97
ccggccgccugccucgccugcac

SEQ ID NO: 1137152 - RNA, 11 nt, Mycobacterium bovis subsp bovis AF2122/97
ccggccgccga

SEQ ID NO: 1137153 - RNA, 13 nt, Mycobacterium bovis subsp bovis AF2122/97
ccggccgccgaaa

SEQ ID NO: 1137154 - RNA, 15 nt, Mycobacterium bovis subsp bovis AF2122/97
ccggccgggugaacc

SEQ ID NO: 1137155 - RNA, 21 nt, Mycobacterium bovis subsp bovis AF2122/97
ccggccggguguagcucggac

SEQ ID NO: 1137156 - RNA, 21 nt, Mycobacterium bovis subsp bovis AF2122/97
ccggccgguccacgguguacc

SEQ ID NO: 1137157 - RNA, 22 nt, Mycobacterium bovis subsp bovis AF2122/97
ccggccgguccgggaagucgcu

SEQ ID NO: 1137158 - RNA, 23 nt, Mycobacterium bovis subsp bovis AF2122/97
ccggccgucccgcgagcagcccg

SEQ ID NO: 1137159 - RNA, 15 nt, Mycobacterium bovis subsp bovis AF2122/97
ccggccgucgccggg

SEQ ID NO: 1137160 - RNA, 12 nt, Mycobacterium bovis subsp bovis AF2122/97
ccggccgguugg

SEQ ID NO: 1137161 - RNA, 14 nt, Mycobacterium bovis subsp bovis AF2122/97
ccggccgguucuug

SEQ ID NO: 1137162 - RNA, 20 nt, Mycobacterium bovis subsp bovis AF2122/97
ccggccgugaugucccgcaa

SEQ ID NO: 1137163 - RNA, 23 nt, Mycobacterium bovis subsp bovis AF2122/97
ccggccgguuggccagccacagc

SEQ ID NO: 1137164 - RNA, 13 nt, Mycobacterium bovis subsp bovis AF2122/97
ccggccgugccgc

SEQ ID NO: 1137165 - RNA, 14 nt, Mycobacterium bovis subsp bovis AF2122/97
ccggccgugccgcc

SEQ ID NO: 1137166 - RNA, 20 nt, Mycobacterium bovis subsp bovis AF2122/97
ccggccgugccgccgacacc

SEQ ID NO: 1137167 - RNA, 19 nt, Mycobacterium bovis subsp bovis AF2122/97
ccggccuuauucacccggu

SEQ ID NO: 1137168 - RNA, 22 nt, Mycobacterium bovis subsp bovis AF2122/97
ccggccuuauucacccgguagg

SEQ ID NO: 1137169 - RNA, 17 nt, Mycobacterium bovis subsp bovis AF2122/97
ccggccuugcccucaac

SEQ ID NO: 1137170 - RNA, 19 nt, Mycobacterium bovis subsp bovis AF2122/97
ccggccuugccgccggccc

SEQ ID NO: 1137171 - RNA, 20 nt, Mycobacterium bovis subsp bovis AF2122/97
ccggccuugccgccggcccc

SEQ ID NO: 1137172 - RNA, 22 nt, Mycobacterium bovis subsp bovis AF2122/97
ccggccuugccgccggcgccgc

SEQ ID NO: 1137173 - RNA, 20 nt, Mycobacterium bovis subsp bovis AF2122/97
ccggccuggcucguccgggu

SEQ ID NO: 1137174 - RNA, 15 nt, Mycobacterium bovis subsp bovis AF2122/97
ccggccugucccgca

SEQ ID NO: 1137175 - RNA, 17 nt, Mycobacterium bovis subsp bovis AF2122/97
ccggcgacaccgcaggu

SEQ ID NO: 1137176 - RNA, 21 nt, Mycobacterium bovis subsp bovis AF2122/97
ccggcgacaccgcaggugccg

SEQ ID NO: 1137177 - RNA, 14 nt, Mycobacterium bovis subsp bovis AF2122/97
ccggcgaccacggc

SEQ ID NO: 1137178 - RNA, 13 nt, Mycobacterium bovis subsp bovis AF2122/97
ccggcgacccggg

SEQ ID NO: 1137179 - RNA, 17 nt, Mycobacterium bovis subsp bovis AF2122/97
ccggcgacgacccgggu

SEQ ID NO: 1137180 - RNA, 14 nt, Mycobacterium bovis subsp bovis AF2122/97
ccggcgaccgacgg

SEQ ID NO: 1137181 - RNA, 21 nt, Mycobacterium bovis subsp bovis AF2122/97
ccggcgaccggcgagcccgca

SEQ ID NO: 1137182 - RNA, 19 nt, Mycobacterium bovis subsp bovis AF2122/97
ccggcgacgaucucgccgc

SEQ ID NO: 1137183 - RNA, 21 nt, Mycobacterium bovis subsp bovis AF2122/97
ccggcgacgaucucgccgcca

SEQ ID NO: 1137184 - RNA, 20 nt, Mycobacterium bovis subsp bovis AF2122/97
ccggcgacgcuaccgccgga

SEQ ID NO: 1137185 - RNA, 17 nt, Mycobacterium bovis subsp bovis AF2122/97
ccggcgacggcguagcc

SEQ ID NO: 1137186 - RNA, 16 nt, Mycobacterium bovis subsp bovis AF2122/97
ccggcgacgggucggg

SEQ ID NO: 1137187 - RNA, 22 nt, Mycobacterium bovis subsp bovis AF2122/97
ccggcgagagcgucaaccacgg

SEQ ID NO: 1137188 - RNA, 23 nt, Mycobacterium bovis subsp bovis AF2122/97
ccggcgagagcgucaaccacggc

SEQ ID NO: 1137189 - RNA, 18 nt, Mycobacterium bovis subsp bovis AF2122/97
ccggcgagcacccgcugg

SEQ ID NO: 1137190 - RNA, 15 nt, Mycobacterium bovis subsp bovis AF2122/97
ccggcgacugcagcg

SEQ ID NO: 1137191 - RNA, 13 nt, Mycobacterium bovis subsp bovis AF2122/97
ccggcgagcaggc

SEQ ID NO: 1137192 - RNA, 15 nt, Mycobacterium bovis subsp bovis AF2122/97
ccggcgagcaggccg

SEQ ID NO: 1137193 - RNA, 16 nt, Mycobacterium bovis subsp bovis AF2122/97
ccggcgagcaggccgu

SEQ ID NO: 1137194 - RNA, 14 nt, Mycobacterium bovis subsp bovis AF2122/97
ccggcgagcagggc

SEQ ID NO: 1137195 - RNA, 16 nt, Mycobacterium bovis subsp bovis AF2122/97
ccggcgagcagggcgu

SEQ ID NO: 1137196 - RNA, 23 nt, Mycobacterium bovis subsp bovis AF2122/97
ccggcgauaaacccgaggcucgu

SEQ ID NO: 1137197 - RNA, 16 nt, Mycobacterium bovis subsp bovis AF2122/97
ccggcgaucaacgcgc

SEQ ID NO: 1137198 - RNA, 19 nt, Mycobacterium bovis subsp bovis AF2122/97
ccggccagcugcguggcga

SEQ ID NO: 1137199 - RNA, 20 nt, Mycobacterium bovis subsp bovis AF2122/97
ccggcaucgaagugcggccc

SEQ ID NO: 1137200 - RNA, 23 nt, Mycobacterium bovis subsp bovis AF2122/97
ccggccaggaguuugaccaccug

SEQ ID NO: 1137201 - RNA, 16 nt, Mycobacterium bovis subsp bovis AF2122/97
ccggccaggccgacaa

SEQ ID NO: 1137202 - RNA, 15 nt, Mycobacterium bovis subsp bovis AF2122/97
ccggccaggccggcg

SEQ ID NO: 1137203 - RNA, 22 nt, Mycobacterium bovis subsp bovis AF2122/97
ccggccaggccggcggcggcgc

SEQ ID NO: 1137204 - RNA, 12 nt, Mycobacterium bovis subsp bovis AF2122/97
ccggccaggccg

SEQ ID NO: 1137205 - RNA, 20 nt, Mycobacterium bovis subsp bovis AF2122/97
ccggccaggcuauggugccg

SEQ ID NO: 1137206 - RNA, 22 nt, Mycobacterium bovis subsp bovis AF2122/97
ccggccaggggcgcagcgcggc

SEQ ID NO: 1137207 - RNA, 21 nt, Mycobacterium bovis subsp bovis AF2122/97
ccggccaugccuucggugccg

SEQ ID NO: 1137208 - RNA, 15 nt, Mycobacterium bovis subsp bovis AF2122/97
ccggcagugagucgg

SEQ ID NO: 1137209 - RNA, 14 nt, Mycobacterium bovis subsp bovis AF2122/97
ccggcauaacgauc

SEQ ID NO: 1137210 - RNA, 19 nt, Mycobacterium bovis subsp bovis AF2122/97
ccggcauaccgaacagcac

SEQ ID NO: 1137211 - RNA, 22 nt, Mycobacterium bovis subsp bovis AF2122/97
ccggcauaccgaacagcaccuc

SEQ ID NO: 1137212 - RNA, 16 nt, Mycobacterium bovis subsp bovis AF2122/97
ccggcauagcggccca

SEQ ID NO: 1137213 - RNA, 17 nt, Mycobacterium bovis subsp bovis AF2122/97
ccggcauagaucggguc

SEQ ID NO: 1137214 - RNA, 15 nt, Mycobacterium bovis subsp bovis AF2122/97
ccggcauagaugccg

SEQ ID NO: 1137215 - RNA, 20 nt, Mycobacterium bovis subsp bovis AF2122/97
ccggcauagccacgcaagca

SEQ ID NO: 1137216 - RNA, 20 nt, Mycobacterium bovis subsp bovis AF2122/97
ccggcaucgagacgcacggc

SEQ ID NO: 1137217 - RNA, 21 nt, Mycobacterium bovis subsp bovis AF2122/97
ccggcaucgagacgcacggcc

SEQ ID NO: 1137218 - RNA, 19 nt, Mycobacterium bovis subsp bovis AF2122/97
ccggcaucgaucaacacca

SEQ ID NO: 1137219 - RNA, 20 nt, Mycobacterium bovis subsp bovis AF2122/97
ccggcaucccggaacgccgc

SEQ ID NO: 1137220 - RNA, 16 nt, Mycobacterium bovis subsp bovis AF2122/97
ccggcauccgguucgc

SEQ ID NO: 1137221 - RNA, 23 nt, Mycobacterium bovis subsp bovis AF2122/97
ccggccagcuccucagccaccgc

SEQ ID NO: 1137222 - RNA, 12 nt, Mycobacterium bovis subsp bovis AF2122/97
ccggcaucgcgc

SEQ ID NO: 1137223 - RNA, 16 nt, Mycobacterium bovis subsp bovis AF2122/97
ccggcaucgcgcgcgg

SEQ ID NO: 1137224 - RNA, 17 nt, Mycobacterium bovis subsp bovis AF2122/97
ccggccccgcaagcgga

SEQ ID NO: 1137225 - RNA, 14 nt, Mycobacterium bovis subsp bovis AF2122/97
ccggcccgccaccc

SEQ ID NO: 1137226 - RNA, 16 nt, Mycobacterium bovis subsp bovis AF2122/97
ccggcccgccaccccg

SEQ ID NO: 1137227 - RNA, 13 nt, Mycobacterium bovis subsp bovis AF2122/97
ccggcccgcgggc

SEQ ID NO: 1137228 - RNA, 21 nt, Mycobacterium bovis subsp bovis AF2122/97
ccggcccgcucagccguccgg

SEQ ID NO: 1137229 - RNA, 16 nt, Mycobacterium bovis subsp bovis AF2122/97
ccggcccccgacuccg

SEQ ID NO: 1137230 - RNA, 24 nt, Mycobacterium bovis subsp bovis AF2122/97
ccggcccccgacuccggcaggccc

SEQ ID NO: 1137231 - RNA, 22 nt, Mycobacterium bovis subsp bovis AF2122/97
ccggcccccgaggcuggcaucc

SEQ ID NO: 1137232 - RNA, 17 nt, Mycobacterium bovis subsp bovis AF2122/97
ccggcccgggucagcga

SEQ ID NO: 1137233 - RNA, 14 nt, Mycobacterium bovis subsp bovis AF2122/97
ccggcccggugaug

SEQ ID NO: 1137234 - RNA, 14 nt, Mycobacterium bovis subsp bovis AF2122/97
ccggcccggcucgg

SEQ ID NO: 1137235 - RNA, 21 nt, Mycobacterium bovis subsp bovis AF2122/97
ccggccgauggugugcacggc

SEQ ID NO: 1137236 - RNA, 15 nt, Mycobacterium bovis subsp bovis AF2122/97
ccggccgcacgccga

SEQ ID NO: 1137237 - RNA, 20 nt, Mycobacterium bovis subsp bovis AF2122/97
ccggccgcacgccgaccagc

SEQ ID NO: 1137238 - RNA, 19 nt, Mycobacterium bovis subsp bovis AF2122/97
ccggcccuacgcagcgcgg

SEQ ID NO: 1137239 - RNA, 20 nt, Mycobacterium bovis subsp bovis AF2122/97
ccggcccuacgcagcgcggc

SEQ ID NO: 1137240 - RNA, 12 nt, Mycobacterium bovis subsp bovis AF2122/97
ccggcccagugg

SEQ ID NO: 1137241 - RNA, 21 nt, Mycobacterium bovis subsp bovis AF2122/97
ccggccccaccgacagcccca

SEQ ID NO: 1137242 - RNA, 20 nt, Mycobacterium bovis subsp bovis AF2122/97
ccggcccaucuucggacgcc

SEQ ID NO: 1137243 - RNA, 23 nt, Mycobacterium bovis subsp bovis AF2122/97
ccggcccaucuucggacgccagc

SEQ ID NO: 1137244 - RNA, 16 nt, Mycobacterium bovis subsp bovis AF2122/97
ccggccccaccggcac

SEQ ID NO: 1137245 - RNA, 21 nt, Mycobacterium bovis subsp bovis AF2122/97
ccggccccaccgguaccgcca

SEQ ID NO: 1137246 - RNA, 13 nt, Mycobacterium bovis subsp bovis AF2122/97
ccggcccagcgcc

SEQ ID NO: 1137247 - RNA, 13 nt, Mycobacterium bovis subsp bovis AF2122/97
ccggcccagaucg

SEQ ID NO: 1137248 - RNA, 15 nt, Mycobacterium bovis subsp bovis AF2122/97
ccggcccaccggucg

SEQ ID NO: 1137249 - RNA, 16 nt, Mycobacterium bovis subsp bovis AF2122/97
ccggcccaccggucgc

SEQ ID NO: 1137250 - RNA, 12 nt, Mycobacterium bovis subsp bovis AF2122/97
ccggcccaccag

SEQ ID NO: 1137251 - RNA, 13 nt, Mycobacterium bovis subsp bovis AF2122/97
ccggcccaccagc

SEQ ID NO: 1137252 - RNA, 21 nt, Mycobacterium bovis subsp bovis AF2122/97
ccggccauggcgcgcaaccgc

SEQ ID NO: 1137253 - RNA, 15 nt, Mycobacterium bovis subsp bovis AF2122/97
ccggagucgcccggu

SEQ ID NO: 1137254 - RNA, 20 nt, Mycobacterium bovis subsp bovis AF2122/97
ccggagucgcccgguccgcc

SEQ ID NO: 1137255 - RNA, 13 nt, Mycobacterium bovis subsp bovis AF2122/97
ccggagucggcgu

SEQ ID NO: 1137256 - RNA, 13 nt, Mycobacterium bovis subsp bovis AF2122/97
ccggagucgacga

SEQ ID NO: 1137257 - RNA, 15 nt, Mycobacterium bovis subsp bovis AF2122/97
ccggagucgacgacg

SEQ ID NO: 1137258 - RNA, 17 nt, Mycobacterium bovis subsp bovis AF2122/97
ccggaggugcgccgcgg

SEQ ID NO: 1137259 - RNA, 22 nt, Mycobacterium bovis subsp bovis AF2122/97
ccggaggguucggacggcuggu

SEQ ID NO: 1137260 - RNA, 15 nt, Mycobacterium bovis subsp bovis AF2122/97
ccggagccggugccg

SEQ ID NO: 1137261 - RNA, 16 nt, Mycobacterium bovis subsp bovis AF2122/97
ccggagccggugccga

SEQ ID NO: 1137262 - RNA, 22 nt, Mycobacterium bovis subsp bovis AF2122/97
ccggagcgguguggucgcagga

SEQ ID NO: 1137263 - RNA, 17 nt, Mycobacterium bovis subsp bovis AF2122/97
ccggaggccgccgcgcc

SEQ ID NO: 1137264 - RNA, 19 nt, Mycobacterium bovis subsp bovis AF2122/97
ccggaggccgccgcgccgg

SEQ ID NO: 1137265 - RNA, 19 nt, Mycobacterium bovis subsp bovis AF2122/97
ccggaggcaagcaaccggu

SEQ ID NO: 1137266 - RNA, 17 nt, Mycobacterium bovis subsp bovis AF2122/97
ccggagccggugccgac

SEQ ID NO: 1137267 - RNA, 23 nt, Mycobacterium bovis subsp bovis AF2122/97
ccggaggcaagcaaccggugcgc

SEQ ID NO: 1137268 - RNA, 17 nt, Mycobacterium bovis subsp bovis AF2122/97
ccggaggcaauccgauc

SEQ ID NO: 1137269 - RNA, 20 nt, Mycobacterium bovis subsp bovis AF2122/97
ccggaggcaauccgaucugg

SEQ ID NO: 1137270 - RNA, 23 nt, Mycobacterium bovis subsp bovis AF2122/97
ccggauacgucagcccgauacgg

SEQ ID NO: 1137271 - RNA, 14 nt, Mycobacterium bovis subsp bovis AF2122/97
ccggaucaggaucg

SEQ ID NO: 1137272 - RNA, 14 nt, Mycobacterium bovis subsp bovis AF2122/97
ccggauacagccac

SEQ ID NO: 1137273 - RNA, 19 nt, Mycobacterium bovis subsp bovis AF2122/97
ccggauaucgaccaccggg

SEQ ID NO: 1137274 - RNA, 17 nt, Mycobacterium bovis subsp bovis AF2122/97
ccggauagcgucuggcg

SEQ ID NO: 1137275 - RNA, 16 nt, Mycobacterium bovis subsp bovis AF2122/97
ccggaucaucgccgcg

SEQ ID NO: 1137276 - RNA, 17 nt, Mycobacterium bovis subsp bovis AF2122/97
ccggaucaucgccgcgg

SEQ ID NO: 1137277 - RNA, 18 nt, Mycobacterium bovis subsp bovis AF2122/97
ccggaucaucgccgcggc

SEQ ID NO: 1137278 - RNA, 19 nt, Mycobacterium bovis subsp bovis AF2122/97
ccggaucccaccaccgcuc

SEQ ID NO: 1137279 - RNA, 22 nt, Mycobacterium bovis subsp bovis AF2122/97
ccggaucgaccaauucgaccgc

SEQ ID NO: 1137280 - RNA, 22 nt, Mycobacterium bovis subsp bovis AF2122/97
ccggaucggcuaccuaacccgc

SEQ ID NO: 1137281 - RNA, 15 nt, Mycobacterium bovis subsp bovis AF2122/97
ccggaucgccgucgg

SEQ ID NO: 1137282 - RNA, 20 nt, Mycobacterium bovis subsp bovis AF2122/97
ccggaucgccuuggcgcccg

SEQ ID NO: 1137283 - RNA, 14 nt, Mycobacterium bovis subsp bovis AF2122/97
ccggagacccgggu

SEQ ID NO: 1137284 - RNA, 18 nt, Mycobacterium bovis subsp bovis AF2122/97
ccggacuugaccagagca

SEQ ID NO: 1137285 - RNA, 14 nt, Mycobacterium bovis subsp bovis AF2122/97
ccggagcacccggg

SEQ ID NO: 1137286 - RNA, 21 nt, Mycobacterium bovis subsp bovis AF2122/97
ccggagaugacaaucucggcg

SEQ ID NO: 1137287 - RNA, 21 nt, Mycobacterium bovis subsp bovis AF2122/97
ccggagcccacacgcucacgg

SEQ ID NO: 1137288 - RNA, 23 nt, Mycobacterium bovis subsp bovis AF2122/97
ccggagccgcuacguuacgccga

SEQ ID NO: 1137289 - RNA, 18 nt, Mycobacterium bovis subsp bovis AF2122/97
ccggagccgcccaagccg

SEQ ID NO: 1137290 - RNA, 12 nt, Mycobacterium bovis subsp bovis AF2122/97
ccggagccgccg

SEQ ID NO: 1137291 - RNA, 14 nt, Mycobacterium bovis subsp bovis AF2122/97
ccggagccgccggc

SEQ ID NO: 1137292 - RNA, 16 nt, Mycobacterium bovis subsp bovis AF2122/97
ccggagccgccggccc

SEQ ID NO: 1137293 - RNA, 17 nt, Mycobacterium bovis subsp bovis AF2122/97
ccggagccgccggcccc

SEQ ID NO: 1137294 - RNA, 19 nt, Mycobacterium bovis subsp bovis AF2122/97
ccggagccgcuacguuacg

SEQ ID NO: 1137295 - RNA, 14 nt, Mycobacterium bovis subsp bovis AF2122/97
ccggagcgccgagc

SEQ ID NO: 1137296 - RNA, 19 nt, Mycobacterium bovis subsp bovis AF2122/97
ccggagcgccgagcucggc

SEQ ID NO: 1137297 - RNA, 14 nt, Mycobacterium bovis subsp bovis AF2122/97
ccggacgggugcgg

SEQ ID NO: 1137298 - RNA, 18 nt, Mycobacterium bovis subsp bovis AF2122/97
ccggacgggugcgggccg

SEQ ID NO: 1137299 - RNA, 19 nt, Mycobacterium bovis subsp bovis AF2122/97
ccggacgggugcgggccga

SEQ ID NO: 1137300 - RNA, 14 nt, Mycobacterium bovis subsp bovis AF2122/97
ccggacgucggcgg

SEQ ID NO: 1137301 - RNA, 18 nt, Mycobacterium bovis subsp bovis AF2122/97
ccggacgucggcggccgu

SEQ ID NO: 1137302 - RNA, 12 nt, Mycobacterium bovis subsp bovis AF2122/97
ccggacuaccgc

SEQ ID NO: 1137303 - RNA, 17 nt, Mycobacterium bovis subsp bovis AF2122/97
ccggacuaccgccggcg

SEQ ID NO: 1137304 - RNA, 23 nt, Mycobacterium bovis subsp bovis AF2122/97
ccggacugcgaaaauccgugccg

SEQ ID NO: 1137305 - RNA, 15 nt, Mycobacterium bovis subsp bovis AF2122/97
ccggacugcgccggg

SEQ ID NO: 1137306 - RNA, 21 nt, Mycobacterium bovis subsp bovis AF2122/97
ccggacgcaacacccgggcga

SEQ ID NO: 1137307 - RNA, 16 nt, Mycobacterium bovis subsp bovis AF2122/97
ccggacgcaacacccg

SEQ ID NO: 1137308 - RNA, 18 nt, Mycobacterium bovis subsp bovis AF2122/97
ccggacgcaacacccggg

SEQ ID NO: 1137309 - RNA, 13 nt, Mycobacterium bovis subsp bovis AF2122/97
ccggacgauggcg

SEQ ID NO: 1137310 - RNA, 18 nt, Mycobacterium bovis subsp bovis AF2122/97
ccggacgauggcgucggc

SEQ ID NO: 1137311 - RNA, 21 nt, Mycobacterium bovis subsp bovis AF2122/97
ccggacgauggcgucggccag

SEQ ID NO: 1137312 - RNA, 20 nt, Mycobacterium bovis subsp bovis AF2122/97
ccggacgccaugcccgcacg

SEQ ID NO: 1137313 - RNA, 23 nt, Mycobacterium bovis subsp bovis AF2122/97
ccggacgccaugcccgcacgcuc

SEQ ID NO: 1137314 - RNA, 13 nt, Mycobacterium bovis subsp bovis AF2122/97
ccggacgcccuca

SEQ ID NO: 1137315 - RNA, 12 nt, Mycobacterium bovis subsp bovis AF2122/97
ccggacggcagc

SEQ ID NO: 1137316 - RNA, 14 nt, Mycobacterium bovis subsp bovis AF2122/97
ccggacggcagccg

SEQ ID NO: 1137317 - RNA, 15 nt, Mycobacterium bovis subsp bovis AF2122/97
ccggacggcagccgg

SEQ ID NO: 1137318 - RNA, 22 nt, Mycobacterium bovis subsp bovis AF2122/97
ccggaccgcgacggcgccggca

SEQ ID NO: 1137319 - RNA, 22 nt, Mycobacterium bovis subsp bovis AF2122/97
ccggaccgcggauuccagcgcg

SEQ ID NO: 1137320 - RNA, 21 nt, Mycobacterium bovis subsp bovis AF2122/97
ccggaccgguguggcgcauca

SEQ ID NO: 1137321 - RNA, 22 nt, Mycobacterium bovis subsp bovis AF2122/97
ccggaccgguguggcgcaucag

SEQ ID NO: 1137322 - RNA, 15 nt, Mycobacterium bovis subsp bovis AF2122/97
ccggaccugaccggu

SEQ ID NO: 1137323 - RNA, 18 nt, Mycobacterium bovis subsp bovis AF2122/97
ccggaccugaccgguggc

SEQ ID NO: 1137324 - RNA, 19 nt, Mycobacterium bovis subsp bovis AF2122/97
ccggaccugaccgguggcc

SEQ ID NO: 1137325 - RNA, 17 nt, Mycobacterium bovis subsp bovis AF2122/97
ccggacgaacgccgucg

SEQ ID NO: 1137326 - RNA, 17 nt, Mycobacterium bovis subsp bovis AF2122/97
ccggaccuggguggcgu

SEQ ID NO: 1137327 - RNA, 22 nt, Mycobacterium bovis subsp bovis AF2122/97
ccggaccuucggcggugccacc

SEQ ID NO: 1137328 - RNA, 24 nt, Mycobacterium bovis subsp bovis AF2122/97
ccggacgaacgccgucgacgcggc

SEQ ID NO: 1137329 - RNA, 13 nt, Mycobacterium bovis subsp bovis AF2122/97
ccggacgaccgga

SEQ ID NO: 1137330 - RNA, 18 nt, Mycobacterium bovis subsp bovis AF2122/97
ccggacccauuggaccga

SEQ ID NO: 1137331 - RNA, 16 nt, Mycobacterium bovis subsp bovis AF2122/97
ccggacccacccgcac

SEQ ID NO: 1137332 - RNA, 22 nt, Mycobacterium bovis subsp bovis AF2122/97
ccggacccacccgcaccgccgg

SEQ ID NO: 1137333 - RNA, 20 nt, Mycobacterium bovis subsp bovis AF2122/97
ccggaccaucagcgucgacg

SEQ ID NO: 1137334 - RNA, 16 nt, Mycobacterium bovis subsp bovis AF2122/97
ccggaccaucgacaac

SEQ ID NO: 1137335 - RNA, 19 nt, Mycobacterium bovis subsp bovis AF2122/97
ccggacccgccggguccgc

SEQ ID NO: 1137336 - RNA, 20 nt, Mycobacterium bovis subsp bovis AF2122/97
ccggacccgccggguccgcc

SEQ ID NO: 1137337 - RNA, 18 nt, Mycobacterium bovis subsp bovis AF2122/97
ccggacccggucgccggg

SEQ ID NO: 1137338 - RNA, 15 nt, Mycobacterium bovis subsp bovis AF2122/97
ccggacccggugcac

SEQ ID NO: 1137339 - RNA, 11 nt, Mycobacterium bovis subsp bovis AF2122/97
ccggaccaccg

SEQ ID NO: 1137340 - RNA, 14 nt, Mycobacterium bovis subsp bovis AF2122/97
ccggaccaccgccg

SEQ ID NO: 1137341 - RNA, 13 nt, Mycobacterium bovis subsp bovis AF2122/97
ccggaccagagcc

SEQ ID NO: 1137342 - RNA, 14 nt, Mycobacterium bovis subsp bovis AF2122/97
ccggacaaacaucg

SEQ ID NO: 1137343 - RNA, 18 nt, Mycobacterium bovis subsp bovis AF2122/97
ccggacaaagcugcucgu

SEQ ID NO: 1137344 - RNA, 22 nt, Mycobacterium bovis subsp bovis AF2122/97
ccggacaaagcugcucgucggc

SEQ ID NO: 1137345 - RNA, 18 nt, Mycobacterium bovis subsp bovis AF2122/97
ccggaauauggcggccgg

SEQ ID NO: 1137346 - RNA, 18 nt, Mycobacterium bovis subsp bovis AF2122/97
ccggaauccccaagcccg

SEQ ID NO: 1137347 - RNA, 13 nt, Mycobacterium bovis subsp bovis AF2122/97
ccggaaucgcccg

SEQ ID NO: 1137348 - RNA, 15 nt, Mycobacterium bovis subsp bovis AF2122/97
ccggaaucgcccggg

SEQ ID NO: 1137349 - RNA, 19 nt, Mycobacterium bovis subsp bovis AF2122/97
ccggaauccccccugucgc

SEQ ID NO: 1137350 - RNA, 22 nt, Mycobacterium bovis subsp bovis AF2122/97
ccggaacggguuggcgaucauc

SEQ ID NO: 1137351 - RNA, 13 nt, Mycobacterium bovis subsp bovis AF2122/97
ccggaaucggcgg

SEQ ID NO: 1137352 - RNA, 19 nt, Mycobacterium bovis subsp bovis AF2122/97
ccggaaucgucgcggccgu

SEQ ID NO: 1137353 - RNA, 22 nt, Mycobacterium bovis subsp bovis AF2122/97
ccggaaucgucgcggccgucgc

SEQ ID NO: 1137354 - RNA, 17 nt, Mycobacterium bovis subsp bovis AF2122/97
ccggacauagccgcgcu

SEQ ID NO: 1137355 - RNA, 13 nt, Mycobacterium bovis subsp bovis AF2122/97
ccggacagggcgg

SEQ ID NO: 1137356 - RNA, 15 nt, Mycobacterium bovis subsp bovis AF2122/97
ccggacagggcggcg

SEQ ID NO: 1137357 - RNA, 17 nt, Mycobacterium bovis subsp bovis AF2122/97
ccggacagggcggcgag

SEQ ID NO: 1137358 - RNA, 18 nt, Mycobacterium bovis subsp bovis AF2122/97
ccggacagggugggggca

SEQ ID NO: 1137359 - RNA, 13 nt, Mycobacterium bovis subsp bovis AF2122/97
ccggacagcucgc

SEQ ID NO: 1137360 - RNA, 21 nt, Mycobacterium bovis subsp bovis AF2122/97
ccggacaaccuggggccacca

SEQ ID NO: 1137361 - RNA, 16 nt, Mycobacterium bovis subsp bovis AF2122/97
ccggaaggcucgccag

SEQ ID NO: 1137362 - RNA, 16 nt, Mycobacterium bovis subsp bovis AF2122/97
ccggaauacgcgccgc

SEQ ID NO: 1137363 - RNA, 20 nt, Mycobacterium bovis subsp bovis AF2122/97
ccggaauacgcgccgccggc

SEQ ID NO: 1137364 - RNA, 24 nt, Mycobacterium bovis subsp bovis AF2122/97
ccggaauacgcgccgccggcucgc

SEQ ID NO: 1137365 - RNA, 14 nt, Mycobacterium bovis subsp bovis AF2122/97
ccggaagauccggg

SEQ ID NO: 1137366 - RNA, 23 nt, Mycobacterium bovis subsp bovis AF2122/97
ccggaacugcgcaacaccgugca

SEQ ID NO: 1137367 - RNA, 12 nt, Mycobacterium bovis subsp bovis AF2122/97
ccggaagcgccg

SEQ ID NO: 1137368 - RNA, 13 nt, Mycobacterium bovis subsp bovis AF2122/97
ccggaagcgccgg

SEQ ID NO: 1137369 - RNA, 14 nt, Mycobacterium bovis subsp bovis AF2122/97
ccggaagcggcguu

SEQ ID NO: 1137370 - RNA, 17 nt, Mycobacterium bovis subsp bovis AF2122/97
ccggaaccagccgcgga

SEQ ID NO: 1137371 - RNA, 22 nt, Mycobacterium bovis subsp bovis AF2122/97
ccggaacccgagccgguaaccg

SEQ ID NO: 1137372 - RNA, 23 nt, Mycobacterium bovis subsp bovis AF2122/97
ccggaaccaccaguaccaccggc

SEQ ID NO: 1137373 - RNA, 16 nt, Mycobacterium bovis subsp bovis AF2122/97
ccggaaccagccgcgg

SEQ ID NO: 1137374 - RNA, 20 nt, Mycobacterium bovis subsp bovis AF2122/97
ccggaacaccgacgucaggc

SEQ ID NO: 1137375 - RNA, 20 nt, Mycobacterium bovis subsp bovis AF2122/97
ccggaaauuccggcgcggcc

SEQ ID NO: 1137376 - RNA, 22 nt, Mycobacterium bovis subsp bovis AF2122/97
ccggaaauuccggcgcggccgg

SEQ ID NO: 1137377 - RNA, 14 nt, Mycobacterium bovis subsp bovis AF2122/97
ccggaacgcccggc

SEQ ID NO: 1137378 - RNA, 13 nt, Mycobacterium bovis subsp bovis AF2122/97
ccggaacgccguc

SEQ ID NO: 1137379 - RNA, 13 nt, Mycobacterium bovis subsp bovis AF2122/97
ccggaaccggcgu

SEQ ID NO: 1137380 - RNA, 14 nt, Mycobacterium bovis subsp bovis AF2122/97
ccggaaccggcgug

SEQ ID NO: 1137381 - RNA, 12 nt, Mycobacterium bovis subsp bovis AF2122/97
ccgcugccgccc

SEQ ID NO: 1137382 - RNA, 16 nt, Mycobacterium bovis subsp bovis AF2122/97
ccgcugccgcccgcgc

SEQ ID NO: 1137383 - RNA, 19 nt, Mycobacterium bovis subsp bovis AF2122/97
ccgcugccgcccuugccgc

SEQ ID NO: 1137384 - RNA, 15 nt, Mycobacterium bovis subsp bovis AF2122/97
ccgcugccaucgccu

SEQ ID NO: 1137385 - RNA, 14 nt, Mycobacterium bovis subsp bovis AF2122/97
ccgcugccaucggc

SEQ ID NO: 1137386 - RNA, 22 nt, Mycobacterium bovis subsp bovis AF2122/97
ccgcugccaucggcaccagcgc

SEQ ID NO: 1137387 - RNA, 18 nt, Mycobacterium bovis subsp bovis AF2122/97
ccgcugccgaagcggcca

SEQ ID NO: 1137388 - RNA, 20 nt, Mycobacterium bovis subsp bovis AF2122/97
ccgcugccgaagcggccacc

SEQ ID NO: 1137389 - RNA, 21 nt, Mycobacterium bovis subsp bovis AF2122/97
ccgcugccgaagcggccaccg

SEQ ID NO: 1137390 - RNA, 22 nt, Mycobacterium bovis subsp bovis AF2122/97
ccgcugcggcggcuuuggccgc

SEQ ID NO: 1137391 - RNA, 22 nt, Mycobacterium bovis subsp bovis AF2122/97
ccgcugcagugguaccggcgcc

SEQ ID NO: 1137392 - RNA, 21 nt, Mycobacterium bovis subsp bovis AF2122/97
ccgcugccgaucaguccggcg

SEQ ID NO: 1137393 - RNA, 23 nt, Mycobacterium bovis subsp bovis AF2122/97
ccgcugccgcccuugccgcccgc

SEQ ID NO: 1137394 - RNA, 22 nt, Mycobacterium bovis subsp bovis AF2122/97
ccgcugcggguagccgucgauc

SEQ ID NO: 1137395 - RNA, 19 nt, Mycobacterium bovis subsp bovis AF2122/97
ccgcugcggugccggcccu

SEQ ID NO: 1137396 - RNA, 17 nt, Mycobacterium bovis subsp bovis AF2122/97
ccgcuggccagcacacc

SEQ ID NO: 1137397 - RNA, 16 nt, Mycobacterium bovis subsp bovis AF2122/97
ccggaaagcucucggc

SEQ ID NO: 1137398 - RNA, 22 nt, Mycobacterium bovis subsp bovis AF2122/97
ccggaaagcucucggcacccgg

SEQ ID NO: 1137399 - RNA, 23 nt, Mycobacterium bovis subsp bovis AF2122/97
ccgcuggcauaucccuugccguc

SEQ ID NO: 1137400 - RNA, 15 nt, Mycobacterium bovis subsp bovis AF2122/97
ccgcuggaucgacuu

SEQ ID NO: 1137401 - RNA, 20 nt, Mycobacterium bovis subsp bovis AF2122/97
ccgcuggagaucacgccgac

SEQ ID NO: 1137402 - RNA, 15 nt, Mycobacterium bovis subsp bovis AF2122/97
ccgcuggaucgcgua

SEQ ID NO: 1137403 - RNA, 22 nt, Mycobacterium bovis subsp bovis AF2122/97
ccgcguagcuggucccacaccu

SEQ ID NO: 1137404 - RNA, 15 nt, Mycobacterium bovis subsp bovis AF2122/97
ccgcguagagcagca

SEQ ID NO: 1137405 - RNA, 17 nt, Mycobacterium bovis subsp bovis AF2122/97
ccgcguagugcuccguc

SEQ ID NO: 1137406 - RNA, 20 nt, Mycobacterium bovis subsp bovis AF2122/97
ccgcguagguggccagcgcg

SEQ ID NO: 1137407 - RNA, 16 nt, Mycobacterium bovis subsp bovis AF2122/97
ccgcguagguggccag

SEQ ID NO: 1137408 - RNA, 16 nt, Mycobacterium bovis subsp bovis AF2122/97
ccgcgucaccggaggc

SEQ ID NO: 1137409 - RNA, 20 nt, Mycobacterium bovis subsp bovis AF2122/97
ccgcgucaccggaggccgcc

SEQ ID NO: 1137410 - RNA, 19 nt, Mycobacterium bovis subsp bovis AF2122/97
ccgcgucaaccgaucgguc

SEQ ID NO: 1137411 - RNA, 17 nt, Mycobacterium bovis subsp bovis AF2122/97
ccgcguaugccaggacu

SEQ ID NO: 1137412 - RNA, 18 nt, Mycobacterium bovis subsp bovis AF2122/97
ccgcgucacuucccggau

SEQ ID NO: 1137413 - RNA, 18 nt, Mycobacterium bovis subsp bovis AF2122/97
ccgcgucgaauuccggcu

SEQ ID NO: 1137414 - RNA, 21 nt, Mycobacterium bovis subsp bovis AF2122/97
ccgcgucgaacugggcgcccg

SEQ ID NO: 1137415 - RNA, 17 nt, Mycobacterium bovis subsp bovis AF2122/97
ccgcgucauucaccgcg

SEQ ID NO: 1137416 - RNA, 19 nt, Mycobacterium bovis subsp bovis AF2122/97
ccgcgucaguccucaucga

SEQ ID NO: 1137417 - RNA, 20 nt, Mycobacterium bovis subsp bovis AF2122/97
ccgcguccgccaauggcgcg

SEQ ID NO: 1137418 - RNA, 23 nt, Mycobacterium bovis subsp bovis AF2122/97
ccgcguccagaccguagcggccg

SEQ ID NO: 1137419 - RNA, 18 nt, Mycobacterium bovis subsp bovis AF2122/97
ccgcgguggaccgggcaa

SEQ ID NO: 1137420 - RNA, 19 nt, Mycobacterium bovis subsp bovis AF2122/97
ccgcgguguggcuugcguc

SEQ ID NO: 1137421 - RNA, 21 nt, Mycobacterium bovis subsp bovis AF2122/97
ccgcgguggaugcgaugcgcg

SEQ ID NO: 1137422 - RNA, 17 nt, Mycobacterium bovis subsp bovis AF2122/97
ccgcgguguauccgacg

SEQ ID NO: 1137423 - RNA, 15 nt, Mycobacterium bovis subsp bovis AF2122/97
ccgcgguggcggcga

SEQ ID NO: 1137424 - RNA, 16 nt, Mycobacterium bovis subsp bovis AF2122/97
ccgcggugccugcagc

SEQ ID NO: 1137425 - RNA, 18 nt, Mycobacterium bovis subsp bovis AF2122/97
ccgcgguguucguggccg

SEQ ID NO: 1137426 - RNA, 20 nt, Mycobacterium bovis subsp bovis AF2122/97
ccgcgguguucguggccgac

SEQ ID NO: 1137427 - RNA, 22 nt, Mycobacterium bovis subsp bovis AF2122/97
ccgcgguguuggacgcgggccg

SEQ ID NO: 1137428 - RNA, 22 nt, Mycobacterium bovis subsp bovis AF2122/97
ccgcgguugugcugggugccgc

SEQ ID NO: 1137429 - RNA, 16 nt, Mycobacterium bovis subsp bovis AF2122/97
ccgcguagaccaguga

SEQ ID NO: 1137430 - RNA, 19 nt, Mycobacterium bovis subsp bovis AF2122/97
ccgcguagaacccaggccg

SEQ ID NO: 1137431 - RNA, 15 nt, Mycobacterium bovis subsp bovis AF2122/97
ccgcguagaccagug

SEQ ID NO: 1137432 - RNA, 22 nt, Mycobacterium bovis subsp bovis AF2122/97
ccgcgguuuggcgacgucgaca

SEQ ID NO: 1137433 - RNA, 22 nt, Mycobacterium bovis subsp bovis AF2122/97
ccgcguaaaggccuugggcggc

SEQ ID NO: 1137434 - RNA, 14 nt, Mycobacterium bovis subsp bovis AF2122/97
ccgcguacaggccg

SEQ ID NO: 1137435 - RNA, 23 nt, Mycobacterium bovis subsp bovis AF2122/97
ccgcguaccaauucccgcgcggc

SEQ ID NO: 1137436 - RNA, 15 nt, Mycobacterium bovis subsp bovis AF2122/97
ccgcgggggcggccg

SEQ ID NO: 1137437 - RNA, 17 nt, Mycobacterium bovis subsp bovis AF2122/97
ccgcgggggcggccggc

SEQ ID NO: 1137438 - RNA, 17 nt, Mycobacterium bovis subsp bovis AF2122/97
ccgcgggggaccgcccg

SEQ ID NO: 1137439 - RNA, 18 nt, Mycobacterium bovis subsp bovis AF2122/97
ccgcgggggaccgcccga

SEQ ID NO: 1137440 - RNA, 12 nt, Mycobacterium bovis subsp bovis AF2122/97
ccgcgggucccg

SEQ ID NO: 1137441 - RNA, 13 nt, Mycobacterium bovis subsp bovis AF2122/97
ccgcgggucgcgc

SEQ ID NO: 1137442 - RNA, 22 nt, Mycobacterium bovis subsp bovis AF2122/97
ccgcgcuggugauucgcagccg

SEQ ID NO: 1137443 - RNA, 16 nt, Mycobacterium bovis subsp bovis AF2122/97
ccgcgggucccggccg

SEQ ID NO: 1137444 - RNA, 14 nt, Mycobacterium bovis subsp bovis AF2122/97
ccgcgguccuggug

SEQ ID NO: 1137445 - RNA, 16 nt, Mycobacterium bovis subsp bovis AF2122/97
ccgcggugccccggau

SEQ ID NO: 1137446 - RNA, 14 nt, Mycobacterium bovis subsp bovis AF2122/97
ccgcggugcccguc

SEQ ID NO: 1137447 - RNA, 20 nt, Mycobacterium bovis subsp bovis AF2122/97
ccgcggugacgcaacaucgg

SEQ ID NO: 1137448 - RNA, 18 nt, Mycobacterium bovis subsp bovis AF2122/97
ccgcggugacgccagccu

SEQ ID NO: 1137449 - RNA, 21 nt, Mycobacterium bovis subsp bovis AF2122/97
ccgcggugacucggccuccgc

SEQ ID NO: 1137450 - RNA, 16 nt, Mycobacterium bovis subsp bovis AF2122/97
ccgcggucguuggcga

SEQ ID NO: 1137451 - RNA, 21 nt, Mycobacterium bovis subsp bovis AF2122/97
ccgcggucuucuucaccgccu

SEQ ID NO: 1137452 - RNA, 14 nt, Mycobacterium bovis subsp bovis AF2122/97
ccgcggugacccgg

SEQ ID NO: 1137453 - RNA, 15 nt, Mycobacterium bovis subsp bovis AF2122/97
ccgcggucugcgcgu

SEQ ID NO: 1137454 - RNA, 14 nt, Mycobacterium bovis subsp bovis AF2122/97
ccgcggucggcgug

SEQ ID NO: 1137455 - RNA, 16 nt, Mycobacterium bovis subsp bovis AF2122/97
ccgcggucggcgugca

SEQ ID NO: 1137456 - RNA, 12 nt, Mycobacterium bovis subsp bovis AF2122/97
ccgcggucgcca

SEQ ID NO: 1137457 - RNA, 19 nt, Mycobacterium bovis subsp bovis AF2122/97
ccgcggucggccaccaacu

SEQ ID NO: 1137458 - RNA, 15 nt, Mycobacterium bovis subsp bovis AF2122/97
ccgcggucggcgacg

SEQ ID NO: 1137459 - RNA, 19 nt, Mycobacterium bovis subsp bovis AF2122/97
ccgcggucggcgacguaga

SEQ ID NO: 1137460 - RNA, 22 nt, Mycobacterium bovis subsp bovis AF2122/97
ccgcgcugcagcacggcuucgc

SEQ ID NO: 1137461 - RNA, 14 nt, Mycobacterium bovis subsp bovis AF2122/97
ccgcgcugcgacgu

SEQ ID NO: 1137462 - RNA, 20 nt, Mycobacterium bovis subsp bovis AF2122/97
ccgcgcuggacaacggcggu

SEQ ID NO: 1137463 - RNA, 16 nt, Mycobacterium bovis subsp bovis AF2122/97
ccgcgcuggucagccg

SEQ ID NO: 1137464 - RNA, 20 nt, Mycobacterium bovis subsp bovis AF2122/97
ccgcgcuggucagccgugcc

SEQ ID NO: 1137465 - RNA, 20 nt, Mycobacterium bovis subsp bovis AF2122/97
ccgcgcuggugauucgcagc

SEQ ID NO: 1137466 - RNA, 18 nt, Mycobacterium bovis subsp bovis AF2122/97
ccgcgcuguugccaucga

SEQ ID NO: 1137467 - RNA, 24 nt, Mycobacterium bovis subsp bovis AF2122/97
ccgcgcuguugccaucgacgccgc

SEQ ID NO: 1137468 - RNA, 23 nt, Mycobacterium bovis subsp bovis AF2122/97
ccgcgcuucacagccaccagccg

SEQ ID NO: 1137469 - RNA, 20 nt, Mycobacterium bovis subsp bovis AF2122/97
ccgcgggcggcaucgccgag

SEQ ID NO: 1137470 - RNA, 15 nt, Mycobacterium bovis subsp bovis AF2122/97
ccgcgggggaccgcc

SEQ ID NO: 1137471 - RNA, 18 nt, Mycobacterium bovis subsp bovis AF2122/97
ccgcggggcagcgggccg

SEQ ID NO: 1137472 - RNA, 21 nt, Mycobacterium bovis subsp bovis AF2122/97
ccgcgcuggugauucgcagcc

SEQ ID NO: 1137473 - RNA, 17 nt, Mycobacterium bovis subsp bovis AF2122/97
ccgcucggccgccgggu

SEQ ID NO: 1137474 - RNA, 16 nt, Mycobacterium bovis subsp bovis AF2122/97
ccgcucggccgcagcc

SEQ ID NO: 1137475 - RNA, 17 nt, Mycobacterium bovis subsp bovis AF2122/97
ccgcucggccgcagcca

SEQ ID NO: 1137476 - RNA, 19 nt, Mycobacterium bovis subsp bovis AF2122/97
ccgcugaacaccgugggcg

SEQ ID NO: 1137477 - RNA, 21 nt, Mycobacterium bovis subsp bovis AF2122/97
ccgcugaacaccgugggcgga

SEQ ID NO: 1137478 - RNA, 14 nt, Mycobacterium bovis subsp bovis AF2122/97
ccgcucggcgcgcg

SEQ ID NO: 1137479 - RNA, 17 nt, Mycobacterium bovis subsp bovis AF2122/97
ccgcucggcgcgcgggu

SEQ ID NO: 1137480 - RNA, 23 nt, Mycobacterium bovis subsp bovis AF2122/97
ccgcugaacucaacgggaccgau

SEQ ID NO: 1137481 - RNA, 21 nt, Mycobacterium bovis subsp bovis AF2122/97
ccgcugaaguggcacaagcug

SEQ ID NO: 1137482 - RNA, 19 nt, Mycobacterium bovis subsp bovis AF2122/97
ccgcucgcccgccgccacc

SEQ ID NO: 1137483 - RNA, 16 nt, Mycobacterium bovis subsp bovis AF2122/97
ccgcucgcaggccggc

SEQ ID NO: 1137484 - RNA, 23 nt, Mycobacterium bovis subsp bovis AF2122/97
ccgcucgagcuacgacgaguggu

SEQ ID NO: 1137485 - RNA, 16 nt, Mycobacterium bovis subsp bovis AF2122/97
ccgcucgcgagcggcu

SEQ ID NO: 1137486 - RNA, 18 nt, Mycobacterium bovis subsp bovis AF2122/97
ccgcucgccgguaggcgg

SEQ ID NO: 1137487 - RNA, 21 nt, Mycobacterium bovis subsp bovis AF2122/97
ccgcucgcaggccggcggcgg

SEQ ID NO: 1137488 - RNA, 21 nt, Mycobacterium bovis subsp bovis AF2122/97
ccgcugauguacccggcgacg

SEQ ID NO: 1137489 - RNA, 19 nt, Mycobacterium bovis subsp bovis AF2122/97
ccgcugaucugccgccgcg

SEQ ID NO: 1137490 - RNA, 23 nt, Mycobacterium bovis subsp bovis AF2122/97
ccgcugaucaacagaccuagcac

SEQ ID NO: 1137491 - RNA, 22 nt, Mycobacterium bovis subsp bovis AF2122/97
ccgcugagcccugcgccucggc

SEQ ID NO: 1137492 - RNA, 21 nt, Mycobacterium bovis subsp bovis AF2122/97
ccgcugaccccggcagcgccc

SEQ ID NO: 1137493 - RNA, 12 nt, Mycobacterium bovis subsp bovis AF2122/97
ccgcugaccgca

SEQ ID NO: 1137494 - RNA, 15 nt, Mycobacterium bovis subsp bovis AF2122/97
ccgcugaccgcaacg

SEQ ID NO: 1137495 - RNA, 19 nt, Mycobacterium bovis subsp bovis AF2122/97
ccgcugaccgcaacgcgua

SEQ ID NO: 1137496 - RNA, 24 nt, Mycobacterium bovis subsp bovis AF2122/97
ccgcugccacccaucgcacggaug

SEQ ID NO: 1137497 - RNA, 13 nt, Mycobacterium bovis subsp bovis AF2122/97
ccgcugccagccg

SEQ ID NO: 1137498 - RNA, 15 nt, Mycobacterium bovis subsp bovis AF2122/97
ccgcugccagggugc

SEQ ID NO: 1137499 - RNA, 23 nt, Mycobacterium bovis subsp bovis AF2122/97
ccgcugcauccgcagcaccaagg

SEQ ID NO: 1137500 - RNA, 22 nt, Mycobacterium bovis subsp bovis AF2122/97
ccgcugcaacggagcgagcuca

SEQ ID NO: 1137501 - RNA, 13 nt, Mycobacterium bovis subsp bovis AF2122/97
ccgcguuugcgaa

SEQ ID NO: 1137502 - RNA, 16 nt, Mycobacterium bovis subsp bovis AF2122/97
ccgcgucugcucggcg

SEQ ID NO: 1137503 - RNA, 17 nt, Mycobacterium bovis subsp bovis AF2122/97
ccgcgucugcucggcgg

SEQ ID NO: 1137504 - RNA, 14 nt, Mycobacterium bovis subsp bovis AF2122/97
ccgcgucuggacgc

SEQ ID NO: 1137505 - RNA, 23 nt, Mycobacterium bovis subsp bovis AF2122/97
ccgcgucuuggugcgcgucagcc

SEQ ID NO: 1137506 - RNA, 23 nt, Mycobacterium bovis subsp bovis AF2122/97
ccgcuaacgcaccugcgcgcggc

SEQ ID NO: 1137507 - RNA, 13 nt, Mycobacterium bovis subsp bovis AF2122/97
ccgcgucgggccg

SEQ ID NO: 1137508 - RNA, 15 nt, Mycobacterium bovis subsp bovis AF2122/97
ccgcgucgggccgca

SEQ ID NO: 1137509 - RNA, 22 nt, Mycobacterium bovis subsp bovis AF2122/97
ccgcgucuacgucguccagcac

SEQ ID NO: 1137510 - RNA, 18 nt, Mycobacterium bovis subsp bovis AF2122/97
ccgcgucucggugcagca

SEQ ID NO: 1137511 - RNA, 17 nt, Mycobacterium bovis subsp bovis AF2122/97
ccgcgucguagccacgc

SEQ ID NO: 1137512 - RNA, 19 nt, Mycobacterium bovis subsp bovis AF2122/97
ccgcgucguagccacgcau

SEQ ID NO: 1137513 - RNA, 23 nt, Mycobacterium bovis subsp bovis AF2122/97
ccgcgucguagccacgcaugggc

SEQ ID NO: 1137514 - RNA, 14 nt, Mycobacterium bovis subsp bovis AF2122/97
ccgcuccgagcacc

SEQ ID NO: 1137515 - RNA, 20 nt, Mycobacterium bovis subsp bovis AF2122/97
ccgcuccgccgucgccgccg

SEQ ID NO: 1137516 - RNA, 18 nt, Mycobacterium bovis subsp bovis AF2122/97
ccgcucgacggcccgccg

SEQ ID NO: 1137517 - RNA, 20 nt, Mycobacterium bovis subsp bovis AF2122/97
ccgcucgacggcccgccguc

SEQ ID NO: 1137518 - RNA, 15 nt, Mycobacterium bovis subsp bovis AF2122/97
ccgcucgagcagcgc

SEQ ID NO: 1137519 - RNA, 21 nt, Mycobacterium bovis subsp bovis AF2122/97
ccgcucgagcuacgacgagug

SEQ ID NO: 1137520 - RNA, 13 nt, Mycobacterium bovis subsp bovis AF2122/97
ccgcuccugcucg

SEQ ID NO: 1137521 - RNA, 20 nt, Mycobacterium bovis subsp bovis AF2122/97
ccgcucccgugcuggcgccg

SEQ ID NO: 1137522 - RNA, 20 nt, Mycobacterium bovis subsp bovis AF2122/97
ccgcuacguuacgccgagau

SEQ ID NO: 1137523 - RNA, 22 nt, Mycobacterium bovis subsp bovis AF2122/97
ccgcuaccgucaguagccacgc

SEQ ID NO: 1137524 - RNA, 17 nt, Mycobacterium bovis subsp bovis AF2122/97
ccgcuacgcgcgcucgc

SEQ ID NO: 1137525 - RNA, 19 nt, Mycobacterium bovis subsp bovis AF2122/97
ccgcuacgcgcgcucgcuc

SEQ ID NO: 1137526 - RNA, 16 nt, Mycobacterium bovis subsp bovis AF2122/97
ccgcuaccccagccgg

SEQ ID NO: 1137527 - RNA, 20 nt, Mycobacterium bovis subsp bovis AF2122/97
ccgcuaccccagccggcagc

SEQ ID NO: 1137528 - RNA, 18 nt, Mycobacterium bovis subsp bovis AF2122/97
ccgcuacccccgauggcg

SEQ ID NO: 1137529 - RNA, 12 nt, Mycobacterium bovis subsp bovis AF2122/97
ccgcuaccgcac

SEQ ID NO: 1137530 - RNA, 14 nt, Mycobacterium bovis subsp bovis AF2122/97
ccgcuaccagcugg

SEQ ID NO: 1137531 - RNA, 18 nt, Mycobacterium bovis subsp bovis AF2122/97
ccgcuaccagcugggcga

SEQ ID NO: 1137532 - RNA, 13 nt, Mycobacterium bovis subsp bovis AF2122/97
ccgagcagggccg

SEQ ID NO: 1137533 - RNA, 15 nt, Mycobacterium bovis subsp bovis AF2122/97
ccgagcagggccggc

SEQ ID NO: 1137534 - RNA, 17 nt, Mycobacterium bovis subsp bovis AF2122/97
ccgagcagcccgcggau

SEQ ID NO: 1137535 - RNA, 18 nt, Mycobacterium bovis subsp bovis AF2122/97
ccgagcagcuucucggcg

SEQ ID NO: 1137536 - RNA, 21 nt, Mycobacterium bovis subsp bovis AF2122/97
ccgagcagcagaaacggcgac

SEQ ID NO: 1137537 - RNA, 17 nt, Mycobacterium bovis subsp bovis AF2122/97
ccgagcagacgcggaau

SEQ ID NO: 1137538 - RNA, 19 nt, Mycobacterium bovis subsp bovis AF2122/97
ccgagcagacacagaaucg

SEQ ID NO: 1137539 - RNA, 14 nt, Mycobacterium bovis subsp bovis AF2122/97
ccgagcagacgcgg

SEQ ID NO: 1137540 - RNA, 16 nt, Mycobacterium bovis subsp bovis AF2122/97
ccgagcacucggccac

SEQ ID NO: 1137541 - RNA, 19 nt, Mycobacterium bovis subsp bovis AF2122/97
ccgagcacugacgggccgu

SEQ ID NO: 1137542 - RNA, 20 nt, Mycobacterium bovis subsp bovis AF2122/97
ccgagcagacacagaaucgc

SEQ ID NO: 1137543 - RNA, 20 nt, Mycobacterium bovis subsp bovis AF2122/97
ccgagcagacgcaaaaucgc

SEQ ID NO: 1137544 - RNA, 17 nt, Mycobacterium bovis subsp bovis AF2122/97
ccgagcagacgcagaau

SEQ ID NO: 1137545 - RNA, 19 nt, Mycobacterium bovis subsp bovis AF2122/97
ccgagcagacgcagaaucg

SEQ ID NO: 1137546 - RNA, 22 nt, Mycobacterium bovis subsp bovis AF2122/97
ccgagcacgggcagauacgcca

SEQ ID NO: 1137547 - RNA, 17 nt, Mycobacterium bovis subsp bovis AF2122/97
ccgagcacgacgacguc

SEQ ID NO: 1137548 - RNA, 13 nt, Mycobacterium bovis subsp bovis AF2122/97
ccgagcaccgggc

SEQ ID NO: 1137549 - RNA, 19 nt, Mycobacterium bovis subsp bovis AF2122/97
ccgcagcgaccaccgucac

SEQ ID NO: 1137550 - RNA, 12 nt, Mycobacterium bovis subsp bovis AF2122/97
ccgcagcucgcc

SEQ ID NO: 1137551 - RNA, 13 nt, Mycobacterium bovis subsp bovis AF2122/97
ccgcagcgccacc

SEQ ID NO: 1137552 - RNA, 17 nt, Mycobacterium bovis subsp bovis AF2122/97
ccgcagcgccacccgau

SEQ ID NO: 1137553 - RNA, 13 nt, Mycobacterium bovis subsp bovis AF2122/97
ccgcagcugcgga

SEQ ID NO: 1137554 - RNA, 14 nt, Mycobacterium bovis subsp bovis AF2122/97
ccgcagcuguggcc

SEQ ID NO: 1137555 - RNA, 16 nt, Mycobacterium bovis subsp bovis AF2122/97
ccgagcaucagauucg

SEQ ID NO: 1137556 - RNA, 17 nt, Mycobacterium bovis subsp bovis AF2122/97
ccgagcagguuccgcac

SEQ ID NO: 1137557 - RNA, 18 nt, Mycobacterium bovis subsp bovis AF2122/97
ccgagcagguuccgcacg

SEQ ID NO: 1137558 - RNA, 21 nt, Mycobacterium bovis subsp bovis AF2122/97
ccgagcaguggaguauccggc

SEQ ID NO: 1137559 - RNA, 16 nt, Mycobacterium bovis subsp bovis AF2122/97
ccgcagcccgccgggc

SEQ ID NO: 1137560 - RNA, 11 nt, Mycobacterium bovis subsp bovis AF2122/97
ccgcagccugc

SEQ ID NO: 1137561 - RNA, 21 nt, Mycobacterium bovis subsp bovis AF2122/97
ccgcagccgcgaguccaggcu

SEQ ID NO: 1137562 - RNA, 15 nt, Mycobacterium bovis subsp bovis AF2122/97
ccgcagucccagcac

SEQ ID NO: 1137563 - RNA, 14 nt, Mycobacterium bovis subsp bovis AF2122/97
ccgcaguccggggc

SEQ ID NO: 1137564 - RNA, 17 nt, Mycobacterium bovis subsp bovis AF2122/97
ccgcaguccggggcgca

SEQ ID NO: 1137565 - RNA, 14 nt, Mycobacterium bovis subsp bovis AF2122/97
ccgcaguggucggc

SEQ ID NO: 1137566 - RNA, 15 nt, Mycobacterium bovis subsp bovis AF2122/97
ccgcaguggucggcu

SEQ ID NO: 1137567 - RNA, 23 nt, Mycobacterium bovis subsp bovis AF2122/97
ccgcaguggucggcuccgcgacg

SEQ ID NO: 1137568 - RNA, 16 nt, Mycobacterium bovis subsp bovis AF2122/97
ccgcagucgcggcaga

SEQ ID NO: 1137569 - RNA, 17 nt, Mycobacterium bovis subsp bovis AF2122/97
ccgcagucgcggcagac

SEQ ID NO: 1137570 - RNA, 22 nt, Mycobacterium bovis subsp bovis AF2122/97
ccgcagucgcuggguggcgggc

SEQ ID NO: 1137571 - RNA, 22 nt, Mycobacterium bovis subsp bovis AF2122/97
ccgcaguuauccgguguccugg

SEQ ID NO: 1137572 - RNA, 15 nt, Mycobacterium bovis subsp bovis AF2122/97
ccgcauaaaucgggg

SEQ ID NO: 1137573 - RNA, 20 nt, Mycobacterium bovis subsp bovis AF2122/97
ccgcauaggccccgccagcg

SEQ ID NO: 1137574 - RNA, 21 nt, Mycobacterium bovis subsp bovis AF2122/97
ccgcauaggccccgccagcgc

SEQ ID NO: 1137575 - RNA, 23 nt, Mycobacterium bovis subsp bovis AF2122/97
ccgcauacgcggcuuugacgccc

SEQ ID NO: 1137576 - RNA, 20 nt, Mycobacterium bovis subsp bovis AF2122/97
ccgcauaaggcccaugccgu

SEQ ID NO: 1137577 - RNA, 22 nt, Mycobacterium bovis subsp bovis AF2122/97
ccgcauaacgcgaacccgcgag

SEQ ID NO: 1137578 - RNA, 19 nt, Mycobacterium bovis subsp bovis AF2122/97
ccgcauaccuaacgagccg

SEQ ID NO: 1137579 - RNA, 17 nt, Mycobacterium bovis subsp bovis AF2122/97
ccgcauccagccgugcg

SEQ ID NO: 1137580 - RNA, 18 nt, Mycobacterium bovis subsp bovis AF2122/97
ccgcauauugcggcgccg

SEQ ID NO: 1137581 - RNA, 20 nt, Mycobacterium bovis subsp bovis AF2122/97
ccgcaucauagacagggccg

SEQ ID NO: 1137582 - RNA, 15 nt, Mycobacterium bovis subsp bovis AF2122/97
ccgcaucaugucgaa

SEQ ID NO: 1137583 - RNA, 19 nt, Mycobacterium bovis subsp bovis AF2122/97
ccgcagcuuggccucagcc

SEQ ID NO: 1137584 - RNA, 20 nt, Mycobacterium bovis subsp bovis AF2122/97
ccgcagcuuggccucagcca

SEQ ID NO: 1137585 - RNA, 15 nt, Mycobacterium bovis subsp bovis AF2122/97
ccgcaggucgcacca

SEQ ID NO: 1137586 - RNA, 16 nt, Mycobacterium bovis subsp bovis AF2122/97
ccgcaggucgcuggcc

SEQ ID NO: 1137587 - RNA, 18 nt, Mycobacterium bovis subsp bovis AF2122/97
ccgcaggucgcuggccgu

SEQ ID NO: 1137588 - RNA, 21 nt, Mycobacterium bovis subsp bovis AF2122/97
ccgcaggcuugccgauggcgg

SEQ ID NO: 1137589 - RNA, 19 nt, Mycobacterium bovis subsp bovis AF2122/97
ccgcagggccgccgcgaac

SEQ ID NO: 1137590 - RNA, 15 nt, Mycobacterium bovis subsp bovis AF2122/97
ccgcagggccgcgcg

SEQ ID NO: 1137591 - RNA, 16 nt, Mycobacterium bovis subsp bovis AF2122/97
ccgcagggccgcgcgc

SEQ ID NO: 1137592 - RNA, 14 nt, Mycobacterium bovis subsp bovis AF2122/97
ccgcaggucgcacc

SEQ ID NO: 1137593 - RNA, 14 nt, Mycobacterium bovis subsp bovis AF2122/97
ccgcaucgccucac

SEQ ID NO: 1137594 - RNA, 14 nt, Mycobacterium bovis subsp bovis AF2122/97
ccgcauccggucuc

SEQ ID NO: 1137595 - RNA, 17 nt, Mycobacterium bovis subsp bovis AF2122/97
ccgcaucgacgcucauc

SEQ ID NO: 1137596 - RNA, 16 nt, Mycobacterium bovis subsp bovis AF2122/97
ccgcaucgccucacca

SEQ ID NO: 1137597 - RNA, 14 nt, Mycobacterium bovis subsp bovis AF2122/97
ccgcauccgcgacg

SEQ ID NO: 1137598 - RNA, 13 nt, Mycobacterium bovis subsp bovis AF2122/97
ccgcaucggcacg

SEQ ID NO: 1137599 - RNA, 14 nt, Mycobacterium bovis subsp bovis AF2122/97
ccgcaucgcggcau

SEQ ID NO: 1137600 - RNA, 15 nt, Mycobacterium bovis subsp bovis AF2122/97
ccgcaucgcggcauc

SEQ ID NO: 1137601 - RNA, 15 nt, Mycobacterium bovis subsp bovis AF2122/97
ccgcaucggcgaaca

SEQ ID NO: 1137602 - RNA, 15 nt, Mycobacterium bovis subsp bovis AF2122/97
ccgcaucggcagcca

SEQ ID NO: 1137603 - RNA, 21 nt, Mycobacterium bovis subsp bovis AF2122/97
ccgcaucgcggcaucgacgcg

SEQ ID NO: 1137604 - RNA, 18 nt, Mycobacterium bovis subsp bovis AF2122/97
ccgccaccaccgcugccg

SEQ ID NO: 1137605 - RNA, 20 nt, Mycobacterium bovis subsp bovis AF2122/97
ccgccaccaccgcugccggc

SEQ ID NO: 1137606 - RNA, 22 nt, Mycobacterium bovis subsp bovis AF2122/97
ccgccaccacggucaagccggc

SEQ ID NO: 1137607 - RNA, 12 nt, Mycobacterium bovis subsp bovis AF2122/97
ccgccaccccgc

SEQ ID NO: 1137608 - RNA, 19 nt, Mycobacterium bovis subsp bovis AF2122/97
ccgccagaauugccggcga

SEQ ID NO: 1137609 - RNA, 18 nt, Mycobacterium bovis subsp bovis AF2122/97
ccgccagaccgcggcggc

SEQ ID NO: 1137610 - RNA, 19 nt, Mycobacterium bovis subsp bovis AF2122/97
ccgccagaccgcggcggcc

SEQ ID NO: 1137611 - RNA, 20 nt, Mycobacterium bovis subsp bovis AF2122/97
ccgccagauuggcgcugccc

SEQ ID NO: 1137612 - RNA, 17 nt, Mycobacterium bovis subsp bovis AF2122/97
ccgccagaucucgcgcg

SEQ ID NO: 1137613 - RNA, 21 nt, Mycobacterium bovis subsp bovis AF2122/97
ccgccagaugaugccacccuc

SEQ ID NO: 1137614 - RNA, 12 nt, Mycobacterium bovis subsp bovis AF2122/97
ccgccaccgcga

SEQ ID NO: 1137615 - RNA, 18 nt, Mycobacterium bovis subsp bovis AF2122/97
ccgccaccgccaccgcgg

SEQ ID NO: 1137616 - RNA, 16 nt, Mycobacterium bovis subsp bovis AF2122/97
ccgccaccgccagcgu

SEQ ID NO: 1137617 - RNA, 14 nt, Mycobacterium bovis subsp bovis AF2122/97
ccgccaccgcgaca

SEQ ID NO: 1137618 - RNA, 14 nt, Mycobacterium bovis subsp bovis AF2122/97
ccgccaccgcgacg

SEQ ID NO: 1137619 - RNA, 12 nt, Mycobacterium bovis subsp bovis AF2122/97
ccgccaccgcgg

SEQ ID NO: 1137620 - RNA, 15 nt, Mycobacterium bovis subsp bovis AF2122/97
ccgcaucggcgccag

SEQ ID NO: 1137621 - RNA, 18 nt, Mycobacterium bovis subsp bovis AF2122/97
ccgccacccuuggcccgg

SEQ ID NO: 1137622 - RNA, 17 nt, Mycobacterium bovis subsp bovis AF2122/97
ccgccaccgaagccgcc

SEQ ID NO: 1137623 - RNA, 22 nt, Mycobacterium bovis subsp bovis AF2122/97
ccgccaccgaagccgccgggug

SEQ ID NO: 1137624 - RNA, 13 nt, Mycobacterium bovis subsp bovis AF2122/97
ccgccaccgcacg

SEQ ID NO: 1137625 - RNA, 12 nt, Mycobacterium bovis subsp bovis AF2122/97
ccgccaccgcca

SEQ ID NO: 1137626 - RNA, 15 nt, Mycobacterium bovis subsp bovis AF2122/97
ccgccagcgccgccg

SEQ ID NO: 1137627 - RNA, 13 nt, Mycobacterium bovis subsp bovis AF2122/97
ccgccagcgccgg

SEQ ID NO: 1137628 - RNA, 20 nt, Mycobacterium bovis subsp bovis AF2122/97
ccgccagcgccaccguuacc

SEQ ID NO: 1137629 - RNA, 15 nt, Mycobacterium bovis subsp bovis AF2122/97
ccgccagcaccaccg

SEQ ID NO: 1137630 - RNA, 15 nt, Mycobacterium bovis subsp bovis AF2122/97
ccgccagccuggucu

SEQ ID NO: 1137631 - RNA, 14 nt, Mycobacterium bovis subsp bovis AF2122/97
ccgccagcgcggug

SEQ ID NO: 1137632 - RNA, 15 nt, Mycobacterium bovis subsp bovis AF2122/97
ccgccagcgcucaca

SEQ ID NO: 1137633 - RNA, 23 nt, Mycobacterium bovis subsp bovis AF2122/97
ccgccagcggcaauggccagcac

SEQ ID NO: 1137634 - RNA, 23 nt, Mycobacterium bovis subsp bovis AF2122/97
ccgccagcgcgccgaucacggug

SEQ ID NO: 1137635 - RNA, 14 nt, Mycobacterium bovis subsp bovis AF2122/97
ccgccaggcucgag

SEQ ID NO: 1137636 - RNA, 16 nt, Mycobacterium bovis subsp bovis AF2122/97
ccgccaggcggccggg

SEQ ID NO: 1137637 - RNA, 20 nt, Mycobacterium bovis subsp bovis AF2122/97
ccgccagguccccgacaacg

SEQ ID NO: 1137638 - RNA, 21 nt, Mycobacterium bovis subsp bovis AF2122/97
ccgccagguccgccggugccg

SEQ ID NO: 1137639 - RNA, 19 nt, Mycobacterium bovis subsp bovis AF2122/97
ccgccaggucgaggcaggc

SEQ ID NO: 1137640 - RNA, 17 nt, Mycobacterium bovis subsp bovis AF2122/97
ccgccaggugcucgucg

SEQ ID NO: 1137641 - RNA, 19 nt, Mycobacterium bovis subsp bovis AF2122/97
ccgccaguccgaucgccga

SEQ ID NO: 1137642 - RNA, 21 nt, Mycobacterium bovis subsp bovis AF2122/97
ccgccagugcccgcacugccg

SEQ ID NO: 1137643 - RNA, 20 nt, Mycobacterium bovis subsp bovis AF2122/97
ccgccaguucggcgucgucc

SEQ ID NO: 1137644 - RNA, 13 nt, Mycobacterium bovis subsp bovis AF2122/97
ccgccaguucggc

SEQ ID NO: 1137645 - RNA, 20 nt, Mycobacterium bovis subsp bovis AF2122/97
ccgccaguccggacggcagc

SEQ ID NO: 1137646 - RNA, 23 nt, Mycobacterium bovis subsp bovis AF2122/97
ccgccagucguccucaucguucc

SEQ ID NO: 1137647 - RNA, 14 nt, Mycobacterium bovis subsp bovis AF2122/97
ccgccgacaggccg

SEQ ID NO: 1137648 - RNA, 21 nt, Mycobacterium bovis subsp bovis AF2122/97
ccgccgacaggccggccacca

SEQ ID NO: 1137649 - RNA, 22 nt, Mycobacterium bovis subsp bovis AF2122/97
ccgccgaaggcgggggagccca

SEQ ID NO: 1137650 - RNA, 18 nt, Mycobacterium bovis subsp bovis AF2122/97
ccgccgaauccgacgucg

SEQ ID NO: 1137651 - RNA, 21 nt, Mycobacterium bovis subsp bovis AF2122/97
ccgccgaauccgacgucgacg

SEQ ID NO: 1137652 - RNA, 20 nt, Mycobacterium bovis subsp bovis AF2122/97
ccgccgaagaaggugacgau

SEQ ID NO: 1137653 - RNA, 12 nt, Mycobacterium bovis subsp bovis AF2122/97
ccgccgaccgga

SEQ ID NO: 1137654 - RNA, 15 nt, Mycobacterium bovis subsp bovis AF2122/97
ccgccgaccgacacc

SEQ ID NO: 1137655 - RNA, 13 nt, Mycobacterium bovis subsp bovis AF2122/97
ccgccgacgccgc

SEQ ID NO: 1137656 - RNA, 14 nt, Mycobacterium bovis subsp bovis AF2122/97
ccgccgacgccgcc

SEQ ID NO: 1137657 - RNA, 14 nt, Mycobacterium bovis subsp bovis AF2122/97
ccgccgaaaaccuc

SEQ ID NO: 1137658 - RNA, 22 nt, Mycobacterium bovis subsp bovis AF2122/97
ccgccgaaaaccucgaaaccgu

SEQ ID NO: 1137659 - RNA, 20 nt, Mycobacterium bovis subsp bovis AF2122/97
ccgccgaaacucaccagcac

SEQ ID NO: 1137660 - RNA, 20 nt, Mycobacterium bovis subsp bovis AF2122/97
ccgccgaacagcuggacggc

SEQ ID NO: 1137661 - RNA, 13 nt, Mycobacterium bovis subsp bovis AF2122/97
ccgccgaacgccu

SEQ ID NO: 1137662 - RNA, 17 nt, Mycobacterium bovis subsp bovis AF2122/97
ccgcccuggcaacgaca

SEQ ID NO: 1137663 - RNA, 18 nt, Mycobacterium bovis subsp bovis AF2122/97
ccgcccuggcaacgacac

SEQ ID NO: 1137664 - RNA, 23 nt, Mycobacterium bovis subsp bovis AF2122/97
ccgcccuggcaacgacacgccgc

SEQ ID NO: 1137665 - RNA, 14 nt, Mycobacterium bovis subsp bovis AF2122/97
ccgcccuggccgcc

SEQ ID NO: 1137666 - RNA, 15 nt, Mycobacterium bovis subsp bovis AF2122/97
ccgcccuggccgccg

SEQ ID NO: 1137667 - RNA, 18 nt, Mycobacterium bovis subsp bovis AF2122/97
ccgcccuggccgccggcc

SEQ ID NO: 1137668 - RNA, 17 nt, Mycobacterium bovis subsp bovis AF2122/97
ccgcccuugauguccgc

SEQ ID NO: 1137669 - RNA, 14 nt, Mycobacterium bovis subsp bovis AF2122/97
ccgcccuugccgcc

SEQ ID NO: 1137670 - RNA, 16 nt, Mycobacterium bovis subsp bovis AF2122/97
ccgcccuugccgcccg

SEQ ID NO: 1137671 - RNA, 17 nt, Mycobacterium bovis subsp bovis AF2122/97
ccgcccuugccgcccgc

SEQ ID NO: 1137672 - RNA, 20 nt, Mycobacterium bovis subsp bovis AF2122/97
ccgcccuugccgccgagggc

SEQ ID NO: 1137673 - RNA, 16 nt, Mycobacterium bovis subsp bovis AF2122/97
ccgcccuugccgccgg

SEQ ID NO: 1137674 - RNA, 18 nt, Mycobacterium bovis subsp bovis AF2122/97
ccgcccuugccgccggcc

SEQ ID NO: 1137675 - RNA, 13 nt, Mycobacterium bovis subsp bovis AF2122/97
ccgcccuugcggc

SEQ ID NO: 1137676 - RNA, 19 nt, Mycobacterium bovis subsp bovis AF2122/97
ccgcccuugcggcgugaug

SEQ ID NO: 1137677 - RNA, 19 nt, Mycobacterium bovis subsp bovis AF2122/97
ccgccaucaucgcuuggcc

SEQ ID NO: 1137678 - RNA, 21 nt, Mycobacterium bovis subsp bovis AF2122/97
ccgccaucaucgcuuggccua

SEQ ID NO: 1137679 - RNA, 15 nt, Mycobacterium bovis subsp bovis AF2122/97
ccgccaucaccgccg

SEQ ID NO: 1137680 - RNA, 20 nt, Mycobacterium bovis subsp bovis AF2122/97
ccgccaucaccgccguuacc

SEQ ID NO: 1137681 - RNA, 22 nt, Mycobacterium bovis subsp bovis AF2122/97
ccgccaucagcccggcgcgccg

SEQ ID NO: 1137682 - RNA, 23 nt, Mycobacterium bovis subsp bovis AF2122/97
ccgccauccgauggcccggcuca

SEQ ID NO: 1137683 - RNA, 19 nt, Mycobacterium bovis subsp bovis AF2122/97
ccgccaucgccaacaccaa

SEQ ID NO: 1137684 - RNA, 13 nt, Mycobacterium bovis subsp bovis AF2122/97
ccgcccgccaacu

SEQ ID NO: 1137685 - RNA, 13 nt, Mycobacterium bovis subsp bovis AF2122/97
ccgcccgccagcg

SEQ ID NO: 1137686 - RNA, 17 nt, Mycobacterium bovis subsp bovis AF2122/97
ccgcccgccagcgaucc

SEQ ID NO: 1137687 - RNA, 23 nt, Mycobacterium bovis subsp bovis AF2122/97
ccgcccgcacguucacgcgcgga

SEQ ID NO: 1137688 - RNA, 16 nt, Mycobacterium bovis subsp bovis AF2122/97
ccgcccgcagggccgc

SEQ ID NO: 1137689 - RNA, 13 nt, Mycobacterium bovis subsp bovis AF2122/97
ccgcccgccgaac

SEQ ID NO: 1137690 - RNA, 13 nt, Mycobacterium bovis subsp bovis AF2122/97
ccgcccgcccgga

SEQ ID NO: 1137691 - RNA, 15 nt, Mycobacterium bovis subsp bovis AF2122/97
ccgcccgcccggacg

SEQ ID NO: 1137692 - RNA, 17 nt, Mycobacterium bovis subsp bovis AF2122/97
ccgcccgcgccaccagc

SEQ ID NO: 1137693 - RNA, 15 nt, Mycobacterium bovis subsp bovis AF2122/97
ccgcccgcgccaccg

SEQ ID NO: 1137694 - RNA, 12 nt, Mycobacterium bovis subsp bovis AF2122/97
ccgcccgcgcgg

SEQ ID NO: 1137695 - RNA, 21 nt, Mycobacterium bovis subsp bovis AF2122/97
ccgcccgcgccuccguugccc

SEQ ID NO: 1137696 - RNA, 16 nt, Mycobacterium bovis subsp bovis AF2122/97
ccgcccgcgccgccgc

SEQ ID NO: 1137697 - RNA, 12 nt, Mycobacterium bovis subsp bovis AF2122/97
ccgcccgcgccu

SEQ ID NO: 1137698 - RNA, 15 nt, Mycobacterium bovis subsp bovis AF2122/97
ccgcccucaccgccu

SEQ ID NO: 1137699 - RNA, 23 nt, Mycobacterium bovis subsp bovis AF2122/97
ccgcccucaguucacguucggcg

SEQ ID NO: 1137700 - RNA, 20 nt, Mycobacterium bovis subsp bovis AF2122/97
ccgcccgugccgcccucacc

SEQ ID NO: 1137701 - RNA, 16 nt, Mycobacterium bovis subsp bovis AF2122/97
ccgcccguugcaggug

SEQ ID NO: 1137702 - RNA, 17 nt, Mycobacterium bovis subsp bovis AF2122/97
ccgcccucucacggcgg

SEQ ID NO: 1137703 - RNA, 13 nt, Mycobacterium bovis subsp bovis AF2122/97
ccgcccggguuga

SEQ ID NO: 1137704 - RNA, 16 nt, Mycobacterium bovis subsp bovis AF2122/97
ccgcccggguugaccg

SEQ ID NO: 1137705 - RNA, 14 nt, Mycobacterium bovis subsp bovis AF2122/97
ccgcccgcgcggug

SEQ ID NO: 1137706 - RNA, 12 nt, Mycobacterium bovis subsp bovis AF2122/97
ccgcccgcgggc

SEQ ID NO: 1137707 - RNA, 19 nt, Mycobacterium bovis subsp bovis AF2122/97
ccgcccgcuccuccggcac

SEQ ID NO: 1137708 - RNA, 20 nt, Mycobacterium bovis subsp bovis AF2122/97
ccgcccgcuccuccggcacc

SEQ ID NO: 1137709 - RNA, 12 nt, Mycobacterium bovis subsp bovis AF2122/97
ccgcccgggcgu

SEQ ID NO: 1137710 - RNA, 12 nt, Mycobacterium bovis subsp bovis AF2122/97
ccgcccguaucg

SEQ ID NO: 1137711 - RNA, 21 nt, Mycobacterium bovis subsp bovis AF2122/97
ccgcccggugcuaaccgacgc

SEQ ID NO: 1137712 - RNA, 23 nt, Mycobacterium bovis subsp bovis AF2122/97
ccgcccggugcuaaccgacgcug

SEQ ID NO: 1137713 - RNA, 15 nt, Mycobacterium bovis subsp bovis AF2122/97
ccgccgccucgucgu

SEQ ID NO: 1137714 - RNA, 13 nt, Mycobacterium bovis subsp bovis AF2122/97
ccgccgccggcgg

SEQ ID NO: 1137715 - RNA, 21 nt, Mycobacterium bovis subsp bovis AF2122/97
ccgccgccugcccggcccgcu

SEQ ID NO: 1137716 - RNA, 12 nt, Mycobacterium bovis subsp bovis AF2122/97
ccgccgcgacgg

SEQ ID NO: 1137717 - RNA, 22 nt, Mycobacterium bovis subsp bovis AF2122/97
ccgccgcgacgcacugccccgc

SEQ ID NO: 1137718 - RNA, 12 nt, Mycobacterium bovis subsp bovis AF2122/97
ccgccgccgaca

SEQ ID NO: 1137719 - RNA, 12 nt, Mycobacterium bovis subsp bovis AF2122/97
ccgccgccgacg

SEQ ID NO: 1137720 - RNA, 16 nt, Mycobacterium bovis subsp bovis AF2122/97
ccgccgccgacgccgc

SEQ ID NO: 1137721 - RNA, 14 nt, Mycobacterium bovis subsp bovis AF2122/97
ccgccgccgacgga

SEQ ID NO: 1137722 - RNA, 15 nt, Mycobacterium bovis subsp bovis AF2122/97
ccgccgccgccaccg

SEQ ID NO: 1137723 - RNA, 17 nt, Mycobacterium bovis subsp bovis AF2122/97
ccgccgccgccaccggc

SEQ ID NO: 1137724 - RNA, 16 nt, Mycobacterium bovis subsp bovis AF2122/97
ccgccgccgccgacgc

SEQ ID NO: 1137725 - RNA, 14 nt, Mycobacterium bovis subsp bovis AF2122/97
ccgccgccggaucg

SEQ ID NO: 1137726 - RNA, 13 nt, Mycobacterium bovis subsp bovis AF2122/97
ccgccgccgccgg

SEQ ID NO: 1137727 - RNA, 14 nt, Mycobacterium bovis subsp bovis AF2122/97
ccgccgccgccggc

SEQ ID NO: 1137728 - RNA, 21 nt, Mycobacterium bovis subsp bovis AF2122/97
ccgccgccggaucgccgguga

SEQ ID NO: 1137729 - RNA, 15 nt, Mycobacterium bovis subsp bovis AF2122/97
ccgccgccggcgccg

SEQ ID NO: 1137730 - RNA, 21 nt, Mycobacterium bovis subsp bovis AF2122/97
ccgccgcagcuuguccgguga

SEQ ID NO: 1137731 - RNA, 20 nt, Mycobacterium bovis subsp bovis AF2122/97
ccgccgcagaugggccucca

SEQ ID NO: 1137732 - RNA, 20 nt, Mycobacterium bovis subsp bovis AF2122/97
ccgccgcaaccgcgaagccg

SEQ ID NO: 1137733 - RNA, 21 nt, Mycobacterium bovis subsp bovis AF2122/97
ccgccgccaccggcgccgccg

SEQ ID NO: 1137734 - RNA, 23 nt, Mycobacterium bovis subsp bovis AF2122/97
ccgccgccaccggcgccgccguc

SEQ ID NO: 1137735 - RNA, 13 nt, Mycobacterium bovis subsp bovis AF2122/97
ccgccgccacggc

SEQ ID NO: 1137736 - RNA, 14 nt, Mycobacterium bovis subsp bovis AF2122/97
ccgccgccacggca

SEQ ID NO: 1137737 - RNA, 13 nt, Mycobacterium bovis subsp bovis AF2122/97
ccgccgcccagcg

SEQ ID NO: 1137738 - RNA, 15 nt, Mycobacterium bovis subsp bovis AF2122/97
ccgccgcccccgccg

SEQ ID NO: 1137739 - RNA, 17 nt, Mycobacterium bovis subsp bovis AF2122/97
ccgccgcccccgccggc

SEQ ID NO: 1137740 - RNA, 19 nt, Mycobacterium bovis subsp bovis AF2122/97
ccgccgcccccgccggccg

SEQ ID NO: 1137741 - RNA, 15 nt, Mycobacterium bovis subsp bovis AF2122/97
ccgccgccccggcgc

SEQ ID NO: 1137742 - RNA, 15 nt, Mycobacterium bovis subsp bovis AF2122/97
ccgccgcccuggucc

SEQ ID NO: 1137743 - RNA, 23 nt, Mycobacterium bovis subsp bovis AF2122/97
ccgccgcccugguccaggcccug

SEQ ID NO: 1137744 - RNA, 12 nt, Mycobacterium bovis subsp bovis AF2122/97
ccgccgcccagc

SEQ ID NO: 1137745 - RNA, 21 nt, Mycobacterium bovis subsp bovis AF2122/97
ccgccgccaguccggacggca

SEQ ID NO: 1137746 - RNA, 13 nt, Mycobacterium bovis subsp bovis AF2122/97
ccgccgccaucgc

SEQ ID NO: 1137747 - RNA, 15 nt, Mycobacterium bovis subsp bovis AF2122/97
ccgccgccaucgccg

SEQ ID NO: 1137748 - RNA, 12 nt, Mycobacterium bovis subsp bovis AF2122/97
ccgccgaugcca

SEQ ID NO: 1137749 - RNA, 19 nt, Mycobacterium bovis subsp bovis AF2122/97
ccgccgaugccaccgcuug

SEQ ID NO: 1137750 - RNA, 22 nt, Mycobacterium bovis subsp bovis AF2122/97
ccgccgaucgggcuucggccag

SEQ ID NO: 1137751 - RNA, 18 nt, Mycobacterium bovis subsp bovis AF2122/97
ccgccgaucgaaccgcug

SEQ ID NO: 1137752 - RNA, 15 nt, Mycobacterium bovis subsp bovis AF2122/97
ccgccgaucaccgcu

SEQ ID NO: 1137753 - RNA, 12 nt, Mycobacterium bovis subsp bovis AF2122/97
ccgccgaucacu

SEQ ID NO: 1137754 - RNA, 15 nt, Mycobacterium bovis subsp bovis AF2122/97
ccgccgauaccgccg

SEQ ID NO: 1137755 - RNA, 15 nt, Mycobacterium bovis subsp bovis AF2122/97
ccgccgaugcugccg

SEQ ID NO: 1137756 - RNA, 18 nt, Mycobacterium bovis subsp bovis AF2122/97
ccgccgaugcugccgccg

SEQ ID NO: 1137757 - RNA, 19 nt, Mycobacterium bovis subsp bovis AF2122/97
ccgccgaugcugccgccgc

SEQ ID NO: 1137758 - RNA, 20 nt, Mycobacterium bovis subsp bovis AF2122/97
ccgccgaugccaccgcuuga

SEQ ID NO: 1137759 - RNA, 17 nt, Mycobacterium bovis subsp bovis AF2122/97
ccgccgaugcccgacac

SEQ ID NO: 1137760 - RNA, 18 nt, Mycobacterium bovis subsp bovis AF2122/97
ccgccgaugucgacgaca

SEQ ID NO: 1137761 - RNA, 17 nt, Mycobacterium bovis subsp bovis AF2122/97
ccgccgcacgcuagccg

SEQ ID NO: 1137762 - RNA, 19 nt, Mycobacterium bovis subsp bovis AF2122/97
ccgccgcacgcuagccgac

SEQ ID NO: 1137763 - RNA, 19 nt, Mycobacterium bovis subsp bovis AF2122/97
ccgccgcagacgccgacuc

SEQ ID NO: 1137764 - RNA, 21 nt, Mycobacterium bovis subsp bovis AF2122/97
ccgccgaggccgccguugccg

SEQ ID NO: 1137765 - RNA, 15 nt, Mycobacterium bovis subsp bovis AF2122/97
ccgccgagggcgccg

SEQ ID NO: 1137766 - RNA, 22 nt, Mycobacterium bovis subsp bovis AF2122/97
ccgccgaggucgguucggccgg

SEQ ID NO: 1137767 - RNA, 16 nt, Mycobacterium bovis subsp bovis AF2122/97
ccgccgagcggugccg

SEQ ID NO: 1137768 - RNA, 16 nt, Mycobacterium bovis subsp bovis AF2122/97
ccgccgagcgguugcc

SEQ ID NO: 1137769 - RNA, 18 nt, Mycobacterium bovis subsp bovis AF2122/97
ccgccgagcucggucacc

SEQ ID NO: 1137770 - RNA, 21 nt, Mycobacterium bovis subsp bovis AF2122/97
ccgccgagcucggucaccacg

SEQ ID NO: 1137771 - RNA, 22 nt, Mycobacterium bovis subsp bovis AF2122/97
ccgccgagcuggcgcgcggggu

SEQ ID NO: 1137772 - RNA, 14 nt, Mycobacterium bovis subsp bovis AF2122/97
ccgccgacgccguu

SEQ ID NO: 1137773 - RNA, 20 nt, Mycobacterium bovis subsp bovis AF2122/97
ccgccgaggccgccguugcc

SEQ ID NO: 1137774 - RNA, 12 nt, Mycobacterium bovis subsp bovis AF2122/97
ccgccgagcgca

SEQ ID NO: 1137775 - RNA, 23 nt, Mycobacterium bovis subsp bovis AF2122/97
ccgccgagcgcaacucccagcac

SEQ ID NO: 1137776 - RNA, 18 nt, Mycobacterium bovis subsp bovis AF2122/97
ccgccgagaugcuggucg

SEQ ID NO: 1137777 - RNA, 22 nt, Mycobacterium bovis subsp bovis AF2122/97
ccgccgagaugcuggucggcga

SEQ ID NO: 1137778 - RNA, 13 nt, Mycobacterium bovis subsp bovis AF2122/97
ccgccgagcaccg

SEQ ID NO: 1137779 - RNA, 22 nt, Mycobacterium bovis subsp bovis AF2122/97
ccgccgagauagcaacgaagcc

SEQ ID NO: 1137780 - RNA, 20 nt, Mycobacterium bovis subsp bovis AF2122/97
ccgccgacuccccgccgggc

SEQ ID NO: 1137781 - RNA, 17 nt, Mycobacterium bovis subsp bovis AF2122/97
ccgccgacuuccgcguc

SEQ ID NO: 1137782 - RNA, 18 nt, Mycobacterium bovis subsp bovis AF2122/97
ccgccgacuuccgcgucg

SEQ ID NO: 1137783 - RNA, 20 nt, Mycobacterium bovis subsp bovis AF2122/97
ccgccgacuuccgcgucgcc

SEQ ID NO: 1137784 - RNA, 14 nt, Mycobacterium bovis subsp bovis AF2122/97
ccgccgacguuggg

SEQ ID NO: 1137785 - RNA, 12 nt, Mycobacterium bovis subsp bovis AF2122/97
ccgccgacggau

SEQ ID NO: 1137786 - RNA, 22 nt, Mycobacterium bovis subsp bovis AF2122/97
ccgcgaggcacuuaccgagccg

SEQ ID NO: 1137787 - RNA, 13 nt, Mycobacterium bovis subsp bovis AF2122/97
ccgcgagucgccc

SEQ ID NO: 1137788 - RNA, 13 nt, Mycobacterium bovis subsp bovis AF2122/97
ccgcgaucaccac

SEQ ID NO: 1137789 - RNA, 21 nt, Mycobacterium bovis subsp bovis AF2122/97
ccgcgauccagcgcugaccgg

SEQ ID NO: 1137790 - RNA, 15 nt, Mycobacterium bovis subsp bovis AF2122/97
ccgcgaucgccgacg

SEQ ID NO: 1137791 - RNA, 23 nt, Mycobacterium bovis subsp bovis AF2122/97
ccgcgaucgccgacgccagaacg

SEQ ID NO: 1137792 - RNA, 13 nt, Mycobacterium bovis subsp bovis AF2122/97
ccgcgauccccac

SEQ ID NO: 1137793 - RNA, 15 nt, Mycobacterium bovis subsp bovis AF2122/97
ccgcgaucaccaccg

SEQ ID NO: 1137794 - RNA, 11 nt, Mycobacterium bovis subsp bovis AF2122/97
ccgcgaucgcc

SEQ ID NO: 1137795 - RNA, 20 nt, Mycobacterium bovis subsp bovis AF2122/97
ccgcgaugugggcuaacgac

SEQ ID NO: 1137796 - RNA, 21 nt, Mycobacterium bovis subsp bovis AF2122/97
ccgcgagguugaccaccagcg

SEQ ID NO: 1137797 - RNA, 14 nt, Mycobacterium bovis subsp bovis AF2122/97
ccgcgagggcgcgu

SEQ ID NO: 1137798 - RNA, 21 nt, Mycobacterium bovis subsp bovis AF2122/97
ccgcgagggggguguugaggc

SEQ ID NO: 1137799 - RNA, 23 nt, Mycobacterium bovis subsp bovis AF2122/97
ccgcgagguacccaucgucgagc

SEQ ID NO: 1137800 - RNA, 20 nt, Mycobacterium bovis subsp bovis AF2122/97
ccgcgaggcaagaacccgau

SEQ ID NO: 1137801 - RNA, 22 nt, Mycobacterium bovis subsp bovis AF2122/97
ccgcgagcuguaggucagcgcg

SEQ ID NO: 1137802 - RNA, 16 nt, Mycobacterium bovis subsp bovis AF2122/97
ccgcgagcgccggccg

SEQ ID NO: 1137803 - RNA, 17 nt, Mycobacterium bovis subsp bovis AF2122/97
ccgcgagcgccggccgc

SEQ ID NO: 1137804 - RNA, 22 nt, Mycobacterium bovis subsp bovis AF2122/97
ccgcgaaggggugcccggcggc

SEQ ID NO: 1137805 - RNA, 23 nt, Mycobacterium bovis subsp bovis AF2122/97
ccgcgagcguaacguggcugcga

SEQ ID NO: 1137806 - RNA, 16 nt, Mycobacterium bovis subsp bovis AF2122/97
ccgcgaaccgcggauc

SEQ ID NO: 1137807 - RNA, 20 nt, Mycobacterium bovis subsp bovis AF2122/97
ccgcgaagugcuugggccgc

SEQ ID NO: 1137808 - RNA, 19 nt, Mycobacterium bovis subsp bovis AF2122/97
ccgcgaagccgaccguacc

SEQ ID NO: 1137809 - RNA, 15 nt, Mycobacterium bovis subsp bovis AF2122/97
ccgcgaagccgaccg

SEQ ID NO: 1137810 - RNA, 13 nt, Mycobacterium bovis subsp bovis AF2122/97
ccgcgcaccgcgg

SEQ ID NO: 1137811 - RNA, 16 nt, Mycobacterium bovis subsp bovis AF2122/97
ccgcgcaacccggacg

SEQ ID NO: 1137812 - RNA, 20 nt, Mycobacterium bovis subsp bovis AF2122/97
ccgcgcaccaacaccagcgc

SEQ ID NO: 1137813 - RNA, 14 nt, Mycobacterium bovis subsp bovis AF2122/97
ccgcgcaccgaccg

SEQ ID NO: 1137814 - RNA, 12 nt, Mycobacterium bovis subsp bovis AF2122/97
ccgcgcacggcg

SEQ ID NO: 1137815 - RNA, 15 nt, Mycobacterium bovis subsp bovis AF2122/97
ccgcgcacggcuggc

SEQ ID NO: 1137816 - RNA, 22 nt, Mycobacterium bovis subsp bovis AF2122/97
ccgcgcaacuaucgcaccuccg

SEQ ID NO: 1137817 - RNA, 18 nt, Mycobacterium bovis subsp bovis AF2122/97
ccgcgauucgcggcagcc

SEQ ID NO: 1137818 - RNA, 15 nt, Mycobacterium bovis subsp bovis AF2122/97
ccgcgaucgcgacac

SEQ ID NO: 1137819 - RNA, 18 nt, Mycobacterium bovis subsp bovis AF2122/97
ccgcgaucgggcccagca

SEQ ID NO: 1137820 - RNA, 15 nt, Mycobacterium bovis subsp bovis AF2122/97
ccgcgaucgggccga

SEQ ID NO: 1137821 - RNA, 16 nt, Mycobacterium bovis subsp bovis AF2122/97
ccgcgccaguggccac

SEQ ID NO: 1137822 - RNA, 22 nt, Mycobacterium bovis subsp bovis AF2122/97
ccgcgccaccgauaccgucagc

SEQ ID NO: 1137823 - RNA, 15 nt, Mycobacterium bovis subsp bovis AF2122/97
ccgcgccaccggcac

SEQ ID NO: 1137824 - RNA, 20 nt, Mycobacterium bovis subsp bovis AF2122/97
ccgcgccaccucccacgccg

SEQ ID NO: 1137825 - RNA, 14 nt, Mycobacterium bovis subsp bovis AF2122/97
ccgcgccaccuccg

SEQ ID NO: 1137826 - RNA, 20 nt, Mycobacterium bovis subsp bovis AF2122/97
ccgcgccaccuccgacgggc

SEQ ID NO: 1137827 - RNA, 16 nt, Mycobacterium bovis subsp bovis AF2122/97
ccgcgcagcacugcgg

SEQ ID NO: 1137828 - RNA, 15 nt, Mycobacterium bovis subsp bovis AF2122/97
ccgcgcagccaggga

SEQ ID NO: 1137829 - RNA, 20 nt, Mycobacterium bovis subsp bovis AF2122/97
ccgcgcagcacugcggcagc

SEQ ID NO: 1137830 - RNA, 16 nt, Mycobacterium bovis subsp bovis AF2122/97
ccgcgcagcgguccgc

SEQ ID NO: 1137831 - RNA, 17 nt, Mycobacterium bovis subsp bovis AF2122/97
ccgcgcagcgguccgcc

SEQ ID NO: 1137832 - RNA, 18 nt, Mycobacterium bovis subsp bovis AF2122/97
ccgcgcagcgguccgccg

SEQ ID NO: 1137833 - RNA, 19 nt, Mycobacterium bovis subsp bovis AF2122/97
ccgcgcagcgguccgccgc

SEQ ID NO: 1137834 - RNA, 16 nt, Mycobacterium bovis subsp bovis AF2122/97
ccgcgccugccucacc

SEQ ID NO: 1137835 - RNA, 20 nt, Mycobacterium bovis subsp bovis AF2122/97
ccgcgcgagccucgcgcgug

SEQ ID NO: 1137836 - RNA, 20 nt, Mycobacterium bovis subsp bovis AF2122/97
ccgcgccuugauggucucca

SEQ ID NO: 1137837 - RNA, 13 nt, Mycobacterium bovis subsp bovis AF2122/97
ccgcgcgcgccgc

SEQ ID NO: 1137838 - RNA, 14 nt, Mycobacterium bovis subsp bovis AF2122/97
ccgcgcgcggcgua

SEQ ID NO: 1137839 - RNA, 13 nt, Mycobacterium bovis subsp bovis AF2122/97
ccgcgccgagcag

SEQ ID NO: 1137840 - RNA, 22 nt, Mycobacterium bovis subsp bovis AF2122/97
ccgcgccgauuccaccgccgac

SEQ ID NO: 1137841 - RNA, 12 nt, Mycobacterium bovis subsp bovis AF2122/97
ccgcgccgcacc

SEQ ID NO: 1137842 - RNA, 20 nt, Mycobacterium bovis subsp bovis AF2122/97
ccgcgccgaucaccaccggc

SEQ ID NO: 1137843 - RNA, 20 nt, Mycobacterium bovis subsp bovis AF2122/97
ccgcgcccuucagcacggug

SEQ ID NO: 1137844 - RNA, 13 nt, Mycobacterium bovis subsp bovis AF2122/97
ccgcgcccaccag

SEQ ID NO: 1137845 - RNA, 14 nt, Mycobacterium bovis subsp bovis AF2122/97
ccgcgccagcuccg

SEQ ID NO: 1137846 - RNA, 18 nt, Mycobacterium bovis subsp bovis AF2122/97
ccgcgcccaacgcgggug

SEQ ID NO: 1137847 - RNA, 22 nt, Mycobacterium bovis subsp bovis AF2122/97
ccgcgccgacacguugcagcuc

SEQ ID NO: 1137848 - RNA, 18 nt, Mycobacterium bovis subsp bovis AF2122/97
ccgcgcucgcacccgcuc

SEQ ID NO: 1137849 - RNA, 20 nt, Mycobacterium bovis subsp bovis AF2122/97
ccgcgcucgacgagcacgcc

SEQ ID NO: 1137850 - RNA, 21 nt, Mycobacterium bovis subsp bovis AF2122/97
ccgcgcucgacgagcacgccg

SEQ ID NO: 1137851 - RNA, 17 nt, Mycobacterium bovis subsp bovis AF2122/97
ccgcgcucgccgauauc

SEQ ID NO: 1137852 - RNA, 14 nt, Mycobacterium bovis subsp bovis AF2122/97
ccgcgcugagcacg

SEQ ID NO: 1137853 - RNA, 18 nt, Mycobacterium bovis subsp bovis AF2122/97
ccgcgcucaccggggccg

SEQ ID NO: 1137854 - RNA, 17 nt, Mycobacterium bovis subsp bovis AF2122/97
ccgcgcucaucgcggcg

SEQ ID NO: 1137855 - RNA, 18 nt, Mycobacterium bovis subsp bovis AF2122/97
ccgcgcucaucgcggcga

SEQ ID NO: 1137856 - RNA, 14 nt, Mycobacterium bovis subsp bovis AF2122/97
ccgcgcucaucugc

SEQ ID NO: 1137857 - RNA, 22 nt, Mycobacterium bovis subsp bovis AF2122/97
ccgcgcguucggcgagcagcgc

SEQ ID NO: 1137858 - RNA, 23 nt, Mycobacterium bovis subsp bovis AF2122/97
ccgcgcguucggcgagcagcgca

SEQ ID NO: 1137859 - RNA, 16 nt, Mycobacterium bovis subsp bovis AF2122/97
ccgcgcguucggcgcu

SEQ ID NO: 1137860 - RNA, 17 nt, Mycobacterium bovis subsp bovis AF2122/97
ccgcgcguugcuggucg

SEQ ID NO: 1137861 - RNA, 11 nt, Mycobacterium bovis subsp bovis AF2122/97
ccgcgcgucgc

SEQ ID NO: 1137862 - RNA, 13 nt, Mycobacterium bovis subsp bovis AF2122/97
ccgcgcgucgccc

SEQ ID NO: 1137863 - RNA, 17 nt, Mycobacterium bovis subsp bovis AF2122/97
ccgcgcgagagccucca

SEQ ID NO: 1137864 - RNA, 19 nt, Mycobacterium bovis subsp bovis AF2122/97
ccgcgcgcuccagaugggg

SEQ ID NO: 1137865 - RNA, 22 nt, Mycobacterium bovis subsp bovis AF2122/97
ccgcgcggggugcgcgcgacca

SEQ ID NO: 1137866 - RNA, 18 nt, Mycobacterium bovis subsp bovis AF2122/97
ccgcgcguccgucggcga

SEQ ID NO: 1137867 - RNA, 23 nt, Mycobacterium bovis subsp bovis AF2122/97
ccgcgcguacccgaucagcgacg

SEQ ID NO: 1137868 - RNA, 24 nt, Mycobacterium bovis subsp bovis AF2122/97
ccgcgcguacccgaucagcgacgc

SEQ ID NO: 1137869 - RNA, 13 nt, Mycobacterium bovis subsp bovis AF2122/97
ccgcgcgguggcg

SEQ ID NO: 1137870 - RNA, 19 nt, Mycobacterium bovis subsp bovis AF2122/97
ccgcgcgguggcggucgcc

SEQ ID NO: 1137871 - RNA, 20 nt, Mycobacterium bovis subsp bovis AF2122/97
ccgcgcgcuggaccugauga

SEQ ID NO: 1137872 - RNA, 20 nt, Mycobacterium bovis subsp bovis AF2122/97
ccgccgcgagcgccggccgc

SEQ ID NO: 1137873 - RNA, 20 nt, Mycobacterium bovis subsp bovis AF2122/97
ccgccgcgaugacggugccg

SEQ ID NO: 1137874 - RNA, 21 nt, Mycobacterium bovis subsp bovis AF2122/97
ccgccgcgaugacggugccga

SEQ ID NO: 1137875 - RNA, 17 nt, Mycobacterium bovis subsp bovis AF2122/97
ccgccgcgaugccaccc

SEQ ID NO: 1137876 - RNA, 14 nt, Mycobacterium bovis subsp bovis AF2122/97
ccgccgcgauggcc

SEQ ID NO: 1137877 - RNA, 14 nt, Mycobacterium bovis subsp bovis AF2122/97
ccgccgcgcaccgc

SEQ ID NO: 1137878 - RNA, 15 nt, Mycobacterium bovis subsp bovis AF2122/97
ccgccgcgcauccgc

SEQ ID NO: 1137879 - RNA, 14 nt, Mycobacterium bovis subsp bovis AF2122/97
ccgccgcgccccgc

SEQ ID NO: 1137880 - RNA, 15 nt, Mycobacterium bovis subsp bovis AF2122/97
ccgccgcgcccggcg

SEQ ID NO: 1137881 - RNA, 16 nt, Mycobacterium bovis subsp bovis AF2122/97
ccgccgcgcccggcgc

SEQ ID NO: 1137882 - RNA, 14 nt, Mycobacterium bovis subsp bovis AF2122/97
ccgccgcgcagccg

SEQ ID NO: 1137883 - RNA, 15 nt, Mycobacterium bovis subsp bovis AF2122/97
ccgccgcgccggcac

SEQ ID NO: 1137884 - RNA, 14 nt, Mycobacterium bovis subsp bovis AF2122/97
ccgccgcgcgacag

SEQ ID NO: 1137885 - RNA, 17 nt, Mycobacterium bovis subsp bovis AF2122/97
ccgccgcgcguucggcg

SEQ ID NO: 1137886 - RNA, 20 nt, Mycobacterium bovis subsp bovis AF2122/97
ccgccgcggacaccaggaug

SEQ ID NO: 1137887 - RNA, 16 nt, Mycobacterium bovis subsp bovis AF2122/97
ccgccggcgccgccgg

SEQ ID NO: 1137888 - RNA, 20 nt, Mycobacterium bovis subsp bovis AF2122/97
ccgccggcgccggagccgcc

SEQ ID NO: 1137889 - RNA, 18 nt, Mycobacterium bovis subsp bovis AF2122/97
ccgccggcgccggugccg

SEQ ID NO: 1137890 - RNA, 21 nt, Mycobacterium bovis subsp bovis AF2122/97
ccgccggcgccggugccgccu

SEQ ID NO: 1137891 - RNA, 17 nt, Mycobacterium bovis subsp bovis AF2122/97
ccgccggcgcuggcggg

SEQ ID NO: 1137892 - RNA, 13 nt, Mycobacterium bovis subsp bovis AF2122/97
ccgccggcgggcg

SEQ ID NO: 1137893 - RNA, 18 nt, Mycobacterium bovis subsp bovis AF2122/97
ccgccggcucgccggcga

SEQ ID NO: 1137894 - RNA, 13 nt, Mycobacterium bovis subsp bovis AF2122/97
ccgccggcggucg

SEQ ID NO: 1137895 - RNA, 22 nt, Mycobacterium bovis subsp bovis AF2122/97
ccgccggcucgucgauccccgc

SEQ ID NO: 1137896 - RNA, 19 nt, Mycobacterium bovis subsp bovis AF2122/97
ccgccggcugcggaggcgg

SEQ ID NO: 1137897 - RNA, 15 nt, Mycobacterium bovis subsp bovis AF2122/97
ccgccgguguuagcc

SEQ ID NO: 1137898 - RNA, 20 nt, Mycobacterium bovis subsp bovis AF2122/97
ccgccguaacggucgcuguc

SEQ ID NO: 1137899 - RNA, 17 nt, Mycobacterium bovis subsp bovis AF2122/97
ccgccguagaccagccg

SEQ ID NO: 1137900 - RNA, 18 nt, Mycobacterium bovis subsp bovis AF2122/97
ccgccguagaccagccgu

SEQ ID NO: 1137901 - RNA, 17 nt, Mycobacterium bovis subsp bovis AF2122/97
ccgccggguuggcgccg

SEQ ID NO: 1137902 - RNA, 14 nt, Mycobacterium bovis subsp bovis AF2122/97
ccgccggguccgcc

SEQ ID NO: 1137903 - RNA, 20 nt, Mycobacterium bovis subsp bovis AF2122/97
ccgccggguccggaaccggu

SEQ ID NO: 1137904 - RNA, 20 nt, Mycobacterium bovis subsp bovis AF2122/97
ccgccgggucgaacgcaugc

SEQ ID NO: 1137905 - RNA, 21 nt, Mycobacterium bovis subsp bovis AF2122/97
ccgccgggugcgccguugccg

SEQ ID NO: 1137906 - RNA, 15 nt, Mycobacterium bovis subsp bovis AF2122/97
ccgccggucacgacg

SEQ ID NO: 1137907 - RNA, 15 nt, Mycobacterium bovis subsp bovis AF2122/97
ccgccgucaccgccg

SEQ ID NO: 1137908 - RNA, 19 nt, Mycobacterium bovis subsp bovis AF2122/97
ccgccgucaccccgauucg

SEQ ID NO: 1137909 - RNA, 19 nt, Mycobacterium bovis subsp bovis AF2122/97
ccgccgucaccgccguugc

SEQ ID NO: 1137910 - RNA, 14 nt, Mycobacterium bovis subsp bovis AF2122/97
ccgccguccccgcc

SEQ ID NO: 1137911 - RNA, 15 nt, Mycobacterium bovis subsp bovis AF2122/97
ccgccguccccgccg

SEQ ID NO: 1137912 - RNA, 19 nt, Mycobacterium bovis subsp bovis AF2122/97
ccgccguccccgccgacgc

SEQ ID NO: 1137913 - RNA, 14 nt, Mycobacterium bovis subsp bovis AF2122/97
ccgccgucccggcu

SEQ ID NO: 1137914 - RNA, 22 nt, Mycobacterium bovis subsp bovis AF2122/97
ccgccgucaccgccguugccga

SEQ ID NO: 1137915 - RNA, 23 nt, Mycobacterium bovis subsp bovis AF2122/97
ccgccgggcaucggugccacggc

SEQ ID NO: 1137916 - RNA, 20 nt, Mycobacterium bovis subsp bovis AF2122/97
ccgccgggauaucgucgacg

SEQ ID NO: 1137917 - RNA, 18 nt, Mycobacterium bovis subsp bovis AF2122/97
ccgccgggcccucgccau

SEQ ID NO: 1137918 - RNA, 17 nt, Mycobacterium bovis subsp bovis AF2122/97
aaaugccugcgcgaugc

SEQ ID NO: 1137919 - RNA, 20 nt, Mycobacterium bovis subsp bovis AF2122/97
aaaugccgagaagugggcgg

SEQ ID NO: 1137920 - RNA, 12 nt, Mycobacterium bovis subsp bovis AF2122/97
aaaugccggugc

SEQ ID NO: 1137921 - RNA, 20 nt, Mycobacterium bovis subsp bovis AF2122/97
ccgccguugucgaccuccuc

SEQ ID NO: 1137922 - RNA, 21 nt, Mycobacterium bovis subsp bovis AF2122/97
ccgccucaaugaccaccgggc

SEQ ID NO: 1137923 - RNA, 14 nt, Mycobacterium bovis subsp bovis AF2122/97
ccgccuccaccgcc

SEQ ID NO: 1137924 - RNA, 21 nt, Mycobacterium bovis subsp bovis AF2122/97
ccgccuggaaggaaccgaucg

SEQ ID NO: 1137925 - RNA, 15 nt, Mycobacterium bovis subsp bovis AF2122/97
ccgccugcuggccgc

SEQ ID NO: 1137926 - RNA, 15 nt, Mycobacterium bovis subsp bovis AF2122/97
ccgccugcucggcga

SEQ ID NO: 1137927 - RNA, 14 nt, Mycobacterium bovis subsp bovis AF2122/97
ccgccuggacgccg

SEQ ID NO: 1137928 - RNA, 17 nt, Mycobacterium bovis subsp bovis AF2122/97
ccgccuggacgccgccg

SEQ ID NO: 1137929 - RNA, 15 nt, Mycobacterium bovis subsp bovis AF2122/97
ccgccguugacgccg

SEQ ID NO: 1137930 - RNA, 15 nt, Mycobacterium bovis subsp bovis AF2122/97
ccgccguccagcgcc

SEQ ID NO: 1137931 - RNA, 15 nt, Mycobacterium bovis subsp bovis AF2122/97
ccgccguugccgauc

SEQ ID NO: 1137932 - RNA, 17 nt, Mycobacterium bovis subsp bovis AF2122/97
ccgccguugccgaucac

SEQ ID NO: 1137933 - RNA, 22 nt, Mycobacterium bovis subsp bovis AF2122/97
ccgccguugccgaucagcccgg

SEQ ID NO: 1137934 - RNA, 17 nt, Mycobacterium bovis subsp bovis AF2122/97
ccgccguugccgauccc

SEQ ID NO: 1137935 - RNA, 18 nt, Mycobacterium bovis subsp bovis AF2122/97
ccgccguugccgaucgcu

SEQ ID NO: 1137936 - RNA, 13 nt, Mycobacterium bovis subsp bovis AF2122/97
ccgccguugccgc

SEQ ID NO: 1137937 - RNA, 15 nt, Mycobacterium bovis subsp bovis AF2122/97
ccgccguugccgcca

SEQ ID NO: 1137938 - RNA, 15 nt, Mycobacterium bovis subsp bovis AF2122/97
ccgccguugccgccg

SEQ ID NO: 1137939 - RNA, 18 nt, Mycobacterium bovis subsp bovis AF2122/97
ccgccguugccgccgacg

SEQ ID NO: 1137940 - RNA, 20 nt, Mycobacterium bovis subsp bovis AF2122/97
ccgccguugccgccgacgcc

SEQ ID NO: 1137941 - RNA, 22 nt, Mycobacterium bovis subsp bovis AF2122/97
ccgccguugccgccgacgccgc

SEQ ID NO: 1137942 - RNA, 16 nt, Mycobacterium bovis subsp bovis AF2122/97
ccgccguugccgccgc

SEQ ID NO: 1137943 - RNA, 22 nt, Mycobacterium bovis subsp bovis AF2122/97
ccgccguugccgccggcgccgc

SEQ ID NO: 1137944 - RNA, 17 nt, Mycobacterium bovis subsp bovis AF2122/97
ccgccguugccgccggu

SEQ ID NO: 1137945 - RNA, 17 nt, Mycobacterium bovis subsp bovis AF2122/97
ccgccguugccgccguc

SEQ ID NO: 1137946 - RNA, 15 nt, Mycobacterium bovis subsp bovis AF2122/97
ccgccguuuccgccg

SEQ ID NO: 1137947 - RNA, 16 nt, Mycobacterium bovis subsp bovis AF2122/97
ccgccguuuccgccgc

SEQ ID NO: 1137948 - RNA, 17 nt, Mycobacterium bovis subsp bovis AF2122/97
ccgccguuuccgccgcc

SEQ ID NO: 1137949 - RNA, 18 nt, Mycobacterium bovis subsp bovis AF2122/97
ccgccguuuccgccgccg

SEQ ID NO: 1137950 - RNA, 20 nt, Mycobacterium bovis subsp bovis AF2122/97
ccgccuaaagcgugucgccc

SEQ ID NO: 1137951 - RNA, 19 nt, Mycobacterium bovis subsp bovis AF2122/97
ccgccguuggcucgagccg

SEQ ID NO: 1137952 - RNA, 20 nt, Mycobacterium bovis subsp bovis AF2122/97
ccgccguuggcucgagccgc

SEQ ID NO: 1137953 - RNA, 16 nt, Mycobacterium bovis subsp bovis AF2122/97
ccgccguugccgauca

SEQ ID NO: 1137954 - RNA, 21 nt, Mycobacterium bovis subsp bovis AF2122/97
ccgccguugccgccguuaccg

SEQ ID NO: 1137955 - RNA, 22 nt, Mycobacterium bovis subsp bovis AF2122/97
ccgccguugccgccguugccga

SEQ ID NO: 1137956 - RNA, 22 nt, Mycobacterium bovis subsp bovis AF2122/97
ccgccguugccgccguugccgc

SEQ ID NO: 1137957 - RNA, 15 nt, Mycobacterium bovis subsp bovis AF2122/97
ccgccguugccgccu

SEQ ID NO: 1137958 - RNA, 14 nt, Mycobacterium bovis subsp bovis AF2122/97
ccgccguugccggc

SEQ ID NO: 1137959 - RNA, 15 nt, Mycobacterium bovis subsp bovis AF2122/97
ccgccguugccguac

SEQ ID NO: 1137960 - RNA, 19 nt, Mycobacterium bovis subsp bovis AF2122/97
ccgccguugccgucgucgc

SEQ ID NO: 1137961 - RNA, 21 nt, Mycobacterium bovis subsp bovis AF2122/97
ccgccguugccgucgucgccg

SEQ ID NO: 1137962 - RNA, 22 nt, Mycobacterium bovis subsp bovis AF2122/97
ccgccguugccguuggugccgc

SEQ ID NO: 1137963 - RNA, 18 nt, Mycobacterium bovis subsp bovis AF2122/97
ccgccugucccgccggcc

SEQ ID NO: 1137964 - RNA, 14 nt, Mycobacterium bovis subsp bovis AF2122/97
ccgccugugccgcc

SEQ ID NO: 1137965 - RNA, 20 nt, Mycobacterium bovis subsp bovis AF2122/97
ccgccuuacgcaccgaugcc

SEQ ID NO: 1137966 - RNA, 17 nt, Mycobacterium bovis subsp bovis AF2122/97
ccgccuucucccgcacg

SEQ ID NO: 1137967 - RNA, 14 nt, Mycobacterium bovis subsp bovis AF2122/97
ccgccuucuccggc

SEQ ID NO: 1137968 - RNA, 15 nt, Mycobacterium bovis subsp bovis AF2122/97
ccgccuucuccggcg

SEQ ID NO: 1137969 - RNA, 16 nt, Mycobacterium bovis subsp bovis AF2122/97
ccgccuuccuggcggg

SEQ ID NO: 1137970 - RNA, 18 nt, Mycobacterium bovis subsp bovis AF2122/97
ccgccuuccuggcgggcg

SEQ ID NO: 1137971 - RNA, 14 nt, Mycobacterium bovis subsp bovis AF2122/97
ccgccuucuuggcg

SEQ ID NO: 1137972 - RNA, 15 nt, Mycobacterium bovis subsp bovis AF2122/97
ccgccuggguugacc

SEQ ID NO: 1137973 - RNA, 20 nt, Mycobacterium bovis subsp bovis AF2122/97
ccgccuggguugaccgccac

SEQ ID NO: 1137974 - RNA, 16 nt, Mycobacterium bovis subsp bovis AF2122/97
ccgccuguacggcggc

SEQ ID NO: 1137975 - RNA, 18 nt, Mycobacterium bovis subsp bovis AF2122/97
ccgccuggaucagcgcgu

SEQ ID NO: 1137976 - RNA, 15 nt, Mycobacterium bovis subsp bovis AF2122/97
ccgccugggcggcca

SEQ ID NO: 1137977 - RNA, 21 nt, Mycobacterium bovis subsp bovis AF2122/97
ccgccuggggguucuggccgu

SEQ ID NO: 1137978 - RNA, 13 nt, Mycobacterium bovis subsp bovis AF2122/97
ccgcgaacccgau

SEQ ID NO: 1137979 - RNA, 16 nt, Mycobacterium bovis subsp bovis AF2122/97
ccgcgaacgcgacagc

SEQ ID NO: 1137980 - RNA, 20 nt, Mycobacterium bovis subsp bovis AF2122/97
ccgcgaaauuacuucggcca

SEQ ID NO: 1137981 - RNA, 18 nt, Mycobacterium bovis subsp bovis AF2122/97
ccgcgaaauagcgagcgu

SEQ ID NO: 1137982 - RNA, 23 nt, Mycobacterium bovis subsp bovis AF2122/97
ccgccuuggucgcgucggcugcc

SEQ ID NO: 1137983 - RNA, 16 nt, Mycobacterium bovis subsp bovis AF2122/97
ccgccuugcagcgcgu

SEQ ID NO: 1137984 - RNA, 13 nt, Mycobacterium bovis subsp bovis AF2122/97
ccgcgaaacccau

SEQ ID NO: 1137985 - RNA, 15 nt, Mycobacterium bovis subsp bovis AF2122/97
ccgccuuugcccgcc

SEQ ID NO: 1137986 - RNA, 17 nt, Mycobacterium bovis subsp bovis AF2122/97
ccgccuuugcccgccgc

SEQ ID NO: 1137987 - RNA, 19 nt, Mycobacterium bovis subsp bovis AF2122/97
ccgccuuggcuucgacgcu

SEQ ID NO: 1137988 - RNA, 22 nt, Mycobacterium bovis subsp bovis AF2122/97
ccgccuuggccaccaucgccgc

SEQ ID NO: 1137989 - RNA, 16 nt, Mycobacterium bovis subsp bovis AF2122/97
ccgccuuggcccccgg

SEQ ID NO: 1137990 - RNA, 18 nt, Mycobacterium bovis subsp bovis AF2122/97
ccgccuuggcccccgggu

SEQ ID NO: 1137991 - RNA, 14 nt, Mycobacterium bovis subsp bovis AF2122/97
ccuggccggugcgc

SEQ ID NO: 1137992 - RNA, 17 nt, Mycobacterium bovis subsp bovis AF2122/97
ccuggccgucccaccag

SEQ ID NO: 1137993 - RNA, 17 nt, Mycobacterium bovis subsp bovis AF2122/97
ccuggccgggaccgccc

SEQ ID NO: 1137994 - RNA, 18 nt, Mycobacterium bovis subsp bovis AF2122/97
ccuggccugcccagcacc

SEQ ID NO: 1137995 - RNA, 22 nt, Mycobacterium bovis subsp bovis AF2122/97
ccuggcccgccacgaugucguc

SEQ ID NO: 1137996 - RNA, 14 nt, Mycobacterium bovis subsp bovis AF2122/97
ccuggccgcccgcu

SEQ ID NO: 1137997 - RNA, 18 nt, Mycobacterium bovis subsp bovis AF2122/97
ccuggccgcccuggccgc

SEQ ID NO: 1137998 - RNA, 12 nt, Mycobacterium bovis subsp bovis AF2122/97
ccuggccgccgc

SEQ ID NO: 1137999 - RNA, 14 nt, Mycobacterium bovis subsp bovis AF2122/97
ccuggccgccgccg

SEQ ID NO: 1138000 - RNA, 14 nt, Mycobacterium bovis subsp bovis AF2122/97
ccuggccgccggcc

SEQ ID NO: 1138001 - RNA, 15 nt, Mycobacterium bovis subsp bovis AF2122/97
ccuggccgccggccc

SEQ ID NO: 1138002 - RNA, 17 nt, Mycobacterium bovis subsp bovis AF2122/97
ccuggccgccggcgccg

SEQ ID NO: 1138003 - RNA, 12 nt, Mycobacterium bovis subsp bovis AF2122/97
ccuggccgcgcc

SEQ ID NO: 1138004 - RNA, 16 nt, Mycobacterium bovis subsp bovis AF2122/97
ccuggccgcgccgggg

SEQ ID NO: 1138005 - RNA, 19 nt, Mycobacterium bovis subsp bovis AF2122/97
ccuggcgggcgccuugguc

SEQ ID NO: 1138006 - RNA, 19 nt, Mycobacterium bovis subsp bovis AF2122/97
ccuggcggguguggcagug

SEQ ID NO: 1138007 - RNA, 16 nt, Mycobacterium bovis subsp bovis AF2122/97
ccuggcggugccggcg

SEQ ID NO: 1138008 - RNA, 21 nt, Mycobacterium bovis subsp bovis AF2122/97
ccuggcggugccggcggcgca

SEQ ID NO: 1138009 - RNA, 18 nt, Mycobacterium bovis subsp bovis AF2122/97
ccuggcgaacucgcgcag

SEQ ID NO: 1138010 - RNA, 21 nt, Mycobacterium bovis subsp bovis AF2122/97
ccuggcgaacucgcgcaggaa

SEQ ID NO: 1138011 - RNA, 23 nt, Mycobacterium bovis subsp bovis AF2122/97
ccuggaaguacacggcggcccgc

SEQ ID NO: 1138012 - RNA, 15 nt, Mycobacterium bovis subsp bovis AF2122/97
ccuggaaugccgcca

SEQ ID NO: 1138013 - RNA, 23 nt, Mycobacterium bovis subsp bovis AF2122/97
ccuggaaagggccgccgcuggug

SEQ ID NO: 1138014 - RNA, 20 nt, Mycobacterium bovis subsp bovis AF2122/97
ccuggaaauuucaguucggc

SEQ ID NO: 1138015 - RNA, 22 nt, Mycobacterium bovis subsp bovis AF2122/97
ccuggaaaggacggccggccgc

SEQ ID NO: 1138016 - RNA, 22 nt, Mycobacterium bovis subsp bovis AF2122/97
ccuggaccucguugcugccggc

SEQ ID NO: 1138017 - RNA, 14 nt, Mycobacterium bovis subsp bovis AF2122/97
ccuggaccagcggg

SEQ ID NO: 1138018 - RNA, 14 nt, Mycobacterium bovis subsp bovis AF2122/97
ccuggacgucggcg

SEQ ID NO: 1138019 - RNA, 21 nt, Mycobacterium bovis subsp bovis AF2122/97
ccuggacgcgcauuucaccgg

SEQ ID NO: 1138020 - RNA, 15 nt, Mycobacterium bovis subsp bovis AF2122/97
ccuggacgccgccgg

SEQ ID NO: 1138021 - RNA, 16 nt, Mycobacterium bovis subsp bovis AF2122/97
ccuggacugcagcgcc

SEQ ID NO: 1138022 - RNA, 11 nt, Mycobacterium bovis subsp bovis AF2122/97
ccuggagccgu

SEQ ID NO: 1138023 - RNA, 15 nt, Mycobacterium bovis subsp bovis AF2122/97
ccuggagccgugcgg

SEQ ID NO: 1138024 - RNA, 19 nt, Mycobacterium bovis subsp bovis AF2122/97
ccuggagccgugcggucgc

SEQ ID NO: 1138025 - RNA, 20 nt, Mycobacterium bovis subsp bovis AF2122/97
ccuggagcagccacgauccu

SEQ ID NO: 1138026 - RNA, 14 nt, Mycobacterium bovis subsp bovis AF2122/97
ccuggccacccaga

SEQ ID NO: 1138027 - RNA, 21 nt, Mycobacterium bovis subsp bovis AF2122/97
ccuggccacucccagccaacc

SEQ ID NO: 1138028 - RNA, 18 nt, Mycobacterium bovis subsp bovis AF2122/97
ccuggccagcccgagcuc

SEQ ID NO: 1138029 - RNA, 21 nt, Mycobacterium bovis subsp bovis AF2122/97
ccuggccagcccgagcucggg

SEQ ID NO: 1138030 - RNA, 22 nt, Mycobacterium bovis subsp bovis AF2122/97
ccuggcacccggggugcccggc

SEQ ID NO: 1138031 - RNA, 14 nt, Mycobacterium bovis subsp bovis AF2122/97
ccuggcagacgccc

SEQ ID NO: 1138032 - RNA, 13 nt, Mycobacterium bovis subsp bovis AF2122/97
ccuggcacccggg

SEQ ID NO: 1138033 - RNA, 16 nt, Mycobacterium bovis subsp bovis AF2122/97
ccuggcaacgacacgc

SEQ ID NO: 1138034 - RNA, 15 nt, Mycobacterium bovis subsp bovis AF2122/97
ccuggaucagccagu

SEQ ID NO: 1138035 - RNA, 17 nt, Mycobacterium bovis subsp bovis AF2122/97
ccuggauggguugacgu

SEQ ID NO: 1138036 - RNA, 20 nt, Mycobacterium bovis subsp bovis AF2122/97
ccuggauaugcuccggccgc

SEQ ID NO: 1138037 - RNA, 14 nt, Mycobacterium bovis subsp bovis AF2122/97
ccuggucgagcacg

SEQ ID NO: 1138038 - RNA, 16 nt, Mycobacterium bovis subsp bovis AF2122/97
ccuggucgagcacgcu

SEQ ID NO: 1138039 - RNA, 16 nt, Mycobacterium bovis subsp bovis AF2122/97
ccuggucggccagguc

SEQ ID NO: 1138040 - RNA, 17 nt, Mycobacterium bovis subsp bovis AF2122/97
ccuggugcaaccgugcc

SEQ ID NO: 1138041 - RNA, 21 nt, Mycobacterium bovis subsp bovis AF2122/97
ccugguugaccucggugaaga

SEQ ID NO: 1138042 - RNA, 18 nt, Mycobacterium bovis subsp bovis AF2122/97
ccugguggucagucacca

SEQ ID NO: 1138043 - RNA, 14 nt, Mycobacterium bovis subsp bovis AF2122/97
ccugguuauucgac

SEQ ID NO: 1138044 - RNA, 15 nt, Mycobacterium bovis subsp bovis AF2122/97
ccugguacucccgcg

SEQ ID NO: 1138045 - RNA, 19 nt, Mycobacterium bovis subsp bovis AF2122/97
ccuggucgaaacgguacgc

SEQ ID NO: 1138046 - RNA, 16 nt, Mycobacterium bovis subsp bovis AF2122/97
ccugguaccccagcac

SEQ ID NO: 1138047 - RNA, 21 nt, Mycobacterium bovis subsp bovis AF2122/97
ccuggguuugcacggcgcgcc

SEQ ID NO: 1138048 - RNA, 17 nt, Mycobacterium bovis subsp bovis AF2122/97
ccugguaaggccggccg

SEQ ID NO: 1138049 - RNA, 19 nt, Mycobacterium bovis subsp bovis AF2122/97
ccugggugauggccgcgcc

SEQ ID NO: 1138050 - RNA, 16 nt, Mycobacterium bovis subsp bovis AF2122/97
ccugggugccggcagc

SEQ ID NO: 1138051 - RNA, 17 nt, Mycobacterium bovis subsp bovis AF2122/97
ccuggguauccaccgcg

SEQ ID NO: 1138052 - RNA, 22 nt, Mycobacterium bovis subsp bovis AF2122/97
ccuggggccguccggcuuggcg

SEQ ID NO: 1138053 - RNA, 13 nt, Mycobacterium bovis subsp bovis AF2122/97
ccuggcucggcau

SEQ ID NO: 1138054 - RNA, 13 nt, Mycobacterium bovis subsp bovis AF2122/97
ccugggccgccgc

SEQ ID NO: 1138055 - RNA, 15 nt, Mycobacterium bovis subsp bovis AF2122/97
ccugggcgcgcuggc

SEQ ID NO: 1138056 - RNA, 16 nt, Mycobacterium bovis subsp bovis AF2122/97
ccugggcgcgcuggcg

SEQ ID NO: 1138057 - RNA, 17 nt, Mycobacterium bovis subsp bovis AF2122/97
ccugggcgacuaccggc

SEQ ID NO: 1138058 - RNA, 19 nt, Mycobacterium bovis subsp bovis AF2122/97
ccugggcgacuaccggcuc

SEQ ID NO: 1138059 - RNA, 13 nt, Mycobacterium bovis subsp bovis AF2122/97
ccugggcgccggc

SEQ ID NO: 1138060 - RNA, 14 nt, Mycobacterium bovis subsp bovis AF2122/97
ccugggcgccggcg

SEQ ID NO: 1138061 - RNA, 13 nt, Mycobacterium bovis subsp bovis AF2122/97
ccugggcgucgac

SEQ ID NO: 1138062 - RNA, 16 nt, Mycobacterium bovis subsp bovis AF2122/97
ccugggcgucgaccac

SEQ ID NO: 1138063 - RNA, 12 nt, Mycobacterium bovis subsp bovis AF2122/97
ccugggcgggcu

SEQ ID NO: 1138064 - RNA, 14 nt, Mycobacterium bovis subsp bovis AF2122/97
ccugggcugccggc

SEQ ID NO: 1138065 - RNA, 17 nt, Mycobacterium bovis subsp bovis AF2122/97
ccuggcgugucgccgcc

SEQ ID NO: 1138066 - RNA, 22 nt, Mycobacterium bovis subsp bovis AF2122/97
ccuggcuagcgccgaucuucgc

SEQ ID NO: 1138067 - RNA, 21 nt, Mycobacterium bovis subsp bovis AF2122/97
ccuggcuaucgcagaacggac

SEQ ID NO: 1138068 - RNA, 19 nt, Mycobacterium bovis subsp bovis AF2122/97
ccuggcuguccgcgggccg

SEQ ID NO: 1138069 - RNA, 19 nt, Mycobacterium bovis subsp bovis AF2122/97
ccugggacggcggcagucg

SEQ ID NO: 1138070 - RNA, 13 nt, Mycobacterium bovis subsp bovis AF2122/97
ccugggagaucgg

SEQ ID NO: 1138071 - RNA, 17 nt, Mycobacterium bovis subsp bovis AF2122/97
ccugggauccggcggca

SEQ ID NO: 1138072 - RNA, 21 nt, Mycobacterium bovis subsp bovis AF2122/97
ccugggauccggcggcaggua

SEQ ID NO: 1138073 - RNA, 14 nt, Mycobacterium bovis subsp bovis AF2122/97
ccugggcacggccg

SEQ ID NO: 1138074 - RNA, 13 nt, Mycobacterium bovis subsp bovis AF2122/97
ccugggccagccg

SEQ ID NO: 1138075 - RNA, 14 nt, Mycobacterium bovis subsp bovis AF2122/97
ccugggccagccgc

SEQ ID NO: 1138076 - RNA, 17 nt, Mycobacterium bovis subsp bovis AF2122/97
ccugggccagccgcuca

SEQ ID NO: 1138077 - RNA, 15 nt, Mycobacterium bovis subsp bovis AF2122/97
ccugcgcgcggccgc

SEQ ID NO: 1138078 - RNA, 18 nt, Mycobacterium bovis subsp bovis AF2122/97
ccugcgcgcggccgcgcu

SEQ ID NO: 1138079 - RNA, 13 nt, Mycobacterium bovis subsp bovis AF2122/97
ccugcgcggcgau

SEQ ID NO: 1138080 - RNA, 13 nt, Mycobacterium bovis subsp bovis AF2122/97
ccugcgccgcagu

SEQ ID NO: 1138081 - RNA, 18 nt, Mycobacterium bovis subsp bovis AF2122/97
ccugcgccucggcggcca

SEQ ID NO: 1138082 - RNA, 13 nt, Mycobacterium bovis subsp bovis AF2122/97
ccugcgcaucacc

SEQ ID NO: 1138083 - RNA, 18 nt, Mycobacterium bovis subsp bovis AF2122/97
ccugcgcgaccgaccagc

SEQ ID NO: 1138084 - RNA, 20 nt, Mycobacterium bovis subsp bovis AF2122/97
ccugcgccuuggucgccggc

SEQ ID NO: 1138085 - RNA, 21 nt, Mycobacterium bovis subsp bovis AF2122/97
ccugcgccuuggucgccggcg

SEQ ID NO: 1138086 - RNA, 19 nt, Mycobacterium bovis subsp bovis AF2122/97
ccugcgccgcacgccgacc

SEQ ID NO: 1138087 - RNA, 17 nt, Mycobacterium bovis subsp bovis AF2122/97
ccugcgccgccagcgcc

SEQ ID NO: 1138088 - RNA, 14 nt, Mycobacterium bovis subsp bovis AF2122/97
ccugcgccgcccgc

SEQ ID NO: 1138089 - RNA, 19 nt, Mycobacterium bovis subsp bovis AF2122/97
ccugcgccgcccgcgccac

SEQ ID NO: 1138090 - RNA, 17 nt, Mycobacterium bovis subsp bovis AF2122/97
ccugcgaaacgcuggcc

SEQ ID NO: 1138091 - RNA, 19 nt, Mycobacterium bovis subsp bovis AF2122/97
ccugcgaaacgcuggccac

SEQ ID NO: 1138092 - RNA, 15 nt, Mycobacterium bovis subsp bovis AF2122/97
ccugccucaccgccg

SEQ ID NO: 1138093 - RNA, 16 nt, Mycobacterium bovis subsp bovis AF2122/97
ccugccucaccgccgc

SEQ ID NO: 1138094 - RNA, 17 nt, Mycobacterium bovis subsp bovis AF2122/97
ccugccucaccgccgcu

SEQ ID NO: 1138095 - RNA, 17 nt, Mycobacterium bovis subsp bovis AF2122/97
ccugcgaagucgcaugg

SEQ ID NO: 1138096 - RNA, 23 nt, Mycobacterium bovis subsp bovis AF2122/97
ccugcgaaacgcuggccacucac

SEQ ID NO: 1138097 - RNA, 18 nt, Mycobacterium bovis subsp bovis AF2122/97
ccugcgaccaggcgcggc

SEQ ID NO: 1138098 - RNA, 19 nt, Mycobacterium bovis subsp bovis AF2122/97
ccugcgaccaggcgcggcg

SEQ ID NO: 1138099 - RNA, 15 nt, Mycobacterium bovis subsp bovis AF2122/97
ccugcgagucgcgcu

SEQ ID NO: 1138100 - RNA, 17 nt, Mycobacterium bovis subsp bovis AF2122/97
ccugcgagugcggcacg

SEQ ID NO: 1138101 - RNA, 13 nt, Mycobacterium bovis subsp bovis AF2122/97
ccugcgcacucga

SEQ ID NO: 1138102 - RNA, 16 nt, Mycobacterium bovis subsp bovis AF2122/97
ccugcgccacccgcgg

SEQ ID NO: 1138103 - RNA, 13 nt, Mycobacterium bovis subsp bovis AF2122/97
ccugcgccgaccc

SEQ ID NO: 1138104 - RNA, 23 nt, Mycobacterium bovis subsp bovis AF2122/97
ccugcgccgaguuguucgcccac

SEQ ID NO: 1138105 - RNA, 13 nt, Mycobacterium bovis subsp bovis AF2122/97
ccugcccuagccc

SEQ ID NO: 1138106 - RNA, 23 nt, Mycobacterium bovis subsp bovis AF2122/97
ccugcccuccgugggcagcgcgc

SEQ ID NO: 1138107 - RNA, 15 nt, Mycobacterium bovis subsp bovis AF2122/97
ccugccgaucgggcu

SEQ ID NO: 1138108 - RNA, 12 nt, Mycobacterium bovis subsp bovis AF2122/97
ccugccgacgcu

SEQ ID NO: 1138109 - RNA, 20 nt, Mycobacterium bovis subsp bovis AF2122/97
ccugccgacucaucggccgc

SEQ ID NO: 1138110 - RNA, 22 nt, Mycobacterium bovis subsp bovis AF2122/97
ccugccgaugacgauggccgcc

SEQ ID NO: 1138111 - RNA, 17 nt, Mycobacterium bovis subsp bovis AF2122/97
ccugccgcuguggccgc

SEQ ID NO: 1138112 - RNA, 16 nt, Mycobacterium bovis subsp bovis AF2122/97
ccugcccagcaccacc

SEQ ID NO: 1138113 - RNA, 14 nt, Mycobacterium bovis subsp bovis AF2122/97
ccugccccacccgc

SEQ ID NO: 1138114 - RNA, 20 nt, Mycobacterium bovis subsp bovis AF2122/97
ccugccccacccgcggcgcc

SEQ ID NO: 1138115 - RNA, 15 nt, Mycobacterium bovis subsp bovis AF2122/97
ccugcccccgcgcgc

SEQ ID NO: 1138116 - RNA, 19 nt, Mycobacterium bovis subsp bovis AF2122/97
ccugcccccgcgcgcacgg

SEQ ID NO: 1138117 - RNA, 20 nt, Mycobacterium bovis subsp bovis AF2122/97
ccugcccccgcgcgcacggc

SEQ ID NO: 1138118 - RNA, 14 nt, Mycobacterium bovis subsp bovis AF2122/97
ccugcccggcccgc

SEQ ID NO: 1138119 - RNA, 15 nt, Mycobacterium bovis subsp bovis AF2122/97
ccugcccggcccgcc

SEQ ID NO: 1138120 - RNA, 17 nt, Mycobacterium bovis subsp bovis AF2122/97
ccugcccgaaccaccac

SEQ ID NO: 1138121 - RNA, 22 nt, Mycobacterium bovis subsp bovis AF2122/97
ccugcccgaaccaccaccggca

SEQ ID NO: 1138122 - RNA, 20 nt, Mycobacterium bovis subsp bovis AF2122/97
ccugcccguaauugcaggug

SEQ ID NO: 1138123 - RNA, 15 nt, Mycobacterium bovis subsp bovis AF2122/97
ccugcccaccauccc

SEQ ID NO: 1138124 - RNA, 15 nt, Mycobacterium bovis subsp bovis AF2122/97
ccugccaucacgcgc

SEQ ID NO: 1138125 - RNA, 14 nt, Mycobacterium bovis subsp bovis AF2122/97
ccugccaucacgcg

SEQ ID NO: 1138126 - RNA, 15 nt, Mycobacterium bovis subsp bovis AF2122/97
ccugcguggagcgcu

SEQ ID NO: 1138127 - RNA, 23 nt, Mycobacterium bovis subsp bovis AF2122/97
ccugcucauccaccucgauggcg

SEQ ID NO: 1138128 - RNA, 22 nt, Mycobacterium bovis subsp bovis AF2122/97
ccugcgggugcgucgaugagca

SEQ ID NO: 1138129 - RNA, 13 nt, Mycobacterium bovis subsp bovis AF2122/97
ccugcguccgacg

SEQ ID NO: 1138130 - RNA, 13 nt, Mycobacterium bovis subsp bovis AF2122/97
ccugcgucggccc

SEQ ID NO: 1138131 - RNA, 19 nt, Mycobacterium bovis subsp bovis AF2122/97
ccugcggcaacggcucguc

SEQ ID NO: 1138132 - RNA, 20 nt, Mycobacterium bovis subsp bovis AF2122/97
ccugcggcaccgcugaggaa

SEQ ID NO: 1138133 - RNA, 13 nt, Mycobacterium bovis subsp bovis AF2122/97
ccugcggaucgga

SEQ ID NO: 1138134 - RNA, 17 nt, Mycobacterium bovis subsp bovis AF2122/97
ccugcggccacgguggc

SEQ ID NO: 1138135 - RNA, 22 nt, Mycobacterium bovis subsp bovis AF2122/97
ccugcgggccgagaucacgccg

SEQ ID NO: 1138136 - RNA, 19 nt, Mycobacterium bovis subsp bovis AF2122/97
ccugcgggccggcaucguc

SEQ ID NO: 1138137 - RNA, 22 nt, Mycobacterium bovis subsp bovis AF2122/97
ccugcgggaacgcggcggcgaa

SEQ ID NO: 1138138 - RNA, 14 nt, Mycobacterium bovis subsp bovis AF2122/97
ccugcgggaaguug

SEQ ID NO: 1138139 - RNA, 19 nt, Mycobacterium bovis subsp bovis AF2122/97
ccugcgggaucgccgagac

SEQ ID NO: 1138140 - RNA, 17 nt, Mycobacterium bovis subsp bovis AF2122/97
ccugcuggucggugaug

SEQ ID NO: 1138141 - RNA, 17 nt, Mycobacterium bovis subsp bovis AF2122/97
ccugcuggcccaacauc

SEQ ID NO: 1138142 - RNA, 16 nt, Mycobacterium bovis subsp bovis AF2122/97
ccugcugcacaucgca

SEQ ID NO: 1138143 - RNA, 13 nt, Mycobacterium bovis subsp bovis AF2122/97
ccugcucgucggu

SEQ ID NO: 1138144 - RNA, 15 nt, Mycobacterium bovis subsp bovis AF2122/97
ccugcucgucgagcc

SEQ ID NO: 1138145 - RNA, 14 nt, Mycobacterium bovis subsp bovis AF2122/97
ccugcucgucggcc

SEQ ID NO: 1138146 - RNA, 16 nt, Mycobacterium bovis subsp bovis AF2122/97
ccugcucgucggccac

SEQ ID NO: 1138147 - RNA, 17 nt, Mycobacterium bovis subsp bovis AF2122/97
ccugcucgucggccacc

SEQ ID NO: 1138148 - RNA, 19 nt, Mycobacterium bovis subsp bovis AF2122/97
ccugcucggcgaccgucgg

SEQ ID NO: 1138149 - RNA, 22 nt, Mycobacterium bovis subsp bovis AF2122/97
ccugcucggcgaguucggcagc

SEQ ID NO: 1138150 - RNA, 17 nt, Mycobacterium bovis subsp bovis AF2122/97
ccugcucggcgcgccgg

SEQ ID NO: 1138151 - RNA, 15 nt, Mycobacterium bovis subsp bovis AF2122/97
ccugcucgauacggc

SEQ ID NO: 1138152 - RNA, 16 nt, Mycobacterium bovis subsp bovis AF2122/97
ccugcuccucggccag

SEQ ID NO: 1138153 - RNA, 12 nt, Mycobacterium bovis subsp bovis AF2122/97
ccugcagcacga

SEQ ID NO: 1138154 - RNA, 14 nt, Mycobacterium bovis subsp bovis AF2122/97
ccugcacgcccggc

SEQ ID NO: 1138155 - RNA, 15 nt, Mycobacterium bovis subsp bovis AF2122/97
ccugcacgcccggcg

SEQ ID NO: 1138156 - RNA, 16 nt, Mycobacterium bovis subsp bovis AF2122/97
ccugcaguucggcgua

SEQ ID NO: 1138157 - RNA, 12 nt, Mycobacterium bovis subsp bovis AF2122/97
ccugcaggccgc

SEQ ID NO: 1138158 - RNA, 14 nt, Mycobacterium bovis subsp bovis AF2122/97
ccugccaccggcgc

SEQ ID NO: 1138159 - RNA, 18 nt, Mycobacterium bovis subsp bovis AF2122/97
ccugccacgacgaacacc

SEQ ID NO: 1138160 - RNA, 21 nt, Mycobacterium bovis subsp bovis AF2122/97
ccugccacagcgacagcgugc

SEQ ID NO: 1138161 - RNA, 22 nt, Mycobacterium bovis subsp bovis AF2122/97
ccugccacagcgacagcgugcc

SEQ ID NO: 1138162 - RNA, 19 nt, Mycobacterium bovis subsp bovis AF2122/97
ccugcacccagccgugccc

SEQ ID NO: 1138163 - RNA, 14 nt, Mycobacterium bovis subsp bovis AF2122/97
ccugcaccgccgcc

SEQ ID NO: 1138164 - RNA, 17 nt, Mycobacterium bovis subsp bovis AF2122/97
ccugcaccgccgccgcc

SEQ ID NO: 1138165 - RNA, 17 nt, Mycobacterium bovis subsp bovis AF2122/97
ccugcaccacggcggcc

SEQ ID NO: 1138166 - RNA, 18 nt, Mycobacterium bovis subsp bovis AF2122/97
ccugcaccacggcggcca

SEQ ID NO: 1138167 - RNA, 18 nt, Mycobacterium bovis subsp bovis AF2122/97
ccugcaagaaccacugca

SEQ ID NO: 1138168 - RNA, 17 nt, Mycobacterium bovis subsp bovis AF2122/97
ccugcaagacgccgauc

SEQ ID NO: 1138169 - RNA, 19 nt, Mycobacterium bovis subsp bovis AF2122/97
ccugcaacgccgcggacca

SEQ ID NO: 1138170 - RNA, 21 nt, Mycobacterium bovis subsp bovis AF2122/97
ccugcaacgucuugcuggucg

SEQ ID NO: 1138171 - RNA, 13 nt, Mycobacterium bovis subsp bovis AF2122/97
ccugcaacgccgc

SEQ ID NO: 1138172 - RNA, 19 nt, Mycobacterium bovis subsp bovis AF2122/97
ccugaugaucguccagccc

SEQ ID NO: 1138173 - RNA, 16 nt, Mycobacterium bovis subsp bovis AF2122/97
ccugaugcggccggcg

SEQ ID NO: 1138174 - RNA, 18 nt, Mycobacterium bovis subsp bovis AF2122/97
ccugaugcggccggcgcc

SEQ ID NO: 1138175 - RNA, 22 nt, Mycobacterium bovis subsp bovis AF2122/97
ccugaugugaguccagccggcg

SEQ ID NO: 1138176 - RNA, 21 nt, Mycobacterium bovis subsp bovis AF2122/97
ccugauaugacuugcgcgcgg

SEQ ID NO: 1138177 - RNA, 20 nt, Mycobacterium bovis subsp bovis AF2122/97
ccugaucgagcgccagcgcc

SEQ ID NO: 1138178 - RNA, 22 nt, Mycobacterium bovis subsp bovis AF2122/97
ccugaucgaguuccgcaucggc

SEQ ID NO: 1138179 - RNA, 17 nt, Mycobacterium bovis subsp bovis AF2122/97
ccugauaaagcccggcg

SEQ ID NO: 1138180 - RNA, 13 nt, Mycobacterium bovis subsp bovis AF2122/97
ccugaucgcgcag

SEQ ID NO: 1138181 - RNA, 20 nt, Mycobacterium bovis subsp bovis AF2122/97
ccugaagggccgccucgcgg

SEQ ID NO: 1138182 - RNA, 19 nt, Mycobacterium bovis subsp bovis AF2122/97
ccugaaucgguucggccag

SEQ ID NO: 1138183 - RNA, 22 nt, Mycobacterium bovis subsp bovis AF2122/97
ccugaaucuuguuguucgccac

SEQ ID NO: 1138184 - RNA, 16 nt, Mycobacterium bovis subsp bovis AF2122/97
ccugaccggcucgccg

SEQ ID NO: 1138185 - RNA, 23 nt, Mycobacterium bovis subsp bovis AF2122/97
ccugaccggcucgccggcgcgca

SEQ ID NO: 1138186 - RNA, 23 nt, Mycobacterium bovis subsp bovis AF2122/97
ccugaccgguggccaucgcgcgg

SEQ ID NO: 1138187 - RNA, 11 nt, Mycobacterium bovis subsp bovis AF2122/97
ccugacccgga

SEQ ID NO: 1138188 - RNA, 22 nt, Mycobacterium bovis subsp bovis AF2122/97
ccugacgccauucaucggcauc

SEQ ID NO: 1138189 - RNA, 17 nt, Mycobacterium bovis subsp bovis AF2122/97
ccugacgcgucagcggc

SEQ ID NO: 1138190 - RNA, 19 nt, Mycobacterium bovis subsp bovis AF2122/97
ccugacgcucggucgccac

SEQ ID NO: 1138191 - RNA, 14 nt, Mycobacterium bovis subsp bovis AF2122/97
ccugagcggccauc

SEQ ID NO: 1138192 - RNA, 16 nt, Mycobacterium bovis subsp bovis AF2122/97
ccugagcucccgccgg

SEQ ID NO: 1138193 - RNA, 16 nt, Mycobacterium bovis subsp bovis AF2122/97
ccugaguccggcacgc

SEQ ID NO: 1138194 - RNA, 15 nt, Mycobacterium bovis subsp bovis AF2122/97
ccugacucaucaccg

SEQ ID NO: 1138195 - RNA, 19 nt, Mycobacterium bovis subsp bovis AF2122/97
ccugacgguacagcuccac

SEQ ID NO: 1138196 - RNA, 19 nt, Mycobacterium bovis subsp bovis AF2122/97
ccugacgugcggcgcggcg

SEQ ID NO: 1138197 - RNA, 21 nt, Mycobacterium bovis subsp bovis AF2122/97
ccugacgugcggcgcggcgac

SEQ ID NO: 1138198 - RNA, 20 nt, Mycobacterium bovis subsp bovis AF2122/97
ccugagaacacguucggcgu

SEQ ID NO: 1138199 - RNA, 15 nt, Mycobacterium bovis subsp bovis AF2122/97
ccugagaugcggcca

SEQ ID NO: 1138200 - RNA, 19 nt, Mycobacterium bovis subsp bovis AF2122/97
ccugagccaccaacaccgc

SEQ ID NO: 1138201 - RNA, 21 nt, Mycobacterium bovis subsp bovis AF2122/97
ccugagcacguucaccgcgcg

SEQ ID NO: 1138202 - RNA, 13 nt, Mycobacterium bovis subsp bovis AF2122/97
ccugagcgccgcg

SEQ ID NO: 1138203 - RNA, 17 nt, Mycobacterium bovis subsp bovis AF2122/97
ccugagcgccgcggcgg

SEQ ID NO: 1138204 - RNA, 22 nt, Mycobacterium bovis subsp bovis AF2122/97
ccugagcgcgcgcggugcggcc

SEQ ID NO: 1138205 - RNA, 13 nt, Mycobacterium bovis subsp bovis AF2122/97
ccugagcggccau

SEQ ID NO: 1138206 - RNA, 14 nt, Mycobacterium bovis subsp bovis AF2122/97
ccucucgggggccg

SEQ ID NO: 1138207 - RNA, 23 nt, Mycobacterium bovis subsp bovis AF2122/97
ccucucagcacgguuguuguaga

SEQ ID NO: 1138208 - RNA, 16 nt, Mycobacterium bovis subsp bovis AF2122/97
ccucugcacggccguc

SEQ ID NO: 1138209 - RNA, 20 nt, Mycobacterium bovis subsp bovis AF2122/97
ccucugcugagcugcucgcc

SEQ ID NO: 1138210 - RNA, 14 nt, Mycobacterium bovis subsp bovis AF2122/97
ccucgugcgcaucg

SEQ ID NO: 1138211 - RNA, 19 nt, Mycobacterium bovis subsp bovis AF2122/97
ccucgucccacagguuugc

SEQ ID NO: 1138212 - RNA, 17 nt, Mycobacterium bovis subsp bovis AF2122/97
ccucguugaccagaacc

SEQ ID NO: 1138213 - RNA, 21 nt, Mycobacterium bovis subsp bovis AF2122/97
ccucguugaccagaaccugga

SEQ ID NO: 1138214 - RNA, 17 nt, Mycobacterium bovis subsp bovis AF2122/97
ccucguugcugccggcg

SEQ ID NO: 1138215 - RNA, 13 nt, Mycobacterium bovis subsp bovis AF2122/97
ccucuuccuggcg

SEQ ID NO: 1138216 - RNA, 13 nt, Mycobacterium bovis subsp bovis AF2122/97
ccugaaggccagc

SEQ ID NO: 1138217 - RNA, 14 nt, Mycobacterium bovis subsp bovis AF2122/97
ccugaagccgcgcu

SEQ ID NO: 1138218 - RNA, 17 nt, Mycobacterium bovis subsp bovis AF2122/97
ccugaagccgcgcugcg

SEQ ID NO: 1138219 - RNA, 23 nt, Mycobacterium bovis subsp bovis AF2122/97
ccucggcaggaaggacaucgcgc

SEQ ID NO: 1138220 - RNA, 12 nt, Mycobacterium bovis subsp bovis AF2122/97
ccucggcaucgc

SEQ ID NO: 1138221 - RNA, 14 nt, Mycobacterium bovis subsp bovis AF2122/97
ccucggcacggucg

SEQ ID NO: 1138222 - RNA, 15 nt, Mycobacterium bovis subsp bovis AF2122/97
ccucggcacggucgc

SEQ ID NO: 1138223 - RNA, 16 nt, Mycobacterium bovis subsp bovis AF2122/97
ccucggaucgccaggc

SEQ ID NO: 1138224 - RNA, 16 nt, Mycobacterium bovis subsp bovis AF2122/97
ccucggcacggucgcc

SEQ ID NO: 1138225 - RNA, 15 nt, Mycobacterium bovis subsp bovis AF2122/97
ccucggcaucgccgc

SEQ ID NO: 1138226 - RNA, 22 nt, Mycobacterium bovis subsp bovis AF2122/97
ccucggcggccagcucggccag

SEQ ID NO: 1138227 - RNA, 13 nt, Mycobacterium bovis subsp bovis AF2122/97
ccucggcggcgcc

SEQ ID NO: 1138228 - RNA, 12 nt, Mycobacterium bovis subsp bovis AF2122/97
ccucggccgccc

SEQ ID NO: 1138229 - RNA, 15 nt, Mycobacterium bovis subsp bovis AF2122/97
ccucggcggcggcac

SEQ ID NO: 1138230 - RNA, 13 nt, Mycobacterium bovis subsp bovis AF2122/97
ccucggcguggca

SEQ ID NO: 1138231 - RNA, 22 nt, Mycobacterium bovis subsp bovis AF2122/97
ccucggcguaggcgauggcggc

SEQ ID NO: 1138232 - RNA, 19 nt, Mycobacterium bovis subsp bovis AF2122/97
ccucgguugguccucggcg

SEQ ID NO: 1138233 - RNA, 20 nt, Mycobacterium bovis subsp bovis AF2122/97
ccucggugugcucgccgacc

SEQ ID NO: 1138234 - RNA, 14 nt, Mycobacterium bovis subsp bovis AF2122/97
ccucggugcggaac

SEQ ID NO: 1138235 - RNA, 21 nt, Mycobacterium bovis subsp bovis AF2122/97
ccucggugcggaacaccgccc

SEQ ID NO: 1138236 - RNA, 16 nt, Mycobacterium bovis subsp bovis AF2122/97
ccucggugccggccgc

SEQ ID NO: 1138237 - RNA, 22 nt, Mycobacterium bovis subsp bovis AF2122/97
ccucguauacccgggcggucga

SEQ ID NO: 1138238 - RNA, 20 nt, Mycobacterium bovis subsp bovis AF2122/97
ccucguaugccguggccgcc

SEQ ID NO: 1138239 - RNA, 21 nt, Mycobacterium bovis subsp bovis AF2122/97
ccucgucaaucaccaccgcca

SEQ ID NO: 1138240 - RNA, 13 nt, Mycobacterium bovis subsp bovis AF2122/97
ccucgucacccgg

SEQ ID NO: 1138241 - RNA, 17 nt, Mycobacterium bovis subsp bovis AF2122/97
ccucguaauccacgccg

SEQ ID NO: 1138242 - RNA, 20 nt, Mycobacterium bovis subsp bovis AF2122/97
ccucguaauccacgccgacc

SEQ ID NO: 1138243 - RNA, 22 nt, Mycobacterium bovis subsp bovis AF2122/97
ccucgugcgugggcgcggcgcc

SEQ ID NO: 1138244 - RNA, 14 nt, Mycobacterium bovis subsp bovis AF2122/97
ccucgugcucggcc

SEQ ID NO: 1138245 - RNA, 14 nt, Mycobacterium bovis subsp bovis AF2122/97
ccucgucaccgcga

SEQ ID NO: 1138246 - RNA, 21 nt, Mycobacterium bovis subsp bovis AF2122/97
ccucgucgucgaaguuggcga

SEQ ID NO: 1138247 - RNA, 14 nt, Mycobacterium bovis subsp bovis AF2122/97
ccucgucgucgagg

SEQ ID NO: 1138248 - RNA, 14 nt, Mycobacterium bovis subsp bovis AF2122/97
ccucgucgaccggg

SEQ ID NO: 1138249 - RNA, 16 nt, Mycobacterium bovis subsp bovis AF2122/97
ccucgagcagcguggg

SEQ ID NO: 1138250 - RNA, 17 nt, Mycobacterium bovis subsp bovis AF2122/97
ccucgacuucggcggga

SEQ ID NO: 1138251 - RNA, 22 nt, Mycobacterium bovis subsp bovis AF2122/97
ccucgacguccaucccggcgcc

SEQ ID NO: 1138252 - RNA, 16 nt, Mycobacterium bovis subsp bovis AF2122/97
ccucgacgucggcgag

SEQ ID NO: 1138253 - RNA, 17 nt, Mycobacterium bovis subsp bovis AF2122/97
ccucgauggccuugucc

SEQ ID NO: 1138254 - RNA, 16 nt, Mycobacterium bovis subsp bovis AF2122/97
ccucgaugcgggcgcc

SEQ ID NO: 1138255 - RNA, 13 nt, Mycobacterium bovis subsp bovis AF2122/97
ccucgauggccag

SEQ ID NO: 1138256 - RNA, 14 nt, Mycobacterium bovis subsp bovis AF2122/97
ccucgaugccgcgu

SEQ ID NO: 1138257 - RNA, 15 nt, Mycobacterium bovis subsp bovis AF2122/97
ccucgagacggucga

SEQ ID NO: 1138258 - RNA, 20 nt, Mycobacterium bovis subsp bovis AF2122/97
ccucgaugaugcgcucggcc

SEQ ID NO: 1138259 - RNA, 15 nt, Mycobacterium bovis subsp bovis AF2122/97
ccucgauggcggugg

SEQ ID NO: 1138260 - RNA, 17 nt, Mycobacterium bovis subsp bovis AF2122/97
ccucgcacaauggcggc

SEQ ID NO: 1138261 - RNA, 22 nt, Mycobacterium bovis subsp bovis AF2122/97
ccucgauucccggcgcgguggc

SEQ ID NO: 1138262 - RNA, 16 nt, Mycobacterium bovis subsp bovis AF2122/97
ccucgcgaaaccgccg

SEQ ID NO: 1138263 - RNA, 19 nt, Mycobacterium bovis subsp bovis AF2122/97
ccucggaggugccggugcu

SEQ ID NO: 1138264 - RNA, 18 nt, Mycobacterium bovis subsp bovis AF2122/97
ccucggauugcagcgcga

SEQ ID NO: 1138265 - RNA, 20 nt, Mycobacterium bovis subsp bovis AF2122/97
ccucggcaaaccaagcgcgc

SEQ ID NO: 1138266 - RNA, 22 nt, Mycobacterium bovis subsp bovis AF2122/97
ccucggcaaaccaagcgcgcca

SEQ ID NO: 1138267 - RNA, 23 nt, Mycobacterium bovis subsp bovis AF2122/97
ccucgccggcgcgcagccgggcc

SEQ ID NO: 1138268 - RNA, 15 nt, Mycobacterium bovis subsp bovis AF2122/97
ccucgcgagucggcg

SEQ ID NO: 1138269 - RNA, 15 nt, Mycobacterium bovis subsp bovis AF2122/97
ccucgcaaccggcgu

SEQ ID NO: 1138270 - RNA, 18 nt, Mycobacterium bovis subsp bovis AF2122/97
ccucgccggucagcgugc

SEQ ID NO: 1138271 - RNA, 17 nt, Mycobacterium bovis subsp bovis AF2122/97
ccucaccgccgcuaccg

SEQ ID NO: 1138272 - RNA, 21 nt, Mycobacterium bovis subsp bovis AF2122/97
ccucaccgccugugccgccgg

SEQ ID NO: 1138273 - RNA, 14 nt, Mycobacterium bovis subsp bovis AF2122/97
ccucacaugcccgg

SEQ ID NO: 1138274 - RNA, 19 nt, Mycobacterium bovis subsp bovis AF2122/97
ccgugguggcguaucgggc

SEQ ID NO: 1138275 - RNA, 17 nt, Mycobacterium bovis subsp bovis AF2122/97
ccguggcggacggcguc

SEQ ID NO: 1138276 - RNA, 21 nt, Mycobacterium bovis subsp bovis AF2122/97
ccguggguguuuuugcgggug

SEQ ID NO: 1138277 - RNA, 14 nt, Mycobacterium bovis subsp bovis AF2122/97
ccgugggcagcgcg

SEQ ID NO: 1138278 - RNA, 22 nt, Mycobacterium bovis subsp bovis AF2122/97
ccguggucgaggugggguggug

SEQ ID NO: 1138279 - RNA, 20 nt, Mycobacterium bovis subsp bovis AF2122/97
ccuccagauaccaccgccgc

SEQ ID NO: 1138280 - RNA, 24 nt, Mycobacterium bovis subsp bovis AF2122/97
ccuccagauaccaccgccgcugcc

SEQ ID NO: 1138281 - RNA, 16 nt, Mycobacterium bovis subsp bovis AF2122/97
ccuccagcaccacggc

SEQ ID NO: 1138282 - RNA, 22 nt, Mycobacterium bovis subsp bovis AF2122/97
ccuccagcagguccgcggccgc

SEQ ID NO: 1138283 - RNA, 15 nt, Mycobacterium bovis subsp bovis AF2122/97
ccuccaccgccgcgc

SEQ ID NO: 1138284 - RNA, 16 nt, Mycobacterium bovis subsp bovis AF2122/97
ccuccaccgccgcgcg

SEQ ID NO: 1138285 - RNA, 17 nt, Mycobacterium bovis subsp bovis AF2122/97
ccuccaccgccgcgcgg

SEQ ID NO: 1138286 - RNA, 20 nt, Mycobacterium bovis subsp bovis AF2122/97
ccuccaccaacucgacgugc

SEQ ID NO: 1138287 - RNA, 19 nt, Mycobacterium bovis subsp bovis AF2122/97
ccucagcccggccagccgc

SEQ ID NO: 1138288 - RNA, 23 nt, Mycobacterium bovis subsp bovis AF2122/97
ccucagcccggccagccgcacgg

SEQ ID NO: 1138289 - RNA, 12 nt, Mycobacterium bovis subsp bovis AF2122/97
ccucagccgcgc

SEQ ID NO: 1138290 - RNA, 13 nt, Mycobacterium bovis subsp bovis AF2122/97
ccucagccgugcc

SEQ ID NO: 1138291 - RNA, 12 nt, Mycobacterium bovis subsp bovis AF2122/97
ccucagccaccg

SEQ ID NO: 1138292 - RNA, 13 nt, Mycobacterium bovis subsp bovis AF2122/97
ccucagcaccgcu

SEQ ID NO: 1138293 - RNA, 18 nt, Mycobacterium bovis subsp bovis AF2122/97
ccucagacagcugcacac

SEQ ID NO: 1138294 - RNA, 19 nt, Mycobacterium bovis subsp bovis AF2122/97
ccucccaccagcggcggcc

SEQ ID NO: 1138295 - RNA, 14 nt, Mycobacterium bovis subsp bovis AF2122/97
ccucccacccccgg

SEQ ID NO: 1138296 - RNA, 23 nt, Mycobacterium bovis subsp bovis AF2122/97
ccucccacagguagaccgucucc

SEQ ID NO: 1138297 - RNA, 12 nt, Mycobacterium bovis subsp bovis AF2122/97
ccucccgcgccg

SEQ ID NO: 1138298 - RNA, 13 nt, Mycobacterium bovis subsp bovis AF2122/97
ccucccgcgccgg

SEQ ID NO: 1138299 - RNA, 12 nt, Mycobacterium bovis subsp bovis AF2122/97
ccucccgcgugc

SEQ ID NO: 1138300 - RNA, 16 nt, Mycobacterium bovis subsp bovis AF2122/97
ccucccacgccgccgu

SEQ ID NO: 1138301 - RNA, 20 nt, Mycobacterium bovis subsp bovis AF2122/97
ccucccagggcucggcggcc

SEQ ID NO: 1138302 - RNA, 23 nt, Mycobacterium bovis subsp bovis AF2122/97
ccucccagggcucggcggcccgg

SEQ ID NO: 1138303 - RNA, 21 nt, Mycobacterium bovis subsp bovis AF2122/97
ccucccauucccaacacagcc

SEQ ID NO: 1138304 - RNA, 14 nt, Mycobacterium bovis subsp bovis AF2122/97
ccuccgacgcgauc

SEQ ID NO: 1138305 - RNA, 13 nt, Mycobacterium bovis subsp bovis AF2122/97
ccuccucggcgcg

SEQ ID NO: 1138306 - RNA, 15 nt, Mycobacterium bovis subsp bovis AF2122/97
ccuccgacggccgcg

SEQ ID NO: 1138307 - RNA, 14 nt, Mycobacterium bovis subsp bovis AF2122/97
ccucgaacgccgcc

SEQ ID NO: 1138308 - RNA, 17 nt, Mycobacterium bovis subsp bovis AF2122/97
ccucgacgaucagcacg

SEQ ID NO: 1138309 - RNA, 22 nt, Mycobacterium bovis subsp bovis AF2122/97
ccucgaagcccagcaccaccac

SEQ ID NO: 1138310 - RNA, 14 nt, Mycobacterium bovis subsp bovis AF2122/97
ccucgacgccgcgc

SEQ ID NO: 1138311 - RNA, 16 nt, Mycobacterium bovis subsp bovis AF2122/97
ccucgacgccgcgcag

SEQ ID NO: 1138312 - RNA, 16 nt, Mycobacterium bovis subsp bovis AF2122/97
ccucgacgcggcaggc

SEQ ID NO: 1138313 - RNA, 20 nt, Mycobacterium bovis subsp bovis AF2122/97
ccucgacggcgucgacugcg

SEQ ID NO: 1138314 - RNA, 21 nt, Mycobacterium bovis subsp bovis AF2122/97
ccuccucgucgacgucggcau

SEQ ID NO: 1138315 - RNA, 14 nt, Mycobacterium bovis subsp bovis AF2122/97
ccuccucgucgcuc

SEQ ID NO: 1138316 - RNA, 16 nt, Mycobacterium bovis subsp bovis AF2122/97
ccuccucgugcaggac

SEQ ID NO: 1138317 - RNA, 12 nt, Mycobacterium bovis subsp bovis AF2122/97
ccuccugccgcc

SEQ ID NO: 1138318 - RNA, 13 nt, Mycobacterium bovis subsp bovis AF2122/97
ccuccugcuggcc

SEQ ID NO: 1138319 - RNA, 21 nt, Mycobacterium bovis subsp bovis AF2122/97
ccucgaaacgcuuacccagcc

SEQ ID NO: 1138320 - RNA, 19 nt, Mycobacterium bovis subsp bovis AF2122/97
ccggugccguuggagccgc

SEQ ID NO: 1138321 - RNA, 20 nt, Mycobacterium bovis subsp bovis AF2122/97
ccggugccguuggagccgcc

SEQ ID NO: 1138322 - RNA, 23 nt, Mycobacterium bovis subsp bovis AF2122/97
ccggugcgaucccacccucgggu

SEQ ID NO: 1138323 - RNA, 20 nt, Mycobacterium bovis subsp bovis AF2122/97
ccggugcgcagguacgccuc

SEQ ID NO: 1138324 - RNA, 13 nt, Mycobacterium bovis subsp bovis AF2122/97
ccggugcgcaucc

SEQ ID NO: 1138325 - RNA, 16 nt, Mycobacterium bovis subsp bovis AF2122/97
ccggugcgcauccguc

SEQ ID NO: 1138326 - RNA, 16 nt, Mycobacterium bovis subsp bovis AF2122/97
ccggugccgccgcggc

SEQ ID NO: 1138327 - RNA, 18 nt, Mycobacterium bovis subsp bovis AF2122/97
ccggugccgccgcggcca

SEQ ID NO: 1138328 - RNA, 21 nt, Mycobacterium bovis subsp bovis AF2122/97
ccggugccgccgcggccacca

SEQ ID NO: 1138329 - RNA, 21 nt, Mycobacterium bovis subsp bovis AF2122/97
ccggugccgccugcgccgcca

SEQ ID NO: 1138330 - RNA, 15 nt, Mycobacterium bovis subsp bovis AF2122/97
ccggugccgcgguag

SEQ ID NO: 1138331 - RNA, 12 nt, Mycobacterium bovis subsp bovis AF2122/97
ccggugccggcc

SEQ ID NO: 1138332 - RNA, 15 nt, Mycobacterium bovis subsp bovis AF2122/97
ccggugccggccaga

SEQ ID NO: 1138333 - RNA, 14 nt, Mycobacterium bovis subsp bovis AF2122/97
ccggugccggcgac

SEQ ID NO: 1138334 - RNA, 17 nt, Mycobacterium bovis subsp bovis AF2122/97
ccggugccggcgacgcu

SEQ ID NO: 1138335 - RNA, 14 nt, Mycobacterium bovis subsp bovis AF2122/97
ccggugccggcgca

SEQ ID NO: 1138336 - RNA, 15 nt, Mycobacterium bovis subsp bovis AF2122/97
ccggugccggcguug

SEQ ID NO: 1138337 - RNA, 21 nt, Mycobacterium bovis subsp bovis AF2122/97
ccggugccggucgagugccuc

SEQ ID NO: 1138338 - RNA, 15 nt, Mycobacterium bovis subsp bovis AF2122/97
ccggugcgccgaucc

SEQ ID NO: 1138339 - RNA, 20 nt, Mycobacterium bovis subsp bovis AF2122/97
ccggugcgccgaucccgccc

SEQ ID NO: 1138340 - RNA, 22 nt, Mycobacterium bovis subsp bovis AF2122/97
ccggugcgcauggacaacagcu

SEQ ID NO: 1138341 - RNA, 12 nt, Mycobacterium bovis subsp bovis AF2122/97
ccggugcgcacc

SEQ ID NO: 1138342 - RNA, 12 nt, Mycobacterium bovis subsp bovis AF2122/97
ccggugcgcagc

SEQ ID NO: 1138343 - RNA, 16 nt, Mycobacterium bovis subsp bovis AF2122/97
ccggugcggacuucga

SEQ ID NO: 1138344 - RNA, 12 nt, Mycobacterium bovis subsp bovis AF2122/97
ccggugcggugc

SEQ ID NO: 1138345 - RNA, 13 nt, Mycobacterium bovis subsp bovis AF2122/97
ccggugcgguggu

SEQ ID NO: 1138346 - RNA, 23 nt, Mycobacterium bovis subsp bovis AF2122/97
ccggugcgguuucaccgacgacg

SEQ ID NO: 1138347 - RNA, 15 nt, Mycobacterium bovis subsp bovis AF2122/97
ccggugcggcgggcu

SEQ ID NO: 1138348 - RNA, 20 nt, Mycobacterium bovis subsp bovis AF2122/97
ccggugcggcgggcucgcuu

SEQ ID NO: 1138349 - RNA, 18 nt, Mycobacterium bovis subsp bovis AF2122/97
ccggugcuaaccgacgcu

SEQ ID NO: 1138350 - RNA, 19 nt, Mycobacterium bovis subsp bovis AF2122/97
ccggugcuaaccgacgcug

SEQ ID NO: 1138351 - RNA, 17 nt, Mycobacterium bovis subsp bovis AF2122/97
ccggugcuccucggcag

SEQ ID NO: 1138352 - RNA, 19 nt, Mycobacterium bovis subsp bovis AF2122/97
ccgguguccagccacgcug

SEQ ID NO: 1138353 - RNA, 20 nt, Mycobacterium bovis subsp bovis AF2122/97
ccgguguccuuggccgccac

SEQ ID NO: 1138354 - RNA, 22 nt, Mycobacterium bovis subsp bovis AF2122/97
ccgguguagcagcgccagcagc

SEQ ID NO: 1138355 - RNA, 20 nt, Mycobacterium bovis subsp bovis AF2122/97
ccgguguagcguucccacac

SEQ ID NO: 1138356 - RNA, 21 nt, Mycobacterium bovis subsp bovis AF2122/97
ccgguguaggccucggcagca

SEQ ID NO: 1138357 - RNA, 21 nt, Mycobacterium bovis subsp bovis AF2122/97
ccggugucuggguggacaggu

SEQ ID NO: 1138358 - RNA, 16 nt, Mycobacterium bovis subsp bovis AF2122/97
ccggugucggugcgcg

SEQ ID NO: 1138359 - RNA, 17 nt, Mycobacterium bovis subsp bovis AF2122/97
ccggugucgugggcacc

SEQ ID NO: 1138360 - RNA, 21 nt, Mycobacterium bovis subsp bovis AF2122/97
ccggugucucccuugccgcca

SEQ ID NO: 1138361 - RNA, 15 nt, Mycobacterium bovis subsp bovis AF2122/97
ccggugucggccagc

SEQ ID NO: 1138362 - RNA, 16 nt, Mycobacterium bovis subsp bovis AF2122/97
ccggugucggccagca

SEQ ID NO: 1138363 - RNA, 18 nt, Mycobacterium bovis subsp bovis AF2122/97
ccggugucggcuggucgc

SEQ ID NO: 1138364 - RNA, 22 nt, Mycobacterium bovis subsp bovis AF2122/97
ccgguucggcgaucuccggcgg

SEQ ID NO: 1138365 - RNA, 22 nt, Mycobacterium bovis subsp bovis AF2122/97
ccggugugcaggaucacgccgc

SEQ ID NO: 1138366 - RNA, 23 nt, Mycobacterium bovis subsp bovis AF2122/97
ccgguguucaucacgccgccgga

SEQ ID NO: 1138367 - RNA, 18 nt, Mycobacterium bovis subsp bovis AF2122/97
ccgguguuccgcccagcg

SEQ ID NO: 1138368 - RNA, 17 nt, Mycobacterium bovis subsp bovis AF2122/97
ccggugugcgcaccccg

SEQ ID NO: 1138369 - RNA, 18 nt, Mycobacterium bovis subsp bovis AF2122/97
ccggugugcgcaccccgc

SEQ ID NO: 1138370 - RNA, 18 nt, Mycobacterium bovis subsp bovis AF2122/97
ccggugugcucgauaucg

SEQ ID NO: 1138371 - RNA, 16 nt, Mycobacterium bovis subsp bovis AF2122/97
ccggugugcugcacgg

SEQ ID NO: 1138372 - RNA, 18 nt, Mycobacterium bovis subsp bovis AF2122/97
ccgguguguucggcccgc

SEQ ID NO: 1138373 - RNA, 20 nt, Mycobacterium bovis subsp bovis AF2122/97
ccgguguguucggcccgcac

SEQ ID NO: 1138374 - RNA, 16 nt, Mycobacterium bovis subsp bovis AF2122/97
ccgguguguuuggcau

SEQ ID NO: 1138375 - RNA, 20 nt, Mycobacterium bovis subsp bovis AF2122/97
ccgguucugcgcccacccgc

SEQ ID NO: 1138376 - RNA, 15 nt, Mycobacterium bovis subsp bovis AF2122/97
ccgguugacgccggu

SEQ ID NO: 1138377 - RNA, 22 nt, Mycobacterium bovis subsp bovis AF2122/97
ccgguugacgggcucggcaggc

SEQ ID NO: 1138378 - RNA, 23 nt, Mycobacterium bovis subsp bovis AF2122/97
ccgguugacucgcuccgaccggu

SEQ ID NO: 1138379 - RNA, 19 nt, Mycobacterium bovis subsp bovis AF2122/97
ccggucccgccgugccgcg

SEQ ID NO: 1138380 - RNA, 17 nt, Mycobacterium bovis subsp bovis AF2122/97
ccggugacgguguuggu

SEQ ID NO: 1138381 - RNA, 18 nt, Mycobacterium bovis subsp bovis AF2122/97
ccggugagaagaagccca

SEQ ID NO: 1138382 - RNA, 21 nt, Mycobacterium bovis subsp bovis AF2122/97
ccggugagaagaagcccagga

SEQ ID NO: 1138383 - RNA, 17 nt, Mycobacterium bovis subsp bovis AF2122/97
ccggugaggcgaccgga

SEQ ID NO: 1138384 - RNA, 22 nt, Mycobacterium bovis subsp bovis AF2122/97
ccggugaggugaugcaauagcu

SEQ ID NO: 1138385 - RNA, 17 nt, Mycobacterium bovis subsp bovis AF2122/97
ccggugaucaccgacac

SEQ ID NO: 1138386 - RNA, 21 nt, Mycobacterium bovis subsp bovis AF2122/97
ccggugaucaccgacaccgug

SEQ ID NO: 1138387 - RNA, 19 nt, Mycobacterium bovis subsp bovis AF2122/97
ccggugaugaccgcguaga

SEQ ID NO: 1138388 - RNA, 17 nt, Mycobacterium bovis subsp bovis AF2122/97
ccggugaucgcgguggc

SEQ ID NO: 1138389 - RNA, 20 nt, Mycobacterium bovis subsp bovis AF2122/97
ccggugauccaacuggccgc

SEQ ID NO: 1138390 - RNA, 16 nt, Mycobacterium bovis subsp bovis AF2122/97
ccggugccgccggugc

SEQ ID NO: 1138391 - RNA, 13 nt, Mycobacterium bovis subsp bovis AF2122/97
ccggugccgccgu

SEQ ID NO: 1138392 - RNA, 14 nt, Mycobacterium bovis subsp bovis AF2122/97
ccggugccgccguc

SEQ ID NO: 1138393 - RNA, 15 nt, Mycobacterium bovis subsp bovis AF2122/97
ccggugccgccgucg

SEQ ID NO: 1138394 - RNA, 16 nt, Mycobacterium bovis subsp bovis AF2122/97
ccggugccgccgucgc

SEQ ID NO: 1138395 - RNA, 20 nt, Mycobacterium bovis subsp bovis AF2122/97
ccggugccgccgucgccgcc

SEQ ID NO: 1138396 - RNA, 21 nt, Mycobacterium bovis subsp bovis AF2122/97
ccggugccgccgucgccgcca

SEQ ID NO: 1138397 - RNA, 17 nt, Mycobacterium bovis subsp bovis AF2122/97
ccggugccgccguugcc

SEQ ID NO: 1138398 - RNA, 14 nt, Mycobacterium bovis subsp bovis AF2122/97
ccggugccgcccga

SEQ ID NO: 1138399 - RNA, 14 nt, Mycobacterium bovis subsp bovis AF2122/97
ccggugccgcccgc

SEQ ID NO: 1138400 - RNA, 16 nt, Mycobacterium bovis subsp bovis AF2122/97
ccggugccgcccgcgc

SEQ ID NO: 1138401 - RNA, 19 nt, Mycobacterium bovis subsp bovis AF2122/97
ccggugccgcccgcgccgc

SEQ ID NO: 1138402 - RNA, 20 nt, Mycobacterium bovis subsp bovis AF2122/97
ccggugccgcccgcgccgcc

SEQ ID NO: 1138403 - RNA, 21 nt, Mycobacterium bovis subsp bovis AF2122/97
ccggugccgcccgcgccgccg

SEQ ID NO: 1138404 - RNA, 20 nt, Mycobacterium bovis subsp bovis AF2122/97
ccggugccgcccgcgccucc

SEQ ID NO: 1138405 - RNA, 13 nt, Mycobacterium bovis subsp bovis AF2122/97
ccggugauggccg

SEQ ID NO: 1138406 - RNA, 22 nt, Mycobacterium bovis subsp bovis AF2122/97
ccggugaugaccgcguagagca

SEQ ID NO: 1138407 - RNA, 14 nt, Mycobacterium bovis subsp bovis AF2122/97
ccggugaugaccgg

SEQ ID NO: 1138408 - RNA, 16 nt, Mycobacterium bovis subsp bovis AF2122/97
ccggugauggccgacc

SEQ ID NO: 1138409 - RNA, 18 nt, Mycobacterium bovis subsp bovis AF2122/97
ccggugauggccgaccag

SEQ ID NO: 1138410 - RNA, 19 nt, Mycobacterium bovis subsp bovis AF2122/97
ccggugauggccgaccagc

SEQ ID NO: 1138411 - RNA, 20 nt, Mycobacterium bovis subsp bovis AF2122/97
ccggugauggccgaccagcc

SEQ ID NO: 1138412 - RNA, 21 nt, Mycobacterium bovis subsp bovis AF2122/97
ccggugauggccgaccagccg

SEQ ID NO: 1138413 - RNA, 19 nt, Mycobacterium bovis subsp bovis AF2122/97
ccggugauggugaccagca

SEQ ID NO: 1138414 - RNA, 16 nt, Mycobacterium bovis subsp bovis AF2122/97
ccggucaucccaagcg

SEQ ID NO: 1138415 - RNA, 20 nt, Mycobacterium bovis subsp bovis AF2122/97
ccggucaucccaagcguccg

SEQ ID NO: 1138416 - RNA, 19 nt, Mycobacterium bovis subsp bovis AF2122/97
ccggucaggccgccgcggc

SEQ ID NO: 1138417 - RNA, 17 nt, Mycobacterium bovis subsp bovis AF2122/97
ccggucauaccaagcgc

SEQ ID NO: 1138418 - RNA, 18 nt, Mycobacterium bovis subsp bovis AF2122/97
ccgguccagcagcucggc

SEQ ID NO: 1138419 - RNA, 18 nt, Mycobacterium bovis subsp bovis AF2122/97
ccgguccagcccagcgcg

SEQ ID NO: 1138420 - RNA, 13 nt, Mycobacterium bovis subsp bovis AF2122/97
ccgguccagccgg

SEQ ID NO: 1138421 - RNA, 17 nt, Mycobacterium bovis subsp bovis AF2122/97
ccgguccagcggccgcc

SEQ ID NO: 1138422 - RNA, 19 nt, Mycobacterium bovis subsp bovis AF2122/97
ccgguccagcggccgccgc

SEQ ID NO: 1138423 - RNA, 19 nt, Mycobacterium bovis subsp bovis AF2122/97
ccgguccagcccagcgcgc

SEQ ID NO: 1138424 - RNA, 18 nt, Mycobacterium bovis subsp bovis AF2122/97
ccggugacgggguugacc

SEQ ID NO: 1138425 - RNA, 16 nt, Mycobacterium bovis subsp bovis AF2122/97
ccggucccggacgugc

SEQ ID NO: 1138426 - RNA, 19 nt, Mycobacterium bovis subsp bovis AF2122/97
ccggucccggacgugccgg

SEQ ID NO: 1138427 - RNA, 16 nt, Mycobacterium bovis subsp bovis AF2122/97
ccgguccccgguuucg

SEQ ID NO: 1138428 - RNA, 17 nt, Mycobacterium bovis subsp bovis AF2122/97
ccgguccccucggugcc

SEQ ID NO: 1138429 - RNA, 20 nt, Mycobacterium bovis subsp bovis AF2122/97
ccggucccgccgaccgacac

SEQ ID NO: 1138430 - RNA, 17 nt, Mycobacterium bovis subsp bovis AF2122/97
ccggucccaaggcguug

SEQ ID NO: 1138431 - RNA, 17 nt, Mycobacterium bovis subsp bovis AF2122/97
ccgguccccgccggcgg

SEQ ID NO: 1138432 - RNA, 21 nt, Mycobacterium bovis subsp bovis AF2122/97
ccguauagccgacgccggugc

SEQ ID NO: 1138433 - RNA, 22 nt, Mycobacterium bovis subsp bovis AF2122/97
ccguauaggcccgggcggccag

SEQ ID NO: 1138434 - RNA, 13 nt, Mycobacterium bovis subsp bovis AF2122/97
ccguauccaggcg

SEQ ID NO: 1138435 - RNA, 19 nt, Mycobacterium bovis subsp bovis AF2122/97
ccguauugaugcugcccga

SEQ ID NO: 1138436 - RNA, 16 nt, Mycobacterium bovis subsp bovis AF2122/97
ccguaucggcuucguc

SEQ ID NO: 1138437 - RNA, 18 nt, Mycobacterium bovis subsp bovis AF2122/97
ccguauggcaucggccug

SEQ ID NO: 1138438 - RNA, 19 nt, Mycobacterium bovis subsp bovis AF2122/97
ccguauggcggcuccaacg

SEQ ID NO: 1138439 - RNA, 14 nt, Mycobacterium bovis subsp bovis AF2122/97
ccguaggcgccgaa

SEQ ID NO: 1138440 - RNA, 15 nt, Mycobacterium bovis subsp bovis AF2122/97
ccguaggcgccgaac

SEQ ID NO: 1138441 - RNA, 16 nt, Mycobacterium bovis subsp bovis AF2122/97
ccguaggguggccgac

SEQ ID NO: 1138442 - RNA, 17 nt, Mycobacterium bovis subsp bovis AF2122/97
ccguaggguggccgacg

SEQ ID NO: 1138443 - RNA, 18 nt, Mycobacterium bovis subsp bovis AF2122/97
ccguaggugcacaacccg

SEQ ID NO: 1138444 - RNA, 14 nt, Mycobacterium bovis subsp bovis AF2122/97
ccguaguggccggc

SEQ ID NO: 1138445 - RNA, 21 nt, Mycobacterium bovis subsp bovis AF2122/97
ccguaguaaggagccgggccg

SEQ ID NO: 1138446 - RNA, 22 nt, Mycobacterium bovis subsp bovis AF2122/97
ccguaguaaggagccgggccgu

SEQ ID NO: 1138447 - RNA, 16 nt, Mycobacterium bovis subsp bovis AF2122/97
ccguaguaccaaagcg

SEQ ID NO: 1138448 - RNA, 14 nt, Mycobacterium bovis subsp bovis AF2122/97
ccguaggaacccga

SEQ ID NO: 1138449 - RNA, 23 nt, Mycobacterium bovis subsp bovis AF2122/97
ccguaggaacccgaacaacgccg

SEQ ID NO: 1138450 - RNA, 14 nt, Mycobacterium bovis subsp bovis AF2122/97
ccguaggcggcgac

SEQ ID NO: 1138451 - RNA, 18 nt, Mycobacterium bovis subsp bovis AF2122/97
ccgguugaugguccgcca

SEQ ID NO: 1138452 - RNA, 17 nt, Mycobacterium bovis subsp bovis AF2122/97
ccgguuggccagccaca

SEQ ID NO: 1138453 - RNA, 17 nt, Mycobacterium bovis subsp bovis AF2122/97
ccgguuggccagugacu

SEQ ID NO: 1138454 - RNA, 19 nt, Mycobacterium bovis subsp bovis AF2122/97
ccgguuggcgauccgcggc

SEQ ID NO: 1138455 - RNA, 16 nt, Mycobacterium bovis subsp bovis AF2122/97
ccguagcaucgggcga

SEQ ID NO: 1138456 - RNA, 18 nt, Mycobacterium bovis subsp bovis AF2122/97
ccguagccggccggccca

SEQ ID NO: 1138457 - RNA, 16 nt, Mycobacterium bovis subsp bovis AF2122/97
ccguagcguccgcgcc

SEQ ID NO: 1138458 - RNA, 23 nt, Mycobacterium bovis subsp bovis AF2122/97
ccguagcucuuugagugccgcgu

SEQ ID NO: 1138459 - RNA, 15 nt, Mycobacterium bovis subsp bovis AF2122/97
ccguagcugcgcagc

SEQ ID NO: 1138460 - RNA, 15 nt, Mycobacterium bovis subsp bovis AF2122/97
ccgucaaguggcaac

SEQ ID NO: 1138461 - RNA, 22 nt, Mycobacterium bovis subsp bovis AF2122/97
ccgucaaguggcaaccgcaccg

SEQ ID NO: 1138462 - RNA, 15 nt, Mycobacterium bovis subsp bovis AF2122/97
ccgucacaagucgac

SEQ ID NO: 1138463 - RNA, 14 nt, Mycobacterium bovis subsp bovis AF2122/97
ccgucaccgacugc

SEQ ID NO: 1138464 - RNA, 12 nt, Mycobacterium bovis subsp bovis AF2122/97
ccgucaccgccc

SEQ ID NO: 1138465 - RNA, 19 nt, Mycobacterium bovis subsp bovis AF2122/97
ccgucaccgccgucaccgu

SEQ ID NO: 1138466 - RNA, 18 nt, Mycobacterium bovis subsp bovis AF2122/97
ccgucaccgccguugccg

SEQ ID NO: 1138467 - RNA, 12 nt, Mycobacterium bovis subsp bovis AF2122/97
ccgucaccgcga

SEQ ID NO: 1138468 - RNA, 13 nt, Mycobacterium bovis subsp bovis AF2122/97
ccgucaccgcggg

SEQ ID NO: 1138469 - RNA, 17 nt, Mycobacterium bovis subsp bovis AF2122/97
ccgucacgucguuuggc

SEQ ID NO: 1138470 - RNA, 16 nt, Mycobacterium bovis subsp bovis AF2122/97
ccgucacgcccgcgaa

SEQ ID NO: 1138471 - RNA, 15 nt, Mycobacterium bovis subsp bovis AF2122/97
ccgucaugccguuga

SEQ ID NO: 1138472 - RNA, 16 nt, Mycobacterium bovis subsp bovis AF2122/97
ccgucaucuggaagua

SEQ ID NO: 1138473 - RNA, 21 nt, Mycobacterium bovis subsp bovis AF2122/97
ccgucaucgcggugugccggu

SEQ ID NO: 1138474 - RNA, 20 nt, Mycobacterium bovis subsp bovis AF2122/97
ccgucaucgcggugugccgg

SEQ ID NO: 1138475 - RNA, 19 nt, Mycobacterium bovis subsp bovis AF2122/97
ccgucaugccgacgacaac

SEQ ID NO: 1138476 - RNA, 22 nt, Mycobacterium bovis subsp bovis AF2122/97
ccgucauuggcuuguccggugg

SEQ ID NO: 1138477 - RNA, 21 nt, Mycobacterium bovis subsp bovis AF2122/97
ccgucagaacaccggccaggc

SEQ ID NO: 1138478 - RNA, 19 nt, Mycobacterium bovis subsp bovis AF2122/97
ccgucagaacaccggccag

SEQ ID NO: 1138479 - RNA, 19 nt, Mycobacterium bovis subsp bovis AF2122/97
ccgucagcaccgcuacgac

SEQ ID NO: 1138480 - RNA, 16 nt, Mycobacterium bovis subsp bovis AF2122/97
ccgucagcgccgcgcg

SEQ ID NO: 1138481 - RNA, 15 nt, Mycobacterium bovis subsp bovis AF2122/97
ccgucagccaggugc

SEQ ID NO: 1138482 - RNA, 17 nt, Mycobacterium bovis subsp bovis AF2122/97
ccgucagcccgaaccgu

SEQ ID NO: 1138483 - RNA, 15 nt, Mycobacterium bovis subsp bovis AF2122/97
ccgucagccguucgg

SEQ ID NO: 1138484 - RNA, 17 nt, Mycobacterium bovis subsp bovis AF2122/97
ccgucagccguucggcu

SEQ ID NO: 1138485 - RNA, 14 nt, Mycobacterium bovis subsp bovis AF2122/97
ccgucaucgccggg

SEQ ID NO: 1138486 - RNA, 15 nt, Mycobacterium bovis subsp bovis AF2122/97
ccgucgcgcacggcc

SEQ ID NO: 1138487 - RNA, 16 nt, Mycobacterium bovis subsp bovis AF2122/97
ccgucgccugccgacg

SEQ ID NO: 1138488 - RNA, 19 nt, Mycobacterium bovis subsp bovis AF2122/97
ccgucgcgacgucggccgu

SEQ ID NO: 1138489 - RNA, 24 nt, Mycobacterium bovis subsp bovis AF2122/97
ccgucgccggucaggccgccgcgg

SEQ ID NO: 1138490 - RNA, 20 nt, Mycobacterium bovis subsp bovis AF2122/97
ccgucgccggugacgacguc

SEQ ID NO: 1138491 - RNA, 16 nt, Mycobacterium bovis subsp bovis AF2122/97
ccgucgccggugccgg

SEQ ID NO: 1138492 - RNA, 19 nt, Mycobacterium bovis subsp bovis AF2122/97
ccgucgcgcugccggccgc

SEQ ID NO: 1138493 - RNA, 22 nt, Mycobacterium bovis subsp bovis AF2122/97
ccgucgcagccagcugaacacg

SEQ ID NO: 1138494 - RNA, 19 nt, Mycobacterium bovis subsp bovis AF2122/97
ccgucgccgcccgugccgc

SEQ ID NO: 1138495 - RNA, 20 nt, Mycobacterium bovis subsp bovis AF2122/97
ccgucgccgcccgugccgcc

SEQ ID NO: 1138496 - RNA, 15 nt, Mycobacterium bovis subsp bovis AF2122/97
ccgucgccgccggcu

SEQ ID NO: 1138497 - RNA, 21 nt, Mycobacterium bovis subsp bovis AF2122/97
ccgucgccgccggcuccggcg

SEQ ID NO: 1138498 - RNA, 14 nt, Mycobacterium bovis subsp bovis AF2122/97
ccgucgccgccggu

SEQ ID NO: 1138499 - RNA, 14 nt, Mycobacterium bovis subsp bovis AF2122/97
ccgucgccgccguc

SEQ ID NO: 1138500 - RNA, 22 nt, Mycobacterium bovis subsp bovis AF2122/97
ccgucgccgccgucaccgcccu

SEQ ID NO: 1138501 - RNA, 18 nt, Mycobacterium bovis subsp bovis AF2122/97
ccgucgccgccguugccg

SEQ ID NO: 1138502 - RNA, 23 nt, Mycobacterium bovis subsp bovis AF2122/97
ccgucgcccggguggcgucgauc

SEQ ID NO: 1138503 - RNA, 19 nt, Mycobacterium bovis subsp bovis AF2122/97
ccguccgcggguagcgguu

SEQ ID NO: 1138504 - RNA, 22 nt, Mycobacterium bovis subsp bovis AF2122/97
ccguccgcggacuuggcggucg

SEQ ID NO: 1138505 - RNA, 23 nt, Mycobacterium bovis subsp bovis AF2122/97
ccguccgcggguagcgguucauc

SEQ ID NO: 1138506 - RNA, 13 nt, Mycobacterium bovis subsp bovis AF2122/97
ccgucgcaccaga

SEQ ID NO: 1138507 - RNA, 14 nt, Mycobacterium bovis subsp bovis AF2122/97
ccguccggccgggc

SEQ ID NO: 1138508 - RNA, 15 nt, Mycobacterium bovis subsp bovis AF2122/97
ccguccgaccaggga

SEQ ID NO: 1138509 - RNA, 18 nt, Mycobacterium bovis subsp bovis AF2122/97
ccguccgccguaugccgc

SEQ ID NO: 1138510 - RNA, 16 nt, Mycobacterium bovis subsp bovis AF2122/97
ccguccgccgcagacg

SEQ ID NO: 1138511 - RNA, 16 nt, Mycobacterium bovis subsp bovis AF2122/97
ccgucccgcucgagca

SEQ ID NO: 1138512 - RNA, 13 nt, Mycobacterium bovis subsp bovis AF2122/97
ccgucccggccuc

SEQ ID NO: 1138513 - RNA, 18 nt, Mycobacterium bovis subsp bovis AF2122/97
ccgucccugugucgccgu

SEQ ID NO: 1138514 - RNA, 15 nt, Mycobacterium bovis subsp bovis AF2122/97
ccguccagcaacagc

SEQ ID NO: 1138515 - RNA, 15 nt, Mycobacterium bovis subsp bovis AF2122/97
ccgucgcggcggcac

SEQ ID NO: 1138516 - RNA, 13 nt, Mycobacterium bovis subsp bovis AF2122/97
ccgucgcggccgg

SEQ ID NO: 1138517 - RNA, 15 nt, Mycobacterium bovis subsp bovis AF2122/97
ccgucgcggccggcg

SEQ ID NO: 1138518 - RNA, 20 nt, Mycobacterium bovis subsp bovis AF2122/97
ccgucgcggccggcggccgc

SEQ ID NO: 1138519 - RNA, 15 nt, Mycobacterium bovis subsp bovis AF2122/97
ccguccggcuuggcg

SEQ ID NO: 1138520 - RNA, 19 nt, Mycobacterium bovis subsp bovis AF2122/97
ccgucggggucguugaggc

SEQ ID NO: 1138521 - RNA, 21 nt, Mycobacterium bovis subsp bovis AF2122/97
ccgucggggucaacaggccgu

SEQ ID NO: 1138522 - RNA, 23 nt, Mycobacterium bovis subsp bovis AF2122/97
ccgucgcgccucaucggcuuuga

SEQ ID NO: 1138523 - RNA, 23 nt, Mycobacterium bovis subsp bovis AF2122/97
ccgucggguaggccgccguggug

SEQ ID NO: 1138524 - RNA, 23 nt, Mycobacterium bovis subsp bovis AF2122/97
ccgucgggugcagcacggcgccg

SEQ ID NO: 1138525 - RNA, 20 nt, Mycobacterium bovis subsp bovis AF2122/97
ccgucguacucgaccgcgag

SEQ ID NO: 1138526 - RNA, 23 nt, Mycobacterium bovis subsp bovis AF2122/97
ccgucgucgucgcuguaggcgau

SEQ ID NO: 1138527 - RNA, 13 nt, Mycobacterium bovis subsp bovis AF2122/97
ccgucggugccgc

SEQ ID NO: 1138528 - RNA, 16 nt, Mycobacterium bovis subsp bovis AF2122/97
ccgucggugccgccgc

SEQ ID NO: 1138529 - RNA, 21 nt, Mycobacterium bovis subsp bovis AF2122/97
ccgucggugccgccgccggcg

SEQ ID NO: 1138530 - RNA, 17 nt, Mycobacterium bovis subsp bovis AF2122/97
ccgucggugccgcggac

SEQ ID NO: 1138531 - RNA, 16 nt, Mycobacterium bovis subsp bovis AF2122/97
ccgucgucgugcacga

SEQ ID NO: 1138532 - RNA, 24 nt, Mycobacterium bovis subsp bovis AF2122/97
ccgucggugguuuucccgucgccg

SEQ ID NO: 1138533 - RNA, 18 nt, Mycobacterium bovis subsp bovis AF2122/97
ccgucggugccgcggacg

SEQ ID NO: 1138534 - RNA, 15 nt, Mycobacterium bovis subsp bovis AF2122/97
ccgucgugccaccgu

SEQ ID NO: 1138535 - RNA, 19 nt, Mycobacterium bovis subsp bovis AF2122/97
ccgucucgcaccgcguuga

SEQ ID NO: 1138536 - RNA, 13 nt, Mycobacterium bovis subsp bovis AF2122/97
ccgucucgccgcg

SEQ ID NO: 1138537 - RNA, 21 nt, Mycobacterium bovis subsp bovis AF2122/97
ccgucucgccgcgcaccgacc

SEQ ID NO: 1138538 - RNA, 13 nt, Mycobacterium bovis subsp bovis AF2122/97
ccgucucggcgac

SEQ ID NO: 1138539 - RNA, 15 nt, Mycobacterium bovis subsp bovis AF2122/97
ccgucguggcggugg

SEQ ID NO: 1138540 - RNA, 16 nt, Mycobacterium bovis subsp bovis AF2122/97
ccgucgugcgugcggc

SEQ ID NO: 1138541 - RNA, 19 nt, Mycobacterium bovis subsp bovis AF2122/97
ccgucgugugguucacucu

SEQ ID NO: 1138542 - RNA, 17 nt, Mycobacterium bovis subsp bovis AF2122/97
ccgucuccaucgggaau

SEQ ID NO: 1138543 - RNA, 17 nt, Mycobacterium bovis subsp bovis AF2122/97
ccgucuccggcgccacc

SEQ ID NO: 1138544 - RNA, 17 nt, Mycobacterium bovis subsp bovis AF2122/97
ccgucguugcccgaccc

SEQ ID NO: 1138545 - RNA, 20 nt, Mycobacterium bovis subsp bovis AF2122/97
ccgucguugcccgacccgcc

SEQ ID NO: 1138546 - RNA, 22 nt, Mycobacterium bovis subsp bovis AF2122/97
ccguggcggcgggccucggcga

SEQ ID NO: 1138547 - RNA, 18 nt, Mycobacterium bovis subsp bovis AF2122/97
ccguggcgccggucgccg

SEQ ID NO: 1138548 - RNA, 20 nt, Mycobacterium bovis subsp bovis AF2122/97
ccguggcgccggucgccggc

SEQ ID NO: 1138549 - RNA, 13 nt, Mycobacterium bovis subsp bovis AF2122/97
ccguggcgcgacg

SEQ ID NO: 1138550 - RNA, 16 nt, Mycobacterium bovis subsp bovis AF2122/97
ccguggcugcgcucgc

SEQ ID NO: 1138551 - RNA, 23 nt, Mycobacterium bovis subsp bovis AF2122/97
ccguggcugcgcucgcccgcggc

SEQ ID NO: 1138552 - RNA, 15 nt, Mycobacterium bovis subsp bovis AF2122/97
ccguggcgcggucgg

SEQ ID NO: 1138553 - RNA, 16 nt, Mycobacterium bovis subsp bovis AF2122/97
ccgugggccugcccgg

SEQ ID NO: 1138554 - RNA, 17 nt, Mycobacterium bovis subsp bovis AF2122/97
ccgugggccugcccggc

SEQ ID NO: 1138555 - RNA, 21 nt, Mycobacterium bovis subsp bovis AF2122/97
ccgugggccugcccggcgccg

SEQ ID NO: 1138556 - RNA, 14 nt, Mycobacterium bovis subsp bovis AF2122/97
ccgugggcgacggc

SEQ ID NO: 1138557 - RNA, 20 nt, Mycobacterium bovis subsp bovis AF2122/97
ccgugggcgacggcggcguc

SEQ ID NO: 1138558 - RNA, 15 nt, Mycobacterium bovis subsp bovis AF2122/97
ccguggcaucgccuc

SEQ ID NO: 1138559 - RNA, 22 nt, Mycobacterium bovis subsp bovis AF2122/97
ccguggccgcgaucccggccgu

SEQ ID NO: 1138560 - RNA, 21 nt, Mycobacterium bovis subsp bovis AF2122/97
ccguggcgaaugacggccagu

SEQ ID NO: 1138561 - RNA, 20 nt, Mycobacterium bovis subsp bovis AF2122/97
ccguggcgaaugacggccag

SEQ ID NO: 1138562 - RNA, 14 nt, Mycobacterium bovis subsp bovis AF2122/97
ccguggccaucgau

SEQ ID NO: 1138563 - RNA, 21 nt, Mycobacterium bovis subsp bovis AF2122/97
ccgugcugggcaucaccgacg

SEQ ID NO: 1138564 - RNA, 14 nt, Mycobacterium bovis subsp bovis AF2122/97
ccguggaucggcag

SEQ ID NO: 1138565 - RNA, 20 nt, Mycobacterium bovis subsp bovis AF2122/97
ccgugcuuguugcgcgacgc

SEQ ID NO: 1138566 - RNA, 21 nt, Mycobacterium bovis subsp bovis AF2122/97
ccguggaagauguugccgccg

SEQ ID NO: 1138567 - RNA, 23 nt, Mycobacterium bovis subsp bovis AF2122/97
ccguggaagauguugccgccggu

SEQ ID NO: 1138568 - RNA, 18 nt, Mycobacterium bovis subsp bovis AF2122/97
ccguggaggcccgucaca

SEQ ID NO: 1138569 - RNA, 21 nt, Mycobacterium bovis subsp bovis AF2122/97
ccguggaucaucccgaccagc

SEQ ID NO: 1138570 - RNA, 21 nt, Mycobacterium bovis subsp bovis AF2122/97
ccguggauaacgacugacaac

SEQ ID NO: 1138571 - RNA, 13 nt, Mycobacterium bovis subsp bovis AF2122/97
ccgugcucgucgu

SEQ ID NO: 1138572 - RNA, 23 nt, Mycobacterium bovis subsp bovis AF2122/97
ccgugcucgucguacaugggcag

SEQ ID NO: 1138573 - RNA, 16 nt, Mycobacterium bovis subsp bovis AF2122/97
ccgugcucaccggcgc

SEQ ID NO: 1138574 - RNA, 18 nt, Mycobacterium bovis subsp bovis AF2122/97
ccgugcucacggcaggcg

SEQ ID NO: 1138575 - RNA, 13 nt, Mycobacterium bovis subsp bovis AF2122/97
ccgugcgugcggg

SEQ ID NO: 1138576 - RNA, 18 nt, Mycobacterium bovis subsp bovis AF2122/97
ccgugcggaucgcgcugc

SEQ ID NO: 1138577 - RNA, 21 nt, Mycobacterium bovis subsp bovis AF2122/97
ccgugcugcccaucccggccg

SEQ ID NO: 1138578 - RNA, 17 nt, Mycobacterium bovis subsp bovis AF2122/97
ccgugcgcgcgcagcug

SEQ ID NO: 1138579 - RNA, 19 nt, Mycobacterium bovis subsp bovis AF2122/97
ccgugcgggucguccgccu

SEQ ID NO: 1138580 - RNA, 23 nt, Mycobacterium bovis subsp bovis AF2122/97
ccgugcggguucacugccggcca

SEQ ID NO: 1138581 - RNA, 23 nt, Mycobacterium bovis subsp bovis AF2122/97
ccgugcgguauuugaacgcccgc

SEQ ID NO: 1138582 - RNA, 17 nt, Mycobacterium bovis subsp bovis AF2122/97
ccgugcggcucgccggc

SEQ ID NO: 1138583 - RNA, 18 nt, Mycobacterium bovis subsp bovis AF2122/97
ccgugcggcucgccggcg

SEQ ID NO: 1138584 - RNA, 15 nt, Mycobacterium bovis subsp bovis AF2122/97
ccgugcggucgcgcc

SEQ ID NO: 1138585 - RNA, 16 nt, Mycobacterium bovis subsp bovis AF2122/97
ccgugcggucgcgccc

SEQ ID NO: 1138586 - RNA, 21 nt, Mycobacterium bovis subsp bovis AF2122/97
ccgugcggucgugccccgcgg

SEQ ID NO: 1138587 - RNA, 20 nt, Mycobacterium bovis subsp bovis AF2122/97
ccgugcggcggcugccgguu

SEQ ID NO: 1138588 - RNA, 21 nt, Mycobacterium bovis subsp bovis AF2122/97
ccgugcgaucaccuccgcgac

SEQ ID NO: 1138589 - RNA, 16 nt, Mycobacterium bovis subsp bovis AF2122/97
ccgugcgaucgucaac

SEQ ID NO: 1138590 - RNA, 21 nt, Mycobacterium bovis subsp bovis AF2122/97
ccgugcgccacggcuguggcc

SEQ ID NO: 1138591 - RNA, 23 nt, Mycobacterium bovis subsp bovis AF2122/97
ccgugcgaucgucaacgacgacg

SEQ ID NO: 1138592 - RNA, 15 nt, Mycobacterium bovis subsp bovis AF2122/97
ccgugccgucggcgu

SEQ ID NO: 1138593 - RNA, 19 nt, Mycobacterium bovis subsp bovis AF2122/97
ccgugccgucaacgauggu

SEQ ID NO: 1138594 - RNA, 13 nt, Mycobacterium bovis subsp bovis AF2122/97
ccgugaucagcuc

SEQ ID NO: 1138595 - RNA, 20 nt, Mycobacterium bovis subsp bovis AF2122/97
ccgugaguucacguucggcg

SEQ ID NO: 1138596 - RNA, 15 nt, Mycobacterium bovis subsp bovis AF2122/97
ccgugaugccacggc

SEQ ID NO: 1138597 - RNA, 17 nt, Mycobacterium bovis subsp bovis AF2122/97
ccgugcaccagcgacca

SEQ ID NO: 1138598 - RNA, 16 nt, Mycobacterium bovis subsp bovis AF2122/97
ccgugcacgaucgcgg

SEQ ID NO: 1138599 - RNA, 20 nt, Mycobacterium bovis subsp bovis AF2122/97
ccgucuuggcccgguccgcc

SEQ ID NO: 1138600 - RNA, 13 nt, Mycobacterium bovis subsp bovis AF2122/97
ccgucuucgccgc

SEQ ID NO: 1138601 - RNA, 16 nt, Mycobacterium bovis subsp bovis AF2122/97
ccgucuuccagccagg

SEQ ID NO: 1138602 - RNA, 19 nt, Mycobacterium bovis subsp bovis AF2122/97
ccgugagcaccagcagcac

SEQ ID NO: 1138603 - RNA, 22 nt, Mycobacterium bovis subsp bovis AF2122/97
ccggcuagauaacccaaccgcg

SEQ ID NO: 1138604 - RNA, 16 nt, Mycobacterium bovis subsp bovis AF2122/97
ccggcuacggcgacac

SEQ ID NO: 1138605 - RNA, 12 nt, Mycobacterium bovis subsp bovis AF2122/97
ccggcuaccgcg

SEQ ID NO: 1138606 - RNA, 20 nt, Mycobacterium bovis subsp bovis AF2122/97
ccggcuagggcagcagcccg

SEQ ID NO: 1138607 - RNA, 21 nt, Mycobacterium bovis subsp bovis AF2122/97
ccggcuagggcagcagcccgg

SEQ ID NO: 1138608 - RNA, 23 nt, Mycobacterium bovis subsp bovis AF2122/97
ccggcuagggcagcagcccgggc

SEQ ID NO: 1138609 - RNA, 23 nt, Mycobacterium bovis subsp bovis AF2122/97
ccggcuauaucccgccccgggcc

SEQ ID NO: 1138610 - RNA, 22 nt, Mycobacterium bovis subsp bovis AF2122/97
ccggcucacagcacagcgcagc

SEQ ID NO: 1138611 - RNA, 16 nt, Mycobacterium bovis subsp bovis AF2122/97
ccggcucaccacgccg

SEQ ID NO: 1138612 - RNA, 21 nt, Mycobacterium bovis subsp bovis AF2122/97
ccggcucaccacgccggucga

SEQ ID NO: 1138613 - RNA, 14 nt, Mycobacterium bovis subsp bovis AF2122/97
ccggcucaacaccg

SEQ ID NO: 1138614 - RNA, 14 nt, Mycobacterium bovis subsp bovis AF2122/97
ccggcucgccgacc

SEQ ID NO: 1138615 - RNA, 20 nt, Mycobacterium bovis subsp bovis AF2122/97
ccggcucgccgacccgccgc

SEQ ID NO: 1138616 - RNA, 14 nt, Mycobacterium bovis subsp bovis AF2122/97
ccggcucgccggcg

SEQ ID NO: 1138617 - RNA, 15 nt, Mycobacterium bovis subsp bovis AF2122/97
ccggcucgccggcgc

SEQ ID NO: 1138618 - RNA, 19 nt, Mycobacterium bovis subsp bovis AF2122/97
ccggcuaugcuggcgcagc

SEQ ID NO: 1138619 - RNA, 18 nt, Mycobacterium bovis subsp bovis AF2122/97
ccggcucggaaaccgccc

SEQ ID NO: 1138620 - RNA, 20 nt, Mycobacterium bovis subsp bovis AF2122/97
ccggcucaaggacgcaccgc

SEQ ID NO: 1138621 - RNA, 14 nt, Mycobacterium bovis subsp bovis AF2122/97
ccggcucggccacc

SEQ ID NO: 1138622 - RNA, 15 nt, Mycobacterium bovis subsp bovis AF2122/97
ccggcucggccagcc

SEQ ID NO: 1138623 - RNA, 20 nt, Mycobacterium bovis subsp bovis AF2122/97
ccggcucuuuuucgaucgcu

SEQ ID NO: 1138624 - RNA, 15 nt, Mycobacterium bovis subsp bovis AF2122/97
ccggcucuccgguga

SEQ ID NO: 1138625 - RNA, 16 nt, Mycobacterium bovis subsp bovis AF2122/97
ccggcucuccggugau

SEQ ID NO: 1138626 - RNA, 18 nt, Mycobacterium bovis subsp bovis AF2122/97
ccggcucggguggccagc

SEQ ID NO: 1138627 - RNA, 17 nt, Mycobacterium bovis subsp bovis AF2122/97
ccggcgaucguguccac

SEQ ID NO: 1138628 - RNA, 14 nt, Mycobacterium bovis subsp bovis AF2122/97
ccggcgaugaccag

SEQ ID NO: 1138629 - RNA, 21 nt, Mycobacterium bovis subsp bovis AF2122/97
ccggcgaugagcaugcccagc

SEQ ID NO: 1138630 - RNA, 14 nt, Mycobacterium bovis subsp bovis AF2122/97
ccggcuacgacggc

SEQ ID NO: 1138631 - RNA, 13 nt, Mycobacterium bovis subsp bovis AF2122/97
ccggcuaccgcgc

SEQ ID NO: 1138632 - RNA, 14 nt, Mycobacterium bovis subsp bovis AF2122/97
ccggcuaccgcgcu

SEQ ID NO: 1138633 - RNA, 21 nt, Mycobacterium bovis subsp bovis AF2122/97
ccggcgauuaccggcacgccg

SEQ ID NO: 1138634 - RNA, 22 nt, Mycobacterium bovis subsp bovis AF2122/97
ccggcgauggcccuuccggccg

SEQ ID NO: 1138635 - RNA, 23 nt, Mycobacterium bovis subsp bovis AF2122/97
ccggcugcuuuaaccgcgucauc

SEQ ID NO: 1138636 - RNA, 22 nt, Mycobacterium bovis subsp bovis AF2122/97
ccggcuggcccaccuccucgcc

SEQ ID NO: 1138637 - RNA, 17 nt, Mycobacterium bovis subsp bovis AF2122/97
ccggcuggcccagcgac

SEQ ID NO: 1138638 - RNA, 15 nt, Mycobacterium bovis subsp bovis AF2122/97
ccggcuggcggcgug

SEQ ID NO: 1138639 - RNA, 15 nt, Mycobacterium bovis subsp bovis AF2122/97
ccggcuucgucggcc

SEQ ID NO: 1138640 - RNA, 18 nt, Mycobacterium bovis subsp bovis AF2122/97
ccggcuucgucggccagc

SEQ ID NO: 1138641 - RNA, 19 nt, Mycobacterium bovis subsp bovis AF2122/97
ccggcuucgucggccagca

SEQ ID NO: 1138642 - RNA, 18 nt, Mycobacterium bovis subsp bovis AF2122/97
ccggcuggucacccguau

SEQ ID NO: 1138643 - RNA, 21 nt, Mycobacterium bovis subsp bovis AF2122/97
ccggcuggccagguggccgca

SEQ ID NO: 1138644 - RNA, 17 nt, Mycobacterium bovis subsp bovis AF2122/97
ccggcuggaagcggcga

SEQ ID NO: 1138645 - RNA, 23 nt, Mycobacterium bovis subsp bovis AF2122/97
ccggcugcgccaguaggcuucga

SEQ ID NO: 1138646 - RNA, 18 nt, Mycobacterium bovis subsp bovis AF2122/97
ccggcugcggggcgaucc

SEQ ID NO: 1138647 - RNA, 20 nt, Mycobacterium bovis subsp bovis AF2122/97
ccggcuugcccggcucggca

SEQ ID NO: 1138648 - RNA, 18 nt, Mycobacterium bovis subsp bovis AF2122/97
ccggcuuggcgggaccgu

SEQ ID NO: 1138649 - RNA, 13 nt, Mycobacterium bovis subsp bovis AF2122/97
ccggcuuggcggc

SEQ ID NO: 1138650 - RNA, 14 nt, Mycobacterium bovis subsp bovis AF2122/97
ccggcuuggcggcg

SEQ ID NO: 1138651 - RNA, 16 nt, Mycobacterium bovis subsp bovis AF2122/97
ccggcuuggcggcgau

SEQ ID NO: 1138652 - RNA, 17 nt, Mycobacterium bovis subsp bovis AF2122/97
ccggcuuggcggcgauc

SEQ ID NO: 1138653 - RNA, 17 nt, Mycobacterium bovis subsp bovis AF2122/97
ccggcuuggccuuugcc

SEQ ID NO: 1138654 - RNA, 22 nt, Mycobacterium bovis subsp bovis AF2122/97
ccggcuugggccaggcccagcu

SEQ ID NO: 1138655 - RNA, 16 nt, Mycobacterium bovis subsp bovis AF2122/97
ccggcuugggcgguag

SEQ ID NO: 1138656 - RNA, 24 nt, Mycobacterium bovis subsp bovis AF2122/97
ccggcuugggcgguagccgacgac

SEQ ID NO: 1138657 - RNA, 21 nt, Mycobacterium bovis subsp bovis AF2122/97
ccggcuuggugaaccgcgcgg

SEQ ID NO: 1138658 - RNA, 22 nt, Mycobacterium bovis subsp bovis AF2122/97
ccggcuuggugaaccgcgcggc

SEQ ID NO: 1138659 - RNA, 18 nt, Mycobacterium bovis subsp bovis AF2122/97
ccggcuuguccgugagca

SEQ ID NO: 1138660 - RNA, 14 nt, Mycobacterium bovis subsp bovis AF2122/97
ccggcuugucgacc

SEQ ID NO: 1138661 - RNA, 21 nt, Mycobacterium bovis subsp bovis AF2122/97
ccggcuugucgaccacgaccg

SEQ ID NO: 1138662 - RNA, 16 nt, Mycobacterium bovis subsp bovis AF2122/97
ccgggaacgcugacgc

SEQ ID NO: 1138663 - RNA, 16 nt, Mycobacterium bovis subsp bovis AF2122/97
ccgggaacccgagcuu

SEQ ID NO: 1138664 - RNA, 20 nt, Mycobacterium bovis subsp bovis AF2122/97
ccgggaaccacggucagcac

SEQ ID NO: 1138665 - RNA, 23 nt, Mycobacterium bovis subsp bovis AF2122/97
ccggcuugucgaccacgaccguc

SEQ ID NO: 1138666 - RNA, 21 nt, Mycobacterium bovis subsp bovis AF2122/97
ccggcuuuuccacgaguccgc

SEQ ID NO: 1138667 - RNA, 13 nt, Mycobacterium bovis subsp bovis AF2122/97
ccgggaaacaccg

SEQ ID NO: 1138668 - RNA, 21 nt, Mycobacterium bovis subsp bovis AF2122/97
ccgggaaacaccggcuuggug

SEQ ID NO: 1138669 - RNA, 21 nt, Mycobacterium bovis subsp bovis AF2122/97
ccgggaagucgcugaagccgu

SEQ ID NO: 1138670 - RNA, 23 nt, Mycobacterium bovis subsp bovis AF2122/97
ccgggaauggacaggucgggcag

SEQ ID NO: 1138671 - RNA, 22 nt, Mycobacterium bovis subsp bovis AF2122/97
ccgggaagccccuuuugccgca

SEQ ID NO: 1138672 - RNA, 19 nt, Mycobacterium bovis subsp bovis AF2122/97
ccgggaaggaaccgggcaa

SEQ ID NO: 1138673 - RNA, 21 nt, Mycobacterium bovis subsp bovis AF2122/97
ccgggaagccguuuucgaaac

SEQ ID NO: 1138674 - RNA, 20 nt, Mycobacterium bovis subsp bovis AF2122/97
ccgggaacgccucaggggcg

SEQ ID NO: 1138675 - RNA, 21 nt, Mycobacterium bovis subsp bovis AF2122/97
ccgggaccggugugcacgcgg

SEQ ID NO: 1138676 - RNA, 17 nt, Mycobacterium bovis subsp bovis AF2122/97
ccgggacgaaccggccg

SEQ ID NO: 1138677 - RNA, 17 nt, Mycobacterium bovis subsp bovis AF2122/97
ccgggacgaaucccgcg

SEQ ID NO: 1138678 - RNA, 15 nt, Mycobacterium bovis subsp bovis AF2122/97
ccgggacggugaaac

SEQ ID NO: 1138679 - RNA, 22 nt, Mycobacterium bovis subsp bovis AF2122/97
ccgggaccaggccaacggcgcu

SEQ ID NO: 1138680 - RNA, 22 nt, Mycobacterium bovis subsp bovis AF2122/97
ccgggaccauagccugcgccga

SEQ ID NO: 1138681 - RNA, 16 nt, Mycobacterium bovis subsp bovis AF2122/97
ccgggcacgcgaggcg

SEQ ID NO: 1138682 - RNA, 23 nt, Mycobacterium bovis subsp bovis AF2122/97
ccgggcacgaacaucagaucgcc

SEQ ID NO: 1138683 - RNA, 22 nt, Mycobacterium bovis subsp bovis AF2122/97
ccgggcacccuugccgauuccg

SEQ ID NO: 1138684 - RNA, 14 nt, Mycobacterium bovis subsp bovis AF2122/97
ccgggcaccggccg

SEQ ID NO: 1138685 - RNA, 13 nt, Mycobacterium bovis subsp bovis AF2122/97
ccgggcaccacca

SEQ ID NO: 1138686 - RNA, 17 nt, Mycobacterium bovis subsp bovis AF2122/97
ccgggacuaccacccgc

SEQ ID NO: 1138687 - RNA, 17 nt, Mycobacterium bovis subsp bovis AF2122/97
ccgggcagcaccagcgc

SEQ ID NO: 1138688 - RNA, 19 nt, Mycobacterium bovis subsp bovis AF2122/97
ccgggcagaugaugccguu

SEQ ID NO: 1138689 - RNA, 17 nt, Mycobacterium bovis subsp bovis AF2122/97
ccgggccacgucgagca

SEQ ID NO: 1138690 - RNA, 21 nt, Mycobacterium bovis subsp bovis AF2122/97
ccgggccaaugccguugaucg

SEQ ID NO: 1138691 - RNA, 13 nt, Mycobacterium bovis subsp bovis AF2122/97
ccgggcgcgccgg

SEQ ID NO: 1138692 - RNA, 14 nt, Mycobacterium bovis subsp bovis AF2122/97
ccgggcgcgccggc

SEQ ID NO: 1138693 - RNA, 16 nt, Mycobacterium bovis subsp bovis AF2122/97
ccgggcgcgccggcca

SEQ ID NO: 1138694 - RNA, 17 nt, Mycobacterium bovis subsp bovis AF2122/97
ccgggcgcgccggccau

SEQ ID NO: 1138695 - RNA, 13 nt, Mycobacterium bovis subsp bovis AF2122/97
ccgggcggccgcc

SEQ ID NO: 1138696 - RNA, 18 nt, Mycobacterium bovis subsp bovis AF2122/97
ccgggcggccaggcgcga

SEQ ID NO: 1138697 - RNA, 21 nt, Mycobacterium bovis subsp bovis AF2122/97
ccgggcggccaggcgcgacgu

SEQ ID NO: 1138698 - RNA, 17 nt, Mycobacterium bovis subsp bovis AF2122/97
ccgggcggaacgccggc

SEQ ID NO: 1138699 - RNA, 15 nt, Mycobacterium bovis subsp bovis AF2122/97
ccgggcggccagcug

SEQ ID NO: 1138700 - RNA, 18 nt, Mycobacterium bovis subsp bovis AF2122/97
ccgggcgcuugcaccagg

SEQ ID NO: 1138701 - RNA, 16 nt, Mycobacterium bovis subsp bovis AF2122/97
ccgggcgcuggacggc

SEQ ID NO: 1138702 - RNA, 23 nt, Mycobacterium bovis subsp bovis AF2122/97
ccgggcgcuggacggcgggccgc

SEQ ID NO: 1138703 - RNA, 19 nt, Mycobacterium bovis subsp bovis AF2122/97
ccgggcggcauccugcacg

SEQ ID NO: 1138704 - RNA, 14 nt, Mycobacterium bovis subsp bovis AF2122/97
ccgggccgaucacc

SEQ ID NO: 1138705 - RNA, 14 nt, Mycobacterium bovis subsp bovis AF2122/97
ccgggcccgucgga

SEQ ID NO: 1138706 - RNA, 20 nt, Mycobacterium bovis subsp bovis AF2122/97
ccgggcccuccacugcgagc

SEQ ID NO: 1138707 - RNA, 23 nt, Mycobacterium bovis subsp bovis AF2122/97
ccgggcccuccacugcgagcgcc

SEQ ID NO: 1138708 - RNA, 14 nt, Mycobacterium bovis subsp bovis AF2122/97
ccgggccgagcgca

SEQ ID NO: 1138709 - RNA, 17 nt, Mycobacterium bovis subsp bovis AF2122/97
ccgggccaggcugcgca

SEQ ID NO: 1138710 - RNA, 15 nt, Mycobacterium bovis subsp bovis AF2122/97
ccgggcccggcgaac

SEQ ID NO: 1138711 - RNA, 13 nt, Mycobacterium bovis subsp bovis AF2122/97
ccggucaccucgc

SEQ ID NO: 1138712 - RNA, 19 nt, Mycobacterium bovis subsp bovis AF2122/97
ccggucaccucgccggcgg

SEQ ID NO: 1138713 - RNA, 13 nt, Mycobacterium bovis subsp bovis AF2122/97
ccggucaccgcgc

SEQ ID NO: 1138714 - RNA, 16 nt, Mycobacterium bovis subsp bovis AF2122/97
ccggucaccgcgcagc

SEQ ID NO: 1138715 - RNA, 13 nt, Mycobacterium bovis subsp bovis AF2122/97
ccggucacgucga

SEQ ID NO: 1138716 - RNA, 14 nt, Mycobacterium bovis subsp bovis AF2122/97
ccggucacgacguc

SEQ ID NO: 1138717 - RNA, 21 nt, Mycobacterium bovis subsp bovis AF2122/97
ccggucagcaccuccaccgcg

SEQ ID NO: 1138718 - RNA, 21 nt, Mycobacterium bovis subsp bovis AF2122/97
ccgguauucccgcuuggcgug

SEQ ID NO: 1138719 - RNA, 22 nt, Mycobacterium bovis subsp bovis AF2122/97
ccggucagcaauacggcggcgc

SEQ ID NO: 1138720 - RNA, 14 nt, Mycobacterium bovis subsp bovis AF2122/97
ccggucaggacggc

SEQ ID NO: 1138721 - RNA, 17 nt, Mycobacterium bovis subsp bovis AF2122/97
ccggucaggacggcacc

SEQ ID NO: 1138722 - RNA, 21 nt, Mycobacterium bovis subsp bovis AF2122/97
ccggucaggcaguccaccgcg

SEQ ID NO: 1138723 - RNA, 22 nt, Mycobacterium bovis subsp bovis AF2122/97
ccggucaggcaguccaccgcgc

SEQ ID NO: 1138724 - RNA, 13 nt, Mycobacterium bovis subsp bovis AF2122/97
ccggucagcgcgg

SEQ ID NO: 1138725 - RNA, 14 nt, Mycobacterium bovis subsp bovis AF2122/97
ccggucagcgcggc

SEQ ID NO: 1138726 - RNA, 16 nt, Mycobacterium bovis subsp bovis AF2122/97
ccggucagcgcggcga

SEQ ID NO: 1138727 - RNA, 16 nt, Mycobacterium bovis subsp bovis AF2122/97
ccggucagcgcggcgc

SEQ ID NO: 1138728 - RNA, 21 nt, Mycobacterium bovis subsp bovis AF2122/97
ccgguaggcggccagcgcgcg

SEQ ID NO: 1138729 - RNA, 16 nt, Mycobacterium bovis subsp bovis AF2122/97
ccgguaguacuagcac

SEQ ID NO: 1138730 - RNA, 17 nt, Mycobacterium bovis subsp bovis AF2122/97
ccgguaguacuagcacg

SEQ ID NO: 1138731 - RNA, 17 nt, Mycobacterium bovis subsp bovis AF2122/97
ccgguaguagcugacca

SEQ ID NO: 1138732 - RNA, 17 nt, Mycobacterium bovis subsp bovis AF2122/97
ccgguauacccggcccc

SEQ ID NO: 1138733 - RNA, 17 nt, Mycobacterium bovis subsp bovis AF2122/97
ccgguaggcggccagcg

SEQ ID NO: 1138734 - RNA, 15 nt, Mycobacterium bovis subsp bovis AF2122/97
ccgguaggcgagaca

SEQ ID NO: 1138735 - RNA, 20 nt, Mycobacterium bovis subsp bovis AF2122/97
ccggucaaacgcgcgcgcca

SEQ ID NO: 1138736 - RNA, 21 nt, Mycobacterium bovis subsp bovis AF2122/97
ccggucaacacccgcccgggc

SEQ ID NO: 1138737 - RNA, 22 nt, Mycobacterium bovis subsp bovis AF2122/97
ccgguaucgucccggcgaccgg

SEQ ID NO: 1138738 - RNA, 20 nt, Mycobacterium bovis subsp bovis AF2122/97
ccgguaugcgccaucucgac

SEQ ID NO: 1138739 - RNA, 12 nt, Mycobacterium bovis subsp bovis AF2122/97
ccgguaugcgcg

SEQ ID NO: 1138740 - RNA, 22 nt, Mycobacterium bovis subsp bovis AF2122/97
ccgguaucgccaaauccggugc

SEQ ID NO: 1138741 - RNA, 14 nt, Mycobacterium bovis subsp bovis AF2122/97
ccgguaucgccgcu

SEQ ID NO: 1138742 - RNA, 20 nt, Mycobacterium bovis subsp bovis AF2122/97
ccgguaucgccgcuacgccg

SEQ ID NO: 1138743 - RNA, 20 nt, Mycobacterium bovis subsp bovis AF2122/97
ccgguagaucagcgccuggu

SEQ ID NO: 1138744 - RNA, 18 nt, Mycobacterium bovis subsp bovis AF2122/97
ccgguagaucagcgccug

SEQ ID NO: 1138745 - RNA, 14 nt, Mycobacterium bovis subsp bovis AF2122/97
ccgguacgccgcgc

SEQ ID NO: 1138746 - RNA, 22 nt, Mycobacterium bovis subsp bovis AF2122/97
ccgguacgcaaccaaccgucgg

SEQ ID NO: 1138747 - RNA, 12 nt, Mycobacterium bovis subsp bovis AF2122/97
ccgguacgccgc

SEQ ID NO: 1138748 - RNA, 16 nt, Mycobacterium bovis subsp bovis AF2122/97
ccgguagccaggcgcg

SEQ ID NO: 1138749 - RNA, 22 nt, Mycobacterium bovis subsp bovis AF2122/97
ccgguagcacagcagcaacgcg

SEQ ID NO: 1138750 - RNA, 14 nt, Mycobacterium bovis subsp bovis AF2122/97
ccgguagcacagca

SEQ ID NO: 1138751 - RNA, 17 nt, Mycobacterium bovis subsp bovis AF2122/97
ccgguagcugugguggu

SEQ ID NO: 1138752 - RNA, 14 nt, Mycobacterium bovis subsp bovis AF2122/97
ccgguagcguucgg

SEQ ID NO: 1138753 - RNA, 13 nt, Mycobacterium bovis subsp bovis AF2122/97
ccgguaccggcga

SEQ ID NO: 1138754 - RNA, 18 nt, Mycobacterium bovis subsp bovis AF2122/97
ccgguaccggcgacgaau

SEQ ID NO: 1138755 - RNA, 13 nt, Mycobacterium bovis subsp bovis AF2122/97
ccgguaccgacgg

SEQ ID NO: 1138756 - RNA, 14 nt, Mycobacterium bovis subsp bovis AF2122/97
ccgguaccgccggc

SEQ ID NO: 1138757 - RNA, 23 nt, Mycobacterium bovis subsp bovis AF2122/97
ccgguacacguccaguggcagcc

SEQ ID NO: 1138758 - RNA, 16 nt, Mycobacterium bovis subsp bovis AF2122/97
ccgguaaccgcgucga

SEQ ID NO: 1138759 - RNA, 20 nt, Mycobacterium bovis subsp bovis AF2122/97
ccgguaaccgcgucgaccgg

SEQ ID NO: 1138760 - RNA, 14 nt, Mycobacterium bovis subsp bovis AF2122/97
ccgguaacgaacag

SEQ ID NO: 1138761 - RNA, 16 nt, Mycobacterium bovis subsp bovis AF2122/97
ccgguaacuguccgcc

SEQ ID NO: 1138762 - RNA, 14 nt, Mycobacterium bovis subsp bovis AF2122/97
ccggguuggccggg

SEQ ID NO: 1138763 - RNA, 15 nt, Mycobacterium bovis subsp bovis AF2122/97
ccggguugagccgcc

SEQ ID NO: 1138764 - RNA, 16 nt, Mycobacterium bovis subsp bovis AF2122/97
ccggguugagccgccg

SEQ ID NO: 1138765 - RNA, 19 nt, Mycobacterium bovis subsp bovis AF2122/97
ccggguugagccgccgcga

SEQ ID NO: 1138766 - RNA, 20 nt, Mycobacterium bovis subsp bovis AF2122/97
ccggguugagccgccgcgac

SEQ ID NO: 1138767 - RNA, 23 nt, Mycobacterium bovis subsp bovis AF2122/97
ccggguugagccgccgcgacggc

SEQ ID NO: 1138768 - RNA, 21 nt, Mycobacterium bovis subsp bovis AF2122/97
ccggguuccagcggcaccgcg

SEQ ID NO: 1138769 - RNA, 15 nt, Mycobacterium bovis subsp bovis AF2122/97
ccgggugccgccacg

SEQ ID NO: 1138770 - RNA, 12 nt, Mycobacterium bovis subsp bovis AF2122/97
ccgggugccggc

SEQ ID NO: 1138771 - RNA, 14 nt, Mycobacterium bovis subsp bovis AF2122/97
ccgggugcaacggc

SEQ ID NO: 1138772 - RNA, 14 nt, Mycobacterium bovis subsp bovis AF2122/97
ccgggugcaccggc

SEQ ID NO: 1138773 - RNA, 18 nt, Mycobacterium bovis subsp bovis AF2122/97
ccgggucuguuggugaca

SEQ ID NO: 1138774 - RNA, 15 nt, Mycobacterium bovis subsp bovis AF2122/97
ccgggucgugcgaca

SEQ ID NO: 1138775 - RNA, 19 nt, Mycobacterium bovis subsp bovis AF2122/97
ccgggucucggugcggcug

SEQ ID NO: 1138776 - RNA, 23 nt, Mycobacterium bovis subsp bovis AF2122/97
ccgggugagcuacucacggugau

SEQ ID NO: 1138777 - RNA, 18 nt, Mycobacterium bovis subsp bovis AF2122/97
ccgggugaggcgggucgc

SEQ ID NO: 1138778 - RNA, 22 nt, Mycobacterium bovis subsp bovis AF2122/97
ccgggugaggcgggucgccgcc

SEQ ID NO: 1138779 - RNA, 21 nt, Mycobacterium bovis subsp bovis AF2122/97
ccgggugcgaucgcaacaccg

SEQ ID NO: 1138780 - RNA, 16 nt, Mycobacterium bovis subsp bovis AF2122/97
ccgggugcgccguugc

SEQ ID NO: 1138781 - RNA, 13 nt, Mycobacterium bovis subsp bovis AF2122/97
ccgggugcgggug

SEQ ID NO: 1138782 - RNA, 17 nt, Mycobacterium bovis subsp bovis AF2122/97
ccgggugcgagcgacac

SEQ ID NO: 1138783 - RNA, 18 nt, Mycobacterium bovis subsp bovis AF2122/97
ccggguggcgucaccgcc

SEQ ID NO: 1138784 - RNA, 19 nt, Mycobacterium bovis subsp bovis AF2122/97
ccggguggcgucaccgccg

SEQ ID NO: 1138785 - RNA, 16 nt, Mycobacterium bovis subsp bovis AF2122/97
ccggguggcgucgauc

SEQ ID NO: 1138786 - RNA, 18 nt, Mycobacterium bovis subsp bovis AF2122/97
ccgggugggagcagccga

SEQ ID NO: 1138787 - RNA, 15 nt, Mycobacterium bovis subsp bovis AF2122/97
ccggguguggucggu

SEQ ID NO: 1138788 - RNA, 20 nt, Mycobacterium bovis subsp bovis AF2122/97
ccgggucgauggguaccgcg

SEQ ID NO: 1138789 - RNA, 19 nt, Mycobacterium bovis subsp bovis AF2122/97
ccgggucgaugucggggcc

SEQ ID NO: 1138790 - RNA, 20 nt, Mycobacterium bovis subsp bovis AF2122/97
ccgggucgaugucggggccg

SEQ ID NO: 1138791 - RNA, 15 nt, Mycobacterium bovis subsp bovis AF2122/97
ccgggucgaucaccg

SEQ ID NO: 1138792 - RNA, 17 nt, Mycobacterium bovis subsp bovis AF2122/97
ccgggucgaucaccgac

SEQ ID NO: 1138793 - RNA, 19 nt, Mycobacterium bovis subsp bovis AF2122/97
ccgggucgaucaccgacac

SEQ ID NO: 1138794 - RNA, 18 nt, Mycobacterium bovis subsp bovis AF2122/97
ccgggucgacgacgucgc

SEQ ID NO: 1138795 - RNA, 23 nt, Mycobacterium bovis subsp bovis AF2122/97
ccgggucgaacuugaucaccgcg

SEQ ID NO: 1138796 - RNA, 20 nt, Mycobacterium bovis subsp bovis AF2122/97
ccgggucgacgacgucgcgc

SEQ ID NO: 1138797 - RNA, 14 nt, Mycobacterium bovis subsp bovis AF2122/97
ccgggucgacgacg

SEQ ID NO: 1138798 - RNA, 22 nt, Mycobacterium bovis subsp bovis AF2122/97
ccgggucgaacuugaucaccgc

SEQ ID NO: 1138799 - RNA, 21 nt, Mycobacterium bovis subsp bovis AF2122/97
ccgggucgaacaggccggccg

SEQ ID NO: 1138800 - RNA, 16 nt, Mycobacterium bovis subsp bovis AF2122/97
ccggguccggugaacc

SEQ ID NO: 1138801 - RNA, 19 nt, Mycobacterium bovis subsp bovis AF2122/97
ccggguccggugaacccga

SEQ ID NO: 1138802 - RNA, 21 nt, Mycobacterium bovis subsp bovis AF2122/97
ccggguccgccgggccccggg

SEQ ID NO: 1138803 - RNA, 17 nt, Mycobacterium bovis subsp bovis AF2122/97
ccggguccggaaccggu

SEQ ID NO: 1138804 - RNA, 22 nt, Mycobacterium bovis subsp bovis AF2122/97
ccgggucgucauacagcgcccu

SEQ ID NO: 1138805 - RNA, 22 nt, Mycobacterium bovis subsp bovis AF2122/97
ccgggucgggcaccgcgcgcuc

SEQ ID NO: 1138806 - RNA, 12 nt, Mycobacterium bovis subsp bovis AF2122/97
ccgggucggcga

SEQ ID NO: 1138807 - RNA, 17 nt, Mycobacterium bovis subsp bovis AF2122/97
ccgggucgcaaccgccg

SEQ ID NO: 1138808 - RNA, 13 nt, Mycobacterium bovis subsp bovis AF2122/97
ccgggucggcacg

SEQ ID NO: 1138809 - RNA, 16 nt, Mycobacterium bovis subsp bovis AF2122/97
ccgggucagcccagcc

SEQ ID NO: 1138810 - RNA, 18 nt, Mycobacterium bovis subsp bovis AF2122/97
ccgggucagcccggcgcg

SEQ ID NO: 1138811 - RNA, 20 nt, Mycobacterium bovis subsp bovis AF2122/97
ccgggucagcccggcgcgau

SEQ ID NO: 1138812 - RNA, 15 nt, Mycobacterium bovis subsp bovis AF2122/97
ccgggucagcgaccu

SEQ ID NO: 1138813 - RNA, 18 nt, Mycobacterium bovis subsp bovis AF2122/97
ccgggucaccagcgcauc

SEQ ID NO: 1138814 - RNA, 14 nt, Mycobacterium bovis subsp bovis AF2122/97
ccgggguggacggc

SEQ ID NO: 1138815 - RNA, 15 nt, Mycobacterium bovis subsp bovis AF2122/97
ccgggguggcgcgcc

SEQ ID NO: 1138816 - RNA, 18 nt, Mycobacterium bovis subsp bovis AF2122/97
ccgggucauccgugucga

SEQ ID NO: 1138817 - RNA, 21 nt, Mycobacterium bovis subsp bovis AF2122/97
ccgggucacuccggcggcuuc

SEQ ID NO: 1138818 - RNA, 22 nt, Mycobacterium bovis subsp bovis AF2122/97
ccgggucagcgaccucacugcg

SEQ ID NO: 1138819 - RNA, 15 nt, Mycobacterium bovis subsp bovis AF2122/97
ccggguccaccgcac

SEQ ID NO: 1138820 - RNA, 16 nt, Mycobacterium bovis subsp bovis AF2122/97
ccggguccaccgcacg

SEQ ID NO: 1138821 - RNA, 17 nt, Mycobacterium bovis subsp bovis AF2122/97
ccggguccaccgcacgg

SEQ ID NO: 1138822 - RNA, 14 nt, Mycobacterium bovis subsp bovis AF2122/97
ccggggucgaacgc

SEQ ID NO: 1138823 - RNA, 15 nt, Mycobacterium bovis subsp bovis AF2122/97
ccggggucgaacgcg

SEQ ID NO: 1138824 - RNA, 18 nt, Mycobacterium bovis subsp bovis AF2122/97
ccggggugcccccggugc

SEQ ID NO: 1138825 - RNA, 14 nt, Mycobacterium bovis subsp bovis AF2122/97
ccggggugcccggc

SEQ ID NO: 1138826 - RNA, 18 nt, Mycobacterium bovis subsp bovis AF2122/97
ccggggugcccggccgcc

SEQ ID NO: 1138827 - RNA, 17 nt, Mycobacterium bovis subsp bovis AF2122/97
ccggggugacaucgcga

SEQ ID NO: 1138828 - RNA, 18 nt, Mycobacterium bovis subsp bovis AF2122/97
ccgggguccaucggggcc

SEQ ID NO: 1138829 - RNA, 23 nt, Mycobacterium bovis subsp bovis AF2122/97
ccgggcgggcuggugucagcuga

SEQ ID NO: 1138830 - RNA, 19 nt, Mycobacterium bovis subsp bovis AF2122/97
ccgggcggcgucggugagc

SEQ ID NO: 1138831 - RNA, 22 nt, Mycobacterium bovis subsp bovis AF2122/97
ccgggcggcgucggugagcgcg

SEQ ID NO: 1138832 - RNA, 15 nt, Mycobacterium bovis subsp bovis AF2122/97
ccgggcggcggccug

SEQ ID NO: 1138833 - RNA, 21 nt, Mycobacterium bovis subsp bovis AF2122/97
ccgggggcaccguuaccgccg

SEQ ID NO: 1138834 - RNA, 13 nt, Mycobacterium bovis subsp bovis AF2122/97
ccgggggcgccgc

SEQ ID NO: 1138835 - RNA, 15 nt, Mycobacterium bovis subsp bovis AF2122/97
ccgggggcgccgccg

SEQ ID NO: 1138836 - RNA, 17 nt, Mycobacterium bovis subsp bovis AF2122/97
ccgggggcgccgccguu

SEQ ID NO: 1138837 - RNA, 19 nt, Mycobacterium bovis subsp bovis AF2122/97
ccgggggcgccgccguugc

SEQ ID NO: 1138838 - RNA, 18 nt, Mycobacterium bovis subsp bovis AF2122/97
ccgggcgggagucgucga

SEQ ID NO: 1138839 - RNA, 23 nt, Mycobacterium bovis subsp bovis AF2122/97
cgccgcacaucugcgggacgucg

SEQ ID NO: 1138840 - RNA, 16 nt, Mycobacterium bovis subsp bovis AF2122/97
cgccgcaauggaccga

SEQ ID NO: 1138841 - RNA, 15 nt, Mycobacterium bovis subsp bovis AF2122/97
cgccgcacacucucg

SEQ ID NO: 1138842 - RNA, 19 nt, Mycobacterium bovis subsp bovis AF2122/97
cgccgcacauuggugucca

SEQ ID NO: 1138843 - RNA, 20 nt, Mycobacterium bovis subsp bovis AF2122/97
cgccgcaccaagcagcgacc

SEQ ID NO: 1138844 - RNA, 19 nt, Mycobacterium bovis subsp bovis AF2122/97
cgccgcaaccgccgcguca

SEQ ID NO: 1138845 - RNA, 22 nt, Mycobacterium bovis subsp bovis AF2122/97
cgccgcaaguucacccaucauc

SEQ ID NO: 1138846 - RNA, 16 nt, Mycobacterium bovis subsp bovis AF2122/97
cgccgcaaucagacgg

SEQ ID NO: 1138847 - RNA, 17 nt, Mycobacterium bovis subsp bovis AF2122/97
cgccgcaaucagacggc

SEQ ID NO: 1138848 - RNA, 23 nt, Mycobacterium bovis subsp bovis AF2122/97
cgccgcaaugacgucgucggcca

SEQ ID NO: 1138849 - RNA, 15 nt, Mycobacterium bovis subsp bovis AF2122/97
cgccgcaaugacguc

SEQ ID NO: 1138850 - RNA, 16 nt, Mycobacterium bovis subsp bovis AF2122/97
cgccgcaaugacgucg

SEQ ID NO: 1138851 - RNA, 21 nt, Mycobacterium bovis subsp bovis AF2122/97
cgccgaucacggugggcgccg

SEQ ID NO: 1138852 - RNA, 19 nt, Mycobacterium bovis subsp bovis AF2122/97
cgccgaucacugucgggua

SEQ ID NO: 1138853 - RNA, 16 nt, Mycobacterium bovis subsp bovis AF2122/97
cgccgaucaccgcugu

SEQ ID NO: 1138854 - RNA, 22 nt, Mycobacterium bovis subsp bovis AF2122/97
cgccgaucagcgaaccaccggc

SEQ ID NO: 1138855 - RNA, 23 nt, Mycobacterium bovis subsp bovis AF2122/97
cgccgaucagcgaaccaccggcg

SEQ ID NO: 1138856 - RNA, 17 nt, Mycobacterium bovis subsp bovis AF2122/97
cgccgaucagcugcgca

SEQ ID NO: 1138857 - RNA, 13 nt, Mycobacterium bovis subsp bovis AF2122/97
cgccgaucccggc

SEQ ID NO: 1138858 - RNA, 14 nt, Mycobacterium bovis subsp bovis AF2122/97
cgccgaucccggcg

SEQ ID NO: 1138859 - RNA, 15 nt, Mycobacterium bovis subsp bovis AF2122/97
cgccgauuccaccgc

SEQ ID NO: 1138860 - RNA, 16 nt, Mycobacterium bovis subsp bovis AF2122/97
cgccgauuccaccgcc

SEQ ID NO: 1138861 - RNA, 17 nt, Mycobacterium bovis subsp bovis AF2122/97
cgccgauuccaccgccg

SEQ ID NO: 1138862 - RNA, 16 nt, Mycobacterium bovis subsp bovis AF2122/97
cgccgaucccggcggu

SEQ ID NO: 1138863 - RNA, 13 nt, Mycobacterium bovis subsp bovis AF2122/97
cgccgaucccguc

SEQ ID NO: 1138864 - RNA, 20 nt, Mycobacterium bovis subsp bovis AF2122/97
cgccgaucccgucgggcaca

SEQ ID NO: 1138865 - RNA, 13 nt, Mycobacterium bovis subsp bovis AF2122/97
cgccgaucaccgc

SEQ ID NO: 1138866 - RNA, 19 nt, Mycobacterium bovis subsp bovis AF2122/97
cgccgauuccaccgccgac

SEQ ID NO: 1138867 - RNA, 18 nt, Mycobacterium bovis subsp bovis AF2122/97
cgccgauguggucggcug

SEQ ID NO: 1138868 - RNA, 19 nt, Mycobacterium bovis subsp bovis AF2122/97
cgccgauuuggccgucauc

SEQ ID NO: 1138869 - RNA, 14 nt, Mycobacterium bovis subsp bovis AF2122/97
cgccgauucgccgu

SEQ ID NO: 1138870 - RNA, 16 nt, Mycobacterium bovis subsp bovis AF2122/97
cgccgcauugcagaac

SEQ ID NO: 1138871 - RNA, 20 nt, Mycobacterium bovis subsp bovis AF2122/97
cgccgcaucguuuucgccga

SEQ ID NO: 1138872 - RNA, 22 nt, Mycobacterium bovis subsp bovis AF2122/97
cgccgcaucauagacagggccg

SEQ ID NO: 1138873 - RNA, 17 nt, Mycobacterium bovis subsp bovis AF2122/97
cgccgcaucggcggguc

SEQ ID NO: 1138874 - RNA, 15 nt, Mycobacterium bovis subsp bovis AF2122/97
cgccgcaucggcggu

SEQ ID NO: 1138875 - RNA, 16 nt, Mycobacterium bovis subsp bovis AF2122/97
cgccgcaucggcggug

SEQ ID NO: 1138876 - RNA, 15 nt, Mycobacterium bovis subsp bovis AF2122/97
cgccgcaucgggcgu

SEQ ID NO: 1138877 - RNA, 19 nt, Mycobacterium bovis subsp bovis AF2122/97
cgccgcagcgcucgcguca

SEQ ID NO: 1138878 - RNA, 16 nt, Mycobacterium bovis subsp bovis AF2122/97
cgccgcaguggaugca

SEQ ID NO: 1138879 - RNA, 14 nt, Mycobacterium bovis subsp bovis AF2122/97
cgccgcagggccgc

SEQ ID NO: 1138880 - RNA, 16 nt, Mycobacterium bovis subsp bovis AF2122/97
cgccgcagcguccgcg

SEQ ID NO: 1138881 - RNA, 15 nt, Mycobacterium bovis subsp bovis AF2122/97
cgccgcagcgcguac

SEQ ID NO: 1138882 - RNA, 20 nt, Mycobacterium bovis subsp bovis AF2122/97
cgccgcagccugcaacgucu

SEQ ID NO: 1138883 - RNA, 19 nt, Mycobacterium bovis subsp bovis AF2122/97
cgccgcagcgaaaacccgg

SEQ ID NO: 1138884 - RNA, 13 nt, Mycobacterium bovis subsp bovis AF2122/97
cgccgcagcaggu

SEQ ID NO: 1138885 - RNA, 21 nt, Mycobacterium bovis subsp bovis AF2122/97
cgccgcacagaaaacgauggu

SEQ ID NO: 1138886 - RNA, 20 nt, Mycobacterium bovis subsp bovis AF2122/97
cgccgcagaucaccgccagc

SEQ ID NO: 1138887 - RNA, 15 nt, Mycobacterium bovis subsp bovis AF2122/97
cgccgcagcaggugc

SEQ ID NO: 1138888 - RNA, 21 nt, Mycobacterium bovis subsp bovis AF2122/97
cgccgcacgccggcaugccag

SEQ ID NO: 1138889 - RNA, 15 nt, Mycobacterium bovis subsp bovis AF2122/97
cgccgcagacgccga

SEQ ID NO: 1138890 - RNA, 23 nt, Mycobacterium bovis subsp bovis AF2122/97
cgccgcagaugggccuccaccgc

SEQ ID NO: 1138891 - RNA, 14 nt, Mycobacterium bovis subsp bovis AF2122/97
cgccgcacgccgac

SEQ ID NO: 1138892 - RNA, 12 nt, Mycobacterium bovis subsp bovis AF2122/97
cgccgcacggcg

SEQ ID NO: 1138893 - RNA, 15 nt, Mycobacterium bovis subsp bovis AF2122/97
cgccgcacggcgacg

SEQ ID NO: 1138894 - RNA, 16 nt, Mycobacterium bovis subsp bovis AF2122/97
cgccgcaccgccgcau

SEQ ID NO: 1138895 - RNA, 14 nt, Mycobacterium bovis subsp bovis AF2122/97
cgccgcacgccggc

SEQ ID NO: 1138896 - RNA, 16 nt, Mycobacterium bovis subsp bovis AF2122/97
cgccgaucaacaugcc

SEQ ID NO: 1138897 - RNA, 20 nt, Mycobacterium bovis subsp bovis AF2122/97
cgccgaucaacaugccgguc

SEQ ID NO: 1138898 - RNA, 13 nt, Mycobacterium bovis subsp bovis AF2122/97
cgccgaucaccac

SEQ ID NO: 1138899 - RNA, 15 nt, Mycobacterium bovis subsp bovis AF2122/97
cgccgaucaccaccg

SEQ ID NO: 1138900 - RNA, 17 nt, Mycobacterium bovis subsp bovis AF2122/97
cgccgaucaccaccggc

SEQ ID NO: 1138901 - RNA, 18 nt, Mycobacterium bovis subsp bovis AF2122/97
cgccgaucaccaccggca

SEQ ID NO: 1138902 - RNA, 20 nt, Mycobacterium bovis subsp bovis AF2122/97
cgccgaucaccaggguuggc

SEQ ID NO: 1138903 - RNA, 17 nt, Mycobacterium bovis subsp bovis AF2122/97
cgccgauaucugccacg

SEQ ID NO: 1138904 - RNA, 20 nt, Mycobacterium bovis subsp bovis AF2122/97
cgccgauaucugccacguug

SEQ ID NO: 1138905 - RNA, 14 nt, Mycobacterium bovis subsp bovis AF2122/97
cgccgauaucgcag

SEQ ID NO: 1138906 - RNA, 16 nt, Mycobacterium bovis subsp bovis AF2122/97
cgccgauaccggcggc

SEQ ID NO: 1138907 - RNA, 17 nt, Mycobacterium bovis subsp bovis AF2122/97
cgccgauaccggcggcg

SEQ ID NO: 1138908 - RNA, 20 nt, Mycobacterium bovis subsp bovis AF2122/97
cgccgauacuaaacaggccg

SEQ ID NO: 1138909 - RNA, 22 nt, Mycobacterium bovis subsp bovis AF2122/97
cgccgauacuaaacaggccgcc

SEQ ID NO: 1138910 - RNA, 23 nt, Mycobacterium bovis subsp bovis AF2122/97
cgccgauacuaaacaggccgcca

SEQ ID NO: 1138911 - RNA, 19 nt, Mycobacterium bovis subsp bovis AF2122/97
cgccgauacuucaucggca

SEQ ID NO: 1138912 - RNA, 21 nt, Mycobacterium bovis subsp bovis AF2122/97
cgccgauacuucaucggcaca

SEQ ID NO: 1138913 - RNA, 17 nt, Mycobacterium bovis subsp bovis AF2122/97
cgccgagguagauggcg

SEQ ID NO: 1138914 - RNA, 13 nt, Mycobacterium bovis subsp bovis AF2122/97
cgccgagggcgcc

SEQ ID NO: 1138915 - RNA, 14 nt, Mycobacterium bovis subsp bovis AF2122/97
cgccgagggcgccg

SEQ ID NO: 1138916 - RNA, 17 nt, Mycobacterium bovis subsp bovis AF2122/97
cgccgagggcgccgggg

SEQ ID NO: 1138917 - RNA, 15 nt, Mycobacterium bovis subsp bovis AF2122/97
cgccgaguugaccgc

SEQ ID NO: 1138918 - RNA, 20 nt, Mycobacterium bovis subsp bovis AF2122/97
cgccgaguugaccgccgugg

SEQ ID NO: 1138919 - RNA, 20 nt, Mycobacterium bovis subsp bovis AF2122/97
cgccgaguugcccgggucgg

SEQ ID NO: 1138920 - RNA, 18 nt, Mycobacterium bovis subsp bovis AF2122/97
cgccgaguuguucgccca

SEQ ID NO: 1138921 - RNA, 17 nt, Mycobacterium bovis subsp bovis AF2122/97
cgccgauacccagcggg

SEQ ID NO: 1138922 - RNA, 18 nt, Mycobacterium bovis subsp bovis AF2122/97
cgccgauaccgccggccc

SEQ ID NO: 1138923 - RNA, 22 nt, Mycobacterium bovis subsp bovis AF2122/97
cgccgaggccucggccagcguc

SEQ ID NO: 1138924 - RNA, 13 nt, Mycobacterium bovis subsp bovis AF2122/97
cgccgaggccgcc

SEQ ID NO: 1138925 - RNA, 14 nt, Mycobacterium bovis subsp bovis AF2122/97
cgccgaggccgccg

SEQ ID NO: 1138926 - RNA, 21 nt, Mycobacterium bovis subsp bovis AF2122/97
cgccgaggccuaccaggcgcg

SEQ ID NO: 1138927 - RNA, 18 nt, Mycobacterium bovis subsp bovis AF2122/97
cgccgaggccucggccag

SEQ ID NO: 1138928 - RNA, 16 nt, Mycobacterium bovis subsp bovis AF2122/97
cgccgagcagacgcgg

SEQ ID NO: 1138929 - RNA, 19 nt, Mycobacterium bovis subsp bovis AF2122/97
cgccgagcacacgucggga

SEQ ID NO: 1138930 - RNA, 20 nt, Mycobacterium bovis subsp bovis AF2122/97
cgccgagcagcccgcggauc

SEQ ID NO: 1138931 - RNA, 15 nt, Mycobacterium bovis subsp bovis AF2122/97
cgccgagauccgcgc

SEQ ID NO: 1138932 - RNA, 15 nt, Mycobacterium bovis subsp bovis AF2122/97
cgccgagaucgacau

SEQ ID NO: 1138933 - RNA, 14 nt, Mycobacterium bovis subsp bovis AF2122/97
cgccgagauccgcg

SEQ ID NO: 1138934 - RNA, 18 nt, Mycobacterium bovis subsp bovis AF2122/97
cgccgacucggcaccgcg

SEQ ID NO: 1138935 - RNA, 19 nt, Mycobacterium bovis subsp bovis AF2122/97
cgccgacuccccgccgggc

SEQ ID NO: 1138936 - RNA, 22 nt, Mycobacterium bovis subsp bovis AF2122/97
cgcccagcagcaccugcaccgc

SEQ ID NO: 1138937 - RNA, 16 nt, Mycobacterium bovis subsp bovis AF2122/97
cgccgacuuccgcguc

SEQ ID NO: 1138938 - RNA, 17 nt, Mycobacterium bovis subsp bovis AF2122/97
cgccgacuuccgcgucg

SEQ ID NO: 1138939 - RNA, 22 nt, Mycobacterium bovis subsp bovis AF2122/97
cgccgacuugauuucgaucgcg

SEQ ID NO: 1138940 - RNA, 20 nt, Mycobacterium bovis subsp bovis AF2122/97
cgccgagagcaccgcucggu

SEQ ID NO: 1138941 - RNA, 21 nt, Mycobacterium bovis subsp bovis AF2122/97
cgccgagagcaccgcucgguc

SEQ ID NO: 1138942 - RNA, 18 nt, Mycobacterium bovis subsp bovis AF2122/97
cgccgagaacgauguccg

SEQ ID NO: 1138943 - RNA, 23 nt, Mycobacterium bovis subsp bovis AF2122/97
cgccgagaccgccgcugccgccg

SEQ ID NO: 1138944 - RNA, 16 nt, Mycobacterium bovis subsp bovis AF2122/97
cgcccacuggugaucu

SEQ ID NO: 1138945 - RNA, 16 nt, Mycobacterium bovis subsp bovis AF2122/97
cgcccacuccagcagc

SEQ ID NO: 1138946 - RNA, 22 nt, Mycobacterium bovis subsp bovis AF2122/97
cgcccacuccagcagcucgccg

SEQ ID NO: 1138947 - RNA, 18 nt, Mycobacterium bovis subsp bovis AF2122/97
cgcccagaccgccgacgc

SEQ ID NO: 1138948 - RNA, 20 nt, Mycobacterium bovis subsp bovis AF2122/97
cgcccagaccgccgacgccg

SEQ ID NO: 1138949 - RNA, 13 nt, Mycobacterium bovis subsp bovis AF2122/97
cgcccagcaaggc

SEQ ID NO: 1138950 - RNA, 18 nt, Mycobacterium bovis subsp bovis AF2122/97
cgcccagcagcaccugca

SEQ ID NO: 1138951 - RNA, 14 nt, Mycobacterium bovis subsp bovis AF2122/97
cgcccagagccgcu

SEQ ID NO: 1138952 - RNA, 17 nt, Mycobacterium bovis subsp bovis AF2122/97
cgcccagagccgcugcg

SEQ ID NO: 1138953 - RNA, 23 nt, Mycobacterium bovis subsp bovis AF2122/97
cgcccagagccgcugcggcaccg

SEQ ID NO: 1138954 - RNA, 18 nt, Mycobacterium bovis subsp bovis AF2122/97
cgccgccuucuuggcggc

SEQ ID NO: 1138955 - RNA, 18 nt, Mycobacterium bovis subsp bovis AF2122/97
cgccgccugugcgcggug

SEQ ID NO: 1138956 - RNA, 19 nt, Mycobacterium bovis subsp bovis AF2122/97
cgccgcgaacuccagcagc

SEQ ID NO: 1138957 - RNA, 19 nt, Mycobacterium bovis subsp bovis AF2122/97
cgccgcgaaugucgccgcc

SEQ ID NO: 1138958 - RNA, 19 nt, Mycobacterium bovis subsp bovis AF2122/97
cgccgcgaagcgcucggca

SEQ ID NO: 1138959 - RNA, 14 nt, Mycobacterium bovis subsp bovis AF2122/97
cgccgcgaaugucg

SEQ ID NO: 1138960 - RNA, 18 nt, Mycobacterium bovis subsp bovis AF2122/97
cgccgcgaccacgcaccg

SEQ ID NO: 1138961 - RNA, 21 nt, Mycobacterium bovis subsp bovis AF2122/97
cgccgcgagagccggcggcga

SEQ ID NO: 1138962 - RNA, 15 nt, Mycobacterium bovis subsp bovis AF2122/97
cgccgcgacggcacg

SEQ ID NO: 1138963 - RNA, 14 nt, Mycobacterium bovis subsp bovis AF2122/97
cgccgcgagcgccg

SEQ ID NO: 1138964 - RNA, 19 nt, Mycobacterium bovis subsp bovis AF2122/97
cgccgcgagcgccggccgc

SEQ ID NO: 1138965 - RNA, 20 nt, Mycobacterium bovis subsp bovis AF2122/97
cgccgcgagcgccggccgcg

SEQ ID NO: 1138966 - RNA, 20 nt, Mycobacterium bovis subsp bovis AF2122/97
cgccgcgaggaugcugagcg

SEQ ID NO: 1138967 - RNA, 23 nt, Mycobacterium bovis subsp bovis AF2122/97
cgccgcgaggaugcugagcgcca

SEQ ID NO: 1138968 - RNA, 21 nt, Mycobacterium bovis subsp bovis AF2122/97
cgccgcgaucuccuuggccgu

SEQ ID NO: 1138969 - RNA, 13 nt, Mycobacterium bovis subsp bovis AF2122/97
cgccgcgaucagu

SEQ ID NO: 1138970 - RNA, 13 nt, Mycobacterium bovis subsp bovis AF2122/97
cgccgcgccggca

SEQ ID NO: 1138971 - RNA, 14 nt, Mycobacterium bovis subsp bovis AF2122/97
cgccgcgccggcgg

SEQ ID NO: 1138972 - RNA, 17 nt, Mycobacterium bovis subsp bovis AF2122/97
cgccgcgccggcggcca

SEQ ID NO: 1138973 - RNA, 18 nt, Mycobacterium bovis subsp bovis AF2122/97
cgccgcgccggcggccac

SEQ ID NO: 1138974 - RNA, 17 nt, Mycobacterium bovis subsp bovis AF2122/97
cgccgcgccggcgggcg

SEQ ID NO: 1138975 - RNA, 20 nt, Mycobacterium bovis subsp bovis AF2122/97
cgccgcgccggugugcgcac

SEQ ID NO: 1138976 - RNA, 12 nt, Mycobacterium bovis subsp bovis AF2122/97
cgccgcgcgaca

SEQ ID NO: 1138977 - RNA, 15 nt, Mycobacterium bovis subsp bovis AF2122/97
cgccgcgccggcacg

SEQ ID NO: 1138978 - RNA, 13 nt, Mycobacterium bovis subsp bovis AF2122/97
cgccgcgccggcg

SEQ ID NO: 1138979 - RNA, 14 nt, Mycobacterium bovis subsp bovis AF2122/97
cgccgcgccguccc

SEQ ID NO: 1138980 - RNA, 12 nt, Mycobacterium bovis subsp bovis AF2122/97
cgccgcccggcg

SEQ ID NO: 1138981 - RNA, 16 nt, Mycobacterium bovis subsp bovis AF2122/97
cgccgcccgugccgcc

SEQ ID NO: 1138982 - RNA, 22 nt, Mycobacterium bovis subsp bovis AF2122/97
cgccgccgaagcgaugccgugc

SEQ ID NO: 1138983 - RNA, 18 nt, Mycobacterium bovis subsp bovis AF2122/97
cgccgccgacaaucacca

SEQ ID NO: 1138984 - RNA, 17 nt, Mycobacterium bovis subsp bovis AF2122/97
cgccgcccuugccgccg

SEQ ID NO: 1138985 - RNA, 22 nt, Mycobacterium bovis subsp bovis AF2122/97
cgccgcccuugccgccggcccc

SEQ ID NO: 1138986 - RNA, 17 nt, Mycobacterium bovis subsp bovis AF2122/97
cgccgcccuggccgccg

SEQ ID NO: 1138987 - RNA, 21 nt, Mycobacterium bovis subsp bovis AF2122/97
cgccgcccuggccgccggccc

SEQ ID NO: 1138988 - RNA, 15 nt, Mycobacterium bovis subsp bovis AF2122/97
cgccgcccuguccgg

SEQ ID NO: 1138989 - RNA, 15 nt, Mycobacterium bovis subsp bovis AF2122/97
cgccgccgacgccgc

SEQ ID NO: 1138990 - RNA, 15 nt, Mycobacterium bovis subsp bovis AF2122/97
cgccgccgccaccac

SEQ ID NO: 1138991 - RNA, 13 nt, Mycobacterium bovis subsp bovis AF2122/97
cgccgccgccacg

SEQ ID NO: 1138992 - RNA, 18 nt, Mycobacterium bovis subsp bovis AF2122/97
cgccgccgacgccgccgg

SEQ ID NO: 1138993 - RNA, 12 nt, Mycobacterium bovis subsp bovis AF2122/97
cgccgccgacgg

SEQ ID NO: 1138994 - RNA, 22 nt, Mycobacterium bovis subsp bovis AF2122/97
cgccgccgacggaucgcccuga

SEQ ID NO: 1138995 - RNA, 14 nt, Mycobacterium bovis subsp bovis AF2122/97
cgccgccgaucacc

SEQ ID NO: 1138996 - RNA, 22 nt, Mycobacterium bovis subsp bovis AF2122/97
cgccgccggcuccggcggugcc

SEQ ID NO: 1138997 - RNA, 16 nt, Mycobacterium bovis subsp bovis AF2122/97
cgccgccggcucgccg

SEQ ID NO: 1138998 - RNA, 18 nt, Mycobacterium bovis subsp bovis AF2122/97
cgccgccggcggcgguac

SEQ ID NO: 1138999 - RNA, 19 nt, Mycobacterium bovis subsp bovis AF2122/97
cgccgccggcggcgguacc

SEQ ID NO: 1139000 - RNA, 14 nt, Mycobacterium bovis subsp bovis AF2122/97
cgccgccggcgcug

SEQ ID NO: 1139001 - RNA, 12 nt, Mycobacterium bovis subsp bovis AF2122/97
cgccgccggcgc

SEQ ID NO: 1139002 - RNA, 13 nt, Mycobacterium bovis subsp bovis AF2122/97
cgccgccggcgcc

SEQ ID NO: 1139003 - RNA, 14 nt, Mycobacterium bovis subsp bovis AF2122/97
cgccgccggcgccg

SEQ ID NO: 1139004 - RNA, 16 nt, Mycobacterium bovis subsp bovis AF2122/97
cgccgccggcgccgcc

SEQ ID NO: 1139005 - RNA, 21 nt, Mycobacterium bovis subsp bovis AF2122/97
cgccgccggcgccgccggugc

SEQ ID NO: 1139006 - RNA, 16 nt, Mycobacterium bovis subsp bovis AF2122/97
cgccgccggcgccgga

SEQ ID NO: 1139007 - RNA, 15 nt, Mycobacterium bovis subsp bovis AF2122/97
cgccgccggcggucg

SEQ ID NO: 1139008 - RNA, 15 nt, Mycobacterium bovis subsp bovis AF2122/97
cgccgccugcccggc

SEQ ID NO: 1139009 - RNA, 21 nt, Mycobacterium bovis subsp bovis AF2122/97
cgccgccugcccggcccgcuc

SEQ ID NO: 1139010 - RNA, 21 nt, Mycobacterium bovis subsp bovis AF2122/97
cgccgccugcuccucggccag

SEQ ID NO: 1139011 - RNA, 22 nt, Mycobacterium bovis subsp bovis AF2122/97
cgccgccugcuccucggccagc

SEQ ID NO: 1139012 - RNA, 22 nt, Mycobacterium bovis subsp bovis AF2122/97
cgccgccuggaaaaaguuaccg

SEQ ID NO: 1139013 - RNA, 23 nt, Mycobacterium bovis subsp bovis AF2122/97
cgccgccggcaccggggcugccc

SEQ ID NO: 1139014 - RNA, 13 nt, Mycobacterium bovis subsp bovis AF2122/97
cgccgccggcaac

SEQ ID NO: 1139015 - RNA, 13 nt, Mycobacterium bovis subsp bovis AF2122/97
cgccgccggccgc

SEQ ID NO: 1139016 - RNA, 15 nt, Mycobacterium bovis subsp bovis AF2122/97
cgccgccggccgcca

SEQ ID NO: 1139017 - RNA, 21 nt, Mycobacterium bovis subsp bovis AF2122/97
cgccgccggccccgccgaugc

SEQ ID NO: 1139018 - RNA, 19 nt, Mycobacterium bovis subsp bovis AF2122/97
cgccgccauaccucggcga

SEQ ID NO: 1139019 - RNA, 15 nt, Mycobacterium bovis subsp bovis AF2122/97
cgccgccaucagccc

SEQ ID NO: 1139020 - RNA, 15 nt, Mycobacterium bovis subsp bovis AF2122/97
cgccgccauugccgc

SEQ ID NO: 1139021 - RNA, 21 nt, Mycobacterium bovis subsp bovis AF2122/97
cgccgccauugccgccggugc

SEQ ID NO: 1139022 - RNA, 14 nt, Mycobacterium bovis subsp bovis AF2122/97
cgccgccaucgccg

SEQ ID NO: 1139023 - RNA, 19 nt, Mycobacterium bovis subsp bovis AF2122/97
cgccgcccaauccaccgaa

SEQ ID NO: 1139024 - RNA, 23 nt, Mycobacterium bovis subsp bovis AF2122/97
cgccgcccaauccaccgaagccc

SEQ ID NO: 1139025 - RNA, 13 nt, Mycobacterium bovis subsp bovis AF2122/97
cgccgcccccgcc

SEQ ID NO: 1139026 - RNA, 21 nt, Mycobacterium bovis subsp bovis AF2122/97
cgccgccccauacuugcgccg

SEQ ID NO: 1139027 - RNA, 23 nt, Mycobacterium bovis subsp bovis AF2122/97
cgccgcccccgcccguugcaggu

SEQ ID NO: 1139028 - RNA, 22 nt, Mycobacterium bovis subsp bovis AF2122/97
cgccgcccccguuuacggcccg

SEQ ID NO: 1139029 - RNA, 13 nt, Mycobacterium bovis subsp bovis AF2122/97
cgccgccccgaua

SEQ ID NO: 1139030 - RNA, 19 nt, Mycobacterium bovis subsp bovis AF2122/97
cgccgccccugcgcggcca

SEQ ID NO: 1139031 - RNA, 18 nt, Mycobacterium bovis subsp bovis AF2122/97
cgccgcccgcaucgcggc

SEQ ID NO: 1139032 - RNA, 14 nt, Mycobacterium bovis subsp bovis AF2122/97
cgccgccccgcucg

SEQ ID NO: 1139033 - RNA, 15 nt, Mycobacterium bovis subsp bovis AF2122/97
cgccgccccggcgcu

SEQ ID NO: 1139034 - RNA, 21 nt, Mycobacterium bovis subsp bovis AF2122/97
cgccgccccggcgcuggugcg

SEQ ID NO: 1139035 - RNA, 14 nt, Mycobacterium bovis subsp bovis AF2122/97
cgccgcccgcgcca

SEQ ID NO: 1139036 - RNA, 18 nt, Mycobacterium bovis subsp bovis AF2122/97
cgccgcccgcgccaccga

SEQ ID NO: 1139037 - RNA, 17 nt, Mycobacterium bovis subsp bovis AF2122/97
cgccgcccgcgccgccg

SEQ ID NO: 1139038 - RNA, 18 nt, Mycobacterium bovis subsp bovis AF2122/97
cgccgcccgcuccuccgg

SEQ ID NO: 1139039 - RNA, 22 nt, Mycobacterium bovis subsp bovis AF2122/97
cgccgcccgcuccuccggcacc

SEQ ID NO: 1139040 - RNA, 16 nt, Mycobacterium bovis subsp bovis AF2122/97
cgccgccagcgccgcc

SEQ ID NO: 1139041 - RNA, 17 nt, Mycobacterium bovis subsp bovis AF2122/97
cgccgccagcgccgccg

SEQ ID NO: 1139042 - RNA, 14 nt, Mycobacterium bovis subsp bovis AF2122/97
cgccgccagcgcgg

SEQ ID NO: 1139043 - RNA, 17 nt, Mycobacterium bovis subsp bovis AF2122/97
cgccgccagcgcggugu

SEQ ID NO: 1139044 - RNA, 22 nt, Mycobacterium bovis subsp bovis AF2122/97
cgccgccagguccgccggugcc

SEQ ID NO: 1139045 - RNA, 19 nt, Mycobacterium bovis subsp bovis AF2122/97
cgccgccagguugcccggu

SEQ ID NO: 1139046 - RNA, 16 nt, Mycobacterium bovis subsp bovis AF2122/97
cgccgccaguccggac

SEQ ID NO: 1139047 - RNA, 13 nt, Mycobacterium bovis subsp bovis AF2122/97
cgccgccagcgcg

SEQ ID NO: 1139048 - RNA, 17 nt, Mycobacterium bovis subsp bovis AF2122/97
cgccgccagcaccaccg

SEQ ID NO: 1139049 - RNA, 19 nt, Mycobacterium bovis subsp bovis AF2122/97
cgccgccagcaccaccggc

SEQ ID NO: 1139050 - RNA, 15 nt, Mycobacterium bovis subsp bovis AF2122/97
cgccgccagcaccac

SEQ ID NO: 1139051 - RNA, 13 nt, Mycobacterium bovis subsp bovis AF2122/97
cgccgccagcacc

SEQ ID NO: 1139052 - RNA, 15 nt, Mycobacterium bovis subsp bovis AF2122/97
cgccgccaccagggc

SEQ ID NO: 1139053 - RNA, 14 nt, Mycobacterium bovis subsp bovis AF2122/97
cgccgccaccggcg

SEQ ID NO: 1139054 - RNA, 13 nt, Mycobacterium bovis subsp bovis AF2122/97
cgccgccaccggc

SEQ ID NO: 1139055 - RNA, 15 nt, Mycobacterium bovis subsp bovis AF2122/97
cgccgccacccggcg

SEQ ID NO: 1139056 - RNA, 13 nt, Mycobacterium bovis subsp bovis AF2122/97
cgccgccaccccg

SEQ ID NO: 1139057 - RNA, 22 nt, Mycobacterium bovis subsp bovis AF2122/97
cgccgccaccccgcgcgccagc

SEQ ID NO: 1139058 - RNA, 13 nt, Mycobacterium bovis subsp bovis AF2122/97
cgccgccacccgg

SEQ ID NO: 1139059 - RNA, 17 nt, Mycobacterium bovis subsp bovis AF2122/97
cgccgccacgggugacg

SEQ ID NO: 1139060 - RNA, 19 nt, Mycobacterium bovis subsp bovis AF2122/97
cgccgccacgggugacgaa

SEQ ID NO: 1139061 - RNA, 19 nt, Mycobacterium bovis subsp bovis AF2122/97
cgccgccacggaucgcggc

SEQ ID NO: 1139062 - RNA, 21 nt, Mycobacterium bovis subsp bovis AF2122/97
cgccgccacggaucgcggcgg

SEQ ID NO: 1139063 - RNA, 14 nt, Mycobacterium bovis subsp bovis AF2122/97
cgccgccacugccg

SEQ ID NO: 1139064 - RNA, 21 nt, Mycobacterium bovis subsp bovis AF2122/97
cgccgccaagcucggccacca

SEQ ID NO: 1139065 - RNA, 19 nt, Mycobacterium bovis subsp bovis AF2122/97
cgccgccacagcacccacg

SEQ ID NO: 1139066 - RNA, 21 nt, Mycobacterium bovis subsp bovis AF2122/97
cgccgccaccacccaacagcc

SEQ ID NO: 1139067 - RNA, 14 nt, Mycobacterium bovis subsp bovis AF2122/97
cgccgccaccaccg

SEQ ID NO: 1139068 - RNA, 21 nt, Mycobacterium bovis subsp bovis AF2122/97
cgccgccaccaccgcugccgg

SEQ ID NO: 1139069 - RNA, 22 nt, Mycobacterium bovis subsp bovis AF2122/97
cgccgccaccaccgcugccggc

SEQ ID NO: 1139070 - RNA, 23 nt, Mycobacterium bovis subsp bovis AF2122/97
cgccgccaccagcugcgcgaugu

SEQ ID NO: 1139071 - RNA, 13 nt, Mycobacterium bovis subsp bovis AF2122/97
cgccgccaccagg

SEQ ID NO: 1139072 - RNA, 19 nt, Mycobacterium bovis subsp bovis AF2122/97
cgccgccaagcucggccac

SEQ ID NO: 1139073 - RNA, 20 nt, Mycobacterium bovis subsp bovis AF2122/97
cgccgccaagcucggccacc

SEQ ID NO: 1139074 - RNA, 13 nt, Mycobacterium bovis subsp bovis AF2122/97
cgccgccaacucc

SEQ ID NO: 1139075 - RNA, 13 nt, Mycobacterium bovis subsp bovis AF2122/97
cgccgcgcugguc

SEQ ID NO: 1139076 - RNA, 14 nt, Mycobacterium bovis subsp bovis AF2122/97
cgccgcgcuggucg

SEQ ID NO: 1139077 - RNA, 23 nt, Mycobacterium bovis subsp bovis AF2122/97
cgccgcgcuugcgaucgccgcua

SEQ ID NO: 1139078 - RNA, 20 nt, Mycobacterium bovis subsp bovis AF2122/97
cgccgcgcuugcgaucggca

SEQ ID NO: 1139079 - RNA, 20 nt, Mycobacterium bovis subsp bovis AF2122/97
cgccgcggaccagaggucga

SEQ ID NO: 1139080 - RNA, 13 nt, Mycobacterium bovis subsp bovis AF2122/97
cgccgcggccacc

SEQ ID NO: 1139081 - RNA, 14 nt, Mycobacterium bovis subsp bovis AF2122/97
cgccgcggccacca

SEQ ID NO: 1139082 - RNA, 17 nt, Mycobacterium bovis subsp bovis AF2122/97
cgccgcggccaccaccg

SEQ ID NO: 1139083 - RNA, 16 nt, Mycobacterium bovis subsp bovis AF2122/97
cgccgcuacccccgau

SEQ ID NO: 1139084 - RNA, 23 nt, Mycobacterium bovis subsp bovis AF2122/97
cgccgcuacccggacagggcggc

SEQ ID NO: 1139085 - RNA, 18 nt, Mycobacterium bovis subsp bovis AF2122/97
cgccgcuaggugacgccg

SEQ ID NO: 1139086 - RNA, 23 nt, Mycobacterium bovis subsp bovis AF2122/97
cgccgcuaggugacgccgccagc

SEQ ID NO: 1139087 - RNA, 17 nt, Mycobacterium bovis subsp bovis AF2122/97
cgccgcggccacaaccu

SEQ ID NO: 1139088 - RNA, 21 nt, Mycobacterium bovis subsp bovis AF2122/97
cgccgcggacucgggcaggcc

SEQ ID NO: 1139089 - RNA, 20 nt, Mycobacterium bovis subsp bovis AF2122/97
cgccgcuaccgcccgcgcca

SEQ ID NO: 1139090 - RNA, 23 nt, Mycobacterium bovis subsp bovis AF2122/97
cgccgcuaccgcccgcgccaccg

SEQ ID NO: 1139091 - RNA, 14 nt, Mycobacterium bovis subsp bovis AF2122/97
cgccgcuaccgccg

SEQ ID NO: 1139092 - RNA, 16 nt, Mycobacterium bovis subsp bovis AF2122/97
cgccgcuaccgccggg

SEQ ID NO: 1139093 - RNA, 15 nt, Mycobacterium bovis subsp bovis AF2122/97
cgccgcuacgccggc

SEQ ID NO: 1139094 - RNA, 17 nt, Mycobacterium bovis subsp bovis AF2122/97
cgccgcuacgccggccc

SEQ ID NO: 1139095 - RNA, 21 nt, Mycobacterium bovis subsp bovis AF2122/97
cgccgcucccucuacacccgg

SEQ ID NO: 1139096 - RNA, 21 nt, Mycobacterium bovis subsp bovis AF2122/97
cgccgcucauccagcgcgugg

SEQ ID NO: 1139097 - RNA, 16 nt, Mycobacterium bovis subsp bovis AF2122/97
cgccgcugccaucugg

SEQ ID NO: 1139098 - RNA, 22 nt, Mycobacterium bovis subsp bovis AF2122/97
cgccgcugccaucuggguccgu

SEQ ID NO: 1139099 - RNA, 13 nt, Mycobacterium bovis subsp bovis AF2122/97
cgccgcugccgcc

SEQ ID NO: 1139100 - RNA, 19 nt, Mycobacterium bovis subsp bovis AF2122/97
cgccgcugacuccugcggc

SEQ ID NO: 1139101 - RNA, 22 nt, Mycobacterium bovis subsp bovis AF2122/97
cgccgcugacuccugcggcacc

SEQ ID NO: 1139102 - RNA, 14 nt, Mycobacterium bovis subsp bovis AF2122/97
cgccgcugccggug

SEQ ID NO: 1139103 - RNA, 20 nt, Mycobacterium bovis subsp bovis AF2122/97
cgccgcugccgguggcggcg

SEQ ID NO: 1139104 - RNA, 14 nt, Mycobacterium bovis subsp bovis AF2122/97
cgccgcugccgccc

SEQ ID NO: 1139105 - RNA, 17 nt, Mycobacterium bovis subsp bovis AF2122/97
cgccgcugccgccgagc

SEQ ID NO: 1139106 - RNA, 15 nt, Mycobacterium bovis subsp bovis AF2122/97
cgccgcugccgccgg

SEQ ID NO: 1139107 - RNA, 19 nt, Mycobacterium bovis subsp bovis AF2122/97
cgccgcugccgccggugcc

SEQ ID NO: 1139108 - RNA, 22 nt, Mycobacterium bovis subsp bovis AF2122/97
cgccgcugccgccggugccgcc

SEQ ID NO: 1139109 - RNA, 14 nt, Mycobacterium bovis subsp bovis AF2122/97
cgccgcugccgccu

SEQ ID NO: 1139110 - RNA, 20 nt, Mycobacterium bovis subsp bovis AF2122/97
cgccgcuggagaucacgccg

SEQ ID NO: 1139111 - RNA, 17 nt, Mycobacterium bovis subsp bovis AF2122/97
cgccggaacugcgcaac

SEQ ID NO: 1139112 - RNA, 16 nt, Mycobacterium bovis subsp bovis AF2122/97
cgccggaacgagcggc

SEQ ID NO: 1139113 - RNA, 18 nt, Mycobacterium bovis subsp bovis AF2122/97
cgccggaacgagcggccg

SEQ ID NO: 1139114 - RNA, 22 nt, Mycobacterium bovis subsp bovis AF2122/97
cgccggaacgagcggccgcgcg

SEQ ID NO: 1139115 - RNA, 16 nt, Mycobacterium bovis subsp bovis AF2122/97
cgccggaaagcccguc

SEQ ID NO: 1139116 - RNA, 14 nt, Mycobacterium bovis subsp bovis AF2122/97
cgccgcuggccagc

SEQ ID NO: 1139117 - RNA, 15 nt, Mycobacterium bovis subsp bovis AF2122/97
cgccggaucgccacg

SEQ ID NO: 1139118 - RNA, 19 nt, Mycobacterium bovis subsp bovis AF2122/97
cgccggaucgccacggugg

SEQ ID NO: 1139119 - RNA, 19 nt, Mycobacterium bovis subsp bovis AF2122/97
cgccggauccgauccgcac

SEQ ID NO: 1139120 - RNA, 14 nt, Mycobacterium bovis subsp bovis AF2122/97
cgccggaggugaca

SEQ ID NO: 1139121 - RNA, 21 nt, Mycobacterium bovis subsp bovis AF2122/97
cgccggagucgaacaucaccg

SEQ ID NO: 1139122 - RNA, 15 nt, Mycobacterium bovis subsp bovis AF2122/97
cgccggagucgauca

SEQ ID NO: 1139123 - RNA, 17 nt, Mycobacterium bovis subsp bovis AF2122/97
cgccggauagcaccggc

SEQ ID NO: 1139124 - RNA, 18 nt, Mycobacterium bovis subsp bovis AF2122/97
cgccggauagcaccggca

SEQ ID NO: 1139125 - RNA, 18 nt, Mycobacterium bovis subsp bovis AF2122/97
cgccggauagcgcagcuc

SEQ ID NO: 1139126 - RNA, 22 nt, Mycobacterium bovis subsp bovis AF2122/97
cgccggauauggcagugucgug

SEQ ID NO: 1139127 - RNA, 13 nt, Mycobacterium bovis subsp bovis AF2122/97
cgccggaucagga

SEQ ID NO: 1139128 - RNA, 14 nt, Mycobacterium bovis subsp bovis AF2122/97
cgccggaucgccgg

SEQ ID NO: 1139129 - RNA, 20 nt, Mycobacterium bovis subsp bovis AF2122/97
cgccggaauacaccagcgac

SEQ ID NO: 1139130 - RNA, 19 nt, Mycobacterium bovis subsp bovis AF2122/97
cgccggauccgccagaccg

SEQ ID NO: 1139131 - RNA, 13 nt, Mycobacterium bovis subsp bovis AF2122/97
cgccggaucgccg

SEQ ID NO: 1139132 - RNA, 21 nt, Mycobacterium bovis subsp bovis AF2122/97
cgccggaucguucgcgugcca

SEQ ID NO: 1139133 - RNA, 13 nt, Mycobacterium bovis subsp bovis AF2122/97
cgccggaucguug

SEQ ID NO: 1139134 - RNA, 15 nt, Mycobacterium bovis subsp bovis AF2122/97
cgccggaucuugccg

SEQ ID NO: 1139135 - RNA, 17 nt, Mycobacterium bovis subsp bovis AF2122/97
cgccggaugacaccgac

SEQ ID NO: 1139136 - RNA, 23 nt, Mycobacterium bovis subsp bovis AF2122/97
cgccggaugacaccgaccggguc

SEQ ID NO: 1139137 - RNA, 16 nt, Mycobacterium bovis subsp bovis AF2122/97
cgccggacccaccguc

SEQ ID NO: 1139138 - RNA, 18 nt, Mycobacterium bovis subsp bovis AF2122/97
cgccggacccaccgucac

SEQ ID NO: 1139139 - RNA, 13 nt, Mycobacterium bovis subsp bovis AF2122/97
cgccggaggcggc

SEQ ID NO: 1139140 - RNA, 14 nt, Mycobacterium bovis subsp bovis AF2122/97
cgccggaggcggcg

SEQ ID NO: 1139141 - RNA, 18 nt, Mycobacterium bovis subsp bovis AF2122/97
cgccggacagcgcaucca

SEQ ID NO: 1139142 - RNA, 21 nt, Mycobacterium bovis subsp bovis AF2122/97
cgccggaacugcgcaacaccg

SEQ ID NO: 1139143 - RNA, 18 nt, Mycobacterium bovis subsp bovis AF2122/97
cgccggaagcgccggccg

SEQ ID NO: 1139144 - RNA, 22 nt, Mycobacterium bovis subsp bovis AF2122/97
cgccggcaccggggcugcccgc

SEQ ID NO: 1139145 - RNA, 16 nt, Mycobacterium bovis subsp bovis AF2122/97
cgccggcacgcagcca

SEQ ID NO: 1139146 - RNA, 20 nt, Mycobacterium bovis subsp bovis AF2122/97
cgccggauggguggccagca

SEQ ID NO: 1139147 - RNA, 16 nt, Mycobacterium bovis subsp bovis AF2122/97
cgccggcagugggggu

SEQ ID NO: 1139148 - RNA, 23 nt, Mycobacterium bovis subsp bovis AF2122/97
cgccggcagcaucggcaccccgg

SEQ ID NO: 1139149 - RNA, 16 nt, Mycobacterium bovis subsp bovis AF2122/97
cgccggccaugccuuc

SEQ ID NO: 1139150 - RNA, 20 nt, Mycobacterium bovis subsp bovis AF2122/97
cgccggccaugccuucggug

SEQ ID NO: 1139151 - RNA, 15 nt, Mycobacterium bovis subsp bovis AF2122/97
cgccggccaugugca

SEQ ID NO: 1139152 - RNA, 20 nt, Mycobacterium bovis subsp bovis AF2122/97
cgccggccaugugcacggcg

SEQ ID NO: 1139153 - RNA, 20 nt, Mycobacterium bovis subsp bovis AF2122/97
cgccggcccaucuucggacg

SEQ ID NO: 1139154 - RNA, 17 nt, Mycobacterium bovis subsp bovis AF2122/97
cgccggccccaccggua

SEQ ID NO: 1139155 - RNA, 17 nt, Mycobacterium bovis subsp bovis AF2122/97
cgccggccccaccggug

SEQ ID NO: 1139156 - RNA, 13 nt, Mycobacterium bovis subsp bovis AF2122/97
cgccggccccgcc

SEQ ID NO: 1139157 - RNA, 17 nt, Mycobacterium bovis subsp bovis AF2122/97
cgccggccccgccagcg

SEQ ID NO: 1139158 - RNA, 20 nt, Mycobacterium bovis subsp bovis AF2122/97
cgccggccccgccagcgccg

SEQ ID NO: 1139159 - RNA, 17 nt, Mycobacterium bovis subsp bovis AF2122/97
cgccggccccgccgcua

SEQ ID NO: 1139160 - RNA, 16 nt, Mycobacterium bovis subsp bovis AF2122/97
cgccggccccgccggc

SEQ ID NO: 1139161 - RNA, 18 nt, Mycobacterium bovis subsp bovis AF2122/97
cgccggccccgccggccc

SEQ ID NO: 1139162 - RNA, 17 nt, Mycobacterium bovis subsp bovis AF2122/97
cgccggccccgccguca

SEQ ID NO: 1139163 - RNA, 20 nt, Mycobacterium bovis subsp bovis AF2122/97
cgccggccccgccgaugccg

SEQ ID NO: 1139164 - RNA, 21 nt, Mycobacterium bovis subsp bovis AF2122/97
cgccggccccgccgucaccgc

SEQ ID NO: 1139165 - RNA, 12 nt, Mycobacterium bovis subsp bovis AF2122/97
cgccggcccgcg

SEQ ID NO: 1139166 - RNA, 23 nt, Mycobacterium bovis subsp bovis AF2122/97
cgccggccccgccgucaccgccg

SEQ ID NO: 1139167 - RNA, 17 nt, Mycobacterium bovis subsp bovis AF2122/97
cgccggccccgccgucg

SEQ ID NO: 1139168 - RNA, 14 nt, Mycobacterium bovis subsp bovis AF2122/97
cgccggccucgccg

SEQ ID NO: 1139169 - RNA, 15 nt, Mycobacterium bovis subsp bovis AF2122/97
cgccggccucgccga

SEQ ID NO: 1139170 - RNA, 17 nt, Mycobacterium bovis subsp bovis AF2122/97
cgccggccucgccgaag

SEQ ID NO: 1139171 - RNA, 22 nt, Mycobacterium bovis subsp bovis AF2122/97
cgccggccucuggaucacgucg

SEQ ID NO: 1139172 - RNA, 17 nt, Mycobacterium bovis subsp bovis AF2122/97
cgccggccucgccgggg

SEQ ID NO: 1139173 - RNA, 18 nt, Mycobacterium bovis subsp bovis AF2122/97
cgccggccucgccggggc

SEQ ID NO: 1139174 - RNA, 19 nt, Mycobacterium bovis subsp bovis AF2122/97
cgccggccuugugcucgau

SEQ ID NO: 1139175 - RNA, 22 nt, Mycobacterium bovis subsp bovis AF2122/97
cgccggcgaauccgcacagguc

SEQ ID NO: 1139176 - RNA, 20 nt, Mycobacterium bovis subsp bovis AF2122/97
cgccggcgaacugaucguug

SEQ ID NO: 1139177 - RNA, 20 nt, Mycobacterium bovis subsp bovis AF2122/97
cgccggcgaagcgugcgccg

SEQ ID NO: 1139178 - RNA, 14 nt, Mycobacterium bovis subsp bovis AF2122/97
cgccggcgacgggu

SEQ ID NO: 1139179 - RNA, 16 nt, Mycobacterium bovis subsp bovis AF2122/97
cgccggccugcucggc

SEQ ID NO: 1139180 - RNA, 12 nt, Mycobacterium bovis subsp bovis AF2122/97
cgccggcgaccc

SEQ ID NO: 1139181 - RNA, 15 nt, Mycobacterium bovis subsp bovis AF2122/97
cgccggcgacggguc

SEQ ID NO: 1139182 - RNA, 17 nt, Mycobacterium bovis subsp bovis AF2122/97
cgccggcgacgggucgg

SEQ ID NO: 1139183 - RNA, 18 nt, Mycobacterium bovis subsp bovis AF2122/97
cgccggcgcgcaccccgg

SEQ ID NO: 1139184 - RNA, 16 nt, Mycobacterium bovis subsp bovis AF2122/97
cgccggcgcgcagccg

SEQ ID NO: 1139185 - RNA, 16 nt, Mycobacterium bovis subsp bovis AF2122/97
cgccggcgcgccgaug

SEQ ID NO: 1139186 - RNA, 17 nt, Mycobacterium bovis subsp bovis AF2122/97
cgccggcgcgccgauga

SEQ ID NO: 1139187 - RNA, 21 nt, Mycobacterium bovis subsp bovis AF2122/97
cgccggcggaccccucgaccg

SEQ ID NO: 1139188 - RNA, 22 nt, Mycobacterium bovis subsp bovis AF2122/97
cgccggcgcuggcgggcgaucg

SEQ ID NO: 1139189 - RNA, 13 nt, Mycobacterium bovis subsp bovis AF2122/97
aacaccgcggcgc

SEQ ID NO: 1139190 - RNA, 12 nt, Mycobacterium bovis subsp bovis AF2122/97
aacaccgcggug

SEQ ID NO: 1139191 - RNA, 21 nt, Mycobacterium bovis subsp bovis AF2122/97
aacaccgcggugaguucgccg

SEQ ID NO: 1139192 - RNA, 13 nt, Mycobacterium bovis subsp bovis AF2122/97
aacaccgcccgca

SEQ ID NO: 1139193 - RNA, 20 nt, Mycobacterium bovis subsp bovis AF2122/97
aacaccgcccggcccggcuc

SEQ ID NO: 1139194 - RNA, 17 nt, Mycobacterium bovis subsp bovis AF2122/97
aacaccggccaggccgg

SEQ ID NO: 1139195 - RNA, 22 nt, Mycobacterium bovis subsp bovis AF2122/97
aacaccggcuccagcaugggcg

SEQ ID NO: 1139196 - RNA, 14 nt, Mycobacterium bovis subsp bovis AF2122/97
aacaccgucagcgu

SEQ ID NO: 1139197 - RNA, 18 nt, Mycobacterium bovis subsp bovis AF2122/97
cgccgguaggcggccagc

SEQ ID NO: 1139198 - RNA, 19 nt, Mycobacterium bovis subsp bovis AF2122/97
cgccgguaugccgaacggu

SEQ ID NO: 1139199 - RNA, 21 nt, Mycobacterium bovis subsp bovis AF2122/97
cgccggucaggccgccgcggc

SEQ ID NO: 1139200 - RNA, 22 nt, Mycobacterium bovis subsp bovis AF2122/97
cgccggucaggccgccgcggcg

SEQ ID NO: 1139201 - RNA, 22 nt, Mycobacterium bovis subsp bovis AF2122/97
cgccggucagcaauacggcggc

SEQ ID NO: 1139202 - RNA, 14 nt, Mycobacterium bovis subsp bovis AF2122/97
cgccggucauccca

SEQ ID NO: 1139203 - RNA, 17 nt, Mycobacterium bovis subsp bovis AF2122/97
cgccgguccccgccggc

SEQ ID NO: 1139204 - RNA, 16 nt, Mycobacterium bovis subsp bovis AF2122/97
cgccggucaucccaag

SEQ ID NO: 1139205 - RNA, 18 nt, Mycobacterium bovis subsp bovis AF2122/97
cgccggucaucccaagcg

SEQ ID NO: 1139206 - RNA, 16 nt, Mycobacterium bovis subsp bovis AF2122/97
cgccgguccucgucgg

SEQ ID NO: 1139207 - RNA, 22 nt, Mycobacterium bovis subsp bovis AF2122/97
cgccgguccccucggugccacu

SEQ ID NO: 1139208 - RNA, 19 nt, Mycobacterium bovis subsp bovis AF2122/97
cgccgguccucgucggcga

SEQ ID NO: 1139209 - RNA, 13 nt, Mycobacterium bovis subsp bovis AF2122/97
cgccggucgccga

SEQ ID NO: 1139210 - RNA, 14 nt, Mycobacterium bovis subsp bovis AF2122/97
cgccggucgccgac

SEQ ID NO: 1139211 - RNA, 15 nt, Mycobacterium bovis subsp bovis AF2122/97
cgccggucgccgacg

SEQ ID NO: 1139212 - RNA, 13 nt, Mycobacterium bovis subsp bovis AF2122/97
cgccggucgccgg

SEQ ID NO: 1139213 - RNA, 15 nt, Mycobacterium bovis subsp bovis AF2122/97
cgccggucgccggcu

SEQ ID NO: 1139214 - RNA, 15 nt, Mycobacterium bovis subsp bovis AF2122/97
cgccgguuugucgug

SEQ ID NO: 1139215 - RNA, 19 nt, Mycobacterium bovis subsp bovis AF2122/97
cgccggugccgccaucgcc

SEQ ID NO: 1139216 - RNA, 17 nt, Mycobacterium bovis subsp bovis AF2122/97
cgccgguuucgaggcga

SEQ ID NO: 1139217 - RNA, 16 nt, Mycobacterium bovis subsp bovis AF2122/97
cgccggugccaccggc

SEQ ID NO: 1139218 - RNA, 18 nt, Mycobacterium bovis subsp bovis AF2122/97
cgccggugccaccggcug

SEQ ID NO: 1139219 - RNA, 15 nt, Mycobacterium bovis subsp bovis AF2122/97
cgccggugccgcccg

SEQ ID NO: 1139220 - RNA, 16 nt, Mycobacterium bovis subsp bovis AF2122/97
cgccggugccgcccga

SEQ ID NO: 1139221 - RNA, 14 nt, Mycobacterium bovis subsp bovis AF2122/97
cgccggugccgccg

SEQ ID NO: 1139222 - RNA, 22 nt, Mycobacterium bovis subsp bovis AF2122/97
cgccggugccgccgauaccgcc

SEQ ID NO: 1139223 - RNA, 17 nt, Mycobacterium bovis subsp bovis AF2122/97
cgccggugccgccgccu

SEQ ID NO: 1139224 - RNA, 14 nt, Mycobacterium bovis subsp bovis AF2122/97
cgccggugagccgg

SEQ ID NO: 1139225 - RNA, 16 nt, Mycobacterium bovis subsp bovis AF2122/97
cgccggucgccggcug

SEQ ID NO: 1139226 - RNA, 17 nt, Mycobacterium bovis subsp bovis AF2122/97
cgccggugaggcgaccg

SEQ ID NO: 1139227 - RNA, 22 nt, Mycobacterium bovis subsp bovis AF2122/97
cgccggugaggcgaccggacga

SEQ ID NO: 1139228 - RNA, 15 nt, Mycobacterium bovis subsp bovis AF2122/97
cgccggugaucggcg

SEQ ID NO: 1139229 - RNA, 16 nt, Mycobacterium bovis subsp bovis AF2122/97
cgccggugaucggcgg

SEQ ID NO: 1139230 - RNA, 18 nt, Mycobacterium bovis subsp bovis AF2122/97
cgccggugaucggcggca

SEQ ID NO: 1139231 - RNA, 14 nt, Mycobacterium bovis subsp bovis AF2122/97
cgccggugccaccc

SEQ ID NO: 1139232 - RNA, 20 nt, Mycobacterium bovis subsp bovis AF2122/97
cgccggugccacccuugccg

SEQ ID NO: 1139233 - RNA, 23 nt, Mycobacterium bovis subsp bovis AF2122/97
cgccggugccacccuugccgccg

SEQ ID NO: 1139234 - RNA, 15 nt, Mycobacterium bovis subsp bovis AF2122/97
cgccggugccaccga

SEQ ID NO: 1139235 - RNA, 17 nt, Mycobacterium bovis subsp bovis AF2122/97
cgccggugccaccgacg

SEQ ID NO: 1139236 - RNA, 13 nt, Mycobacterium bovis subsp bovis AF2122/97
cgccggugccacc

SEQ ID NO: 1139237 - RNA, 19 nt, Mycobacterium bovis subsp bovis AF2122/97
cgccggugccaccgacgcc

SEQ ID NO: 1139238 - RNA, 15 nt, Mycobacterium bovis subsp bovis AF2122/97
cgccguagaccagca

SEQ ID NO: 1139239 - RNA, 18 nt, Mycobacterium bovis subsp bovis AF2122/97
cgccguagaccagcaggc

SEQ ID NO: 1139240 - RNA, 14 nt, Mycobacterium bovis subsp bovis AF2122/97
cgccguagccgagg

SEQ ID NO: 1139241 - RNA, 20 nt, Mycobacterium bovis subsp bovis AF2122/97
cgccguagccggccggccca

SEQ ID NO: 1139242 - RNA, 15 nt, Mycobacterium bovis subsp bovis AF2122/97
cgccguacagcggcg

SEQ ID NO: 1139243 - RNA, 18 nt, Mycobacterium bovis subsp bovis AF2122/97
cgccguacagcggcggcg

SEQ ID NO: 1139244 - RNA, 18 nt, Mycobacterium bovis subsp bovis AF2122/97
cgccguacaucagcgcga

SEQ ID NO: 1139245 - RNA, 22 nt, Mycobacterium bovis subsp bovis AF2122/97
cgccguaagcaccagccagccu

SEQ ID NO: 1139246 - RNA, 22 nt, Mycobacterium bovis subsp bovis AF2122/97
cgccguacaucagcgcgaacgc

SEQ ID NO: 1139247 - RNA, 14 nt, Mycobacterium bovis subsp bovis AF2122/97
cgccguacaaccac

SEQ ID NO: 1139248 - RNA, 15 nt, Mycobacterium bovis subsp bovis AF2122/97
cgccguaacggucgc

SEQ ID NO: 1139249 - RNA, 21 nt, Mycobacterium bovis subsp bovis AF2122/97
cgccguaacggucgcugucgg

SEQ ID NO: 1139250 - RNA, 19 nt, Mycobacterium bovis subsp bovis AF2122/97
cgccguaagcaccagccag

SEQ ID NO: 1139251 - RNA, 18 nt, Mycobacterium bovis subsp bovis AF2122/97
cgccguaacagccggccg

SEQ ID NO: 1139252 - RNA, 20 nt, Mycobacterium bovis subsp bovis AF2122/97
cgccguaacagccggccgga

SEQ ID NO: 1139253 - RNA, 13 nt, Mycobacterium bovis subsp bovis AF2122/97
cgccguccagucg

SEQ ID NO: 1139254 - RNA, 18 nt, Mycobacterium bovis subsp bovis AF2122/97
cgccguccagucggucgg

SEQ ID NO: 1139255 - RNA, 22 nt, Mycobacterium bovis subsp bovis AF2122/97
cgccguccccgccgucgccacc

SEQ ID NO: 1139256 - RNA, 13 nt, Mycobacterium bovis subsp bovis AF2122/97
cgccguccagcgc

SEQ ID NO: 1139257 - RNA, 18 nt, Mycobacterium bovis subsp bovis AF2122/97
cgccguccccgccgacgc

SEQ ID NO: 1139258 - RNA, 21 nt, Mycobacterium bovis subsp bovis AF2122/97
cgccguccccgccgacgccga

SEQ ID NO: 1139259 - RNA, 14 nt, Mycobacterium bovis subsp bovis AF2122/97
cgccguaucggcgu

SEQ ID NO: 1139260 - RNA, 15 nt, Mycobacterium bovis subsp bovis AF2122/97
cgccguaucggcgug

SEQ ID NO: 1139261 - RNA, 13 nt, Mycobacterium bovis subsp bovis AF2122/97
cgccguaucggcg

SEQ ID NO: 1139262 - RNA, 18 nt, Mycobacterium bovis subsp bovis AF2122/97
cgccgucaucgugcccgc

SEQ ID NO: 1139263 - RNA, 14 nt, Mycobacterium bovis subsp bovis AF2122/97
cgccguccacgccg

SEQ ID NO: 1139264 - RNA, 23 nt, Mycobacterium bovis subsp bovis AF2122/97
cgccguccacgccgacggcaccg

SEQ ID NO: 1139265 - RNA, 14 nt, Mycobacterium bovis subsp bovis AF2122/97
cgccggggccgccg

SEQ ID NO: 1139266 - RNA, 20 nt, Mycobacterium bovis subsp bovis AF2122/97
cgccggggccgccgaugcca

SEQ ID NO: 1139267 - RNA, 16 nt, Mycobacterium bovis subsp bovis AF2122/97
cgccgggggcgccgcc

SEQ ID NO: 1139268 - RNA, 21 nt, Mycobacterium bovis subsp bovis AF2122/97
cgccgggggacgauuccgccc

SEQ ID NO: 1139269 - RNA, 14 nt, Mycobacterium bovis subsp bovis AF2122/97
cgccgggucagccc

SEQ ID NO: 1139270 - RNA, 13 nt, Mycobacterium bovis subsp bovis AF2122/97
cgccgggucacgu

SEQ ID NO: 1139271 - RNA, 15 nt, Mycobacterium bovis subsp bovis AF2122/97
cgccgggugucggug

SEQ ID NO: 1139272 - RNA, 17 nt, Mycobacterium bovis subsp bovis AF2122/97
cgccgggugucgguggu

SEQ ID NO: 1139273 - RNA, 22 nt, Mycobacterium bovis subsp bovis AF2122/97
cgccggguguggcuugacgccc

SEQ ID NO: 1139274 - RNA, 15 nt, Mycobacterium bovis subsp bovis AF2122/97
cgccgggucagcccg

SEQ ID NO: 1139275 - RNA, 18 nt, Mycobacterium bovis subsp bovis AF2122/97
cgccgggucagcccggcg

SEQ ID NO: 1139276 - RNA, 14 nt, Mycobacterium bovis subsp bovis AF2122/97
cgccgggugcgccg

SEQ ID NO: 1139277 - RNA, 16 nt, Mycobacterium bovis subsp bovis AF2122/97
cgccgggugaggcggu

SEQ ID NO: 1139278 - RNA, 21 nt, Mycobacterium bovis subsp bovis AF2122/97
cgccgggugaggcggugacga

SEQ ID NO: 1139279 - RNA, 21 nt, Mycobacterium bovis subsp bovis AF2122/97
cgccgguaacuguccgcccgg

SEQ ID NO: 1139280 - RNA, 15 nt, Mycobacterium bovis subsp bovis AF2122/97
cgccggguucgccgg

SEQ ID NO: 1139281 - RNA, 16 nt, Mycobacterium bovis subsp bovis AF2122/97
cgccgguaggcggcca

SEQ ID NO: 1139282 - RNA, 15 nt, Mycobacterium bovis subsp bovis AF2122/97
cgccggggacgccgc

SEQ ID NO: 1139283 - RNA, 18 nt, Mycobacterium bovis subsp bovis AF2122/97
cgccggggacgccgcggc

SEQ ID NO: 1139284 - RNA, 19 nt, Mycobacterium bovis subsp bovis AF2122/97
cgccggggacgccgcggcg

SEQ ID NO: 1139285 - RNA, 22 nt, Mycobacterium bovis subsp bovis AF2122/97
cgccggggacgccgcggcgccg

SEQ ID NO: 1139286 - RNA, 20 nt, Mycobacterium bovis subsp bovis AF2122/97
cgccgggcuuggccgcgccg

SEQ ID NO: 1139287 - RNA, 18 nt, Mycobacterium bovis subsp bovis AF2122/97
cgccggggaccacgguga

SEQ ID NO: 1139288 - RNA, 22 nt, Mycobacterium bovis subsp bovis AF2122/97
aacacgccggcccggugaugaa

SEQ ID NO: 1139289 - RNA, 17 nt, Mycobacterium bovis subsp bovis AF2122/97
cgccgggcuccacguca

SEQ ID NO: 1139290 - RNA, 22 nt, Mycobacterium bovis subsp bovis AF2122/97
cgccgggcuuacuugaucucgg

SEQ ID NO: 1139291 - RNA, 15 nt, Mycobacterium bovis subsp bovis AF2122/97
cgccgggcggcaucc

SEQ ID NO: 1139292 - RNA, 22 nt, Mycobacterium bovis subsp bovis AF2122/97
cgccgggcggcauccugcacga

SEQ ID NO: 1139293 - RNA, 12 nt, Mycobacterium bovis subsp bovis AF2122/97
cgccgggcggca

SEQ ID NO: 1139294 - RNA, 13 nt, Mycobacterium bovis subsp bovis AF2122/97
cgccgggcguccg

SEQ ID NO: 1139295 - RNA, 15 nt, Mycobacterium bovis subsp bovis AF2122/97
cgccgggcggcgcga

SEQ ID NO: 1139296 - RNA, 16 nt, Mycobacterium bovis subsp bovis AF2122/97
aacaccggugucggcc

SEQ ID NO: 1139297 - RNA, 20 nt, Mycobacterium bovis subsp bovis AF2122/97
aacacgaugcgcggugcgcg

SEQ ID NO: 1139298 - RNA, 12 nt, Mycobacterium bovis subsp bovis AF2122/97
cgcgaccagcgc

SEQ ID NO: 1139299 - RNA, 13 nt, Mycobacterium bovis subsp bovis AF2122/97
cgcgaccagccag

SEQ ID NO: 1139300 - RNA, 14 nt, Mycobacterium bovis subsp bovis AF2122/97
cgcgaccaucgcga

SEQ ID NO: 1139301 - RNA, 16 nt, Mycobacterium bovis subsp bovis AF2122/97
cgcgaccaucucgacg

SEQ ID NO: 1139302 - RNA, 15 nt, Mycobacterium bovis subsp bovis AF2122/97
cgcgaccgaccagcc

SEQ ID NO: 1139303 - RNA, 22 nt, Mycobacterium bovis subsp bovis AF2122/97
cgcgaccgccucgccguagagc

SEQ ID NO: 1139304 - RNA, 22 nt, Mycobacterium bovis subsp bovis AF2122/97
cgcgaccgaccagccguggugg

SEQ ID NO: 1139305 - RNA, 19 nt, Mycobacterium bovis subsp bovis AF2122/97
cgcgaccgaccgcauggug

SEQ ID NO: 1139306 - RNA, 21 nt, Mycobacterium bovis subsp bovis AF2122/97
cgcgaccgaugaucgguaccg

SEQ ID NO: 1139307 - RNA, 13 nt, Mycobacterium bovis subsp bovis AF2122/97
cgcgaccacgcac

SEQ ID NO: 1139308 - RNA, 22 nt, Mycobacterium bovis subsp bovis AF2122/97
cgcgaccaaaccgcuguaaccg

SEQ ID NO: 1139309 - RNA, 19 nt, Mycobacterium bovis subsp bovis AF2122/97
cgcgaccaaugcguugacg

SEQ ID NO: 1139310 - RNA, 17 nt, Mycobacterium bovis subsp bovis AF2122/97
cgcgaccacccgccgca

SEQ ID NO: 1139311 - RNA, 15 nt, Mycobacterium bovis subsp bovis AF2122/97
cgcgacagccaccuc

SEQ ID NO: 1139312 - RNA, 16 nt, Mycobacterium bovis subsp bovis AF2122/97
cgcgacagccaccucg

SEQ ID NO: 1139313 - RNA, 13 nt, Mycobacterium bovis subsp bovis AF2122/97
cgcgacaucaccg

SEQ ID NO: 1139314 - RNA, 13 nt, Mycobacterium bovis subsp bovis AF2122/97
cgcgaagccgcca

SEQ ID NO: 1139315 - RNA, 17 nt, Mycobacterium bovis subsp bovis AF2122/97
cgcgaagccaccagguc

SEQ ID NO: 1139316 - RNA, 17 nt, Mycobacterium bovis subsp bovis AF2122/97
cgcgaagcgcucggcag

SEQ ID NO: 1139317 - RNA, 19 nt, Mycobacterium bovis subsp bovis AF2122/97
cgcgaagcggaccgagccg

SEQ ID NO: 1139318 - RNA, 22 nt, Mycobacterium bovis subsp bovis AF2122/97
cgcgaagaacgacgccaccgcg

SEQ ID NO: 1139319 - RNA, 20 nt, Mycobacterium bovis subsp bovis AF2122/97
cgcgaacucaugcccgacga

SEQ ID NO: 1139320 - RNA, 23 nt, Mycobacterium bovis subsp bovis AF2122/97
cgcgaacuccagcagcccggugg

SEQ ID NO: 1139321 - RNA, 22 nt, Mycobacterium bovis subsp bovis AF2122/97
cgcgaaggggugcccggcggcc

SEQ ID NO: 1139322 - RNA, 14 nt, Mycobacterium bovis subsp bovis AF2122/97
cgcgaagugcuugg

SEQ ID NO: 1139323 - RNA, 20 nt, Mycobacterium bovis subsp bovis AF2122/97
cgcgaauauagcggcguucc

SEQ ID NO: 1139324 - RNA, 16 nt, Mycobacterium bovis subsp bovis AF2122/97
cgcgaagucuugaccg

SEQ ID NO: 1139325 - RNA, 17 nt, Mycobacterium bovis subsp bovis AF2122/97
cgcgacaaaucggucga

SEQ ID NO: 1139326 - RNA, 18 nt, Mycobacterium bovis subsp bovis AF2122/97
cgcgacaauggugcccag

SEQ ID NO: 1139327 - RNA, 19 nt, Mycobacterium bovis subsp bovis AF2122/97
cgcgacaaaucggucgacg

SEQ ID NO: 1139328 - RNA, 21 nt, Mycobacterium bovis subsp bovis AF2122/97
cgcgacaacaacucuucggcg

SEQ ID NO: 1139329 - RNA, 22 nt, Mycobacterium bovis subsp bovis AF2122/97
cgcgacaacaacucuucggcgg

SEQ ID NO: 1139330 - RNA, 16 nt, Mycobacterium bovis subsp bovis AF2122/97
cgcgacaacccggcgu

SEQ ID NO: 1139331 - RNA, 21 nt, Mycobacterium bovis subsp bovis AF2122/97
cgcgacaacccggcgucgacg

SEQ ID NO: 1139332 - RNA, 18 nt, Mycobacterium bovis subsp bovis AF2122/97
cgcgacagccguggcgcg

SEQ ID NO: 1139333 - RNA, 21 nt, Mycobacterium bovis subsp bovis AF2122/97
cgcgacagccguggcgcgacg

SEQ ID NO: 1139334 - RNA, 22 nt, Mycobacterium bovis subsp bovis AF2122/97
cgcgacagccguggcgcgacgu

SEQ ID NO: 1139335 - RNA, 15 nt, Mycobacterium bovis subsp bovis AF2122/97
cgcgacagacagcac

SEQ ID NO: 1139336 - RNA, 17 nt, Mycobacterium bovis subsp bovis AF2122/97
cgcgacacgccgauucg

SEQ ID NO: 1139337 - RNA, 20 nt, Mycobacterium bovis subsp bovis AF2122/97
cgcgaaugaagcccucgucg

SEQ ID NO: 1139338 - RNA, 21 nt, Mycobacterium bovis subsp bovis AF2122/97
cgcgaauauucgcugggcgca

SEQ ID NO: 1139339 - RNA, 14 nt, Mycobacterium bovis subsp bovis AF2122/97
cgcgaaugucgcgc

SEQ ID NO: 1139340 - RNA, 15 nt, Mycobacterium bovis subsp bovis AF2122/97
cgcgaauguccggca

SEQ ID NO: 1139341 - RNA, 17 nt, Mycobacterium bovis subsp bovis AF2122/97
cgcgaaucgcgucgagc

SEQ ID NO: 1139342 - RNA, 18 nt, Mycobacterium bovis subsp bovis AF2122/97
cgcgaaucgcgucgagcg

SEQ ID NO: 1139343 - RNA, 19 nt, Mycobacterium bovis subsp bovis AF2122/97
cgcgaaugcugugccgaga

SEQ ID NO: 1139344 - RNA, 23 nt, Mycobacterium bovis subsp bovis AF2122/97
cgcgaauggcggacagggcggca

SEQ ID NO: 1139345 - RNA, 23 nt, Mycobacterium bovis subsp bovis AF2122/97
cgcgaaauauuggcccgucacgc

SEQ ID NO: 1139346 - RNA, 16 nt, Mycobacterium bovis subsp bovis AF2122/97
cgcgaaagaacaucuc

SEQ ID NO: 1139347 - RNA, 22 nt, Mycobacterium bovis subsp bovis AF2122/97
cgccuuguggcacacccgcacc

SEQ ID NO: 1139348 - RNA, 20 nt, Mycobacterium bovis subsp bovis AF2122/97
cgccuuugccgccggcaccg

SEQ ID NO: 1139349 - RNA, 18 nt, Mycobacterium bovis subsp bovis AF2122/97
cgcgaaaauucgucgcgu

SEQ ID NO: 1139350 - RNA, 20 nt, Mycobacterium bovis subsp bovis AF2122/97
cgcgaaaauucgucgcgucg

SEQ ID NO: 1139351 - RNA, 20 nt, Mycobacterium bovis subsp bovis AF2122/97
cgcgaaaccguggguucacg

SEQ ID NO: 1139352 - RNA, 15 nt, Mycobacterium bovis subsp bovis AF2122/97
cgcgaaacgccgcaa

SEQ ID NO: 1139353 - RNA, 14 nt, Mycobacterium bovis subsp bovis AF2122/97
cgcgaacgggucgg

SEQ ID NO: 1139354 - RNA, 19 nt, Mycobacterium bovis subsp bovis AF2122/97
cgcgaaccugcucggcgcg

SEQ ID NO: 1139355 - RNA, 17 nt, Mycobacterium bovis subsp bovis AF2122/97
cgcgaacgaagucgacg

SEQ ID NO: 1139356 - RNA, 18 nt, Mycobacterium bovis subsp bovis AF2122/97
cgcgaacgaagucgacga

SEQ ID NO: 1139357 - RNA, 15 nt, Mycobacterium bovis subsp bovis AF2122/97
cgcgaacgauuucgg

SEQ ID NO: 1139358 - RNA, 18 nt, Mycobacterium bovis subsp bovis AF2122/97
cgcgaaccggccaucgac

SEQ ID NO: 1139359 - RNA, 15 nt, Mycobacterium bovis subsp bovis AF2122/97
cgcgaaccgucucgg

SEQ ID NO: 1139360 - RNA, 15 nt, Mycobacterium bovis subsp bovis AF2122/97
cgcgaaccgcggauc

SEQ ID NO: 1139361 - RNA, 20 nt, Mycobacterium bovis subsp bovis AF2122/97
cgcgaaccgcggaucgaccg

SEQ ID NO: 1139362 - RNA, 16 nt, Mycobacterium bovis subsp bovis AF2122/97
cgcgaaagcgccgaaa

SEQ ID NO: 1139363 - RNA, 20 nt, Mycobacterium bovis subsp bovis AF2122/97
cgcgaacccgaucgucgagc

SEQ ID NO: 1139364 - RNA, 15 nt, Mycobacterium bovis subsp bovis AF2122/97
cgcgaacaucgccag

SEQ ID NO: 1139365 - RNA, 13 nt, Mycobacterium bovis subsp bovis AF2122/97
cgccuucgccacg

SEQ ID NO: 1139366 - RNA, 17 nt, Mycobacterium bovis subsp bovis AF2122/97
cgccuucgccacguucg

SEQ ID NO: 1139367 - RNA, 13 nt, Mycobacterium bovis subsp bovis AF2122/97
cgccuucgccagc

SEQ ID NO: 1139368 - RNA, 14 nt, Mycobacterium bovis subsp bovis AF2122/97
cgccuucgccagcg

SEQ ID NO: 1139369 - RNA, 17 nt, Mycobacterium bovis subsp bovis AF2122/97
cgccuucgccagcggcg

SEQ ID NO: 1139370 - RNA, 13 nt, Mycobacterium bovis subsp bovis AF2122/97
cgccuugagccga

SEQ ID NO: 1139371 - RNA, 19 nt, Mycobacterium bovis subsp bovis AF2122/97
cgccuugaggcccugcggc

SEQ ID NO: 1139372 - RNA, 14 nt, Mycobacterium bovis subsp bovis AF2122/97
cgccuugaucggcg

SEQ ID NO: 1139373 - RNA, 16 nt, Mycobacterium bovis subsp bovis AF2122/97
cgccuugaagcggugg

SEQ ID NO: 1139374 - RNA, 18 nt, Mycobacterium bovis subsp bovis AF2122/97
cgccuucuuggcaggugc

SEQ ID NO: 1139375 - RNA, 20 nt, Mycobacterium bovis subsp bovis AF2122/97
cgccuucuuggcaggugccu

SEQ ID NO: 1139376 - RNA, 19 nt, Mycobacterium bovis subsp bovis AF2122/97
cgccuucuucucggcgagc

SEQ ID NO: 1139377 - RNA, 17 nt, Mycobacterium bovis subsp bovis AF2122/97
cgccuugaucggcgagg

SEQ ID NO: 1139378 - RNA, 22 nt, Mycobacterium bovis subsp bovis AF2122/97
cgccuugauggucuccaccagg

SEQ ID NO: 1139379 - RNA, 15 nt, Mycobacterium bovis subsp bovis AF2122/97
cgccuugaucggcga

SEQ ID NO: 1139380 - RNA, 17 nt, Mycobacterium bovis subsp bovis AF2122/97
cgccuugcccagcgaca

SEQ ID NO: 1139381 - RNA, 13 nt, Mycobacterium bovis subsp bovis AF2122/97
cgccuuggucgcc

SEQ ID NO: 1139382 - RNA, 12 nt, Mycobacterium bovis subsp bovis AF2122/97
cgccuuggcccc

SEQ ID NO: 1139383 - RNA, 23 nt, Mycobacterium bovis subsp bovis AF2122/97
cgccuuggccaccaucgccgccg

SEQ ID NO: 1139384 - RNA, 14 nt, Mycobacterium bovis subsp bovis AF2122/97
cgccuuggccacca

SEQ ID NO: 1139385 - RNA, 14 nt, Mycobacterium bovis subsp bovis AF2122/97
cgccuugucggcga

SEQ ID NO: 1139386 - RNA, 19 nt, Mycobacterium bovis subsp bovis AF2122/97
cgccuuguggcacacccgc

SEQ ID NO: 1139387 - RNA, 15 nt, Mycobacterium bovis subsp bovis AF2122/97
cgccuuggucgccgc

SEQ ID NO: 1139388 - RNA, 18 nt, Mycobacterium bovis subsp bovis AF2122/97
cgccuuggucgccggcgu

SEQ ID NO: 1139389 - RNA, 17 nt, Mycobacterium bovis subsp bovis AF2122/97
cgccuuggucgcgucgg

SEQ ID NO: 1139390 - RNA, 14 nt, Mycobacterium bovis subsp bovis AF2122/97
cgccgucgccaccg

SEQ ID NO: 1139391 - RNA, 22 nt, Mycobacterium bovis subsp bovis AF2122/97
cgccgucgaugaccagcacacc

SEQ ID NO: 1139392 - RNA, 14 nt, Mycobacterium bovis subsp bovis AF2122/97
cgccgucgcagcca

SEQ ID NO: 1139393 - RNA, 17 nt, Mycobacterium bovis subsp bovis AF2122/97
cgccgucgcagccagcu

SEQ ID NO: 1139394 - RNA, 20 nt, Mycobacterium bovis subsp bovis AF2122/97
cgccgucgccaccgguaccg

SEQ ID NO: 1139395 - RNA, 13 nt, Mycobacterium bovis subsp bovis AF2122/97
cgccgucgccacc

SEQ ID NO: 1139396 - RNA, 14 nt, Mycobacterium bovis subsp bovis AF2122/97
cgccgucgccacgc

SEQ ID NO: 1139397 - RNA, 19 nt, Mycobacterium bovis subsp bovis AF2122/97
cgccgucgccacgcccagc

SEQ ID NO: 1139398 - RNA, 16 nt, Mycobacterium bovis subsp bovis AF2122/97
cgccgucgccggugcc

SEQ ID NO: 1139399 - RNA, 14 nt, Mycobacterium bovis subsp bovis AF2122/97
cgccgucgccgcca

SEQ ID NO: 1139400 - RNA, 15 nt, Mycobacterium bovis subsp bovis AF2122/97
cgccgucgccgccgc

SEQ ID NO: 1139401 - RNA, 17 nt, Mycobacterium bovis subsp bovis AF2122/97
cgccgucgccgccggcg

SEQ ID NO: 1139402 - RNA, 22 nt, Mycobacterium bovis subsp bovis AF2122/97
cgccgucgccgccggcgccgcc

SEQ ID NO: 1139403 - RNA, 15 nt, Mycobacterium bovis subsp bovis AF2122/97
cgccgucgcggcacg

SEQ ID NO: 1139404 - RNA, 15 nt, Mycobacterium bovis subsp bovis AF2122/97
cgccuccagccggcg

SEQ ID NO: 1139405 - RNA, 16 nt, Mycobacterium bovis subsp bovis AF2122/97
cgccuccagccggcga

SEQ ID NO: 1139406 - RNA, 18 nt, Mycobacterium bovis subsp bovis AF2122/97
cgccuccacucuucgggc

SEQ ID NO: 1139407 - RNA, 13 nt, Mycobacterium bovis subsp bovis AF2122/97
cgccuccucgauc

SEQ ID NO: 1139408 - RNA, 16 nt, Mycobacterium bovis subsp bovis AF2122/97
cgccuccugccgccgc

SEQ ID NO: 1139409 - RNA, 13 nt, Mycobacterium bovis subsp bovis AF2122/97
cgccuccucgacg

SEQ ID NO: 1139410 - RNA, 16 nt, Mycobacterium bovis subsp bovis AF2122/97
cgccuccucgacgucg

SEQ ID NO: 1139411 - RNA, 17 nt, Mycobacterium bovis subsp bovis AF2122/97
cgccuccucgacgucgg

SEQ ID NO: 1139412 - RNA, 18 nt, Mycobacterium bovis subsp bovis AF2122/97
cgccuccucgacgucggc

SEQ ID NO: 1139413 - RNA, 22 nt, Mycobacterium bovis subsp bovis AF2122/97
cgccuccucgacgucggcgagc

SEQ ID NO: 1139414 - RNA, 13 nt, Mycobacterium bovis subsp bovis AF2122/97
cgccuccucgaua

SEQ ID NO: 1139415 - RNA, 16 nt, Mycobacterium bovis subsp bovis AF2122/97
cgccuccgccgaggcc

SEQ ID NO: 1139416 - RNA, 19 nt, Mycobacterium bovis subsp bovis AF2122/97
cgccuccgccgaggccgcc

SEQ ID NO: 1139417 - RNA, 14 nt, Mycobacterium bovis subsp bovis AF2122/97
cgccuccggcaccu

SEQ ID NO: 1139418 - RNA, 15 nt, Mycobacterium bovis subsp bovis AF2122/97
cgccucgaccgccag

SEQ ID NO: 1139419 - RNA, 22 nt, Mycobacterium bovis subsp bovis AF2122/97
cgccuccucgugcaggaccagc

SEQ ID NO: 1139420 - RNA, 14 nt, Mycobacterium bovis subsp bovis AF2122/97
cgccucgagcaacg

SEQ ID NO: 1139421 - RNA, 19 nt, Mycobacterium bovis subsp bovis AF2122/97
cgccucgagcaacggacga

SEQ ID NO: 1139422 - RNA, 17 nt, Mycobacterium bovis subsp bovis AF2122/97
cgccucggcguaggcga

SEQ ID NO: 1139423 - RNA, 16 nt, Mycobacterium bovis subsp bovis AF2122/97
cgccugcacgcccggc

SEQ ID NO: 1139424 - RNA, 17 nt, Mycobacterium bovis subsp bovis AF2122/97
cgccugcaccgccgccg

SEQ ID NO: 1139425 - RNA, 21 nt, Mycobacterium bovis subsp bovis AF2122/97
cgccugcaccgccgccgcccg

SEQ ID NO: 1139426 - RNA, 21 nt, Mycobacterium bovis subsp bovis AF2122/97
cgccugcaagcuaagcgccug

SEQ ID NO: 1139427 - RNA, 14 nt, Mycobacterium bovis subsp bovis AF2122/97
cgccugcaccgccg

SEQ ID NO: 1139428 - RNA, 16 nt, Mycobacterium bovis subsp bovis AF2122/97
cgccugccgcuggucg

SEQ ID NO: 1139429 - RNA, 16 nt, Mycobacterium bovis subsp bovis AF2122/97
cgccugcccggcccgc

SEQ ID NO: 1139430 - RNA, 23 nt, Mycobacterium bovis subsp bovis AF2122/97
cgccugcccggcccgcucagccg

SEQ ID NO: 1139431 - RNA, 22 nt, Mycobacterium bovis subsp bovis AF2122/97
cgccugccgaaacgccgaccgc

SEQ ID NO: 1139432 - RNA, 13 nt, Mycobacterium bovis subsp bovis AF2122/97
cgccugccgacga

SEQ ID NO: 1139433 - RNA, 19 nt, Mycobacterium bovis subsp bovis AF2122/97
cgccugcgacagcacgugc

SEQ ID NO: 1139434 - RNA, 20 nt, Mycobacterium bovis subsp bovis AF2122/97
cgccugcgacagcacgugcc

SEQ ID NO: 1139435 - RNA, 17 nt, Mycobacterium bovis subsp bovis AF2122/97
cgccugccucaccgccg

SEQ ID NO: 1139436 - RNA, 15 nt, Mycobacterium bovis subsp bovis AF2122/97
cgccugcgccacccg

SEQ ID NO: 1139437 - RNA, 22 nt, Mycobacterium bovis subsp bovis AF2122/97
cgccucgggccggcguagcggc

SEQ ID NO: 1139438 - RNA, 22 nt, Mycobacterium bovis subsp bovis AF2122/97
cgccucgggaggcagcgcgagg

SEQ ID NO: 1139439 - RNA, 13 nt, Mycobacterium bovis subsp bovis AF2122/97
cgccucgggccgg

SEQ ID NO: 1139440 - RNA, 16 nt, Mycobacterium bovis subsp bovis AF2122/97
cgccucguacggaccg

SEQ ID NO: 1139441 - RNA, 16 nt, Mycobacterium bovis subsp bovis AF2122/97
cgccugauaggccuga

SEQ ID NO: 1139442 - RNA, 22 nt, Mycobacterium bovis subsp bovis AF2122/97
cgccugauaugacuugcgcgcg

SEQ ID NO: 1139443 - RNA, 15 nt, Mycobacterium bovis subsp bovis AF2122/97
cgccugaugcggccg

SEQ ID NO: 1139444 - RNA, 14 nt, Mycobacterium bovis subsp bovis AF2122/97
cgccugagccacca

SEQ ID NO: 1139445 - RNA, 13 nt, Mycobacterium bovis subsp bovis AF2122/97
cgccucgucgaug

SEQ ID NO: 1139446 - RNA, 19 nt, Mycobacterium bovis subsp bovis AF2122/97
cgccugagccaccaacacc

SEQ ID NO: 1139447 - RNA, 19 nt, Mycobacterium bovis subsp bovis AF2122/97
cgccugagcgccgcggcgg

SEQ ID NO: 1139448 - RNA, 17 nt, Mycobacterium bovis subsp bovis AF2122/97
cgccugugcgcggugac

SEQ ID NO: 1139449 - RNA, 19 nt, Mycobacterium bovis subsp bovis AF2122/97
cgccuguucgggagcugau

SEQ ID NO: 1139450 - RNA, 14 nt, Mycobacterium bovis subsp bovis AF2122/97
cgccugugccgccg

SEQ ID NO: 1139451 - RNA, 20 nt, Mycobacterium bovis subsp bovis AF2122/97
cgccugugccgccggcgcca

SEQ ID NO: 1139452 - RNA, 13 nt, Mycobacterium bovis subsp bovis AF2122/97
cgccugugccacc

SEQ ID NO: 1139453 - RNA, 12 nt, Mycobacterium bovis subsp bovis AF2122/97
cgccugucgggc

SEQ ID NO: 1139454 - RNA, 15 nt, Mycobacterium bovis subsp bovis AF2122/97
cgccugucccgccgg

SEQ ID NO: 1139455 - RNA, 19 nt, Mycobacterium bovis subsp bovis AF2122/97
cgccugucccgccggcccc

SEQ ID NO: 1139456 - RNA, 19 nt, Mycobacterium bovis subsp bovis AF2122/97
cgccuggguugaccgccac

SEQ ID NO: 1139457 - RNA, 17 nt, Mycobacterium bovis subsp bovis AF2122/97
cgccugguaccgcggug

SEQ ID NO: 1139458 - RNA, 16 nt, Mycobacterium bovis subsp bovis AF2122/97
cgccuguacggcggcu

SEQ ID NO: 1139459 - RNA, 14 nt, Mycobacterium bovis subsp bovis AF2122/97
cgccuggucaccga

SEQ ID NO: 1139460 - RNA, 22 nt, Mycobacterium bovis subsp bovis AF2122/97
cgccugugccaccgcuggaucg

SEQ ID NO: 1139461 - RNA, 21 nt, Mycobacterium bovis subsp bovis AF2122/97
cgccuucaccuggugugcggg

SEQ ID NO: 1139462 - RNA, 23 nt, Mycobacterium bovis subsp bovis AF2122/97
cgccuuccaggcgggcggcaccg

SEQ ID NO: 1139463 - RNA, 17 nt, Mycobacterium bovis subsp bovis AF2122/97
cgccuggccggaauacc

SEQ ID NO: 1139464 - RNA, 22 nt, Mycobacterium bovis subsp bovis AF2122/97
cgccugggcggccagcacgucg

SEQ ID NO: 1139465 - RNA, 16 nt, Mycobacterium bovis subsp bovis AF2122/97
cgccuggcuggccagc

SEQ ID NO: 1139466 - RNA, 23 nt, Mycobacterium bovis subsp bovis AF2122/97
cgccuggcuugucauccccgacu

SEQ ID NO: 1139467 - RNA, 14 nt, Mycobacterium bovis subsp bovis AF2122/97
cgccuggcggcgcc

SEQ ID NO: 1139468 - RNA, 17 nt, Mycobacterium bovis subsp bovis AF2122/97
cgccuggcggcgccgca

SEQ ID NO: 1139469 - RNA, 18 nt, Mycobacterium bovis subsp bovis AF2122/97
cgccuggacgccgccgga

SEQ ID NO: 1139470 - RNA, 14 nt, Mycobacterium bovis subsp bovis AF2122/97
cgccuggaucagcg

SEQ ID NO: 1139471 - RNA, 21 nt, Mycobacterium bovis subsp bovis AF2122/97
cgccuggaucagcgcguugag

SEQ ID NO: 1139472 - RNA, 14 nt, Mycobacterium bovis subsp bovis AF2122/97
cgccuggacgccgc

SEQ ID NO: 1139473 - RNA, 20 nt, Mycobacterium bovis subsp bovis AF2122/97
cgccugcuggccgcggcugg

SEQ ID NO: 1139474 - RNA, 21 nt, Mycobacterium bovis subsp bovis AF2122/97
cgccugcgccuugaagcggug

SEQ ID NO: 1139475 - RNA, 14 nt, Mycobacterium bovis subsp bovis AF2122/97
cgccugcgccgcca

SEQ ID NO: 1139476 - RNA, 15 nt, Mycobacterium bovis subsp bovis AF2122/97
cgccugcgccgccag

SEQ ID NO: 1139477 - RNA, 14 nt, Mycobacterium bovis subsp bovis AF2122/97
cgccugcgccgccc

SEQ ID NO: 1139478 - RNA, 15 nt, Mycobacterium bovis subsp bovis AF2122/97
cgccugcgccgcccg

SEQ ID NO: 1139479 - RNA, 22 nt, Mycobacterium bovis subsp bovis AF2122/97
cgcgcagcaguuggucgcgguc

SEQ ID NO: 1139480 - RNA, 12 nt, Mycobacterium bovis subsp bovis AF2122/97
cgcgcagcagug

SEQ ID NO: 1139481 - RNA, 13 nt, Mycobacterium bovis subsp bovis AF2122/97
cgcgcagcugacg

SEQ ID NO: 1139482 - RNA, 14 nt, Mycobacterium bovis subsp bovis AF2122/97
cgcgcaggccgccg

SEQ ID NO: 1139483 - RNA, 13 nt, Mycobacterium bovis subsp bovis AF2122/97
cgcgcaggccgcc

SEQ ID NO: 1139484 - RNA, 14 nt, Mycobacterium bovis subsp bovis AF2122/97
cgcgcagcaccggc

SEQ ID NO: 1139485 - RNA, 20 nt, Mycobacterium bovis subsp bovis AF2122/97
cgcgcagcaccggcucgacu

SEQ ID NO: 1139486 - RNA, 13 nt, Mycobacterium bovis subsp bovis AF2122/97
cgcgcagcacugc

SEQ ID NO: 1139487 - RNA, 15 nt, Mycobacterium bovis subsp bovis AF2122/97
cgcgcagcacugcgg

SEQ ID NO: 1139488 - RNA, 21 nt, Mycobacterium bovis subsp bovis AF2122/97
cgcgcagaacgaucgcgcugg

SEQ ID NO: 1139489 - RNA, 21 nt, Mycobacterium bovis subsp bovis AF2122/97
cgcgcagacucgccaccgcgg

SEQ ID NO: 1139490 - RNA, 16 nt, Mycobacterium bovis subsp bovis AF2122/97
cgcgcagauacgcgug

SEQ ID NO: 1139491 - RNA, 18 nt, Mycobacterium bovis subsp bovis AF2122/97
cgcgcagaucguccaccg

SEQ ID NO: 1139492 - RNA, 21 nt, Mycobacterium bovis subsp bovis AF2122/97
cgcgcagaucguccaccgccg

SEQ ID NO: 1139493 - RNA, 20 nt, Mycobacterium bovis subsp bovis AF2122/97
cgcgcagauauuccucgucg

SEQ ID NO: 1139494 - RNA, 19 nt, Mycobacterium bovis subsp bovis AF2122/97
cgcgcagauacgcgugugg

SEQ ID NO: 1139495 - RNA, 15 nt, Mycobacterium bovis subsp bovis AF2122/97
cgcgcaggccgccgc

SEQ ID NO: 1139496 - RNA, 16 nt, Mycobacterium bovis subsp bovis AF2122/97
cgcgcaguuuggcggc

SEQ ID NO: 1139497 - RNA, 17 nt, Mycobacterium bovis subsp bovis AF2122/97
cgcgcaguuuggcggcg

SEQ ID NO: 1139498 - RNA, 14 nt, Mycobacterium bovis subsp bovis AF2122/97
cgcgcauauccgca

SEQ ID NO: 1139499 - RNA, 17 nt, Mycobacterium bovis subsp bovis AF2122/97
cgcgcauauccgcaggc

SEQ ID NO: 1139500 - RNA, 18 nt, Mycobacterium bovis subsp bovis AF2122/97
cgcgccaucgucgcgccg

SEQ ID NO: 1139501 - RNA, 14 nt, Mycobacterium bovis subsp bovis AF2122/97
cgcgccaucgucgc

SEQ ID NO: 1139502 - RNA, 13 nt, Mycobacterium bovis subsp bovis AF2122/97
cgcgccgcggccc

SEQ ID NO: 1139503 - RNA, 14 nt, Mycobacterium bovis subsp bovis AF2122/97
cgcgccgcggcccg

SEQ ID NO: 1139504 - RNA, 16 nt, Mycobacterium bovis subsp bovis AF2122/97
cgcgccgcgcucgccg

SEQ ID NO: 1139505 - RNA, 18 nt, Mycobacterium bovis subsp bovis AF2122/97
cgcgccggccgcacgccg

SEQ ID NO: 1139506 - RNA, 22 nt, Mycobacterium bovis subsp bovis AF2122/97
cgcgccggccgcacgccggcca

SEQ ID NO: 1139507 - RNA, 13 nt, Mycobacterium bovis subsp bovis AF2122/97
cgcgccggccgca

SEQ ID NO: 1139508 - RNA, 13 nt, Mycobacterium bovis subsp bovis AF2122/97
cgcgccggccgcu

SEQ ID NO: 1139509 - RNA, 12 nt, Mycobacterium bovis subsp bovis AF2122/97
cgcgccggcgac

SEQ ID NO: 1139510 - RNA, 22 nt, Mycobacterium bovis subsp bovis AF2122/97
cgcgccggcggaagcggcggcc

SEQ ID NO: 1139511 - RNA, 14 nt, Mycobacterium bovis subsp bovis AF2122/97
cgcgccggcgaccc

SEQ ID NO: 1139512 - RNA, 14 nt, Mycobacterium bovis subsp bovis AF2122/97
cgcgccgaucacca

SEQ ID NO: 1139513 - RNA, 17 nt, Mycobacterium bovis subsp bovis AF2122/97
cgcgccgauuccaccgc

SEQ ID NO: 1139514 - RNA, 18 nt, Mycobacterium bovis subsp bovis AF2122/97
cgcgccgauuccaccgcc

SEQ ID NO: 1139515 - RNA, 14 nt, Mycobacterium bovis subsp bovis AF2122/97
cgcgccgcacacgu

SEQ ID NO: 1139516 - RNA, 19 nt, Mycobacterium bovis subsp bovis AF2122/97
cgcgccgauuccaccgccg

SEQ ID NO: 1139517 - RNA, 23 nt, Mycobacterium bovis subsp bovis AF2122/97
cgcgccgauuccaccgccgacgc

SEQ ID NO: 1139518 - RNA, 23 nt, Mycobacterium bovis subsp bovis AF2122/97
cgcgccgcacauugguguccacc

SEQ ID NO: 1139519 - RNA, 19 nt, Mycobacterium bovis subsp bovis AF2122/97
cgcgccgcaccaucggcga

SEQ ID NO: 1139520 - RNA, 16 nt, Mycobacterium bovis subsp bovis AF2122/97
cgcgccgcacccggga

SEQ ID NO: 1139521 - RNA, 19 nt, Mycobacterium bovis subsp bovis AF2122/97
cgcgccgcagagcaccgcg

SEQ ID NO: 1139522 - RNA, 18 nt, Mycobacterium bovis subsp bovis AF2122/97
cgcgccgcgcaucgcggc

SEQ ID NO: 1139523 - RNA, 15 nt, Mycobacterium bovis subsp bovis AF2122/97
cgcgccgcauccagc

SEQ ID NO: 1139524 - RNA, 20 nt, Mycobacterium bovis subsp bovis AF2122/97
cgcgccgcgaggcaccgaca

SEQ ID NO: 1139525 - RNA, 15 nt, Mycobacterium bovis subsp bovis AF2122/97
cgcgccgccucgggc

SEQ ID NO: 1139526 - RNA, 15 nt, Mycobacterium bovis subsp bovis AF2122/97
cgcgcccgagccggu

SEQ ID NO: 1139527 - RNA, 14 nt, Mycobacterium bovis subsp bovis AF2122/97
cgcgcccgcaccac

SEQ ID NO: 1139528 - RNA, 22 nt, Mycobacterium bovis subsp bovis AF2122/97
cgcgcccgccaucagcccggcg

SEQ ID NO: 1139529 - RNA, 15 nt, Mycobacterium bovis subsp bovis AF2122/97
cgcgcccgcaccacc

SEQ ID NO: 1139530 - RNA, 16 nt, Mycobacterium bovis subsp bovis AF2122/97
cgcgcccgcaccaccg

SEQ ID NO: 1139531 - RNA, 15 nt, Mycobacterium bovis subsp bovis AF2122/97
cgcgccccgcggcag

SEQ ID NO: 1139532 - RNA, 20 nt, Mycobacterium bovis subsp bovis AF2122/97
cgcgcccgaaugcgacgucg

SEQ ID NO: 1139533 - RNA, 21 nt, Mycobacterium bovis subsp bovis AF2122/97
cgcgcccgaaugcgacgucgu

SEQ ID NO: 1139534 - RNA, 14 nt, Mycobacterium bovis subsp bovis AF2122/97
cgcgcccaccggcu

SEQ ID NO: 1139535 - RNA, 13 nt, Mycobacterium bovis subsp bovis AF2122/97
cgcgcccaccggg

SEQ ID NO: 1139536 - RNA, 14 nt, Mycobacterium bovis subsp bovis AF2122/97
cgcgcccaccgggc

SEQ ID NO: 1139537 - RNA, 15 nt, Mycobacterium bovis subsp bovis AF2122/97
cgcgcccaccgggcg

SEQ ID NO: 1139538 - RNA, 17 nt, Mycobacterium bovis subsp bovis AF2122/97
cgcgcccaccgggcggc

SEQ ID NO: 1139539 - RNA, 16 nt, Mycobacterium bovis subsp bovis AF2122/97
cgcgcccaccagcggc

SEQ ID NO: 1139540 - RNA, 18 nt, Mycobacterium bovis subsp bovis AF2122/97
cgcgcccaccagcggcgg

SEQ ID NO: 1139541 - RNA, 19 nt, Mycobacterium bovis subsp bovis AF2122/97
cgcgcccaccccggccgca

SEQ ID NO: 1139542 - RNA, 16 nt, Mycobacterium bovis subsp bovis AF2122/97
cgcgccauuggcgccg

SEQ ID NO: 1139543 - RNA, 18 nt, Mycobacterium bovis subsp bovis AF2122/97
cgcgccauuggcgccgcc

SEQ ID NO: 1139544 - RNA, 19 nt, Mycobacterium bovis subsp bovis AF2122/97
cgcgccauuggcgccgccg

SEQ ID NO: 1139545 - RNA, 20 nt, Mycobacterium bovis subsp bovis AF2122/97
cgcgccauuggcgccgccga

SEQ ID NO: 1139546 - RNA, 17 nt, Mycobacterium bovis subsp bovis AF2122/97
cgcgccauuggcggugg

SEQ ID NO: 1139547 - RNA, 23 nt, Mycobacterium bovis subsp bovis AF2122/97
cgcgccgaccagaacgacgccgc

SEQ ID NO: 1139548 - RNA, 14 nt, Mycobacterium bovis subsp bovis AF2122/97
cgcgccgaucgagu

SEQ ID NO: 1139549 - RNA, 17 nt, Mycobacterium bovis subsp bovis AF2122/97
cgcgccgaucacggugg

SEQ ID NO: 1139550 - RNA, 14 nt, Mycobacterium bovis subsp bovis AF2122/97
cgcgccgaccaccg

SEQ ID NO: 1139551 - RNA, 20 nt, Mycobacterium bovis subsp bovis AF2122/97
cgcgccgaccaccgcugcga

SEQ ID NO: 1139552 - RNA, 17 nt, Mycobacterium bovis subsp bovis AF2122/97
cgcgccgaccaccgcug

SEQ ID NO: 1139553 - RNA, 16 nt, Mycobacterium bovis subsp bovis AF2122/97
cgcgcccugcggaucg

SEQ ID NO: 1139554 - RNA, 23 nt, Mycobacterium bovis subsp bovis AF2122/97
cgcgcccuucagcacggugauca

SEQ ID NO: 1139555 - RNA, 14 nt, Mycobacterium bovis subsp bovis AF2122/97
cgcgcccuagcugg

SEQ ID NO: 1139556 - RNA, 15 nt, Mycobacterium bovis subsp bovis AF2122/97
cgcgcccucagccgc

SEQ ID NO: 1139557 - RNA, 20 nt, Mycobacterium bovis subsp bovis AF2122/97
cgcgcccucagccgcggcca

SEQ ID NO: 1139558 - RNA, 20 nt, Mycobacterium bovis subsp bovis AF2122/97
cgcgagcgcuaucaccgccu

SEQ ID NO: 1139559 - RNA, 22 nt, Mycobacterium bovis subsp bovis AF2122/97
cgcgagcggaauggaggccgcc

SEQ ID NO: 1139560 - RNA, 19 nt, Mycobacterium bovis subsp bovis AF2122/97
cgcgagcgcuaucaccgcc

SEQ ID NO: 1139561 - RNA, 15 nt, Mycobacterium bovis subsp bovis AF2122/97
cgcgagcgccggccg

SEQ ID NO: 1139562 - RNA, 23 nt, Mycobacterium bovis subsp bovis AF2122/97
cgcgacggucaaggugcgccgcc

SEQ ID NO: 1139563 - RNA, 14 nt, Mycobacterium bovis subsp bovis AF2122/97
cgcgagcgcggcgg

SEQ ID NO: 1139564 - RNA, 23 nt, Mycobacterium bovis subsp bovis AF2122/97
cgcgagcucccuaacaucguuga

SEQ ID NO: 1139565 - RNA, 16 nt, Mycobacterium bovis subsp bovis AF2122/97
cgcgaggcucgcgugg

SEQ ID NO: 1139566 - RNA, 22 nt, Mycobacterium bovis subsp bovis AF2122/97
cgcgaggcucgcguggccgccg

SEQ ID NO: 1139567 - RNA, 14 nt, Mycobacterium bovis subsp bovis AF2122/97
cgcgaggggccggc

SEQ ID NO: 1139568 - RNA, 17 nt, Mycobacterium bovis subsp bovis AF2122/97
cgcgagggggguguuga

SEQ ID NO: 1139569 - RNA, 22 nt, Mycobacterium bovis subsp bovis AF2122/97
cgcgagggggguguugaggccg

SEQ ID NO: 1139570 - RNA, 22 nt, Mycobacterium bovis subsp bovis AF2122/97
cgcgagguacccaucgucgagc

SEQ ID NO: 1139571 - RNA, 17 nt, Mycobacterium bovis subsp bovis AF2122/97
cgcgagcuuggccggca

SEQ ID NO: 1139572 - RNA, 17 nt, Mycobacterium bovis subsp bovis AF2122/97
cgcgaggaacgccgggg

SEQ ID NO: 1139573 - RNA, 13 nt, Mycobacterium bovis subsp bovis AF2122/97
cgcgagccggcuc

SEQ ID NO: 1139574 - RNA, 14 nt, Mycobacterium bovis subsp bovis AF2122/97
cgcgagccagcugc

SEQ ID NO: 1139575 - RNA, 22 nt, Mycobacterium bovis subsp bovis AF2122/97
cgcgagccagcugcuccacccg

SEQ ID NO: 1139576 - RNA, 19 nt, Mycobacterium bovis subsp bovis AF2122/97
cgcgagcccggccucggcg

SEQ ID NO: 1139577 - RNA, 17 nt, Mycobacterium bovis subsp bovis AF2122/97
cgcgagccucgcgcgug

SEQ ID NO: 1139578 - RNA, 23 nt, Mycobacterium bovis subsp bovis AF2122/97
cgcgagccugauaaagcccggcg

SEQ ID NO: 1139579 - RNA, 14 nt, Mycobacterium bovis subsp bovis AF2122/97
cgcgacguccacca

SEQ ID NO: 1139580 - RNA, 17 nt, Mycobacterium bovis subsp bovis AF2122/97
cgcgacguccaccagcc

SEQ ID NO: 1139581 - RNA, 15 nt, Mycobacterium bovis subsp bovis AF2122/97
cgcgagcaucgacga

SEQ ID NO: 1139582 - RNA, 22 nt, Mycobacterium bovis subsp bovis AF2122/97
cgcgagcaucugggguccggug

SEQ ID NO: 1139583 - RNA, 23 nt, Mycobacterium bovis subsp bovis AF2122/97
cgcgagcaucugggguccgguga

SEQ ID NO: 1139584 - RNA, 13 nt, Mycobacterium bovis subsp bovis AF2122/97
cgcgacguagugg

SEQ ID NO: 1139585 - RNA, 22 nt, Mycobacterium bovis subsp bovis AF2122/97
cgcgacguaguggaagccgacc

SEQ ID NO: 1139586 - RNA, 19 nt, Mycobacterium bovis subsp bovis AF2122/97
cgcgacguagacgacgucg

SEQ ID NO: 1139587 - RNA, 20 nt, Mycobacterium bovis subsp bovis AF2122/97
cgcgacguagacgacgucgg

SEQ ID NO: 1139588 - RNA, 23 nt, Mycobacterium bovis subsp bovis AF2122/97
cgcgacggucccuucgucaccgu

SEQ ID NO: 1139589 - RNA, 22 nt, Mycobacterium bovis subsp bovis AF2122/97
cgcgacggucaaggugcgccgc

SEQ ID NO: 1139590 - RNA, 12 nt, Mycobacterium bovis subsp bovis AF2122/97
cgcgacguagac

SEQ ID NO: 1139591 - RNA, 13 nt, Mycobacterium bovis subsp bovis AF2122/97
cgcgacgggccgc

SEQ ID NO: 1139592 - RNA, 11 nt, Mycobacterium bovis subsp bovis AF2122/97
cgcgacgccgu

SEQ ID NO: 1139593 - RNA, 12 nt, Mycobacterium bovis subsp bovis AF2122/97
cgcgaccgcggg

SEQ ID NO: 1139594 - RNA, 17 nt, Mycobacterium bovis subsp bovis AF2122/97
cgcgaccggucugaucg

SEQ ID NO: 1139595 - RNA, 13 nt, Mycobacterium bovis subsp bovis AF2122/97
cgcgaccgucagg

SEQ ID NO: 1139596 - RNA, 17 nt, Mycobacterium bovis subsp bovis AF2122/97
cgcgaccgucaggguca

SEQ ID NO: 1139597 - RNA, 13 nt, Mycobacterium bovis subsp bovis AF2122/97
cgcgaccgucugg

SEQ ID NO: 1139598 - RNA, 20 nt, Mycobacterium bovis subsp bovis AF2122/97
cgcgacgacacgccugggcg

SEQ ID NO: 1139599 - RNA, 18 nt, Mycobacterium bovis subsp bovis AF2122/97
cgcgaccucgcuggccgc

SEQ ID NO: 1139600 - RNA, 19 nt, Mycobacterium bovis subsp bovis AF2122/97
cgcgacgaugccucggcgg

SEQ ID NO: 1139601 - RNA, 15 nt, Mycobacterium bovis subsp bovis AF2122/97
cgcgacgagcggccg

SEQ ID NO: 1139602 - RNA, 21 nt, Mycobacterium bovis subsp bovis AF2122/97
cgcgacgagacgcaaaaucgc

SEQ ID NO: 1139603 - RNA, 14 nt, Mycobacterium bovis subsp bovis AF2122/97
cgcgacgagccgca

SEQ ID NO: 1139604 - RNA, 12 nt, Mycobacterium bovis subsp bovis AF2122/97
cgcgacgaugcc

SEQ ID NO: 1139605 - RNA, 19 nt, Mycobacterium bovis subsp bovis AF2122/97
cgcgacgaugccccgguug

SEQ ID NO: 1139606 - RNA, 14 nt, Mycobacterium bovis subsp bovis AF2122/97
cgcgaccuugcccg

SEQ ID NO: 1139607 - RNA, 17 nt, Mycobacterium bovis subsp bovis AF2122/97
cgcgaccuugcccgcua

SEQ ID NO: 1139608 - RNA, 17 nt, Mycobacterium bovis subsp bovis AF2122/97
cgcgagucggcggggcg

SEQ ID NO: 1139609 - RNA, 21 nt, Mycobacterium bovis subsp bovis AF2122/97
cgcgaguagaucaucgagccc

SEQ ID NO: 1139610 - RNA, 15 nt, Mycobacterium bovis subsp bovis AF2122/97
cgcgaguagcugacc

SEQ ID NO: 1139611 - RNA, 16 nt, Mycobacterium bovis subsp bovis AF2122/97
cgcgaggucggcggcg

SEQ ID NO: 1139612 - RNA, 20 nt, Mycobacterium bovis subsp bovis AF2122/97
cgcgagguugaccaccagcg

SEQ ID NO: 1139613 - RNA, 17 nt, Mycobacterium bovis subsp bovis AF2122/97
cgcgaggugaagccgag

SEQ ID NO: 1139614 - RNA, 17 nt, Mycobacterium bovis subsp bovis AF2122/97
cgcgaguagaucaucga

SEQ ID NO: 1139615 - RNA, 14 nt, Mycobacterium bovis subsp bovis AF2122/97
cgcgaucaccaccg

SEQ ID NO: 1139616 - RNA, 15 nt, Mycobacterium bovis subsp bovis AF2122/97
cgcgaucaccaccgg

SEQ ID NO: 1139617 - RNA, 16 nt, Mycobacterium bovis subsp bovis AF2122/97
cgcgaucaccaccgga

SEQ ID NO: 1139618 - RNA, 15 nt, Mycobacterium bovis subsp bovis AF2122/97
cgcgaucaccgaguc

SEQ ID NO: 1139619 - RNA, 17 nt, Mycobacterium bovis subsp bovis AF2122/97
cgcgaucaacgcguugc

SEQ ID NO: 1139620 - RNA, 15 nt, Mycobacterium bovis subsp bovis AF2122/97
cgcgaguccaggcug

SEQ ID NO: 1139621 - RNA, 19 nt, Mycobacterium bovis subsp bovis AF2122/97
cgcgaguccaggcugaucc

SEQ ID NO: 1139622 - RNA, 12 nt, Mycobacterium bovis subsp bovis AF2122/97
cgcgaucagcgc

SEQ ID NO: 1139623 - RNA, 16 nt, Mycobacterium bovis subsp bovis AF2122/97
cgcgaucaggcgcucg

SEQ ID NO: 1139624 - RNA, 13 nt, Mycobacterium bovis subsp bovis AF2122/97
cgcgaucggcguc

SEQ ID NO: 1139625 - RNA, 17 nt, Mycobacterium bovis subsp bovis AF2122/97
cgcgaucgggcccagca

SEQ ID NO: 1139626 - RNA, 20 nt, Mycobacterium bovis subsp bovis AF2122/97
cgcgaucgggcccagcagcg

SEQ ID NO: 1139627 - RNA, 17 nt, Mycobacterium bovis subsp bovis AF2122/97
cgcgaucgggccgaucu

SEQ ID NO: 1139628 - RNA, 17 nt, Mycobacterium bovis subsp bovis AF2122/97
cgcgaucgggccggcgc

SEQ ID NO: 1139629 - RNA, 21 nt, Mycobacterium bovis subsp bovis AF2122/97
cgcgaucgggccggcgcgguc

SEQ ID NO: 1139630 - RNA, 14 nt, Mycobacterium bovis subsp bovis AF2122/97
cgcgaucggugccg

SEQ ID NO: 1139631 - RNA, 19 nt, Mycobacterium bovis subsp bovis AF2122/97
cgcgaucggugcgggcgcc

SEQ ID NO: 1139632 - RNA, 20 nt, Mycobacterium bovis subsp bovis AF2122/97
cgcgaucggugcgggcgccg

SEQ ID NO: 1139633 - RNA, 23 nt, Mycobacterium bovis subsp bovis AF2122/97
cgcgaucggugcgggcgccgcua

SEQ ID NO: 1139634 - RNA, 16 nt, Mycobacterium bovis subsp bovis AF2122/97
cgcgauccagcgcuga

SEQ ID NO: 1139635 - RNA, 13 nt, Mycobacterium bovis subsp bovis AF2122/97
cgcgauccagcgc

SEQ ID NO: 1139636 - RNA, 19 nt, Mycobacterium bovis subsp bovis AF2122/97
cgcgaucagguaccggcgg

SEQ ID NO: 1139637 - RNA, 14 nt, Mycobacterium bovis subsp bovis AF2122/97
cgcgauccacccgg

SEQ ID NO: 1139638 - RNA, 18 nt, Mycobacterium bovis subsp bovis AF2122/97
cgcgauggugguuccgcc

SEQ ID NO: 1139639 - RNA, 20 nt, Mycobacterium bovis subsp bovis AF2122/97
cgcgauggugguuccgcccg

SEQ ID NO: 1139640 - RNA, 22 nt, Mycobacterium bovis subsp bovis AF2122/97
cgcgauggugcgcccgccggcg

SEQ ID NO: 1139641 - RNA, 19 nt, Mycobacterium bovis subsp bovis AF2122/97
cgcgauggugcgccgggcg

SEQ ID NO: 1139642 - RNA, 16 nt, Mycobacterium bovis subsp bovis AF2122/97
cgcgaugguggccgcc

SEQ ID NO: 1139643 - RNA, 18 nt, Mycobacterium bovis subsp bovis AF2122/97
cgcgaucugcucgcccca

SEQ ID NO: 1139644 - RNA, 18 nt, Mycobacterium bovis subsp bovis AF2122/97
cgcgaucgggccgaucuc

SEQ ID NO: 1139645 - RNA, 18 nt, Mycobacterium bovis subsp bovis AF2122/97
cgcgaucuccuccaccag

SEQ ID NO: 1139646 - RNA, 15 nt, Mycobacterium bovis subsp bovis AF2122/97
cgcgaucucggagcg

SEQ ID NO: 1139647 - RNA, 13 nt, Mycobacterium bovis subsp bovis AF2122/97
cgcgcaccggauc

SEQ ID NO: 1139648 - RNA, 17 nt, Mycobacterium bovis subsp bovis AF2122/97
cgcgcaccggaucgccg

SEQ ID NO: 1139649 - RNA, 20 nt, Mycobacterium bovis subsp bovis AF2122/97
cgcgcaccggaucgccgucg

SEQ ID NO: 1139650 - RNA, 15 nt, Mycobacterium bovis subsp bovis AF2122/97
cgcgcaccuggcgcg

SEQ ID NO: 1139651 - RNA, 14 nt, Mycobacterium bovis subsp bovis AF2122/97
cgcgcaaccgcuca

SEQ ID NO: 1139652 - RNA, 13 nt, Mycobacterium bovis subsp bovis AF2122/97
cgcgcaaccgcug

SEQ ID NO: 1139653 - RNA, 18 nt, Mycobacterium bovis subsp bovis AF2122/97
cgcgcacccguccgccgc

SEQ ID NO: 1139654 - RNA, 19 nt, Mycobacterium bovis subsp bovis AF2122/97
cgcgcacccguccgccgca

SEQ ID NO: 1139655 - RNA, 16 nt, Mycobacterium bovis subsp bovis AF2122/97
cgcgcaccgcaggguc

SEQ ID NO: 1139656 - RNA, 18 nt, Mycobacterium bovis subsp bovis AF2122/97
cgcgcaacccugccgcga

SEQ ID NO: 1139657 - RNA, 21 nt, Mycobacterium bovis subsp bovis AF2122/97
cgcgcaacccugccgcgauga

SEQ ID NO: 1139658 - RNA, 15 nt, Mycobacterium bovis subsp bovis AF2122/97
cgcgcaaccagccca

SEQ ID NO: 1139659 - RNA, 16 nt, Mycobacterium bovis subsp bovis AF2122/97
cgcgcaacaccucguc

SEQ ID NO: 1139660 - RNA, 17 nt, Mycobacterium bovis subsp bovis AF2122/97
cgcgcaacaccucgucg

SEQ ID NO: 1139661 - RNA, 13 nt, Mycobacterium bovis subsp bovis AF2122/97
cgcgaugucacgg

SEQ ID NO: 1139662 - RNA, 21 nt, Mycobacterium bovis subsp bovis AF2122/97
cgcgauguccagguggcgcgg

SEQ ID NO: 1139663 - RNA, 14 nt, Mycobacterium bovis subsp bovis AF2122/97
cgcgauguccucga

SEQ ID NO: 1139664 - RNA, 22 nt, Mycobacterium bovis subsp bovis AF2122/97
cgcgauguccucgagcaccgcg

SEQ ID NO: 1139665 - RNA, 22 nt, Mycobacterium bovis subsp bovis AF2122/97
cgcgauguccuuguuggccagu

SEQ ID NO: 1139666 - RNA, 18 nt, Mycobacterium bovis subsp bovis AF2122/97
cgcgaugucguucgcguc

SEQ ID NO: 1139667 - RNA, 22 nt, Mycobacterium bovis subsp bovis AF2122/97
cgcgaugggcccagcggccgcg

SEQ ID NO: 1139668 - RNA, 22 nt, Mycobacterium bovis subsp bovis AF2122/97
cgcgauuagcaaaccgaccgug

SEQ ID NO: 1139669 - RNA, 21 nt, Mycobacterium bovis subsp bovis AF2122/97
cgcgauuagcaaaccgaccgu

SEQ ID NO: 1139670 - RNA, 20 nt, Mycobacterium bovis subsp bovis AF2122/97
cgcgaugugcgccaccucga

SEQ ID NO: 1139671 - RNA, 19 nt, Mycobacterium bovis subsp bovis AF2122/97
cgcgaugugggcuaacgac

SEQ ID NO: 1139672 - RNA, 13 nt, Mycobacterium bovis subsp bovis AF2122/97
cgcgaugugcgcc

SEQ ID NO: 1139673 - RNA, 16 nt, Mycobacterium bovis subsp bovis AF2122/97
cgcgaugugcgccacc

SEQ ID NO: 1139674 - RNA, 16 nt, Mycobacterium bovis subsp bovis AF2122/97
cgcgauuucgucgucg

SEQ ID NO: 1139675 - RNA, 15 nt, Mycobacterium bovis subsp bovis AF2122/97
cgcgauugccgcggu

SEQ ID NO: 1139676 - RNA, 19 nt, Mycobacterium bovis subsp bovis AF2122/97
cgcgauuccggcggccacg

SEQ ID NO: 1139677 - RNA, 18 nt, Mycobacterium bovis subsp bovis AF2122/97
cgcguccucgccgcacgc

SEQ ID NO: 1139678 - RNA, 15 nt, Mycobacterium bovis subsp bovis AF2122/97
cgcgucgaccggaca

SEQ ID NO: 1139679 - RNA, 13 nt, Mycobacterium bovis subsp bovis AF2122/97
cgcgucgacccga

SEQ ID NO: 1139680 - RNA, 22 nt, Mycobacterium bovis subsp bovis AF2122/97
cgcgucgacccgaacugggcga

SEQ ID NO: 1139681 - RNA, 14 nt, Mycobacterium bovis subsp bovis AF2122/97
cgcgucgagcagca

SEQ ID NO: 1139682 - RNA, 15 nt, Mycobacterium bovis subsp bovis AF2122/97
cgcgucgagugccgc

SEQ ID NO: 1139683 - RNA, 19 nt, Mycobacterium bovis subsp bovis AF2122/97
cgcgucgagcgccggccgc

SEQ ID NO: 1139684 - RNA, 20 nt, Mycobacterium bovis subsp bovis AF2122/97
cgcgucgagcgccggccgcg

SEQ ID NO: 1139685 - RNA, 19 nt, Mycobacterium bovis subsp bovis AF2122/97
cgcguccgccucgggugca

SEQ ID NO: 1139686 - RNA, 18 nt, Mycobacterium bovis subsp bovis AF2122/97
cgcguccgcgaucugcag

SEQ ID NO: 1139687 - RNA, 16 nt, Mycobacterium bovis subsp bovis AF2122/97
cgcguccggugcacca

SEQ ID NO: 1139688 - RNA, 17 nt, Mycobacterium bovis subsp bovis AF2122/97
cgcguccgggcagccgc

SEQ ID NO: 1139689 - RNA, 17 nt, Mycobacterium bovis subsp bovis AF2122/97
cgcguccgggcucgcgc

SEQ ID NO: 1139690 - RNA, 18 nt, Mycobacterium bovis subsp bovis AF2122/97
cgcguccggugcaccagg

SEQ ID NO: 1139691 - RNA, 19 nt, Mycobacterium bovis subsp bovis AF2122/97
cgcguccucgcccuggccg

SEQ ID NO: 1139692 - RNA, 14 nt, Mycobacterium bovis subsp bovis AF2122/97
cgcguccucgccgc

SEQ ID NO: 1139693 - RNA, 16 nt, Mycobacterium bovis subsp bovis AF2122/97
cgcguccccagcgcca

SEQ ID NO: 1139694 - RNA, 19 nt, Mycobacterium bovis subsp bovis AF2122/97
cgcguccccagcgccaccg

SEQ ID NO: 1139695 - RNA, 12 nt, Mycobacterium bovis subsp bovis AF2122/97
cgcguccagcgc

SEQ ID NO: 1139696 - RNA, 18 nt, Mycobacterium bovis subsp bovis AF2122/97
cgcgucccgccgcaccgc

SEQ ID NO: 1139697 - RNA, 20 nt, Mycobacterium bovis subsp bovis AF2122/97
cgcgguggucagcaccggcg

SEQ ID NO: 1139698 - RNA, 23 nt, Mycobacterium bovis subsp bovis AF2122/97
cgcgguguagaagcgggcgucgc

SEQ ID NO: 1139699 - RNA, 22 nt, Mycobacterium bovis subsp bovis AF2122/97
cgcgguguagaagcgggcgucg

SEQ ID NO: 1139700 - RNA, 21 nt, Mycobacterium bovis subsp bovis AF2122/97
cgcgguguagagcgcaccgcg

SEQ ID NO: 1139701 - RNA, 16 nt, Mycobacterium bovis subsp bovis AF2122/97
cgcgguguauccgacg

SEQ ID NO: 1139702 - RNA, 17 nt, Mycobacterium bovis subsp bovis AF2122/97
cgcguacggaaccaccg

SEQ ID NO: 1139703 - RNA, 18 nt, Mycobacterium bovis subsp bovis AF2122/97
cgcggugggcacagccag

SEQ ID NO: 1139704 - RNA, 15 nt, Mycobacterium bovis subsp bovis AF2122/97
cgcgguggcggcggu

SEQ ID NO: 1139705 - RNA, 19 nt, Mycobacterium bovis subsp bovis AF2122/97
cgcgguggcggcggugcca

SEQ ID NO: 1139706 - RNA, 21 nt, Mycobacterium bovis subsp bovis AF2122/97
cgcgguggcggugucggcgcc

SEQ ID NO: 1139707 - RNA, 23 nt, Mycobacterium bovis subsp bovis AF2122/97
cgcgguggcggucgccacacccg

SEQ ID NO: 1139708 - RNA, 13 nt, Mycobacterium bovis subsp bovis AF2122/97
cgcgguggcggug

SEQ ID NO: 1139709 - RNA, 14 nt, Mycobacterium bovis subsp bovis AF2122/97
cgcgguggcggcga

SEQ ID NO: 1139710 - RNA, 13 nt, Mycobacterium bovis subsp bovis AF2122/97
cgcggugguggug

SEQ ID NO: 1139711 - RNA, 14 nt, Mycobacterium bovis subsp bovis AF2122/97
cgcgguggucagca

SEQ ID NO: 1139712 - RNA, 13 nt, Mycobacterium bovis subsp bovis AF2122/97
cgcguagagccga

SEQ ID NO: 1139713 - RNA, 19 nt, Mycobacterium bovis subsp bovis AF2122/97
cgcguagagccgaucaccg

SEQ ID NO: 1139714 - RNA, 13 nt, Mycobacterium bovis subsp bovis AF2122/97
cgcguacgucggu

SEQ ID NO: 1139715 - RNA, 18 nt, Mycobacterium bovis subsp bovis AF2122/97
cgcguagaccccaaucga

SEQ ID NO: 1139716 - RNA, 19 nt, Mycobacterium bovis subsp bovis AF2122/97
cgcgucacggaccuggaac

SEQ ID NO: 1139717 - RNA, 23 nt, Mycobacterium bovis subsp bovis AF2122/97
cgcgucacuucccggauagacgg

SEQ ID NO: 1139718 - RNA, 20 nt, Mycobacterium bovis subsp bovis AF2122/97
cgcguagcgggcgcccuuga

SEQ ID NO: 1139719 - RNA, 18 nt, Mycobacterium bovis subsp bovis AF2122/97
cgcgucagccgcaccccg

SEQ ID NO: 1139720 - RNA, 15 nt, Mycobacterium bovis subsp bovis AF2122/97
cgcguagggccagcg

SEQ ID NO: 1139721 - RNA, 15 nt, Mycobacterium bovis subsp bovis AF2122/97
cgcgucaggccagcg

SEQ ID NO: 1139722 - RNA, 13 nt, Mycobacterium bovis subsp bovis AF2122/97
cgcgucaucaccg

SEQ ID NO: 1139723 - RNA, 19 nt, Mycobacterium bovis subsp bovis AF2122/97
cgcguccaaggcgcgcugg

SEQ ID NO: 1139724 - RNA, 22 nt, Mycobacterium bovis subsp bovis AF2122/97
cgcguccacccacgaucagcag

SEQ ID NO: 1139725 - RNA, 22 nt, Mycobacterium bovis subsp bovis AF2122/97
cgcgucauggcgaguacggccu

SEQ ID NO: 1139726 - RNA, 14 nt, Mycobacterium bovis subsp bovis AF2122/97
cgcgucauucaccg

SEQ ID NO: 1139727 - RNA, 14 nt, Mycobacterium bovis subsp bovis AF2122/97
cgcggucauggcga

SEQ ID NO: 1139728 - RNA, 24 nt, Mycobacterium bovis subsp bovis AF2122/97
cgcgguccagaaugucgcgggugg

SEQ ID NO: 1139729 - RNA, 21 nt, Mycobacterium bovis subsp bovis AF2122/97
cgcggucccacucgucgucgg

SEQ ID NO: 1139730 - RNA, 19 nt, Mycobacterium bovis subsp bovis AF2122/97
cgcgguccaucccgagcuc

SEQ ID NO: 1139731 - RNA, 21 nt, Mycobacterium bovis subsp bovis AF2122/97
cgcgguccucgagccgauaag

SEQ ID NO: 1139732 - RNA, 16 nt, Mycobacterium bovis subsp bovis AF2122/97
cgcggucgacagcgca

SEQ ID NO: 1139733 - RNA, 14 nt, Mycobacterium bovis subsp bovis AF2122/97
cgcggucgacgacg

SEQ ID NO: 1139734 - RNA, 16 nt, Mycobacterium bovis subsp bovis AF2122/97
cgcggucgacgacgcc

SEQ ID NO: 1139735 - RNA, 13 nt, Mycobacterium bovis subsp bovis AF2122/97
cgcggucgugauc

SEQ ID NO: 1139736 - RNA, 13 nt, Mycobacterium bovis subsp bovis AF2122/97
cgcggucucgagu

SEQ ID NO: 1139737 - RNA, 16 nt, Mycobacterium bovis subsp bovis AF2122/97
cgcggucucgagucgg

SEQ ID NO: 1139738 - RNA, 13 nt, Mycobacterium bovis subsp bovis AF2122/97
cgcggugaccggc

SEQ ID NO: 1139739 - RNA, 19 nt, Mycobacterium bovis subsp bovis AF2122/97
cgcggugaccggcucggcg

SEQ ID NO: 1139740 - RNA, 18 nt, Mycobacterium bovis subsp bovis AF2122/97
cgcggugacgagccacca

SEQ ID NO: 1139741 - RNA, 21 nt, Mycobacterium bovis subsp bovis AF2122/97
cgcggugacgagccaccaccg

SEQ ID NO: 1139742 - RNA, 24 nt, Mycobacterium bovis subsp bovis AF2122/97
cgcggugacgagccaccaccgccg

SEQ ID NO: 1139743 - RNA, 13 nt, Mycobacterium bovis subsp bovis AF2122/97
cgcggugacgauu

SEQ ID NO: 1139744 - RNA, 16 nt, Mycobacterium bovis subsp bovis AF2122/97
cgcggugacgccagcc

SEQ ID NO: 1139745 - RNA, 19 nt, Mycobacterium bovis subsp bovis AF2122/97
cgcggugacgccagccugg

SEQ ID NO: 1139746 - RNA, 22 nt, Mycobacterium bovis subsp bovis AF2122/97
cgcggugacgccagccuggcca

SEQ ID NO: 1139747 - RNA, 20 nt, Mycobacterium bovis subsp bovis AF2122/97
cgcggucugcuccaggcgcg

SEQ ID NO: 1139748 - RNA, 14 nt, Mycobacterium bovis subsp bovis AF2122/97
cgcggugaccaccc

SEQ ID NO: 1139749 - RNA, 16 nt, Mycobacterium bovis subsp bovis AF2122/97
cgcggucauggcgacg

SEQ ID NO: 1139750 - RNA, 17 nt, Mycobacterium bovis subsp bovis AF2122/97
cgcggucuuugagccgg

SEQ ID NO: 1139751 - RNA, 13 nt, Mycobacterium bovis subsp bovis AF2122/97
cgcggugacccgg

SEQ ID NO: 1139752 - RNA, 15 nt, Mycobacterium bovis subsp bovis AF2122/97
cgcggugauggugaa

SEQ ID NO: 1139753 - RNA, 12 nt, Mycobacterium bovis subsp bovis AF2122/97
cgcggugcccgc

SEQ ID NO: 1139754 - RNA, 22 nt, Mycobacterium bovis subsp bovis AF2122/97
cgcggugcccgcgaacgauccc

SEQ ID NO: 1139755 - RNA, 16 nt, Mycobacterium bovis subsp bovis AF2122/97
cgcggugcccugccgg

SEQ ID NO: 1139756 - RNA, 21 nt, Mycobacterium bovis subsp bovis AF2122/97
cgcggugcccugccggcagcg

SEQ ID NO: 1139757 - RNA, 23 nt, Mycobacterium bovis subsp bovis AF2122/97
cgcggugcccugccggcagcggc

SEQ ID NO: 1139758 - RNA, 13 nt, Mycobacterium bovis subsp bovis AF2122/97
cgcggugcccguc

SEQ ID NO: 1139759 - RNA, 14 nt, Mycobacterium bovis subsp bovis AF2122/97
cgcgguaaccacgc

SEQ ID NO: 1139760 - RNA, 15 nt, Mycobacterium bovis subsp bovis AF2122/97
cgcggguugcgcggc

SEQ ID NO: 1139761 - RNA, 18 nt, Mycobacterium bovis subsp bovis AF2122/97
cgcggguugucggcgacc

SEQ ID NO: 1139762 - RNA, 19 nt, Mycobacterium bovis subsp bovis AF2122/97
cgcggguuugaucuccacc

SEQ ID NO: 1139763 - RNA, 18 nt, Mycobacterium bovis subsp bovis AF2122/97
cgcggguuacccgcagcg

SEQ ID NO: 1139764 - RNA, 14 nt, Mycobacterium bovis subsp bovis AF2122/97
cgcgguaccgcucg

SEQ ID NO: 1139765 - RNA, 17 nt, Mycobacterium bovis subsp bovis AF2122/97
cgcgguaccgcucgggc

SEQ ID NO: 1139766 - RNA, 18 nt, Mycobacterium bovis subsp bovis AF2122/97
cgcgguaccaucaccgcg

SEQ ID NO: 1139767 - RNA, 13 nt, Mycobacterium bovis subsp bovis AF2122/97
cgcgguacgccgg

SEQ ID NO: 1139768 - RNA, 14 nt, Mycobacterium bovis subsp bovis AF2122/97
cgcgguacugcgca

SEQ ID NO: 1139769 - RNA, 18 nt, Mycobacterium bovis subsp bovis AF2122/97
cgcgguacugcgcagcgc

SEQ ID NO: 1139770 - RNA, 13 nt, Mycobacterium bovis subsp bovis AF2122/97
cgcgggcgauggc

SEQ ID NO: 1139771 - RNA, 14 nt, Mycobacterium bovis subsp bovis AF2122/97
cgcgggcgauggcc

SEQ ID NO: 1139772 - RNA, 19 nt, Mycobacterium bovis subsp bovis AF2122/97
cgcgggcacgcccucgucg

SEQ ID NO: 1139773 - RNA, 22 nt, Mycobacterium bovis subsp bovis AF2122/97
cgcgggcgaguagucgacgucg

SEQ ID NO: 1139774 - RNA, 18 nt, Mycobacterium bovis subsp bovis AF2122/97
cgcgggcgaccaccgcgg

SEQ ID NO: 1139775 - RNA, 19 nt, Mycobacterium bovis subsp bovis AF2122/97
cgcgggcgaccaccgcggc

SEQ ID NO: 1139776 - RNA, 14 nt, Mycobacterium bovis subsp bovis AF2122/97
cgcgggcgccggga

SEQ ID NO: 1139777 - RNA, 13 nt, Mycobacterium bovis subsp bovis AF2122/97
cgcgggcgccggu

SEQ ID NO: 1139778 - RNA, 13 nt, Mycobacterium bovis subsp bovis AF2122/97
cgcgggcaguggc

SEQ ID NO: 1139779 - RNA, 18 nt, Mycobacterium bovis subsp bovis AF2122/97
cgcgggcacugguggcga

SEQ ID NO: 1139780 - RNA, 16 nt, Mycobacterium bovis subsp bovis AF2122/97
cgcgggaucgguggcg

SEQ ID NO: 1139781 - RNA, 21 nt, Mycobacterium bovis subsp bovis AF2122/97
cgcgggaucgguggcggcacg

SEQ ID NO: 1139782 - RNA, 15 nt, Mycobacterium bovis subsp bovis AF2122/97
cgcgggcaagccgga

SEQ ID NO: 1139783 - RNA, 21 nt, Mycobacterium bovis subsp bovis AF2122/97
cgcucccucuacacccggacu

SEQ ID NO: 1139784 - RNA, 17 nt, Mycobacterium bovis subsp bovis AF2122/97
cgcucccugcacccagc

SEQ ID NO: 1139785 - RNA, 17 nt, Mycobacterium bovis subsp bovis AF2122/97
cgcucccguacgccggc

SEQ ID NO: 1139786 - RNA, 16 nt, Mycobacterium bovis subsp bovis AF2122/97
cgcucccgucucgaca

SEQ ID NO: 1139787 - RNA, 17 nt, Mycobacterium bovis subsp bovis AF2122/97
cgcucccccgccaaccc

SEQ ID NO: 1139788 - RNA, 18 nt, Mycobacterium bovis subsp bovis AF2122/97
cgcucccccgccaacccc

SEQ ID NO: 1139789 - RNA, 22 nt, Mycobacterium bovis subsp bovis AF2122/97
cgcuccccagcgaaucacccgc

SEQ ID NO: 1139790 - RNA, 15 nt, Mycobacterium bovis subsp bovis AF2122/97
cgcuccggcccugcc

SEQ ID NO: 1139791 - RNA, 23 nt, Mycobacterium bovis subsp bovis AF2122/97
cgcuccggcccugccgccggccc

SEQ ID NO: 1139792 - RNA, 13 nt, Mycobacterium bovis subsp bovis AF2122/97
cgcuccggcgcga

SEQ ID NO: 1139793 - RNA, 15 nt, Mycobacterium bovis subsp bovis AF2122/97
cgcucagcuccggcg

SEQ ID NO: 1139794 - RNA, 19 nt, Mycobacterium bovis subsp bovis AF2122/97
cgcucagggugcgccgcag

SEQ ID NO: 1139795 - RNA, 17 nt, Mycobacterium bovis subsp bovis AF2122/97
cgcuccaguggcgccag

SEQ ID NO: 1139796 - RNA, 18 nt, Mycobacterium bovis subsp bovis AF2122/97
cgcuccaguggcgccagg

SEQ ID NO: 1139797 - RNA, 15 nt, Mycobacterium bovis subsp bovis AF2122/97
cgcuccaggucgaca

SEQ ID NO: 1139798 - RNA, 23 nt, Mycobacterium bovis subsp bovis AF2122/97
cgcuaccgcccgcgccaccggca

SEQ ID NO: 1139799 - RNA, 16 nt, Mycobacterium bovis subsp bovis AF2122/97
cgcuacccgccacggu

SEQ ID NO: 1139800 - RNA, 16 nt, Mycobacterium bovis subsp bovis AF2122/97
cgcuaccagcucacgg

SEQ ID NO: 1139801 - RNA, 16 nt, Mycobacterium bovis subsp bovis AF2122/97
cgcuaccagcugggcg

SEQ ID NO: 1139802 - RNA, 20 nt, Mycobacterium bovis subsp bovis AF2122/97
cgcuaccagcugggcgacca

SEQ ID NO: 1139803 - RNA, 23 nt, Mycobacterium bovis subsp bovis AF2122/97
cgcuaccagcugggcgaccacuu

SEQ ID NO: 1139804 - RNA, 18 nt, Mycobacterium bovis subsp bovis AF2122/97
cgcuaauggauccagccc

SEQ ID NO: 1139805 - RNA, 19 nt, Mycobacterium bovis subsp bovis AF2122/97
cgcuaauugcggccgccgg

SEQ ID NO: 1139806 - RNA, 16 nt, Mycobacterium bovis subsp bovis AF2122/97
cgcuaaccuuggcgau

SEQ ID NO: 1139807 - RNA, 23 nt, Mycobacterium bovis subsp bovis AF2122/97
cgcuaacagauuguccggccggu

SEQ ID NO: 1139808 - RNA, 20 nt, Mycobacterium bovis subsp bovis AF2122/97
cgcuaacugcuuuucgacgg

SEQ ID NO: 1139809 - RNA, 17 nt, Mycobacterium bovis subsp bovis AF2122/97
cgcucagcgcggccacg

SEQ ID NO: 1139810 - RNA, 19 nt, Mycobacterium bovis subsp bovis AF2122/97
cgcucagcgcggccacgcc

SEQ ID NO: 1139811 - RNA, 21 nt, Mycobacterium bovis subsp bovis AF2122/97
cgcucagcgcggccacgccga

SEQ ID NO: 1139812 - RNA, 19 nt, Mycobacterium bovis subsp bovis AF2122/97
cgcucagccguccgggcgg

SEQ ID NO: 1139813 - RNA, 20 nt, Mycobacterium bovis subsp bovis AF2122/97
cgcucaccuuuggccgcgac

SEQ ID NO: 1139814 - RNA, 14 nt, Mycobacterium bovis subsp bovis AF2122/97
cgcucacgaagacc

SEQ ID NO: 1139815 - RNA, 13 nt, Mycobacterium bovis subsp bovis AF2122/97
cgcucacgccguc

SEQ ID NO: 1139816 - RNA, 17 nt, Mycobacterium bovis subsp bovis AF2122/97
cgcucacgcucacccgg

SEQ ID NO: 1139817 - RNA, 20 nt, Mycobacterium bovis subsp bovis AF2122/97
cgcucacugcagcgccucga

SEQ ID NO: 1139818 - RNA, 23 nt, Mycobacterium bovis subsp bovis AF2122/97
cgcucacugcagcgccucgaucc

SEQ ID NO: 1139819 - RNA, 15 nt, Mycobacterium bovis subsp bovis AF2122/97
cgcucaccggggccg

SEQ ID NO: 1139820 - RNA, 15 nt, Mycobacterium bovis subsp bovis AF2122/97
cgcucacccggucgc

SEQ ID NO: 1139821 - RNA, 14 nt, Mycobacterium bovis subsp bovis AF2122/97
cgcucacccgguua

SEQ ID NO: 1139822 - RNA, 20 nt, Mycobacterium bovis subsp bovis AF2122/97
cgcucacccggcgucucgca

SEQ ID NO: 1139823 - RNA, 17 nt, Mycobacterium bovis subsp bovis AF2122/97
cgcuacgcgcgcucgcu

SEQ ID NO: 1139824 - RNA, 20 nt, Mycobacterium bovis subsp bovis AF2122/97
cgcuacgcgcgcucgcucac

SEQ ID NO: 1139825 - RNA, 15 nt, Mycobacterium bovis subsp bovis AF2122/97
cgcucacccgcccgg

SEQ ID NO: 1139826 - RNA, 16 nt, Mycobacterium bovis subsp bovis AF2122/97
cgcucacccgccgcgg

SEQ ID NO: 1139827 - RNA, 20 nt, Mycobacterium bovis subsp bovis AF2122/97
cgcguuucgucgaccgcgcc

SEQ ID NO: 1139828 - RNA, 22 nt, Mycobacterium bovis subsp bovis AF2122/97
cgcguuucgaaccgcacgguga

SEQ ID NO: 1139829 - RNA, 15 nt, Mycobacterium bovis subsp bovis AF2122/97
cgcguuucgcagccg

SEQ ID NO: 1139830 - RNA, 20 nt, Mycobacterium bovis subsp bovis AF2122/97
cgcguuuauaccucgccgcc

SEQ ID NO: 1139831 - RNA, 21 nt, Mycobacterium bovis subsp bovis AF2122/97
cgcguuuauaccucgccgccc

SEQ ID NO: 1139832 - RNA, 23 nt, Mycobacterium bovis subsp bovis AF2122/97
cgcguuguaggcuuccagcucgu

SEQ ID NO: 1139833 - RNA, 14 nt, Mycobacterium bovis subsp bovis AF2122/97
cgcguuggcccgcc

SEQ ID NO: 1139834 - RNA, 13 nt, Mycobacterium bovis subsp bovis AF2122/97
cgcguuggccaca

SEQ ID NO: 1139835 - RNA, 14 nt, Mycobacterium bovis subsp bovis AF2122/97
cgcguuggguugaa

SEQ ID NO: 1139836 - RNA, 16 nt, Mycobacterium bovis subsp bovis AF2122/97
cgcguugugcccgccg

SEQ ID NO: 1139837 - RNA, 21 nt, Mycobacterium bovis subsp bovis AF2122/97
cgcguugugcccgccggccca

SEQ ID NO: 1139838 - RNA, 12 nt, Mycobacterium bovis subsp bovis AF2122/97
cgcguuggccac

SEQ ID NO: 1139839 - RNA, 16 nt, Mycobacterium bovis subsp bovis AF2122/97
cgcguucuccggcacc

SEQ ID NO: 1139840 - RNA, 17 nt, Mycobacterium bovis subsp bovis AF2122/97
cgcguuggacaauucga

SEQ ID NO: 1139841 - RNA, 19 nt, Mycobacterium bovis subsp bovis AF2122/97
cgcgugcggugccguggug

SEQ ID NO: 1139842 - RNA, 20 nt, Mycobacterium bovis subsp bovis AF2122/97
cgcgugcgguggcgcgcagc

SEQ ID NO: 1139843 - RNA, 13 nt, Mycobacterium bovis subsp bovis AF2122/97
cgcgugcucgacg

SEQ ID NO: 1139844 - RNA, 22 nt, Mycobacterium bovis subsp bovis AF2122/97
cgcgugcucgagcaccucggcc

SEQ ID NO: 1139845 - RNA, 12 nt, Mycobacterium bovis subsp bovis AF2122/97
cgcgugcugagu

SEQ ID NO: 1139846 - RNA, 17 nt, Mycobacterium bovis subsp bovis AF2122/97
cgcguucgagugcgguc

SEQ ID NO: 1139847 - RNA, 12 nt, Mycobacterium bovis subsp bovis AF2122/97
cgcguucgcgca

SEQ ID NO: 1139848 - RNA, 15 nt, Mycobacterium bovis subsp bovis AF2122/97
cgcguucccacgguu

SEQ ID NO: 1139849 - RNA, 16 nt, Mycobacterium bovis subsp bovis AF2122/97
cgcguucccacgguuc

SEQ ID NO: 1139850 - RNA, 17 nt, Mycobacterium bovis subsp bovis AF2122/97
cgcguuccuccagcagc

SEQ ID NO: 1139851 - RNA, 14 nt, Mycobacterium bovis subsp bovis AF2122/97
cgcguucucggcac

SEQ ID NO: 1139852 - RNA, 14 nt, Mycobacterium bovis subsp bovis AF2122/97
cgcguucggcaccu

SEQ ID NO: 1139853 - RNA, 13 nt, Mycobacterium bovis subsp bovis AF2122/97
cgcguucgcgcaa

SEQ ID NO: 1139854 - RNA, 15 nt, Mycobacterium bovis subsp bovis AF2122/97
cgcguucggcgagca

SEQ ID NO: 1139855 - RNA, 23 nt, Mycobacterium bovis subsp bovis AF2122/97
cgcgugcgacgauaucgggagcg

SEQ ID NO: 1139856 - RNA, 13 nt, Mycobacterium bovis subsp bovis AF2122/97
cgcgugcgccggg

SEQ ID NO: 1139857 - RNA, 14 nt, Mycobacterium bovis subsp bovis AF2122/97
cgcgugcggcugcc

SEQ ID NO: 1139858 - RNA, 17 nt, Mycobacterium bovis subsp bovis AF2122/97
cgcgugcggcugccagu

SEQ ID NO: 1139859 - RNA, 18 nt, Mycobacterium bovis subsp bovis AF2122/97
cgcgugcgggggacgggu

SEQ ID NO: 1139860 - RNA, 13 nt, Mycobacterium bovis subsp bovis AF2122/97
cgcgugccgcccg

SEQ ID NO: 1139861 - RNA, 13 nt, Mycobacterium bovis subsp bovis AF2122/97
cgcgugccagcgc

SEQ ID NO: 1139862 - RNA, 15 nt, Mycobacterium bovis subsp bovis AF2122/97
cgcgugccagcgccc

SEQ ID NO: 1139863 - RNA, 18 nt, Mycobacterium bovis subsp bovis AF2122/97
cgcgugccagcgccccgc

SEQ ID NO: 1139864 - RNA, 21 nt, Mycobacterium bovis subsp bovis AF2122/97
cgcgugccagcgccccgcggu

SEQ ID NO: 1139865 - RNA, 19 nt, Mycobacterium bovis subsp bovis AF2122/97
cgcgugcccguggugaugg

SEQ ID NO: 1139866 - RNA, 15 nt, Mycobacterium bovis subsp bovis AF2122/97
cgcgugccgcaaccg

SEQ ID NO: 1139867 - RNA, 22 nt, Mycobacterium bovis subsp bovis AF2122/97
cgcgugccgcaaccggcgaucg

SEQ ID NO: 1139868 - RNA, 13 nt, Mycobacterium bovis subsp bovis AF2122/97
cgcgugcagcggc

SEQ ID NO: 1139869 - RNA, 23 nt, Mycobacterium bovis subsp bovis AF2122/97
cgcgugcagcggcgccgccaagg

SEQ ID NO: 1139870 - RNA, 14 nt, Mycobacterium bovis subsp bovis AF2122/97
cgcgugccacucga

SEQ ID NO: 1139871 - RNA, 19 nt, Mycobacterium bovis subsp bovis AF2122/97
cgcgugcaggcugucaauc

SEQ ID NO: 1139872 - RNA, 22 nt, Mycobacterium bovis subsp bovis AF2122/97
cgcgugcaccauacucaccgac

SEQ ID NO: 1139873 - RNA, 24 nt, Mycobacterium bovis subsp bovis AF2122/97
cgcgugcaccauacucaccgacgc

SEQ ID NO: 1139874 - RNA, 15 nt, Mycobacterium bovis subsp bovis AF2122/97
cgcgucgaucugugg

SEQ ID NO: 1139875 - RNA, 16 nt, Mycobacterium bovis subsp bovis AF2122/97
cgcgucgagugccgcc

SEQ ID NO: 1139876 - RNA, 17 nt, Mycobacterium bovis subsp bovis AF2122/97
cgcgucgagugccgcca

SEQ ID NO: 1139877 - RNA, 15 nt, Mycobacterium bovis subsp bovis AF2122/97
cgcgucggcggccag

SEQ ID NO: 1139878 - RNA, 14 nt, Mycobacterium bovis subsp bovis AF2122/97
cgcgucggcguugg

SEQ ID NO: 1139879 - RNA, 15 nt, Mycobacterium bovis subsp bovis AF2122/97
cgcgucggcugccgc

SEQ ID NO: 1139880 - RNA, 18 nt, Mycobacterium bovis subsp bovis AF2122/97
cgcgucggcugccgcggc

SEQ ID NO: 1139881 - RNA, 13 nt, Mycobacterium bovis subsp bovis AF2122/97
cgcgucggcggcg

SEQ ID NO: 1139882 - RNA, 19 nt, Mycobacterium bovis subsp bovis AF2122/97
cgcgucggcggcgaccgcc

SEQ ID NO: 1139883 - RNA, 21 nt, Mycobacterium bovis subsp bovis AF2122/97
cgcgucggcggcgaccgccag

SEQ ID NO: 1139884 - RNA, 16 nt, Mycobacterium bovis subsp bovis AF2122/97
cgcgucggcggccagu

SEQ ID NO: 1139885 - RNA, 19 nt, Mycobacterium bovis subsp bovis AF2122/97
cgcgucggcguuggggcuc

SEQ ID NO: 1139886 - RNA, 12 nt, Mycobacterium bovis subsp bovis AF2122/97
cgcggccacccg

SEQ ID NO: 1139887 - RNA, 16 nt, Mycobacterium bovis subsp bovis AF2122/97
cgcggccacccgcgac

SEQ ID NO: 1139888 - RNA, 15 nt, Mycobacterium bovis subsp bovis AF2122/97
cgcggccaccaccag

SEQ ID NO: 1139889 - RNA, 20 nt, Mycobacterium bovis subsp bovis AF2122/97
cgcggccaccacaacgccag

SEQ ID NO: 1139890 - RNA, 17 nt, Mycobacterium bovis subsp bovis AF2122/97
cgcggccaccaccaggc

SEQ ID NO: 1139891 - RNA, 23 nt, Mycobacterium bovis subsp bovis AF2122/97
cgcggccaccaccaggcugacgu

SEQ ID NO: 1139892 - RNA, 17 nt, Mycobacterium bovis subsp bovis AF2122/97
cgcggccaccaccgccg

SEQ ID NO: 1139893 - RNA, 14 nt, Mycobacterium bovis subsp bovis AF2122/97
cgcggccaauggcc

SEQ ID NO: 1139894 - RNA, 18 nt, Mycobacterium bovis subsp bovis AF2122/97
cgcggccaauugcgccgc

SEQ ID NO: 1139895 - RNA, 17 nt, Mycobacterium bovis subsp bovis AF2122/97
cgcggccacaucgccag

SEQ ID NO: 1139896 - RNA, 20 nt, Mycobacterium bovis subsp bovis AF2122/97
cgcggccacaccuuggccgc

SEQ ID NO: 1139897 - RNA, 22 nt, Mycobacterium bovis subsp bovis AF2122/97
cgcggccacaccuuggccgccg

SEQ ID NO: 1139898 - RNA, 19 nt, Mycobacterium bovis subsp bovis AF2122/97
cgcggccaaucagcccgcc

SEQ ID NO: 1139899 - RNA, 20 nt, Mycobacterium bovis subsp bovis AF2122/97
cgcggccaaucagcccgccg

SEQ ID NO: 1139900 - RNA, 22 nt, Mycobacterium bovis subsp bovis AF2122/97
cgcggccaaucagcccgccgga

SEQ ID NO: 1139901 - RNA, 23 nt, Mycobacterium bovis subsp bovis AF2122/97
cgcggccaaucagcccgccggac

SEQ ID NO: 1139902 - RNA, 24 nt, Mycobacterium bovis subsp bovis AF2122/97
cgcggcaugauuuuucgcagugac

SEQ ID NO: 1139903 - RNA, 22 nt, Mycobacterium bovis subsp bovis AF2122/97
cgcggcaugcaaugcuggcggc

SEQ ID NO: 1139904 - RNA, 18 nt, Mycobacterium bovis subsp bovis AF2122/97
cgcggcagguugcguugc

SEQ ID NO: 1139905 - RNA, 18 nt, Mycobacterium bovis subsp bovis AF2122/97
cgcggcacgcuccagcuc

SEQ ID NO: 1139906 - RNA, 19 nt, Mycobacterium bovis subsp bovis AF2122/97
cgcggcaucgacgcggcca

SEQ ID NO: 1139907 - RNA, 14 nt, Mycobacterium bovis subsp bovis AF2122/97
cgcggcaucccgcc

SEQ ID NO: 1139908 - RNA, 18 nt, Mycobacterium bovis subsp bovis AF2122/97
cgcggcaacgcggucugc

SEQ ID NO: 1139909 - RNA, 14 nt, Mycobacterium bovis subsp bovis AF2122/97
cgcggcacgcccac

SEQ ID NO: 1139910 - RNA, 14 nt, Mycobacterium bovis subsp bovis AF2122/97
cgcggcacgcucca

SEQ ID NO: 1139911 - RNA, 14 nt, Mycobacterium bovis subsp bovis AF2122/97
cgcggcaccuucgg

SEQ ID NO: 1139912 - RNA, 16 nt, Mycobacterium bovis subsp bovis AF2122/97
cgcggcaccgccgagc

SEQ ID NO: 1139913 - RNA, 17 nt, Mycobacterium bovis subsp bovis AF2122/97
cgcggcaccgccgagca

SEQ ID NO: 1139914 - RNA, 21 nt, Mycobacterium bovis subsp bovis AF2122/97
cgcggcacggugugcggcauu

SEQ ID NO: 1139915 - RNA, 21 nt, Mycobacterium bovis subsp bovis AF2122/97
cgcggcacuuuguagcccgcg

SEQ ID NO: 1139916 - RNA, 13 nt, Mycobacterium bovis subsp bovis AF2122/97
cgcggcagcacga

SEQ ID NO: 1139917 - RNA, 14 nt, Mycobacterium bovis subsp bovis AF2122/97
cgcggcagggcggu

SEQ ID NO: 1139918 - RNA, 18 nt, Mycobacterium bovis subsp bovis AF2122/97
cgcggcagggcggugcca

SEQ ID NO: 1139919 - RNA, 21 nt, Mycobacterium bovis subsp bovis AF2122/97
cgcggcagggcggugccaucg

SEQ ID NO: 1139920 - RNA, 14 nt, Mycobacterium bovis subsp bovis AF2122/97
cgcggcaggccggu

SEQ ID NO: 1139921 - RNA, 12 nt, Mycobacterium bovis subsp bovis AF2122/97
cgcggcagcgga

SEQ ID NO: 1139922 - RNA, 13 nt, Mycobacterium bovis subsp bovis AF2122/97
cgcggcagcguug

SEQ ID NO: 1139923 - RNA, 17 nt, Mycobacterium bovis subsp bovis AF2122/97
cgcggaucgaccgccag

SEQ ID NO: 1139924 - RNA, 22 nt, Mycobacterium bovis subsp bovis AF2122/97
cgcggaucgaccgccagcgccg

SEQ ID NO: 1139925 - RNA, 21 nt, Mycobacterium bovis subsp bovis AF2122/97
cgcggaucgacuucgacgaca

SEQ ID NO: 1139926 - RNA, 22 nt, Mycobacterium bovis subsp bovis AF2122/97
cgcggagucugcugaucgagcg

SEQ ID NO: 1139927 - RNA, 15 nt, Mycobacterium bovis subsp bovis AF2122/97
cgcggaucucaucgg

SEQ ID NO: 1139928 - RNA, 21 nt, Mycobacterium bovis subsp bovis AF2122/97
cgcggauguccaggagugcgg

SEQ ID NO: 1139929 - RNA, 23 nt, Mycobacterium bovis subsp bovis AF2122/97
cgcggaugcucaggucaccggcc

SEQ ID NO: 1139930 - RNA, 14 nt, Mycobacterium bovis subsp bovis AF2122/97
cgcggaugcucguu

SEQ ID NO: 1139931 - RNA, 19 nt, Mycobacterium bovis subsp bovis AF2122/97
cgcggcaaucucaugcccg

SEQ ID NO: 1139932 - RNA, 20 nt, Mycobacterium bovis subsp bovis AF2122/97
cgcggcaaucucaugcccgg

SEQ ID NO: 1139933 - RNA, 16 nt, Mycobacterium bovis subsp bovis AF2122/97
cgcggcaaugaggccg

SEQ ID NO: 1139934 - RNA, 22 nt, Mycobacterium bovis subsp bovis AF2122/97
cgcggcaagaguugccggaucg

SEQ ID NO: 1139935 - RNA, 15 nt, Mycobacterium bovis subsp bovis AF2122/97
cgcggauuccagcgc

SEQ ID NO: 1139936 - RNA, 13 nt, Mycobacterium bovis subsp bovis AF2122/97
cgcggcaacacca

SEQ ID NO: 1139937 - RNA, 23 nt, Mycobacterium bovis subsp bovis AF2122/97
cgcggcaaccgucgaaaaaucga

SEQ ID NO: 1139938 - RNA, 23 nt, Mycobacterium bovis subsp bovis AF2122/97
cgcggcaauugcgguucgaacgc

SEQ ID NO: 1139939 - RNA, 15 nt, Mycobacterium bovis subsp bovis AF2122/97
cgcggcaccagcacc

SEQ ID NO: 1139940 - RNA, 19 nt, Mycobacterium bovis subsp bovis AF2122/97
cgcggcaccagcaccgucg

SEQ ID NO: 1139941 - RNA, 22 nt, Mycobacterium bovis subsp bovis AF2122/97
cgcggcacccaaccaggccgcg

SEQ ID NO: 1139942 - RNA, 19 nt, Mycobacterium bovis subsp bovis AF2122/97
cgcggcacccggucggcca

SEQ ID NO: 1139943 - RNA, 14 nt, Mycobacterium bovis subsp bovis AF2122/97
cgcggcaccacguc

SEQ ID NO: 1139944 - RNA, 20 nt, Mycobacterium bovis subsp bovis AF2122/97
cgcggcacccggucggccau

SEQ ID NO: 1139945 - RNA, 16 nt, Mycobacterium bovis subsp bovis AF2122/97
cgcggcaccgauggcg

SEQ ID NO: 1139946 - RNA, 23 nt, Mycobacterium bovis subsp bovis AF2122/97
cgcggcaccgauggcgcaccggc

SEQ ID NO: 1139947 - RNA, 20 nt, Mycobacterium bovis subsp bovis AF2122/97
cgcggcaccgccccgccaac

SEQ ID NO: 1139948 - RNA, 13 nt, Mycobacterium bovis subsp bovis AF2122/97
cgcggcaccgccg

SEQ ID NO: 1139949 - RNA, 15 nt, Mycobacterium bovis subsp bovis AF2122/97
cgcggauuccggcuc

SEQ ID NO: 1139950 - RNA, 23 nt, Mycobacterium bovis subsp bovis AF2122/97
cgcggauuccagcgcguaguccg

SEQ ID NO: 1139951 - RNA, 12 nt, Mycobacterium bovis subsp bovis AF2122/97
cgcggauuccgg

SEQ ID NO: 1139952 - RNA, 16 nt, Mycobacterium bovis subsp bovis AF2122/97
cgcggauuucucgccc

SEQ ID NO: 1139953 - RNA, 16 nt, Mycobacterium bovis subsp bovis AF2122/97
cgcggauuucgccgug

SEQ ID NO: 1139954 - RNA, 20 nt, Mycobacterium bovis subsp bovis AF2122/97
cgcggauuucgccgugauga

SEQ ID NO: 1139955 - RNA, 16 nt, Mycobacterium bovis subsp bovis AF2122/97
cgcggauugccgcgcg

SEQ ID NO: 1139956 - RNA, 22 nt, Mycobacterium bovis subsp bovis AF2122/97
cgcggauugccgcgcgcaagcc

SEQ ID NO: 1139957 - RNA, 22 nt, Mycobacterium bovis subsp bovis AF2122/97
cgcggcaaaguuggccgcccga

SEQ ID NO: 1139958 - RNA, 22 nt, Mycobacterium bovis subsp bovis AF2122/97
cgcggcaaaccugaguccggca

SEQ ID NO: 1139959 - RNA, 15 nt, Mycobacterium bovis subsp bovis AF2122/97
cgcggagccaggacg

SEQ ID NO: 1139960 - RNA, 15 nt, Mycobacterium bovis subsp bovis AF2122/97
cgcggacggugcggu

SEQ ID NO: 1139961 - RNA, 15 nt, Mycobacterium bovis subsp bovis AF2122/97
cgcggacguggucgg

SEQ ID NO: 1139962 - RNA, 14 nt, Mycobacterium bovis subsp bovis AF2122/97
cgcggacucgggca

SEQ ID NO: 1139963 - RNA, 16 nt, Mycobacterium bovis subsp bovis AF2122/97
cgcggacuugcgagcc

SEQ ID NO: 1139964 - RNA, 15 nt, Mycobacterium bovis subsp bovis AF2122/97
cgcggacuuggcggu

SEQ ID NO: 1139965 - RNA, 17 nt, Mycobacterium bovis subsp bovis AF2122/97
cgcggacuuggcggucg

SEQ ID NO: 1139966 - RNA, 16 nt, Mycobacterium bovis subsp bovis AF2122/97
cgcggagcgugagcca

SEQ ID NO: 1139967 - RNA, 14 nt, Mycobacterium bovis subsp bovis AF2122/97
cgcggaguagccgc

SEQ ID NO: 1139968 - RNA, 20 nt, Mycobacterium bovis subsp bovis AF2122/97
cgcggaucagcccgcgcagc

SEQ ID NO: 1139969 - RNA, 22 nt, Mycobacterium bovis subsp bovis AF2122/97
cgcggaucauccuucgccggcg

SEQ ID NO: 1139970 - RNA, 19 nt, Mycobacterium bovis subsp bovis AF2122/97
cgcggaucaccaucgccgc

SEQ ID NO: 1139971 - RNA, 22 nt, Mycobacterium bovis subsp bovis AF2122/97
cgcggauaggccgcgcggcggc

SEQ ID NO: 1139972 - RNA, 20 nt, Mycobacterium bovis subsp bovis AF2122/97
cgcggaucaacaggccggcu

SEQ ID NO: 1139973 - RNA, 21 nt, Mycobacterium bovis subsp bovis AF2122/97
cgcggaucaacaggccggcuc

SEQ ID NO: 1139974 - RNA, 16 nt, Mycobacterium bovis subsp bovis AF2122/97
cgcggaucaccaucgc

SEQ ID NO: 1139975 - RNA, 21 nt, Mycobacterium bovis subsp bovis AF2122/97
cgcggacaccuuucuccacac

SEQ ID NO: 1139976 - RNA, 20 nt, Mycobacterium bovis subsp bovis AF2122/97
cgcggacacgaucgcgucgg

SEQ ID NO: 1139977 - RNA, 16 nt, Mycobacterium bovis subsp bovis AF2122/97
cgcggacacgaucgcg

SEQ ID NO: 1139978 - RNA, 18 nt, Mycobacterium bovis subsp bovis AF2122/97
cgcggaagcgggcgaugc

SEQ ID NO: 1139979 - RNA, 15 nt, Mycobacterium bovis subsp bovis AF2122/97
cgcggaaggccagcu

SEQ ID NO: 1139980 - RNA, 23 nt, Mycobacterium bovis subsp bovis AF2122/97
cgcggaaguaccguuccacgucg

SEQ ID NO: 1139981 - RNA, 15 nt, Mycobacterium bovis subsp bovis AF2122/97
cgcggaaucgcaccg

SEQ ID NO: 1139982 - RNA, 18 nt, Mycobacterium bovis subsp bovis AF2122/97
cgcggaaucgcaucggcg

SEQ ID NO: 1139983 - RNA, 22 nt, Mycobacterium bovis subsp bovis AF2122/97
cgcggaaucgcaucggcggggc

SEQ ID NO: 1139984 - RNA, 13 nt, Mycobacterium bovis subsp bovis AF2122/97
cgcggacaccgcg

SEQ ID NO: 1139985 - RNA, 15 nt, Mycobacterium bovis subsp bovis AF2122/97
cgcggacaccgcggc

SEQ ID NO: 1139986 - RNA, 17 nt, Mycobacterium bovis subsp bovis AF2122/97
cgcggacaccgcggcga

SEQ ID NO: 1139987 - RNA, 21 nt, Mycobacterium bovis subsp bovis AF2122/97
cgcgccggcgugcaugagccg

SEQ ID NO: 1139988 - RNA, 13 nt, Mycobacterium bovis subsp bovis AF2122/97
cgcgccggcggcc

SEQ ID NO: 1139989 - RNA, 11 nt, Mycobacterium bovis subsp bovis AF2122/97
cgcgccggcuc

SEQ ID NO: 1139990 - RNA, 17 nt, Mycobacterium bovis subsp bovis AF2122/97
cgcgccgggcggcgcga

SEQ ID NO: 1139991 - RNA, 16 nt, Mycobacterium bovis subsp bovis AF2122/97
cgcgccggcugccaca

SEQ ID NO: 1139992 - RNA, 16 nt, Mycobacterium bovis subsp bovis AF2122/97
cgcgcugugccgugcg

SEQ ID NO: 1139993 - RNA, 22 nt, Mycobacterium bovis subsp bovis AF2122/97
cgcgcugugccgugcgaucacc

SEQ ID NO: 1139994 - RNA, 22 nt, Mycobacterium bovis subsp bovis AF2122/97
cgcgcuguccacgaugacgucg

SEQ ID NO: 1139995 - RNA, 23 nt, Mycobacterium bovis subsp bovis AF2122/97
cgcgcuguccacgaugacgucga

SEQ ID NO: 1139996 - RNA, 22 nt, Mycobacterium bovis subsp bovis AF2122/97
cgcgcuugguguggcccaaccg

SEQ ID NO: 1139997 - RNA, 17 nt, Mycobacterium bovis subsp bovis AF2122/97
cgcgcuugggguccgga

SEQ ID NO: 1139998 - RNA, 13 nt, Mycobacterium bovis subsp bovis AF2122/97
cgcgcuugcgccg

SEQ ID NO: 1139999 - RNA, 18 nt, Mycobacterium bovis subsp bovis AF2122/97
cgcgcuugcgccgcccau

SEQ ID NO: 1140000 - RNA, 20 nt, Mycobacterium bovis subsp bovis AF2122/97
cgcgcuugcgaucgccgcua

SEQ ID NO: 1140001 - RNA, 16 nt, Mycobacterium bovis subsp bovis AF2122/97
cgcgcuugcgaucggc

SEQ ID NO: 1140002 - RNA, 18 nt, Mycobacterium bovis subsp bovis AF2122/97
cgcgcuugcgaucgccgc

SEQ ID NO: 1140003 - RNA, 12 nt, Mycobacterium bovis subsp bovis AF2122/97
cgcgcuugcgau

SEQ ID NO: 1140004 - RNA, 14 nt, Mycobacterium bovis subsp bovis AF2122/97
cgcgcuugcgaucg

SEQ ID NO: 1140005 - RNA, 22 nt, Mycobacterium bovis subsp bovis AF2122/97
cgcgcuguugccaucgacgccg

SEQ ID NO: 1140006 - RNA, 23 nt, Mycobacterium bovis subsp bovis AF2122/97
cgcgcuguugccaucgacgccgc

SEQ ID NO: 1140007 - RNA, 16 nt, Mycobacterium bovis subsp bovis AF2122/97
cgcgcuucaugagccg

SEQ ID NO: 1140008 - RNA, 19 nt, Mycobacterium bovis subsp bovis AF2122/97
cgcgcuucaggcaucaccg

SEQ ID NO: 1140009 - RNA, 21 nt, Mycobacterium bovis subsp bovis AF2122/97
cgcgcuugaagguucgaucgc

SEQ ID NO: 1140010 - RNA, 19 nt, Mycobacterium bovis subsp bovis AF2122/97
cgcgcuugauccacccgac

SEQ ID NO: 1140011 - RNA, 13 nt, Mycobacterium bovis subsp bovis AF2122/97
cgcggccacgccg

SEQ ID NO: 1140012 - RNA, 13 nt, Mycobacterium bovis subsp bovis AF2122/97
cgcggccaccgac

SEQ ID NO: 1140013 - RNA, 12 nt, Mycobacterium bovis subsp bovis AF2122/97
cgcggccaccgc

SEQ ID NO: 1140014 - RNA, 13 nt, Mycobacterium bovis subsp bovis AF2122/97
cgcggccaccgcc

SEQ ID NO: 1140015 - RNA, 14 nt, Mycobacterium bovis subsp bovis AF2122/97
cgcggccaccgccg

SEQ ID NO: 1140016 - RNA, 18 nt, Mycobacterium bovis subsp bovis AF2122/97
cgcggccaccgccgccgc

SEQ ID NO: 1140017 - RNA, 21 nt, Mycobacterium bovis subsp bovis AF2122/97
cgcggccaccgccgccgccga

SEQ ID NO: 1140018 - RNA, 18 nt, Mycobacterium bovis subsp bovis AF2122/97
cgcggccacggucagcca

SEQ ID NO: 1140019 - RNA, 22 nt, Mycobacterium bovis subsp bovis AF2122/97
cgcggccacggucagccaggug

SEQ ID NO: 1140020 - RNA, 16 nt, Mycobacterium bovis subsp bovis AF2122/97
cgcggccagagccgcg

SEQ ID NO: 1140021 - RNA, 18 nt, Mycobacterium bovis subsp bovis AF2122/97
cgcggccagagccgcgcg

SEQ ID NO: 1140022 - RNA, 13 nt, Mycobacterium bovis subsp bovis AF2122/97
cgcggccagcagc

SEQ ID NO: 1140023 - RNA, 12 nt, Mycobacterium bovis subsp bovis AF2122/97
cgcggccagccc

SEQ ID NO: 1140024 - RNA, 13 nt, Mycobacterium bovis subsp bovis AF2122/97
cgcggccagccca

SEQ ID NO: 1140025 - RNA, 14 nt, Mycobacterium bovis subsp bovis AF2122/97
cgcggccagcggga

SEQ ID NO: 1140026 - RNA, 17 nt, Mycobacterium bovis subsp bovis AF2122/97
cgcggccaguacgucga

SEQ ID NO: 1140027 - RNA, 16 nt, Mycobacterium bovis subsp bovis AF2122/97
cgcggccaguacgucg

SEQ ID NO: 1140028 - RNA, 18 nt, Mycobacterium bovis subsp bovis AF2122/97
cgcggcccacucucgcca

SEQ ID NO: 1140029 - RNA, 22 nt, Mycobacterium bovis subsp bovis AF2122/97
cgcggccauuagcagcacccgg

SEQ ID NO: 1140030 - RNA, 16 nt, Mycobacterium bovis subsp bovis AF2122/97
cgcggccauggcagcg

SEQ ID NO: 1140031 - RNA, 17 nt, Mycobacterium bovis subsp bovis AF2122/97
cgcggccaucgccgaca

SEQ ID NO: 1140032 - RNA, 18 nt, Mycobacterium bovis subsp bovis AF2122/97
cgcggccaucgccgacac

SEQ ID NO: 1140033 - RNA, 19 nt, Mycobacterium bovis subsp bovis AF2122/97
cgcggccaucgccgacacc

SEQ ID NO: 1140034 - RNA, 20 nt, Mycobacterium bovis subsp bovis AF2122/97
cgcggccccgccguugccgc

SEQ ID NO: 1140035 - RNA, 18 nt, Mycobacterium bovis subsp bovis AF2122/97
cgcggccccgacugccgc

SEQ ID NO: 1140036 - RNA, 19 nt, Mycobacterium bovis subsp bovis AF2122/97
cgcggccccgacugccgcg

SEQ ID NO: 1140037 - RNA, 20 nt, Mycobacterium bovis subsp bovis AF2122/97
cgcggccgaaagagccagcg

SEQ ID NO: 1140038 - RNA, 15 nt, Mycobacterium bovis subsp bovis AF2122/97
cgcggccgagacggc

SEQ ID NO: 1140039 - RNA, 15 nt, Mycobacterium bovis subsp bovis AF2122/97
cgcggccgaggucgc

SEQ ID NO: 1140040 - RNA, 16 nt, Mycobacterium bovis subsp bovis AF2122/97
cgcggccgaggucacc

SEQ ID NO: 1140041 - RNA, 17 nt, Mycobacterium bovis subsp bovis AF2122/97
cgcggccgaggucaccc

SEQ ID NO: 1140042 - RNA, 20 nt, Mycobacterium bovis subsp bovis AF2122/97
cgcggccgaggucacccggu

SEQ ID NO: 1140043 - RNA, 21 nt, Mycobacterium bovis subsp bovis AF2122/97
cgcggcgacaagccgagcccg

SEQ ID NO: 1140044 - RNA, 17 nt, Mycobacterium bovis subsp bovis AF2122/97
cgcggcgaagauaucgg

SEQ ID NO: 1140045 - RNA, 19 nt, Mycobacterium bovis subsp bovis AF2122/97
cgcggcgaagugcacccgg

SEQ ID NO: 1140046 - RNA, 17 nt, Mycobacterium bovis subsp bovis AF2122/97
cgcggcgaagccgggug

SEQ ID NO: 1140047 - RNA, 19 nt, Mycobacterium bovis subsp bovis AF2122/97
cgcggccuuggcggccgcg

SEQ ID NO: 1140048 - RNA, 21 nt, Mycobacterium bovis subsp bovis AF2122/97
cgcggccuuggcggccgcgac

SEQ ID NO: 1140049 - RNA, 20 nt, Mycobacterium bovis subsp bovis AF2122/97
cgcggccuugcgcacaggcg

SEQ ID NO: 1140050 - RNA, 21 nt, Mycobacterium bovis subsp bovis AF2122/97
cgcggccuugcgcacaggcgc

SEQ ID NO: 1140051 - RNA, 22 nt, Mycobacterium bovis subsp bovis AF2122/97
cgcggccuugcgcacaggcgcg

SEQ ID NO: 1140052 - RNA, 17 nt, Mycobacterium bovis subsp bovis AF2122/97
cgcggcgacgacggccu

SEQ ID NO: 1140053 - RNA, 13 nt, Mycobacterium bovis subsp bovis AF2122/97
cgcggcgaccugu

SEQ ID NO: 1140054 - RNA, 17 nt, Mycobacterium bovis subsp bovis AF2122/97
cgcggcgauuacggcca

SEQ ID NO: 1140055 - RNA, 18 nt, Mycobacterium bovis subsp bovis AF2122/97
cgcggccgaggucgcggu

SEQ ID NO: 1140056 - RNA, 17 nt, Mycobacterium bovis subsp bovis AF2122/97
cgcggccgaggucgcgg

SEQ ID NO: 1140057 - RNA, 13 nt, Mycobacterium bovis subsp bovis AF2122/97
cgcggccgcccca

SEQ ID NO: 1140058 - RNA, 13 nt, Mycobacterium bovis subsp bovis AF2122/97
cgcggccucgucg

SEQ ID NO: 1140059 - RNA, 20 nt, Mycobacterium bovis subsp bovis AF2122/97
cgcggccucguuguagccga

SEQ ID NO: 1140060 - RNA, 17 nt, Mycobacterium bovis subsp bovis AF2122/97
cgcggccugcaccagcg

SEQ ID NO: 1140061 - RNA, 20 nt, Mycobacterium bovis subsp bovis AF2122/97
cgcggccugcaccagcgagu

SEQ ID NO: 1140062 - RNA, 20 nt, Mycobacterium bovis subsp bovis AF2122/97
cgcggccgccguccccgccg

SEQ ID NO: 1140063 - RNA, 17 nt, Mycobacterium bovis subsp bovis AF2122/97
cgcggcgccgcaaugac

SEQ ID NO: 1140064 - RNA, 19 nt, Mycobacterium bovis subsp bovis AF2122/97
cgcggcgccgucgucagcg

SEQ ID NO: 1140065 - RNA, 14 nt, Mycobacterium bovis subsp bovis AF2122/97
cgcggcgccggugg

SEQ ID NO: 1140066 - RNA, 14 nt, Mycobacterium bovis subsp bovis AF2122/97
cgcggcggccagcg

SEQ ID NO: 1140067 - RNA, 14 nt, Mycobacterium bovis subsp bovis AF2122/97
cgcggcggcggcca

SEQ ID NO: 1140068 - RNA, 21 nt, Mycobacterium bovis subsp bovis AF2122/97
cgcggcgguuaucgucggguc

SEQ ID NO: 1140069 - RNA, 18 nt, Mycobacterium bovis subsp bovis AF2122/97
cgcggcgcagcaccgucg

SEQ ID NO: 1140070 - RNA, 19 nt, Mycobacterium bovis subsp bovis AF2122/97
cgcggcgacauccacaccg

SEQ ID NO: 1140071 - RNA, 17 nt, Mycobacterium bovis subsp bovis AF2122/97
cgcggcgagcaccaccc

SEQ ID NO: 1140072 - RNA, 17 nt, Mycobacterium bovis subsp bovis AF2122/97
cgcggcgcagcacggcg

SEQ ID NO: 1140073 - RNA, 20 nt, Mycobacterium bovis subsp bovis AF2122/97
cgcggcgcauuccggcgcca

SEQ ID NO: 1140074 - RNA, 18 nt, Mycobacterium bovis subsp bovis AF2122/97
cgcggcgcccuggccgcc

SEQ ID NO: 1140075 - RNA, 19 nt, Mycobacterium bovis subsp bovis AF2122/97
cgcggcgcccuggccgccc

SEQ ID NO: 1140076 - RNA, 14 nt, Mycobacterium bovis subsp bovis AF2122/97
cgcggcggccccgc

SEQ ID NO: 1140077 - RNA, 12 nt, Mycobacterium bovis subsp bovis AF2122/97
cgcggcgucgau

SEQ ID NO: 1140078 - RNA, 18 nt, Mycobacterium bovis subsp bovis AF2122/97
cgcggcuaggccaagccg

SEQ ID NO: 1140079 - RNA, 17 nt, Mycobacterium bovis subsp bovis AF2122/97
cgcggcuaggccagcac

SEQ ID NO: 1140080 - RNA, 23 nt, Mycobacterium bovis subsp bovis AF2122/97
cgcggcuccguuguccagcgcga

SEQ ID NO: 1140081 - RNA, 15 nt, Mycobacterium bovis subsp bovis AF2122/97
cgcggcuauggcgcc

SEQ ID NO: 1140082 - RNA, 16 nt, Mycobacterium bovis subsp bovis AF2122/97
cgcggcuauggcgccg

SEQ ID NO: 1140083 - RNA, 13 nt, Mycobacterium bovis subsp bovis AF2122/97
cgcggcucguugg

SEQ ID NO: 1140084 - RNA, 16 nt, Mycobacterium bovis subsp bovis AF2122/97
cgcggcugccagaaug

SEQ ID NO: 1140085 - RNA, 15 nt, Mycobacterium bovis subsp bovis AF2122/97
cgcggcugcguugug

SEQ ID NO: 1140086 - RNA, 18 nt, Mycobacterium bovis subsp bovis AF2122/97
cgcggcugcgucgucugc

SEQ ID NO: 1140087 - RNA, 13 nt, Mycobacterium bovis subsp bovis AF2122/97
cgcgggaucggug

SEQ ID NO: 1140088 - RNA, 19 nt, Mycobacterium bovis subsp bovis AF2122/97
cgcggcuuccccgguagcg

SEQ ID NO: 1140089 - RNA, 21 nt, Mycobacterium bovis subsp bovis AF2122/97
cgcggcuuggccuagccgcgg

SEQ ID NO: 1140090 - RNA, 16 nt, Mycobacterium bovis subsp bovis AF2122/97
cgcggcuggugucggg

SEQ ID NO: 1140091 - RNA, 19 nt, Mycobacterium bovis subsp bovis AF2122/97
cgcggcuucaguccggccc

SEQ ID NO: 1140092 - RNA, 20 nt, Mycobacterium bovis subsp bovis AF2122/97
cgcggcuucaguccggcccc

SEQ ID NO: 1140093 - RNA, 20 nt, Mycobacterium bovis subsp bovis AF2122/97
cgcggcugggggauaccgcu

SEQ ID NO: 1140094 - RNA, 14 nt, Mycobacterium bovis subsp bovis AF2122/97
cgcugcgcgcccac

SEQ ID NO: 1140095 - RNA, 18 nt, Mycobacterium bovis subsp bovis AF2122/97
cgcugcggguagccgucg

SEQ ID NO: 1140096 - RNA, 22 nt, Mycobacterium bovis subsp bovis AF2122/97
cgcugcggguagccgucgaucc

SEQ ID NO: 1140097 - RNA, 15 nt, Mycobacterium bovis subsp bovis AF2122/97
cgcugcgggucccaa

SEQ ID NO: 1140098 - RNA, 16 nt, Mycobacterium bovis subsp bovis AF2122/97
cgcugcgucguggaga

SEQ ID NO: 1140099 - RNA, 12 nt, Mycobacterium bovis subsp bovis AF2122/97
cgcugcggugga

SEQ ID NO: 1140100 - RNA, 17 nt, Mycobacterium bovis subsp bovis AF2122/97
cgcugcggugggccagg

SEQ ID NO: 1140101 - RNA, 22 nt, Mycobacterium bovis subsp bovis AF2122/97
cgcugcgggucccaaucgucgg

SEQ ID NO: 1140102 - RNA, 21 nt, Mycobacterium bovis subsp bovis AF2122/97
cgcugcgggucgaagcgaucc

SEQ ID NO: 1140103 - RNA, 17 nt, Mycobacterium bovis subsp bovis AF2122/97
cgcugcugaacaaccag

SEQ ID NO: 1140104 - RNA, 14 nt, Mycobacterium bovis subsp bovis AF2122/97
cgcugcucgacggu

SEQ ID NO: 1140105 - RNA, 22 nt, Mycobacterium bovis subsp bovis AF2122/97
cgcugcggcggcuuuggccgcc

SEQ ID NO: 1140106 - RNA, 13 nt, Mycobacterium bovis subsp bovis AF2122/97
cgcugcggcaccg

SEQ ID NO: 1140107 - RNA, 13 nt, Mycobacterium bovis subsp bovis AF2122/97
cgcugcggccagc

SEQ ID NO: 1140108 - RNA, 14 nt, Mycobacterium bovis subsp bovis AF2122/97
cgcugcggccagcg

SEQ ID NO: 1140109 - RNA, 22 nt, Mycobacterium bovis subsp bovis AF2122/97
cgcugcggcccacaccagcgca

SEQ ID NO: 1140110 - RNA, 12 nt, Mycobacterium bovis subsp bovis AF2122/97
cgcugcggcccg

SEQ ID NO: 1140111 - RNA, 13 nt, Mycobacterium bovis subsp bovis AF2122/97
cgcugcgcgacga

SEQ ID NO: 1140112 - RNA, 20 nt, Mycobacterium bovis subsp bovis AF2122/97
cgcugcgcgaaucgcgucga

SEQ ID NO: 1140113 - RNA, 14 nt, Mycobacterium bovis subsp bovis AF2122/97
cgcugcugcgaucg

SEQ ID NO: 1140114 - RNA, 20 nt, Mycobacterium bovis subsp bovis AF2122/97
cgcugcugcgaucgccgcgc

SEQ ID NO: 1140115 - RNA, 14 nt, Mycobacterium bovis subsp bovis AF2122/97
cgcugcugucgauu

SEQ ID NO: 1140116 - RNA, 21 nt, Mycobacterium bovis subsp bovis AF2122/97
cgcuggaaaccucuucgggug

SEQ ID NO: 1140117 - RNA, 19 nt, Mycobacterium bovis subsp bovis AF2122/97
cgcuggaacuuggcgucga

SEQ ID NO: 1140118 - RNA, 20 nt, Mycobacterium bovis subsp bovis AF2122/97
cgcuggaaugcggucgauag

SEQ ID NO: 1140119 - RNA, 23 nt, Mycobacterium bovis subsp bovis AF2122/97
cgcuggacaguuacgcuggcaca

SEQ ID NO: 1140120 - RNA, 23 nt, Mycobacterium bovis subsp bovis AF2122/97
cgcuggaccugaugagcucaccg

SEQ ID NO: 1140121 - RNA, 13 nt, Mycobacterium bovis subsp bovis AF2122/97
cgcuggacggcgg

SEQ ID NO: 1140122 - RNA, 13 nt, Mycobacterium bovis subsp bovis AF2122/97
cgcuggcccggcg

SEQ ID NO: 1140123 - RNA, 15 nt, Mycobacterium bovis subsp bovis AF2122/97
cgcuggcccggcgcu

SEQ ID NO: 1140124 - RNA, 20 nt, Mycobacterium bovis subsp bovis AF2122/97
cgcuggcccgccagaacggc

SEQ ID NO: 1140125 - RNA, 15 nt, Mycobacterium bovis subsp bovis AF2122/97
cgcuggccauggugg

SEQ ID NO: 1140126 - RNA, 14 nt, Mycobacterium bovis subsp bovis AF2122/97
cgcuggcaggccgg

SEQ ID NO: 1140127 - RNA, 17 nt, Mycobacterium bovis subsp bovis AF2122/97
cgcuggccagcacaccg

SEQ ID NO: 1140128 - RNA, 20 nt, Mycobacterium bovis subsp bovis AF2122/97
cgcuggccagcacaccgucg

SEQ ID NO: 1140129 - RNA, 13 nt, Mycobacterium bovis subsp bovis AF2122/97
cgcuggccagccc

SEQ ID NO: 1140130 - RNA, 16 nt, Mycobacterium bovis subsp bovis AF2122/97
cgcuggacggcgggcc

SEQ ID NO: 1140131 - RNA, 17 nt, Mycobacterium bovis subsp bovis AF2122/97
cgcuggacggcgggccg

SEQ ID NO: 1140132 - RNA, 19 nt, Mycobacterium bovis subsp bovis AF2122/97
cgcuggaggcuccuggucg

SEQ ID NO: 1140133 - RNA, 22 nt, Mycobacterium bovis subsp bovis AF2122/97
cgcuggaggcuccuggucgccg

SEQ ID NO: 1140134 - RNA, 21 nt, Mycobacterium bovis subsp bovis AF2122/97
cgcuggaggacccgcuacgac

SEQ ID NO: 1140135 - RNA, 17 nt, Mycobacterium bovis subsp bovis AF2122/97
cgcuggagaucacgccg

SEQ ID NO: 1140136 - RNA, 15 nt, Mycobacterium bovis subsp bovis AF2122/97
cgcuggaucaacccg

SEQ ID NO: 1140137 - RNA, 13 nt, Mycobacterium bovis subsp bovis AF2122/97
cgcuggaucgcgu

SEQ ID NO: 1140138 - RNA, 13 nt, Mycobacterium bovis subsp bovis AF2122/97
cgcugggccgggg

SEQ ID NO: 1140139 - RNA, 15 nt, Mycobacterium bovis subsp bovis AF2122/97
cgcugggccgaccgc

SEQ ID NO: 1140140 - RNA, 21 nt, Mycobacterium bovis subsp bovis AF2122/97
cgcuggggcuguagucgaugu

SEQ ID NO: 1140141 - RNA, 18 nt, Mycobacterium bovis subsp bovis AF2122/97
cgcugggguccgcgucgg

SEQ ID NO: 1140142 - RNA, 19 nt, Mycobacterium bovis subsp bovis AF2122/97
cgcugggcgcgcucaucga

SEQ ID NO: 1140143 - RNA, 14 nt, Mycobacterium bovis subsp bovis AF2122/97
cgcugggcgguagc

SEQ ID NO: 1140144 - RNA, 18 nt, Mycobacterium bovis subsp bovis AF2122/97
cgcugggugaccaggaag

SEQ ID NO: 1140145 - RNA, 23 nt, Mycobacterium bovis subsp bovis AF2122/97
cgcuggguccccucccaccagcg

SEQ ID NO: 1140146 - RNA, 22 nt, Mycobacterium bovis subsp bovis AF2122/97
cgcugggucgugucgccacacc

SEQ ID NO: 1140147 - RNA, 23 nt, Mycobacterium bovis subsp bovis AF2122/97
cgcugggucgugucgccacaccg

SEQ ID NO: 1140148 - RNA, 19 nt, Mycobacterium bovis subsp bovis AF2122/97
cgcuggucaacuccacgcg

SEQ ID NO: 1140149 - RNA, 19 nt, Mycobacterium bovis subsp bovis AF2122/97
cgcugguauagcucacggu

SEQ ID NO: 1140150 - RNA, 22 nt, Mycobacterium bovis subsp bovis AF2122/97
cgcugguauagcucacgguggc

SEQ ID NO: 1140151 - RNA, 19 nt, Mycobacterium bovis subsp bovis AF2122/97
cgcugggaggcgcggucga

SEQ ID NO: 1140152 - RNA, 21 nt, Mycobacterium bovis subsp bovis AF2122/97
cgcugggaggcgcggucgacc

SEQ ID NO: 1140153 - RNA, 13 nt, Mycobacterium bovis subsp bovis AF2122/97
cgcugggacgggc

SEQ ID NO: 1140154 - RNA, 14 nt, Mycobacterium bovis subsp bovis AF2122/97
cgcugggacggucg

SEQ ID NO: 1140155 - RNA, 16 nt, Mycobacterium bovis subsp bovis AF2122/97
cgcuggcugacaccga

SEQ ID NO: 1140156 - RNA, 18 nt, Mycobacterium bovis subsp bovis AF2122/97
cgcugggaaaucccgacc

SEQ ID NO: 1140157 - RNA, 21 nt, Mycobacterium bovis subsp bovis AF2122/97
cgcugggacggucgcucggca

SEQ ID NO: 1140158 - RNA, 19 nt, Mycobacterium bovis subsp bovis AF2122/97
cgcuggcuacccaccggcc

SEQ ID NO: 1140159 - RNA, 20 nt, Mycobacterium bovis subsp bovis AF2122/97
cgcuggcuacccaccggccg

SEQ ID NO: 1140160 - RNA, 14 nt, Mycobacterium bovis subsp bovis AF2122/97
cgcuggcucaucga

SEQ ID NO: 1140161 - RNA, 18 nt, Mycobacterium bovis subsp bovis AF2122/97
cgcuggcuugggccagcg

SEQ ID NO: 1140162 - RNA, 12 nt, Mycobacterium bovis subsp bovis AF2122/97
cgcuggcgucgu

SEQ ID NO: 1140163 - RNA, 19 nt, Mycobacterium bovis subsp bovis AF2122/97
cgcuggcguuguugacgau

SEQ ID NO: 1140164 - RNA, 15 nt, Mycobacterium bovis subsp bovis AF2122/97
cgcuggcgccggcca

SEQ ID NO: 1140165 - RNA, 18 nt, Mycobacterium bovis subsp bovis AF2122/97
cgcuggcgccggccagcc

SEQ ID NO: 1140166 - RNA, 14 nt, Mycobacterium bovis subsp bovis AF2122/97
cgcuggcgcccccg

SEQ ID NO: 1140167 - RNA, 21 nt, Mycobacterium bovis subsp bovis AF2122/97
cgcuggcgcccccgacgacgg

SEQ ID NO: 1140168 - RNA, 19 nt, Mycobacterium bovis subsp bovis AF2122/97
cgcuggcgcccuugccggc

SEQ ID NO: 1140169 - RNA, 20 nt, Mycobacterium bovis subsp bovis AF2122/97
cgcuggcgcccuugccggcg

SEQ ID NO: 1140170 - RNA, 16 nt, Mycobacterium bovis subsp bovis AF2122/97
cgcuggccuccagcuu

SEQ ID NO: 1140171 - RNA, 14 nt, Mycobacterium bovis subsp bovis AF2122/97
cgcuggccucgucg

SEQ ID NO: 1140172 - RNA, 13 nt, Mycobacterium bovis subsp bovis AF2122/97
cgcuggccggcac

SEQ ID NO: 1140173 - RNA, 20 nt, Mycobacterium bovis subsp bovis AF2122/97
cgcuggccaugguggcgccg

SEQ ID NO: 1140174 - RNA, 19 nt, Mycobacterium bovis subsp bovis AF2122/97
cgcuggcgagcagacgcga

SEQ ID NO: 1140175 - RNA, 19 nt, Mycobacterium bovis subsp bovis AF2122/97
cgcuggccgucgaagacga

SEQ ID NO: 1140176 - RNA, 18 nt, Mycobacterium bovis subsp bovis AF2122/97
cgcugcgccgaggcauug

SEQ ID NO: 1140177 - RNA, 14 nt, Mycobacterium bovis subsp bovis AF2122/97
cgcugcgcaccgcc

SEQ ID NO: 1140178 - RNA, 15 nt, Mycobacterium bovis subsp bovis AF2122/97
cgcugcgcaccgccg

SEQ ID NO: 1140179 - RNA, 20 nt, Mycobacterium bovis subsp bovis AF2122/97
cgcugcgaugcugaucaccg

SEQ ID NO: 1140180 - RNA, 13 nt, Mycobacterium bovis subsp bovis AF2122/97
cgcugcgaucacc

SEQ ID NO: 1140181 - RNA, 18 nt, Mycobacterium bovis subsp bovis AF2122/97
cgcugcgaugcugaucac

SEQ ID NO: 1140182 - RNA, 22 nt, Mycobacterium bovis subsp bovis AF2122/97
cgcugcgagaucgcggcgaccc

SEQ ID NO: 1140183 - RNA, 18 nt, Mycobacterium bovis subsp bovis AF2122/97
cgcugcgaaagcacgugc

SEQ ID NO: 1140184 - RNA, 21 nt, Mycobacterium bovis subsp bovis AF2122/97
cgcugccuucuuugccggcgc

SEQ ID NO: 1140185 - RNA, 17 nt, Mycobacterium bovis subsp bovis AF2122/97
cgcugccuuggcgcggc

SEQ ID NO: 1140186 - RNA, 15 nt, Mycobacterium bovis subsp bovis AF2122/97
cgcugccuggccggg

SEQ ID NO: 1140187 - RNA, 18 nt, Mycobacterium bovis subsp bovis AF2122/97
cgcugccucuugcucggc

SEQ ID NO: 1140188 - RNA, 15 nt, Mycobacterium bovis subsp bovis AF2122/97
cgcugccgccggugc

SEQ ID NO: 1140189 - RNA, 20 nt, Mycobacterium bovis subsp bovis AF2122/97
cgcugccgccggugccgccg

SEQ ID NO: 1140190 - RNA, 17 nt, Mycobacterium bovis subsp bovis AF2122/97
cgcugccgcgcggcgag

SEQ ID NO: 1140191 - RNA, 13 nt, Mycobacterium bovis subsp bovis AF2122/97
cgcugccggccgc

SEQ ID NO: 1140192 - RNA, 14 nt, Mycobacterium bovis subsp bovis AF2122/97
cgcugccggcacgc

SEQ ID NO: 1140193 - RNA, 19 nt, Mycobacterium bovis subsp bovis AF2122/97
cgcugccggcgccgccacu

SEQ ID NO: 1140194 - RNA, 21 nt, Mycobacterium bovis subsp bovis AF2122/97
cgcugccggcgccgccacugc

SEQ ID NO: 1140195 - RNA, 23 nt, Mycobacterium bovis subsp bovis AF2122/97
cgcugccgguagcacagcagcaa

SEQ ID NO: 1140196 - RNA, 17 nt, Mycobacterium bovis subsp bovis AF2122/97
cgcugccggcugacgac

SEQ ID NO: 1140197 - RNA, 13 nt, Mycobacterium bovis subsp bovis AF2122/97
cgcugccggcgcc

SEQ ID NO: 1140198 - RNA, 12 nt, Mycobacterium bovis subsp bovis AF2122/97
cgcugccggugu

SEQ ID NO: 1140199 - RNA, 16 nt, Mycobacterium bovis subsp bovis AF2122/97
cgcugccggugucucc

SEQ ID NO: 1140200 - RNA, 19 nt, Mycobacterium bovis subsp bovis AF2122/97
cgcugcccaucacacccgg

SEQ ID NO: 1140201 - RNA, 20 nt, Mycobacterium bovis subsp bovis AF2122/97
cgcugcccaucacacccggu

SEQ ID NO: 1140202 - RNA, 21 nt, Mycobacterium bovis subsp bovis AF2122/97
cgcugcccaucacacccggua

SEQ ID NO: 1140203 - RNA, 18 nt, Mycobacterium bovis subsp bovis AF2122/97
cgcugcccgggcugccgc

SEQ ID NO: 1140204 - RNA, 19 nt, Mycobacterium bovis subsp bovis AF2122/97
cgcugcccgggcugccgcc

SEQ ID NO: 1140205 - RNA, 22 nt, Mycobacterium bovis subsp bovis AF2122/97
cgcugccgccgccggcggucgc

SEQ ID NO: 1140206 - RNA, 15 nt, Mycobacterium bovis subsp bovis AF2122/97
cgcugccgccgccgg

SEQ ID NO: 1140207 - RNA, 12 nt, Mycobacterium bovis subsp bovis AF2122/97
cgcugccgccgc

SEQ ID NO: 1140208 - RNA, 14 nt, Mycobacterium bovis subsp bovis AF2122/97
cgcugccgaucagu

SEQ ID NO: 1140209 - RNA, 12 nt, Mycobacterium bovis subsp bovis AF2122/97
cgcugccgccga

SEQ ID NO: 1140210 - RNA, 15 nt, Mycobacterium bovis subsp bovis AF2122/97
cgcugccgccgaucg

SEQ ID NO: 1140211 - RNA, 14 nt, Mycobacterium bovis subsp bovis AF2122/97
cgcugccgacgcgu

SEQ ID NO: 1140212 - RNA, 21 nt, Mycobacterium bovis subsp bovis AF2122/97
cgcugccgaagcggccaccgc

SEQ ID NO: 1140213 - RNA, 14 nt, Mycobacterium bovis subsp bovis AF2122/97
cgcugccgcccgcg

SEQ ID NO: 1140214 - RNA, 13 nt, Mycobacterium bovis subsp bovis AF2122/97
cgcugccgcccuu

SEQ ID NO: 1140215 - RNA, 16 nt, Mycobacterium bovis subsp bovis AF2122/97
cgcugccaauccgauc

SEQ ID NO: 1140216 - RNA, 15 nt, Mycobacterium bovis subsp bovis AF2122/97
cgcugccacagguga

SEQ ID NO: 1140217 - RNA, 19 nt, Mycobacterium bovis subsp bovis AF2122/97
cgcugccacuagcauuguc

SEQ ID NO: 1140218 - RNA, 14 nt, Mycobacterium bovis subsp bovis AF2122/97
cgcugccaccgcgg

SEQ ID NO: 1140219 - RNA, 19 nt, Mycobacterium bovis subsp bovis AF2122/97
cgcugccaccgcgguggcg

SEQ ID NO: 1140220 - RNA, 21 nt, Mycobacterium bovis subsp bovis AF2122/97
cgcugccaccgcgguggcggc

SEQ ID NO: 1140221 - RNA, 18 nt, Mycobacterium bovis subsp bovis AF2122/97
cgcugccagcggccgggc

SEQ ID NO: 1140222 - RNA, 19 nt, Mycobacterium bovis subsp bovis AF2122/97
cgcugccagcggccgggcg

SEQ ID NO: 1140223 - RNA, 14 nt, Mycobacterium bovis subsp bovis AF2122/97
cgcugcccacgggc

SEQ ID NO: 1140224 - RNA, 19 nt, Mycobacterium bovis subsp bovis AF2122/97
cgcugcccacgggccggcc

SEQ ID NO: 1140225 - RNA, 20 nt, Mycobacterium bovis subsp bovis AF2122/97
cgcugcccacgggccggccg

SEQ ID NO: 1140226 - RNA, 19 nt, Mycobacterium bovis subsp bovis AF2122/97
cgcugcccaaaagcgcggc

SEQ ID NO: 1140227 - RNA, 13 nt, Mycobacterium bovis subsp bovis AF2122/97
cgcugccagcggc

SEQ ID NO: 1140228 - RNA, 19 nt, Mycobacterium bovis subsp bovis AF2122/97
cgcugccaucggcaccagc

SEQ ID NO: 1140229 - RNA, 22 nt, Mycobacterium bovis subsp bovis AF2122/97
cgcugccaucggcaccagcgcg

SEQ ID NO: 1140230 - RNA, 21 nt, Mycobacterium bovis subsp bovis AF2122/97
cgcugccagggugcgccgguc

SEQ ID NO: 1140231 - RNA, 19 nt, Mycobacterium bovis subsp bovis AF2122/97
cgcugaucagauccucgac

SEQ ID NO: 1140232 - RNA, 22 nt, Mycobacterium bovis subsp bovis AF2122/97
cgcugauaguggcgcgcggcgc

SEQ ID NO: 1140233 - RNA, 20 nt, Mycobacterium bovis subsp bovis AF2122/97
cgcugaucagcaugcggcca

SEQ ID NO: 1140234 - RNA, 19 nt, Mycobacterium bovis subsp bovis AF2122/97
cgcugauccacgauaucga

SEQ ID NO: 1140235 - RNA, 22 nt, Mycobacterium bovis subsp bovis AF2122/97
cgcugaucaggucuucgauggc

SEQ ID NO: 1140236 - RNA, 12 nt, Mycobacterium bovis subsp bovis AF2122/97
cgcugauccggg

SEQ ID NO: 1140237 - RNA, 18 nt, Mycobacterium bovis subsp bovis AF2122/97
cgcucgaccccgcgcugg

SEQ ID NO: 1140238 - RNA, 22 nt, Mycobacterium bovis subsp bovis AF2122/97
cgcugagguggcggugcggcga

SEQ ID NO: 1140239 - RNA, 23 nt, Mycobacterium bovis subsp bovis AF2122/97
cgcugagguggcggugcggcgag

SEQ ID NO: 1140240 - RNA, 17 nt, Mycobacterium bovis subsp bovis AF2122/97
cgcugauagcggucggu

SEQ ID NO: 1140241 - RNA, 22 nt, Mycobacterium bovis subsp bovis AF2122/97
cgcugauagcggucggucacca

SEQ ID NO: 1140242 - RNA, 17 nt, Mycobacterium bovis subsp bovis AF2122/97
cgcuccgcggcgcagca

SEQ ID NO: 1140243 - RNA, 14 nt, Mycobacterium bovis subsp bovis AF2122/97
cgcucgaccagacg

SEQ ID NO: 1140244 - RNA, 21 nt, Mycobacterium bovis subsp bovis AF2122/97
cgcucgaaagcgucgaucacc

SEQ ID NO: 1140245 - RNA, 17 nt, Mycobacterium bovis subsp bovis AF2122/97
cgcucgaaaaccucgga

SEQ ID NO: 1140246 - RNA, 20 nt, Mycobacterium bovis subsp bovis AF2122/97
cgcuccuucagggcgucgaa

SEQ ID NO: 1140247 - RNA, 14 nt, Mycobacterium bovis subsp bovis AF2122/97
cgcuccuccggcac

SEQ ID NO: 1140248 - RNA, 18 nt, Mycobacterium bovis subsp bovis AF2122/97
cgcuccuccggcaccaac

SEQ ID NO: 1140249 - RNA, 22 nt, Mycobacterium bovis subsp bovis AF2122/97
cgcuccgccggguuggcgccgg

SEQ ID NO: 1140250 - RNA, 16 nt, Mycobacterium bovis subsp bovis AF2122/97
cgcugauugcggucgu

SEQ ID NO: 1140251 - RNA, 18 nt, Mycobacterium bovis subsp bovis AF2122/97
cgcugauugcggucgucc

SEQ ID NO: 1140252 - RNA, 21 nt, Mycobacterium bovis subsp bovis AF2122/97
cgcugcaaccgccggugccga

SEQ ID NO: 1140253 - RNA, 15 nt, Mycobacterium bovis subsp bovis AF2122/97
cgcugaucggcaggg

SEQ ID NO: 1140254 - RNA, 20 nt, Mycobacterium bovis subsp bovis AF2122/97
cgcugaucuggggcaccacg

SEQ ID NO: 1140255 - RNA, 20 nt, Mycobacterium bovis subsp bovis AF2122/97
cgcugaugaccguauagccg

SEQ ID NO: 1140256 - RNA, 16 nt, Mycobacterium bovis subsp bovis AF2122/97
cgcugaugcaucccaa

SEQ ID NO: 1140257 - RNA, 21 nt, Mycobacterium bovis subsp bovis AF2122/97
cgcugaucuuccccucggccg

SEQ ID NO: 1140258 - RNA, 12 nt, Mycobacterium bovis subsp bovis AF2122/97
cgcugcacgugg

SEQ ID NO: 1140259 - RNA, 23 nt, Mycobacterium bovis subsp bovis AF2122/97
cgcugcaccgggucaacgccauc

SEQ ID NO: 1140260 - RNA, 15 nt, Mycobacterium bovis subsp bovis AF2122/97
cgcugcacgacaucg

SEQ ID NO: 1140261 - RNA, 12 nt, Mycobacterium bovis subsp bovis AF2122/97
cgcugcacgccg

SEQ ID NO: 1140262 - RNA, 22 nt, Mycobacterium bovis subsp bovis AF2122/97
cgcugcauccgcagcaccaagg

SEQ ID NO: 1140263 - RNA, 20 nt, Mycobacterium bovis subsp bovis AF2122/97
cgcugcagcugcucgucgug

SEQ ID NO: 1140264 - RNA, 15 nt, Mycobacterium bovis subsp bovis AF2122/97
cgcugcaggcggccg

SEQ ID NO: 1140265 - RNA, 21 nt, Mycobacterium bovis subsp bovis AF2122/97
cgcugcagugguaccggcgcc

SEQ ID NO: 1140266 - RNA, 22 nt, Mycobacterium bovis subsp bovis AF2122/97
cgcugcagugguaccggcgccg

SEQ ID NO: 1140267 - RNA, 14 nt, Mycobacterium bovis subsp bovis AF2122/97
cgcuucgcccuugc

SEQ ID NO: 1140268 - RNA, 14 nt, Mycobacterium bovis subsp bovis AF2122/97
cgcuucgccacacc

SEQ ID NO: 1140269 - RNA, 19 nt, Mycobacterium bovis subsp bovis AF2122/97
cgcuucgccacaccaugau

SEQ ID NO: 1140270 - RNA, 20 nt, Mycobacterium bovis subsp bovis AF2122/97
cgcuucgcaagucauccagg

SEQ ID NO: 1140271 - RNA, 17 nt, Mycobacterium bovis subsp bovis AF2122/97
cgcuucgacgucguugc

SEQ ID NO: 1140272 - RNA, 21 nt, Mycobacterium bovis subsp bovis AF2122/97
cgcuucgacgucguugccguc

SEQ ID NO: 1140273 - RNA, 15 nt, Mycobacterium bovis subsp bovis AF2122/97
cgcuuccucguaggc

SEQ ID NO: 1140274 - RNA, 18 nt, Mycobacterium bovis subsp bovis AF2122/97
cgcuucccggaagcgccg

SEQ ID NO: 1140275 - RNA, 21 nt, Mycobacterium bovis subsp bovis AF2122/97
cgcuuccguggcccaacccgg

SEQ ID NO: 1140276 - RNA, 15 nt, Mycobacterium bovis subsp bovis AF2122/97
cgcuuccaucgccac

SEQ ID NO: 1140277 - RNA, 19 nt, Mycobacterium bovis subsp bovis AF2122/97
cgcuucaggcaccggauga

SEQ ID NO: 1140278 - RNA, 14 nt, Mycobacterium bovis subsp bovis AF2122/97
cgcuucaggcgcca

SEQ ID NO: 1140279 - RNA, 14 nt, Mycobacterium bovis subsp bovis AF2122/97
cgcuuacccagccc

SEQ ID NO: 1140280 - RNA, 18 nt, Mycobacterium bovis subsp bovis AF2122/97
cgcuucacagccaccagc

SEQ ID NO: 1140281 - RNA, 16 nt, Mycobacterium bovis subsp bovis AF2122/97
cgcuucggcggucagc

SEQ ID NO: 1140282 - RNA, 17 nt, Mycobacterium bovis subsp bovis AF2122/97
cgcuucggcggucgccg

SEQ ID NO: 1140283 - RNA, 20 nt, Mycobacterium bovis subsp bovis AF2122/97
cgcuucgucggccggcaccc

SEQ ID NO: 1140284 - RNA, 23 nt, Mycobacterium bovis subsp bovis AF2122/97
cgcuucuugguugaacuggcggu

SEQ ID NO: 1140285 - RNA, 23 nt, Mycobacterium bovis subsp bovis AF2122/97
cgcuugccccgccgagcaccggg

SEQ ID NO: 1140286 - RNA, 15 nt, Mycobacterium bovis subsp bovis AF2122/97
cgcuugccccgccuu

SEQ ID NO: 1140287 - RNA, 17 nt, Mycobacterium bovis subsp bovis AF2122/97
cgcuugcccgcgcagca

SEQ ID NO: 1140288 - RNA, 17 nt, Mycobacterium bovis subsp bovis AF2122/97
cgcuugccgcugagccc

SEQ ID NO: 1140289 - RNA, 16 nt, Mycobacterium bovis subsp bovis AF2122/97
cgcuugcgaccccggc

SEQ ID NO: 1140290 - RNA, 20 nt, Mycobacterium bovis subsp bovis AF2122/97
cgcuugcgaccccggcugcg

SEQ ID NO: 1140291 - RNA, 18 nt, Mycobacterium bovis subsp bovis AF2122/97
cgcuugaccccuggccgc

SEQ ID NO: 1140292 - RNA, 19 nt, Mycobacterium bovis subsp bovis AF2122/97
cgcuugaccccuggccgcc

SEQ ID NO: 1140293 - RNA, 18 nt, Mycobacterium bovis subsp bovis AF2122/97
cgcuugacccgcggaccg

SEQ ID NO: 1140294 - RNA, 21 nt, Mycobacterium bovis subsp bovis AF2122/97
cgcuugaagguucgaucgcgg

SEQ ID NO: 1140295 - RNA, 22 nt, Mycobacterium bovis subsp bovis AF2122/97
cgcuugaucugggcugcggccg

SEQ ID NO: 1140296 - RNA, 23 nt, Mycobacterium bovis subsp bovis AF2122/97
cgcuugaucugggcugcggccgc

SEQ ID NO: 1140297 - RNA, 13 nt, Mycobacterium bovis subsp bovis AF2122/97
cgcuugcaccagg

SEQ ID NO: 1140298 - RNA, 23 nt, Mycobacterium bovis subsp bovis AF2122/97
cgcuguuguggaacaccgcggca

SEQ ID NO: 1140299 - RNA, 13 nt, Mycobacterium bovis subsp bovis AF2122/97
cgcuguuggccgg

SEQ ID NO: 1140300 - RNA, 14 nt, Mycobacterium bovis subsp bovis AF2122/97
cgcuguuccucgag

SEQ ID NO: 1140301 - RNA, 17 nt, Mycobacterium bovis subsp bovis AF2122/97
cgcuguugccaucgacg

SEQ ID NO: 1140302 - RNA, 17 nt, Mycobacterium bovis subsp bovis AF2122/97
cgcuguugcuggcgccc

SEQ ID NO: 1140303 - RNA, 22 nt, Mycobacterium bovis subsp bovis AF2122/97
cgcugugggcuuugccgucgag

SEQ ID NO: 1140304 - RNA, 16 nt, Mycobacterium bovis subsp bovis AF2122/97
cgcugugggucgaucc

SEQ ID NO: 1140305 - RNA, 17 nt, Mycobacterium bovis subsp bovis AF2122/97
cgcugucguaccgcucg

SEQ ID NO: 1140306 - RNA, 17 nt, Mycobacterium bovis subsp bovis AF2122/97
cgcugucgcccucgauc

SEQ ID NO: 1140307 - RNA, 15 nt, Mycobacterium bovis subsp bovis AF2122/97
cgcugucggcaguag

SEQ ID NO: 1140308 - RNA, 16 nt, Mycobacterium bovis subsp bovis AF2122/97
cgcugucggcaguagc

SEQ ID NO: 1140309 - RNA, 18 nt, Mycobacterium bovis subsp bovis AF2122/97
cgcugguggcgccauccc

SEQ ID NO: 1140310 - RNA, 23 nt, Mycobacterium bovis subsp bovis AF2122/97
cgcugguggcgccauccccgccg

SEQ ID NO: 1140311 - RNA, 16 nt, Mycobacterium bovis subsp bovis AF2122/97
cgcugguggcggcgac

SEQ ID NO: 1140312 - RNA, 18 nt, Mycobacterium bovis subsp bovis AF2122/97
cgcugguggcggucacca

SEQ ID NO: 1140313 - RNA, 24 nt, Mycobacterium bovis subsp bovis AF2122/97
cgcugguggcggucaccacgcggc

SEQ ID NO: 1140314 - RNA, 19 nt, Mycobacterium bovis subsp bovis AF2122/97
cgcugguggucagcaccca

SEQ ID NO: 1140315 - RNA, 14 nt, Mycobacterium bovis subsp bovis AF2122/97
cgcugguggugauu

SEQ ID NO: 1140316 - RNA, 19 nt, Mycobacterium bovis subsp bovis AF2122/97
cgcugguuugcuucucccg

SEQ ID NO: 1140317 - RNA, 18 nt, Mycobacterium bovis subsp bovis AF2122/97
cgcuguaagcaugccguu

SEQ ID NO: 1140318 - RNA, 15 nt, Mycobacterium bovis subsp bovis AF2122/97
cgcuggugcgccacg

SEQ ID NO: 1140319 - RNA, 19 nt, Mycobacterium bovis subsp bovis AF2122/97
cgcuggugcgccacgccac

SEQ ID NO: 1140320 - RNA, 20 nt, Mycobacterium bovis subsp bovis AF2122/97
cgcuggugcgccacgccacc

SEQ ID NO: 1140321 - RNA, 14 nt, Mycobacterium bovis subsp bovis AF2122/97
cgcuggugcgccca

SEQ ID NO: 1140322 - RNA, 16 nt, Mycobacterium bovis subsp bovis AF2122/97
cgcuggucgcgguggc

SEQ ID NO: 1140323 - RNA, 19 nt, Mycobacterium bovis subsp bovis AF2122/97
cgcuggucgcgguggcggc

SEQ ID NO: 1140324 - RNA, 22 nt, Mycobacterium bovis subsp bovis AF2122/97
cgcuggucgcaauggucguagg

SEQ ID NO: 1140325 - RNA, 18 nt, Mycobacterium bovis subsp bovis AF2122/97
cgcuggugaaccacucgg

SEQ ID NO: 1140326 - RNA, 17 nt, Mycobacterium bovis subsp bovis AF2122/97
cgcuggucggcggcuuc

SEQ ID NO: 1140327 - RNA, 20 nt, Mycobacterium bovis subsp bovis AF2122/97
cgcugucccgcgggccagca

SEQ ID NO: 1140328 - RNA, 15 nt, Mycobacterium bovis subsp bovis AF2122/97
cgcuguccgacuugu

SEQ ID NO: 1140329 - RNA, 18 nt, Mycobacterium bovis subsp bovis AF2122/97
cgcugucgagccggugcc

SEQ ID NO: 1140330 - RNA, 22 nt, Mycobacterium bovis subsp bovis AF2122/97
cgcugucgagccggugccgcgg

SEQ ID NO: 1140331 - RNA, 12 nt, Mycobacterium bovis subsp bovis AF2122/97
cgcugucgauca

SEQ ID NO: 1140332 - RNA, 17 nt, Mycobacterium bovis subsp bovis AF2122/97
cgcugucgaucagcgac

SEQ ID NO: 1140333 - RNA, 16 nt, Mycobacterium bovis subsp bovis AF2122/97
cgcuguaggccagccc

SEQ ID NO: 1140334 - RNA, 18 nt, Mycobacterium bovis subsp bovis AF2122/97
cgcuguaggccagcccgg

SEQ ID NO: 1140335 - RNA, 24 nt, Mycobacterium bovis subsp bovis AF2122/97
cgcugucaccccugggcggauggc

SEQ ID NO: 1140336 - RNA, 19 nt, Mycobacterium bovis subsp bovis AF2122/97
cgcugucaccguacggcca

SEQ ID NO: 1140337 - RNA, 15 nt, Mycobacterium bovis subsp bovis AF2122/97
cggaaggacggcagc

SEQ ID NO: 1140338 - RNA, 13 nt, Mycobacterium bovis subsp bovis AF2122/97
cggaaggcccggc

SEQ ID NO: 1140339 - RNA, 16 nt, Mycobacterium bovis subsp bovis AF2122/97
cggaaggcccggcgcg

SEQ ID NO: 1140340 - RNA, 16 nt, Mycobacterium bovis subsp bovis AF2122/97
cggaagcggcggcccu

SEQ ID NO: 1140341 - RNA, 19 nt, Mycobacterium bovis subsp bovis AF2122/97
cggaagcggcguucgaugc

SEQ ID NO: 1140342 - RNA, 13 nt, Mycobacterium bovis subsp bovis AF2122/97
cggaagcgggcga

SEQ ID NO: 1140343 - RNA, 15 nt, Mycobacterium bovis subsp bovis AF2122/97
cggaagcgccggccc

SEQ ID NO: 1140344 - RNA, 17 nt, Mycobacterium bovis subsp bovis AF2122/97
cggaagcgccggccgau

SEQ ID NO: 1140345 - RNA, 14 nt, Mycobacterium bovis subsp bovis AF2122/97
cggaagaagcagua

SEQ ID NO: 1140346 - RNA, 14 nt, Mycobacterium bovis subsp bovis AF2122/97
cggaacugggcccc

SEQ ID NO: 1140347 - RNA, 17 nt, Mycobacterium bovis subsp bovis AF2122/97
cggaacuugccggugcg

SEQ ID NO: 1140348 - RNA, 13 nt, Mycobacterium bovis subsp bovis AF2122/97
cggaagaccgcgg

SEQ ID NO: 1140349 - RNA, 21 nt, Mycobacterium bovis subsp bovis AF2122/97
cggaagaccgcgggaccuucg

SEQ ID NO: 1140350 - RNA, 23 nt, Mycobacterium bovis subsp bovis AF2122/97
cggaagcccuuguagcacaccga

SEQ ID NO: 1140351 - RNA, 19 nt, Mycobacterium bovis subsp bovis AF2122/97
cggaagaagcaguagcugc

SEQ ID NO: 1140352 - RNA, 19 nt, Mycobacterium bovis subsp bovis AF2122/97
cggaacgcgucgccgacgc

SEQ ID NO: 1140353 - RNA, 17 nt, Mycobacterium bovis subsp bovis AF2122/97
cggaaccguacgccaga

SEQ ID NO: 1140354 - RNA, 23 nt, Mycobacterium bovis subsp bovis AF2122/97
cggaaccguuugacgcgcucgcg

SEQ ID NO: 1140355 - RNA, 16 nt, Mycobacterium bovis subsp bovis AF2122/97
cggaacgggucguugc

SEQ ID NO: 1140356 - RNA, 18 nt, Mycobacterium bovis subsp bovis AF2122/97
cggaacucgucgcugccc

SEQ ID NO: 1140357 - RNA, 16 nt, Mycobacterium bovis subsp bovis AF2122/97
cggaacgagcggccgc

SEQ ID NO: 1140358 - RNA, 17 nt, Mycobacterium bovis subsp bovis AF2122/97
cggaacgagcggccgcg

SEQ ID NO: 1140359 - RNA, 11 nt, Mycobacterium bovis subsp bovis AF2122/97
cggaacgccau

SEQ ID NO: 1140360 - RNA, 19 nt, Mycobacterium bovis subsp bovis AF2122/97
cggaacgccgccagcgcgg

SEQ ID NO: 1140361 - RNA, 17 nt, Mycobacterium bovis subsp bovis AF2122/97
cggaacgccggcaccga

SEQ ID NO: 1140362 - RNA, 18 nt, Mycobacterium bovis subsp bovis AF2122/97
cggaaccgguaucgccaa

SEQ ID NO: 1140363 - RNA, 22 nt, Mycobacterium bovis subsp bovis AF2122/97
cggaaccccucgauucccggcg

SEQ ID NO: 1140364 - RNA, 14 nt, Mycobacterium bovis subsp bovis AF2122/97
cggaacccgagccg

SEQ ID NO: 1140365 - RNA, 19 nt, Mycobacterium bovis subsp bovis AF2122/97
cggaacccccagcugcagg

SEQ ID NO: 1140366 - RNA, 19 nt, Mycobacterium bovis subsp bovis AF2122/97
cggaaccaguugacgaaga

SEQ ID NO: 1140367 - RNA, 12 nt, Mycobacterium bovis subsp bovis AF2122/97
cggaaccagcgu

SEQ ID NO: 1140368 - RNA, 21 nt, Mycobacterium bovis subsp bovis AF2122/97
cggaaccagcguaucggccgg

SEQ ID NO: 1140369 - RNA, 16 nt, Mycobacterium bovis subsp bovis AF2122/97
cggaaucgucggcgcg

SEQ ID NO: 1140370 - RNA, 21 nt, Mycobacterium bovis subsp bovis AF2122/97
cggaaucgucgcggccgucgc

SEQ ID NO: 1140371 - RNA, 22 nt, Mycobacterium bovis subsp bovis AF2122/97
cggaaucgucgcggccgucgcg

SEQ ID NO: 1140372 - RNA, 17 nt, Mycobacterium bovis subsp bovis AF2122/97
cggaaucgucggcgcgg

SEQ ID NO: 1140373 - RNA, 23 nt, Mycobacterium bovis subsp bovis AF2122/97
cggaaucggcggaugaugcaacg

SEQ ID NO: 1140374 - RNA, 18 nt, Mycobacterium bovis subsp bovis AF2122/97
cggaaucgguuucgaccu

SEQ ID NO: 1140375 - RNA, 17 nt, Mycobacterium bovis subsp bovis AF2122/97
cggaauccuggccgccg

SEQ ID NO: 1140376 - RNA, 19 nt, Mycobacterium bovis subsp bovis AF2122/97
cggaauccuggccgccgcc

SEQ ID NO: 1140377 - RNA, 21 nt, Mycobacterium bovis subsp bovis AF2122/97
cggaauccuggccgccgcccc

SEQ ID NO: 1140378 - RNA, 16 nt, Mycobacterium bovis subsp bovis AF2122/97
cggaaucgcgaaacag

SEQ ID NO: 1140379 - RNA, 12 nt, Mycobacterium bovis subsp bovis AF2122/97
cggaaucgcgag

SEQ ID NO: 1140380 - RNA, 17 nt, Mycobacterium bovis subsp bovis AF2122/97
cggaaucgcaucggcgg

SEQ ID NO: 1140381 - RNA, 21 nt, Mycobacterium bovis subsp bovis AF2122/97
cggaaucgcaucggcggggcc

SEQ ID NO: 1140382 - RNA, 15 nt, Mycobacterium bovis subsp bovis AF2122/97
cggaaucgcccgggc

SEQ ID NO: 1140383 - RNA, 17 nt, Mycobacterium bovis subsp bovis AF2122/97
cggaaucagcaccccau

SEQ ID NO: 1140384 - RNA, 23 nt, Mycobacterium bovis subsp bovis AF2122/97
cggaauccccccugucgccgaug

SEQ ID NO: 1140385 - RNA, 15 nt, Mycobacterium bovis subsp bovis AF2122/97
cggaagugucgucgg

SEQ ID NO: 1140386 - RNA, 20 nt, Mycobacterium bovis subsp bovis AF2122/97
cggaagggggcaagcuccag

SEQ ID NO: 1140387 - RNA, 13 nt, Mycobacterium bovis subsp bovis AF2122/97
cggaaguccuaca

SEQ ID NO: 1140388 - RNA, 21 nt, Mycobacterium bovis subsp bovis AF2122/97
cggaaguccuacaugggggcg

SEQ ID NO: 1140389 - RNA, 18 nt, Mycobacterium bovis subsp bovis AF2122/97
cggaauauggcggccggg

SEQ ID NO: 1140390 - RNA, 14 nt, Mycobacterium bovis subsp bovis AF2122/97
cggaauacgcgccg

SEQ ID NO: 1140391 - RNA, 15 nt, Mycobacterium bovis subsp bovis AF2122/97
cggaauacgcgccgc

SEQ ID NO: 1140392 - RNA, 18 nt, Mycobacterium bovis subsp bovis AF2122/97
cggaauacgcgccgccgg

SEQ ID NO: 1140393 - RNA, 15 nt, Mycobacterium bovis subsp bovis AF2122/97
cggaauacccgcugg

SEQ ID NO: 1140394 - RNA, 16 nt, Mycobacterium bovis subsp bovis AF2122/97
cggaauacccggccca

SEQ ID NO: 1140395 - RNA, 21 nt, Mycobacterium bovis subsp bovis AF2122/97
cggaauacccggcccauuguc

SEQ ID NO: 1140396 - RNA, 18 nt, Mycobacterium bovis subsp bovis AF2122/97
cggaauggaggccgccga

SEQ ID NO: 1140397 - RNA, 21 nt, Mycobacterium bovis subsp bovis AF2122/97
cggaauguagccgacuucguc

SEQ ID NO: 1140398 - RNA, 13 nt, Mycobacterium bovis subsp bovis AF2122/97
cggaauggcgccg

SEQ ID NO: 1140399 - RNA, 19 nt, Mycobacterium bovis subsp bovis AF2122/97
cggaauggcgccggccggc

SEQ ID NO: 1140400 - RNA, 23 nt, Mycobacterium bovis subsp bovis AF2122/97
cggaauguugcgagugagcucag

SEQ ID NO: 1140401 - RNA, 22 nt, Mycobacterium bovis subsp bovis AF2122/97
cggaauguaguccagcucgcug

SEQ ID NO: 1140402 - RNA, 14 nt, Mycobacterium bovis subsp bovis AF2122/97
cggaaugucagccg

SEQ ID NO: 1140403 - RNA, 23 nt, Mycobacterium bovis subsp bovis AF2122/97
cggaaugccgucgccggucaggc

SEQ ID NO: 1140404 - RNA, 15 nt, Mycobacterium bovis subsp bovis AF2122/97
cggaauucagcgacg

SEQ ID NO: 1140405 - RNA, 17 nt, Mycobacterium bovis subsp bovis AF2122/97
cggacaaagccgucgcg

SEQ ID NO: 1140406 - RNA, 23 nt, Mycobacterium bovis subsp bovis AF2122/97
cggacaaagcugcucgucggcgc

SEQ ID NO: 1140407 - RNA, 19 nt, Mycobacterium bovis subsp bovis AF2122/97
cggacaaccuggggccacc

SEQ ID NO: 1140408 - RNA, 18 nt, Mycobacterium bovis subsp bovis AF2122/97
cggacaaggacugaccgu

SEQ ID NO: 1140409 - RNA, 20 nt, Mycobacterium bovis subsp bovis AF2122/97
cggacaagucggcaccggug

SEQ ID NO: 1140410 - RNA, 18 nt, Mycobacterium bovis subsp bovis AF2122/97
cggacaauuccgcuugcu

SEQ ID NO: 1140411 - RNA, 18 nt, Mycobacterium bovis subsp bovis AF2122/97
cgcuuugaauugcgcgcc

SEQ ID NO: 1140412 - RNA, 16 nt, Mycobacterium bovis subsp bovis AF2122/97
cgcuuugaugccgaug

SEQ ID NO: 1140413 - RNA, 21 nt, Mycobacterium bovis subsp bovis AF2122/97
cgcuuugaauugcgcgcccgg

SEQ ID NO: 1140414 - RNA, 14 nt, Mycobacterium bovis subsp bovis AF2122/97
cgcuuugcacagcg

SEQ ID NO: 1140415 - RNA, 22 nt, Mycobacterium bovis subsp bovis AF2122/97
cgcuuggaccguugccgauggu

SEQ ID NO: 1140416 - RNA, 14 nt, Mycobacterium bovis subsp bovis AF2122/97
cgcuuggcccuggg

SEQ ID NO: 1140417 - RNA, 18 nt, Mycobacterium bovis subsp bovis AF2122/97
cgcuuggccuaugcugcc

SEQ ID NO: 1140418 - RNA, 17 nt, Mycobacterium bovis subsp bovis AF2122/97
cgcuugcggggccgggc

SEQ ID NO: 1140419 - RNA, 19 nt, Mycobacterium bovis subsp bovis AF2122/97
cgcuugcggccgcgcgccg

SEQ ID NO: 1140420 - RNA, 19 nt, Mycobacterium bovis subsp bovis AF2122/97
cgcuuguacaagucgacca

SEQ ID NO: 1140421 - RNA, 22 nt, Mycobacterium bovis subsp bovis AF2122/97
cgcuugggcggugucgucgagg

SEQ ID NO: 1140422 - RNA, 23 nt, Mycobacterium bovis subsp bovis AF2122/97
cgcuuggcguauccuugcgacgu

SEQ ID NO: 1140423 - RNA, 20 nt, Mycobacterium bovis subsp bovis AF2122/97
cgcuugugacaccacaucgg

SEQ ID NO: 1140424 - RNA, 21 nt, Mycobacterium bovis subsp bovis AF2122/97
cgcuugugacaccacaucggg

SEQ ID NO: 1140425 - RNA, 15 nt, Mycobacterium bovis subsp bovis AF2122/97
cggaaauuccaagcg

SEQ ID NO: 1140426 - RNA, 23 nt, Mycobacterium bovis subsp bovis AF2122/97
cggaacaagguauggccggagcg

SEQ ID NO: 1140427 - RNA, 13 nt, Mycobacterium bovis subsp bovis AF2122/97
cggaacaccacca

SEQ ID NO: 1140428 - RNA, 18 nt, Mycobacterium bovis subsp bovis AF2122/97
cggaacaccgacgucagg

SEQ ID NO: 1140429 - RNA, 13 nt, Mycobacterium bovis subsp bovis AF2122/97
cggaacaccgagg

SEQ ID NO: 1140430 - RNA, 13 nt, Mycobacterium bovis subsp bovis AF2122/97
cggaacaccgccc

SEQ ID NO: 1140431 - RNA, 14 nt, Mycobacterium bovis subsp bovis AF2122/97
cggaacaccgcccg

SEQ ID NO: 1140432 - RNA, 16 nt, Mycobacterium bovis subsp bovis AF2122/97
cggaacaccgcccggc

SEQ ID NO: 1140433 - RNA, 13 nt, Mycobacterium bovis subsp bovis AF2122/97
cggaacacgaugc

SEQ ID NO: 1140434 - RNA, 17 nt, Mycobacterium bovis subsp bovis AF2122/97
cggaaaaccgcaccguc

SEQ ID NO: 1140435 - RNA, 23 nt, Mycobacterium bovis subsp bovis AF2122/97
cggaaagcccgucgggccgucgg

SEQ ID NO: 1140436 - RNA, 16 nt, Mycobacterium bovis subsp bovis AF2122/97
cggaaaggucggccug

SEQ ID NO: 1140437 - RNA, 20 nt, Mycobacterium bovis subsp bovis AF2122/97
cggaaaccaucgccagccgg

SEQ ID NO: 1140438 - RNA, 16 nt, Mycobacterium bovis subsp bovis AF2122/97
cggaaacccggccgcc

SEQ ID NO: 1140439 - RNA, 17 nt, Mycobacterium bovis subsp bovis AF2122/97
cggaaacccggccgccg

SEQ ID NO: 1140440 - RNA, 18 nt, Mycobacterium bovis subsp bovis AF2122/97
cggaaacccggccgccga

SEQ ID NO: 1140441 - RNA, 15 nt, Mycobacterium bovis subsp bovis AF2122/97
cgcuuuucgauggug

SEQ ID NO: 1140442 - RNA, 20 nt, Mycobacterium bovis subsp bovis AF2122/97
cgcuuuucgauggugucgcg

SEQ ID NO: 1140443 - RNA, 14 nt, Mycobacterium bovis subsp bovis AF2122/97
cgcuuuggcguucg

SEQ ID NO: 1140444 - RNA, 15 nt, Mycobacterium bovis subsp bovis AF2122/97
cgcuuugggcugccg

SEQ ID NO: 1140445 - RNA, 17 nt, Mycobacterium bovis subsp bovis AF2122/97
cgggcgcacgcccgcac

SEQ ID NO: 1140446 - RNA, 21 nt, Mycobacterium bovis subsp bovis AF2122/97
cgggcgcacgcccgcacucgg

SEQ ID NO: 1140447 - RNA, 15 nt, Mycobacterium bovis subsp bovis AF2122/97
cgggcgcaccaggga

SEQ ID NO: 1140448 - RNA, 14 nt, Mycobacterium bovis subsp bovis AF2122/97
cgggcgcccaugcu

SEQ ID NO: 1140449 - RNA, 17 nt, Mycobacterium bovis subsp bovis AF2122/97
cgggcgccccaccggcc

SEQ ID NO: 1140450 - RNA, 20 nt, Mycobacterium bovis subsp bovis AF2122/97
cgggcgcccuugagccgccg

SEQ ID NO: 1140451 - RNA, 12 nt, Mycobacterium bovis subsp bovis AF2122/97
cgggcgccgcua

SEQ ID NO: 1140452 - RNA, 17 nt, Mycobacterium bovis subsp bovis AF2122/97
cgggcgccgcagcgcuc

SEQ ID NO: 1140453 - RNA, 21 nt, Mycobacterium bovis subsp bovis AF2122/97
cgggcggauacaugguccggc

SEQ ID NO: 1140454 - RNA, 14 nt, Mycobacterium bovis subsp bovis AF2122/97
cgggcggaucgccg

SEQ ID NO: 1140455 - RNA, 17 nt, Mycobacterium bovis subsp bovis AF2122/97
cgggcggaacgccggca

SEQ ID NO: 1140456 - RNA, 18 nt, Mycobacterium bovis subsp bovis AF2122/97
cgggcggaacgccggcac

SEQ ID NO: 1140457 - RNA, 20 nt, Mycobacterium bovis subsp bovis AF2122/97
cgggcggaacgccggcaccg

SEQ ID NO: 1140458 - RNA, 21 nt, Mycobacterium bovis subsp bovis AF2122/97
cgggcgcuugcaccaggggcg

SEQ ID NO: 1140459 - RNA, 23 nt, Mycobacterium bovis subsp bovis AF2122/97
cgggcggaacgccggcaccgacg

SEQ ID NO: 1140460 - RNA, 17 nt, Mycobacterium bovis subsp bovis AF2122/97
cgggcggaaacaagcaa

SEQ ID NO: 1140461 - RNA, 19 nt, Mycobacterium bovis subsp bovis AF2122/97
cgggcggaaagcccgucgg

SEQ ID NO: 1140462 - RNA, 15 nt, Mycobacterium bovis subsp bovis AF2122/97
cgggcggcgucggug

SEQ ID NO: 1140463 - RNA, 13 nt, Mycobacterium bovis subsp bovis AF2122/97
cgggcggcgucgg

SEQ ID NO: 1140464 - RNA, 15 nt, Mycobacterium bovis subsp bovis AF2122/97
cgggcggccaccgca

SEQ ID NO: 1140465 - RNA, 15 nt, Mycobacterium bovis subsp bovis AF2122/97
cgggcggcgucgcgg

SEQ ID NO: 1140466 - RNA, 11 nt, Mycobacterium bovis subsp bovis AF2122/97
cgggcggcgug

SEQ ID NO: 1140467 - RNA, 14 nt, Mycobacterium bovis subsp bovis AF2122/97
cgggcggcgugguu

SEQ ID NO: 1140468 - RNA, 22 nt, Mycobacterium bovis subsp bovis AF2122/97
cgggcggaugcuguugacccgu

SEQ ID NO: 1140469 - RNA, 19 nt, Mycobacterium bovis subsp bovis AF2122/97
cgggcggugcacaccgucg

SEQ ID NO: 1140470 - RNA, 21 nt, Mycobacterium bovis subsp bovis AF2122/97
cgggcggcaucgccgaggugg

SEQ ID NO: 1140471 - RNA, 23 nt, Mycobacterium bovis subsp bovis AF2122/97
cgggcgucaagccacacccggcg

SEQ ID NO: 1140472 - RNA, 17 nt, Mycobacterium bovis subsp bovis AF2122/97
cgggcgucaagccacac

SEQ ID NO: 1140473 - RNA, 22 nt, Mycobacterium bovis subsp bovis AF2122/97
cgggcguacauucgggcgugcu

SEQ ID NO: 1140474 - RNA, 21 nt, Mycobacterium bovis subsp bovis AF2122/97
cgggcggugggcagcagcugg

SEQ ID NO: 1140475 - RNA, 19 nt, Mycobacterium bovis subsp bovis AF2122/97
cgggcggugggcagcagcu

SEQ ID NO: 1140476 - RNA, 17 nt, Mycobacterium bovis subsp bovis AF2122/97
cgggcgggugaacgcgu

SEQ ID NO: 1140477 - RNA, 16 nt, Mycobacterium bovis subsp bovis AF2122/97
cgggcgguaaucgcga

SEQ ID NO: 1140478 - RNA, 18 nt, Mycobacterium bovis subsp bovis AF2122/97
cgggcgggauccacccag

SEQ ID NO: 1140479 - RNA, 23 nt, Mycobacterium bovis subsp bovis AF2122/97
cgggcgggcuggugucagcugau

SEQ ID NO: 1140480 - RNA, 17 nt, Mycobacterium bovis subsp bovis AF2122/97
cgggcggggacggcggc

SEQ ID NO: 1140481 - RNA, 19 nt, Mycobacterium bovis subsp bovis AF2122/97
cgggcggggacggcggcaa

SEQ ID NO: 1140482 - RNA, 13 nt, Mycobacterium bovis subsp bovis AF2122/97
cgggcgggcuggu

SEQ ID NO: 1140483 - RNA, 17 nt, Mycobacterium bovis subsp bovis AF2122/97
cgggcgggagucgucga

SEQ ID NO: 1140484 - RNA, 20 nt, Mycobacterium bovis subsp bovis AF2122/97
cgggcgggagucgucgagcu

SEQ ID NO: 1140485 - RNA, 17 nt, Mycobacterium bovis subsp bovis AF2122/97
cgggcguuggccagcag

SEQ ID NO: 1140486 - RNA, 18 nt, Mycobacterium bovis subsp bovis AF2122/97
cgggcguuggccagcagg

SEQ ID NO: 1140487 - RNA, 14 nt, Mycobacterium bovis subsp bovis AF2122/97
cgggcgugucggga

SEQ ID NO: 1140488 - RNA, 21 nt, Mycobacterium bovis subsp bovis AF2122/97
cgggcguugggaucgcgcagc

SEQ ID NO: 1140489 - RNA, 17 nt, Mycobacterium bovis subsp bovis AF2122/97
cgggcguuuggacgggc

SEQ ID NO: 1140490 - RNA, 23 nt, Mycobacterium bovis subsp bovis AF2122/97
cgggcguuuggacgggcgugcug

SEQ ID NO: 1140491 - RNA, 22 nt, Mycobacterium bovis subsp bovis AF2122/97
cgggcucgcauguucuccacgc

SEQ ID NO: 1140492 - RNA, 18 nt, Mycobacterium bovis subsp bovis AF2122/97
cgggcucgcauucggcga

SEQ ID NO: 1140493 - RNA, 12 nt, Mycobacterium bovis subsp bovis AF2122/97
cgggcgucacgg

SEQ ID NO: 1140494 - RNA, 15 nt, Mycobacterium bovis subsp bovis AF2122/97
cgggcgucacggugc

SEQ ID NO: 1140495 - RNA, 14 nt, Mycobacterium bovis subsp bovis AF2122/97
cgggcgugggccgc

SEQ ID NO: 1140496 - RNA, 15 nt, Mycobacterium bovis subsp bovis AF2122/97
cgggcgugggccgcu

SEQ ID NO: 1140497 - RNA, 17 nt, Mycobacterium bovis subsp bovis AF2122/97
cgggcgugggccgcugg

SEQ ID NO: 1140498 - RNA, 19 nt, Mycobacterium bovis subsp bovis AF2122/97
cgggcgugguaucgccggg

SEQ ID NO: 1140499 - RNA, 14 nt, Mycobacterium bovis subsp bovis AF2122/97
cgggcguggugagc

SEQ ID NO: 1140500 - RNA, 15 nt, Mycobacterium bovis subsp bovis AF2122/97
cgggcgugcugccga

SEQ ID NO: 1140501 - RNA, 17 nt, Mycobacterium bovis subsp bovis AF2122/97
cgggcgugguaucgccg

SEQ ID NO: 1140502 - RNA, 13 nt, Mycobacterium bovis subsp bovis AF2122/97
cgggccgccgagc

SEQ ID NO: 1140503 - RNA, 15 nt, Mycobacterium bovis subsp bovis AF2122/97
cgggccgccgagcgg

SEQ ID NO: 1140504 - RNA, 14 nt, Mycobacterium bovis subsp bovis AF2122/97
cgggccgccgagcu

SEQ ID NO: 1140505 - RNA, 21 nt, Mycobacterium bovis subsp bovis AF2122/97
cgggccgcaucgucgccgcgc

SEQ ID NO: 1140506 - RNA, 13 nt, Mycobacterium bovis subsp bovis AF2122/97
cgggccgccaggc

SEQ ID NO: 1140507 - RNA, 17 nt, Mycobacterium bovis subsp bovis AF2122/97
cgggccgccaggcggcc

SEQ ID NO: 1140508 - RNA, 19 nt, Mycobacterium bovis subsp bovis AF2122/97
cgggccgccaggcggccgg

SEQ ID NO: 1140509 - RNA, 20 nt, Mycobacterium bovis subsp bovis AF2122/97
cgggccgccaggcggccggg

SEQ ID NO: 1140510 - RNA, 16 nt, Mycobacterium bovis subsp bovis AF2122/97
cgggccgcgcgggccg

SEQ ID NO: 1140511 - RNA, 18 nt, Mycobacterium bovis subsp bovis AF2122/97
cgggccggaugacgccca

SEQ ID NO: 1140512 - RNA, 23 nt, Mycobacterium bovis subsp bovis AF2122/97
cgggccggagccggugccgacgg

SEQ ID NO: 1140513 - RNA, 15 nt, Mycobacterium bovis subsp bovis AF2122/97
cgggccgcggcggcc

SEQ ID NO: 1140514 - RNA, 15 nt, Mycobacterium bovis subsp bovis AF2122/97
cgggccggccgagcg

SEQ ID NO: 1140515 - RNA, 13 nt, Mycobacterium bovis subsp bovis AF2122/97
cgggccggccacg

SEQ ID NO: 1140516 - RNA, 14 nt, Mycobacterium bovis subsp bovis AF2122/97
cgggccggucggug

SEQ ID NO: 1140517 - RNA, 21 nt, Mycobacterium bovis subsp bovis AF2122/97
cgggccggucggugagccgug

SEQ ID NO: 1140518 - RNA, 17 nt, Mycobacterium bovis subsp bovis AF2122/97
cgggccggucgugccgg

SEQ ID NO: 1140519 - RNA, 14 nt, Mycobacterium bovis subsp bovis AF2122/97
cgggccggugcgca

SEQ ID NO: 1140520 - RNA, 17 nt, Mycobacterium bovis subsp bovis AF2122/97
cgggccggugcgcacca

SEQ ID NO: 1140521 - RNA, 22 nt, Mycobacterium bovis subsp bovis AF2122/97
cgggccgguggaaaagccacgg

SEQ ID NO: 1140522 - RNA, 15 nt, Mycobacterium bovis subsp bovis AF2122/97
cgggcgaccaccacc

SEQ ID NO: 1140523 - RNA, 19 nt, Mycobacterium bovis subsp bovis AF2122/97
cgggcgaccaccaccgccg

SEQ ID NO: 1140524 - RNA, 15 nt, Mycobacterium bovis subsp bovis AF2122/97
cgggcgaccaccgcg

SEQ ID NO: 1140525 - RNA, 16 nt, Mycobacterium bovis subsp bovis AF2122/97
cgggcgacaucgagau

SEQ ID NO: 1140526 - RNA, 20 nt, Mycobacterium bovis subsp bovis AF2122/97
cgggcgaccuccggaaucgc

SEQ ID NO: 1140527 - RNA, 14 nt, Mycobacterium bovis subsp bovis AF2122/97
cgggcgacgguuuc

SEQ ID NO: 1140528 - RNA, 22 nt, Mycobacterium bovis subsp bovis AF2122/97
cgggcgagaacccacgcaugca

SEQ ID NO: 1140529 - RNA, 14 nt, Mycobacterium bovis subsp bovis AF2122/97
cgggcgauggccag

SEQ ID NO: 1140530 - RNA, 16 nt, Mycobacterium bovis subsp bovis AF2122/97
cgggcgauggccaguu

SEQ ID NO: 1140531 - RNA, 21 nt, Mycobacterium bovis subsp bovis AF2122/97
cgggcgagaagucaagguguc

SEQ ID NO: 1140532 - RNA, 19 nt, Mycobacterium bovis subsp bovis AF2122/97
cgggcgauuucggcgccgg

SEQ ID NO: 1140533 - RNA, 20 nt, Mycobacterium bovis subsp bovis AF2122/97
cgggcgauuucggcgccggc

SEQ ID NO: 1140534 - RNA, 24 nt, Mycobacterium bovis subsp bovis AF2122/97
cgggcgauuucggcgccggcgucg

SEQ ID NO: 1140535 - RNA, 20 nt, Mycobacterium bovis subsp bovis AF2122/97
cgggcgcaagcagcccgggu

SEQ ID NO: 1140536 - RNA, 20 nt, Mycobacterium bovis subsp bovis AF2122/97
cgggcgcaccaagacgccac

SEQ ID NO: 1140537 - RNA, 13 nt, Mycobacterium bovis subsp bovis AF2122/97
cgggccggccgcc

SEQ ID NO: 1140538 - RNA, 18 nt, Mycobacterium bovis subsp bovis AF2122/97
cgggccgucaaucgcaau

SEQ ID NO: 1140539 - RNA, 13 nt, Mycobacterium bovis subsp bovis AF2122/97
cgggccgugaccc

SEQ ID NO: 1140540 - RNA, 22 nt, Mycobacterium bovis subsp bovis AF2122/97
cgggccgugacccucagcaccg

SEQ ID NO: 1140541 - RNA, 23 nt, Mycobacterium bovis subsp bovis AF2122/97
cgggccucaugcuaggccaccgg

SEQ ID NO: 1140542 - RNA, 14 nt, Mycobacterium bovis subsp bovis AF2122/97
cgggccucccccaa

SEQ ID NO: 1140543 - RNA, 15 nt, Mycobacterium bovis subsp bovis AF2122/97
cgggccuccugcugg

SEQ ID NO: 1140544 - RNA, 17 nt, Mycobacterium bovis subsp bovis AF2122/97
cgggccuccugcuggcc

SEQ ID NO: 1140545 - RNA, 18 nt, Mycobacterium bovis subsp bovis AF2122/97
cgggcgaauccggcgggu

SEQ ID NO: 1140546 - RNA, 20 nt, Mycobacterium bovis subsp bovis AF2122/97
cgggccugcacgccggcgcu

SEQ ID NO: 1140547 - RNA, 17 nt, Mycobacterium bovis subsp bovis AF2122/97
cgggccugaaccacgcg

SEQ ID NO: 1140548 - RNA, 14 nt, Mycobacterium bovis subsp bovis AF2122/97
cgggccucggcgcc

SEQ ID NO: 1140549 - RNA, 15 nt, Mycobacterium bovis subsp bovis AF2122/97
cgggccugcaccacg

SEQ ID NO: 1140550 - RNA, 17 nt, Mycobacterium bovis subsp bovis AF2122/97
cgggccugcaccacggc

SEQ ID NO: 1140551 - RNA, 12 nt, Mycobacterium bovis subsp bovis AF2122/97
cgggccugcacg

SEQ ID NO: 1140552 - RNA, 15 nt, Mycobacterium bovis subsp bovis AF2122/97
cgggacagcgccggg

SEQ ID NO: 1140553 - RNA, 12 nt, Mycobacterium bovis subsp bovis AF2122/97
cggcuugccgcc

SEQ ID NO: 1140554 - RNA, 22 nt, Mycobacterium bovis subsp bovis AF2122/97
cgggaccauagccugcgccgac

SEQ ID NO: 1140555 - RNA, 20 nt, Mycobacterium bovis subsp bovis AF2122/97
cgggaccauagucgccgucg

SEQ ID NO: 1140556 - RNA, 15 nt, Mycobacterium bovis subsp bovis AF2122/97
cgggaccgccccggc

SEQ ID NO: 1140557 - RNA, 20 nt, Mycobacterium bovis subsp bovis AF2122/97
cgggacacgucgcgccaggc

SEQ ID NO: 1140558 - RNA, 17 nt, Mycobacterium bovis subsp bovis AF2122/97
cgggacagauggcggcc

SEQ ID NO: 1140559 - RNA, 19 nt, Mycobacterium bovis subsp bovis AF2122/97
cgggacagauggcggccga

SEQ ID NO: 1140560 - RNA, 13 nt, Mycobacterium bovis subsp bovis AF2122/97
cggcuugagccgc

SEQ ID NO: 1140561 - RNA, 19 nt, Mycobacterium bovis subsp bovis AF2122/97
cggcuucuugaccacgaac

SEQ ID NO: 1140562 - RNA, 18 nt, Mycobacterium bovis subsp bovis AF2122/97
cggcuucuugaccacgaa

SEQ ID NO: 1140563 - RNA, 21 nt, Mycobacterium bovis subsp bovis AF2122/97
cgggaggccggcuaccgcgcu

SEQ ID NO: 1140564 - RNA, 17 nt, Mycobacterium bovis subsp bovis AF2122/97
cgggaggaugucgagcc

SEQ ID NO: 1140565 - RNA, 17 nt, Mycobacterium bovis subsp bovis AF2122/97
cgggagcggcugcggca

SEQ ID NO: 1140566 - RNA, 18 nt, Mycobacterium bovis subsp bovis AF2122/97
cgggagcggcugcggcaa

SEQ ID NO: 1140567 - RNA, 13 nt, Mycobacterium bovis subsp bovis AF2122/97
cgggagccggcug

SEQ ID NO: 1140568 - RNA, 19 nt, Mycobacterium bovis subsp bovis AF2122/97
cgggaccggugugcacgcg

SEQ ID NO: 1140569 - RNA, 21 nt, Mycobacterium bovis subsp bovis AF2122/97
cgggaccgugacguaucgccg

SEQ ID NO: 1140570 - RNA, 15 nt, Mycobacterium bovis subsp bovis AF2122/97
cgggagcgacgucgg

SEQ ID NO: 1140571 - RNA, 12 nt, Mycobacterium bovis subsp bovis AF2122/97
cgggagucgucg

SEQ ID NO: 1140572 - RNA, 13 nt, Mycobacterium bovis subsp bovis AF2122/97
cgggagucgucga

SEQ ID NO: 1140573 - RNA, 20 nt, Mycobacterium bovis subsp bovis AF2122/97
cggcuugagccgcagcaccu

SEQ ID NO: 1140574 - RNA, 18 nt, Mycobacterium bovis subsp bovis AF2122/97
cgggaggcggcgccgcac

SEQ ID NO: 1140575 - RNA, 15 nt, Mycobacterium bovis subsp bovis AF2122/97
cgggaguccgguagc

SEQ ID NO: 1140576 - RNA, 15 nt, Mycobacterium bovis subsp bovis AF2122/97
cgggagucuucggcg

SEQ ID NO: 1140577 - RNA, 13 nt, Mycobacterium bovis subsp bovis AF2122/97
cgggagugcgccg

SEQ ID NO: 1140578 - RNA, 15 nt, Mycobacterium bovis subsp bovis AF2122/97
cgggaguucggggug

SEQ ID NO: 1140579 - RNA, 23 nt, Mycobacterium bovis subsp bovis AF2122/97
cgggaguucggggugcgcccagg

SEQ ID NO: 1140580 - RNA, 15 nt, Mycobacterium bovis subsp bovis AF2122/97
cgggauccuccgggu

SEQ ID NO: 1140581 - RNA, 21 nt, Mycobacterium bovis subsp bovis AF2122/97
cgggaucccacggcgggcgag

SEQ ID NO: 1140582 - RNA, 18 nt, Mycobacterium bovis subsp bovis AF2122/97
cgggcaaaucaagcacag

SEQ ID NO: 1140583 - RNA, 20 nt, Mycobacterium bovis subsp bovis AF2122/97
cgggcaacacgauaucgggc

SEQ ID NO: 1140584 - RNA, 15 nt, Mycobacterium bovis subsp bovis AF2122/97
cgggcaacggcagcc

SEQ ID NO: 1140585 - RNA, 16 nt, Mycobacterium bovis subsp bovis AF2122/97
cgggcaacggcagccc

SEQ ID NO: 1140586 - RNA, 12 nt, Mycobacterium bovis subsp bovis AF2122/97
cgggcaaccgau

SEQ ID NO: 1140587 - RNA, 16 nt, Mycobacterium bovis subsp bovis AF2122/97
cgggcaaccgaugacg

SEQ ID NO: 1140588 - RNA, 18 nt, Mycobacterium bovis subsp bovis AF2122/97
cgggcaaccggagauccc

SEQ ID NO: 1140589 - RNA, 13 nt, Mycobacterium bovis subsp bovis AF2122/97
cgggcaaccugcc

SEQ ID NO: 1140590 - RNA, 15 nt, Mycobacterium bovis subsp bovis AF2122/97
cgggcaacgccucga

SEQ ID NO: 1140591 - RNA, 20 nt, Mycobacterium bovis subsp bovis AF2122/97
cgggcaacgccucgagcaac

SEQ ID NO: 1140592 - RNA, 17 nt, Mycobacterium bovis subsp bovis AF2122/97
cgggaugaagccaccca

SEQ ID NO: 1140593 - RNA, 18 nt, Mycobacterium bovis subsp bovis AF2122/97
cgggaucugcgccgcgcg

SEQ ID NO: 1140594 - RNA, 15 nt, Mycobacterium bovis subsp bovis AF2122/97
cgggaucugcuccgc

SEQ ID NO: 1140595 - RNA, 18 nt, Mycobacterium bovis subsp bovis AF2122/97
cgggaucugggcucgguc

SEQ ID NO: 1140596 - RNA, 14 nt, Mycobacterium bovis subsp bovis AF2122/97
cgggaugaccaccg

SEQ ID NO: 1140597 - RNA, 18 nt, Mycobacterium bovis subsp bovis AF2122/97
cgggaugaauacgcguug

SEQ ID NO: 1140598 - RNA, 22 nt, Mycobacterium bovis subsp bovis AF2122/97
aacauugcuagguucgcgacgu

SEQ ID NO: 1140599 - RNA, 21 nt, Mycobacterium bovis subsp bovis AF2122/97
cgggaucgguggcggcacgca

SEQ ID NO: 1140600 - RNA, 17 nt, Mycobacterium bovis subsp bovis AF2122/97
cgggaucguuggccagu

SEQ ID NO: 1140601 - RNA, 19 nt, Mycobacterium bovis subsp bovis AF2122/97
cgggaucucgaaggccgcc

SEQ ID NO: 1140602 - RNA, 21 nt, Mycobacterium bovis subsp bovis AF2122/97
cgggaucgcugccagcggccg

SEQ ID NO: 1140603 - RNA, 23 nt, Mycobacterium bovis subsp bovis AF2122/97
cgggaucgcugccagcggccggg

SEQ ID NO: 1140604 - RNA, 16 nt, Mycobacterium bovis subsp bovis AF2122/97
cgggaucgccgagacc

SEQ ID NO: 1140605 - RNA, 16 nt, Mycobacterium bovis subsp bovis AF2122/97
cgggaucgaucugcgg

SEQ ID NO: 1140606 - RNA, 17 nt, Mycobacterium bovis subsp bovis AF2122/97
cgggaucgcccaggcgc

SEQ ID NO: 1140607 - RNA, 22 nt, Mycobacterium bovis subsp bovis AF2122/97
cgggaucgcccaggcgcgacgu

SEQ ID NO: 1140608 - RNA, 17 nt, Mycobacterium bovis subsp bovis AF2122/97
cgggccagcacccgcuc

SEQ ID NO: 1140609 - RNA, 13 nt, Mycobacterium bovis subsp bovis AF2122/97
cgggcccgccggc

SEQ ID NO: 1140610 - RNA, 15 nt, Mycobacterium bovis subsp bovis AF2122/97
cgggcccgccggccc

SEQ ID NO: 1140611 - RNA, 16 nt, Mycobacterium bovis subsp bovis AF2122/97
cgggcccgccggcccc

SEQ ID NO: 1140612 - RNA, 16 nt, Mycobacterium bovis subsp bovis AF2122/97
cgggcccgcguucucg

SEQ ID NO: 1140613 - RNA, 21 nt, Mycobacterium bovis subsp bovis AF2122/97
cgggccagcacccgcuccagc

SEQ ID NO: 1140614 - RNA, 16 nt, Mycobacterium bovis subsp bovis AF2122/97
cgggcccgcgcggcgg

SEQ ID NO: 1140615 - RNA, 16 nt, Mycobacterium bovis subsp bovis AF2122/97
cgggcccguccugcgg

SEQ ID NO: 1140616 - RNA, 13 nt, Mycobacterium bovis subsp bovis AF2122/97
cgggcccggcgag

SEQ ID NO: 1140617 - RNA, 22 nt, Mycobacterium bovis subsp bovis AF2122/97
cgggccgaucucuccggcggcg

SEQ ID NO: 1140618 - RNA, 17 nt, Mycobacterium bovis subsp bovis AF2122/97
cgggcccgucgucgucg

SEQ ID NO: 1140619 - RNA, 22 nt, Mycobacterium bovis subsp bovis AF2122/97
cgggccaccguaaacagcgcgc

SEQ ID NO: 1140620 - RNA, 15 nt, Mycobacterium bovis subsp bovis AF2122/97
cgggccaccgcuguc

SEQ ID NO: 1140621 - RNA, 18 nt, Mycobacterium bovis subsp bovis AF2122/97
cgggccaccagcgucgca

SEQ ID NO: 1140622 - RNA, 13 nt, Mycobacterium bovis subsp bovis AF2122/97
cgggccaccagcg

SEQ ID NO: 1140623 - RNA, 15 nt, Mycobacterium bovis subsp bovis AF2122/97
cgggccacgaugcgc

SEQ ID NO: 1140624 - RNA, 21 nt, Mycobacterium bovis subsp bovis AF2122/97
cgggccacguccugcccgucg

SEQ ID NO: 1140625 - RNA, 20 nt, Mycobacterium bovis subsp bovis AF2122/97
cgggccaagccggagcccgg

SEQ ID NO: 1140626 - RNA, 16 nt, Mycobacterium bovis subsp bovis AF2122/97
cgggccaaugccguug

SEQ ID NO: 1140627 - RNA, 20 nt, Mycobacterium bovis subsp bovis AF2122/97
cgggccaacucggcgaugac

SEQ ID NO: 1140628 - RNA, 21 nt, Mycobacterium bovis subsp bovis AF2122/97
cgggccaacucggcgaugaca

SEQ ID NO: 1140629 - RNA, 17 nt, Mycobacterium bovis subsp bovis AF2122/97
cgggcaccaaccugagc

SEQ ID NO: 1140630 - RNA, 20 nt, Mycobacterium bovis subsp bovis AF2122/97
cgggcacccgagccgcacag

SEQ ID NO: 1140631 - RNA, 19 nt, Mycobacterium bovis subsp bovis AF2122/97
cgggcaccacccuugccga

SEQ ID NO: 1140632 - RNA, 18 nt, Mycobacterium bovis subsp bovis AF2122/97
cgggcaccuggucggccg

SEQ ID NO: 1140633 - RNA, 19 nt, Mycobacterium bovis subsp bovis AF2122/97
cgggcaccuggucggccgc

SEQ ID NO: 1140634 - RNA, 15 nt, Mycobacterium bovis subsp bovis AF2122/97
cgggcaccggccggu

SEQ ID NO: 1140635 - RNA, 16 nt, Mycobacterium bovis subsp bovis AF2122/97
cgggcaccggccggug

SEQ ID NO: 1140636 - RNA, 20 nt, Mycobacterium bovis subsp bovis AF2122/97
cgggcaccgucggaacugac

SEQ ID NO: 1140637 - RNA, 22 nt, Mycobacterium bovis subsp bovis AF2122/97
cgggcaccgucggaacugacca

SEQ ID NO: 1140638 - RNA, 15 nt, Mycobacterium bovis subsp bovis AF2122/97
cgggcaccuggucgg

SEQ ID NO: 1140639 - RNA, 18 nt, Mycobacterium bovis subsp bovis AF2122/97
cgggcaccgcgcgcucca

SEQ ID NO: 1140640 - RNA, 12 nt, Mycobacterium bovis subsp bovis AF2122/97
cgggcaccgcca

SEQ ID NO: 1140641 - RNA, 21 nt, Mycobacterium bovis subsp bovis AF2122/97
cgggcacgaucgucgcggcca

SEQ ID NO: 1140642 - RNA, 14 nt, Mycobacterium bovis subsp bovis AF2122/97
cgggcacgccgccg

SEQ ID NO: 1140643 - RNA, 20 nt, Mycobacterium bovis subsp bovis AF2122/97
cgggcagcugguaggucacc

SEQ ID NO: 1140644 - RNA, 21 nt, Mycobacterium bovis subsp bovis AF2122/97
cgggcagcugguaggucaccg

SEQ ID NO: 1140645 - RNA, 11 nt, Mycobacterium bovis subsp bovis AF2122/97
cgggcagcugg

SEQ ID NO: 1140646 - RNA, 14 nt, Mycobacterium bovis subsp bovis AF2122/97
cgggcagcugggca

SEQ ID NO: 1140647 - RNA, 14 nt, Mycobacterium bovis subsp bovis AF2122/97
cgggcaggccccac

SEQ ID NO: 1140648 - RNA, 17 nt, Mycobacterium bovis subsp bovis AF2122/97
cgggcaggccccacugg

SEQ ID NO: 1140649 - RNA, 20 nt, Mycobacterium bovis subsp bovis AF2122/97
cgggcaggagcagcacgucg

SEQ ID NO: 1140650 - RNA, 22 nt, Mycobacterium bovis subsp bovis AF2122/97
cgggcagcugguaggucaccgg

SEQ ID NO: 1140651 - RNA, 18 nt, Mycobacterium bovis subsp bovis AF2122/97
cgggcagcuucaacaccg

SEQ ID NO: 1140652 - RNA, 19 nt, Mycobacterium bovis subsp bovis AF2122/97
cgggcagcuucaacaccgg

SEQ ID NO: 1140653 - RNA, 21 nt, Mycobacterium bovis subsp bovis AF2122/97
cgggcagcuucaacaccggca

SEQ ID NO: 1140654 - RNA, 13 nt, Mycobacterium bovis subsp bovis AF2122/97
cgggcaugccggc

SEQ ID NO: 1140655 - RNA, 20 nt, Mycobacterium bovis subsp bovis AF2122/97
cgggcaugauccccguugac

SEQ ID NO: 1140656 - RNA, 22 nt, Mycobacterium bovis subsp bovis AF2122/97
cgggcaugauguugaaacaccg

SEQ ID NO: 1140657 - RNA, 18 nt, Mycobacterium bovis subsp bovis AF2122/97
cgggcaguagcuguggcc

SEQ ID NO: 1140658 - RNA, 17 nt, Mycobacterium bovis subsp bovis AF2122/97
cgggcaugaucacacug

SEQ ID NO: 1140659 - RNA, 15 nt, Mycobacterium bovis subsp bovis AF2122/97
cgggcaggccgucga

SEQ ID NO: 1140660 - RNA, 13 nt, Mycobacterium bovis subsp bovis AF2122/97
cgggcaggcggcc

SEQ ID NO: 1140661 - RNA, 17 nt, Mycobacterium bovis subsp bovis AF2122/97
cgggcaggcggccagcg

SEQ ID NO: 1140662 - RNA, 18 nt, Mycobacterium bovis subsp bovis AF2122/97
cgggcagggaccgcaucg

SEQ ID NO: 1140663 - RNA, 21 nt, Mycobacterium bovis subsp bovis AF2122/97
cggcuggccgcgccucggucu

SEQ ID NO: 1140664 - RNA, 16 nt, Mycobacterium bovis subsp bovis AF2122/97
cggcuggccgcgccuc

SEQ ID NO: 1140665 - RNA, 19 nt, Mycobacterium bovis subsp bovis AF2122/97
cggcuggucgcugcugcga

SEQ ID NO: 1140666 - RNA, 20 nt, Mycobacterium bovis subsp bovis AF2122/97
cggcuggugccuuaccaccg

SEQ ID NO: 1140667 - RNA, 22 nt, Mycobacterium bovis subsp bovis AF2122/97
cggcugguguccagccaggcga

SEQ ID NO: 1140668 - RNA, 20 nt, Mycobacterium bovis subsp bovis AF2122/97
cggcugucacaagccugccg

SEQ ID NO: 1140669 - RNA, 21 nt, Mycobacterium bovis subsp bovis AF2122/97
cggcugucacaagccugccgg

SEQ ID NO: 1140670 - RNA, 18 nt, Mycobacterium bovis subsp bovis AF2122/97
cggcugucacgccugcca

SEQ ID NO: 1140671 - RNA, 20 nt, Mycobacterium bovis subsp bovis AF2122/97
cggcugucacgccugccacc

SEQ ID NO: 1140672 - RNA, 14 nt, Mycobacterium bovis subsp bovis AF2122/97
cggcuucggcagcc

SEQ ID NO: 1140673 - RNA, 15 nt, Mycobacterium bovis subsp bovis AF2122/97
cggcuucggcagccg

SEQ ID NO: 1140674 - RNA, 16 nt, Mycobacterium bovis subsp bovis AF2122/97
cggcuucggcagccgc

SEQ ID NO: 1140675 - RNA, 14 nt, Mycobacterium bovis subsp bovis AF2122/97
cggcuucgccgcgg

SEQ ID NO: 1140676 - RNA, 21 nt, Mycobacterium bovis subsp bovis AF2122/97
cggcuucgacgucggcgacca

SEQ ID NO: 1140677 - RNA, 14 nt, Mycobacterium bovis subsp bovis AF2122/97
cggcuucgccccga

SEQ ID NO: 1140678 - RNA, 16 nt, Mycobacterium bovis subsp bovis AF2122/97
cggcuucguccaccgc

SEQ ID NO: 1140679 - RNA, 18 nt, Mycobacterium bovis subsp bovis AF2122/97
cggcuucguccaccgcga

SEQ ID NO: 1140680 - RNA, 14 nt, Mycobacterium bovis subsp bovis AF2122/97
cggcuucgucgaca

SEQ ID NO: 1140681 - RNA, 18 nt, Mycobacterium bovis subsp bovis AF2122/97
cggcuucgucgacaucgc

SEQ ID NO: 1140682 - RNA, 14 nt, Mycobacterium bovis subsp bovis AF2122/97
cggcuucggccagc

SEQ ID NO: 1140683 - RNA, 12 nt, Mycobacterium bovis subsp bovis AF2122/97
cggcuucggcga

SEQ ID NO: 1140684 - RNA, 18 nt, Mycobacterium bovis subsp bovis AF2122/97
cggcuucguggcggcgcg

SEQ ID NO: 1140685 - RNA, 20 nt, Mycobacterium bovis subsp bovis AF2122/97
cggcuucucgaugaugucga

SEQ ID NO: 1140686 - RNA, 15 nt, Mycobacterium bovis subsp bovis AF2122/97
cggcuucgccgcgcu

SEQ ID NO: 1140687 - RNA, 18 nt, Mycobacterium bovis subsp bovis AF2122/97
cggcuucgacgucggcga

SEQ ID NO: 1140688 - RNA, 19 nt, Mycobacterium bovis subsp bovis AF2122/97
cggcuuccuccucggcgcg

SEQ ID NO: 1140689 - RNA, 20 nt, Mycobacterium bovis subsp bovis AF2122/97
cggcuuccuccucggcgcga

SEQ ID NO: 1140690 - RNA, 17 nt, Mycobacterium bovis subsp bovis AF2122/97
cggcuuccuccucggcg

SEQ ID NO: 1140691 - RNA, 23 nt, Mycobacterium bovis subsp bovis AF2122/97
cggcuuccccagcaguucgccgc

SEQ ID NO: 1140692 - RNA, 22 nt, Mycobacterium bovis subsp bovis AF2122/97
cggcugcccguucugcccaggc

SEQ ID NO: 1140693 - RNA, 16 nt, Mycobacterium bovis subsp bovis AF2122/97
cggcugccgcaccaag

SEQ ID NO: 1140694 - RNA, 24 nt, Mycobacterium bovis subsp bovis AF2122/97
cggcugccgucuccuggucaaccg

SEQ ID NO: 1140695 - RNA, 20 nt, Mycobacterium bovis subsp bovis AF2122/97
cggcugcgaaagccacucgc

SEQ ID NO: 1140696 - RNA, 14 nt, Mycobacterium bovis subsp bovis AF2122/97
cggcugccgcucga

SEQ ID NO: 1140697 - RNA, 17 nt, Mycobacterium bovis subsp bovis AF2122/97
cggcugccgcaccaagg

SEQ ID NO: 1140698 - RNA, 22 nt, Mycobacterium bovis subsp bovis AF2122/97
cggcugccgcaccaaggccgcc

SEQ ID NO: 1140699 - RNA, 17 nt, Mycobacterium bovis subsp bovis AF2122/97
cggcuggacggcgccgg

SEQ ID NO: 1140700 - RNA, 18 nt, Mycobacterium bovis subsp bovis AF2122/97
cggcugcuuggucgccca

SEQ ID NO: 1140701 - RNA, 18 nt, Mycobacterium bovis subsp bovis AF2122/97
cggcugcgcgcucggcca

SEQ ID NO: 1140702 - RNA, 14 nt, Mycobacterium bovis subsp bovis AF2122/97
cggcugccgcgcgc

SEQ ID NO: 1140703 - RNA, 19 nt, Mycobacterium bovis subsp bovis AF2122/97
cggcuggaagcggcgacua

SEQ ID NO: 1140704 - RNA, 15 nt, Mycobacterium bovis subsp bovis AF2122/97
cggcugaaccgcugg

SEQ ID NO: 1140705 - RNA, 19 nt, Mycobacterium bovis subsp bovis AF2122/97
cggcucguccgggcagaug

SEQ ID NO: 1140706 - RNA, 15 nt, Mycobacterium bovis subsp bovis AF2122/97
cggcugaacggcagc

SEQ ID NO: 1140707 - RNA, 20 nt, Mycobacterium bovis subsp bovis AF2122/97
cggcucuccggugaucaccg

SEQ ID NO: 1140708 - RNA, 21 nt, Mycobacterium bovis subsp bovis AF2122/97
cggcucuccggugaucaccga

SEQ ID NO: 1140709 - RNA, 22 nt, Mycobacterium bovis subsp bovis AF2122/97
cggcucuccggugaucaccgac

SEQ ID NO: 1140710 - RNA, 21 nt, Mycobacterium bovis subsp bovis AF2122/97
cggcucucuucgcgcgcuggg

SEQ ID NO: 1140711 - RNA, 15 nt, Mycobacterium bovis subsp bovis AF2122/97
cggcucguugcgggc

SEQ ID NO: 1140712 - RNA, 17 nt, Mycobacterium bovis subsp bovis AF2122/97
cggcucguugcgggcgg

SEQ ID NO: 1140713 - RNA, 12 nt, Mycobacterium bovis subsp bovis AF2122/97
cggcucggugcg

SEQ ID NO: 1140714 - RNA, 24 nt, Mycobacterium bovis subsp bovis AF2122/97
cggcucgggugcgcccggccaagc

SEQ ID NO: 1140715 - RNA, 20 nt, Mycobacterium bovis subsp bovis AF2122/97
cggcucgggaacuucgccga

SEQ ID NO: 1140716 - RNA, 13 nt, Mycobacterium bovis subsp bovis AF2122/97
cggcucguccggg

SEQ ID NO: 1140717 - RNA, 14 nt, Mycobacterium bovis subsp bovis AF2122/97
cggcucgggcagcg

SEQ ID NO: 1140718 - RNA, 22 nt, Mycobacterium bovis subsp bovis AF2122/97
cggcucgucagguuccgcgaca

SEQ ID NO: 1140719 - RNA, 19 nt, Mycobacterium bovis subsp bovis AF2122/97
cggcucgguggcguauucg

SEQ ID NO: 1140720 - RNA, 15 nt, Mycobacterium bovis subsp bovis AF2122/97
cggcucgucgcucga

SEQ ID NO: 1140721 - RNA, 23 nt, Mycobacterium bovis subsp bovis AF2122/97
cggcucgucgaugucgacgucgc

SEQ ID NO: 1140722 - RNA, 19 nt, Mycobacterium bovis subsp bovis AF2122/97
cggcuccacuuggggcgcc

SEQ ID NO: 1140723 - RNA, 21 nt, Mycobacterium bovis subsp bovis AF2122/97
cggcucagucacgcacucccg

SEQ ID NO: 1140724 - RNA, 21 nt, Mycobacterium bovis subsp bovis AF2122/97
cggcucagacgacgaucgcgu

SEQ ID NO: 1140725 - RNA, 13 nt, Mycobacterium bovis subsp bovis AF2122/97
cggcuccaccggg

SEQ ID NO: 1140726 - RNA, 17 nt, Mycobacterium bovis subsp bovis AF2122/97
cggcuccaccgggcccg

SEQ ID NO: 1140727 - RNA, 18 nt, Mycobacterium bovis subsp bovis AF2122/97
cggcuccaccgggcccgc

SEQ ID NO: 1140728 - RNA, 20 nt, Mycobacterium bovis subsp bovis AF2122/97
cggcuccaccgggcccgccg

SEQ ID NO: 1140729 - RNA, 20 nt, Mycobacterium bovis subsp bovis AF2122/97
cggcuagcugaugccugguc

SEQ ID NO: 1140730 - RNA, 22 nt, Mycobacterium bovis subsp bovis AF2122/97
cggcuagcugugcuucguuguc

SEQ ID NO: 1140731 - RNA, 16 nt, Mycobacterium bovis subsp bovis AF2122/97
cggcuagcaacggguc

SEQ ID NO: 1140732 - RNA, 15 nt, Mycobacterium bovis subsp bovis AF2122/97
cggcuacggcugccc

SEQ ID NO: 1140733 - RNA, 17 nt, Mycobacterium bovis subsp bovis AF2122/97
cggcuacuagcgguguc

SEQ ID NO: 1140734 - RNA, 19 nt, Mycobacterium bovis subsp bovis AF2122/97
cggcuauaucccgccccgg

SEQ ID NO: 1140735 - RNA, 21 nt, Mycobacterium bovis subsp bovis AF2122/97
cggcuagggcccuggcggccc

SEQ ID NO: 1140736 - RNA, 23 nt, Mycobacterium bovis subsp bovis AF2122/97
cggcuaggucagcgggcuugccg

SEQ ID NO: 1140737 - RNA, 20 nt, Mycobacterium bovis subsp bovis AF2122/97
cggcuaggagaucagcaccg

SEQ ID NO: 1140738 - RNA, 16 nt, Mycobacterium bovis subsp bovis AF2122/97
cggcuaggcaccagcg

SEQ ID NO: 1140739 - RNA, 17 nt, Mycobacterium bovis subsp bovis AF2122/97
cggcuaggccagcacgg

SEQ ID NO: 1140740 - RNA, 21 nt, Mycobacterium bovis subsp bovis AF2122/97
cggcuauggguucgcgguugu

SEQ ID NO: 1140741 - RNA, 13 nt, Mycobacterium bovis subsp bovis AF2122/97
cggcuaugcuggc

SEQ ID NO: 1140742 - RNA, 19 nt, Mycobacterium bovis subsp bovis AF2122/97
cggcuaugcuggcgcagcg

SEQ ID NO: 1140743 - RNA, 15 nt, Mycobacterium bovis subsp bovis AF2122/97
cggcuauggcgccgc

SEQ ID NO: 1140744 - RNA, 17 nt, Mycobacterium bovis subsp bovis AF2122/97
cggcuauggcgccgcgg

SEQ ID NO: 1140745 - RNA, 18 nt, Mycobacterium bovis subsp bovis AF2122/97
cggcuauggguucgcggu

SEQ ID NO: 1140746 - RNA, 20 nt, Mycobacterium bovis subsp bovis AF2122/97
cggcucaaccucuggcggcg

SEQ ID NO: 1140747 - RNA, 21 nt, Mycobacterium bovis subsp bovis AF2122/97
cggcucaaggacgcaccgcca

SEQ ID NO: 1140748 - RNA, 14 nt, Mycobacterium bovis subsp bovis AF2122/97
cggcucacagcaca

SEQ ID NO: 1140749 - RNA, 16 nt, Mycobacterium bovis subsp bovis AF2122/97
cggcucacagcacagc

SEQ ID NO: 1140750 - RNA, 23 nt, Mycobacterium bovis subsp bovis AF2122/97
cggcucaccgaucccgcggccgg

SEQ ID NO: 1140751 - RNA, 12 nt, Mycobacterium bovis subsp bovis AF2122/97
cggcucaccgcg

SEQ ID NO: 1140752 - RNA, 13 nt, Mycobacterium bovis subsp bovis AF2122/97
cggcucaccgcgc

SEQ ID NO: 1140753 - RNA, 19 nt, Mycobacterium bovis subsp bovis AF2122/97
cggcucacgaccggccaac

SEQ ID NO: 1140754 - RNA, 22 nt, Mycobacterium bovis subsp bovis AF2122/97
cggcucacgaccggccaacgcc

SEQ ID NO: 1140755 - RNA, 15 nt, Mycobacterium bovis subsp bovis AF2122/97
cggcucgccggcgcg

SEQ ID NO: 1140756 - RNA, 17 nt, Mycobacterium bovis subsp bovis AF2122/97
cggcucgccggcgcgca

SEQ ID NO: 1140757 - RNA, 17 nt, Mycobacterium bovis subsp bovis AF2122/97
cggcucgccggcgaccg

SEQ ID NO: 1140758 - RNA, 20 nt, Mycobacterium bovis subsp bovis AF2122/97
cggcucgccggcgaccggga

SEQ ID NO: 1140759 - RNA, 14 nt, Mycobacterium bovis subsp bovis AF2122/97
cggcucgccggcgg

SEQ ID NO: 1140760 - RNA, 15 nt, Mycobacterium bovis subsp bovis AF2122/97
cggcucgccggcggc

SEQ ID NO: 1140761 - RNA, 21 nt, Mycobacterium bovis subsp bovis AF2122/97
cggcucgccggcggcccgcuc

SEQ ID NO: 1140762 - RNA, 20 nt, Mycobacterium bovis subsp bovis AF2122/97
cggcucgccggcucggcggu

SEQ ID NO: 1140763 - RNA, 15 nt, Mycobacterium bovis subsp bovis AF2122/97
cggcucggcccccga

SEQ ID NO: 1140764 - RNA, 15 nt, Mycobacterium bovis subsp bovis AF2122/97
cggcucggccaccga

SEQ ID NO: 1140765 - RNA, 12 nt, Mycobacterium bovis subsp bovis AF2122/97
cggcucggccag

SEQ ID NO: 1140766 - RNA, 15 nt, Mycobacterium bovis subsp bovis AF2122/97
cggcucggccagcca

SEQ ID NO: 1140767 - RNA, 22 nt, Mycobacterium bovis subsp bovis AF2122/97
cggcucggccagccagcgggcg

SEQ ID NO: 1140768 - RNA, 19 nt, Mycobacterium bovis subsp bovis AF2122/97
cggcucggaaaccgccccg

SEQ ID NO: 1140769 - RNA, 18 nt, Mycobacterium bovis subsp bovis AF2122/97
cggcucggcaggugacca

SEQ ID NO: 1140770 - RNA, 12 nt, Mycobacterium bovis subsp bovis AF2122/97
cggcucggcgcu

SEQ ID NO: 1140771 - RNA, 21 nt, Mycobacterium bovis subsp bovis AF2122/97
cggcuccuccgguaucggcga

SEQ ID NO: 1140772 - RNA, 17 nt, Mycobacterium bovis subsp bovis AF2122/97
cggcucgagcucggcga

SEQ ID NO: 1140773 - RNA, 21 nt, Mycobacterium bovis subsp bovis AF2122/97
cggcucgaauacggugccaag

SEQ ID NO: 1140774 - RNA, 23 nt, Mycobacterium bovis subsp bovis AF2122/97
cggcuccagcaccgugacccuga

SEQ ID NO: 1140775 - RNA, 13 nt, Mycobacterium bovis subsp bovis AF2122/97
cggcucgagucgc

SEQ ID NO: 1140776 - RNA, 22 nt, Mycobacterium bovis subsp bovis AF2122/97
cggcucgagucgcagcacgggu

SEQ ID NO: 1140777 - RNA, 21 nt, Mycobacterium bovis subsp bovis AF2122/97
cggcucgccgacccgccgcgg

SEQ ID NO: 1140778 - RNA, 16 nt, Mycobacterium bovis subsp bovis AF2122/97
cggcucgacgcgucgc

SEQ ID NO: 1140779 - RNA, 18 nt, Mycobacterium bovis subsp bovis AF2122/97
cggcuccuccccggcccg

SEQ ID NO: 1140780 - RNA, 22 nt, Mycobacterium bovis subsp bovis AF2122/97
cggcuccuccccggcccgcuca

SEQ ID NO: 1140781 - RNA, 16 nt, Mycobacterium bovis subsp bovis AF2122/97
cggcuccggcggugcc

SEQ ID NO: 1140782 - RNA, 13 nt, Mycobacterium bovis subsp bovis AF2122/97
cggcuccgggacg

SEQ ID NO: 1140783 - RNA, 17 nt, Mycobacterium bovis subsp bovis AF2122/97
cggcuccgauuccgaac

SEQ ID NO: 1140784 - RNA, 20 nt, Mycobacterium bovis subsp bovis AF2122/97
cggcuccgccguugccgccg

SEQ ID NO: 1140785 - RNA, 21 nt, Mycobacterium bovis subsp bovis AF2122/97
cggcuccgccguugccgccgc

SEQ ID NO: 1140786 - RNA, 11 nt, Mycobacterium bovis subsp bovis AF2122/97
cggcucccggg

SEQ ID NO: 1140787 - RNA, 20 nt, Mycobacterium bovis subsp bovis AF2122/97
cggcuccgaaggccgccagu

SEQ ID NO: 1140788 - RNA, 13 nt, Mycobacterium bovis subsp bovis AF2122/97
cggcuccgcagcg

SEQ ID NO: 1140789 - RNA, 14 nt, Mycobacterium bovis subsp bovis AF2122/97
cggcuccgccacug

SEQ ID NO: 1140790 - RNA, 20 nt, Mycobacterium bovis subsp bovis AF2122/97
cggcuccgccacuggcgccg

SEQ ID NO: 1140791 - RNA, 21 nt, Mycobacterium bovis subsp bovis AF2122/97
cggcuccgccacuggcgccgg

SEQ ID NO: 1140792 - RNA, 13 nt, Mycobacterium bovis subsp bovis AF2122/97
cggcuccgccgcg

SEQ ID NO: 1140793 - RNA, 14 nt, Mycobacterium bovis subsp bovis AF2122/97
cggcuccgccgcgg

SEQ ID NO: 1140794 - RNA, 14 nt, Mycobacterium bovis subsp bovis AF2122/97
cggcuccgccguug

SEQ ID NO: 1140795 - RNA, 15 nt, Mycobacterium bovis subsp bovis AF2122/97
cggcuccgccguugc

SEQ ID NO: 1140796 - RNA, 17 nt, Mycobacterium bovis subsp bovis AF2122/97
cggcuccgccguugccg

SEQ ID NO: 1140797 - RNA, 19 nt, Mycobacterium bovis subsp bovis AF2122/97
cggcuccgccguugccgcc

SEQ ID NO: 1140798 - RNA, 14 nt, Mycobacterium bovis subsp bovis AF2122/97
cggcgucgaaggug

SEQ ID NO: 1140799 - RNA, 22 nt, Mycobacterium bovis subsp bovis AF2122/97
cggcgucgaaggugaccaggcg

SEQ ID NO: 1140800 - RNA, 13 nt, Mycobacterium bovis subsp bovis AF2122/97
cggcgucgaagug

SEQ ID NO: 1140801 - RNA, 19 nt, Mycobacterium bovis subsp bovis AF2122/97
cggcgucgaagugggugaa

SEQ ID NO: 1140802 - RNA, 15 nt, Mycobacterium bovis subsp bovis AF2122/97
cggcgucgacgucgg

SEQ ID NO: 1140803 - RNA, 17 nt, Mycobacterium bovis subsp bovis AF2122/97
cggcgucgaccucgcgg

SEQ ID NO: 1140804 - RNA, 19 nt, Mycobacterium bovis subsp bovis AF2122/97
cggcgucgccgccauugcc

SEQ ID NO: 1140805 - RNA, 13 nt, Mycobacterium bovis subsp bovis AF2122/97
cggcgucgcuggc

SEQ ID NO: 1140806 - RNA, 16 nt, Mycobacterium bovis subsp bovis AF2122/97
cggcgucggccaccgc

SEQ ID NO: 1140807 - RNA, 22 nt, Mycobacterium bovis subsp bovis AF2122/97
cggcgucgacguccaguccguc

SEQ ID NO: 1140808 - RNA, 16 nt, Mycobacterium bovis subsp bovis AF2122/97
cggcgucggccacccg

SEQ ID NO: 1140809 - RNA, 13 nt, Mycobacterium bovis subsp bovis AF2122/97
cggcgucggcgcc

SEQ ID NO: 1140810 - RNA, 18 nt, Mycobacterium bovis subsp bovis AF2122/97
cggcgucggccaccgccu

SEQ ID NO: 1140811 - RNA, 13 nt, Mycobacterium bovis subsp bovis AF2122/97
cggcgucugcccg

SEQ ID NO: 1140812 - RNA, 19 nt, Mycobacterium bovis subsp bovis AF2122/97
cggcgucugcccgcccagc

SEQ ID NO: 1140813 - RNA, 16 nt, Mycobacterium bovis subsp bovis AF2122/97
cggcgucugcgccaga

SEQ ID NO: 1140814 - RNA, 16 nt, Mycobacterium bovis subsp bovis AF2122/97
cggcgucugcgguggc

SEQ ID NO: 1140815 - RNA, 17 nt, Mycobacterium bovis subsp bovis AF2122/97
cggcgucuguaccacgg

SEQ ID NO: 1140816 - RNA, 23 nt, Mycobacterium bovis subsp bovis AF2122/97
cggcgucuuccucggccacccgc

SEQ ID NO: 1140817 - RNA, 15 nt, Mycobacterium bovis subsp bovis AF2122/97
cggcguccagcagcg

SEQ ID NO: 1140818 - RNA, 23 nt, Mycobacterium bovis subsp bovis AF2122/97
cggcguccaccugcuccgcuguc

SEQ ID NO: 1140819 - RNA, 23 nt, Mycobacterium bovis subsp bovis AF2122/97
cggcgucaggcacaacgcgacgc

SEQ ID NO: 1140820 - RNA, 15 nt, Mycobacterium bovis subsp bovis AF2122/97
cggcgucauccaccg

SEQ ID NO: 1140821 - RNA, 17 nt, Mycobacterium bovis subsp bovis AF2122/97
cggcgucaccguguugc

SEQ ID NO: 1140822 - RNA, 15 nt, Mycobacterium bovis subsp bovis AF2122/97
cggcguagacguccg

SEQ ID NO: 1140823 - RNA, 23 nt, Mycobacterium bovis subsp bovis AF2122/97
cggcguagacguccgcggucgca

SEQ ID NO: 1140824 - RNA, 18 nt, Mycobacterium bovis subsp bovis AF2122/97
cggcguacuucgacagcg

SEQ ID NO: 1140825 - RNA, 20 nt, Mycobacterium bovis subsp bovis AF2122/97
cggcguacuucgacagcggc

SEQ ID NO: 1140826 - RNA, 19 nt, Mycobacterium bovis subsp bovis AF2122/97
cggcgucagccccgacugc

SEQ ID NO: 1140827 - RNA, 13 nt, Mycobacterium bovis subsp bovis AF2122/97
cggcgucacggcg

SEQ ID NO: 1140828 - RNA, 15 nt, Mycobacterium bovis subsp bovis AF2122/97
cggcgucagccccga

SEQ ID NO: 1140829 - RNA, 17 nt, Mycobacterium bovis subsp bovis AF2122/97
cggcggcccguuugccg

SEQ ID NO: 1140830 - RNA, 20 nt, Mycobacterium bovis subsp bovis AF2122/97
cggcggcccguuugccgguu

SEQ ID NO: 1140831 - RNA, 16 nt, Mycobacterium bovis subsp bovis AF2122/97
cggcggcccgcucggg

SEQ ID NO: 1140832 - RNA, 21 nt, Mycobacterium bovis subsp bovis AF2122/97
cggcggcccuaaacaccgcga

SEQ ID NO: 1140833 - RNA, 20 nt, Mycobacterium bovis subsp bovis AF2122/97
cggcggcccuuuccagggga

SEQ ID NO: 1140834 - RNA, 15 nt, Mycobacterium bovis subsp bovis AF2122/97
cggcguacucggcau

SEQ ID NO: 1140835 - RNA, 21 nt, Mycobacterium bovis subsp bovis AF2122/97
cggcguacucggugaucgcgg

SEQ ID NO: 1140836 - RNA, 22 nt, Mycobacterium bovis subsp bovis AF2122/97
cggcguacccguuaugcgccgc

SEQ ID NO: 1140837 - RNA, 15 nt, Mycobacterium bovis subsp bovis AF2122/97
cggcguacagcgccu

SEQ ID NO: 1140838 - RNA, 16 nt, Mycobacterium bovis subsp bovis AF2122/97
cggcguacagcgccug

SEQ ID NO: 1140839 - RNA, 18 nt, Mycobacterium bovis subsp bovis AF2122/97
cggcguacaaaccgucgg

SEQ ID NO: 1140840 - RNA, 15 nt, Mycobacterium bovis subsp bovis AF2122/97
cggcggcccgcagcc

SEQ ID NO: 1140841 - RNA, 21 nt, Mycobacterium bovis subsp bovis AF2122/97
cggcguacaaaccgucgggga

SEQ ID NO: 1140842 - RNA, 13 nt, Mycobacterium bovis subsp bovis AF2122/97
cggcgugcgcgag

SEQ ID NO: 1140843 - RNA, 15 nt, Mycobacterium bovis subsp bovis AF2122/97
cggcgugccgggugg

SEQ ID NO: 1140844 - RNA, 15 nt, Mycobacterium bovis subsp bovis AF2122/97
cggcgugcggcgagg

SEQ ID NO: 1140845 - RNA, 20 nt, Mycobacterium bovis subsp bovis AF2122/97
cggcgugcuugcccagguug

SEQ ID NO: 1140846 - RNA, 22 nt, Mycobacterium bovis subsp bovis AF2122/97
cggcguggaucaguuugccauc

SEQ ID NO: 1140847 - RNA, 22 nt, Mycobacterium bovis subsp bovis AF2122/97
cggcguggucgcgcggcaccga

SEQ ID NO: 1140848 - RNA, 21 nt, Mycobacterium bovis subsp bovis AF2122/97
cggcguggugagccucggcga

SEQ ID NO: 1140849 - RNA, 16 nt, Mycobacterium bovis subsp bovis AF2122/97
cggcgugucacgucgc

SEQ ID NO: 1140850 - RNA, 15 nt, Mycobacterium bovis subsp bovis AF2122/97
cggcgugguguccac

SEQ ID NO: 1140851 - RNA, 18 nt, Mycobacterium bovis subsp bovis AF2122/97
cggcguguacgucgauca

SEQ ID NO: 1140852 - RNA, 13 nt, Mycobacterium bovis subsp bovis AF2122/97
cggcguguccgcc

SEQ ID NO: 1140853 - RNA, 20 nt, Mycobacterium bovis subsp bovis AF2122/97
cggcguuaaugcuucgcguc

SEQ ID NO: 1140854 - RNA, 14 nt, Mycobacterium bovis subsp bovis AF2122/97
cggcguuaccaccg

SEQ ID NO: 1140855 - RNA, 22 nt, Mycobacterium bovis subsp bovis AF2122/97
cggcguuaccaccgucaccgcc

SEQ ID NO: 1140856 - RNA, 19 nt, Mycobacterium bovis subsp bovis AF2122/97
cggcgugucgccgccacca

SEQ ID NO: 1140857 - RNA, 16 nt, Mycobacterium bovis subsp bovis AF2122/97
cggcgugucucgucgc

SEQ ID NO: 1140858 - RNA, 16 nt, Mycobacterium bovis subsp bovis AF2122/97
cggcguuagcguagcc

SEQ ID NO: 1140859 - RNA, 19 nt, Mycobacterium bovis subsp bovis AF2122/97
cggcguuagucgaucacgu

SEQ ID NO: 1140860 - RNA, 17 nt, Mycobacterium bovis subsp bovis AF2122/97
cggcguugagcuggcgg

SEQ ID NO: 1140861 - RNA, 18 nt, Mycobacterium bovis subsp bovis AF2122/97
cggcguugagcuggcggu

SEQ ID NO: 1140862 - RNA, 16 nt, Mycobacterium bovis subsp bovis AF2122/97
cggcguuccgggccga

SEQ ID NO: 1140863 - RNA, 20 nt, Mycobacterium bovis subsp bovis AF2122/97
cggcguuccgggccgaucac

SEQ ID NO: 1140864 - RNA, 14 nt, Mycobacterium bovis subsp bovis AF2122/97
cggcguugccgaaa

SEQ ID NO: 1140865 - RNA, 20 nt, Mycobacterium bovis subsp bovis AF2122/97
cggcguugccgaaacccgag

SEQ ID NO: 1140866 - RNA, 21 nt, Mycobacterium bovis subsp bovis AF2122/97
cggcguugccgaaacccgagu

SEQ ID NO: 1140867 - RNA, 13 nt, Mycobacterium bovis subsp bovis AF2122/97
cggcguugaucga

SEQ ID NO: 1140868 - RNA, 22 nt, Mycobacterium bovis subsp bovis AF2122/97
cggcguugaucgacaucaccac

SEQ ID NO: 1140869 - RNA, 17 nt, Mycobacterium bovis subsp bovis AF2122/97
cggcguugccgccggcu

SEQ ID NO: 1140870 - RNA, 15 nt, Mycobacterium bovis subsp bovis AF2122/97
cggcguugccgccgu

SEQ ID NO: 1140871 - RNA, 13 nt, Mycobacterium bovis subsp bovis AF2122/97
cggcguugccgcc

SEQ ID NO: 1140872 - RNA, 15 nt, Mycobacterium bovis subsp bovis AF2122/97
cggcguugccgccgg

SEQ ID NO: 1140873 - RNA, 23 nt, Mycobacterium bovis subsp bovis AF2122/97
cggcguugccgccguuaccgccg

SEQ ID NO: 1140874 - RNA, 19 nt, Mycobacterium bovis subsp bovis AF2122/97
cggcguugcggaaucagca

SEQ ID NO: 1140875 - RNA, 20 nt, Mycobacterium bovis subsp bovis AF2122/97
cggcguuggaaaagucgggc

SEQ ID NO: 1140876 - RNA, 13 nt, Mycobacterium bovis subsp bovis AF2122/97
cggcguuggcgcc

SEQ ID NO: 1140877 - RNA, 14 nt, Mycobacterium bovis subsp bovis AF2122/97
cggcguuggcgccg

SEQ ID NO: 1140878 - RNA, 17 nt, Mycobacterium bovis subsp bovis AF2122/97
cggcguuggcgccguua

SEQ ID NO: 1140879 - RNA, 19 nt, Mycobacterium bovis subsp bovis AF2122/97
cggcguuggcgccguuacc

SEQ ID NO: 1140880 - RNA, 15 nt, Mycobacterium bovis subsp bovis AF2122/97
cggcguugucgacga

SEQ ID NO: 1140881 - RNA, 19 nt, Mycobacterium bovis subsp bovis AF2122/97
cggcguuguggcguguggc

SEQ ID NO: 1140882 - RNA, 18 nt, Mycobacterium bovis subsp bovis AF2122/97
cggcguuguugaccagca

SEQ ID NO: 1140883 - RNA, 19 nt, Mycobacterium bovis subsp bovis AF2122/97
cggcguuugaggcagcgua

SEQ ID NO: 1140884 - RNA, 18 nt, Mycobacterium bovis subsp bovis AF2122/97
cggcguuuccuucgacga

SEQ ID NO: 1140885 - RNA, 19 nt, Mycobacterium bovis subsp bovis AF2122/97
cggcguuuccuucgacgaa

SEQ ID NO: 1140886 - RNA, 18 nt, Mycobacterium bovis subsp bovis AF2122/97
cggcuaccuuguccggcc

SEQ ID NO: 1140887 - RNA, 20 nt, Mycobacterium bovis subsp bovis AF2122/97
cggcuaccuuguccggcccg

SEQ ID NO: 1140888 - RNA, 21 nt, Mycobacterium bovis subsp bovis AF2122/97
cggcuaccuuguccggcccgu

SEQ ID NO: 1140889 - RNA, 15 nt, Mycobacterium bovis subsp bovis AF2122/97
cggcuacgacggcgc

SEQ ID NO: 1140890 - RNA, 18 nt, Mycobacterium bovis subsp bovis AF2122/97
cggcuacgccucggcgug

SEQ ID NO: 1140891 - RNA, 23 nt, Mycobacterium bovis subsp bovis AF2122/97
cggcuacggccagugccaucgcc

SEQ ID NO: 1140892 - RNA, 15 nt, Mycobacterium bovis subsp bovis AF2122/97
cggcuacggcgacac

SEQ ID NO: 1140893 - RNA, 13 nt, Mycobacterium bovis subsp bovis AF2122/97
cggcuaccggcgu

SEQ ID NO: 1140894 - RNA, 15 nt, Mycobacterium bovis subsp bovis AF2122/97
cggcuaccggcgugu

SEQ ID NO: 1140895 - RNA, 17 nt, Mycobacterium bovis subsp bovis AF2122/97
cggcuaccgccgaccgg

SEQ ID NO: 1140896 - RNA, 21 nt, Mycobacterium bovis subsp bovis AF2122/97
cggcuaccgcgcucccggcgu

SEQ ID NO: 1140897 - RNA, 18 nt, Mycobacterium bovis subsp bovis AF2122/97
cggcuaccuaacccgcac

SEQ ID NO: 1140898 - RNA, 17 nt, Mycobacterium bovis subsp bovis AF2122/97
cggcuaccccgcagaau

SEQ ID NO: 1140899 - RNA, 19 nt, Mycobacterium bovis subsp bovis AF2122/97
cggcuaccccgcagaaucc

SEQ ID NO: 1140900 - RNA, 21 nt, Mycobacterium bovis subsp bovis AF2122/97
cggcuaccgccuugucggcga

SEQ ID NO: 1140901 - RNA, 17 nt, Mycobacterium bovis subsp bovis AF2122/97
cggcuaccgcgcucccg

SEQ ID NO: 1140902 - RNA, 20 nt, Mycobacterium bovis subsp bovis AF2122/97
cggcuaccgcgcucccggcg

SEQ ID NO: 1140903 - RNA, 22 nt, Mycobacterium bovis subsp bovis AF2122/97
cggcuaagccuucggugucgcc

SEQ ID NO: 1140904 - RNA, 14 nt, Mycobacterium bovis subsp bovis AF2122/97
cggcuacaucggcg

SEQ ID NO: 1140905 - RNA, 17 nt, Mycobacterium bovis subsp bovis AF2122/97
cggcuacaucggcggcg

SEQ ID NO: 1140906 - RNA, 18 nt, Mycobacterium bovis subsp bovis AF2122/97
cggcuacaucggcggcgu

SEQ ID NO: 1140907 - RNA, 19 nt, Mycobacterium bovis subsp bovis AF2122/97
cggcuaagccuucgguguc

SEQ ID NO: 1140908 - RNA, 20 nt, Mycobacterium bovis subsp bovis AF2122/97
cggcuaacuggacuggggcg

SEQ ID NO: 1140909 - RNA, 15 nt, Mycobacterium bovis subsp bovis AF2122/97
cgggucccggcagcu

SEQ ID NO: 1140910 - RNA, 20 nt, Mycobacterium bovis subsp bovis AF2122/97
cggguccgaaguacuggccg

SEQ ID NO: 1140911 - RNA, 13 nt, Mycobacterium bovis subsp bovis AF2122/97
cggguccccaccg

SEQ ID NO: 1140912 - RNA, 14 nt, Mycobacterium bovis subsp bovis AF2122/97
cggguccccaccgg

SEQ ID NO: 1140913 - RNA, 15 nt, Mycobacterium bovis subsp bovis AF2122/97
cggguccagcccgga

SEQ ID NO: 1140914 - RNA, 21 nt, Mycobacterium bovis subsp bovis AF2122/97
cggguccagcccggaacccga

SEQ ID NO: 1140915 - RNA, 18 nt, Mycobacterium bovis subsp bovis AF2122/97
cggguccuucugccggga

SEQ ID NO: 1140916 - RNA, 20 nt, Mycobacterium bovis subsp bovis AF2122/97
cgggucgaacaggccggccg

SEQ ID NO: 1140917 - RNA, 23 nt, Mycobacterium bovis subsp bovis AF2122/97
cgggucgaacuugaucaccgcgu

SEQ ID NO: 1140918 - RNA, 19 nt, Mycobacterium bovis subsp bovis AF2122/97
cgggucgaagcgauccggc

SEQ ID NO: 1140919 - RNA, 14 nt, Mycobacterium bovis subsp bovis AF2122/97
cgggucgaccccgg

SEQ ID NO: 1140920 - RNA, 16 nt, Mycobacterium bovis subsp bovis AF2122/97
cgggucgaaucguguc

SEQ ID NO: 1140921 - RNA, 19 nt, Mycobacterium bovis subsp bovis AF2122/97
cgggucgaaucgugucgcc

SEQ ID NO: 1140922 - RNA, 13 nt, Mycobacterium bovis subsp bovis AF2122/97
cggguccggugaa

SEQ ID NO: 1140923 - RNA, 19 nt, Mycobacterium bovis subsp bovis AF2122/97
cggguccggugaacccgau

SEQ ID NO: 1140924 - RNA, 17 nt, Mycobacterium bovis subsp bovis AF2122/97
cggguccucgcggagcc

SEQ ID NO: 1140925 - RNA, 12 nt, Mycobacterium bovis subsp bovis AF2122/97
cgggucgauggg

SEQ ID NO: 1140926 - RNA, 14 nt, Mycobacterium bovis subsp bovis AF2122/97
cgggucgaugucgg

SEQ ID NO: 1140927 - RNA, 16 nt, Mycobacterium bovis subsp bovis AF2122/97
cgggucgaugucggca

SEQ ID NO: 1140928 - RNA, 18 nt, Mycobacterium bovis subsp bovis AF2122/97
cgggucgcaccccggcgg

SEQ ID NO: 1140929 - RNA, 19 nt, Mycobacterium bovis subsp bovis AF2122/97
cgggucgcaccccggcggc

SEQ ID NO: 1140930 - RNA, 13 nt, Mycobacterium bovis subsp bovis AF2122/97
cgggucgccgcca

SEQ ID NO: 1140931 - RNA, 20 nt, Mycobacterium bovis subsp bovis AF2122/97
cgggucgccggacugcggcc

SEQ ID NO: 1140932 - RNA, 14 nt, Mycobacterium bovis subsp bovis AF2122/97
cgggucgccgggcc

SEQ ID NO: 1140933 - RNA, 16 nt, Mycobacterium bovis subsp bovis AF2122/97
cgggucgccgggcccg

SEQ ID NO: 1140934 - RNA, 14 nt, Mycobacterium bovis subsp bovis AF2122/97
cgggucgcgcuggc

SEQ ID NO: 1140935 - RNA, 16 nt, Mycobacterium bovis subsp bovis AF2122/97
cgggucgaucaccgac

SEQ ID NO: 1140936 - RNA, 17 nt, Mycobacterium bovis subsp bovis AF2122/97
cgggucgaucaccgaca

SEQ ID NO: 1140937 - RNA, 24 nt, Mycobacterium bovis subsp bovis AF2122/97
cgggucgaucaccgacaccguguu

SEQ ID NO: 1140938 - RNA, 13 nt, Mycobacterium bovis subsp bovis AF2122/97
cgggucgaucacc

SEQ ID NO: 1140939 - RNA, 14 nt, Mycobacterium bovis subsp bovis AF2122/97
cgggucgaucaccg

SEQ ID NO: 1140940 - RNA, 19 nt, Mycobacterium bovis subsp bovis AF2122/97
cgggucgaguccgacgggg

SEQ ID NO: 1140941 - RNA, 14 nt, Mycobacterium bovis subsp bovis AF2122/97
cgggucgagugcgg

SEQ ID NO: 1140942 - RNA, 20 nt, Mycobacterium bovis subsp bovis AF2122/97
cgggucgagccggacccggu

SEQ ID NO: 1140943 - RNA, 20 nt, Mycobacterium bovis subsp bovis AF2122/97
cgggucgaccccggccagga

SEQ ID NO: 1140944 - RNA, 14 nt, Mycobacterium bovis subsp bovis AF2122/97
cgggucgagccgga

SEQ ID NO: 1140945 - RNA, 21 nt, Mycobacterium bovis subsp bovis AF2122/97
cggguagggcaucgucgccga

SEQ ID NO: 1140946 - RNA, 16 nt, Mycobacterium bovis subsp bovis AF2122/97
cggguagcugccgcgg

SEQ ID NO: 1140947 - RNA, 17 nt, Mycobacterium bovis subsp bovis AF2122/97
cggguagcugccgcggc

SEQ ID NO: 1140948 - RNA, 19 nt, Mycobacterium bovis subsp bovis AF2122/97
cggguagccggcgugcacu

SEQ ID NO: 1140949 - RNA, 14 nt, Mycobacterium bovis subsp bovis AF2122/97
cggguagccgucga

SEQ ID NO: 1140950 - RNA, 15 nt, Mycobacterium bovis subsp bovis AF2122/97
cggguagcggcgccg

SEQ ID NO: 1140951 - RNA, 16 nt, Mycobacterium bovis subsp bovis AF2122/97
cggguagcggcgccgc

SEQ ID NO: 1140952 - RNA, 18 nt, Mycobacterium bovis subsp bovis AF2122/97
cggguagcggcgccgccc

SEQ ID NO: 1140953 - RNA, 20 nt, Mycobacterium bovis subsp bovis AF2122/97
cggguagcgguucaucaccg

SEQ ID NO: 1140954 - RNA, 13 nt, Mycobacterium bovis subsp bovis AF2122/97
cggguagccggcg

SEQ ID NO: 1140955 - RNA, 12 nt, Mycobacterium bovis subsp bovis AF2122/97
aaccagcagcag

SEQ ID NO: 1140956 - RNA, 17 nt, Mycobacterium bovis subsp bovis AF2122/97
aaccagaguucggccag

SEQ ID NO: 1140957 - RNA, 14 nt, Mycobacterium bovis subsp bovis AF2122/97
cggguaggccgccg

SEQ ID NO: 1140958 - RNA, 13 nt, Mycobacterium bovis subsp bovis AF2122/97
cggguagucgggc

SEQ ID NO: 1140959 - RNA, 13 nt, Mycobacterium bovis subsp bovis AF2122/97
cggguaucgccag

SEQ ID NO: 1140960 - RNA, 19 nt, Mycobacterium bovis subsp bovis AF2122/97
cgggucaaugcuggcagcg

SEQ ID NO: 1140961 - RNA, 16 nt, Mycobacterium bovis subsp bovis AF2122/97
cgggucacuccggcgg

SEQ ID NO: 1140962 - RNA, 17 nt, Mycobacterium bovis subsp bovis AF2122/97
cgggucacuccggcggc

SEQ ID NO: 1140963 - RNA, 21 nt, Mycobacterium bovis subsp bovis AF2122/97
cgggucacuccggcggcuucg

SEQ ID NO: 1140964 - RNA, 22 nt, Mycobacterium bovis subsp bovis AF2122/97
cgggucacuccggcggcuucgc

SEQ ID NO: 1140965 - RNA, 15 nt, Mycobacterium bovis subsp bovis AF2122/97
cgggucaccagcgca

SEQ ID NO: 1140966 - RNA, 15 nt, Mycobacterium bovis subsp bovis AF2122/97
cgggucagcccagcc

SEQ ID NO: 1140967 - RNA, 21 nt, Mycobacterium bovis subsp bovis AF2122/97
cgggucagcaccaccagcagc

SEQ ID NO: 1140968 - RNA, 14 nt, Mycobacterium bovis subsp bovis AF2122/97
cgggucagcaccac

SEQ ID NO: 1140969 - RNA, 22 nt, Mycobacterium bovis subsp bovis AF2122/97
cgggucaccgauucggccagcg

SEQ ID NO: 1140970 - RNA, 16 nt, Mycobacterium bovis subsp bovis AF2122/97
cgggucacccccggcc

SEQ ID NO: 1140971 - RNA, 17 nt, Mycobacterium bovis subsp bovis AF2122/97
cgggucaucuugccacc

SEQ ID NO: 1140972 - RNA, 19 nt, Mycobacterium bovis subsp bovis AF2122/97
cggguccaagaaccacgac

SEQ ID NO: 1140973 - RNA, 24 nt, Mycobacterium bovis subsp bovis AF2122/97
cggguccaagaaccacgacguugc

SEQ ID NO: 1140974 - RNA, 16 nt, Mycobacterium bovis subsp bovis AF2122/97
cgggucaggccagggu

SEQ ID NO: 1140975 - RNA, 18 nt, Mycobacterium bovis subsp bovis AF2122/97
cgggucagcccggcgcga

SEQ ID NO: 1140976 - RNA, 20 nt, Mycobacterium bovis subsp bovis AF2122/97
cgggucagcugacgggccgc

SEQ ID NO: 1140977 - RNA, 13 nt, Mycobacterium bovis subsp bovis AF2122/97
cgggucagcgcgu

SEQ ID NO: 1140978 - RNA, 15 nt, Mycobacterium bovis subsp bovis AF2122/97
cgggcucgcugcacc

SEQ ID NO: 1140979 - RNA, 16 nt, Mycobacterium bovis subsp bovis AF2122/97
cgggcucggcaggccc

SEQ ID NO: 1140980 - RNA, 23 nt, Mycobacterium bovis subsp bovis AF2122/97
cgggcucgcuucaggcaccggau

SEQ ID NO: 1140981 - RNA, 15 nt, Mycobacterium bovis subsp bovis AF2122/97
cgggcucguguccgc

SEQ ID NO: 1140982 - RNA, 17 nt, Mycobacterium bovis subsp bovis AF2122/97
cgggcucguguccgccg

SEQ ID NO: 1140983 - RNA, 21 nt, Mycobacterium bovis subsp bovis AF2122/97
cgggcucguguccgccgucac

SEQ ID NO: 1140984 - RNA, 19 nt, Mycobacterium bovis subsp bovis AF2122/97
cgggcucuacucgcggccg

SEQ ID NO: 1140985 - RNA, 20 nt, Mycobacterium bovis subsp bovis AF2122/97
cgggcucggcgucgccgcca

SEQ ID NO: 1140986 - RNA, 15 nt, Mycobacterium bovis subsp bovis AF2122/97
cgggcucguccagca

SEQ ID NO: 1140987 - RNA, 13 nt, Mycobacterium bovis subsp bovis AF2122/97
cggggucgccggc

SEQ ID NO: 1140988 - RNA, 13 nt, Mycobacterium bovis subsp bovis AF2122/97
cgggguccgcggc

SEQ ID NO: 1140989 - RNA, 20 nt, Mycobacterium bovis subsp bovis AF2122/97
cgggguccaucggggccguc

SEQ ID NO: 1140990 - RNA, 17 nt, Mycobacterium bovis subsp bovis AF2122/97
cgggcucucggcgucga

SEQ ID NO: 1140991 - RNA, 20 nt, Mycobacterium bovis subsp bovis AF2122/97
cggggucaacaggccguggc

SEQ ID NO: 1140992 - RNA, 22 nt, Mycobacterium bovis subsp bovis AF2122/97
cggggucaaucccacgcccggc

SEQ ID NO: 1140993 - RNA, 13 nt, Mycobacterium bovis subsp bovis AF2122/97
cggggucaccggc

SEQ ID NO: 1140994 - RNA, 14 nt, Mycobacterium bovis subsp bovis AF2122/97
cggggucaccggcu

SEQ ID NO: 1140995 - RNA, 17 nt, Mycobacterium bovis subsp bovis AF2122/97
cggggucaccuuggccg

SEQ ID NO: 1140996 - RNA, 13 nt, Mycobacterium bovis subsp bovis AF2122/97
cggggugccggcu

SEQ ID NO: 1140997 - RNA, 21 nt, Mycobacterium bovis subsp bovis AF2122/97
cggggugcccggccgccagcg

SEQ ID NO: 1140998 - RNA, 13 nt, Mycobacterium bovis subsp bovis AF2122/97
cggggugcccccg

SEQ ID NO: 1140999 - RNA, 13 nt, Mycobacterium bovis subsp bovis AF2122/97
cggggugcccggc

SEQ ID NO: 1141000 - RNA, 15 nt, Mycobacterium bovis subsp bovis AF2122/97
cggggugcccggccg

SEQ ID NO: 1141001 - RNA, 20 nt, Mycobacterium bovis subsp bovis AF2122/97
cggggugcccggccgccagc

SEQ ID NO: 1141002 - RNA, 21 nt, Mycobacterium bovis subsp bovis AF2122/97
cggggucgcggaucucaucgg

SEQ ID NO: 1141003 - RNA, 21 nt, Mycobacterium bovis subsp bovis AF2122/97
cggggucgaacaugauccgcc

SEQ ID NO: 1141004 - RNA, 17 nt, Mycobacterium bovis subsp bovis AF2122/97
cggggugcacgaugacg

SEQ ID NO: 1141005 - RNA, 17 nt, Mycobacterium bovis subsp bovis AF2122/97
cgggguggucgcaccgc

SEQ ID NO: 1141006 - RNA, 19 nt, Mycobacterium bovis subsp bovis AF2122/97
cgggguggucgcaccgccg

SEQ ID NO: 1141007 - RNA, 21 nt, Mycobacterium bovis subsp bovis AF2122/97
cgggguggucgcaccgccggc

SEQ ID NO: 1141008 - RNA, 12 nt, Mycobacterium bovis subsp bovis AF2122/97
cgggguggugga

SEQ ID NO: 1141009 - RNA, 22 nt, Mycobacterium bovis subsp bovis AF2122/97
cggggugguggaagguguuggu

SEQ ID NO: 1141010 - RNA, 17 nt, Mycobacterium bovis subsp bovis AF2122/97
cgggguggccaccagcg

SEQ ID NO: 1141011 - RNA, 18 nt, Mycobacterium bovis subsp bovis AF2122/97
cgggguggccaccagcgg

SEQ ID NO: 1141012 - RNA, 15 nt, Mycobacterium bovis subsp bovis AF2122/97
cggggugcgcgcgac

SEQ ID NO: 1141013 - RNA, 20 nt, Mycobacterium bovis subsp bovis AF2122/97
cggguagauguucacgccgc

SEQ ID NO: 1141014 - RNA, 23 nt, Mycobacterium bovis subsp bovis AF2122/97
cggguagauguucacgccgccgg

SEQ ID NO: 1141015 - RNA, 22 nt, Mycobacterium bovis subsp bovis AF2122/97
aaccaccgguccagcgccggaa

SEQ ID NO: 1141016 - RNA, 19 nt, Mycobacterium bovis subsp bovis AF2122/97
aaccacucgcucaggaaca

SEQ ID NO: 1141017 - RNA, 16 nt, Mycobacterium bovis subsp bovis AF2122/97
aaccacuuuccgagga

SEQ ID NO: 1141018 - RNA, 18 nt, Mycobacterium bovis subsp bovis AF2122/97
aaccacgccccgaucggu

SEQ ID NO: 1141019 - RNA, 15 nt, Mycobacterium bovis subsp bovis AF2122/97
aaccacgcgcccgca

SEQ ID NO: 1141020 - RNA, 12 nt, Mycobacterium bovis subsp bovis AF2122/97
cggggugguggu

SEQ ID NO: 1141021 - RNA, 14 nt, Mycobacterium bovis subsp bovis AF2122/97
cggggugggugaca

SEQ ID NO: 1141022 - RNA, 14 nt, Mycobacterium bovis subsp bovis AF2122/97
cggggugugcgggc

SEQ ID NO: 1141023 - RNA, 19 nt, Mycobacterium bovis subsp bovis AF2122/97
cggggugugcgggcggugc

SEQ ID NO: 1141024 - RNA, 17 nt, Mycobacterium bovis subsp bovis AF2122/97
cgggguguucgucgacc

SEQ ID NO: 1141025 - RNA, 20 nt, Mycobacterium bovis subsp bovis AF2122/97
cgggguuacucgcagcgccg

SEQ ID NO: 1141026 - RNA, 17 nt, Mycobacterium bovis subsp bovis AF2122/97
cgggguuacucgcagcg

SEQ ID NO: 1141027 - RNA, 20 nt, Mycobacterium bovis subsp bovis AF2122/97
aaccaaccucggaucgccag

SEQ ID NO: 1141028 - RNA, 16 nt, Mycobacterium bovis subsp bovis AF2122/97
aacauuuucgcccgcu

SEQ ID NO: 1141029 - RNA, 23 nt, Mycobacterium bovis subsp bovis AF2122/97
aacauuuucgcccgcuccgggac

SEQ ID NO: 1141030 - RNA, 18 nt, Mycobacterium bovis subsp bovis AF2122/97
cgggugacucgggcacgg

SEQ ID NO: 1141031 - RNA, 15 nt, Mycobacterium bovis subsp bovis AF2122/97
cgggugacucgggca

SEQ ID NO: 1141032 - RNA, 16 nt, Mycobacterium bovis subsp bovis AF2122/97
cgggugaguucggcgu

SEQ ID NO: 1141033 - RNA, 17 nt, Mycobacterium bovis subsp bovis AF2122/97
cgggugaguucggcgua

SEQ ID NO: 1141034 - RNA, 21 nt, Mycobacterium bovis subsp bovis AF2122/97
cgggugauggaugggucgacc

SEQ ID NO: 1141035 - RNA, 22 nt, Mycobacterium bovis subsp bovis AF2122/97
cgggugauggaugggucgaccg

SEQ ID NO: 1141036 - RNA, 17 nt, Mycobacterium bovis subsp bovis AF2122/97
cgggugaucuuggcgcc

SEQ ID NO: 1141037 - RNA, 20 nt, Mycobacterium bovis subsp bovis AF2122/97
cgggugaucuuggcgcccgc

SEQ ID NO: 1141038 - RNA, 15 nt, Mycobacterium bovis subsp bovis AF2122/97
cgggugcgacaucgg

SEQ ID NO: 1141039 - RNA, 17 nt, Mycobacterium bovis subsp bovis AF2122/97
cgggugcgacaucgguc

SEQ ID NO: 1141040 - RNA, 18 nt, Mycobacterium bovis subsp bovis AF2122/97
cgggugccgagcuggcga

SEQ ID NO: 1141041 - RNA, 16 nt, Mycobacterium bovis subsp bovis AF2122/97
cgggugccgacgucgg

SEQ ID NO: 1141042 - RNA, 16 nt, Mycobacterium bovis subsp bovis AF2122/97
cgggugcauucugcgg

SEQ ID NO: 1141043 - RNA, 12 nt, Mycobacterium bovis subsp bovis AF2122/97
cgggugccagcc

SEQ ID NO: 1141044 - RNA, 15 nt, Mycobacterium bovis subsp bovis AF2122/97
cgggugccagcccgu

SEQ ID NO: 1141045 - RNA, 16 nt, Mycobacterium bovis subsp bovis AF2122/97
cgggugccaucggugg

SEQ ID NO: 1141046 - RNA, 20 nt, Mycobacterium bovis subsp bovis AF2122/97
cgggugccaucggugguggc

SEQ ID NO: 1141047 - RNA, 19 nt, Mycobacterium bovis subsp bovis AF2122/97
cgggugcaacggcguuggc

SEQ ID NO: 1141048 - RNA, 20 nt, Mycobacterium bovis subsp bovis AF2122/97
cgggugcagcacggcgccgc

SEQ ID NO: 1141049 - RNA, 16 nt, Mycobacterium bovis subsp bovis AF2122/97
cgggugcagcgcaacc

SEQ ID NO: 1141050 - RNA, 13 nt, Mycobacterium bovis subsp bovis AF2122/97
cgggugcaggcga

SEQ ID NO: 1141051 - RNA, 14 nt, Mycobacterium bovis subsp bovis AF2122/97
cgggugaccaggcg

SEQ ID NO: 1141052 - RNA, 17 nt, Mycobacterium bovis subsp bovis AF2122/97
aaccagcuugcgccgca

SEQ ID NO: 1141053 - RNA, 12 nt, Mycobacterium bovis subsp bovis AF2122/97
aaccagcgccac

SEQ ID NO: 1141054 - RNA, 19 nt, Mycobacterium bovis subsp bovis AF2122/97
cgggugaccaggcggcgcg

SEQ ID NO: 1141055 - RNA, 19 nt, Mycobacterium bovis subsp bovis AF2122/97
aaccaguccucgggcaggc

SEQ ID NO: 1141056 - RNA, 23 nt, Mycobacterium bovis subsp bovis AF2122/97
aaccagugaccguauuucgucca

SEQ ID NO: 1141057 - RNA, 16 nt, Mycobacterium bovis subsp bovis AF2122/97
aaccagugcagcucga

SEQ ID NO: 1141058 - RNA, 17 nt, Mycobacterium bovis subsp bovis AF2122/97
aaccaggcggccgcguc

SEQ ID NO: 1141059 - RNA, 22 nt, Mycobacterium bovis subsp bovis AF2122/97
aaccaggcuaauagcucgccgg

SEQ ID NO: 1141060 - RNA, 14 nt, Mycobacterium bovis subsp bovis AF2122/97
cgggucgcgggaug

SEQ ID NO: 1141061 - RNA, 22 nt, Mycobacterium bovis subsp bovis AF2122/97
cgggucgcggcuauggcgccgc

SEQ ID NO: 1141062 - RNA, 14 nt, Mycobacterium bovis subsp bovis AF2122/97
cgggucgcguuucg

SEQ ID NO: 1141063 - RNA, 19 nt, Mycobacterium bovis subsp bovis AF2122/97
cgggucggcacgacccggg

SEQ ID NO: 1141064 - RNA, 21 nt, Mycobacterium bovis subsp bovis AF2122/97
cgggucgcugccggcugacga

SEQ ID NO: 1141065 - RNA, 14 nt, Mycobacterium bovis subsp bovis AF2122/97
cgggucggcgccga

SEQ ID NO: 1141066 - RNA, 16 nt, Mycobacterium bovis subsp bovis AF2122/97
cgggucggcgccgagc

SEQ ID NO: 1141067 - RNA, 17 nt, Mycobacterium bovis subsp bovis AF2122/97
cgggucggcgccgagca

SEQ ID NO: 1141068 - RNA, 11 nt, Mycobacterium bovis subsp bovis AF2122/97
cgggucggcga

SEQ ID NO: 1141069 - RNA, 15 nt, Mycobacterium bovis subsp bovis AF2122/97
cgggucgggcaccgc

SEQ ID NO: 1141070 - RNA, 17 nt, Mycobacterium bovis subsp bovis AF2122/97
cgggucggcgaccgcgc

SEQ ID NO: 1141071 - RNA, 20 nt, Mycobacterium bovis subsp bovis AF2122/97
cgggucguacaacacgggca

SEQ ID NO: 1141072 - RNA, 13 nt, Mycobacterium bovis subsp bovis AF2122/97
cgggucggcaucg

SEQ ID NO: 1141073 - RNA, 19 nt, Mycobacterium bovis subsp bovis AF2122/97
cgggucggcauugaucggu

SEQ ID NO: 1141074 - RNA, 13 nt, Mycobacterium bovis subsp bovis AF2122/97
cgggucggccgcu

SEQ ID NO: 1141075 - RNA, 18 nt, Mycobacterium bovis subsp bovis AF2122/97
cgggucgggcaccgcgcg

SEQ ID NO: 1141076 - RNA, 21 nt, Mycobacterium bovis subsp bovis AF2122/97
cgggucgucaugccagucgcc

SEQ ID NO: 1141077 - RNA, 22 nt, Mycobacterium bovis subsp bovis AF2122/97
cgggucgucaugccagucgccg

SEQ ID NO: 1141078 - RNA, 20 nt, Mycobacterium bovis subsp bovis AF2122/97
cgggucguaggacaccaccg

SEQ ID NO: 1141079 - RNA, 15 nt, Mycobacterium bovis subsp bovis AF2122/97
cgggucguccggcgg

SEQ ID NO: 1141080 - RNA, 17 nt, Mycobacterium bovis subsp bovis AF2122/97
cgggucguccggcggca

SEQ ID NO: 1141081 - RNA, 20 nt, Mycobacterium bovis subsp bovis AF2122/97
cgggucguccgccugcaccg

SEQ ID NO: 1141082 - RNA, 19 nt, Mycobacterium bovis subsp bovis AF2122/97
cgggucguccggcggcagg

SEQ ID NO: 1141083 - RNA, 15 nt, Mycobacterium bovis subsp bovis AF2122/97
cgggucgugccagca

SEQ ID NO: 1141084 - RNA, 18 nt, Mycobacterium bovis subsp bovis AF2122/97
cgggucgugccagcagca

SEQ ID NO: 1141085 - RNA, 14 nt, Mycobacterium bovis subsp bovis AF2122/97
cgggucgugccccg

SEQ ID NO: 1141086 - RNA, 16 nt, Mycobacterium bovis subsp bovis AF2122/97
cgggucgugccccggc

SEQ ID NO: 1141087 - RNA, 17 nt, Mycobacterium bovis subsp bovis AF2122/97
cgggucgucgcgaucca

SEQ ID NO: 1141088 - RNA, 15 nt, Mycobacterium bovis subsp bovis AF2122/97
cgggucuccggcgca

SEQ ID NO: 1141089 - RNA, 17 nt, Mycobacterium bovis subsp bovis AF2122/97
cgggucuccggcgcacc

SEQ ID NO: 1141090 - RNA, 22 nt, Mycobacterium bovis subsp bovis AF2122/97
cgggucuguccaaugcuguggc

SEQ ID NO: 1141091 - RNA, 14 nt, Mycobacterium bovis subsp bovis AF2122/97
cgggucucggugcg

SEQ ID NO: 1141092 - RNA, 16 nt, Mycobacterium bovis subsp bovis AF2122/97
cgggucugcggucauc

SEQ ID NO: 1141093 - RNA, 20 nt, Mycobacterium bovis subsp bovis AF2122/97
cgggucuggccaacgccggg

SEQ ID NO: 1141094 - RNA, 20 nt, Mycobacterium bovis subsp bovis AF2122/97
cgggugaaucgacaccgccc

SEQ ID NO: 1141095 - RNA, 22 nt, Mycobacterium bovis subsp bovis AF2122/97
cgggugaaucgacaccgcccga

SEQ ID NO: 1141096 - RNA, 18 nt, Mycobacterium bovis subsp bovis AF2122/97
cggguggaguuggcugcc

SEQ ID NO: 1141097 - RNA, 20 nt, Mycobacterium bovis subsp bovis AF2122/97
cggguggaguuggcugccgg

SEQ ID NO: 1141098 - RNA, 16 nt, Mycobacterium bovis subsp bovis AF2122/97
cggguggcagcggcga

SEQ ID NO: 1141099 - RNA, 21 nt, Mycobacterium bovis subsp bovis AF2122/97
cgggugcgaucgcaacaccgg

SEQ ID NO: 1141100 - RNA, 18 nt, Mycobacterium bovis subsp bovis AF2122/97
cggguggccacgcccagg

SEQ ID NO: 1141101 - RNA, 12 nt, Mycobacterium bovis subsp bovis AF2122/97
cggguggcgucg

SEQ ID NO: 1141102 - RNA, 19 nt, Mycobacterium bovis subsp bovis AF2122/97
cggguggcgucaccgccgg

SEQ ID NO: 1141103 - RNA, 21 nt, Mycobacterium bovis subsp bovis AF2122/97
cggguggcgaggcagcacccg

SEQ ID NO: 1141104 - RNA, 22 nt, Mycobacterium bovis subsp bovis AF2122/97
cggguggcgaggcagcacccgc

SEQ ID NO: 1141105 - RNA, 18 nt, Mycobacterium bovis subsp bovis AF2122/97
cggguggcccggaacacc

SEQ ID NO: 1141106 - RNA, 19 nt, Mycobacterium bovis subsp bovis AF2122/97
cggguggcgccggugcggc

SEQ ID NO: 1141107 - RNA, 18 nt, Mycobacterium bovis subsp bovis AF2122/97
cgggugggcaagcugacc

SEQ ID NO: 1141108 - RNA, 15 nt, Mycobacterium bovis subsp bovis AF2122/97
cgggugggcacaccg

SEQ ID NO: 1141109 - RNA, 21 nt, Mycobacterium bovis subsp bovis AF2122/97
cggguggcuuccggggugaca

SEQ ID NO: 1141110 - RNA, 14 nt, Mycobacterium bovis subsp bovis AF2122/97
cgggugggccagug

SEQ ID NO: 1141111 - RNA, 19 nt, Mycobacterium bovis subsp bovis AF2122/97
cggguggggaucacgauca

SEQ ID NO: 1141112 - RNA, 13 nt, Mycobacterium bovis subsp bovis AF2122/97
cgggugcgggccg

SEQ ID NO: 1141113 - RNA, 22 nt, Mycobacterium bovis subsp bovis AF2122/97
cgggugcgggccgaacacaccg

SEQ ID NO: 1141114 - RNA, 23 nt, Mycobacterium bovis subsp bovis AF2122/97
cgggugcgggccgaacacaccgg

SEQ ID NO: 1141115 - RNA, 22 nt, Mycobacterium bovis subsp bovis AF2122/97
cgggugcggcgauucccgcgaa

SEQ ID NO: 1141116 - RNA, 16 nt, Mycobacterium bovis subsp bovis AF2122/97
cgggugcugauggguc

SEQ ID NO: 1141117 - RNA, 14 nt, Mycobacterium bovis subsp bovis AF2122/97
cgggugcgcugcga

SEQ ID NO: 1141118 - RNA, 16 nt, Mycobacterium bovis subsp bovis AF2122/97
cgggugcgcugcagcg

SEQ ID NO: 1141119 - RNA, 17 nt, Mycobacterium bovis subsp bovis AF2122/97
cgggugcgcugcgauca

SEQ ID NO: 1141120 - RNA, 19 nt, Mycobacterium bovis subsp bovis AF2122/97
cgggugcgcugcgaucacc

SEQ ID NO: 1141121 - RNA, 16 nt, Mycobacterium bovis subsp bovis AF2122/97
cgggugcggacaccga

SEQ ID NO: 1141122 - RNA, 14 nt, Mycobacterium bovis subsp bovis AF2122/97
cgggugcgccguug

SEQ ID NO: 1141123 - RNA, 17 nt, Mycobacterium bovis subsp bovis AF2122/97
cgggugcgccguugccg

SEQ ID NO: 1141124 - RNA, 20 nt, Mycobacterium bovis subsp bovis AF2122/97
cgggugcgccguugccgccg

SEQ ID NO: 1141125 - RNA, 14 nt, Mycobacterium bovis subsp bovis AF2122/97
cgggugcgcccggc

SEQ ID NO: 1141126 - RNA, 14 nt, Mycobacterium bovis subsp bovis AF2122/97
cgggugcgccggcg

SEQ ID NO: 1141127 - RNA, 18 nt, Mycobacterium bovis subsp bovis AF2122/97
cgggugcgccggcguuug

SEQ ID NO: 1141128 - RNA, 17 nt, Mycobacterium bovis subsp bovis AF2122/97
cgggugcgcacccgggu

SEQ ID NO: 1141129 - RNA, 13 nt, Mycobacterium bovis subsp bovis AF2122/97
cgggugcgacgcg

SEQ ID NO: 1141130 - RNA, 21 nt, Mycobacterium bovis subsp bovis AF2122/97
cgggugcgacgcgaccgcgau

SEQ ID NO: 1141131 - RNA, 14 nt, Mycobacterium bovis subsp bovis AF2122/97
cgggugucggcgug

SEQ ID NO: 1141132 - RNA, 15 nt, Mycobacterium bovis subsp bovis AF2122/97
cgggugucgggcgcg

SEQ ID NO: 1141133 - RNA, 18 nt, Mycobacterium bovis subsp bovis AF2122/97
cgggugguuguucggcca

SEQ ID NO: 1141134 - RNA, 22 nt, Mycobacterium bovis subsp bovis AF2122/97
cggguggugagcugaaggcccg

SEQ ID NO: 1141135 - RNA, 20 nt, Mycobacterium bovis subsp bovis AF2122/97
cgggugguucaccucggcga

SEQ ID NO: 1141136 - RNA, 14 nt, Mycobacterium bovis subsp bovis AF2122/97
cggguggugccggc

SEQ ID NO: 1141137 - RNA, 15 nt, Mycobacterium bovis subsp bovis AF2122/97
cggguggugccggcg

SEQ ID NO: 1141138 - RNA, 16 nt, Mycobacterium bovis subsp bovis AF2122/97
cggguggugccggcgg

SEQ ID NO: 1141139 - RNA, 16 nt, Mycobacterium bovis subsp bovis AF2122/97
cggguggugcgcuggc

SEQ ID NO: 1141140 - RNA, 13 nt, Mycobacterium bovis subsp bovis AF2122/97
cggguggugcggc

SEQ ID NO: 1141141 - RNA, 16 nt, Mycobacterium bovis subsp bovis AF2122/97
cggguggugcggccgu

SEQ ID NO: 1141142 - RNA, 18 nt, Mycobacterium bovis subsp bovis AF2122/97
cgggugggucguucaccg

SEQ ID NO: 1141143 - RNA, 22 nt, Mycobacterium bovis subsp bovis AF2122/97
cggguggugaaguagucggcgc

SEQ ID NO: 1141144 - RNA, 23 nt, Mycobacterium bovis subsp bovis AF2122/97
cggguggugaaguagucggcgcc

SEQ ID NO: 1141145 - RNA, 15 nt, Mycobacterium bovis subsp bovis AF2122/97
cgggugugcaggccg

SEQ ID NO: 1141146 - RNA, 14 nt, Mycobacterium bovis subsp bovis AF2122/97
cggguguggccguu

SEQ ID NO: 1141147 - RNA, 14 nt, Mycobacterium bovis subsp bovis AF2122/97
cgggugguccagcc

SEQ ID NO: 1141148 - RNA, 16 nt, Mycobacterium bovis subsp bovis AF2122/97
cgggugguuugcgccc

SEQ ID NO: 1141149 - RNA, 22 nt, Mycobacterium bovis subsp bovis AF2122/97
cggguguggcuugacgcccggg

SEQ ID NO: 1141150 - RNA, 18 nt, Mycobacterium bovis subsp bovis AF2122/97
cggguguuccacaccagg

SEQ ID NO: 1141151 - RNA, 18 nt, Mycobacterium bovis subsp bovis AF2122/97
cggguguucgcgcgcgac

SEQ ID NO: 1141152 - RNA, 20 nt, Mycobacterium bovis subsp bovis AF2122/97
cggguguucucgcgcgucgc

SEQ ID NO: 1141153 - RNA, 19 nt, Mycobacterium bovis subsp bovis AF2122/97
cggguucuucaacuccggg

SEQ ID NO: 1141154 - RNA, 23 nt, Mycobacterium bovis subsp bovis AF2122/97
cggguucuucaacuccgggaccg

SEQ ID NO: 1141155 - RNA, 16 nt, Mycobacterium bovis subsp bovis AF2122/97
cggguugagccgccgc

SEQ ID NO: 1141156 - RNA, 18 nt, Mycobacterium bovis subsp bovis AF2122/97
cggguugagccgccgcga

SEQ ID NO: 1141157 - RNA, 18 nt, Mycobacterium bovis subsp bovis AF2122/97
cggguugagguaggggca

SEQ ID NO: 1141158 - RNA, 15 nt, Mycobacterium bovis subsp bovis AF2122/97
cggguugagccgccg

SEQ ID NO: 1141159 - RNA, 14 nt, Mycobacterium bovis subsp bovis AF2122/97
cggguugcccuggu

SEQ ID NO: 1141160 - RNA, 21 nt, Mycobacterium bovis subsp bovis AF2122/97
cggguugcccuggugugccgc

SEQ ID NO: 1141161 - RNA, 23 nt, Mycobacterium bovis subsp bovis AF2122/97
cggguucgacguugaucgccaug

SEQ ID NO: 1141162 - RNA, 15 nt, Mycobacterium bovis subsp bovis AF2122/97
cggguucgucgucgu

SEQ ID NO: 1141163 - RNA, 20 nt, Mycobacterium bovis subsp bovis AF2122/97
cggguucgccggauccgauc

SEQ ID NO: 1141164 - RNA, 20 nt, Mycobacterium bovis subsp bovis AF2122/97
cggguucgacguugaucgcc

SEQ ID NO: 1141165 - RNA, 16 nt, Mycobacterium bovis subsp bovis AF2122/97
cggguuacccgcagcg

SEQ ID NO: 1141166 - RNA, 16 nt, Mycobacterium bovis subsp bovis AF2122/97
cggguuaucggcagca

SEQ ID NO: 1141167 - RNA, 17 nt, Mycobacterium bovis subsp bovis AF2122/97
cgguccggcuucggcga

SEQ ID NO: 1141168 - RNA, 21 nt, Mycobacterium bovis subsp bovis AF2122/97
cgguccggaaauuccggcgcg

SEQ ID NO: 1141169 - RNA, 22 nt, Mycobacterium bovis subsp bovis AF2122/97
cgguccggauugaagucgucgg

SEQ ID NO: 1141170 - RNA, 18 nt, Mycobacterium bovis subsp bovis AF2122/97
cgguccgccacggcgggc

SEQ ID NO: 1141171 - RNA, 14 nt, Mycobacterium bovis subsp bovis AF2122/97
cgguccgccagcgc

SEQ ID NO: 1141172 - RNA, 15 nt, Mycobacterium bovis subsp bovis AF2122/97
cgguccgccagcgcg

SEQ ID NO: 1141173 - RNA, 16 nt, Mycobacterium bovis subsp bovis AF2122/97
cgguccgccagcgcga

SEQ ID NO: 1141174 - RNA, 14 nt, Mycobacterium bovis subsp bovis AF2122/97
cggucccagguugg

SEQ ID NO: 1141175 - RNA, 20 nt, Mycobacterium bovis subsp bovis AF2122/97
cgguccgauugaguucuggg

SEQ ID NO: 1141176 - RNA, 18 nt, Mycobacterium bovis subsp bovis AF2122/97
cggucccguugccgccca

SEQ ID NO: 1141177 - RNA, 14 nt, Mycobacterium bovis subsp bovis AF2122/97
cggucccucaugcu

SEQ ID NO: 1141178 - RNA, 13 nt, Mycobacterium bovis subsp bovis AF2122/97
cggucccgccgac

SEQ ID NO: 1141179 - RNA, 14 nt, Mycobacterium bovis subsp bovis AF2122/97
cggucccgccgacc

SEQ ID NO: 1141180 - RNA, 13 nt, Mycobacterium bovis subsp bovis AF2122/97
cggucccgccggu

SEQ ID NO: 1141181 - RNA, 17 nt, Mycobacterium bovis subsp bovis AF2122/97
cggucccgccgugccgc

SEQ ID NO: 1141182 - RNA, 21 nt, Mycobacterium bovis subsp bovis AF2122/97
cggucccuuuguggggccggg

SEQ ID NO: 1141183 - RNA, 22 nt, Mycobacterium bovis subsp bovis AF2122/97
cggucccuuuguggggccgggc

SEQ ID NO: 1141184 - RNA, 14 nt, Mycobacterium bovis subsp bovis AF2122/97
cgguccagccggua

SEQ ID NO: 1141185 - RNA, 13 nt, Mycobacterium bovis subsp bovis AF2122/97
cgguccagcgucg

SEQ ID NO: 1141186 - RNA, 18 nt, Mycobacterium bovis subsp bovis AF2122/97
cgguccagcgucgccgcc

SEQ ID NO: 1141187 - RNA, 20 nt, Mycobacterium bovis subsp bovis AF2122/97
cgguccagcgucgccgccag

SEQ ID NO: 1141188 - RNA, 20 nt, Mycobacterium bovis subsp bovis AF2122/97
cgguccaucccgagcuccgc

SEQ ID NO: 1141189 - RNA, 16 nt, Mycobacterium bovis subsp bovis AF2122/97
cgguccaggccggcac

SEQ ID NO: 1141190 - RNA, 18 nt, Mycobacterium bovis subsp bovis AF2122/97
cgguccaggccggcaccc

SEQ ID NO: 1141191 - RNA, 21 nt, Mycobacterium bovis subsp bovis AF2122/97
cgguccccccguugccgccgu

SEQ ID NO: 1141192 - RNA, 23 nt, Mycobacterium bovis subsp bovis AF2122/97
cgguccccccguugccgccguug

SEQ ID NO: 1141193 - RNA, 14 nt, Mycobacterium bovis subsp bovis AF2122/97
cgguccccgcagcu

SEQ ID NO: 1141194 - RNA, 15 nt, Mycobacterium bovis subsp bovis AF2122/97
cgguccccgccggcg

SEQ ID NO: 1141195 - RNA, 15 nt, Mycobacterium bovis subsp bovis AF2122/97
cggucccacggccgg

SEQ ID NO: 1141196 - RNA, 19 nt, Mycobacterium bovis subsp bovis AF2122/97
cggucccacggccggccgc

SEQ ID NO: 1141197 - RNA, 19 nt, Mycobacterium bovis subsp bovis AF2122/97
cgguccauucguccgcggu

SEQ ID NO: 1141198 - RNA, 16 nt, Mycobacterium bovis subsp bovis AF2122/97
cggucccaaggcguug

SEQ ID NO: 1141199 - RNA, 20 nt, Mycobacterium bovis subsp bovis AF2122/97
cgguccauggacggccaggu

SEQ ID NO: 1141200 - RNA, 15 nt, Mycobacterium bovis subsp bovis AF2122/97
cgguccguucgcgcc

SEQ ID NO: 1141201 - RNA, 17 nt, Mycobacterium bovis subsp bovis AF2122/97
cgguccguucgcgccgu

SEQ ID NO: 1141202 - RNA, 20 nt, Mycobacterium bovis subsp bovis AF2122/97
cgguccgucaccaccgccgc

SEQ ID NO: 1141203 - RNA, 21 nt, Mycobacterium bovis subsp bovis AF2122/97
cgguccgucaccaccgccgcc

SEQ ID NO: 1141204 - RNA, 22 nt, Mycobacterium bovis subsp bovis AF2122/97
cgguccgucaccaccgccgcca

SEQ ID NO: 1141205 - RNA, 16 nt, Mycobacterium bovis subsp bovis AF2122/97
cgguccggugaugguc

SEQ ID NO: 1141206 - RNA, 14 nt, Mycobacterium bovis subsp bovis AF2122/97
cgguccgucaccac

SEQ ID NO: 1141207 - RNA, 18 nt, Mycobacterium bovis subsp bovis AF2122/97
cgguccgucaccaccgcc

SEQ ID NO: 1141208 - RNA, 15 nt, Mycobacterium bovis subsp bovis AF2122/97
cgguccucgaucggu

SEQ ID NO: 1141209 - RNA, 19 nt, Mycobacterium bovis subsp bovis AF2122/97
cgguccguucgcgccguug

SEQ ID NO: 1141210 - RNA, 16 nt, Mycobacterium bovis subsp bovis AF2122/97
cgguccucgagccgau

SEQ ID NO: 1141211 - RNA, 14 nt, Mycobacterium bovis subsp bovis AF2122/97
cgguccugcucgca

SEQ ID NO: 1141212 - RNA, 13 nt, Mycobacterium bovis subsp bovis AF2122/97
cgguccucgucgg

SEQ ID NO: 1141213 - RNA, 23 nt, Mycobacterium bovis subsp bovis AF2122/97
cgguccugggauccggcggcagg

SEQ ID NO: 1141214 - RNA, 18 nt, Mycobacterium bovis subsp bovis AF2122/97
cgguccugcucgcacagc

SEQ ID NO: 1141215 - RNA, 23 nt, Mycobacterium bovis subsp bovis AF2122/97
cggucgaauucuguugugccgca

SEQ ID NO: 1141216 - RNA, 14 nt, Mycobacterium bovis subsp bovis AF2122/97
cggucgaacaucau

SEQ ID NO: 1141217 - RNA, 18 nt, Mycobacterium bovis subsp bovis AF2122/97
cggucgaagagguggggc

SEQ ID NO: 1141218 - RNA, 23 nt, Mycobacterium bovis subsp bovis AF2122/97
cggucgagacgcuuuccgccgca

SEQ ID NO: 1141219 - RNA, 19 nt, Mycobacterium bovis subsp bovis AF2122/97
cggucgagcuucaucccgg

SEQ ID NO: 1141220 - RNA, 22 nt, Mycobacterium bovis subsp bovis AF2122/97
cggucgacgaucucgccggcga

SEQ ID NO: 1141221 - RNA, 15 nt, Mycobacterium bovis subsp bovis AF2122/97
cggucgacgggucgg

SEQ ID NO: 1141222 - RNA, 14 nt, Mycobacterium bovis subsp bovis AF2122/97
cggucgacuccagc

SEQ ID NO: 1141223 - RNA, 16 nt, Mycobacterium bovis subsp bovis AF2122/97
cggucgacuccagcac

SEQ ID NO: 1141224 - RNA, 20 nt, Mycobacterium bovis subsp bovis AF2122/97
cggucgacuccagcaccagc

SEQ ID NO: 1141225 - RNA, 19 nt, Mycobacterium bovis subsp bovis AF2122/97
cggucgacugggacgacgc

SEQ ID NO: 1141226 - RNA, 16 nt, Mycobacterium bovis subsp bovis AF2122/97
cggucgaccugagccc

SEQ ID NO: 1141227 - RNA, 15 nt, Mycobacterium bovis subsp bovis AF2122/97
cggucgaccgugcgu

SEQ ID NO: 1141228 - RNA, 18 nt, Mycobacterium bovis subsp bovis AF2122/97
cggucgacagcgaaggcg

SEQ ID NO: 1141229 - RNA, 20 nt, Mycobacterium bovis subsp bovis AF2122/97
cggucgacagcgcaguaacg

SEQ ID NO: 1141230 - RNA, 21 nt, Mycobacterium bovis subsp bovis AF2122/97
cggucgaccaauuggucgagu

SEQ ID NO: 1141231 - RNA, 20 nt, Mycobacterium bovis subsp bovis AF2122/97
cggucgaugucggcgaacca

SEQ ID NO: 1141232 - RNA, 14 nt, Mycobacterium bovis subsp bovis AF2122/97
cggucgauguccgc

SEQ ID NO: 1141233 - RNA, 17 nt, Mycobacterium bovis subsp bovis AF2122/97
cggucgauguccgcagc

SEQ ID NO: 1141234 - RNA, 21 nt, Mycobacterium bovis subsp bovis AF2122/97
cggucgauguccgcagcaccg

SEQ ID NO: 1141235 - RNA, 12 nt, Mycobacterium bovis subsp bovis AF2122/97
cggucgauagcg

SEQ ID NO: 1141236 - RNA, 18 nt, Mycobacterium bovis subsp bovis AF2122/97
cggucgagccacccaccg

SEQ ID NO: 1141237 - RNA, 19 nt, Mycobacterium bovis subsp bovis AF2122/97
cggucgaugaucucgcccc

SEQ ID NO: 1141238 - RNA, 21 nt, Mycobacterium bovis subsp bovis AF2122/97
cggucgaugaucucgccccag

SEQ ID NO: 1141239 - RNA, 17 nt, Mycobacterium bovis subsp bovis AF2122/97
cggucgagguggcgggc

SEQ ID NO: 1141240 - RNA, 15 nt, Mycobacterium bovis subsp bovis AF2122/97
cggucauccgggcga

SEQ ID NO: 1141241 - RNA, 18 nt, Mycobacterium bovis subsp bovis AF2122/97
cggucauccgggcgacca

SEQ ID NO: 1141242 - RNA, 23 nt, Mycobacterium bovis subsp bovis AF2122/97
cggucaucccuuucgcgccgcga

SEQ ID NO: 1141243 - RNA, 14 nt, Mycobacterium bovis subsp bovis AF2122/97
cggucauccggccg

SEQ ID NO: 1141244 - RNA, 13 nt, Mycobacterium bovis subsp bovis AF2122/97
cggucaucgccga

SEQ ID NO: 1141245 - RNA, 15 nt, Mycobacterium bovis subsp bovis AF2122/97
cggucaucggcgcca

SEQ ID NO: 1141246 - RNA, 18 nt, Mycobacterium bovis subsp bovis AF2122/97
cgguccaaaacaccgcca

SEQ ID NO: 1141247 - RNA, 20 nt, Mycobacterium bovis subsp bovis AF2122/97
cggucauguccguccgcgac

SEQ ID NO: 1141248 - RNA, 17 nt, Mycobacterium bovis subsp bovis AF2122/97
cggucaugucggccacc

SEQ ID NO: 1141249 - RNA, 15 nt, Mycobacterium bovis subsp bovis AF2122/97
cggucaugccgccgc

SEQ ID NO: 1141250 - RNA, 16 nt, Mycobacterium bovis subsp bovis AF2122/97
cggucauggcgacggu

SEQ ID NO: 1141251 - RNA, 16 nt, Mycobacterium bovis subsp bovis AF2122/97
cgguccaaagcacguc

SEQ ID NO: 1141252 - RNA, 12 nt, Mycobacterium bovis subsp bovis AF2122/97
cgguccaacagc

SEQ ID NO: 1141253 - RNA, 22 nt, Mycobacterium bovis subsp bovis AF2122/97
cggucaggcucauccgccgggc

SEQ ID NO: 1141254 - RNA, 13 nt, Mycobacterium bovis subsp bovis AF2122/97
cggucaggccgcc

SEQ ID NO: 1141255 - RNA, 14 nt, Mycobacterium bovis subsp bovis AF2122/97
cggucaggccgccg

SEQ ID NO: 1141256 - RNA, 21 nt, Mycobacterium bovis subsp bovis AF2122/97
cggucaggucgagguccucgg

SEQ ID NO: 1141257 - RNA, 23 nt, Mycobacterium bovis subsp bovis AF2122/97
cggucagggugggcucguugugu

SEQ ID NO: 1141258 - RNA, 22 nt, Mycobacterium bovis subsp bovis AF2122/97
cggucaggcaguccaccgcgcg

SEQ ID NO: 1141259 - RNA, 20 nt, Mycobacterium bovis subsp bovis AF2122/97
cggucagugggacgggcgcg

SEQ ID NO: 1141260 - RNA, 16 nt, Mycobacterium bovis subsp bovis AF2122/97
cggucaggacggcacc

SEQ ID NO: 1141261 - RNA, 18 nt, Mycobacterium bovis subsp bovis AF2122/97
cggucaggcaguccaccg

SEQ ID NO: 1141262 - RNA, 19 nt, Mycobacterium bovis subsp bovis AF2122/97
cggucagcucgcugacggc

SEQ ID NO: 1141263 - RNA, 14 nt, Mycobacterium bovis subsp bovis AF2122/97
cggucagcucggca

SEQ ID NO: 1141264 - RNA, 23 nt, Mycobacterium bovis subsp bovis AF2122/97
cggucaccaccgacccgcugcca

SEQ ID NO: 1141265 - RNA, 16 nt, Mycobacterium bovis subsp bovis AF2122/97
cggucaauugugcggc

SEQ ID NO: 1141266 - RNA, 18 nt, Mycobacterium bovis subsp bovis AF2122/97
cggucaauugugcggccc

SEQ ID NO: 1141267 - RNA, 17 nt, Mycobacterium bovis subsp bovis AF2122/97
cggucacacgccagccg

SEQ ID NO: 1141268 - RNA, 18 nt, Mycobacterium bovis subsp bovis AF2122/97
cggucaaggugcgccgcc

SEQ ID NO: 1141269 - RNA, 19 nt, Mycobacterium bovis subsp bovis AF2122/97
cggucaaggugcgccgcca

SEQ ID NO: 1141270 - RNA, 16 nt, Mycobacterium bovis subsp bovis AF2122/97
cggucaagccggcgcc

SEQ ID NO: 1141271 - RNA, 13 nt, Mycobacterium bovis subsp bovis AF2122/97
cggucaccgcggc

SEQ ID NO: 1141272 - RNA, 12 nt, Mycobacterium bovis subsp bovis AF2122/97
cggucaccgcgu

SEQ ID NO: 1141273 - RNA, 14 nt, Mycobacterium bovis subsp bovis AF2122/97
cggucaccgcguca

SEQ ID NO: 1141274 - RNA, 20 nt, Mycobacterium bovis subsp bovis AF2122/97
cggucaccauggcgccgcgc

SEQ ID NO: 1141275 - RNA, 23 nt, Mycobacterium bovis subsp bovis AF2122/97
cggucaccacggcggcggcguag

SEQ ID NO: 1141276 - RNA, 13 nt, Mycobacterium bovis subsp bovis AF2122/97
cggucaccggcgc

SEQ ID NO: 1141277 - RNA, 14 nt, Mycobacterium bovis subsp bovis AF2122/97
cggucaccggcgca

SEQ ID NO: 1141278 - RNA, 15 nt, Mycobacterium bovis subsp bovis AF2122/97
cggucaccggcgcac

SEQ ID NO: 1141279 - RNA, 22 nt, Mycobacterium bovis subsp bovis AF2122/97
cggucaccccggcucggccacc

SEQ ID NO: 1141280 - RNA, 14 nt, Mycobacterium bovis subsp bovis AF2122/97
cggucaccucgaug

SEQ ID NO: 1141281 - RNA, 16 nt, Mycobacterium bovis subsp bovis AF2122/97
cggucaccucgaugcg

SEQ ID NO: 1141282 - RNA, 20 nt, Mycobacterium bovis subsp bovis AF2122/97
cggucacgcugugcgguauc

SEQ ID NO: 1141283 - RNA, 17 nt, Mycobacterium bovis subsp bovis AF2122/97
cggucacgacggcacgc

SEQ ID NO: 1141284 - RNA, 18 nt, Mycobacterium bovis subsp bovis AF2122/97
cggucacgacggcacgcc

SEQ ID NO: 1141285 - RNA, 20 nt, Mycobacterium bovis subsp bovis AF2122/97
cggucagcgggcacgccgcc

SEQ ID NO: 1141286 - RNA, 14 nt, Mycobacterium bovis subsp bovis AF2122/97
cggucagccggcca

SEQ ID NO: 1141287 - RNA, 15 nt, Mycobacterium bovis subsp bovis AF2122/97
cggucagcgcggcga

SEQ ID NO: 1141288 - RNA, 13 nt, Mycobacterium bovis subsp bovis AF2122/97
cggucagcgccga

SEQ ID NO: 1141289 - RNA, 17 nt, Mycobacterium bovis subsp bovis AF2122/97
cggucagccauguccgc

SEQ ID NO: 1141290 - RNA, 22 nt, Mycobacterium bovis subsp bovis AF2122/97
cggucagcaauacggcggcgcc

SEQ ID NO: 1141291 - RNA, 15 nt, Mycobacterium bovis subsp bovis AF2122/97
cggucagcagcgccg

SEQ ID NO: 1141292 - RNA, 14 nt, Mycobacterium bovis subsp bovis AF2122/97
cggucagccacgcc

SEQ ID NO: 1141293 - RNA, 15 nt, Mycobacterium bovis subsp bovis AF2122/97
cggucagccagccca

SEQ ID NO: 1141294 - RNA, 16 nt, Mycobacterium bovis subsp bovis AF2122/97
cggucagcaccuccac

SEQ ID NO: 1141295 - RNA, 15 nt, Mycobacterium bovis subsp bovis AF2122/97
cgguagccaggcgcg

SEQ ID NO: 1141296 - RNA, 20 nt, Mycobacterium bovis subsp bovis AF2122/97
cgguagccccgucgaccucc

SEQ ID NO: 1141297 - RNA, 19 nt, Mycobacterium bovis subsp bovis AF2122/97
cgguagcagcagcgggccg

SEQ ID NO: 1141298 - RNA, 13 nt, Mycobacterium bovis subsp bovis AF2122/97
cgguagcagcgcu

SEQ ID NO: 1141299 - RNA, 16 nt, Mycobacterium bovis subsp bovis AF2122/97
cgguagcauccagcgc

SEQ ID NO: 1141300 - RNA, 18 nt, Mycobacterium bovis subsp bovis AF2122/97
cgguagcauccagcgcgc

SEQ ID NO: 1141301 - RNA, 13 nt, Mycobacterium bovis subsp bovis AF2122/97
cgguagccgacga

SEQ ID NO: 1141302 - RNA, 17 nt, Mycobacterium bovis subsp bovis AF2122/97
cgguagccgaccagcgc

SEQ ID NO: 1141303 - RNA, 15 nt, Mycobacterium bovis subsp bovis AF2122/97
cgguacugugggcga

SEQ ID NO: 1141304 - RNA, 15 nt, Mycobacterium bovis subsp bovis AF2122/97
cgguagccgggcacc

SEQ ID NO: 1141305 - RNA, 16 nt, Mycobacterium bovis subsp bovis AF2122/97
cgguagccuggcuguc

SEQ ID NO: 1141306 - RNA, 18 nt, Mycobacterium bovis subsp bovis AF2122/97
cgguagccuggcuguccg

SEQ ID NO: 1141307 - RNA, 22 nt, Mycobacterium bovis subsp bovis AF2122/97
cgguagcgaucgugcugcccgc

SEQ ID NO: 1141308 - RNA, 15 nt, Mycobacterium bovis subsp bovis AF2122/97
cgguagcggaccugc

SEQ ID NO: 1141309 - RNA, 17 nt, Mycobacterium bovis subsp bovis AF2122/97
cgguagcucauugccga

SEQ ID NO: 1141310 - RNA, 18 nt, Mycobacterium bovis subsp bovis AF2122/97
cgguagcucauugccgau

SEQ ID NO: 1141311 - RNA, 17 nt, Mycobacterium bovis subsp bovis AF2122/97
cgguagcucgucgagga

SEQ ID NO: 1141312 - RNA, 14 nt, Mycobacterium bovis subsp bovis AF2122/97
cgguagcgcgggug

SEQ ID NO: 1141313 - RNA, 21 nt, Mycobacterium bovis subsp bovis AF2122/97
cgguagcugaccgugcugaau

SEQ ID NO: 1141314 - RNA, 14 nt, Mycobacterium bovis subsp bovis AF2122/97
cgguagcugcccag

SEQ ID NO: 1141315 - RNA, 14 nt, Mycobacterium bovis subsp bovis AF2122/97
cgguaggcaccgau

SEQ ID NO: 1141316 - RNA, 18 nt, Mycobacterium bovis subsp bovis AF2122/97
cgguaggcaccgaucggu

SEQ ID NO: 1141317 - RNA, 21 nt, Mycobacterium bovis subsp bovis AF2122/97
cgguaggcaccgaucggugcc

SEQ ID NO: 1141318 - RNA, 24 nt, Mycobacterium bovis subsp bovis AF2122/97
cgguaggcaccgaucggugccggc

SEQ ID NO: 1141319 - RNA, 21 nt, Mycobacterium bovis subsp bovis AF2122/97
cgguacggaccguggcagcug

SEQ ID NO: 1141320 - RNA, 18 nt, Mycobacterium bovis subsp bovis AF2122/97
cgguacugcgcagcgccu

SEQ ID NO: 1141321 - RNA, 20 nt, Mycobacterium bovis subsp bovis AF2122/97
cgguacugcgcagcgccugc

SEQ ID NO: 1141322 - RNA, 19 nt, Mycobacterium bovis subsp bovis AF2122/97
cgguagacaagucggcgcu

SEQ ID NO: 1141323 - RNA, 15 nt, Mycobacterium bovis subsp bovis AF2122/97
cgguagaucagcgcc

SEQ ID NO: 1141324 - RNA, 20 nt, Mycobacterium bovis subsp bovis AF2122/97
cgguagaucuucggccgcac

SEQ ID NO: 1141325 - RNA, 21 nt, Mycobacterium bovis subsp bovis AF2122/97
cgguagaucuucggccgcacu

SEQ ID NO: 1141326 - RNA, 16 nt, Mycobacterium bovis subsp bovis AF2122/97
cgguagacgccgccgu

SEQ ID NO: 1141327 - RNA, 16 nt, Mycobacterium bovis subsp bovis AF2122/97
cgguacgggucgccgg

SEQ ID NO: 1141328 - RNA, 13 nt, Mycobacterium bovis subsp bovis AF2122/97
cgguacgccgccg

SEQ ID NO: 1141329 - RNA, 15 nt, Mycobacterium bovis subsp bovis AF2122/97
cgguacgccggucgg

SEQ ID NO: 1141330 - RNA, 18 nt, Mycobacterium bovis subsp bovis AF2122/97
cgguacgcaaccaaccgu

SEQ ID NO: 1141331 - RNA, 14 nt, Mycobacterium bovis subsp bovis AF2122/97
cgguaccucgucga

SEQ ID NO: 1141332 - RNA, 19 nt, Mycobacterium bovis subsp bovis AF2122/97
cgguaccugacagcucacg

SEQ ID NO: 1141333 - RNA, 13 nt, Mycobacterium bovis subsp bovis AF2122/97
cgguagcuuccgc

SEQ ID NO: 1141334 - RNA, 15 nt, Mycobacterium bovis subsp bovis AF2122/97
cgguaggcggccagc

SEQ ID NO: 1141335 - RNA, 23 nt, Mycobacterium bovis subsp bovis AF2122/97
cgguaucgccgcuacgccggccc

SEQ ID NO: 1141336 - RNA, 13 nt, Mycobacterium bovis subsp bovis AF2122/97
cgguagucgaugc

SEQ ID NO: 1141337 - RNA, 14 nt, Mycobacterium bovis subsp bovis AF2122/97
cgguagucggccag

SEQ ID NO: 1141338 - RNA, 20 nt, Mycobacterium bovis subsp bovis AF2122/97
cgguaggugcaugucgauga

SEQ ID NO: 1141339 - RNA, 15 nt, Mycobacterium bovis subsp bovis AF2122/97
cgguaguugcgcggc

SEQ ID NO: 1141340 - RNA, 17 nt, Mycobacterium bovis subsp bovis AF2122/97
cgguaucggugcugguc

SEQ ID NO: 1141341 - RNA, 15 nt, Mycobacterium bovis subsp bovis AF2122/97
cgguaucggcgacca

SEQ ID NO: 1141342 - RNA, 22 nt, Mycobacterium bovis subsp bovis AF2122/97
cgguaugcgcguccccagcgcc

SEQ ID NO: 1141343 - RNA, 22 nt, Mycobacterium bovis subsp bovis AF2122/97
cgguaucgucccggcgaccggg

SEQ ID NO: 1141344 - RNA, 18 nt, Mycobacterium bovis subsp bovis AF2122/97
cgguauucccgcuuggcg

SEQ ID NO: 1141345 - RNA, 16 nt, Mycobacterium bovis subsp bovis AF2122/97
cgguaugcucgcuggc

SEQ ID NO: 1141346 - RNA, 18 nt, Mycobacterium bovis subsp bovis AF2122/97
cgguaugcucgcuggcgc

SEQ ID NO: 1141347 - RNA, 16 nt, Mycobacterium bovis subsp bovis AF2122/97
cggucaacgcugacgu

SEQ ID NO: 1141348 - RNA, 13 nt, Mycobacterium bovis subsp bovis AF2122/97
cggucaacucgaa

SEQ ID NO: 1141349 - RNA, 19 nt, Mycobacterium bovis subsp bovis AF2122/97
cggucaaauccagcagcca

SEQ ID NO: 1141350 - RNA, 13 nt, Mycobacterium bovis subsp bovis AF2122/97
cggucaacgaucc

SEQ ID NO: 1141351 - RNA, 18 nt, Mycobacterium bovis subsp bovis AF2122/97
cggucaacgaucccgggg

SEQ ID NO: 1141352 - RNA, 18 nt, Mycobacterium bovis subsp bovis AF2122/97
cggucaaaccggugccgg

SEQ ID NO: 1141353 - RNA, 21 nt, Mycobacterium bovis subsp bovis AF2122/97
cggucaaagaugucgcugggu

SEQ ID NO: 1141354 - RNA, 23 nt, Mycobacterium bovis subsp bovis AF2122/97
cgguauugccuagguucgcccag

SEQ ID NO: 1141355 - RNA, 13 nt, Mycobacterium bovis subsp bovis AF2122/97
cgguaccgccggc

SEQ ID NO: 1141356 - RNA, 15 nt, Mycobacterium bovis subsp bovis AF2122/97
cgguaccgccgcggu

SEQ ID NO: 1141357 - RNA, 15 nt, Mycobacterium bovis subsp bovis AF2122/97
cgguaccgccgcugc

SEQ ID NO: 1141358 - RNA, 17 nt, Mycobacterium bovis subsp bovis AF2122/97
cgguaccgccgcugccg

SEQ ID NO: 1141359 - RNA, 19 nt, Mycobacterium bovis subsp bovis AF2122/97
cgguaccgccgcugccggu

SEQ ID NO: 1141360 - RNA, 19 nt, Mycobacterium bovis subsp bovis AF2122/97
cgguaccgacggggaugga

SEQ ID NO: 1141361 - RNA, 13 nt, Mycobacterium bovis subsp bovis AF2122/97
cgguaccgcccag

SEQ ID NO: 1141362 - RNA, 14 nt, Mycobacterium bovis subsp bovis AF2122/97
cgguaccgcccagu

SEQ ID NO: 1141363 - RNA, 20 nt, Mycobacterium bovis subsp bovis AF2122/97
cgguacccguagcaccacau

SEQ ID NO: 1141364 - RNA, 17 nt, Mycobacterium bovis subsp bovis AF2122/97
cgguaccaaccugcgcg

SEQ ID NO: 1141365 - RNA, 20 nt, Mycobacterium bovis subsp bovis AF2122/97
cgguaccaucaccgcgccag

SEQ ID NO: 1141366 - RNA, 23 nt, Mycobacterium bovis subsp bovis AF2122/97
cgguacccaccucccgcagccgg

SEQ ID NO: 1141367 - RNA, 14 nt, Mycobacterium bovis subsp bovis AF2122/97
cgguaccaucaccg

SEQ ID NO: 1141368 - RNA, 17 nt, Mycobacterium bovis subsp bovis AF2122/97
cgguaccaucaccgcgc

SEQ ID NO: 1141369 - RNA, 18 nt, Mycobacterium bovis subsp bovis AF2122/97
cgguaccaucaccgcgcc

SEQ ID NO: 1141370 - RNA, 23 nt, Mycobacterium bovis subsp bovis AF2122/97
cgguacaacccccaggcgcucag

SEQ ID NO: 1141371 - RNA, 23 nt, Mycobacterium bovis subsp bovis AF2122/97
cgguaauccacuccagcgaaccg

SEQ ID NO: 1141372 - RNA, 14 nt, Mycobacterium bovis subsp bovis AF2122/97
cgguaagcgccaag

SEQ ID NO: 1141373 - RNA, 22 nt, Mycobacterium bovis subsp bovis AF2122/97
cgguaagaaucgaagcggcugc

SEQ ID NO: 1141374 - RNA, 19 nt, Mycobacterium bovis subsp bovis AF2122/97
cgguaacuguccgcccgga

SEQ ID NO: 1141375 - RNA, 20 nt, Mycobacterium bovis subsp bovis AF2122/97
cgguaaagaucuugucgcgu

SEQ ID NO: 1141376 - RNA, 20 nt, Mycobacterium bovis subsp bovis AF2122/97
cgguaaagcucaccacaucg

SEQ ID NO: 1141377 - RNA, 14 nt, Mycobacterium bovis subsp bovis AF2122/97
cgguaaccacgcgg

SEQ ID NO: 1141378 - RNA, 15 nt, Mycobacterium bovis subsp bovis AF2122/97
cgguaacuguccgcc

SEQ ID NO: 1141379 - RNA, 16 nt, Mycobacterium bovis subsp bovis AF2122/97
cgguaacgccaacacc

SEQ ID NO: 1141380 - RNA, 17 nt, Mycobacterium bovis subsp bovis AF2122/97
cgguaacggcggugcgg

SEQ ID NO: 1141381 - RNA, 21 nt, Mycobacterium bovis subsp bovis AF2122/97
cggguuggguguguucggagc

SEQ ID NO: 1141382 - RNA, 19 nt, Mycobacterium bovis subsp bovis AF2122/97
cggguuggucccgaugacc

SEQ ID NO: 1141383 - RNA, 22 nt, Mycobacterium bovis subsp bovis AF2122/97
cggguuggccgaacagcugccc

SEQ ID NO: 1141384 - RNA, 13 nt, Mycobacterium bovis subsp bovis AF2122/97
cggguugucggcg

SEQ ID NO: 1141385 - RNA, 17 nt, Mycobacterium bovis subsp bovis AF2122/97
cggguuguggcacccgg

SEQ ID NO: 1141386 - RNA, 19 nt, Mycobacterium bovis subsp bovis AF2122/97
cggguugguuggcucgcug

SEQ ID NO: 1141387 - RNA, 19 nt, Mycobacterium bovis subsp bovis AF2122/97
cggguuuugauagacgacc

SEQ ID NO: 1141388 - RNA, 22 nt, Mycobacterium bovis subsp bovis AF2122/97
cggguuuugauagacgacccgg

SEQ ID NO: 1141389 - RNA, 16 nt, Mycobacterium bovis subsp bovis AF2122/97
cggguuuugcgcggcc

SEQ ID NO: 1141390 - RNA, 23 nt, Mycobacterium bovis subsp bovis AF2122/97
cggguuuggccgacagccaccgc

SEQ ID NO: 1141391 - RNA, 17 nt, Mycobacterium bovis subsp bovis AF2122/97
cggguuuggugcagccg

SEQ ID NO: 1141392 - RNA, 22 nt, Mycobacterium bovis subsp bovis AF2122/97
cggguuuucucgccguuggcgg

SEQ ID NO: 1141393 - RNA, 19 nt, Mycobacterium bovis subsp bovis AF2122/97
cggguuucgcucgcaccgc

SEQ ID NO: 1141394 - RNA, 23 nt, Mycobacterium bovis subsp bovis AF2122/97
cggguuucgcucgcaccgcccgc

SEQ ID NO: 1141395 - RNA, 15 nt, Mycobacterium bovis subsp bovis AF2122/97
aacccacucgcagca

SEQ ID NO: 1141396 - RNA, 16 nt, Mycobacterium bovis subsp bovis AF2122/97
aaccauugcccgacga

SEQ ID NO: 1141397 - RNA, 18 nt, Mycobacterium bovis subsp bovis AF2122/97
aaccauguuaacgcgcgu

SEQ ID NO: 1141398 - RNA, 21 nt, Mycobacterium bovis subsp bovis AF2122/97
aacccaacaaaaggccauccg

SEQ ID NO: 1141399 - RNA, 22 nt, Mycobacterium bovis subsp bovis AF2122/97
cggccggcaccccacggccagu

SEQ ID NO: 1141400 - RNA, 23 nt, Mycobacterium bovis subsp bovis AF2122/97
cggccgcucaccccgcgcuccuc

SEQ ID NO: 1141401 - RNA, 17 nt, Mycobacterium bovis subsp bovis AF2122/97
cggccggcacgaccgcu

SEQ ID NO: 1141402 - RNA, 18 nt, Mycobacterium bovis subsp bovis AF2122/97
cggccggcaguccgagcu

SEQ ID NO: 1141403 - RNA, 14 nt, Mycobacterium bovis subsp bovis AF2122/97
cggccggccagcac

SEQ ID NO: 1141404 - RNA, 15 nt, Mycobacterium bovis subsp bovis AF2122/97
cggccggccagcacc

SEQ ID NO: 1141405 - RNA, 16 nt, Mycobacterium bovis subsp bovis AF2122/97
cggccggccagcaccc

SEQ ID NO: 1141406 - RNA, 12 nt, Mycobacterium bovis subsp bovis AF2122/97
cggccggccgcc

SEQ ID NO: 1141407 - RNA, 14 nt, Mycobacterium bovis subsp bovis AF2122/97
cggccggccgcuca

SEQ ID NO: 1141408 - RNA, 23 nt, Mycobacterium bovis subsp bovis AF2122/97
cggccggccgcucaccccgcgcu

SEQ ID NO: 1141409 - RNA, 17 nt, Mycobacterium bovis subsp bovis AF2122/97
cggccggccuagccgau

SEQ ID NO: 1141410 - RNA, 14 nt, Mycobacterium bovis subsp bovis AF2122/97
cggccugcgccggc

SEQ ID NO: 1141411 - RNA, 18 nt, Mycobacterium bovis subsp bovis AF2122/97
cggccugcgcgaccgacc

SEQ ID NO: 1141412 - RNA, 17 nt, Mycobacterium bovis subsp bovis AF2122/97
cggccugcggcaccggc

SEQ ID NO: 1141413 - RNA, 13 nt, Mycobacterium bovis subsp bovis AF2122/97
cggccugcucgac

SEQ ID NO: 1141414 - RNA, 17 nt, Mycobacterium bovis subsp bovis AF2122/97
cggccugcggcaacggc

SEQ ID NO: 1141415 - RNA, 23 nt, Mycobacterium bovis subsp bovis AF2122/97
cggccugcggcaacggcucgucg

SEQ ID NO: 1141416 - RNA, 15 nt, Mycobacterium bovis subsp bovis AF2122/97
cggccugcggcaccg

SEQ ID NO: 1141417 - RNA, 12 nt, Mycobacterium bovis subsp bovis AF2122/97
cggccugcgaac

SEQ ID NO: 1141418 - RNA, 21 nt, Mycobacterium bovis subsp bovis AF2122/97
cggccugcgacgagcccaccg

SEQ ID NO: 1141419 - RNA, 15 nt, Mycobacterium bovis subsp bovis AF2122/97
cggccugcgcgaccg

SEQ ID NO: 1141420 - RNA, 17 nt, Mycobacterium bovis subsp bovis AF2122/97
cggccugcgcgaccgac

SEQ ID NO: 1141421 - RNA, 15 nt, Mycobacterium bovis subsp bovis AF2122/97
cggccugcgccggcg

SEQ ID NO: 1141422 - RNA, 16 nt, Mycobacterium bovis subsp bovis AF2122/97
cggccugcgccggcgc

SEQ ID NO: 1141423 - RNA, 18 nt, Mycobacterium bovis subsp bovis AF2122/97
cggccuggaucgugccga

SEQ ID NO: 1141424 - RNA, 14 nt, Mycobacterium bovis subsp bovis AF2122/97
cggccuggcacccg

SEQ ID NO: 1141425 - RNA, 14 nt, Mycobacterium bovis subsp bovis AF2122/97
cggccuggccaccu

SEQ ID NO: 1141426 - RNA, 15 nt, Mycobacterium bovis subsp bovis AF2122/97
cggccuggccaccug

SEQ ID NO: 1141427 - RNA, 21 nt, Mycobacterium bovis subsp bovis AF2122/97
cggccugcucggcgaguucgg

SEQ ID NO: 1141428 - RNA, 14 nt, Mycobacterium bovis subsp bovis AF2122/97
cggccugcugguca

SEQ ID NO: 1141429 - RNA, 18 nt, Mycobacterium bovis subsp bovis AF2122/97
cggccugcuggucaccau

SEQ ID NO: 1141430 - RNA, 19 nt, Mycobacterium bovis subsp bovis AF2122/97
cggccugcuggucaccauc

SEQ ID NO: 1141431 - RNA, 23 nt, Mycobacterium bovis subsp bovis AF2122/97
cggccugcuggucaccaucaccg

SEQ ID NO: 1141432 - RNA, 22 nt, Mycobacterium bovis subsp bovis AF2122/97
cggccugcucgggggccgacca

SEQ ID NO: 1141433 - RNA, 18 nt, Mycobacterium bovis subsp bovis AF2122/97
cggccuggccaccugguu

SEQ ID NO: 1141434 - RNA, 15 nt, Mycobacterium bovis subsp bovis AF2122/97
cggccuggccgccag

SEQ ID NO: 1141435 - RNA, 22 nt, Mycobacterium bovis subsp bovis AF2122/97
cggccuugcccucaacggcggc

SEQ ID NO: 1141436 - RNA, 14 nt, Mycobacterium bovis subsp bovis AF2122/97
cggccuugccgccg

SEQ ID NO: 1141437 - RNA, 16 nt, Mycobacterium bovis subsp bovis AF2122/97
cggccuugccgccggc

SEQ ID NO: 1141438 - RNA, 16 nt, Mycobacterium bovis subsp bovis AF2122/97
cggccuugaucaccgu

SEQ ID NO: 1141439 - RNA, 20 nt, Mycobacterium bovis subsp bovis AF2122/97
cggccuugaucaccgugcgg

SEQ ID NO: 1141440 - RNA, 23 nt, Mycobacterium bovis subsp bovis AF2122/97
cggccuugaucaccgugcggucg

SEQ ID NO: 1141441 - RNA, 19 nt, Mycobacterium bovis subsp bovis AF2122/97
cggccuugaucgugcuggc

SEQ ID NO: 1141442 - RNA, 21 nt, Mycobacterium bovis subsp bovis AF2122/97
cggccuugaucgugcuggcga

SEQ ID NO: 1141443 - RNA, 22 nt, Mycobacterium bovis subsp bovis AF2122/97
cggccuugaucgugcuggcgac

SEQ ID NO: 1141444 - RNA, 21 nt, Mycobacterium bovis subsp bovis AF2122/97
cggccuugcgcacaggcgcga

SEQ ID NO: 1141445 - RNA, 16 nt, Mycobacterium bovis subsp bovis AF2122/97
cggccuugccgggccg

SEQ ID NO: 1141446 - RNA, 23 nt, Mycobacterium bovis subsp bovis AF2122/97
cggccuugcgggcucucggcguc

SEQ ID NO: 1141447 - RNA, 20 nt, Mycobacterium bovis subsp bovis AF2122/97
cggcgaaacucgucgauucg

SEQ ID NO: 1141448 - RNA, 21 nt, Mycobacterium bovis subsp bovis AF2122/97
cggcgaaacucgucgauucgg

SEQ ID NO: 1141449 - RNA, 18 nt, Mycobacterium bovis subsp bovis AF2122/97
cggccuugcucagcacgc

SEQ ID NO: 1141450 - RNA, 22 nt, Mycobacterium bovis subsp bovis AF2122/97
cggccuugcucagcacgccggg

SEQ ID NO: 1141451 - RNA, 18 nt, Mycobacterium bovis subsp bovis AF2122/97
cggcgaaagcuugggcga

SEQ ID NO: 1141452 - RNA, 23 nt, Mycobacterium bovis subsp bovis AF2122/97
cggcgaaaucgacagcagcgcga

SEQ ID NO: 1141453 - RNA, 21 nt, Mycobacterium bovis subsp bovis AF2122/97
cggcgaaagcuugggcgaucg

SEQ ID NO: 1141454 - RNA, 16 nt, Mycobacterium bovis subsp bovis AF2122/97
cggcgaaaggccaguc

SEQ ID NO: 1141455 - RNA, 20 nt, Mycobacterium bovis subsp bovis AF2122/97
cggcgaaaggccagucgugc

SEQ ID NO: 1141456 - RNA, 18 nt, Mycobacterium bovis subsp bovis AF2122/97
cggcgaaaguccugcagu

SEQ ID NO: 1141457 - RNA, 17 nt, Mycobacterium bovis subsp bovis AF2122/97
cggcgacaagccgagcc

SEQ ID NO: 1141458 - RNA, 14 nt, Mycobacterium bovis subsp bovis AF2122/97
cggcgacaacagca

SEQ ID NO: 1141459 - RNA, 15 nt, Mycobacterium bovis subsp bovis AF2122/97
cggcgacaacagcac

SEQ ID NO: 1141460 - RNA, 21 nt, Mycobacterium bovis subsp bovis AF2122/97
cggcgacaacagcacguacug

SEQ ID NO: 1141461 - RNA, 18 nt, Mycobacterium bovis subsp bovis AF2122/97
cggcgaaugcgauugccg

SEQ ID NO: 1141462 - RNA, 22 nt, Mycobacterium bovis subsp bovis AF2122/97
cggcgaaugcgauugccgucgu

SEQ ID NO: 1141463 - RNA, 17 nt, Mycobacterium bovis subsp bovis AF2122/97
cggcgaaugcgguccuc

SEQ ID NO: 1141464 - RNA, 21 nt, Mycobacterium bovis subsp bovis AF2122/97
cggcgaaucgguggucgaugg

SEQ ID NO: 1141465 - RNA, 15 nt, Mycobacterium bovis subsp bovis AF2122/97
cggcgaauacgaccg

SEQ ID NO: 1141466 - RNA, 15 nt, Mycobacterium bovis subsp bovis AF2122/97
cggcgaaggccgcgc

SEQ ID NO: 1141467 - RNA, 23 nt, Mycobacterium bovis subsp bovis AF2122/97
cggcgaagguguccuccagcugc

SEQ ID NO: 1141468 - RNA, 13 nt, Mycobacterium bovis subsp bovis AF2122/97
cggcgaagucacg

SEQ ID NO: 1141469 - RNA, 20 nt, Mycobacterium bovis subsp bovis AF2122/97
cggcgaagucacgcacccgg

SEQ ID NO: 1141470 - RNA, 14 nt, Mycobacterium bovis subsp bovis AF2122/97
cggcgaauacgacc

SEQ ID NO: 1141471 - RNA, 19 nt, Mycobacterium bovis subsp bovis AF2122/97
cggcgaagugcacccggau

SEQ ID NO: 1141472 - RNA, 22 nt, Mycobacterium bovis subsp bovis AF2122/97
cggcgaagucacgcacccggcg

SEQ ID NO: 1141473 - RNA, 14 nt, Mycobacterium bovis subsp bovis AF2122/97
cggcgaccacgccg

SEQ ID NO: 1141474 - RNA, 15 nt, Mycobacterium bovis subsp bovis AF2122/97
cggcgaccacgccgc

SEQ ID NO: 1141475 - RNA, 18 nt, Mycobacterium bovis subsp bovis AF2122/97
cggcgaccacgccgccgg

SEQ ID NO: 1141476 - RNA, 15 nt, Mycobacterium bovis subsp bovis AF2122/97
cggcgaccaaggccg

SEQ ID NO: 1141477 - RNA, 16 nt, Mycobacterium bovis subsp bovis AF2122/97
cggcgaccaccagcgc

SEQ ID NO: 1141478 - RNA, 18 nt, Mycobacterium bovis subsp bovis AF2122/97
cggcgaccaccagcgccg

SEQ ID NO: 1141479 - RNA, 20 nt, Mycobacterium bovis subsp bovis AF2122/97
cggcgacauccacaccgcgg

SEQ ID NO: 1141480 - RNA, 14 nt, Mycobacterium bovis subsp bovis AF2122/97
cggcgaccaccccg

SEQ ID NO: 1141481 - RNA, 13 nt, Mycobacterium bovis subsp bovis AF2122/97
cggcgacaccgca

SEQ ID NO: 1141482 - RNA, 14 nt, Mycobacterium bovis subsp bovis AF2122/97
cggcgacacgccag

SEQ ID NO: 1141483 - RNA, 19 nt, Mycobacterium bovis subsp bovis AF2122/97
cggcgacaccgcaggugcc

SEQ ID NO: 1141484 - RNA, 14 nt, Mycobacterium bovis subsp bovis AF2122/97
cggcgacaucggcc

SEQ ID NO: 1141485 - RNA, 18 nt, Mycobacterium bovis subsp bovis AF2122/97
cggcgacaugaucugcca

SEQ ID NO: 1141486 - RNA, 12 nt, Mycobacterium bovis subsp bovis AF2122/97
cggcgacagcgc

SEQ ID NO: 1141487 - RNA, 15 nt, Mycobacterium bovis subsp bovis AF2122/97
cggcgacagcgcggc

SEQ ID NO: 1141488 - RNA, 18 nt, Mycobacterium bovis subsp bovis AF2122/97
cggcgacagcgcggcggu

SEQ ID NO: 1141489 - RNA, 19 nt, Mycobacterium bovis subsp bovis AF2122/97
cggcgacagcuuggccggu

SEQ ID NO: 1141490 - RNA, 22 nt, Mycobacterium bovis subsp bovis AF2122/97
cggcgacagcuuggccgguuca

SEQ ID NO: 1141491 - RNA, 22 nt, Mycobacterium bovis subsp bovis AF2122/97
cggcgaacggauucccgcccag

SEQ ID NO: 1141492 - RNA, 15 nt, Mycobacterium bovis subsp bovis AF2122/97
cggcgaacggcacca

SEQ ID NO: 1141493 - RNA, 14 nt, Mycobacterium bovis subsp bovis AF2122/97
cggcgaacucggcg

SEQ ID NO: 1141494 - RNA, 15 nt, Mycobacterium bovis subsp bovis AF2122/97
cggcgaacucggcga

SEQ ID NO: 1141495 - RNA, 15 nt, Mycobacterium bovis subsp bovis AF2122/97
cggcgaacucgcgcc

SEQ ID NO: 1141496 - RNA, 19 nt, Mycobacterium bovis subsp bovis AF2122/97
cggcgaacucuacgguggu

SEQ ID NO: 1141497 - RNA, 23 nt, Mycobacterium bovis subsp bovis AF2122/97
cggcgaacucuacgguggugcgg

SEQ ID NO: 1141498 - RNA, 13 nt, Mycobacterium bovis subsp bovis AF2122/97
cggcgaacugcga

SEQ ID NO: 1141499 - RNA, 16 nt, Mycobacterium bovis subsp bovis AF2122/97
cggcgaacugcgaucg

SEQ ID NO: 1141500 - RNA, 18 nt, Mycobacterium bovis subsp bovis AF2122/97
cggcgaagcgggcgugcu

SEQ ID NO: 1141501 - RNA, 20 nt, Mycobacterium bovis subsp bovis AF2122/97
cggcgaagcgugcgccgacu

SEQ ID NO: 1141502 - RNA, 14 nt, Mycobacterium bovis subsp bovis AF2122/97
cggcgaagccgggu

SEQ ID NO: 1141503 - RNA, 19 nt, Mycobacterium bovis subsp bovis AF2122/97
cggcgaacugggugcgguc

SEQ ID NO: 1141504 - RNA, 15 nt, Mycobacterium bovis subsp bovis AF2122/97
cggcgaagaccgccg

SEQ ID NO: 1141505 - RNA, 21 nt, Mycobacterium bovis subsp bovis AF2122/97
cggcgaagauaucggcacggu

SEQ ID NO: 1141506 - RNA, 19 nt, Mycobacterium bovis subsp bovis AF2122/97
cggcgaagcacaccguccg

SEQ ID NO: 1141507 - RNA, 19 nt, Mycobacterium bovis subsp bovis AF2122/97
cggcgaacgcguccagcgc

SEQ ID NO: 1141508 - RNA, 19 nt, Mycobacterium bovis subsp bovis AF2122/97
cggcgaaccuugguugcca

SEQ ID NO: 1141509 - RNA, 23 nt, Mycobacterium bovis subsp bovis AF2122/97
cggcgaaccuugguugccaacga

SEQ ID NO: 1141510 - RNA, 14 nt, Mycobacterium bovis subsp bovis AF2122/97
cggcgaaccccagc

SEQ ID NO: 1141511 - RNA, 22 nt, Mycobacterium bovis subsp bovis AF2122/97
cggcgaaccggcccaccgacgg

SEQ ID NO: 1141512 - RNA, 16 nt, Mycobacterium bovis subsp bovis AF2122/97
cggcgaaccggcccac

SEQ ID NO: 1141513 - RNA, 18 nt, Mycobacterium bovis subsp bovis AF2122/97
cggcgaaccggcccaccg

SEQ ID NO: 1141514 - RNA, 19 nt, Mycobacterium bovis subsp bovis AF2122/97
cggcgaaccggcccaccga

SEQ ID NO: 1141515 - RNA, 17 nt, Mycobacterium bovis subsp bovis AF2122/97
cggcgaacccgcagucg

SEQ ID NO: 1141516 - RNA, 15 nt, Mycobacterium bovis subsp bovis AF2122/97
cggcgaacccgccga

SEQ ID NO: 1141517 - RNA, 18 nt, Mycobacterium bovis subsp bovis AF2122/97
cggcgaacccaccgcauu

SEQ ID NO: 1141518 - RNA, 18 nt, Mycobacterium bovis subsp bovis AF2122/97
cggcgaacccuccgcagc

SEQ ID NO: 1141519 - RNA, 16 nt, Mycobacterium bovis subsp bovis AF2122/97
cggcgaacaaccacgc

SEQ ID NO: 1141520 - RNA, 15 nt, Mycobacterium bovis subsp bovis AF2122/97
cggcgaacaggcgac

SEQ ID NO: 1141521 - RNA, 17 nt, Mycobacterium bovis subsp bovis AF2122/97
cggcgaacaggcgaccg

SEQ ID NO: 1141522 - RNA, 19 nt, Mycobacterium bovis subsp bovis AF2122/97
cggcgaacaggcgaccggg

SEQ ID NO: 1141523 - RNA, 17 nt, Mycobacterium bovis subsp bovis AF2122/97
cggcgaacaucaccguc

SEQ ID NO: 1141524 - RNA, 23 nt, Mycobacterium bovis subsp bovis AF2122/97
cggcgaacaaccacgcacggugg

SEQ ID NO: 1141525 - RNA, 18 nt, Mycobacterium bovis subsp bovis AF2122/97
cggcgaaccacggcagcc

SEQ ID NO: 1141526 - RNA, 20 nt, Mycobacterium bovis subsp bovis AF2122/97
cggcgaacaucaccgucgcc

SEQ ID NO: 1141527 - RNA, 14 nt, Mycobacterium bovis subsp bovis AF2122/97
cggcgaacccaccg

SEQ ID NO: 1141528 - RNA, 14 nt, Mycobacterium bovis subsp bovis AF2122/97
cggcgaaccagcgc

SEQ ID NO: 1141529 - RNA, 22 nt, Mycobacterium bovis subsp bovis AF2122/97
cggcgaccaccgcggcugcucc

SEQ ID NO: 1141530 - RNA, 13 nt, Mycobacterium bovis subsp bovis AF2122/97
cggcgaccaccgu

SEQ ID NO: 1141531 - RNA, 17 nt, Mycobacterium bovis subsp bovis AF2122/97
cggcgaccaccguuuga

SEQ ID NO: 1141532 - RNA, 18 nt, Mycobacterium bovis subsp bovis AF2122/97
cggcgaccacggcaccga

SEQ ID NO: 1141533 - RNA, 19 nt, Mycobacterium bovis subsp bovis AF2122/97
cggcgaccacggcaccgau

SEQ ID NO: 1141534 - RNA, 22 nt, Mycobacterium bovis subsp bovis AF2122/97
cggcgaccauauucagcucggg

SEQ ID NO: 1141535 - RNA, 23 nt, Mycobacterium bovis subsp bovis AF2122/97
cggcgaccaucugaucgggcccg

SEQ ID NO: 1141536 - RNA, 14 nt, Mycobacterium bovis subsp bovis AF2122/97
cggcgacccagcgg

SEQ ID NO: 1141537 - RNA, 23 nt, Mycobacterium bovis subsp bovis AF2122/97
cggcgaccauaagcucguagagc

SEQ ID NO: 1141538 - RNA, 16 nt, Mycobacterium bovis subsp bovis AF2122/97
cggcgaccaggucggc

SEQ ID NO: 1141539 - RNA, 22 nt, Mycobacterium bovis subsp bovis AF2122/97
cggcgaccagaggaugucgaug

SEQ ID NO: 1141540 - RNA, 19 nt, Mycobacterium bovis subsp bovis AF2122/97
cggcgaccagcucagcugc

SEQ ID NO: 1141541 - RNA, 13 nt, Mycobacterium bovis subsp bovis AF2122/97
cggcgacccgggu

SEQ ID NO: 1141542 - RNA, 23 nt, Mycobacterium bovis subsp bovis AF2122/97
cggcgaccccgaacauccgccgc

SEQ ID NO: 1141543 - RNA, 17 nt, Mycobacterium bovis subsp bovis AF2122/97
cggcgaccgccugcgcg

SEQ ID NO: 1141544 - RNA, 18 nt, Mycobacterium bovis subsp bovis AF2122/97
cggcgaccgagacggcgu

SEQ ID NO: 1141545 - RNA, 20 nt, Mycobacterium bovis subsp bovis AF2122/97
cggcgacccggguagacacc

SEQ ID NO: 1141546 - RNA, 22 nt, Mycobacterium bovis subsp bovis AF2122/97
cggcgacccggguagacaccgc

SEQ ID NO: 1141547 - RNA, 12 nt, Mycobacterium bovis subsp bovis AF2122/97
cggcgacccggu

SEQ ID NO: 1141548 - RNA, 20 nt, Mycobacterium bovis subsp bovis AF2122/97
cggcgacccggucgcggaac

SEQ ID NO: 1141549 - RNA, 15 nt, Mycobacterium bovis subsp bovis AF2122/97
cggcgacccgucccc

SEQ ID NO: 1141550 - RNA, 22 nt, Mycobacterium bovis subsp bovis AF2122/97
cggcgacccgucccccgcacgc

SEQ ID NO: 1141551 - RNA, 15 nt, Mycobacterium bovis subsp bovis AF2122/97
cggcgacgaccgucg

SEQ ID NO: 1141552 - RNA, 15 nt, Mycobacterium bovis subsp bovis AF2122/97
cggcgacgacccggg

SEQ ID NO: 1141553 - RNA, 21 nt, Mycobacterium bovis subsp bovis AF2122/97
cggcgacgacccgggucggca

SEQ ID NO: 1141554 - RNA, 20 nt, Mycobacterium bovis subsp bovis AF2122/97
cggcgacgaacucacgcagg

SEQ ID NO: 1141555 - RNA, 18 nt, Mycobacterium bovis subsp bovis AF2122/97
cggcgaccuggcucaucg

SEQ ID NO: 1141556 - RNA, 18 nt, Mycobacterium bovis subsp bovis AF2122/97
cggcgaccugccggaccg

SEQ ID NO: 1141557 - RNA, 22 nt, Mycobacterium bovis subsp bovis AF2122/97
cggcgaccugccggaccgcgga

SEQ ID NO: 1141558 - RNA, 13 nt, Mycobacterium bovis subsp bovis AF2122/97
cggcgaccgcgcu

SEQ ID NO: 1141559 - RNA, 18 nt, Mycobacterium bovis subsp bovis AF2122/97
cggcgaccgcgcucaccg

SEQ ID NO: 1141560 - RNA, 15 nt, Mycobacterium bovis subsp bovis AF2122/97
cggcgaccgcggucg

SEQ ID NO: 1141561 - RNA, 11 nt, Mycobacterium bovis subsp bovis AF2122/97
cggcgaccggc

SEQ ID NO: 1141562 - RNA, 19 nt, Mycobacterium bovis subsp bovis AF2122/97
cggcgaccggccggccgcg

SEQ ID NO: 1141563 - RNA, 22 nt, Mycobacterium bovis subsp bovis AF2122/97
cggcgaccggccggccgcgggc

SEQ ID NO: 1141564 - RNA, 16 nt, Mycobacterium bovis subsp bovis AF2122/97
cggcgaccuccgggau

SEQ ID NO: 1141565 - RNA, 17 nt, Mycobacterium bovis subsp bovis AF2122/97
cggcgaccuccgggaug

SEQ ID NO: 1141566 - RNA, 18 nt, Mycobacterium bovis subsp bovis AF2122/97
cggcgaccucggcggcgg

SEQ ID NO: 1141567 - RNA, 19 nt, Mycobacterium bovis subsp bovis AF2122/97
cggcgaccucggcggcggc

SEQ ID NO: 1141568 - RNA, 13 nt, Mycobacterium bovis subsp bovis AF2122/97
cggcgaccggguc

SEQ ID NO: 1141569 - RNA, 16 nt, Mycobacterium bovis subsp bovis AF2122/97
cggcgaccggguccgg

SEQ ID NO: 1141570 - RNA, 18 nt, Mycobacterium bovis subsp bovis AF2122/97
cggcgaccggguccggcg

SEQ ID NO: 1141571 - RNA, 13 nt, Mycobacterium bovis subsp bovis AF2122/97
cggcgaccgggau

SEQ ID NO: 1141572 - RNA, 13 nt, Mycobacterium bovis subsp bovis AF2122/97
cggcgacgaucuc

SEQ ID NO: 1141573 - RNA, 22 nt, Mycobacterium bovis subsp bovis AF2122/97
cggcgacgauauagggcuccuc

SEQ ID NO: 1141574 - RNA, 22 nt, Mycobacterium bovis subsp bovis AF2122/97
cggcgaccgccugcgcggcugc

SEQ ID NO: 1141575 - RNA, 19 nt, Mycobacterium bovis subsp bovis AF2122/97
cggcgacgacaucugccca

SEQ ID NO: 1141576 - RNA, 16 nt, Mycobacterium bovis subsp bovis AF2122/97
cggcgacgaccgucgg

SEQ ID NO: 1141577 - RNA, 12 nt, Mycobacterium bovis subsp bovis AF2122/97
cggcgacgaugu

SEQ ID NO: 1141578 - RNA, 21 nt, Mycobacterium bovis subsp bovis AF2122/97
cggcgacgaucucgccgccag

SEQ ID NO: 1141579 - RNA, 15 nt, Mycobacterium bovis subsp bovis AF2122/97
cggcgacgaucucgg

SEQ ID NO: 1141580 - RNA, 15 nt, Mycobacterium bovis subsp bovis AF2122/97
cggcgacgaugucga

SEQ ID NO: 1141581 - RNA, 23 nt, Mycobacterium bovis subsp bovis AF2122/97
cggcgacgauucgagcgguugcc

SEQ ID NO: 1141582 - RNA, 17 nt, Mycobacterium bovis subsp bovis AF2122/97
cggcgacgaucucggcg

SEQ ID NO: 1141583 - RNA, 19 nt, Mycobacterium bovis subsp bovis AF2122/97
cggcgacgaucucggcggc

SEQ ID NO: 1141584 - RNA, 21 nt, Mycobacterium bovis subsp bovis AF2122/97
cggcgacgaucucggcggccg

SEQ ID NO: 1141585 - RNA, 22 nt, Mycobacterium bovis subsp bovis AF2122/97
cggcgacgaucucggcggccgc

SEQ ID NO: 1141586 - RNA, 24 nt, Mycobacterium bovis subsp bovis AF2122/97
cggcgacgaucucggcggccgcgu

SEQ ID NO: 1141587 - RNA, 16 nt, Mycobacterium bovis subsp bovis AF2122/97
cggcgacgcuaccgcc

SEQ ID NO: 1141588 - RNA, 17 nt, Mycobacterium bovis subsp bovis AF2122/97
cggcgacgcuaccgccg

SEQ ID NO: 1141589 - RNA, 14 nt, Mycobacterium bovis subsp bovis AF2122/97
cggcgacgcgccgg

SEQ ID NO: 1141590 - RNA, 18 nt, Mycobacterium bovis subsp bovis AF2122/97
cggcgacgcgccgguuca

SEQ ID NO: 1141591 - RNA, 18 nt, Mycobacterium bovis subsp bovis AF2122/97
cggcgacguggcgccgac

SEQ ID NO: 1141592 - RNA, 21 nt, Mycobacterium bovis subsp bovis AF2122/97
cggcgacguagacgguccggu

SEQ ID NO: 1141593 - RNA, 13 nt, Mycobacterium bovis subsp bovis AF2122/97
cggcgacggcggc

SEQ ID NO: 1141594 - RNA, 16 nt, Mycobacterium bovis subsp bovis AF2122/97
cggcgacggcggcacg

SEQ ID NO: 1141595 - RNA, 17 nt, Mycobacterium bovis subsp bovis AF2122/97
cggcgacggcggcacgg

SEQ ID NO: 1141596 - RNA, 23 nt, Mycobacterium bovis subsp bovis AF2122/97
cggcgacggcggcacgggcggcc

SEQ ID NO: 1141597 - RNA, 13 nt, Mycobacterium bovis subsp bovis AF2122/97
cggcgacggcgcc

SEQ ID NO: 1141598 - RNA, 20 nt, Mycobacterium bovis subsp bovis AF2122/97
cggcgagcucggccccgccg

SEQ ID NO: 1141599 - RNA, 21 nt, Mycobacterium bovis subsp bovis AF2122/97
cggcgagcucggccccgccgc

SEQ ID NO: 1141600 - RNA, 22 nt, Mycobacterium bovis subsp bovis AF2122/97
cggcgagcucggccccgccgcc

SEQ ID NO: 1141601 - RNA, 15 nt, Mycobacterium bovis subsp bovis AF2122/97
cggcgagcgcgaugc

SEQ ID NO: 1141602 - RNA, 21 nt, Mycobacterium bovis subsp bovis AF2122/97
cggcgagcgcccuggcgugug

SEQ ID NO: 1141603 - RNA, 22 nt, Mycobacterium bovis subsp bovis AF2122/97
cggcgagcgcccuggcgugugu

SEQ ID NO: 1141604 - RNA, 12 nt, Mycobacterium bovis subsp bovis AF2122/97
cggcgaggcggu

SEQ ID NO: 1141605 - RNA, 16 nt, Mycobacterium bovis subsp bovis AF2122/97
cggcgaggccucggcg

SEQ ID NO: 1141606 - RNA, 17 nt, Mycobacterium bovis subsp bovis AF2122/97
cggcgaggccucggcgg

SEQ ID NO: 1141607 - RNA, 15 nt, Mycobacterium bovis subsp bovis AF2122/97
cggcgagggcgcgcc

SEQ ID NO: 1141608 - RNA, 16 nt, Mycobacterium bovis subsp bovis AF2122/97
cggcgagggcgcgccg

SEQ ID NO: 1141609 - RNA, 17 nt, Mycobacterium bovis subsp bovis AF2122/97
cggcgagggcgcgccgu

SEQ ID NO: 1141610 - RNA, 20 nt, Mycobacterium bovis subsp bovis AF2122/97
cggcgagggcggucagcggc

SEQ ID NO: 1141611 - RNA, 14 nt, Mycobacterium bovis subsp bovis AF2122/97
cggcgagggugagc

SEQ ID NO: 1141612 - RNA, 14 nt, Mycobacterium bovis subsp bovis AF2122/97
cggcgaggacgcgc

SEQ ID NO: 1141613 - RNA, 20 nt, Mycobacterium bovis subsp bovis AF2122/97
cggcgagugguccagccaga

SEQ ID NO: 1141614 - RNA, 15 nt, Mycobacterium bovis subsp bovis AF2122/97
cggcgagugcugucg

SEQ ID NO: 1141615 - RNA, 13 nt, Mycobacterium bovis subsp bovis AF2122/97
cggcgaguggcuc

SEQ ID NO: 1141616 - RNA, 15 nt, Mycobacterium bovis subsp bovis AF2122/97
cggcgagucgguugu

SEQ ID NO: 1141617 - RNA, 18 nt, Mycobacterium bovis subsp bovis AF2122/97
cggcgagucgguugucgg

SEQ ID NO: 1141618 - RNA, 22 nt, Mycobacterium bovis subsp bovis AF2122/97
cggcgagguauaaacgcggcgc

SEQ ID NO: 1141619 - RNA, 13 nt, Mycobacterium bovis subsp bovis AF2122/97
cggcgaggucccg

SEQ ID NO: 1141620 - RNA, 21 nt, Mycobacterium bovis subsp bovis AF2122/97
cggcgauaccgaggaucucgc

SEQ ID NO: 1141621 - RNA, 24 nt, Mycobacterium bovis subsp bovis AF2122/97
cggcgauaccgaggaucucgcggu

SEQ ID NO: 1141622 - RNA, 16 nt, Mycobacterium bovis subsp bovis AF2122/97
cggcgauaccgguugc

SEQ ID NO: 1141623 - RNA, 21 nt, Mycobacterium bovis subsp bovis AF2122/97
cggcgauauaggacgccgcgc

SEQ ID NO: 1141624 - RNA, 20 nt, Mycobacterium bovis subsp bovis AF2122/97
cggcgaguucggcagcgggc

SEQ ID NO: 1141625 - RNA, 11 nt, Mycobacterium bovis subsp bovis AF2122/97
cggcgagcacc

SEQ ID NO: 1141626 - RNA, 14 nt, Mycobacterium bovis subsp bovis AF2122/97
cggcgagcaccacc

SEQ ID NO: 1141627 - RNA, 15 nt, Mycobacterium bovis subsp bovis AF2122/97
cggcgagcaccaccc

SEQ ID NO: 1141628 - RNA, 19 nt, Mycobacterium bovis subsp bovis AF2122/97
cggcgagcacccgcugguc

SEQ ID NO: 1141629 - RNA, 15 nt, Mycobacterium bovis subsp bovis AF2122/97
cggcgagcacgcggg

SEQ ID NO: 1141630 - RNA, 14 nt, Mycobacterium bovis subsp bovis AF2122/97
cggcgagcaccgug

SEQ ID NO: 1141631 - RNA, 17 nt, Mycobacterium bovis subsp bovis AF2122/97
cggcgagcagacgccgc

SEQ ID NO: 1141632 - RNA, 17 nt, Mycobacterium bovis subsp bovis AF2122/97
cggcgagcgcaucggcc

SEQ ID NO: 1141633 - RNA, 23 nt, Mycobacterium bovis subsp bovis AF2122/97
cggcgagcgcaucggccaacacc

SEQ ID NO: 1141634 - RNA, 13 nt, Mycobacterium bovis subsp bovis AF2122/97
cggcgagcgcccu

SEQ ID NO: 1141635 - RNA, 23 nt, Mycobacterium bovis subsp bovis AF2122/97
cggcgagcagagaacuccgccac

SEQ ID NO: 1141636 - RNA, 15 nt, Mycobacterium bovis subsp bovis AF2122/97
cggcgagcaucucga

SEQ ID NO: 1141637 - RNA, 18 nt, Mycobacterium bovis subsp bovis AF2122/97
cggcgagcaucucgacau

SEQ ID NO: 1141638 - RNA, 19 nt, Mycobacterium bovis subsp bovis AF2122/97
cggcgacgugaaugguggu

SEQ ID NO: 1141639 - RNA, 22 nt, Mycobacterium bovis subsp bovis AF2122/97
cggcgacgugaauggugguguc

SEQ ID NO: 1141640 - RNA, 21 nt, Mycobacterium bovis subsp bovis AF2122/97
cggcgacuacccagccagccg

SEQ ID NO: 1141641 - RNA, 16 nt, Mycobacterium bovis subsp bovis AF2122/97
cggcgacggugagggc

SEQ ID NO: 1141642 - RNA, 17 nt, Mycobacterium bovis subsp bovis AF2122/97
cggcgacgggucgggca

SEQ ID NO: 1141643 - RNA, 17 nt, Mycobacterium bovis subsp bovis AF2122/97
cggcgacuugcuuggug

SEQ ID NO: 1141644 - RNA, 21 nt, Mycobacterium bovis subsp bovis AF2122/97
cggcgagaaacacgacagcca

SEQ ID NO: 1141645 - RNA, 14 nt, Mycobacterium bovis subsp bovis AF2122/97
cggcgacugcagcg

SEQ ID NO: 1141646 - RNA, 15 nt, Mycobacterium bovis subsp bovis AF2122/97
cggcgacugcgucgg

SEQ ID NO: 1141647 - RNA, 19 nt, Mycobacterium bovis subsp bovis AF2122/97
cggcgacugcgucggcggc

SEQ ID NO: 1141648 - RNA, 20 nt, Mycobacterium bovis subsp bovis AF2122/97
cggcgacugcgucggcggcu

SEQ ID NO: 1141649 - RNA, 23 nt, Mycobacterium bovis subsp bovis AF2122/97
cggcgagcaauuccucagccggu

SEQ ID NO: 1141650 - RNA, 19 nt, Mycobacterium bovis subsp bovis AF2122/97
cggcgagcacaugcugccg

SEQ ID NO: 1141651 - RNA, 20 nt, Mycobacterium bovis subsp bovis AF2122/97
cggcgagcacaugcugccgc

SEQ ID NO: 1141652 - RNA, 13 nt, Mycobacterium bovis subsp bovis AF2122/97
cggcgacuguccc

SEQ ID NO: 1141653 - RNA, 17 nt, Mycobacterium bovis subsp bovis AF2122/97
cggcgacugcgcaccug

SEQ ID NO: 1141654 - RNA, 12 nt, Mycobacterium bovis subsp bovis AF2122/97
cggcgacugcgu

SEQ ID NO: 1141655 - RNA, 14 nt, Mycobacterium bovis subsp bovis AF2122/97
cggcgagagcguca

SEQ ID NO: 1141656 - RNA, 22 nt, Mycobacterium bovis subsp bovis AF2122/97
cggcgacgaugccgggucgcgg

SEQ ID NO: 1141657 - RNA, 23 nt, Mycobacterium bovis subsp bovis AF2122/97
cggcgagagggcggggcagaagu

SEQ ID NO: 1141658 - RNA, 16 nt, Mycobacterium bovis subsp bovis AF2122/97
cggcgccagaucgacg

SEQ ID NO: 1141659 - RNA, 18 nt, Mycobacterium bovis subsp bovis AF2122/97
cggcgccaccgucaccgc

SEQ ID NO: 1141660 - RNA, 23 nt, Mycobacterium bovis subsp bovis AF2122/97
cggcgccaccgucaccgccguug

SEQ ID NO: 1141661 - RNA, 14 nt, Mycobacterium bovis subsp bovis AF2122/97
cggcgccaccgucg

SEQ ID NO: 1141662 - RNA, 16 nt, Mycobacterium bovis subsp bovis AF2122/97
cggcgccaccguggug

SEQ ID NO: 1141663 - RNA, 17 nt, Mycobacterium bovis subsp bovis AF2122/97
cggcgccaccguugccg

SEQ ID NO: 1141664 - RNA, 17 nt, Mycobacterium bovis subsp bovis AF2122/97
cggcgccacccccaccg

SEQ ID NO: 1141665 - RNA, 12 nt, Mycobacterium bovis subsp bovis AF2122/97
cggcgccaccgc

SEQ ID NO: 1141666 - RNA, 15 nt, Mycobacterium bovis subsp bovis AF2122/97
cggcgccaccgccgc

SEQ ID NO: 1141667 - RNA, 17 nt, Mycobacterium bovis subsp bovis AF2122/97
cggcgccaccggcgccg

SEQ ID NO: 1141668 - RNA, 18 nt, Mycobacterium bovis subsp bovis AF2122/97
cggcgccaccggcgccgc

SEQ ID NO: 1141669 - RNA, 21 nt, Mycobacterium bovis subsp bovis AF2122/97
cggcgccaccggcgccgcccg

SEQ ID NO: 1141670 - RNA, 19 nt, Mycobacterium bovis subsp bovis AF2122/97
cggcgccagaucgacgcca

SEQ ID NO: 1141671 - RNA, 16 nt, Mycobacterium bovis subsp bovis AF2122/97
cggcgccagcgccgcc

SEQ ID NO: 1141672 - RNA, 15 nt, Mycobacterium bovis subsp bovis AF2122/97
cggcgccaggaucga

SEQ ID NO: 1141673 - RNA, 19 nt, Mycobacterium bovis subsp bovis AF2122/97
cggcgccaggcaccacgac

SEQ ID NO: 1141674 - RNA, 23 nt, Mycobacterium bovis subsp bovis AF2122/97
cggcgccaggcaccacgaccgac

SEQ ID NO: 1141675 - RNA, 22 nt, Mycobacterium bovis subsp bovis AF2122/97
cggcgccgaagagucgugccgc

SEQ ID NO: 1141676 - RNA, 18 nt, Mycobacterium bovis subsp bovis AF2122/97
cggcgccgagcagcccgc

SEQ ID NO: 1141677 - RNA, 14 nt, Mycobacterium bovis subsp bovis AF2122/97
cggcgccgcaccca

SEQ ID NO: 1141678 - RNA, 19 nt, Mycobacterium bovis subsp bovis AF2122/97
cggcgccgcagaucaccgc

SEQ ID NO: 1141679 - RNA, 15 nt, Mycobacterium bovis subsp bovis AF2122/97
cggcgccgaggucga

SEQ ID NO: 1141680 - RNA, 14 nt, Mycobacterium bovis subsp bovis AF2122/97
cggcgccgccacgg

SEQ ID NO: 1141681 - RNA, 15 nt, Mycobacterium bovis subsp bovis AF2122/97
cggcgccgccacgga

SEQ ID NO: 1141682 - RNA, 21 nt, Mycobacterium bovis subsp bovis AF2122/97
cggcgccgccacugccggcag

SEQ ID NO: 1141683 - RNA, 22 nt, Mycobacterium bovis subsp bovis AF2122/97
cggcgccgccagcaccaccggc

SEQ ID NO: 1141684 - RNA, 13 nt, Mycobacterium bovis subsp bovis AF2122/97
cggcgccgccauc

SEQ ID NO: 1141685 - RNA, 13 nt, Mycobacterium bovis subsp bovis AF2122/97
cggcgccgccauu

SEQ ID NO: 1141686 - RNA, 14 nt, Mycobacterium bovis subsp bovis AF2122/97
cggcgccgccauug

SEQ ID NO: 1141687 - RNA, 11 nt, Mycobacterium bovis subsp bovis AF2122/97
cggcgccgccc

SEQ ID NO: 1141688 - RNA, 13 nt, Mycobacterium bovis subsp bovis AF2122/97
cggcgccgcccaa

SEQ ID NO: 1141689 - RNA, 22 nt, Mycobacterium bovis subsp bovis AF2122/97
cggcgccgcccaacgcgagcuu

SEQ ID NO: 1141690 - RNA, 13 nt, Mycobacterium bovis subsp bovis AF2122/97
cggcgccggccuc

SEQ ID NO: 1141691 - RNA, 20 nt, Mycobacterium bovis subsp bovis AF2122/97
cggcgccgcccgcgccacca

SEQ ID NO: 1141692 - RNA, 21 nt, Mycobacterium bovis subsp bovis AF2122/97
cggcgccgcccaauccaccga

SEQ ID NO: 1141693 - RNA, 14 nt, Mycobacterium bovis subsp bovis AF2122/97
cggcgccgcccagc

SEQ ID NO: 1141694 - RNA, 18 nt, Mycobacterium bovis subsp bovis AF2122/97
cggcgccgcccagcaucu

SEQ ID NO: 1141695 - RNA, 16 nt, Mycobacterium bovis subsp bovis AF2122/97
cggcgccggugccgcc

SEQ ID NO: 1141696 - RNA, 15 nt, Mycobacterium bovis subsp bovis AF2122/97
cggcgccggcggccg

SEQ ID NO: 1141697 - RNA, 16 nt, Mycobacterium bovis subsp bovis AF2122/97
cggcgccggcggccgc

SEQ ID NO: 1141698 - RNA, 13 nt, Mycobacterium bovis subsp bovis AF2122/97
cggcgccggcggc

SEQ ID NO: 1141699 - RNA, 12 nt, Mycobacterium bovis subsp bovis AF2122/97
cggcgccggcgu

SEQ ID NO: 1141700 - RNA, 13 nt, Mycobacterium bovis subsp bovis AF2122/97
cggcgccggcuug

SEQ ID NO: 1141701 - RNA, 13 nt, Mycobacterium bovis subsp bovis AF2122/97
cggcgccgguggu

SEQ ID NO: 1141702 - RNA, 23 nt, Mycobacterium bovis subsp bovis AF2122/97
cggcgccggugguaacggcggcc

SEQ ID NO: 1141703 - RNA, 18 nt, Mycobacterium bovis subsp bovis AF2122/97
cggcgccguugccaccgu

SEQ ID NO: 1141704 - RNA, 16 nt, Mycobacterium bovis subsp bovis AF2122/97
cggcgccggugggcgg

SEQ ID NO: 1141705 - RNA, 22 nt, Mycobacterium bovis subsp bovis AF2122/97
cggcgccggggggcugcugcuc

SEQ ID NO: 1141706 - RNA, 18 nt, Mycobacterium bovis subsp bovis AF2122/97
cggcgccuaaagacucga

SEQ ID NO: 1141707 - RNA, 20 nt, Mycobacterium bovis subsp bovis AF2122/97
cggcgccuaaagacucgacc

SEQ ID NO: 1141708 - RNA, 17 nt, Mycobacterium bovis subsp bovis AF2122/97
cggcgccucaucggaca

SEQ ID NO: 1141709 - RNA, 20 nt, Mycobacterium bovis subsp bovis AF2122/97
cggcgccucaucggacagcg

SEQ ID NO: 1141710 - RNA, 18 nt, Mycobacterium bovis subsp bovis AF2122/97
cggcgccucgugcguggg

SEQ ID NO: 1141711 - RNA, 16 nt, Mycobacterium bovis subsp bovis AF2122/97
cggcgccucguugccg

SEQ ID NO: 1141712 - RNA, 16 nt, Mycobacterium bovis subsp bovis AF2122/97
cggcgccuacaccggc

SEQ ID NO: 1141713 - RNA, 22 nt, Mycobacterium bovis subsp bovis AF2122/97
cggcgccuccggcaccuccagc

SEQ ID NO: 1141714 - RNA, 13 nt, Mycobacterium bovis subsp bovis AF2122/97
cggcgccuccggc

SEQ ID NO: 1141715 - RNA, 15 nt, Mycobacterium bovis subsp bovis AF2122/97
cggcgccuccggcac

SEQ ID NO: 1141716 - RNA, 19 nt, Mycobacterium bovis subsp bovis AF2122/97
cggcgccuccggcaccucc

SEQ ID NO: 1141717 - RNA, 21 nt, Mycobacterium bovis subsp bovis AF2122/97
cggcgccucguugccguagcu

SEQ ID NO: 1141718 - RNA, 20 nt, Mycobacterium bovis subsp bovis AF2122/97
cggcgccugacucaucaccg

SEQ ID NO: 1141719 - RNA, 22 nt, Mycobacterium bovis subsp bovis AF2122/97
cggcgccugacucaucaccgau

SEQ ID NO: 1141720 - RNA, 15 nt, Mycobacterium bovis subsp bovis AF2122/97
cggcgaucaggcgga

SEQ ID NO: 1141721 - RNA, 22 nt, Mycobacterium bovis subsp bovis AF2122/97
cggcgaucaggcggacgggacg

SEQ ID NO: 1141722 - RNA, 14 nt, Mycobacterium bovis subsp bovis AF2122/97
cggcgaucacgcga

SEQ ID NO: 1141723 - RNA, 11 nt, Mycobacterium bovis subsp bovis AF2122/97
cggcgaucacg

SEQ ID NO: 1141724 - RNA, 13 nt, Mycobacterium bovis subsp bovis AF2122/97
cggcgaucacgcg

SEQ ID NO: 1141725 - RNA, 23 nt, Mycobacterium bovis subsp bovis AF2122/97
cggcgaucacgcgaaugacgauc

SEQ ID NO: 1141726 - RNA, 12 nt, Mycobacterium bovis subsp bovis AF2122/97
cggcgauccgac

SEQ ID NO: 1141727 - RNA, 16 nt, Mycobacterium bovis subsp bovis AF2122/97
cggcgaugcgcgggug

SEQ ID NO: 1141728 - RNA, 17 nt, Mycobacterium bovis subsp bovis AF2122/97
cggcgaugcgcgggugg

SEQ ID NO: 1141729 - RNA, 13 nt, Mycobacterium bovis subsp bovis AF2122/97
cggcgaugcgguc

SEQ ID NO: 1141730 - RNA, 14 nt, Mycobacterium bovis subsp bovis AF2122/97
cggcgaugcguccg

SEQ ID NO: 1141731 - RNA, 17 nt, Mycobacterium bovis subsp bovis AF2122/97
cggcgaugcguccgccc

SEQ ID NO: 1141732 - RNA, 18 nt, Mycobacterium bovis subsp bovis AF2122/97
cggcgaugcguccgccca

SEQ ID NO: 1141733 - RNA, 20 nt, Mycobacterium bovis subsp bovis AF2122/97
cggcgaugcguccgcccagc

SEQ ID NO: 1141734 - RNA, 23 nt, Mycobacterium bovis subsp bovis AF2122/97
cggcgaugcguccgcccagccgc

SEQ ID NO: 1141735 - RNA, 21 nt, Mycobacterium bovis subsp bovis AF2122/97
cggcgauucccgcgaagcggg

SEQ ID NO: 1141736 - RNA, 18 nt, Mycobacterium bovis subsp bovis AF2122/97
cggcgauuggaccgccaa

SEQ ID NO: 1141737 - RNA, 22 nt, Mycobacterium bovis subsp bovis AF2122/97
cggcgaucaauugcccggcacg

SEQ ID NO: 1141738 - RNA, 18 nt, Mycobacterium bovis subsp bovis AF2122/97
cggcgauugauccggugg

SEQ ID NO: 1141739 - RNA, 19 nt, Mycobacterium bovis subsp bovis AF2122/97
cggcgauuggcugugaucg

SEQ ID NO: 1141740 - RNA, 15 nt, Mycobacterium bovis subsp bovis AF2122/97
cggcgcaagcgccgc

SEQ ID NO: 1141741 - RNA, 16 nt, Mycobacterium bovis subsp bovis AF2122/97
cggcgcaacucgacca

SEQ ID NO: 1141742 - RNA, 19 nt, Mycobacterium bovis subsp bovis AF2122/97
cggcgcaacucgaccacuu

SEQ ID NO: 1141743 - RNA, 23 nt, Mycobacterium bovis subsp bovis AF2122/97
cggcgauuuugcgucgcgccugc

SEQ ID NO: 1141744 - RNA, 15 nt, Mycobacterium bovis subsp bovis AF2122/97
cggcgauggccagca

SEQ ID NO: 1141745 - RNA, 16 nt, Mycobacterium bovis subsp bovis AF2122/97
cggcgauggccagcac

SEQ ID NO: 1141746 - RNA, 18 nt, Mycobacterium bovis subsp bovis AF2122/97
cggcgauggccagcacgg

SEQ ID NO: 1141747 - RNA, 14 nt, Mycobacterium bovis subsp bovis AF2122/97
cggcgaugcggucg

SEQ ID NO: 1141748 - RNA, 15 nt, Mycobacterium bovis subsp bovis AF2122/97
cggcgaugcggucgg

SEQ ID NO: 1141749 - RNA, 17 nt, Mycobacterium bovis subsp bovis AF2122/97
cggcgauuacggccagu

SEQ ID NO: 1141750 - RNA, 16 nt, Mycobacterium bovis subsp bovis AF2122/97
cggcgauuaccggcac

SEQ ID NO: 1141751 - RNA, 17 nt, Mycobacterium bovis subsp bovis AF2122/97
cggcgauuaccggcacg

SEQ ID NO: 1141752 - RNA, 20 nt, Mycobacterium bovis subsp bovis AF2122/97
cggcgauuaccggcacgccg

SEQ ID NO: 1141753 - RNA, 21 nt, Mycobacterium bovis subsp bovis AF2122/97
cggcgauuaccggcacgccgg

SEQ ID NO: 1141754 - RNA, 15 nt, Mycobacterium bovis subsp bovis AF2122/97
cggcgcagugcgacu

SEQ ID NO: 1141755 - RNA, 15 nt, Mycobacterium bovis subsp bovis AF2122/97
cggcgcagugguguc

SEQ ID NO: 1141756 - RNA, 21 nt, Mycobacterium bovis subsp bovis AF2122/97
cggcgcaguuggcaccagccg

SEQ ID NO: 1141757 - RNA, 23 nt, Mycobacterium bovis subsp bovis AF2122/97
cggcgcaguuuccguucgacauc

SEQ ID NO: 1141758 - RNA, 18 nt, Mycobacterium bovis subsp bovis AF2122/97
cggcgcaguucgucgugg

SEQ ID NO: 1141759 - RNA, 19 nt, Mycobacterium bovis subsp bovis AF2122/97
cggcgcaguuggcaccagc

SEQ ID NO: 1141760 - RNA, 15 nt, Mycobacterium bovis subsp bovis AF2122/97
cggcgcaugcaaguc

SEQ ID NO: 1141761 - RNA, 16 nt, Mycobacterium bovis subsp bovis AF2122/97
cggcgcaugcguaugc

SEQ ID NO: 1141762 - RNA, 18 nt, Mycobacterium bovis subsp bovis AF2122/97
cggcgccaauucagcggc

SEQ ID NO: 1141763 - RNA, 23 nt, Mycobacterium bovis subsp bovis AF2122/97
cggcgccaauucagcggcaacga

SEQ ID NO: 1141764 - RNA, 19 nt, Mycobacterium bovis subsp bovis AF2122/97
cggcgccacccgcgccgcc

SEQ ID NO: 1141765 - RNA, 22 nt, Mycobacterium bovis subsp bovis AF2122/97
cggcgccacccgcgccgcccgc

SEQ ID NO: 1141766 - RNA, 21 nt, Mycobacterium bovis subsp bovis AF2122/97
cggcgcauucccuugucgguc

SEQ ID NO: 1141767 - RNA, 23 nt, Mycobacterium bovis subsp bovis AF2122/97
cggcgcauucccuugucggucga

SEQ ID NO: 1141768 - RNA, 19 nt, Mycobacterium bovis subsp bovis AF2122/97
cggcgcauuccggcgccag

SEQ ID NO: 1141769 - RNA, 14 nt, Mycobacterium bovis subsp bovis AF2122/97
cggcgcagcacggc

SEQ ID NO: 1141770 - RNA, 15 nt, Mycobacterium bovis subsp bovis AF2122/97
cggcgcagcacggcg

SEQ ID NO: 1141771 - RNA, 18 nt, Mycobacterium bovis subsp bovis AF2122/97
cggcgcagcacggcggcc

SEQ ID NO: 1141772 - RNA, 21 nt, Mycobacterium bovis subsp bovis AF2122/97
cggcgcagcacggcggccacg

SEQ ID NO: 1141773 - RNA, 15 nt, Mycobacterium bovis subsp bovis AF2122/97
cggcgcaguagaugc

SEQ ID NO: 1141774 - RNA, 18 nt, Mycobacterium bovis subsp bovis AF2122/97
cggcgcaguagccgacca

SEQ ID NO: 1141775 - RNA, 21 nt, Mycobacterium bovis subsp bovis AF2122/97
cggcgcagguauaccgagggu

SEQ ID NO: 1141776 - RNA, 22 nt, Mycobacterium bovis subsp bovis AF2122/97
cggcgcagguauaccgaggguc

SEQ ID NO: 1141777 - RNA, 21 nt, Mycobacterium bovis subsp bovis AF2122/97
cggcgcaccuugaccgucgcg

SEQ ID NO: 1141778 - RNA, 20 nt, Mycobacterium bovis subsp bovis AF2122/97
cggcgcaccuugaccgucgc

SEQ ID NO: 1141779 - RNA, 20 nt, Mycobacterium bovis subsp bovis AF2122/97
cggcgcaccugggcugccgg

SEQ ID NO: 1141780 - RNA, 23 nt, Mycobacterium bovis subsp bovis AF2122/97
cggcgcaccugggcugccggcca

SEQ ID NO: 1141781 - RNA, 18 nt, Mycobacterium bovis subsp bovis AF2122/97
cggcgcaccuugaccguc

SEQ ID NO: 1141782 - RNA, 19 nt, Mycobacterium bovis subsp bovis AF2122/97
cggcgcaagcgccgcgcuu

SEQ ID NO: 1141783 - RNA, 20 nt, Mycobacterium bovis subsp bovis AF2122/97
cggcgccuggcggcgccgca

SEQ ID NO: 1141784 - RNA, 19 nt, Mycobacterium bovis subsp bovis AF2122/97
cggcgccuuggucgccgcc

SEQ ID NO: 1141785 - RNA, 22 nt, Mycobacterium bovis subsp bovis AF2122/97
cggcgccuuguggaaccauccc

SEQ ID NO: 1141786 - RNA, 21 nt, Mycobacterium bovis subsp bovis AF2122/97
cggcgccuggcggcgccgcag

SEQ ID NO: 1141787 - RNA, 22 nt, Mycobacterium bovis subsp bovis AF2122/97
cggcgcgaagucuugaccgcac

SEQ ID NO: 1141788 - RNA, 15 nt, Mycobacterium bovis subsp bovis AF2122/97
cggcgcgaaucacgu

SEQ ID NO: 1141789 - RNA, 13 nt, Mycobacterium bovis subsp bovis AF2122/97
cggcgcgacaggu

SEQ ID NO: 1141790 - RNA, 15 nt, Mycobacterium bovis subsp bovis AF2122/97
cggcgcgcagccggg

SEQ ID NO: 1141791 - RNA, 20 nt, Mycobacterium bovis subsp bovis AF2122/97
cggcgcgaagucuugaccgc

SEQ ID NO: 1141792 - RNA, 14 nt, Mycobacterium bovis subsp bovis AF2122/97
cggcgcgcagccgg

SEQ ID NO: 1141793 - RNA, 13 nt, Mycobacterium bovis subsp bovis AF2122/97
cggcgcgcagcuu

SEQ ID NO: 1141794 - RNA, 15 nt, Mycobacterium bovis subsp bovis AF2122/97
cggcgcgcaggaccu

SEQ ID NO: 1141795 - RNA, 23 nt, Mycobacterium bovis subsp bovis AF2122/97
cggcgcgcaggaccugcgucauc

SEQ ID NO: 1141796 - RNA, 19 nt, Mycobacterium bovis subsp bovis AF2122/97
cggcgcgccaaacaccccg

SEQ ID NO: 1141797 - RNA, 20 nt, Mycobacterium bovis subsp bovis AF2122/97
cggcgcgccaaacaccccgg

SEQ ID NO: 1141798 - RNA, 15 nt, Mycobacterium bovis subsp bovis AF2122/97
cggcgcgcgcgccgg

SEQ ID NO: 1141799 - RNA, 17 nt, Mycobacterium bovis subsp bovis AF2122/97
cggcgcgcgcgccggcu

SEQ ID NO: 1141800 - RNA, 20 nt, Mycobacterium bovis subsp bovis AF2122/97
cggcgcgccccaccgcgccg

SEQ ID NO: 1141801 - RNA, 22 nt, Mycobacterium bovis subsp bovis AF2122/97
cggcgcgccccaccgcgccgag

SEQ ID NO: 1141802 - RNA, 15 nt, Mycobacterium bovis subsp bovis AF2122/97
cggcgcgccccgccg

SEQ ID NO: 1141803 - RNA, 17 nt, Mycobacterium bovis subsp bovis AF2122/97
cggcgcgccccgccgca

SEQ ID NO: 1141804 - RNA, 15 nt, Mycobacterium bovis subsp bovis AF2122/97
cggcgcgcgcugcgc

SEQ ID NO: 1141805 - RNA, 21 nt, Mycobacterium bovis subsp bovis AF2122/97
cggcgcgccaaacaccccggc

SEQ ID NO: 1141806 - RNA, 14 nt, Mycobacterium bovis subsp bovis AF2122/97
cggcgcgcggguug

SEQ ID NO: 1141807 - RNA, 14 nt, Mycobacterium bovis subsp bovis AF2122/97
cggcgcgcugcacg

SEQ ID NO: 1141808 - RNA, 18 nt, Mycobacterium bovis subsp bovis AF2122/97
cggcgcgcgcgccggcug

SEQ ID NO: 1141809 - RNA, 16 nt, Mycobacterium bovis subsp bovis AF2122/97
cggcgcggcggcgucg

SEQ ID NO: 1141810 - RNA, 18 nt, Mycobacterium bovis subsp bovis AF2122/97
cggcgcggaacgcgucgc

SEQ ID NO: 1141811 - RNA, 22 nt, Mycobacterium bovis subsp bovis AF2122/97
cggcgcggagugcccagggccg

SEQ ID NO: 1141812 - RNA, 22 nt, Mycobacterium bovis subsp bovis AF2122/97
cggcgcggagagccugcucgca

SEQ ID NO: 1141813 - RNA, 17 nt, Mycobacterium bovis subsp bovis AF2122/97
cggcgcgggccaccacg

SEQ ID NO: 1141814 - RNA, 22 nt, Mycobacterium bovis subsp bovis AF2122/97
cggcgcgggccaccacgcgccg

SEQ ID NO: 1141815 - RNA, 23 nt, Mycobacterium bovis subsp bovis AF2122/97
cggcgcgggccaccacgcgccgc

SEQ ID NO: 1141816 - RNA, 24 nt, Mycobacterium bovis subsp bovis AF2122/97
cggcgcgggccaccacgcgccgca

SEQ ID NO: 1141817 - RNA, 18 nt, Mycobacterium bovis subsp bovis AF2122/97
cggcgcuagcgccgcgcu

SEQ ID NO: 1141818 - RNA, 17 nt, Mycobacterium bovis subsp bovis AF2122/97
cggcgcucaaugcgguc

SEQ ID NO: 1141819 - RNA, 15 nt, Mycobacterium bovis subsp bovis AF2122/97
cggcgcuagcgccgc

SEQ ID NO: 1141820 - RNA, 19 nt, Mycobacterium bovis subsp bovis AF2122/97
cggcgcuagcgccgcgcuu

SEQ ID NO: 1141821 - RNA, 19 nt, Mycobacterium bovis subsp bovis AF2122/97
cggcgcguugggaccagug

SEQ ID NO: 1141822 - RNA, 15 nt, Mycobacterium bovis subsp bovis AF2122/97
cggcggagucgacgg

SEQ ID NO: 1141823 - RNA, 15 nt, Mycobacterium bovis subsp bovis AF2122/97
cggcggagucgcgca

SEQ ID NO: 1141824 - RNA, 17 nt, Mycobacterium bovis subsp bovis AF2122/97
cggcggaggcugggcug

SEQ ID NO: 1141825 - RNA, 12 nt, Mycobacterium bovis subsp bovis AF2122/97
cggcggagugca

SEQ ID NO: 1141826 - RNA, 15 nt, Mycobacterium bovis subsp bovis AF2122/97
cggcggaucggcggc

SEQ ID NO: 1141827 - RNA, 19 nt, Mycobacterium bovis subsp bovis AF2122/97
cggcggaucggcggccggc

SEQ ID NO: 1141828 - RNA, 20 nt, Mycobacterium bovis subsp bovis AF2122/97
cggcggaucggcggccggca

SEQ ID NO: 1141829 - RNA, 17 nt, Mycobacterium bovis subsp bovis AF2122/97
cggcggaucccgaggcg

SEQ ID NO: 1141830 - RNA, 23 nt, Mycobacterium bovis subsp bovis AF2122/97
cggcggaucccgaggcgcccaac

SEQ ID NO: 1141831 - RNA, 19 nt, Mycobacterium bovis subsp bovis AF2122/97
cggcggauggcgucgacca

SEQ ID NO: 1141832 - RNA, 20 nt, Mycobacterium bovis subsp bovis AF2122/97
cggcggauggcgucgaccac

SEQ ID NO: 1141833 - RNA, 18 nt, Mycobacterium bovis subsp bovis AF2122/97
cggcggauuccggcaucg

SEQ ID NO: 1141834 - RNA, 20 nt, Mycobacterium bovis subsp bovis AF2122/97
cggcggauucgcgcugguca

SEQ ID NO: 1141835 - RNA, 13 nt, Mycobacterium bovis subsp bovis AF2122/97
cggcggaucugau

SEQ ID NO: 1141836 - RNA, 18 nt, Mycobacterium bovis subsp bovis AF2122/97
cggcggauagucgcgggc

SEQ ID NO: 1141837 - RNA, 17 nt, Mycobacterium bovis subsp bovis AF2122/97
cggcggccaccugcugg

SEQ ID NO: 1141838 - RNA, 20 nt, Mycobacterium bovis subsp bovis AF2122/97
cggcggccaccugcuggccg

SEQ ID NO: 1141839 - RNA, 13 nt, Mycobacterium bovis subsp bovis AF2122/97
cggcggccacgug

SEQ ID NO: 1141840 - RNA, 18 nt, Mycobacterium bovis subsp bovis AF2122/97
cggcggccacguggucgg

SEQ ID NO: 1141841 - RNA, 14 nt, Mycobacterium bovis subsp bovis AF2122/97
cggcggccacgccg

SEQ ID NO: 1141842 - RNA, 17 nt, Mycobacterium bovis subsp bovis AF2122/97
cggcggccacgccggcg

SEQ ID NO: 1141843 - RNA, 16 nt, Mycobacterium bovis subsp bovis AF2122/97
cggcggccacggccau

SEQ ID NO: 1141844 - RNA, 22 nt, Mycobacterium bovis subsp bovis AF2122/97
cggcggccauucggucagccag

SEQ ID NO: 1141845 - RNA, 16 nt, Mycobacterium bovis subsp bovis AF2122/97
cggcggcaucggcggc

SEQ ID NO: 1141846 - RNA, 15 nt, Mycobacterium bovis subsp bovis AF2122/97
cggcggcccaucgac

SEQ ID NO: 1141847 - RNA, 16 nt, Mycobacterium bovis subsp bovis AF2122/97
cggcggcccaucgacc

SEQ ID NO: 1141848 - RNA, 22 nt, Mycobacterium bovis subsp bovis AF2122/97
cggcggccccaggggcaccagc

SEQ ID NO: 1141849 - RNA, 16 nt, Mycobacterium bovis subsp bovis AF2122/97
cggcggccccgcgcca

SEQ ID NO: 1141850 - RNA, 17 nt, Mycobacterium bovis subsp bovis AF2122/97
cggcggccccggcauug

SEQ ID NO: 1141851 - RNA, 17 nt, Mycobacterium bovis subsp bovis AF2122/97
cggcggccaacagcacc

SEQ ID NO: 1141852 - RNA, 23 nt, Mycobacterium bovis subsp bovis AF2122/97
cggcggcaucaccuggcgugucg

SEQ ID NO: 1141853 - RNA, 20 nt, Mycobacterium bovis subsp bovis AF2122/97
cggcggcaucucgcaccgcg

SEQ ID NO: 1141854 - RNA, 21 nt, Mycobacterium bovis subsp bovis AF2122/97
cggcggcaucucgcaccgcgc

SEQ ID NO: 1141855 - RNA, 23 nt, Mycobacterium bovis subsp bovis AF2122/97
cggcggcaucucgcaccgcgccg

SEQ ID NO: 1141856 - RNA, 15 nt, Mycobacterium bovis subsp bovis AF2122/97
cggcggcagucgcgg

SEQ ID NO: 1141857 - RNA, 23 nt, Mycobacterium bovis subsp bovis AF2122/97
cggcggcauaaacaucgguggcg

SEQ ID NO: 1141858 - RNA, 22 nt, Mycobacterium bovis subsp bovis AF2122/97
cggcggcaaagaacagccggcc

SEQ ID NO: 1141859 - RNA, 16 nt, Mycobacterium bovis subsp bovis AF2122/97
cggcgcuggccgucga

SEQ ID NO: 1141860 - RNA, 22 nt, Mycobacterium bovis subsp bovis AF2122/97
cggcgcuggccgucgaagacga

SEQ ID NO: 1141861 - RNA, 12 nt, Mycobacterium bovis subsp bovis AF2122/97
cggcgcuggccg

SEQ ID NO: 1141862 - RNA, 15 nt, Mycobacterium bovis subsp bovis AF2122/97
cggcgcuggccagca

SEQ ID NO: 1141863 - RNA, 12 nt, Mycobacterium bovis subsp bovis AF2122/97
cggcgcuggcgg

SEQ ID NO: 1141864 - RNA, 20 nt, Mycobacterium bovis subsp bovis AF2122/97
cggcgcuggcgggcgaucgc

SEQ ID NO: 1141865 - RNA, 23 nt, Mycobacterium bovis subsp bovis AF2122/97
cggcgcuggcgggcgaucgcggc

SEQ ID NO: 1141866 - RNA, 19 nt, Mycobacterium bovis subsp bovis AF2122/97
cggcggacugagagauggu

SEQ ID NO: 1141867 - RNA, 15 nt, Mycobacterium bovis subsp bovis AF2122/97
cggcgcuggcugcgg

SEQ ID NO: 1141868 - RNA, 18 nt, Mycobacterium bovis subsp bovis AF2122/97
cggcgcugggacggucgc

SEQ ID NO: 1141869 - RNA, 19 nt, Mycobacterium bovis subsp bovis AF2122/97
cggcggagccgggugaggc

SEQ ID NO: 1141870 - RNA, 12 nt, Mycobacterium bovis subsp bovis AF2122/97
cggcggagcggg

SEQ ID NO: 1141871 - RNA, 13 nt, Mycobacterium bovis subsp bovis AF2122/97
cggcggagcgggc

SEQ ID NO: 1141872 - RNA, 22 nt, Mycobacterium bovis subsp bovis AF2122/97
cggcgcuccaacgcacacaccg

SEQ ID NO: 1141873 - RNA, 14 nt, Mycobacterium bovis subsp bovis AF2122/97
cggcgcuccgccag

SEQ ID NO: 1141874 - RNA, 15 nt, Mycobacterium bovis subsp bovis AF2122/97
cggcgcuccgccaga

SEQ ID NO: 1141875 - RNA, 13 nt, Mycobacterium bovis subsp bovis AF2122/97
cggcgcucggcca

SEQ ID NO: 1141876 - RNA, 16 nt, Mycobacterium bovis subsp bovis AF2122/97
cggcgcucgcggcggc

SEQ ID NO: 1141877 - RNA, 15 nt, Mycobacterium bovis subsp bovis AF2122/97
cggcgcugaucgcga

SEQ ID NO: 1141878 - RNA, 19 nt, Mycobacterium bovis subsp bovis AF2122/97
cggcgcugcggcgugccgg

SEQ ID NO: 1141879 - RNA, 15 nt, Mycobacterium bovis subsp bovis AF2122/97
cggcgcugcgcgcga

SEQ ID NO: 1141880 - RNA, 14 nt, Mycobacterium bovis subsp bovis AF2122/97
cggcgcugcugcca

SEQ ID NO: 1141881 - RNA, 13 nt, Mycobacterium bovis subsp bovis AF2122/97
cggcgcugacgac

SEQ ID NO: 1141882 - RNA, 23 nt, Mycobacterium bovis subsp bovis AF2122/97
cggcgcugacuagggucaccgac

SEQ ID NO: 1141883 - RNA, 14 nt, Mycobacterium bovis subsp bovis AF2122/97
cggcgcucggccau

SEQ ID NO: 1141884 - RNA, 22 nt, Mycobacterium bovis subsp bovis AF2122/97
cggcgcucggccauagcgccgc

SEQ ID NO: 1141885 - RNA, 14 nt, Mycobacterium bovis subsp bovis AF2122/97
cggcgcucggcgcc

SEQ ID NO: 1141886 - RNA, 14 nt, Mycobacterium bovis subsp bovis AF2122/97
cggccccgccgaug

SEQ ID NO: 1141887 - RNA, 14 nt, Mycobacterium bovis subsp bovis AF2122/97
cggccccgccggcg

SEQ ID NO: 1141888 - RNA, 15 nt, Mycobacterium bovis subsp bovis AF2122/97
cggccccgccggcgc

SEQ ID NO: 1141889 - RNA, 19 nt, Mycobacterium bovis subsp bovis AF2122/97
cggccccgccggcgccgcc

SEQ ID NO: 1141890 - RNA, 14 nt, Mycobacterium bovis subsp bovis AF2122/97
cggccccgccguca

SEQ ID NO: 1141891 - RNA, 15 nt, Mycobacterium bovis subsp bovis AF2122/97
cggccccgccgucac

SEQ ID NO: 1141892 - RNA, 15 nt, Mycobacterium bovis subsp bovis AF2122/97
cggccccgccgccgg

SEQ ID NO: 1141893 - RNA, 16 nt, Mycobacterium bovis subsp bovis AF2122/97
cggccccgccgucacc

SEQ ID NO: 1141894 - RNA, 19 nt, Mycobacterium bovis subsp bovis AF2122/97
cggccccgccgucaccgcc

SEQ ID NO: 1141895 - RNA, 18 nt, Mycobacterium bovis subsp bovis AF2122/97
cggccccgcggccagcac

SEQ ID NO: 1141896 - RNA, 14 nt, Mycobacterium bovis subsp bovis AF2122/97
cggccccgccgucg

SEQ ID NO: 1141897 - RNA, 15 nt, Mycobacterium bovis subsp bovis AF2122/97
cggccccgccgucgc

SEQ ID NO: 1141898 - RNA, 23 nt, Mycobacterium bovis subsp bovis AF2122/97
cggccccgccguuaccgccguug

SEQ ID NO: 1141899 - RNA, 23 nt, Mycobacterium bovis subsp bovis AF2122/97
cggccccgccgucaccgccguug

SEQ ID NO: 1141900 - RNA, 23 nt, Mycobacterium bovis subsp bovis AF2122/97
cggccccgccguugccgccgacg

SEQ ID NO: 1141901 - RNA, 21 nt, Mycobacterium bovis subsp bovis AF2122/97
cggccccgccguuuccgccgc

SEQ ID NO: 1141902 - RNA, 13 nt, Mycobacterium bovis subsp bovis AF2122/97
cggcccgacgggu

SEQ ID NO: 1141903 - RNA, 21 nt, Mycobacterium bovis subsp bovis AF2122/97
cggccccgggggaagcgccaa

SEQ ID NO: 1141904 - RNA, 14 nt, Mycobacterium bovis subsp bovis AF2122/97
cggccccggccgcg

SEQ ID NO: 1141905 - RNA, 17 nt, Mycobacterium bovis subsp bovis AF2122/97
cggccccggccgcguca

SEQ ID NO: 1141906 - RNA, 20 nt, Mycobacterium bovis subsp bovis AF2122/97
cggccccgucgucuagcggc

SEQ ID NO: 1141907 - RNA, 21 nt, Mycobacterium bovis subsp bovis AF2122/97
cggcccgaucccgaucgauca

SEQ ID NO: 1141908 - RNA, 13 nt, Mycobacterium bovis subsp bovis AF2122/97
cggcccgcaacgc

SEQ ID NO: 1141909 - RNA, 18 nt, Mycobacterium bovis subsp bovis AF2122/97
cggcccgcaacgcgucgg

SEQ ID NO: 1141910 - RNA, 16 nt, Mycobacterium bovis subsp bovis AF2122/97
cggcccgaugccgagg

SEQ ID NO: 1141911 - RNA, 15 nt, Mycobacterium bovis subsp bovis AF2122/97
cggcccgaucaccau

SEQ ID NO: 1141912 - RNA, 17 nt, Mycobacterium bovis subsp bovis AF2122/97
cggcccgaucaccagcc

SEQ ID NO: 1141913 - RNA, 14 nt, Mycobacterium bovis subsp bovis AF2122/97
cggcccgaucacca

SEQ ID NO: 1141914 - RNA, 15 nt, Mycobacterium bovis subsp bovis AF2122/97
cggcccgaucaccag

SEQ ID NO: 1141915 - RNA, 19 nt, Mycobacterium bovis subsp bovis AF2122/97
cggcccgaggugccggggc

SEQ ID NO: 1141916 - RNA, 14 nt, Mycobacterium bovis subsp bovis AF2122/97
cggcccgagccgcg

SEQ ID NO: 1141917 - RNA, 22 nt, Mycobacterium bovis subsp bovis AF2122/97
cggcccgagccgcgugggccgc

SEQ ID NO: 1141918 - RNA, 19 nt, Mycobacterium bovis subsp bovis AF2122/97
cggcccgaggcucgggccg

SEQ ID NO: 1141919 - RNA, 22 nt, Mycobacterium bovis subsp bovis AF2122/97
cggcccgcacccguccggccgg

SEQ ID NO: 1141920 - RNA, 20 nt, Mycobacterium bovis subsp bovis AF2122/97
cggcccgcaggcuuccccga

SEQ ID NO: 1141921 - RNA, 12 nt, Mycobacterium bovis subsp bovis AF2122/97
cggcccgccacc

SEQ ID NO: 1141922 - RNA, 19 nt, Mycobacterium bovis subsp bovis AF2122/97
cggcccgccguccggcgcc

SEQ ID NO: 1141923 - RNA, 12 nt, Mycobacterium bovis subsp bovis AF2122/97
cggcccgccgag

SEQ ID NO: 1141924 - RNA, 15 nt, Mycobacterium bovis subsp bovis AF2122/97
cggcccgcgaucggg

SEQ ID NO: 1141925 - RNA, 21 nt, Mycobacterium bovis subsp bovis AF2122/97
cggcccgcucaacgggccgca

SEQ ID NO: 1141926 - RNA, 13 nt, Mycobacterium bovis subsp bovis AF2122/97
cggcccgcugugg

SEQ ID NO: 1141927 - RNA, 22 nt, Mycobacterium bovis subsp bovis AF2122/97
cggcccggucuacgccaccgag

SEQ ID NO: 1141928 - RNA, 20 nt, Mycobacterium bovis subsp bovis AF2122/97
cggcccggguggcccggaac

SEQ ID NO: 1141929 - RNA, 17 nt, Mycobacterium bovis subsp bovis AF2122/97
cggcccggguuggccga

SEQ ID NO: 1141930 - RNA, 15 nt, Mycobacterium bovis subsp bovis AF2122/97
cggcccggacgucgg

SEQ ID NO: 1141931 - RNA, 18 nt, Mycobacterium bovis subsp bovis AF2122/97
cggcccggacgucggcgg

SEQ ID NO: 1141932 - RNA, 19 nt, Mycobacterium bovis subsp bovis AF2122/97
cggcccgcugaccaucaca

SEQ ID NO: 1141933 - RNA, 16 nt, Mycobacterium bovis subsp bovis AF2122/97
cggcccgggcucggcg

SEQ ID NO: 1141934 - RNA, 17 nt, Mycobacterium bovis subsp bovis AF2122/97
cggcccgggcucggcga

SEQ ID NO: 1141935 - RNA, 15 nt, Mycobacterium bovis subsp bovis AF2122/97
cggcccggggacgcc

SEQ ID NO: 1141936 - RNA, 23 nt, Mycobacterium bovis subsp bovis AF2122/97
cggcccguuugccgguucggcga

SEQ ID NO: 1141937 - RNA, 17 nt, Mycobacterium bovis subsp bovis AF2122/97
cggcccuaaacaccgcg

SEQ ID NO: 1141938 - RNA, 18 nt, Mycobacterium bovis subsp bovis AF2122/97
cggcccguuugccgguuc

SEQ ID NO: 1141939 - RNA, 22 nt, Mycobacterium bovis subsp bovis AF2122/97
cggcccgguuggaccacgugau

SEQ ID NO: 1141940 - RNA, 17 nt, Mycobacterium bovis subsp bovis AF2122/97
cggcccguagcugcgca

SEQ ID NO: 1141941 - RNA, 19 nt, Mycobacterium bovis subsp bovis AF2122/97
cggcccuacgcagcgcggc

SEQ ID NO: 1141942 - RNA, 22 nt, Mycobacterium bovis subsp bovis AF2122/97
cggcccuacgcagcgcggcugg

SEQ ID NO: 1141943 - RNA, 17 nt, Mycobacterium bovis subsp bovis AF2122/97
cggcccuccaccggugu

SEQ ID NO: 1141944 - RNA, 18 nt, Mycobacterium bovis subsp bovis AF2122/97
cggccgaaagagccagcg

SEQ ID NO: 1141945 - RNA, 15 nt, Mycobacterium bovis subsp bovis AF2122/97
cggccgacaccgcca

SEQ ID NO: 1141946 - RNA, 16 nt, Mycobacterium bovis subsp bovis AF2122/97
cggccgacaccgccac

SEQ ID NO: 1141947 - RNA, 17 nt, Mycobacterium bovis subsp bovis AF2122/97
cggccgacaccgccacc

SEQ ID NO: 1141948 - RNA, 19 nt, Mycobacterium bovis subsp bovis AF2122/97
cggccgacaccgccaccac

SEQ ID NO: 1141949 - RNA, 16 nt, Mycobacterium bovis subsp bovis AF2122/97
cggccgaucggccggu

SEQ ID NO: 1141950 - RNA, 14 nt, Mycobacterium bovis subsp bovis AF2122/97
cggccgaugcgacc

SEQ ID NO: 1141951 - RNA, 21 nt, Mycobacterium bovis subsp bovis AF2122/97
cggccgaugcgcagugcaccg

SEQ ID NO: 1141952 - RNA, 22 nt, Mycobacterium bovis subsp bovis AF2122/97
cggccgaacgccucgccggcca

SEQ ID NO: 1141953 - RNA, 23 nt, Mycobacterium bovis subsp bovis AF2122/97
cggccgaacgccucgccggccac

SEQ ID NO: 1141954 - RNA, 19 nt, Mycobacterium bovis subsp bovis AF2122/97
cggccgacaacccggccgg

SEQ ID NO: 1141955 - RNA, 20 nt, Mycobacterium bovis subsp bovis AF2122/97
cggccgacaacccggccggg

SEQ ID NO: 1141956 - RNA, 12 nt, Mycobacterium bovis subsp bovis AF2122/97
cggccgcacccg

SEQ ID NO: 1141957 - RNA, 14 nt, Mycobacterium bovis subsp bovis AF2122/97
cggccgcacccguu

SEQ ID NO: 1141958 - RNA, 13 nt, Mycobacterium bovis subsp bovis AF2122/97
cggccgcacgccg

SEQ ID NO: 1141959 - RNA, 16 nt, Mycobacterium bovis subsp bovis AF2122/97
cggccgcacgccgacc

SEQ ID NO: 1141960 - RNA, 22 nt, Mycobacterium bovis subsp bovis AF2122/97
cggccgcacgccgaccagcacc

SEQ ID NO: 1141961 - RNA, 16 nt, Mycobacterium bovis subsp bovis AF2122/97
cggccgcacgccuacg

SEQ ID NO: 1141962 - RNA, 18 nt, Mycobacterium bovis subsp bovis AF2122/97
cggccgccagcagcuucu

SEQ ID NO: 1141963 - RNA, 15 nt, Mycobacterium bovis subsp bovis AF2122/97
cggccgccagcgcgc

SEQ ID NO: 1141964 - RNA, 15 nt, Mycobacterium bovis subsp bovis AF2122/97
cggccgccaguacca

SEQ ID NO: 1141965 - RNA, 20 nt, Mycobacterium bovis subsp bovis AF2122/97
cggccgccaguucggcgucg

SEQ ID NO: 1141966 - RNA, 13 nt, Mycobacterium bovis subsp bovis AF2122/97
cggccgccagccc

SEQ ID NO: 1141967 - RNA, 15 nt, Mycobacterium bovis subsp bovis AF2122/97
cggccgccaucaucg

SEQ ID NO: 1141968 - RNA, 22 nt, Mycobacterium bovis subsp bovis AF2122/97
cggccgccccaggcugguccgg

SEQ ID NO: 1141969 - RNA, 20 nt, Mycobacterium bovis subsp bovis AF2122/97
cggccgcgaccagcgccgca

SEQ ID NO: 1141970 - RNA, 17 nt, Mycobacterium bovis subsp bovis AF2122/97
cggccgccuucuccggc

SEQ ID NO: 1141971 - RNA, 14 nt, Mycobacterium bovis subsp bovis AF2122/97
cggccgcgacgaca

SEQ ID NO: 1141972 - RNA, 14 nt, Mycobacterium bovis subsp bovis AF2122/97
cggccgcgacggau

SEQ ID NO: 1141973 - RNA, 15 nt, Mycobacterium bovis subsp bovis AF2122/97
cggccgcgacgacac

SEQ ID NO: 1141974 - RNA, 22 nt, Mycobacterium bovis subsp bovis AF2122/97
cggccgcgauggugcgccgggc

SEQ ID NO: 1141975 - RNA, 15 nt, Mycobacterium bovis subsp bovis AF2122/97
cggccgcgccggccc

SEQ ID NO: 1141976 - RNA, 18 nt, Mycobacterium bovis subsp bovis AF2122/97
cggccgcgccggccccgg

SEQ ID NO: 1141977 - RNA, 13 nt, Mycobacterium bovis subsp bovis AF2122/97
cggccgcgccggc

SEQ ID NO: 1141978 - RNA, 12 nt, Mycobacterium bovis subsp bovis AF2122/97
cggccgcgccgg

SEQ ID NO: 1141979 - RNA, 20 nt, Mycobacterium bovis subsp bovis AF2122/97
cggccgcgcggggugcgcgc

SEQ ID NO: 1141980 - RNA, 22 nt, Mycobacterium bovis subsp bovis AF2122/97
cggccgcgcggggugcgcgcga

SEQ ID NO: 1141981 - RNA, 12 nt, Mycobacterium bovis subsp bovis AF2122/97
cggccgcgcugc

SEQ ID NO: 1141982 - RNA, 21 nt, Mycobacterium bovis subsp bovis AF2122/97
cggccgcggacuugcgagccg

SEQ ID NO: 1141983 - RNA, 17 nt, Mycobacterium bovis subsp bovis AF2122/97
cggccgcgugccgcccg

SEQ ID NO: 1141984 - RNA, 17 nt, Mycobacterium bovis subsp bovis AF2122/97
cggccgcgugcucgccg

SEQ ID NO: 1141985 - RNA, 20 nt, Mycobacterium bovis subsp bovis AF2122/97
cggccgcgcugcagcacggc

SEQ ID NO: 1141986 - RNA, 19 nt, Mycobacterium bovis subsp bovis AF2122/97
cggccgcucguuacgccga

SEQ ID NO: 1141987 - RNA, 14 nt, Mycobacterium bovis subsp bovis AF2122/97
cggccgcuggaggc

SEQ ID NO: 1141988 - RNA, 19 nt, Mycobacterium bovis subsp bovis AF2122/97
cggccgcuggaggcggcgc

SEQ ID NO: 1141989 - RNA, 13 nt, Mycobacterium bovis subsp bovis AF2122/97
cggccgcucgggc

SEQ ID NO: 1141990 - RNA, 18 nt, Mycobacterium bovis subsp bovis AF2122/97
cggccgcucgggccagcg

SEQ ID NO: 1141991 - RNA, 15 nt, Mycobacterium bovis subsp bovis AF2122/97
cggccgcugacgccg

SEQ ID NO: 1141992 - RNA, 17 nt, Mycobacterium bovis subsp bovis AF2122/97
cggccgcugaucaacag

SEQ ID NO: 1141993 - RNA, 15 nt, Mycobacterium bovis subsp bovis AF2122/97
cggccggcaccccac

SEQ ID NO: 1141994 - RNA, 18 nt, Mycobacterium bovis subsp bovis AF2122/97
cggccggcaccccacggc

SEQ ID NO: 1141995 - RNA, 21 nt, Mycobacterium bovis subsp bovis AF2122/97
cggccgcugaucaacagaccu

SEQ ID NO: 1141996 - RNA, 18 nt, Mycobacterium bovis subsp bovis AF2122/97
cggccggcaaugccgcgg

SEQ ID NO: 1141997 - RNA, 22 nt, Mycobacterium bovis subsp bovis AF2122/97
cggccggcaaugccgcggccag

SEQ ID NO: 1141998 - RNA, 12 nt, Mycobacterium bovis subsp bovis AF2122/97
cggccagcgcgc

SEQ ID NO: 1141999 - RNA, 16 nt, Mycobacterium bovis subsp bovis AF2122/97
cggccagcgcggcgcg

SEQ ID NO: 1142000 - RNA, 18 nt, Mycobacterium bovis subsp bovis AF2122/97
cggccagcuccgccugcc

SEQ ID NO: 1142001 - RNA, 23 nt, Mycobacterium bovis subsp bovis AF2122/97
cggccagcgugucccaacgccac

SEQ ID NO: 1142002 - RNA, 16 nt, Mycobacterium bovis subsp bovis AF2122/97
cggccagcgugucgug

SEQ ID NO: 1142003 - RNA, 12 nt, Mycobacterium bovis subsp bovis AF2122/97
cggccagcucgc

SEQ ID NO: 1142004 - RNA, 13 nt, Mycobacterium bovis subsp bovis AF2122/97
cggccagcucgcg

SEQ ID NO: 1142005 - RNA, 15 nt, Mycobacterium bovis subsp bovis AF2122/97
cggccagcugcagca

SEQ ID NO: 1142006 - RNA, 19 nt, Mycobacterium bovis subsp bovis AF2122/97
cggccagcugcagcagacc

SEQ ID NO: 1142007 - RNA, 18 nt, Mycobacterium bovis subsp bovis AF2122/97
cggccagcuugagguccg

SEQ ID NO: 1142008 - RNA, 13 nt, Mycobacterium bovis subsp bovis AF2122/97
cggccagcuugcg

SEQ ID NO: 1142009 - RNA, 19 nt, Mycobacterium bovis subsp bovis AF2122/97
cggccagcuugcggagccg

SEQ ID NO: 1142010 - RNA, 17 nt, Mycobacterium bovis subsp bovis AF2122/97
cggccagcuguucgagc

SEQ ID NO: 1142011 - RNA, 21 nt, Mycobacterium bovis subsp bovis AF2122/97
cggccaggaugccugccaccc

SEQ ID NO: 1142012 - RNA, 20 nt, Mycobacterium bovis subsp bovis AF2122/97
cggccaggaucaaccggccc

SEQ ID NO: 1142013 - RNA, 19 nt, Mycobacterium bovis subsp bovis AF2122/97
cggccaggaucgcuacguc

SEQ ID NO: 1142014 - RNA, 22 nt, Mycobacterium bovis subsp bovis AF2122/97
cggccaggaguuugaccaccug

SEQ ID NO: 1142015 - RNA, 19 nt, Mycobacterium bovis subsp bovis AF2122/97
cggccaccagcccgaugau

SEQ ID NO: 1142016 - RNA, 14 nt, Mycobacterium bovis subsp bovis AF2122/97
cggccaccagccgg

SEQ ID NO: 1142017 - RNA, 16 nt, Mycobacterium bovis subsp bovis AF2122/97
cggccaccaccgccgc

SEQ ID NO: 1142018 - RNA, 17 nt, Mycobacterium bovis subsp bovis AF2122/97
cggccaccaccgccgcc

SEQ ID NO: 1142019 - RNA, 16 nt, Mycobacterium bovis subsp bovis AF2122/97
cggccaccaccgcgcc

SEQ ID NO: 1142020 - RNA, 17 nt, Mycobacterium bovis subsp bovis AF2122/97
cggccaccagcgcccgg

SEQ ID NO: 1142021 - RNA, 23 nt, Mycobacterium bovis subsp bovis AF2122/97
cggccaccagcgcccggcccgcc

SEQ ID NO: 1142022 - RNA, 14 nt, Mycobacterium bovis subsp bovis AF2122/97
cggccaccagcgcc

SEQ ID NO: 1142023 - RNA, 20 nt, Mycobacterium bovis subsp bovis AF2122/97
cggccagcacccgaaccggg

SEQ ID NO: 1142024 - RNA, 23 nt, Mycobacterium bovis subsp bovis AF2122/97
cggccagcaagacgaugacagac

SEQ ID NO: 1142025 - RNA, 19 nt, Mycobacterium bovis subsp bovis AF2122/97
cggccagccuaccggcuac

SEQ ID NO: 1142026 - RNA, 13 nt, Mycobacterium bovis subsp bovis AF2122/97
cggccagcgcccg

SEQ ID NO: 1142027 - RNA, 15 nt, Mycobacterium bovis subsp bovis AF2122/97
cggccagcgcccgca

SEQ ID NO: 1142028 - RNA, 15 nt, Mycobacterium bovis subsp bovis AF2122/97
cggccagcgagauca

SEQ ID NO: 1142029 - RNA, 20 nt, Mycobacterium bovis subsp bovis AF2122/97
cggcccacaccagcgcagca

SEQ ID NO: 1142030 - RNA, 14 nt, Mycobacterium bovis subsp bovis AF2122/97
cggcccagguugcc

SEQ ID NO: 1142031 - RNA, 17 nt, Mycobacterium bovis subsp bovis AF2122/97
cggcccagguugccaac

SEQ ID NO: 1142032 - RNA, 22 nt, Mycobacterium bovis subsp bovis AF2122/97
cggcccagguugccuuggcggc

SEQ ID NO: 1142033 - RNA, 22 nt, Mycobacterium bovis subsp bovis AF2122/97
cggcccagugggacaggucggc

SEQ ID NO: 1142034 - RNA, 16 nt, Mycobacterium bovis subsp bovis AF2122/97
cggccccgaaacgaug

SEQ ID NO: 1142035 - RNA, 18 nt, Mycobacterium bovis subsp bovis AF2122/97
cggccccgaaacgauggc

SEQ ID NO: 1142036 - RNA, 13 nt, Mycobacterium bovis subsp bovis AF2122/97
cggccccgacggu

SEQ ID NO: 1142037 - RNA, 16 nt, Mycobacterium bovis subsp bovis AF2122/97
cggccccgacggucaa

SEQ ID NO: 1142038 - RNA, 13 nt, Mycobacterium bovis subsp bovis AF2122/97
cggccccgccagc

SEQ ID NO: 1142039 - RNA, 21 nt, Mycobacterium bovis subsp bovis AF2122/97
cggccccgccagcgccgccgg

SEQ ID NO: 1142040 - RNA, 13 nt, Mycobacterium bovis subsp bovis AF2122/97
cggccccgcccgc

SEQ ID NO: 1142041 - RNA, 18 nt, Mycobacterium bovis subsp bovis AF2122/97
cggccccgcccgcgcggu

SEQ ID NO: 1142042 - RNA, 14 nt, Mycobacterium bovis subsp bovis AF2122/97
cggcccccggcagc

SEQ ID NO: 1142043 - RNA, 16 nt, Mycobacterium bovis subsp bovis AF2122/97
cggccauucuugguga

SEQ ID NO: 1142044 - RNA, 22 nt, Mycobacterium bovis subsp bovis AF2122/97
cggcccaaacggcgugucggug

SEQ ID NO: 1142045 - RNA, 20 nt, Mycobacterium bovis subsp bovis AF2122/97
cggccauuagcagcacccgg

SEQ ID NO: 1142046 - RNA, 21 nt, Mycobacterium bovis subsp bovis AF2122/97
cggccauuagcagcacccggg

SEQ ID NO: 1142047 - RNA, 19 nt, Mycobacterium bovis subsp bovis AF2122/97
cggccauugcccgggcggg

SEQ ID NO: 1142048 - RNA, 14 nt, Mycobacterium bovis subsp bovis AF2122/97
cggccauugcgggc

SEQ ID NO: 1142049 - RNA, 20 nt, Mycobacterium bovis subsp bovis AF2122/97
cggcccaaacggcgugucgg

SEQ ID NO: 1142050 - RNA, 13 nt, Mycobacterium bovis subsp bovis AF2122/97
cggccaucgcgag

SEQ ID NO: 1142051 - RNA, 14 nt, Mycobacterium bovis subsp bovis AF2122/97
cggccaucgcccga

SEQ ID NO: 1142052 - RNA, 19 nt, Mycobacterium bovis subsp bovis AF2122/97
cggccauggcggcgccggu

SEQ ID NO: 1142053 - RNA, 13 nt, Mycobacterium bovis subsp bovis AF2122/97
cggccaucgucca

SEQ ID NO: 1142054 - RNA, 14 nt, Mycobacterium bovis subsp bovis AF2122/97
cggccaucguccag

SEQ ID NO: 1142055 - RNA, 20 nt, Mycobacterium bovis subsp bovis AF2122/97
cggccauguagccguugccg

SEQ ID NO: 1142056 - RNA, 16 nt, Mycobacterium bovis subsp bovis AF2122/97
cggccaugucagcggc

SEQ ID NO: 1142057 - RNA, 17 nt, Mycobacterium bovis subsp bovis AF2122/97
cggccaugucagcggcc

SEQ ID NO: 1142058 - RNA, 13 nt, Mycobacterium bovis subsp bovis AF2122/97
cggccauggcggc

SEQ ID NO: 1142059 - RNA, 12 nt, Mycobacterium bovis subsp bovis AF2122/97
cggccaguacga

SEQ ID NO: 1142060 - RNA, 15 nt, Mycobacterium bovis subsp bovis AF2122/97
cggccaguacgucga

SEQ ID NO: 1142061 - RNA, 15 nt, Mycobacterium bovis subsp bovis AF2122/97
cggccagguugaucg

SEQ ID NO: 1142062 - RNA, 15 nt, Mycobacterium bovis subsp bovis AF2122/97
cggccaggucggcgu

SEQ ID NO: 1142063 - RNA, 23 nt, Mycobacterium bovis subsp bovis AF2122/97
cggccagugacaacgcgaugccg

SEQ ID NO: 1142064 - RNA, 16 nt, Mycobacterium bovis subsp bovis AF2122/97
cggccaguacgucgau

SEQ ID NO: 1142065 - RNA, 18 nt, Mycobacterium bovis subsp bovis AF2122/97
cggccaguacgucgauca

SEQ ID NO: 1142066 - RNA, 22 nt, Mycobacterium bovis subsp bovis AF2122/97
cggccagucguacucccaggcc

SEQ ID NO: 1142067 - RNA, 12 nt, Mycobacterium bovis subsp bovis AF2122/97
cggccauccacc

SEQ ID NO: 1142068 - RNA, 20 nt, Mycobacterium bovis subsp bovis AF2122/97
cggccagugcgcagaacacc

SEQ ID NO: 1142069 - RNA, 16 nt, Mycobacterium bovis subsp bovis AF2122/97
cggccauccggcggcg

SEQ ID NO: 1142070 - RNA, 20 nt, Mycobacterium bovis subsp bovis AF2122/97
cggccauccggcggcggcca

SEQ ID NO: 1142071 - RNA, 14 nt, Mycobacterium bovis subsp bovis AF2122/97
cggccaucgaccgu

SEQ ID NO: 1142072 - RNA, 17 nt, Mycobacterium bovis subsp bovis AF2122/97
cggccauccaccgcaga

SEQ ID NO: 1142073 - RNA, 20 nt, Mycobacterium bovis subsp bovis AF2122/97
cggccaucgaguccaccacc

SEQ ID NO: 1142074 - RNA, 13 nt, Mycobacterium bovis subsp bovis AF2122/97
cggccaucgcccg

SEQ ID NO: 1142075 - RNA, 15 nt, Mycobacterium bovis subsp bovis AF2122/97
cggccaucgaccguc

SEQ ID NO: 1142076 - RNA, 19 nt, Mycobacterium bovis subsp bovis AF2122/97
cggccaucgaccguccggg

SEQ ID NO: 1142077 - RNA, 12 nt, Mycobacterium bovis subsp bovis AF2122/97
cggccaucgacg

SEQ ID NO: 1142078 - RNA, 18 nt, Mycobacterium bovis subsp bovis AF2122/97
aacauccgguggugcucg

SEQ ID NO: 1142079 - RNA, 17 nt, Mycobacterium bovis subsp bovis AF2122/97
aacaucgccagcgccgg

SEQ ID NO: 1142080 - RNA, 18 nt, Mycobacterium bovis subsp bovis AF2122/97
cggccaggucgagcaccg

SEQ ID NO: 1142081 - RNA, 17 nt, Mycobacterium bovis subsp bovis AF2122/97
cggccaggucggcguug

SEQ ID NO: 1142082 - RNA, 22 nt, Mycobacterium bovis subsp bovis AF2122/97
cggccaggucgcgauagccgcc

SEQ ID NO: 1142083 - RNA, 23 nt, Mycobacterium bovis subsp bovis AF2122/97
aacaucggaacgugaccgacgcc

SEQ ID NO: 1142084 - RNA, 19 nt, Mycobacterium bovis subsp bovis AF2122/97
aacaucggacagggugcgc

SEQ ID NO: 1142085 - RNA, 14 nt, Mycobacterium bovis subsp bovis AF2122/97
aacaucuccgcguc

SEQ ID NO: 1142086 - RNA, 18 nt, Mycobacterium bovis subsp bovis AF2122/97
aacaucgguggcgccgaa

SEQ ID NO: 1142087 - RNA, 13 nt, Mycobacterium bovis subsp bovis AF2122/97
cggcagccggcgg

SEQ ID NO: 1142088 - RNA, 19 nt, Mycobacterium bovis subsp bovis AF2122/97
cggcagccggcuugggcgg

SEQ ID NO: 1142089 - RNA, 15 nt, Mycobacterium bovis subsp bovis AF2122/97
cggcagcccggcggc

SEQ ID NO: 1142090 - RNA, 17 nt, Mycobacterium bovis subsp bovis AF2122/97
cggcagcccggcggccg

SEQ ID NO: 1142091 - RNA, 19 nt, Mycobacterium bovis subsp bovis AF2122/97
cggcagcccggcggccgcu

SEQ ID NO: 1142092 - RNA, 13 nt, Mycobacterium bovis subsp bovis AF2122/97
cggcagcccgggc

SEQ ID NO: 1142093 - RNA, 14 nt, Mycobacterium bovis subsp bovis AF2122/97
cggcagcccgcugg

SEQ ID NO: 1142094 - RNA, 18 nt, Mycobacterium bovis subsp bovis AF2122/97
cggcagccccugccgauc

SEQ ID NO: 1142095 - RNA, 19 nt, Mycobacterium bovis subsp bovis AF2122/97
cggcagccccugccgaucc

SEQ ID NO: 1142096 - RNA, 13 nt, Mycobacterium bovis subsp bovis AF2122/97
cggcagccgcaua

SEQ ID NO: 1142097 - RNA, 18 nt, Mycobacterium bovis subsp bovis AF2122/97
cggcagccaccagcgacg

SEQ ID NO: 1142098 - RNA, 13 nt, Mycobacterium bovis subsp bovis AF2122/97
cggcagccaccgu

SEQ ID NO: 1142099 - RNA, 16 nt, Mycobacterium bovis subsp bovis AF2122/97
cggcagccagccaccg

SEQ ID NO: 1142100 - RNA, 15 nt, Mycobacterium bovis subsp bovis AF2122/97
cggcagccccugccg

SEQ ID NO: 1142101 - RNA, 16 nt, Mycobacterium bovis subsp bovis AF2122/97
cggcagccccugccga

SEQ ID NO: 1142102 - RNA, 17 nt, Mycobacterium bovis subsp bovis AF2122/97
cggcagccccugccgau

SEQ ID NO: 1142103 - RNA, 17 nt, Mycobacterium bovis subsp bovis AF2122/97
cggcagccagggcgccg

SEQ ID NO: 1142104 - RNA, 18 nt, Mycobacterium bovis subsp bovis AF2122/97
cggcagccagggcgccga

SEQ ID NO: 1142105 - RNA, 20 nt, Mycobacterium bovis subsp bovis AF2122/97
cggcagccagggcgccgaau

SEQ ID NO: 1142106 - RNA, 14 nt, Mycobacterium bovis subsp bovis AF2122/97
cggcagcgccgguc

SEQ ID NO: 1142107 - RNA, 16 nt, Mycobacterium bovis subsp bovis AF2122/97
cggcagcgccggucgg

SEQ ID NO: 1142108 - RNA, 19 nt, Mycobacterium bovis subsp bovis AF2122/97
cggcagcgccggucggauc

SEQ ID NO: 1142109 - RNA, 17 nt, Mycobacterium bovis subsp bovis AF2122/97
cggcagcgcggccaauu

SEQ ID NO: 1142110 - RNA, 14 nt, Mycobacterium bovis subsp bovis AF2122/97
cggcagcgaugcgg

SEQ ID NO: 1142111 - RNA, 14 nt, Mycobacterium bovis subsp bovis AF2122/97
cggcagcgagucga

SEQ ID NO: 1142112 - RNA, 14 nt, Mycobacterium bovis subsp bovis AF2122/97
cggcagcgcccaga

SEQ ID NO: 1142113 - RNA, 19 nt, Mycobacterium bovis subsp bovis AF2122/97
cggcagcgcccagaucgcc

SEQ ID NO: 1142114 - RNA, 24 nt, Mycobacterium bovis subsp bovis AF2122/97
cggcagcccaaagcgccagcagcc

SEQ ID NO: 1142115 - RNA, 18 nt, Mycobacterium bovis subsp bovis AF2122/97
cggcagcgacgccggccc

SEQ ID NO: 1142116 - RNA, 18 nt, Mycobacterium bovis subsp bovis AF2122/97
cggcagcgaggccauguu

SEQ ID NO: 1142117 - RNA, 20 nt, Mycobacterium bovis subsp bovis AF2122/97
cggcagccuggccucgccau

SEQ ID NO: 1142118 - RNA, 16 nt, Mycobacterium bovis subsp bovis AF2122/97
cggcaggugcccaucg

SEQ ID NO: 1142119 - RNA, 16 nt, Mycobacterium bovis subsp bovis AF2122/97
cggcaggugcggcggc

SEQ ID NO: 1142120 - RNA, 17 nt, Mycobacterium bovis subsp bovis AF2122/97
cggcaggugcggcggca

SEQ ID NO: 1142121 - RNA, 15 nt, Mycobacterium bovis subsp bovis AF2122/97
cggcagguguuggug

SEQ ID NO: 1142122 - RNA, 21 nt, Mycobacterium bovis subsp bovis AF2122/97
cggcaggugcccaucgggugg

SEQ ID NO: 1142123 - RNA, 15 nt, Mycobacterium bovis subsp bovis AF2122/97
cggcagguucggcga

SEQ ID NO: 1142124 - RNA, 14 nt, Mycobacterium bovis subsp bovis AF2122/97
cggcaggcucgggc

SEQ ID NO: 1142125 - RNA, 15 nt, Mycobacterium bovis subsp bovis AF2122/97
cggcaggcucgggca

SEQ ID NO: 1142126 - RNA, 16 nt, Mycobacterium bovis subsp bovis AF2122/97
cggcaggcggccgccg

SEQ ID NO: 1142127 - RNA, 21 nt, Mycobacterium bovis subsp bovis AF2122/97
cggcagcggguuugccgggcg

SEQ ID NO: 1142128 - RNA, 23 nt, Mycobacterium bovis subsp bovis AF2122/97
cggcagcgaugcggugucgggcu

SEQ ID NO: 1142129 - RNA, 13 nt, Mycobacterium bovis subsp bovis AF2122/97
cggcagcggcgua

SEQ ID NO: 1142130 - RNA, 19 nt, Mycobacterium bovis subsp bovis AF2122/97
cggcagcgguggcuugccc

SEQ ID NO: 1142131 - RNA, 19 nt, Mycobacterium bovis subsp bovis AF2122/97
cggcagcgugcggggcgcc

SEQ ID NO: 1142132 - RNA, 21 nt, Mycobacterium bovis subsp bovis AF2122/97
cggcagcguggacaucgggcg

SEQ ID NO: 1142133 - RNA, 16 nt, Mycobacterium bovis subsp bovis AF2122/97
cggcaggccggcgucg

SEQ ID NO: 1142134 - RNA, 20 nt, Mycobacterium bovis subsp bovis AF2122/97
cggcaggccggcgucgauca

SEQ ID NO: 1142135 - RNA, 18 nt, Mycobacterium bovis subsp bovis AF2122/97
cggcaggccggccaccga

SEQ ID NO: 1142136 - RNA, 19 nt, Mycobacterium bovis subsp bovis AF2122/97
cggcagcguccgaaccacc

SEQ ID NO: 1142137 - RNA, 21 nt, Mycobacterium bovis subsp bovis AF2122/97
cggcagcggcgaguuggccgu

SEQ ID NO: 1142138 - RNA, 18 nt, Mycobacterium bovis subsp bovis AF2122/97
cggcagcggcgccgccug

SEQ ID NO: 1142139 - RNA, 17 nt, Mycobacterium bovis subsp bovis AF2122/97
cggcagcggcgcgcugc

SEQ ID NO: 1142140 - RNA, 15 nt, Mycobacterium bovis subsp bovis AF2122/97
cggcagcggcgauca

SEQ ID NO: 1142141 - RNA, 20 nt, Mycobacterium bovis subsp bovis AF2122/97
cggcagcggcgaucaggcgg

SEQ ID NO: 1142142 - RNA, 12 nt, Mycobacterium bovis subsp bovis AF2122/97
cggcagcggcgc

SEQ ID NO: 1142143 - RNA, 17 nt, Mycobacterium bovis subsp bovis AF2122/97
cggcagcggcgucgucg

SEQ ID NO: 1142144 - RNA, 18 nt, Mycobacterium bovis subsp bovis AF2122/97
cggcagcggcgcgcugca

SEQ ID NO: 1142145 - RNA, 21 nt, Mycobacterium bovis subsp bovis AF2122/97
cggcagcggcggucucggcgu

SEQ ID NO: 1142146 - RNA, 20 nt, Mycobacterium bovis subsp bovis AF2122/97
cggcagcggguuugccgggc

SEQ ID NO: 1142147 - RNA, 17 nt, Mycobacterium bovis subsp bovis AF2122/97
cggcaguaccccucgca

SEQ ID NO: 1142148 - RNA, 19 nt, Mycobacterium bovis subsp bovis AF2122/97
cggcagucauuauucgcgc

SEQ ID NO: 1142149 - RNA, 21 nt, Mycobacterium bovis subsp bovis AF2122/97
cggcagucauuauucgcgcaa

SEQ ID NO: 1142150 - RNA, 15 nt, Mycobacterium bovis subsp bovis AF2122/97
cggcagucccagcgc

SEQ ID NO: 1142151 - RNA, 21 nt, Mycobacterium bovis subsp bovis AF2122/97
cggcaguucgcggccaucgcc

SEQ ID NO: 1142152 - RNA, 23 nt, Mycobacterium bovis subsp bovis AF2122/97
cggcaguucgcggccaucgccga

SEQ ID NO: 1142153 - RNA, 17 nt, Mycobacterium bovis subsp bovis AF2122/97
cggcagugagucgguga

SEQ ID NO: 1142154 - RNA, 21 nt, Mycobacterium bovis subsp bovis AF2122/97
cggcagucgcgguaccaucac

SEQ ID NO: 1142155 - RNA, 15 nt, Mycobacterium bovis subsp bovis AF2122/97
cggcauacaccguga

SEQ ID NO: 1142156 - RNA, 20 nt, Mycobacterium bovis subsp bovis AF2122/97
cggcauaacgaucccgugau

SEQ ID NO: 1142157 - RNA, 14 nt, Mycobacterium bovis subsp bovis AF2122/97
cggcauacaacugg

SEQ ID NO: 1142158 - RNA, 20 nt, Mycobacterium bovis subsp bovis AF2122/97
cggcaguccgagcuuggccg

SEQ ID NO: 1142159 - RNA, 16 nt, Mycobacterium bovis subsp bovis AF2122/97
cggcaguggccagacc

SEQ ID NO: 1142160 - RNA, 18 nt, Mycobacterium bovis subsp bovis AF2122/97
cggcauaacccuggccgg

SEQ ID NO: 1142161 - RNA, 18 nt, Mycobacterium bovis subsp bovis AF2122/97
cggcauaacgaucccgug

SEQ ID NO: 1142162 - RNA, 22 nt, Mycobacterium bovis subsp bovis AF2122/97
cggcaguugaacucgaccaccg

SEQ ID NO: 1142163 - RNA, 18 nt, Mycobacterium bovis subsp bovis AF2122/97
cggcaucugguauggguc

SEQ ID NO: 1142164 - RNA, 15 nt, Mycobacterium bovis subsp bovis AF2122/97
cggcaucuccaccgu

SEQ ID NO: 1142165 - RNA, 16 nt, Mycobacterium bovis subsp bovis AF2122/97
cggcaugagucgaacc

SEQ ID NO: 1142166 - RNA, 19 nt, Mycobacterium bovis subsp bovis AF2122/97
cggcaucgucgacgcccga

SEQ ID NO: 1142167 - RNA, 15 nt, Mycobacterium bovis subsp bovis AF2122/97
cggcaugcaaugcug

SEQ ID NO: 1142168 - RNA, 23 nt, Mycobacterium bovis subsp bovis AF2122/97
cggcaugcaaugcuggcggcgcg

SEQ ID NO: 1142169 - RNA, 15 nt, Mycobacterium bovis subsp bovis AF2122/97
cggcaugcagcccca

SEQ ID NO: 1142170 - RNA, 16 nt, Mycobacterium bovis subsp bovis AF2122/97
cggcaucggccagccg

SEQ ID NO: 1142171 - RNA, 12 nt, Mycobacterium bovis subsp bovis AF2122/97
cggcaucggcga

SEQ ID NO: 1142172 - RNA, 18 nt, Mycobacterium bovis subsp bovis AF2122/97
cggcaucggucaccgcgg

SEQ ID NO: 1142173 - RNA, 13 nt, Mycobacterium bovis subsp bovis AF2122/97
cggcaucggugau

SEQ ID NO: 1142174 - RNA, 21 nt, Mycobacterium bovis subsp bovis AF2122/97
cggcaucggcggcaacggcgg

SEQ ID NO: 1142175 - RNA, 12 nt, Mycobacterium bovis subsp bovis AF2122/97
cggcauacaucc

SEQ ID NO: 1142176 - RNA, 20 nt, Mycobacterium bovis subsp bovis AF2122/97
cggcauacccaucaacaucg

SEQ ID NO: 1142177 - RNA, 18 nt, Mycobacterium bovis subsp bovis AF2122/97
cggcaucgcgagcugcga

SEQ ID NO: 1142178 - RNA, 15 nt, Mycobacterium bovis subsp bovis AF2122/97
cggcaucgcgggcgg

SEQ ID NO: 1142179 - RNA, 23 nt, Mycobacterium bovis subsp bovis AF2122/97
cggcaucgcgggcggcgcuggcg

SEQ ID NO: 1142180 - RNA, 12 nt, Mycobacterium bovis subsp bovis AF2122/97
cggccaacccgu

SEQ ID NO: 1142181 - RNA, 16 nt, Mycobacterium bovis subsp bovis AF2122/97
cggccaacagcacccg

SEQ ID NO: 1142182 - RNA, 17 nt, Mycobacterium bovis subsp bovis AF2122/97
cggccaaccaugcuguc

SEQ ID NO: 1142183 - RNA, 17 nt, Mycobacterium bovis subsp bovis AF2122/97
cggccaacgaacgugcc

SEQ ID NO: 1142184 - RNA, 22 nt, Mycobacterium bovis subsp bovis AF2122/97
cggccaacgaacgugccccggc

SEQ ID NO: 1142185 - RNA, 18 nt, Mycobacterium bovis subsp bovis AF2122/97
cggccaacgacgacccgu

SEQ ID NO: 1142186 - RNA, 18 nt, Mycobacterium bovis subsp bovis AF2122/97
cggccaacgacggccgac

SEQ ID NO: 1142187 - RNA, 20 nt, Mycobacterium bovis subsp bovis AF2122/97
cggccaacgacggccgacaa

SEQ ID NO: 1142188 - RNA, 22 nt, Mycobacterium bovis subsp bovis AF2122/97
cggccaacgacggccgacaacc

SEQ ID NO: 1142189 - RNA, 16 nt, Mycobacterium bovis subsp bovis AF2122/97
cggccaacgccgccgc

SEQ ID NO: 1142190 - RNA, 15 nt, Mycobacterium bovis subsp bovis AF2122/97
cggccaacggcaccc

SEQ ID NO: 1142191 - RNA, 16 nt, Mycobacterium bovis subsp bovis AF2122/97
cggccaacugggccga

SEQ ID NO: 1142192 - RNA, 18 nt, Mycobacterium bovis subsp bovis AF2122/97
cggccaacggcuccgggc

SEQ ID NO: 1142193 - RNA, 21 nt, Mycobacterium bovis subsp bovis AF2122/97
cggccaacggcuccgggcgcu

SEQ ID NO: 1142194 - RNA, 18 nt, Mycobacterium bovis subsp bovis AF2122/97
cggccaacccgggccgcc

SEQ ID NO: 1142195 - RNA, 20 nt, Mycobacterium bovis subsp bovis AF2122/97
cggccaaucagcccgccgga

SEQ ID NO: 1142196 - RNA, 20 nt, Mycobacterium bovis subsp bovis AF2122/97
cggccaaugacgucggacca

SEQ ID NO: 1142197 - RNA, 15 nt, Mycobacterium bovis subsp bovis AF2122/97
cggccaccaccgccg

SEQ ID NO: 1142198 - RNA, 20 nt, Mycobacterium bovis subsp bovis AF2122/97
cggccaauggccugcagcgc

SEQ ID NO: 1142199 - RNA, 14 nt, Mycobacterium bovis subsp bovis AF2122/97
cggccaaggucgac

SEQ ID NO: 1142200 - RNA, 19 nt, Mycobacterium bovis subsp bovis AF2122/97
cggccaacugggccgagcg

SEQ ID NO: 1142201 - RNA, 13 nt, Mycobacterium bovis subsp bovis AF2122/97
cggccaacagcac

SEQ ID NO: 1142202 - RNA, 22 nt, Mycobacterium bovis subsp bovis AF2122/97
cggccaacaccacuagcggcuc

SEQ ID NO: 1142203 - RNA, 20 nt, Mycobacterium bovis subsp bovis AF2122/97
cggccaaagcuuucccguug

SEQ ID NO: 1142204 - RNA, 23 nt, Mycobacterium bovis subsp bovis AF2122/97
cggccaaagacccggcacccagu

SEQ ID NO: 1142205 - RNA, 21 nt, Mycobacterium bovis subsp bovis AF2122/97
cggccaacagggcgccgacga

SEQ ID NO: 1142206 - RNA, 20 nt, Mycobacterium bovis subsp bovis AF2122/97
cggccaacagguccaccggc

SEQ ID NO: 1142207 - RNA, 21 nt, Mycobacterium bovis subsp bovis AF2122/97
cggccaacagguccaccggcc

SEQ ID NO: 1142208 - RNA, 22 nt, Mycobacterium bovis subsp bovis AF2122/97
cggccaacagguccaccggcca

SEQ ID NO: 1142209 - RNA, 21 nt, Mycobacterium bovis subsp bovis AF2122/97
cggcaugcagccccacuucgg

SEQ ID NO: 1142210 - RNA, 17 nt, Mycobacterium bovis subsp bovis AF2122/97
cggcaugcgcagaaacg

SEQ ID NO: 1142211 - RNA, 22 nt, Mycobacterium bovis subsp bovis AF2122/97
cggcaugccgccaugcgcacca

SEQ ID NO: 1142212 - RNA, 14 nt, Mycobacterium bovis subsp bovis AF2122/97
cggcaugcgugccg

SEQ ID NO: 1142213 - RNA, 20 nt, Mycobacterium bovis subsp bovis AF2122/97
cggcaugcgugccggcagcg

SEQ ID NO: 1142214 - RNA, 18 nt, Mycobacterium bovis subsp bovis AF2122/97
cggcaugcucaccgaaac

SEQ ID NO: 1142215 - RNA, 18 nt, Mycobacterium bovis subsp bovis AF2122/97
cggccaaagacccggcac

SEQ ID NO: 1142216 - RNA, 14 nt, Mycobacterium bovis subsp bovis AF2122/97
cggcacccugcggc

SEQ ID NO: 1142217 - RNA, 17 nt, Mycobacterium bovis subsp bovis AF2122/97
cggcacccugcggcacc

SEQ ID NO: 1142218 - RNA, 20 nt, Mycobacterium bovis subsp bovis AF2122/97
cggcaccgaagucgaugaug

SEQ ID NO: 1142219 - RNA, 16 nt, Mycobacterium bovis subsp bovis AF2122/97
cggcacccggcagagc

SEQ ID NO: 1142220 - RNA, 23 nt, Mycobacterium bovis subsp bovis AF2122/97
cggcacccgcacggccuccggac

SEQ ID NO: 1142221 - RNA, 14 nt, Mycobacterium bovis subsp bovis AF2122/97
cggcacccgggugg

SEQ ID NO: 1142222 - RNA, 12 nt, Mycobacterium bovis subsp bovis AF2122/97
cggcacccggug

SEQ ID NO: 1142223 - RNA, 16 nt, Mycobacterium bovis subsp bovis AF2122/97
cggcacccgucgggug

SEQ ID NO: 1142224 - RNA, 20 nt, Mycobacterium bovis subsp bovis AF2122/97
cggcacccgucgggugcuga

SEQ ID NO: 1142225 - RNA, 12 nt, Mycobacterium bovis subsp bovis AF2122/97
cggcaccgaugg

SEQ ID NO: 1142226 - RNA, 17 nt, Mycobacterium bovis subsp bovis AF2122/97
cggcaccgauggcgcac

SEQ ID NO: 1142227 - RNA, 12 nt, Mycobacterium bovis subsp bovis AF2122/97
cggcaccgccag

SEQ ID NO: 1142228 - RNA, 13 nt, Mycobacterium bovis subsp bovis AF2122/97
cggcaccgacggu

SEQ ID NO: 1142229 - RNA, 22 nt, Mycobacterium bovis subsp bovis AF2122/97
cggcaccgacugcugucaccgc

SEQ ID NO: 1142230 - RNA, 15 nt, Mycobacterium bovis subsp bovis AF2122/97
cggcaccgccagugc

SEQ ID NO: 1142231 - RNA, 19 nt, Mycobacterium bovis subsp bovis AF2122/97
cggcaccuuguagcgggca

SEQ ID NO: 1142232 - RNA, 23 nt, Mycobacterium bovis subsp bovis AF2122/97
cggcacgaaaaugggggcuggua

SEQ ID NO: 1142233 - RNA, 14 nt, Mycobacterium bovis subsp bovis AF2122/97
aacaggccggccgc

SEQ ID NO: 1142234 - RNA, 15 nt, Mycobacterium bovis subsp bovis AF2122/97
cggcacccgccgugc

SEQ ID NO: 1142235 - RNA, 22 nt, Mycobacterium bovis subsp bovis AF2122/97
cggcacccgccgugcccccggc

SEQ ID NO: 1142236 - RNA, 15 nt, Mycobacterium bovis subsp bovis AF2122/97
cggcacccgcggcga

SEQ ID NO: 1142237 - RNA, 15 nt, Mycobacterium bovis subsp bovis AF2122/97
cggcacccgcacggc

SEQ ID NO: 1142238 - RNA, 14 nt, Mycobacterium bovis subsp bovis AF2122/97
cggcaccccggcca

SEQ ID NO: 1142239 - RNA, 15 nt, Mycobacterium bovis subsp bovis AF2122/97
cggcaccccggccac

SEQ ID NO: 1142240 - RNA, 18 nt, Mycobacterium bovis subsp bovis AF2122/97
cggcaccccuuugacgcc

SEQ ID NO: 1142241 - RNA, 20 nt, Mycobacterium bovis subsp bovis AF2122/97
cggcaccccuuugacgccga

SEQ ID NO: 1142242 - RNA, 13 nt, Mycobacterium bovis subsp bovis AF2122/97
cggcacccgaguu

SEQ ID NO: 1142243 - RNA, 14 nt, Mycobacterium bovis subsp bovis AF2122/97
cggacagcucgcgg

SEQ ID NO: 1142244 - RNA, 15 nt, Mycobacterium bovis subsp bovis AF2122/97
cggacagcgucucgg

SEQ ID NO: 1142245 - RNA, 13 nt, Mycobacterium bovis subsp bovis AF2122/97
cggacagcgaguu

SEQ ID NO: 1142246 - RNA, 17 nt, Mycobacterium bovis subsp bovis AF2122/97
cggacagcgccuggccg

SEQ ID NO: 1142247 - RNA, 16 nt, Mycobacterium bovis subsp bovis AF2122/97
cggacagcagccggcg

SEQ ID NO: 1142248 - RNA, 15 nt, Mycobacterium bovis subsp bovis AF2122/97
cggacaccgcggcga

SEQ ID NO: 1142249 - RNA, 21 nt, Mycobacterium bovis subsp bovis AF2122/97
cggacacgaucgcgucggcua

SEQ ID NO: 1142250 - RNA, 15 nt, Mycobacterium bovis subsp bovis AF2122/97
cggacacacaggcgg

SEQ ID NO: 1142251 - RNA, 20 nt, Mycobacterium bovis subsp bovis AF2122/97
cggacacagcccacaggcgg

SEQ ID NO: 1142252 - RNA, 23 nt, Mycobacterium bovis subsp bovis AF2122/97
cggacacagcccacaggcggcgc

SEQ ID NO: 1142253 - RNA, 18 nt, Mycobacterium bovis subsp bovis AF2122/97
aacagguaagcagccagc

SEQ ID NO: 1142254 - RNA, 15 nt, Mycobacterium bovis subsp bovis AF2122/97
aacaggauggugcgg

SEQ ID NO: 1142255 - RNA, 18 nt, Mycobacterium bovis subsp bovis AF2122/97
cggcacgcaaugucggca

SEQ ID NO: 1142256 - RNA, 19 nt, Mycobacterium bovis subsp bovis AF2122/97
cggcacgcagccaaugccg

SEQ ID NO: 1142257 - RNA, 23 nt, Mycobacterium bovis subsp bovis AF2122/97
cggcacgcacgcgguucaccacg

SEQ ID NO: 1142258 - RNA, 19 nt, Mycobacterium bovis subsp bovis AF2122/97
cggcacgcccacagcugac

SEQ ID NO: 1142259 - RNA, 15 nt, Mycobacterium bovis subsp bovis AF2122/97
cggcacgccgaccgg

SEQ ID NO: 1142260 - RNA, 18 nt, Mycobacterium bovis subsp bovis AF2122/97
cggcacgccgaccggugg

SEQ ID NO: 1142261 - RNA, 17 nt, Mycobacterium bovis subsp bovis AF2122/97
cggcacgccggcggcgg

SEQ ID NO: 1142262 - RNA, 13 nt, Mycobacterium bovis subsp bovis AF2122/97
cggcacgccgggc

SEQ ID NO: 1142263 - RNA, 15 nt, Mycobacterium bovis subsp bovis AF2122/97
cggcacgcuccagcu

SEQ ID NO: 1142264 - RNA, 17 nt, Mycobacterium bovis subsp bovis AF2122/97
cggcacggaccgcgucg

SEQ ID NO: 1142265 - RNA, 15 nt, Mycobacterium bovis subsp bovis AF2122/97
cggcacggaugcgau

SEQ ID NO: 1142266 - RNA, 15 nt, Mycobacterium bovis subsp bovis AF2122/97
cggcacgggcggcca

SEQ ID NO: 1142267 - RNA, 19 nt, Mycobacterium bovis subsp bovis AF2122/97
cggcacgggcggccauggc

SEQ ID NO: 1142268 - RNA, 21 nt, Mycobacterium bovis subsp bovis AF2122/97
cggcacgggcggggacggcgg

SEQ ID NO: 1142269 - RNA, 21 nt, Mycobacterium bovis subsp bovis AF2122/97
cggcacgggaaucgcucgcgc

SEQ ID NO: 1142270 - RNA, 18 nt, Mycobacterium bovis subsp bovis AF2122/97
cggcacggugucgcgcga

SEQ ID NO: 1142271 - RNA, 18 nt, Mycobacterium bovis subsp bovis AF2122/97
cggcacgucgcccccggc

SEQ ID NO: 1142272 - RNA, 13 nt, Mycobacterium bovis subsp bovis AF2122/97
cggcagacccgag

SEQ ID NO: 1142273 - RNA, 13 nt, Mycobacterium bovis subsp bovis AF2122/97
cggcagaccgacc

SEQ ID NO: 1142274 - RNA, 16 nt, Mycobacterium bovis subsp bovis AF2122/97
cggcacugcggccagu

SEQ ID NO: 1142275 - RNA, 17 nt, Mycobacterium bovis subsp bovis AF2122/97
cggcagaccgaccucgg

SEQ ID NO: 1142276 - RNA, 17 nt, Mycobacterium bovis subsp bovis AF2122/97
cggcagaccggugcugu

SEQ ID NO: 1142277 - RNA, 19 nt, Mycobacterium bovis subsp bovis AF2122/97
cggcagaccggugcugucg

SEQ ID NO: 1142278 - RNA, 15 nt, Mycobacterium bovis subsp bovis AF2122/97
cggcagaccaagccc

SEQ ID NO: 1142279 - RNA, 21 nt, Mycobacterium bovis subsp bovis AF2122/97
cggcagaauguucuccacgag

SEQ ID NO: 1142280 - RNA, 20 nt, Mycobacterium bovis subsp bovis AF2122/97
cggcagaccgaccucggcga

SEQ ID NO: 1142281 - RNA, 17 nt, Mycobacterium bovis subsp bovis AF2122/97
cggcagauacucggcga

SEQ ID NO: 1142282 - RNA, 17 nt, Mycobacterium bovis subsp bovis AF2122/97
cggcagaucccacgcca

SEQ ID NO: 1142283 - RNA, 19 nt, Mycobacterium bovis subsp bovis AF2122/97
cggcagaucccacgccagg

SEQ ID NO: 1142284 - RNA, 21 nt, Mycobacterium bovis subsp bovis AF2122/97
cggcagauguguccggcaucg

SEQ ID NO: 1142285 - RNA, 22 nt, Mycobacterium bovis subsp bovis AF2122/97
cggcagaugcagcgggucgccg

SEQ ID NO: 1142286 - RNA, 22 nt, Mycobacterium bovis subsp bovis AF2122/97
cggcagaugagucaaaauccgc

SEQ ID NO: 1142287 - RNA, 16 nt, Mycobacterium bovis subsp bovis AF2122/97
cggcagacgcguuucg

SEQ ID NO: 1142288 - RNA, 20 nt, Mycobacterium bovis subsp bovis AF2122/97
cggcagacgcguuucgucga

SEQ ID NO: 1142289 - RNA, 23 nt, Mycobacterium bovis subsp bovis AF2122/97
cggcagacgcguuucgucgaccg

SEQ ID NO: 1142290 - RNA, 20 nt, Mycobacterium bovis subsp bovis AF2122/97
cggcacuugggaaggauggu

SEQ ID NO: 1142291 - RNA, 22 nt, Mycobacterium bovis subsp bovis AF2122/97
cggcacuugggaaggauggucg

SEQ ID NO: 1142292 - RNA, 20 nt, Mycobacterium bovis subsp bovis AF2122/97
cggcacuuuguagcccgcga

SEQ ID NO: 1142293 - RNA, 18 nt, Mycobacterium bovis subsp bovis AF2122/97
cggcacuuagcccgaugg

SEQ ID NO: 1142294 - RNA, 19 nt, Mycobacterium bovis subsp bovis AF2122/97
cggcacuuagcccgauggu

SEQ ID NO: 1142295 - RNA, 15 nt, Mycobacterium bovis subsp bovis AF2122/97
cggcacugccgagca

SEQ ID NO: 1142296 - RNA, 21 nt, Mycobacterium bovis subsp bovis AF2122/97
cggcacugcgaaucuccgcgc

SEQ ID NO: 1142297 - RNA, 22 nt, Mycobacterium bovis subsp bovis AF2122/97
cggcacugcgaaucuccgcgcg

SEQ ID NO: 1142298 - RNA, 13 nt, Mycobacterium bovis subsp bovis AF2122/97
cggcacugcggcc

SEQ ID NO: 1142299 - RNA, 14 nt, Mycobacterium bovis subsp bovis AF2122/97
cggcacugcggcca

SEQ ID NO: 1142300 - RNA, 16 nt, Mycobacterium bovis subsp bovis AF2122/97
cggcacuggccccggu

SEQ ID NO: 1142301 - RNA, 20 nt, Mycobacterium bovis subsp bovis AF2122/97
cggcacugugcguccgcaac

SEQ ID NO: 1142302 - RNA, 17 nt, Mycobacterium bovis subsp bovis AF2122/97
cggcacugaccgcgaug

SEQ ID NO: 1142303 - RNA, 14 nt, Mycobacterium bovis subsp bovis AF2122/97
cggcacugaucugc

SEQ ID NO: 1142304 - RNA, 15 nt, Mycobacterium bovis subsp bovis AF2122/97
cggcacugaccgcga

SEQ ID NO: 1142305 - RNA, 19 nt, Mycobacterium bovis subsp bovis AF2122/97
cggcacgggcgucgucggu

SEQ ID NO: 1142306 - RNA, 13 nt, Mycobacterium bovis subsp bovis AF2122/97
cggcacugaccgc

SEQ ID NO: 1142307 - RNA, 16 nt, Mycobacterium bovis subsp bovis AF2122/97
cggcacuacgcagccg

SEQ ID NO: 1142308 - RNA, 19 nt, Mycobacterium bovis subsp bovis AF2122/97
cggcacuagcccgaccggu

SEQ ID NO: 1142309 - RNA, 20 nt, Mycobacterium bovis subsp bovis AF2122/97
cggcacuagcgagccggcgc

SEQ ID NO: 1142310 - RNA, 21 nt, Mycobacterium bovis subsp bovis AF2122/97
cggcagcagaguucccugaug

SEQ ID NO: 1142311 - RNA, 14 nt, Mycobacterium bovis subsp bovis AF2122/97
cggcagcagcgccg

SEQ ID NO: 1142312 - RNA, 21 nt, Mycobacterium bovis subsp bovis AF2122/97
cggcagcagcgccguaguugg

SEQ ID NO: 1142313 - RNA, 16 nt, Mycobacterium bovis subsp bovis AF2122/97
cggcagcagccggcgg

SEQ ID NO: 1142314 - RNA, 17 nt, Mycobacterium bovis subsp bovis AF2122/97
cggcagcagcgggcgcg

SEQ ID NO: 1142315 - RNA, 14 nt, Mycobacterium bovis subsp bovis AF2122/97
cggcagcagcggug

SEQ ID NO: 1142316 - RNA, 23 nt, Mycobacterium bovis subsp bovis AF2122/97
cggcagauggucucgaacuccau

SEQ ID NO: 1142317 - RNA, 15 nt, Mycobacterium bovis subsp bovis AF2122/97
cggcagcaccgcacg

SEQ ID NO: 1142318 - RNA, 15 nt, Mycobacterium bovis subsp bovis AF2122/97
cggcagcacggucug

SEQ ID NO: 1142319 - RNA, 20 nt, Mycobacterium bovis subsp bovis AF2122/97
cggcagcaacgacgucgucg

SEQ ID NO: 1142320 - RNA, 20 nt, Mycobacterium bovis subsp bovis AF2122/97
cggcagcaucggcaccccgg

SEQ ID NO: 1142321 - RNA, 19 nt, Mycobacterium bovis subsp bovis AF2122/97
cggcagcauauccgccggc

SEQ ID NO: 1142322 - RNA, 21 nt, Mycobacterium bovis subsp bovis AF2122/97
cggcagcauauccgccggcga

SEQ ID NO: 1142323 - RNA, 18 nt, Mycobacterium bovis subsp bovis AF2122/97
cggcagcaucuccgucgg

SEQ ID NO: 1142324 - RNA, 12 nt, Mycobacterium bovis subsp bovis AF2122/97
cggcagccacca

SEQ ID NO: 1142325 - RNA, 22 nt, Mycobacterium bovis subsp bovis AF2122/97
aacaguugcacaccggcacugc

SEQ ID NO: 1142326 - RNA, 23 nt, Mycobacterium bovis subsp bovis AF2122/97
aacaguugcccgacgccggucac

SEQ ID NO: 1142327 - RNA, 14 nt, Mycobacterium bovis subsp bovis AF2122/97
ggccgcaccagcau

SEQ ID NO: 1142328 - RNA, 15 nt, Mycobacterium bovis subsp bovis AF2122/97
ggccgcaaugcguug

SEQ ID NO: 1142329 - RNA, 16 nt, Mycobacterium bovis subsp bovis AF2122/97
ggccgcaaggcgccga

SEQ ID NO: 1142330 - RNA, 22 nt, Mycobacterium bovis subsp bovis AF2122/97
ggccgcaaggcgccgauaccgg

SEQ ID NO: 1142331 - RNA, 22 nt, Mycobacterium bovis subsp bovis AF2122/97
ggccgcacaaguggucgaugaa

SEQ ID NO: 1142332 - RNA, 16 nt, Mycobacterium bovis subsp bovis AF2122/97
ggccgauuccgcgcgu

SEQ ID NO: 1142333 - RNA, 14 nt, Mycobacterium bovis subsp bovis AF2122/97
ggccgauugcucgg

SEQ ID NO: 1142334 - RNA, 16 nt, Mycobacterium bovis subsp bovis AF2122/97
ggccgauuuagugggc

SEQ ID NO: 1142335 - RNA, 14 nt, Mycobacterium bovis subsp bovis AF2122/97
ggccgcacgccgac

SEQ ID NO: 1142336 - RNA, 19 nt, Mycobacterium bovis subsp bovis AF2122/97
ggccgcacgccgaccagca

SEQ ID NO: 1142337 - RNA, 22 nt, Mycobacterium bovis subsp bovis AF2122/97
ggccgcacgccgaccagcaccc

SEQ ID NO: 1142338 - RNA, 16 nt, Mycobacterium bovis subsp bovis AF2122/97
ggccgcacgccggcca

SEQ ID NO: 1142339 - RNA, 18 nt, Mycobacterium bovis subsp bovis AF2122/97
ggccgcacgccggccagc

SEQ ID NO: 1142340 - RNA, 19 nt, Mycobacterium bovis subsp bovis AF2122/97
ggccgcacgucgaccucgg

SEQ ID NO: 1142341 - RNA, 14 nt, Mycobacterium bovis subsp bovis AF2122/97
ggccgcagccagca

SEQ ID NO: 1142342 - RNA, 14 nt, Mycobacterium bovis subsp bovis AF2122/97
ggccgcagcggcca

SEQ ID NO: 1142343 - RNA, 12 nt, Mycobacterium bovis subsp bovis AF2122/97
ggccgccgcaag

SEQ ID NO: 1142344 - RNA, 23 nt, Mycobacterium bovis subsp bovis AF2122/97
ggccgcaggcuugccgauggcgg

SEQ ID NO: 1142345 - RNA, 23 nt, Mycobacterium bovis subsp bovis AF2122/97
ggccgccgcagcuccccgaccga

SEQ ID NO: 1142346 - RNA, 17 nt, Mycobacterium bovis subsp bovis AF2122/97
ggccgccgccagaugag

SEQ ID NO: 1142347 - RNA, 23 nt, Mycobacterium bovis subsp bovis AF2122/97
ggccgccgccaguccggacggca

SEQ ID NO: 1142348 - RNA, 15 nt, Mycobacterium bovis subsp bovis AF2122/97
ggccgccgccccggc

SEQ ID NO: 1142349 - RNA, 16 nt, Mycobacterium bovis subsp bovis AF2122/97
ggccgccgcgauggcc

SEQ ID NO: 1142350 - RNA, 14 nt, Mycobacterium bovis subsp bovis AF2122/97
ggccgccgggcagu

SEQ ID NO: 1142351 - RNA, 21 nt, Mycobacterium bovis subsp bovis AF2122/97
ggccgccgccguaacggucgc

SEQ ID NO: 1142352 - RNA, 22 nt, Mycobacterium bovis subsp bovis AF2122/97
ggccgccgccguaacggucgcu

SEQ ID NO: 1142353 - RNA, 14 nt, Mycobacterium bovis subsp bovis AF2122/97
ggccgccgcgcacc

SEQ ID NO: 1142354 - RNA, 18 nt, Mycobacterium bovis subsp bovis AF2122/97
ggccgccguccccgccgu

SEQ ID NO: 1142355 - RNA, 14 nt, Mycobacterium bovis subsp bovis AF2122/97
ggccgccgugguga

SEQ ID NO: 1142356 - RNA, 15 nt, Mycobacterium bovis subsp bovis AF2122/97
ggccgccucgcggau

SEQ ID NO: 1142357 - RNA, 17 nt, Mycobacterium bovis subsp bovis AF2122/97
ggccgccucgcggauga

SEQ ID NO: 1142358 - RNA, 22 nt, Mycobacterium bovis subsp bovis AF2122/97
ggccgccucguacggaccgucg

SEQ ID NO: 1142359 - RNA, 18 nt, Mycobacterium bovis subsp bovis AF2122/97
ggccgccuucuccggcgu

SEQ ID NO: 1142360 - RNA, 19 nt, Mycobacterium bovis subsp bovis AF2122/97
ggccgccuucuccggcguc

SEQ ID NO: 1142361 - RNA, 14 nt, Mycobacterium bovis subsp bovis AF2122/97
ggccgcgaccagcg

SEQ ID NO: 1142362 - RNA, 17 nt, Mycobacterium bovis subsp bovis AF2122/97
ggccgcgaccagcgccg

SEQ ID NO: 1142363 - RNA, 13 nt, Mycobacterium bovis subsp bovis AF2122/97
ggccgcgaccgcg

SEQ ID NO: 1142364 - RNA, 13 nt, Mycobacterium bovis subsp bovis AF2122/97
ggccgcgaccagc

SEQ ID NO: 1142365 - RNA, 17 nt, Mycobacterium bovis subsp bovis AF2122/97
ggccgcgacguugaacu

SEQ ID NO: 1142366 - RNA, 12 nt, Mycobacterium bovis subsp bovis AF2122/97
ggccgcgcccgc

SEQ ID NO: 1142367 - RNA, 22 nt, Mycobacterium bovis subsp bovis AF2122/97
ggccgcgcccgccucgaccgcc

SEQ ID NO: 1142368 - RNA, 15 nt, Mycobacterium bovis subsp bovis AF2122/97
ggccgcgcccgccuc

SEQ ID NO: 1142369 - RNA, 21 nt, Mycobacterium bovis subsp bovis AF2122/97
ggccgcgcccgccucgaccgc

SEQ ID NO: 1142370 - RNA, 14 nt, Mycobacterium bovis subsp bovis AF2122/97
ggccgcgccgggga

SEQ ID NO: 1142371 - RNA, 15 nt, Mycobacterium bovis subsp bovis AF2122/97
ggccgcgcgacaacc

SEQ ID NO: 1142372 - RNA, 12 nt, Mycobacterium bovis subsp bovis AF2122/97
ggccgcggcagc

SEQ ID NO: 1142373 - RNA, 16 nt, Mycobacterium bovis subsp bovis AF2122/97
ggccggcacugccgag

SEQ ID NO: 1142374 - RNA, 23 nt, Mycobacterium bovis subsp bovis AF2122/97
ggccggcagcuugcagugccgcc

SEQ ID NO: 1142375 - RNA, 13 nt, Mycobacterium bovis subsp bovis AF2122/97
ggccggcaucguc

SEQ ID NO: 1142376 - RNA, 14 nt, Mycobacterium bovis subsp bovis AF2122/97
ggccggccgcgauc

SEQ ID NO: 1142377 - RNA, 18 nt, Mycobacterium bovis subsp bovis AF2122/97
ggccggcacccaccagug

SEQ ID NO: 1142378 - RNA, 14 nt, Mycobacterium bovis subsp bovis AF2122/97
ggccggcaccgcag

SEQ ID NO: 1142379 - RNA, 14 nt, Mycobacterium bovis subsp bovis AF2122/97
ggccggcaacggcg

SEQ ID NO: 1142380 - RNA, 23 nt, Mycobacterium bovis subsp bovis AF2122/97
ggccggcaacggcgcgccgacca

SEQ ID NO: 1142381 - RNA, 23 nt, Mycobacterium bovis subsp bovis AF2122/97
ggccggcaagaccgaacagcggc

SEQ ID NO: 1142382 - RNA, 20 nt, Mycobacterium bovis subsp bovis AF2122/97
ggccggaugucgacgagcac

SEQ ID NO: 1142383 - RNA, 22 nt, Mycobacterium bovis subsp bovis AF2122/97
ggccggcaaugccgcggccagu

SEQ ID NO: 1142384 - RNA, 14 nt, Mycobacterium bovis subsp bovis AF2122/97
ggccggaugggcgu

SEQ ID NO: 1142385 - RNA, 16 nt, Mycobacterium bovis subsp bovis AF2122/97
ggccggaugucgacga

SEQ ID NO: 1142386 - RNA, 13 nt, Mycobacterium bovis subsp bovis AF2122/97
ggccggaugagcg

SEQ ID NO: 1142387 - RNA, 16 nt, Mycobacterium bovis subsp bovis AF2122/97
ggccggauacggcgac

SEQ ID NO: 1142388 - RNA, 14 nt, Mycobacterium bovis subsp bovis AF2122/97
ggccggaauacccg

SEQ ID NO: 1142389 - RNA, 19 nt, Mycobacterium bovis subsp bovis AF2122/97
ggccggaauacccgcuggc

SEQ ID NO: 1142390 - RNA, 20 nt, Mycobacterium bovis subsp bovis AF2122/97
ggccgcuuugcgcggucagc

SEQ ID NO: 1142391 - RNA, 20 nt, Mycobacterium bovis subsp bovis AF2122/97
ggccgcuuuugauugaccaa

SEQ ID NO: 1142392 - RNA, 23 nt, Mycobacterium bovis subsp bovis AF2122/97
ggccggaccaucagcgucgacgu

SEQ ID NO: 1142393 - RNA, 14 nt, Mycobacterium bovis subsp bovis AF2122/97
ggccggaacgcccg

SEQ ID NO: 1142394 - RNA, 15 nt, Mycobacterium bovis subsp bovis AF2122/97
ggccgcuuugcgcgg

SEQ ID NO: 1142395 - RNA, 18 nt, Mycobacterium bovis subsp bovis AF2122/97
ggccgcuuugcgcgguca

SEQ ID NO: 1142396 - RNA, 18 nt, Mycobacterium bovis subsp bovis AF2122/97
ggccgcuuuucgauggug

SEQ ID NO: 1142397 - RNA, 20 nt, Mycobacterium bovis subsp bovis AF2122/97
ggccgcuuuucgaugguguc

SEQ ID NO: 1142398 - RNA, 21 nt, Mycobacterium bovis subsp bovis AF2122/97
ggccgcuuuucgauggugucg

SEQ ID NO: 1142399 - RNA, 19 nt, Mycobacterium bovis subsp bovis AF2122/97
ggccggagucgacgacguc

SEQ ID NO: 1142400 - RNA, 14 nt, Mycobacterium bovis subsp bovis AF2122/97
ggccggagcgcacc

SEQ ID NO: 1142401 - RNA, 19 nt, Mycobacterium bovis subsp bovis AF2122/97
ggccggagccggugccgac

SEQ ID NO: 1142402 - RNA, 21 nt, Mycobacterium bovis subsp bovis AF2122/97
ggccggagccggugccgacgg

SEQ ID NO: 1142403 - RNA, 15 nt, Mycobacterium bovis subsp bovis AF2122/97
ggccggagccgccgg

SEQ ID NO: 1142404 - RNA, 16 nt, Mycobacterium bovis subsp bovis AF2122/97
ggccggagccgccggc

SEQ ID NO: 1142405 - RNA, 13 nt, Mycobacterium bovis subsp bovis AF2122/97
ggccggagccggu

SEQ ID NO: 1142406 - RNA, 18 nt, Mycobacterium bovis subsp bovis AF2122/97
ggccgcgcgacaacccgg

SEQ ID NO: 1142407 - RNA, 17 nt, Mycobacterium bovis subsp bovis AF2122/97
ggccgcggcgcgacggc

SEQ ID NO: 1142408 - RNA, 12 nt, Mycobacterium bovis subsp bovis AF2122/97
ggccgcggcguc

SEQ ID NO: 1142409 - RNA, 16 nt, Mycobacterium bovis subsp bovis AF2122/97
ggccgcggcggccccg

SEQ ID NO: 1142410 - RNA, 22 nt, Mycobacterium bovis subsp bovis AF2122/97
ggccgcuucggcggucagcggc

SEQ ID NO: 1142411 - RNA, 15 nt, Mycobacterium bovis subsp bovis AF2122/97
ggccgcuuggccgcu

SEQ ID NO: 1142412 - RNA, 14 nt, Mycobacterium bovis subsp bovis AF2122/97
ggccgcuuggcgua

SEQ ID NO: 1142413 - RNA, 23 nt, Mycobacterium bovis subsp bovis AF2122/97
ggccgcugucguaccgcucggcg

SEQ ID NO: 1142414 - RNA, 15 nt, Mycobacterium bovis subsp bovis AF2122/97
ggccgcugugggcga

SEQ ID NO: 1142415 - RNA, 21 nt, Mycobacterium bovis subsp bovis AF2122/97
ggccgcugugggcgagucggg

SEQ ID NO: 1142416 - RNA, 22 nt, Mycobacterium bovis subsp bovis AF2122/97
ggccgcugugggucgauccggu

SEQ ID NO: 1142417 - RNA, 12 nt, Mycobacterium bovis subsp bovis AF2122/97
ggccggcgcagu

SEQ ID NO: 1142418 - RNA, 17 nt, Mycobacterium bovis subsp bovis AF2122/97
ggccggcgcagugcgac

SEQ ID NO: 1142419 - RNA, 17 nt, Mycobacterium bovis subsp bovis AF2122/97
ggccgggggaacgggau

SEQ ID NO: 1142420 - RNA, 17 nt, Mycobacterium bovis subsp bovis AF2122/97
ggccggggugccggcga

SEQ ID NO: 1142421 - RNA, 20 nt, Mycobacterium bovis subsp bovis AF2122/97
ggccgggucgaucaccgaca

SEQ ID NO: 1142422 - RNA, 21 nt, Mycobacterium bovis subsp bovis AF2122/97
ggccgggucgaucaccgacac

SEQ ID NO: 1142423 - RNA, 18 nt, Mycobacterium bovis subsp bovis AF2122/97
ggccgggugcgugcgcgu

SEQ ID NO: 1142424 - RNA, 18 nt, Mycobacterium bovis subsp bovis AF2122/97
ggccgggucgcgcuggcg

SEQ ID NO: 1142425 - RNA, 23 nt, Mycobacterium bovis subsp bovis AF2122/97
ggccgggucgcgcuggcgccggc

SEQ ID NO: 1142426 - RNA, 18 nt, Mycobacterium bovis subsp bovis AF2122/97
ggccggguucgcgucuga

SEQ ID NO: 1142427 - RNA, 21 nt, Mycobacterium bovis subsp bovis AF2122/97
ggccggguuccagcggcaccg

SEQ ID NO: 1142428 - RNA, 20 nt, Mycobacterium bovis subsp bovis AF2122/97
ggccgguggaaaagccacgg

SEQ ID NO: 1142429 - RNA, 15 nt, Mycobacterium bovis subsp bovis AF2122/97
ggccggugggccgcc

SEQ ID NO: 1142430 - RNA, 16 nt, Mycobacterium bovis subsp bovis AF2122/97
ggccggugggccgccc

SEQ ID NO: 1142431 - RNA, 23 nt, Mycobacterium bovis subsp bovis AF2122/97
ggccgguucagguugagugucgg

SEQ ID NO: 1142432 - RNA, 21 nt, Mycobacterium bovis subsp bovis AF2122/97
ggccggugugcaggaucacgc

SEQ ID NO: 1142433 - RNA, 16 nt, Mycobacterium bovis subsp bovis AF2122/97
ggccgguucgcccgag

SEQ ID NO: 1142434 - RNA, 14 nt, Mycobacterium bovis subsp bovis AF2122/97
ggccguaccgguga

SEQ ID NO: 1142435 - RNA, 13 nt, Mycobacterium bovis subsp bovis AF2122/97
ggccguacucgau

SEQ ID NO: 1142436 - RNA, 16 nt, Mycobacterium bovis subsp bovis AF2122/97
ggccguagcccacgac

SEQ ID NO: 1142437 - RNA, 18 nt, Mycobacterium bovis subsp bovis AF2122/97
ggccguagcccacgacga

SEQ ID NO: 1142438 - RNA, 19 nt, Mycobacterium bovis subsp bovis AF2122/97
ggccguagcccacgacgaa

SEQ ID NO: 1142439 - RNA, 23 nt, Mycobacterium bovis subsp bovis AF2122/97
ggccguccgaccgauaacacccg

SEQ ID NO: 1142440 - RNA, 23 nt, Mycobacterium bovis subsp bovis AF2122/97
ggccgucgaacgguagcacgguc

SEQ ID NO: 1142441 - RNA, 23 nt, Mycobacterium bovis subsp bovis AF2122/97
ggccguccggcuuggcggcgauc

SEQ ID NO: 1142442 - RNA, 20 nt, Mycobacterium bovis subsp bovis AF2122/97
ggccgucgaucuucuccucg

SEQ ID NO: 1142443 - RNA, 23 nt, Mycobacterium bovis subsp bovis AF2122/97
ggccgucgacgcaugggucaugg

SEQ ID NO: 1142444 - RNA, 20 nt, Mycobacterium bovis subsp bovis AF2122/97
ggccgucgaucaagugcggu

SEQ ID NO: 1142445 - RNA, 14 nt, Mycobacterium bovis subsp bovis AF2122/97
ggccgucgacgauc

SEQ ID NO: 1142446 - RNA, 21 nt, Mycobacterium bovis subsp bovis AF2122/97
ggccgucgcgggacaacagca

SEQ ID NO: 1142447 - RNA, 15 nt, Mycobacterium bovis subsp bovis AF2122/97
ggccgucgcuggugu

SEQ ID NO: 1142448 - RNA, 24 nt, Mycobacterium bovis subsp bovis AF2122/97
ggccgucgggugcagcacggcgcc

SEQ ID NO: 1142449 - RNA, 12 nt, Mycobacterium bovis subsp bovis AF2122/97
ggccgucggcgu

SEQ ID NO: 1142450 - RNA, 17 nt, Mycobacterium bovis subsp bovis AF2122/97
ggccgucgggacggcca

SEQ ID NO: 1142451 - RNA, 18 nt, Mycobacterium bovis subsp bovis AF2122/97
ggccgucgggacggccaa

SEQ ID NO: 1142452 - RNA, 16 nt, Mycobacterium bovis subsp bovis AF2122/97
ggccgucgucggucac

SEQ ID NO: 1142453 - RNA, 19 nt, Mycobacterium bovis subsp bovis AF2122/97
ggccgucguugccggcgac

SEQ ID NO: 1142454 - RNA, 12 nt, Mycobacterium bovis subsp bovis AF2122/97
ggccgugccgcc

SEQ ID NO: 1142455 - RNA, 15 nt, Mycobacterium bovis subsp bovis AF2122/97
ggccgugccgccgac

SEQ ID NO: 1142456 - RNA, 19 nt, Mycobacterium bovis subsp bovis AF2122/97
ggccguggaaagccggcgu

SEQ ID NO: 1142457 - RNA, 14 nt, Mycobacterium bovis subsp bovis AF2122/97
ggccguggaugucg

SEQ ID NO: 1142458 - RNA, 15 nt, Mycobacterium bovis subsp bovis AF2122/97
ggccguggcacccgc

SEQ ID NO: 1142459 - RNA, 19 nt, Mycobacterium bovis subsp bovis AF2122/97
ggccguugcccgacucggc

SEQ ID NO: 1142460 - RNA, 23 nt, Mycobacterium bovis subsp bovis AF2122/97
ggccguugaggaacuccgcgauc

SEQ ID NO: 1142461 - RNA, 16 nt, Mycobacterium bovis subsp bovis AF2122/97
ggccguugacgguguc

SEQ ID NO: 1142462 - RNA, 17 nt, Mycobacterium bovis subsp bovis AF2122/97
ggccugcagcgaugacg

SEQ ID NO: 1142463 - RNA, 20 nt, Mycobacterium bovis subsp bovis AF2122/97
ggccugcacggcgcugacga

SEQ ID NO: 1142464 - RNA, 22 nt, Mycobacterium bovis subsp bovis AF2122/97
ggccugcccagcaccaccgcgg

SEQ ID NO: 1142465 - RNA, 20 nt, Mycobacterium bovis subsp bovis AF2122/97
ggccugcagcgaugacgacc

SEQ ID NO: 1142466 - RNA, 14 nt, Mycobacterium bovis subsp bovis AF2122/97
ggccugcagcgcga

SEQ ID NO: 1142467 - RNA, 15 nt, Mycobacterium bovis subsp bovis AF2122/97
ggccugcccggcgcc

SEQ ID NO: 1142468 - RNA, 21 nt, Mycobacterium bovis subsp bovis AF2122/97
ggccugcccccggcgcggcgg

SEQ ID NO: 1142469 - RNA, 14 nt, Mycobacterium bovis subsp bovis AF2122/97
ggccugccggcagc

SEQ ID NO: 1142470 - RNA, 19 nt, Mycobacterium bovis subsp bovis AF2122/97
ggccugcgagucgcgcuug

SEQ ID NO: 1142471 - RNA, 20 nt, Mycobacterium bovis subsp bovis AF2122/97
ggccugcgaacacgcgauga

SEQ ID NO: 1142472 - RNA, 14 nt, Mycobacterium bovis subsp bovis AF2122/97
ggccugccgcucgc

SEQ ID NO: 1142473 - RNA, 17 nt, Mycobacterium bovis subsp bovis AF2122/97
ggccugcgcgauccgcg

SEQ ID NO: 1142474 - RNA, 18 nt, Mycobacterium bovis subsp bovis AF2122/97
ggccugcgcgaccgacca

SEQ ID NO: 1142475 - RNA, 15 nt, Mycobacterium bovis subsp bovis AF2122/97
ggccugcgccggcgc

SEQ ID NO: 1142476 - RNA, 16 nt, Mycobacterium bovis subsp bovis AF2122/97
ggccugcgccggcgcu

SEQ ID NO: 1142477 - RNA, 20 nt, Mycobacterium bovis subsp bovis AF2122/97
ggccugcggcaacggcucgu

SEQ ID NO: 1142478 - RNA, 16 nt, Mycobacterium bovis subsp bovis AF2122/97
ggccugcggcaccggc

SEQ ID NO: 1142479 - RNA, 21 nt, Mycobacterium bovis subsp bovis AF2122/97
ggccugcggcaccggcucagg

SEQ ID NO: 1142480 - RNA, 22 nt, Mycobacterium bovis subsp bovis AF2122/97
ggccugcgcuucguccagcgau

SEQ ID NO: 1142481 - RNA, 13 nt, Mycobacterium bovis subsp bovis AF2122/97
ggccugcggcaac

SEQ ID NO: 1142482 - RNA, 21 nt, Mycobacterium bovis subsp bovis AF2122/97
ggccugcucggcgaguucggc

SEQ ID NO: 1142483 - RNA, 14 nt, Mycobacterium bovis subsp bovis AF2122/97
ggccugcggucagg

SEQ ID NO: 1142484 - RNA, 18 nt, Mycobacterium bovis subsp bovis AF2122/97
ggccugcagcgcgacccg

SEQ ID NO: 1142485 - RNA, 19 nt, Mycobacterium bovis subsp bovis AF2122/97
ggccugcuggucaccauca

SEQ ID NO: 1142486 - RNA, 19 nt, Mycobacterium bovis subsp bovis AF2122/97
ggccugcuaaccacggugu

SEQ ID NO: 1142487 - RNA, 22 nt, Mycobacterium bovis subsp bovis AF2122/97
ggccugcaccacggcggccacc

SEQ ID NO: 1142488 - RNA, 20 nt, Mycobacterium bovis subsp bovis AF2122/97
ggccugauuguugagccacg

SEQ ID NO: 1142489 - RNA, 17 nt, Mycobacterium bovis subsp bovis AF2122/97
ggccugcacgccggcgc

SEQ ID NO: 1142490 - RNA, 15 nt, Mycobacterium bovis subsp bovis AF2122/97
ggccugaugcagggc

SEQ ID NO: 1142491 - RNA, 19 nt, Mycobacterium bovis subsp bovis AF2122/97
ggccugauuccacugggcc

SEQ ID NO: 1142492 - RNA, 23 nt, Mycobacterium bovis subsp bovis AF2122/97
ggccuccucgucgcucccgguug

SEQ ID NO: 1142493 - RNA, 19 nt, Mycobacterium bovis subsp bovis AF2122/97
ggccugaccggcucgccgg

SEQ ID NO: 1142494 - RNA, 20 nt, Mycobacterium bovis subsp bovis AF2122/97
ggccugaccggcucgccggc

SEQ ID NO: 1142495 - RNA, 19 nt, Mycobacterium bovis subsp bovis AF2122/97
ggccuccuccccgaccgcc

SEQ ID NO: 1142496 - RNA, 18 nt, Mycobacterium bovis subsp bovis AF2122/97
ggccuccgcugccgcccg

SEQ ID NO: 1142497 - RNA, 22 nt, Mycobacterium bovis subsp bovis AF2122/97
ggccuccgcugccgcccgcgcc

SEQ ID NO: 1142498 - RNA, 14 nt, Mycobacterium bovis subsp bovis AF2122/97
ggccugagcggcca

SEQ ID NO: 1142499 - RNA, 18 nt, Mycobacterium bovis subsp bovis AF2122/97
ggccugagcgugucuggc

SEQ ID NO: 1142500 - RNA, 17 nt, Mycobacterium bovis subsp bovis AF2122/97
ggccucccacucaccca

SEQ ID NO: 1142501 - RNA, 15 nt, Mycobacterium bovis subsp bovis AF2122/97
ggccucccgggccgc

SEQ ID NO: 1142502 - RNA, 16 nt, Mycobacterium bovis subsp bovis AF2122/97
ggccuccgcugccgcc

SEQ ID NO: 1142503 - RNA, 18 nt, Mycobacterium bovis subsp bovis AF2122/97
ggccuccacccgccacgg

SEQ ID NO: 1142504 - RNA, 17 nt, Mycobacterium bovis subsp bovis AF2122/97
ggccucauccaccgaug

SEQ ID NO: 1142505 - RNA, 21 nt, Mycobacterium bovis subsp bovis AF2122/97
ggccucauccaccgauggcgc

SEQ ID NO: 1142506 - RNA, 23 nt, Mycobacterium bovis subsp bovis AF2122/97
ggccucaugcuaggccaccggcg

SEQ ID NO: 1142507 - RNA, 18 nt, Mycobacterium bovis subsp bovis AF2122/97
ggccguuggcggcggugg

SEQ ID NO: 1142508 - RNA, 18 nt, Mycobacterium bovis subsp bovis AF2122/97
ggccguugggccaccggc

SEQ ID NO: 1142509 - RNA, 19 nt, Mycobacterium bovis subsp bovis AF2122/97
ggccguugggccaccggcg

SEQ ID NO: 1142510 - RNA, 22 nt, Mycobacterium bovis subsp bovis AF2122/97
ggccgaguaccagcccaccggc

SEQ ID NO: 1142511 - RNA, 17 nt, Mycobacterium bovis subsp bovis AF2122/97
ggccgagucgauugcca

SEQ ID NO: 1142512 - RNA, 16 nt, Mycobacterium bovis subsp bovis AF2122/97
ggccgaguucgucagc

SEQ ID NO: 1142513 - RNA, 16 nt, Mycobacterium bovis subsp bovis AF2122/97
ggccgaucccaccggc

SEQ ID NO: 1142514 - RNA, 19 nt, Mycobacterium bovis subsp bovis AF2122/97
ggccgaucagcgcggcgcc

SEQ ID NO: 1142515 - RNA, 21 nt, Mycobacterium bovis subsp bovis AF2122/97
ggccgaucagcgcggcgcccu

SEQ ID NO: 1142516 - RNA, 17 nt, Mycobacterium bovis subsp bovis AF2122/97
ggccgaucagcguggcg

SEQ ID NO: 1142517 - RNA, 11 nt, Mycobacterium bovis subsp bovis AF2122/97
ggccgauggcg

SEQ ID NO: 1142518 - RNA, 12 nt, Mycobacterium bovis subsp bovis AF2122/97
ggccgauggcgu

SEQ ID NO: 1142519 - RNA, 20 nt, Mycobacterium bovis subsp bovis AF2122/97
ggccgaugcgcagugcaccg

SEQ ID NO: 1142520 - RNA, 21 nt, Mycobacterium bovis subsp bovis AF2122/97
ggccgaugcgcagugcaccgc

SEQ ID NO: 1142521 - RNA, 21 nt, Mycobacterium bovis subsp bovis AF2122/97
ggccgaugacgaugccgccga

SEQ ID NO: 1142522 - RNA, 15 nt, Mycobacterium bovis subsp bovis AF2122/97
ggccgaugagcccag

SEQ ID NO: 1142523 - RNA, 23 nt, Mycobacterium bovis subsp bovis AF2122/97
ggccgaugagcccagccgcgggc

SEQ ID NO: 1142524 - RNA, 18 nt, Mycobacterium bovis subsp bovis AF2122/97
ggccgaucucuccggcgg

SEQ ID NO: 1142525 - RNA, 15 nt, Mycobacterium bovis subsp bovis AF2122/97
ggccgacgcagguga

SEQ ID NO: 1142526 - RNA, 21 nt, Mycobacterium bovis subsp bovis AF2122/97
ggccgacgcaggugaacgccg

SEQ ID NO: 1142527 - RNA, 22 nt, Mycobacterium bovis subsp bovis AF2122/97
ggccgacgcugcugauggugac

SEQ ID NO: 1142528 - RNA, 14 nt, Mycobacterium bovis subsp bovis AF2122/97
ggccgacucgaggu

SEQ ID NO: 1142529 - RNA, 19 nt, Mycobacterium bovis subsp bovis AF2122/97
ggccgacgucgaccacugc

SEQ ID NO: 1142530 - RNA, 17 nt, Mycobacterium bovis subsp bovis AF2122/97
ggccgacgugacaacug

SEQ ID NO: 1142531 - RNA, 14 nt, Mycobacterium bovis subsp bovis AF2122/97
ggccgacgugacca

SEQ ID NO: 1142532 - RNA, 16 nt, Mycobacterium bovis subsp bovis AF2122/97
ggccgacgugaccagc

SEQ ID NO: 1142533 - RNA, 16 nt, Mycobacterium bovis subsp bovis AF2122/97
ggccgacgggacaacc

SEQ ID NO: 1142534 - RNA, 17 nt, Mycobacterium bovis subsp bovis AF2122/97
ggccgaccucguucguc

SEQ ID NO: 1142535 - RNA, 18 nt, Mycobacterium bovis subsp bovis AF2122/97
ggccgacgucgaccacug

SEQ ID NO: 1142536 - RNA, 20 nt, Mycobacterium bovis subsp bovis AF2122/97
ggccgagcagggccggcacc

SEQ ID NO: 1142537 - RNA, 22 nt, Mycobacterium bovis subsp bovis AF2122/97
ggccgagcagggccggcaccgc

SEQ ID NO: 1142538 - RNA, 16 nt, Mycobacterium bovis subsp bovis AF2122/97
ggccgacuuggugacc

SEQ ID NO: 1142539 - RNA, 16 nt, Mycobacterium bovis subsp bovis AF2122/97
ggccgacugggcgcga

SEQ ID NO: 1142540 - RNA, 18 nt, Mycobacterium bovis subsp bovis AF2122/97
ggccgaggaccagaggcg

SEQ ID NO: 1142541 - RNA, 13 nt, Mycobacterium bovis subsp bovis AF2122/97
ggccgaggccgcu

SEQ ID NO: 1142542 - RNA, 22 nt, Mycobacterium bovis subsp bovis AF2122/97
ggccgagcgcaccacggcgguc

SEQ ID NO: 1142543 - RNA, 13 nt, Mycobacterium bovis subsp bovis AF2122/97
ggccgagccgcgg

SEQ ID NO: 1142544 - RNA, 16 nt, Mycobacterium bovis subsp bovis AF2122/97
ggccgagccgcgguca

SEQ ID NO: 1142545 - RNA, 18 nt, Mycobacterium bovis subsp bovis AF2122/97
ggccgagccgcggucacc

SEQ ID NO: 1142546 - RNA, 13 nt, Mycobacterium bovis subsp bovis AF2122/97
ggccgacagccac

SEQ ID NO: 1142547 - RNA, 20 nt, Mycobacterium bovis subsp bovis AF2122/97
ggccgaccagcacaccgguu

SEQ ID NO: 1142548 - RNA, 20 nt, Mycobacterium bovis subsp bovis AF2122/97
ggccgaccuguaugccgcgg

SEQ ID NO: 1142549 - RNA, 14 nt, Mycobacterium bovis subsp bovis AF2122/97
ggccgacgauagcg

SEQ ID NO: 1142550 - RNA, 21 nt, Mycobacterium bovis subsp bovis AF2122/97
ggccgacgaaagguugccgau

SEQ ID NO: 1142551 - RNA, 14 nt, Mycobacterium bovis subsp bovis AF2122/97
ggccgacgagaucg

SEQ ID NO: 1142552 - RNA, 11 nt, Mycobacterium bovis subsp bovis AF2122/97
ggccgaccgcg

SEQ ID NO: 1142553 - RNA, 21 nt, Mycobacterium bovis subsp bovis AF2122/97
ggccgaccgcgacccggccca

SEQ ID NO: 1142554 - RNA, 21 nt, Mycobacterium bovis subsp bovis AF2122/97
ggccgaacgggucggcgacca

SEQ ID NO: 1142555 - RNA, 19 nt, Mycobacterium bovis subsp bovis AF2122/97
ggccgaacguggcucggcg

SEQ ID NO: 1142556 - RNA, 22 nt, Mycobacterium bovis subsp bovis AF2122/97
ggccgaacguggcucggcgggu

SEQ ID NO: 1142557 - RNA, 18 nt, Mycobacterium bovis subsp bovis AF2122/97
ggccgaacuaccgacgca

SEQ ID NO: 1142558 - RNA, 19 nt, Mycobacterium bovis subsp bovis AF2122/97
ggccgaacuaccgacgcac

SEQ ID NO: 1142559 - RNA, 15 nt, Mycobacterium bovis subsp bovis AF2122/97
ggccgaacgccucgc

SEQ ID NO: 1142560 - RNA, 13 nt, Mycobacterium bovis subsp bovis AF2122/97
ggccgaacggguc

SEQ ID NO: 1142561 - RNA, 16 nt, Mycobacterium bovis subsp bovis AF2122/97
ggccgaaccguucggc

SEQ ID NO: 1142562 - RNA, 18 nt, Mycobacterium bovis subsp bovis AF2122/97
ggccgaaccguucggcga

SEQ ID NO: 1142563 - RNA, 14 nt, Mycobacterium bovis subsp bovis AF2122/97
ggccgaagccccga

SEQ ID NO: 1142564 - RNA, 18 nt, Mycobacterium bovis subsp bovis AF2122/97
ggccgaagcccgaucggc

SEQ ID NO: 1142565 - RNA, 18 nt, Mycobacterium bovis subsp bovis AF2122/97
ggccgaauccguccgacg

SEQ ID NO: 1142566 - RNA, 23 nt, Mycobacterium bovis subsp bovis AF2122/97
ggccgaauaccacaccgugacca

SEQ ID NO: 1142567 - RNA, 18 nt, Mycobacterium bovis subsp bovis AF2122/97
ggccgaacgggucggcga

SEQ ID NO: 1142568 - RNA, 20 nt, Mycobacterium bovis subsp bovis AF2122/97
ggccgacaaugucggcgaug

SEQ ID NO: 1142569 - RNA, 22 nt, Mycobacterium bovis subsp bovis AF2122/97
ggccgacaaugucggcgaugcg

SEQ ID NO: 1142570 - RNA, 11 nt, Mycobacterium bovis subsp bovis AF2122/97
ggccgacaccg

SEQ ID NO: 1142571 - RNA, 14 nt, Mycobacterium bovis subsp bovis AF2122/97
ggccgacaacccgg

SEQ ID NO: 1142572 - RNA, 19 nt, Mycobacterium bovis subsp bovis AF2122/97
ggccgaaucuccgccguga

SEQ ID NO: 1142573 - RNA, 20 nt, Mycobacterium bovis subsp bovis AF2122/97
ggcccucgaauucggccggc

SEQ ID NO: 1142574 - RNA, 15 nt, Mycobacterium bovis subsp bovis AF2122/97
ggcccuccucgguga

SEQ ID NO: 1142575 - RNA, 19 nt, Mycobacterium bovis subsp bovis AF2122/97
ggcccucgagcagugccgu

SEQ ID NO: 1142576 - RNA, 23 nt, Mycobacterium bovis subsp bovis AF2122/97
ggcccuccggcgcagcgaccggu

SEQ ID NO: 1142577 - RNA, 20 nt, Mycobacterium bovis subsp bovis AF2122/97
ggcccucgagcagugccgug

SEQ ID NO: 1142578 - RNA, 14 nt, Mycobacterium bovis subsp bovis AF2122/97
ggcccucggcgauc

SEQ ID NO: 1142579 - RNA, 20 nt, Mycobacterium bovis subsp bovis AF2122/97
ggcccugcacagcagcguca

SEQ ID NO: 1142580 - RNA, 12 nt, Mycobacterium bovis subsp bovis AF2122/97
ggcccugccgac

SEQ ID NO: 1142581 - RNA, 15 nt, Mycobacterium bovis subsp bovis AF2122/97
ggcccugccgccggc

SEQ ID NO: 1142582 - RNA, 12 nt, Mycobacterium bovis subsp bovis AF2122/97
ggcccugcuccu

SEQ ID NO: 1142583 - RNA, 21 nt, Mycobacterium bovis subsp bovis AF2122/97
ggcccuggccagcccgagcuc

SEQ ID NO: 1142584 - RNA, 13 nt, Mycobacterium bovis subsp bovis AF2122/97
ggcccuggccgcg

SEQ ID NO: 1142585 - RNA, 15 nt, Mycobacterium bovis subsp bovis AF2122/97
ggcccuggccgcgcc

SEQ ID NO: 1142586 - RNA, 18 nt, Mycobacterium bovis subsp bovis AF2122/97
ggcccuggccgcgccggg

SEQ ID NO: 1142587 - RNA, 12 nt, Mycobacterium bovis subsp bovis AF2122/97
ggccgaacagca

SEQ ID NO: 1142588 - RNA, 13 nt, Mycobacterium bovis subsp bovis AF2122/97
ggccgaaauccag

SEQ ID NO: 1142589 - RNA, 23 nt, Mycobacterium bovis subsp bovis AF2122/97
ggccgaaaacgacaucaccaccg

SEQ ID NO: 1142590 - RNA, 22 nt, Mycobacterium bovis subsp bovis AF2122/97
ggccgaacagcugcccgccagc

SEQ ID NO: 1142591 - RNA, 16 nt, Mycobacterium bovis subsp bovis AF2122/97
ggccgaacacaccggg

SEQ ID NO: 1142592 - RNA, 22 nt, Mycobacterium bovis subsp bovis AF2122/97
ggccgaaacuucgcccgggccg

SEQ ID NO: 1142593 - RNA, 19 nt, Mycobacterium bovis subsp bovis AF2122/97
ggcccuuguggaguacggc

SEQ ID NO: 1142594 - RNA, 23 nt, Mycobacterium bovis subsp bovis AF2122/97
ggcccuuguggaguacggcgaug

SEQ ID NO: 1142595 - RNA, 20 nt, Mycobacterium bovis subsp bovis AF2122/97
ggcccuggccagcccgagcu

SEQ ID NO: 1142596 - RNA, 14 nt, Mycobacterium bovis subsp bovis AF2122/97
ggcccuggcggccc

SEQ ID NO: 1142597 - RNA, 15 nt, Mycobacterium bovis subsp bovis AF2122/97
ggcccuggcggcccg

SEQ ID NO: 1142598 - RNA, 21 nt, Mycobacterium bovis subsp bovis AF2122/97
ggcccuucaguucgacggugc

SEQ ID NO: 1142599 - RNA, 13 nt, Mycobacterium bovis subsp bovis AF2122/97
ggcccuguucggc

SEQ ID NO: 1142600 - RNA, 23 nt, Mycobacterium bovis subsp bovis AF2122/97
ggccaggcuauggugccggugau

SEQ ID NO: 1142601 - RNA, 19 nt, Mycobacterium bovis subsp bovis AF2122/97
ggcccaucuucggacgcca

SEQ ID NO: 1142602 - RNA, 17 nt, Mycobacterium bovis subsp bovis AF2122/97
ggcccaucgcccggugc

SEQ ID NO: 1142603 - RNA, 16 nt, Mycobacterium bovis subsp bovis AF2122/97
ggccaggcugcgcagu

SEQ ID NO: 1142604 - RNA, 18 nt, Mycobacterium bovis subsp bovis AF2122/97
ggccccaccggcaccccc

SEQ ID NO: 1142605 - RNA, 22 nt, Mycobacterium bovis subsp bovis AF2122/97
ggccccaccgacagccccauca

SEQ ID NO: 1142606 - RNA, 21 nt, Mycobacterium bovis subsp bovis AF2122/97
ggccccaagcgugcugccgcc

SEQ ID NO: 1142607 - RNA, 16 nt, Mycobacterium bovis subsp bovis AF2122/97
ggcccaugcagcggcg

SEQ ID NO: 1142608 - RNA, 21 nt, Mycobacterium bovis subsp bovis AF2122/97
ggccccacuggugcagcgccg

SEQ ID NO: 1142609 - RNA, 13 nt, Mycobacterium bovis subsp bovis AF2122/97
ggccccaccggug

SEQ ID NO: 1142610 - RNA, 14 nt, Mycobacterium bovis subsp bovis AF2122/97
ggccccaccggugc

SEQ ID NO: 1142611 - RNA, 16 nt, Mycobacterium bovis subsp bovis AF2122/97
ggccccaccggugccg

SEQ ID NO: 1142612 - RNA, 22 nt, Mycobacterium bovis subsp bovis AF2122/97
ggccagcgguaaugccagcggc

SEQ ID NO: 1142613 - RNA, 14 nt, Mycobacterium bovis subsp bovis AF2122/97
ggccaggcccaagc

SEQ ID NO: 1142614 - RNA, 11 nt, Mycobacterium bovis subsp bovis AF2122/97
ggccaggccgu

SEQ ID NO: 1142615 - RNA, 15 nt, Mycobacterium bovis subsp bovis AF2122/97
ggccaggccggcggc

SEQ ID NO: 1142616 - RNA, 17 nt, Mycobacterium bovis subsp bovis AF2122/97
ggccaggcccucgacgg

SEQ ID NO: 1142617 - RNA, 19 nt, Mycobacterium bovis subsp bovis AF2122/97
ggccaggcccucgacggcg

SEQ ID NO: 1142618 - RNA, 21 nt, Mycobacterium bovis subsp bovis AF2122/97
ggccaggccgaugccgaccuu

SEQ ID NO: 1142619 - RNA, 16 nt, Mycobacterium bovis subsp bovis AF2122/97
ggccccccggggccgc

SEQ ID NO: 1142620 - RNA, 12 nt, Mycobacterium bovis subsp bovis AF2122/97
ggcccccgacgg

SEQ ID NO: 1142621 - RNA, 15 nt, Mycobacterium bovis subsp bovis AF2122/97
ggcccccgacuccgg

SEQ ID NO: 1142622 - RNA, 15 nt, Mycobacterium bovis subsp bovis AF2122/97
ggcccccaguucggc

SEQ ID NO: 1142623 - RNA, 18 nt, Mycobacterium bovis subsp bovis AF2122/97
ggcccccaguucggcguc

SEQ ID NO: 1142624 - RNA, 16 nt, Mycobacterium bovis subsp bovis AF2122/97
ggccccaggggcacca

SEQ ID NO: 1142625 - RNA, 13 nt, Mycobacterium bovis subsp bovis AF2122/97
ggccccaugcgcc

SEQ ID NO: 1142626 - RNA, 14 nt, Mycobacterium bovis subsp bovis AF2122/97
ggcccccucggcgu

SEQ ID NO: 1142627 - RNA, 12 nt, Mycobacterium bovis subsp bovis AF2122/97
ggccccccgcgc

SEQ ID NO: 1142628 - RNA, 19 nt, Mycobacterium bovis subsp bovis AF2122/97
ggccccgaaacgauggccg

SEQ ID NO: 1142629 - RNA, 18 nt, Mycobacterium bovis subsp bovis AF2122/97
ggccccgacacagcggcg

SEQ ID NO: 1142630 - RNA, 19 nt, Mycobacterium bovis subsp bovis AF2122/97
ggccccgacacagcggcgg

SEQ ID NO: 1142631 - RNA, 21 nt, Mycobacterium bovis subsp bovis AF2122/97
ggccccgacggucaacgacau

SEQ ID NO: 1142632 - RNA, 14 nt, Mycobacterium bovis subsp bovis AF2122/97
ggccccgacugccg

SEQ ID NO: 1142633 - RNA, 12 nt, Mycobacterium bovis subsp bovis AF2122/97
ggccccgccgau

SEQ ID NO: 1142634 - RNA, 15 nt, Mycobacterium bovis subsp bovis AF2122/97
ggccccgccgaugcc

SEQ ID NO: 1142635 - RNA, 16 nt, Mycobacterium bovis subsp bovis AF2122/97
ggccccgccgauggag

SEQ ID NO: 1142636 - RNA, 16 nt, Mycobacterium bovis subsp bovis AF2122/97
ggccccgccagcgccg

SEQ ID NO: 1142637 - RNA, 16 nt, Mycobacterium bovis subsp bovis AF2122/97
ggccccgccagcggca

SEQ ID NO: 1142638 - RNA, 19 nt, Mycobacterium bovis subsp bovis AF2122/97
ggccccgcccgcgcggugg

SEQ ID NO: 1142639 - RNA, 22 nt, Mycobacterium bovis subsp bovis AF2122/97
ggcccgacggguaucccguccc

SEQ ID NO: 1142640 - RNA, 17 nt, Mycobacterium bovis subsp bovis AF2122/97
ggcccgacgacgacguu

SEQ ID NO: 1142641 - RNA, 12 nt, Mycobacterium bovis subsp bovis AF2122/97
ggccccgcgcca

SEQ ID NO: 1142642 - RNA, 18 nt, Mycobacterium bovis subsp bovis AF2122/97
ggccccgaaacgauggcc

SEQ ID NO: 1142643 - RNA, 16 nt, Mycobacterium bovis subsp bovis AF2122/97
ggcccgacccggccga

SEQ ID NO: 1142644 - RNA, 15 nt, Mycobacterium bovis subsp bovis AF2122/97
ggccccgccgucacc

SEQ ID NO: 1142645 - RNA, 22 nt, Mycobacterium bovis subsp bovis AF2122/97
ggccccgccgucacccccgaua

SEQ ID NO: 1142646 - RNA, 23 nt, Mycobacterium bovis subsp bovis AF2122/97
ggccccgccgucgccgccggcuc

SEQ ID NO: 1142647 - RNA, 20 nt, Mycobacterium bovis subsp bovis AF2122/97
ggccccgccguugccgccga

SEQ ID NO: 1142648 - RNA, 21 nt, Mycobacterium bovis subsp bovis AF2122/97
ggccccgccguugccgccgac

SEQ ID NO: 1142649 - RNA, 21 nt, Mycobacterium bovis subsp bovis AF2122/97
ggccccgccguuuccgccgcc

SEQ ID NO: 1142650 - RNA, 17 nt, Mycobacterium bovis subsp bovis AF2122/97
ggccccgccgccggugc

SEQ ID NO: 1142651 - RNA, 12 nt, Mycobacterium bovis subsp bovis AF2122/97
ggccccgccggc

SEQ ID NO: 1142652 - RNA, 15 nt, Mycobacterium bovis subsp bovis AF2122/97
ggccccgccggcgcc

SEQ ID NO: 1142653 - RNA, 21 nt, Mycobacterium bovis subsp bovis AF2122/97
ggccccgccggcgccgcccaa

SEQ ID NO: 1142654 - RNA, 17 nt, Mycobacterium bovis subsp bovis AF2122/97
ggcccgaguuaccggug

SEQ ID NO: 1142655 - RNA, 18 nt, Mycobacterium bovis subsp bovis AF2122/97
ggcccgaguuaccgguga

SEQ ID NO: 1142656 - RNA, 21 nt, Mycobacterium bovis subsp bovis AF2122/97
ggcccgaguuggcgaagcccg

SEQ ID NO: 1142657 - RNA, 17 nt, Mycobacterium bovis subsp bovis AF2122/97
ggcccgaggcggguaca

SEQ ID NO: 1142658 - RNA, 22 nt, Mycobacterium bovis subsp bovis AF2122/97
ggcccgaggugccggggcccca

SEQ ID NO: 1142659 - RNA, 16 nt, Mycobacterium bovis subsp bovis AF2122/97
ggcccgaucaccagcc

SEQ ID NO: 1142660 - RNA, 16 nt, Mycobacterium bovis subsp bovis AF2122/97
ggcccgaucaccaucc

SEQ ID NO: 1142661 - RNA, 21 nt, Mycobacterium bovis subsp bovis AF2122/97
ggcccgaucggcaacccgcac

SEQ ID NO: 1142662 - RNA, 20 nt, Mycobacterium bovis subsp bovis AF2122/97
ggcccgaggcucgggccgca

SEQ ID NO: 1142663 - RNA, 22 nt, Mycobacterium bovis subsp bovis AF2122/97
ggcccgaugccgaggaucgcgc

SEQ ID NO: 1142664 - RNA, 21 nt, Mycobacterium bovis subsp bovis AF2122/97
ggcccgcaccgcugaccccgg

SEQ ID NO: 1142665 - RNA, 16 nt, Mycobacterium bovis subsp bovis AF2122/97
ggcccgaugucgucga

SEQ ID NO: 1142666 - RNA, 20 nt, Mycobacterium bovis subsp bovis AF2122/97
ggcccgcaugccggcgcacc

SEQ ID NO: 1142667 - RNA, 22 nt, Mycobacterium bovis subsp bovis AF2122/97
ggcccgcauccgcaccgaaacc

SEQ ID NO: 1142668 - RNA, 20 nt, Mycobacterium bovis subsp bovis AF2122/97
ggcccgccagcccagcacgc

SEQ ID NO: 1142669 - RNA, 13 nt, Mycobacterium bovis subsp bovis AF2122/97
ggcccggcaccgc

SEQ ID NO: 1142670 - RNA, 15 nt, Mycobacterium bovis subsp bovis AF2122/97
ggcccggccggacgg

SEQ ID NO: 1142671 - RNA, 17 nt, Mycobacterium bovis subsp bovis AF2122/97
ggcccggcgcggccgca

SEQ ID NO: 1142672 - RNA, 23 nt, Mycobacterium bovis subsp bovis AF2122/97
ggcccggcgaacaggcgaccggg

SEQ ID NO: 1142673 - RNA, 13 nt, Mycobacterium bovis subsp bovis AF2122/97
ggcccggcucggu

SEQ ID NO: 1142674 - RNA, 18 nt, Mycobacterium bovis subsp bovis AF2122/97
ggcccggcuacgacggcg

SEQ ID NO: 1142675 - RNA, 14 nt, Mycobacterium bovis subsp bovis AF2122/97
ggcccggcucacag

SEQ ID NO: 1142676 - RNA, 14 nt, Mycobacterium bovis subsp bovis AF2122/97
ggcccgggccaccg

SEQ ID NO: 1142677 - RNA, 15 nt, Mycobacterium bovis subsp bovis AF2122/97
ggcccgggcccgcgg

SEQ ID NO: 1142678 - RNA, 16 nt, Mycobacterium bovis subsp bovis AF2122/97
ggcccgggcucggcga

SEQ ID NO: 1142679 - RNA, 18 nt, Mycobacterium bovis subsp bovis AF2122/97
ggcccgggucuccggcgc

SEQ ID NO: 1142680 - RNA, 21 nt, Mycobacterium bovis subsp bovis AF2122/97
ggcccgggucuccggcgcacc

SEQ ID NO: 1142681 - RNA, 12 nt, Mycobacterium bovis subsp bovis AF2122/97
ggcccgggugac

SEQ ID NO: 1142682 - RNA, 24 nt, Mycobacterium bovis subsp bovis AF2122/97
ggcccggucuacgccaccgagauc

SEQ ID NO: 1142683 - RNA, 16 nt, Mycobacterium bovis subsp bovis AF2122/97
ggcccgucggcgugcg

SEQ ID NO: 1142684 - RNA, 19 nt, Mycobacterium bovis subsp bovis AF2122/97
ggcccgucgcgucgaccgg

SEQ ID NO: 1142685 - RNA, 20 nt, Mycobacterium bovis subsp bovis AF2122/97
ggcccgucgcgucgaccgga

SEQ ID NO: 1142686 - RNA, 17 nt, Mycobacterium bovis subsp bovis AF2122/97
ggcccgucgugaccgac

SEQ ID NO: 1142687 - RNA, 22 nt, Mycobacterium bovis subsp bovis AF2122/97
ggcccgugccacagcucgccgu

SEQ ID NO: 1142688 - RNA, 22 nt, Mycobacterium bovis subsp bovis AF2122/97
ggcccuccacugcgagcgccgg

SEQ ID NO: 1142689 - RNA, 18 nt, Mycobacterium bovis subsp bovis AF2122/97
ggcccuacgcagcgcggc

SEQ ID NO: 1142690 - RNA, 17 nt, Mycobacterium bovis subsp bovis AF2122/97
ggcccuagccggcgcgc

SEQ ID NO: 1142691 - RNA, 21 nt, Mycobacterium bovis subsp bovis AF2122/97
ggcccguagcugcgcagcgca

SEQ ID NO: 1142692 - RNA, 12 nt, Mycobacterium bovis subsp bovis AF2122/97
ggcccgucgcgu

SEQ ID NO: 1142693 - RNA, 17 nt, Mycobacterium bovis subsp bovis AF2122/97
ggcccgguccgccauug

SEQ ID NO: 1142694 - RNA, 15 nt, Mycobacterium bovis subsp bovis AF2122/97
ggcccgggaacccgc

SEQ ID NO: 1142695 - RNA, 22 nt, Mycobacterium bovis subsp bovis AF2122/97
ggcccggucuugggcgcgggug

SEQ ID NO: 1142696 - RNA, 19 nt, Mycobacterium bovis subsp bovis AF2122/97
ggcccguagcguccgcgcc

SEQ ID NO: 1142697 - RNA, 21 nt, Mycobacterium bovis subsp bovis AF2122/97
ggcccgguguguauucgccga

SEQ ID NO: 1142698 - RNA, 23 nt, Mycobacterium bovis subsp bovis AF2122/97
ggcccgguguguauucgccgacg

SEQ ID NO: 1142699 - RNA, 13 nt, Mycobacterium bovis subsp bovis AF2122/97
ggcccgcgggauc

SEQ ID NO: 1142700 - RNA, 16 nt, Mycobacterium bovis subsp bovis AF2122/97
ggcccgcgggcaagcc

SEQ ID NO: 1142701 - RNA, 12 nt, Mycobacterium bovis subsp bovis AF2122/97
ggcccgcgguga

SEQ ID NO: 1142702 - RNA, 21 nt, Mycobacterium bovis subsp bovis AF2122/97
ggcccgcggugacgcaacauc

SEQ ID NO: 1142703 - RNA, 12 nt, Mycobacterium bovis subsp bovis AF2122/97
ggcccgcggugg

SEQ ID NO: 1142704 - RNA, 19 nt, Mycobacterium bovis subsp bovis AF2122/97
ggcccgcuccacggucagg

SEQ ID NO: 1142705 - RNA, 19 nt, Mycobacterium bovis subsp bovis AF2122/97
ggcccgcucgaucggcagc

SEQ ID NO: 1142706 - RNA, 22 nt, Mycobacterium bovis subsp bovis AF2122/97
ggcccgcugggcuuggggccgg

SEQ ID NO: 1142707 - RNA, 14 nt, Mycobacterium bovis subsp bovis AF2122/97
ggcccgcucggggu

SEQ ID NO: 1142708 - RNA, 12 nt, Mycobacterium bovis subsp bovis AF2122/97
ggcccgcucggg

SEQ ID NO: 1142709 - RNA, 20 nt, Mycobacterium bovis subsp bovis AF2122/97
ggcccgcucgaucggcagcc

SEQ ID NO: 1142710 - RNA, 23 nt, Mycobacterium bovis subsp bovis AF2122/97
ggcccggacgucggcggccguca

SEQ ID NO: 1142711 - RNA, 14 nt, Mycobacterium bovis subsp bovis AF2122/97
ggcccgccgucacc

SEQ ID NO: 1142712 - RNA, 17 nt, Mycobacterium bovis subsp bovis AF2122/97
ggcccgcgagauagcac

SEQ ID NO: 1142713 - RNA, 22 nt, Mycobacterium bovis subsp bovis AF2122/97
ggcccgcgcguacccgaucagc

SEQ ID NO: 1142714 - RNA, 19 nt, Mycobacterium bovis subsp bovis AF2122/97
ggccaacugggccgagcgc

SEQ ID NO: 1142715 - RNA, 21 nt, Mycobacterium bovis subsp bovis AF2122/97
ggccaacugggccgagcgcgc

SEQ ID NO: 1142716 - RNA, 15 nt, Mycobacterium bovis subsp bovis AF2122/97
ggccaacucggcgau

SEQ ID NO: 1142717 - RNA, 12 nt, Mycobacterium bovis subsp bovis AF2122/97
ggccaacggcgc

SEQ ID NO: 1142718 - RNA, 21 nt, Mycobacterium bovis subsp bovis AF2122/97
ggccaacggcuccgggcgcuc

SEQ ID NO: 1142719 - RNA, 15 nt, Mycobacterium bovis subsp bovis AF2122/97
ggccaaggucgaccc

SEQ ID NO: 1142720 - RNA, 20 nt, Mycobacterium bovis subsp bovis AF2122/97
ggccaacuucugcacgaacg

SEQ ID NO: 1142721 - RNA, 13 nt, Mycobacterium bovis subsp bovis AF2122/97
ggccaagauggcg

SEQ ID NO: 1142722 - RNA, 20 nt, Mycobacterium bovis subsp bovis AF2122/97
ggccaacccugcggcgucgu

SEQ ID NO: 1142723 - RNA, 15 nt, Mycobacterium bovis subsp bovis AF2122/97
ggccaaacgccauca

SEQ ID NO: 1142724 - RNA, 19 nt, Mycobacterium bovis subsp bovis AF2122/97
ggccaacccauuucgucag

SEQ ID NO: 1142725 - RNA, 18 nt, Mycobacterium bovis subsp bovis AF2122/97
ggccaacccgggccgcca

SEQ ID NO: 1142726 - RNA, 16 nt, Mycobacterium bovis subsp bovis AF2122/97
ggccaaccggucgucu

SEQ ID NO: 1142727 - RNA, 16 nt, Mycobacterium bovis subsp bovis AF2122/97
ggccaacgaacgugcc

SEQ ID NO: 1142728 - RNA, 18 nt, Mycobacterium bovis subsp bovis AF2122/97
ggccaacgaacgugcccc

SEQ ID NO: 1142729 - RNA, 15 nt, Mycobacterium bovis subsp bovis AF2122/97
ggccaacgacggccg

SEQ ID NO: 1142730 - RNA, 18 nt, Mycobacterium bovis subsp bovis AF2122/97
ggccaacgacggccgaca

SEQ ID NO: 1142731 - RNA, 17 nt, Mycobacterium bovis subsp bovis AF2122/97
ggccaaguugcagcggg

SEQ ID NO: 1142732 - RNA, 14 nt, Mycobacterium bovis subsp bovis AF2122/97
ggccaagcgccaac

SEQ ID NO: 1142733 - RNA, 18 nt, Mycobacterium bovis subsp bovis AF2122/97
ggccaauccggcggcgac

SEQ ID NO: 1142734 - RNA, 17 nt, Mycobacterium bovis subsp bovis AF2122/97
ggccacacucagcaccc

SEQ ID NO: 1142735 - RNA, 22 nt, Mycobacterium bovis subsp bovis AF2122/97
ggccacacucagcacccaauac

SEQ ID NO: 1142736 - RNA, 14 nt, Mycobacterium bovis subsp bovis AF2122/97
ggccacaaccucgu

SEQ ID NO: 1142737 - RNA, 15 nt, Mycobacterium bovis subsp bovis AF2122/97
ggccaauggccugca

SEQ ID NO: 1142738 - RNA, 18 nt, Mycobacterium bovis subsp bovis AF2122/97
ggccaaugccguugaucg

SEQ ID NO: 1142739 - RNA, 21 nt, Mycobacterium bovis subsp bovis AF2122/97
ggccaauccggcggcgacgug

SEQ ID NO: 1142740 - RNA, 13 nt, Mycobacterium bovis subsp bovis AF2122/97
ggccaccaucgcc

SEQ ID NO: 1142741 - RNA, 15 nt, Mycobacterium bovis subsp bovis AF2122/97
ggccaccaucgcccc

SEQ ID NO: 1142742 - RNA, 14 nt, Mycobacterium bovis subsp bovis AF2122/97
ggccaccaucgccg

SEQ ID NO: 1142743 - RNA, 18 nt, Mycobacterium bovis subsp bovis AF2122/97
ggccacaucgccagcagc

SEQ ID NO: 1142744 - RNA, 19 nt, Mycobacterium bovis subsp bovis AF2122/97
ggccaccaucgccgccguu

SEQ ID NO: 1142745 - RNA, 13 nt, Mycobacterium bovis subsp bovis AF2122/97
ggccacagcccgg

SEQ ID NO: 1142746 - RNA, 12 nt, Mycobacterium bovis subsp bovis AF2122/97
ggccacagugca

SEQ ID NO: 1142747 - RNA, 16 nt, Mycobacterium bovis subsp bovis AF2122/97
ggccaccaggugccgu

SEQ ID NO: 1142748 - RNA, 14 nt, Mycobacterium bovis subsp bovis AF2122/97
ggccacauaccacc

SEQ ID NO: 1142749 - RNA, 17 nt, Mycobacterium bovis subsp bovis AF2122/97
ggccaccgcagacgccg

SEQ ID NO: 1142750 - RNA, 13 nt, Mycobacterium bovis subsp bovis AF2122/97
ggccaccgaacgc

SEQ ID NO: 1142751 - RNA, 21 nt, Mycobacterium bovis subsp bovis AF2122/97
ggccaccgaccgcaugaucgc

SEQ ID NO: 1142752 - RNA, 13 nt, Mycobacterium bovis subsp bovis AF2122/97
ggccaccgaggcg

SEQ ID NO: 1142753 - RNA, 20 nt, Mycobacterium bovis subsp bovis AF2122/97
ggccacccgcgcgaugcugg

SEQ ID NO: 1142754 - RNA, 22 nt, Mycobacterium bovis subsp bovis AF2122/97
ggccacccggacauagccgcgc

SEQ ID NO: 1142755 - RNA, 22 nt, Mycobacterium bovis subsp bovis AF2122/97
ggccacccggccgcgcggggug

SEQ ID NO: 1142756 - RNA, 20 nt, Mycobacterium bovis subsp bovis AF2122/97
ggccacccgcgaagccgcca

SEQ ID NO: 1142757 - RNA, 15 nt, Mycobacterium bovis subsp bovis AF2122/97
ggccacccgcgacga

SEQ ID NO: 1142758 - RNA, 17 nt, Mycobacterium bovis subsp bovis AF2122/97
ggccacccgcaggucgc

SEQ ID NO: 1142759 - RNA, 17 nt, Mycobacterium bovis subsp bovis AF2122/97
ggccaccgucagcgcga

SEQ ID NO: 1142760 - RNA, 16 nt, Mycobacterium bovis subsp bovis AF2122/97
ggccaccggggucacc

SEQ ID NO: 1142761 - RNA, 22 nt, Mycobacterium bovis subsp bovis AF2122/97
ggccaccgucccugugucgccg

SEQ ID NO: 1142762 - RNA, 23 nt, Mycobacterium bovis subsp bovis AF2122/97
ggccaccgucccugugucgccgu

SEQ ID NO: 1142763 - RNA, 12 nt, Mycobacterium bovis subsp bovis AF2122/97
ggccaccgucgc

SEQ ID NO: 1142764 - RNA, 12 nt, Mycobacterium bovis subsp bovis AF2122/97
ggccaccguccc

SEQ ID NO: 1142765 - RNA, 20 nt, Mycobacterium bovis subsp bovis AF2122/97
ggccaccgucgcggcggcac

SEQ ID NO: 1142766 - RNA, 21 nt, Mycobacterium bovis subsp bovis AF2122/97
ggccaccucggugcggaacac

SEQ ID NO: 1142767 - RNA, 23 nt, Mycobacterium bovis subsp bovis AF2122/97
ggccaccuccgaggccgccaucg

SEQ ID NO: 1142768 - RNA, 20 nt, Mycobacterium bovis subsp bovis AF2122/97
ggccaccuguuggcaugccg

SEQ ID NO: 1142769 - RNA, 20 nt, Mycobacterium bovis subsp bovis AF2122/97
ggccaccuuagcgcuugccg

SEQ ID NO: 1142770 - RNA, 23 nt, Mycobacterium bovis subsp bovis AF2122/97
ggccacgcuucuuccgcgcgccg

SEQ ID NO: 1142771 - RNA, 18 nt, Mycobacterium bovis subsp bovis AF2122/97
ggccacggcgucggccac

SEQ ID NO: 1142772 - RNA, 17 nt, Mycobacterium bovis subsp bovis AF2122/97
ggccacggggcugccgg

SEQ ID NO: 1142773 - RNA, 18 nt, Mycobacterium bovis subsp bovis AF2122/97
ggccacgaacccucagcc

SEQ ID NO: 1142774 - RNA, 20 nt, Mycobacterium bovis subsp bovis AF2122/97
ggccaccuugugcaggccca

SEQ ID NO: 1142775 - RNA, 17 nt, Mycobacterium bovis subsp bovis AF2122/97
ggccacgaauccgauca

SEQ ID NO: 1142776 - RNA, 12 nt, Mycobacterium bovis subsp bovis AF2122/97
ggccagcagggc

SEQ ID NO: 1142777 - RNA, 17 nt, Mycobacterium bovis subsp bovis AF2122/97
ggccagcagggccacca

SEQ ID NO: 1142778 - RNA, 20 nt, Mycobacterium bovis subsp bovis AF2122/97
ggccagcagggccaccacca

SEQ ID NO: 1142779 - RNA, 23 nt, Mycobacterium bovis subsp bovis AF2122/97
ggccagcaggaugaugaccgcca

SEQ ID NO: 1142780 - RNA, 18 nt, Mycobacterium bovis subsp bovis AF2122/97
ggccagcccacucgucga

SEQ ID NO: 1142781 - RNA, 15 nt, Mycobacterium bovis subsp bovis AF2122/97
ggccagcccagccgg

SEQ ID NO: 1142782 - RNA, 15 nt, Mycobacterium bovis subsp bovis AF2122/97
ggccagcccgcccag

SEQ ID NO: 1142783 - RNA, 16 nt, Mycobacterium bovis subsp bovis AF2122/97
ggccagccgacgcggc

SEQ ID NO: 1142784 - RNA, 17 nt, Mycobacterium bovis subsp bovis AF2122/97
ggccagccgacgcggcg

SEQ ID NO: 1142785 - RNA, 16 nt, Mycobacterium bovis subsp bovis AF2122/97
ggccagcaacugccgc

SEQ ID NO: 1142786 - RNA, 19 nt, Mycobacterium bovis subsp bovis AF2122/97
ggccagcaacugccgcacc

SEQ ID NO: 1142787 - RNA, 15 nt, Mycobacterium bovis subsp bovis AF2122/97
ggccagaucgaacgc

SEQ ID NO: 1142788 - RNA, 22 nt, Mycobacterium bovis subsp bovis AF2122/97
ggccagauuucugggagccggu

SEQ ID NO: 1142789 - RNA, 17 nt, Mycobacterium bovis subsp bovis AF2122/97
ggccagcaaguacgcgu

SEQ ID NO: 1142790 - RNA, 18 nt, Mycobacterium bovis subsp bovis AF2122/97
ggccagcagcgcgggauc

SEQ ID NO: 1142791 - RNA, 14 nt, Mycobacterium bovis subsp bovis AF2122/97
ggccagcagcgcgg

SEQ ID NO: 1142792 - RNA, 23 nt, Mycobacterium bovis subsp bovis AF2122/97
ggccagcagcgacuccagcgccc

SEQ ID NO: 1142793 - RNA, 16 nt, Mycobacterium bovis subsp bovis AF2122/97
ggccagacggugcagc

SEQ ID NO: 1142794 - RNA, 19 nt, Mycobacterium bovis subsp bovis AF2122/97
ggccagacccaccaccgca

SEQ ID NO: 1142795 - RNA, 14 nt, Mycobacterium bovis subsp bovis AF2122/97
ggccagaucgccgg

SEQ ID NO: 1142796 - RNA, 17 nt, Mycobacterium bovis subsp bovis AF2122/97
ggccagacucgcggucg

SEQ ID NO: 1142797 - RNA, 15 nt, Mycobacterium bovis subsp bovis AF2122/97
ggccagccgcggccc

SEQ ID NO: 1142798 - RNA, 15 nt, Mycobacterium bovis subsp bovis AF2122/97
ggccagccgcucacc

SEQ ID NO: 1142799 - RNA, 20 nt, Mycobacterium bovis subsp bovis AF2122/97
ggccagccgcucacccgguc

SEQ ID NO: 1142800 - RNA, 15 nt, Mycobacterium bovis subsp bovis AF2122/97
ggccagcgcgcccgc

SEQ ID NO: 1142801 - RNA, 16 nt, Mycobacterium bovis subsp bovis AF2122/97
ggccagcgcgcccgcg

SEQ ID NO: 1142802 - RNA, 18 nt, Mycobacterium bovis subsp bovis AF2122/97
ggccagcgcgcccgcggc

SEQ ID NO: 1142803 - RNA, 12 nt, Mycobacterium bovis subsp bovis AF2122/97
ggccagcgcggc

SEQ ID NO: 1142804 - RNA, 19 nt, Mycobacterium bovis subsp bovis AF2122/97
ggccagcuccgugacaccg

SEQ ID NO: 1142805 - RNA, 23 nt, Mycobacterium bovis subsp bovis AF2122/97
ggccagcucccgggcggcggccu

SEQ ID NO: 1142806 - RNA, 16 nt, Mycobacterium bovis subsp bovis AF2122/97
ggccagcuccgccugc

SEQ ID NO: 1142807 - RNA, 22 nt, Mycobacterium bovis subsp bovis AF2122/97
ggccagcuccgccugccgcugg

SEQ ID NO: 1142808 - RNA, 21 nt, Mycobacterium bovis subsp bovis AF2122/97
ggccaggaagucccgggcacc

SEQ ID NO: 1142809 - RNA, 22 nt, Mycobacterium bovis subsp bovis AF2122/97
ggccagcgggugaaucgacacc

SEQ ID NO: 1142810 - RNA, 18 nt, Mycobacterium bovis subsp bovis AF2122/97
ggccagcgguaaugccag

SEQ ID NO: 1142811 - RNA, 19 nt, Mycobacterium bovis subsp bovis AF2122/97
ggccagcgugucccaacgc

SEQ ID NO: 1142812 - RNA, 13 nt, Mycobacterium bovis subsp bovis AF2122/97
ggcagcgcggcca

SEQ ID NO: 1142813 - RNA, 18 nt, Mycobacterium bovis subsp bovis AF2122/97
ggcagcgcggccacccgc

SEQ ID NO: 1142814 - RNA, 15 nt, Mycobacterium bovis subsp bovis AF2122/97
ggcagcgcggccagu

SEQ ID NO: 1142815 - RNA, 15 nt, Mycobacterium bovis subsp bovis AF2122/97
ggcagcgcggccggg

SEQ ID NO: 1142816 - RNA, 16 nt, Mycobacterium bovis subsp bovis AF2122/97
ggcagcggccuccggg

SEQ ID NO: 1142817 - RNA, 17 nt, Mycobacterium bovis subsp bovis AF2122/97
ggcagcggcaucggcca

SEQ ID NO: 1142818 - RNA, 13 nt, Mycobacterium bovis subsp bovis AF2122/97
ggcagcggcgagu

SEQ ID NO: 1142819 - RNA, 19 nt, Mycobacterium bovis subsp bovis AF2122/97
ggcagcggcgaucaggcgg

SEQ ID NO: 1142820 - RNA, 21 nt, Mycobacterium bovis subsp bovis AF2122/97
ggcagcggcgaucaggcggac

SEQ ID NO: 1142821 - RNA, 12 nt, Mycobacterium bovis subsp bovis AF2122/97
ggcagcggcgau

SEQ ID NO: 1142822 - RNA, 20 nt, Mycobacterium bovis subsp bovis AF2122/97
ggcagcuccgccgccgacgg

SEQ ID NO: 1142823 - RNA, 21 nt, Mycobacterium bovis subsp bovis AF2122/97
ggcagcuccucgcgcucgccg

SEQ ID NO: 1142824 - RNA, 22 nt, Mycobacterium bovis subsp bovis AF2122/97
ggcagcggcggucucggcgucg

SEQ ID NO: 1142825 - RNA, 13 nt, Mycobacterium bovis subsp bovis AF2122/97
ggcagcggcgucg

SEQ ID NO: 1142826 - RNA, 17 nt, Mycobacterium bovis subsp bovis AF2122/97
ggcagcggcgucgucgu

SEQ ID NO: 1142827 - RNA, 21 nt, Mycobacterium bovis subsp bovis AF2122/97
ggcagcucccgccacgucgcc

SEQ ID NO: 1142828 - RNA, 16 nt, Mycobacterium bovis subsp bovis AF2122/97
ggcagcuccgccgccg

SEQ ID NO: 1142829 - RNA, 17 nt, Mycobacterium bovis subsp bovis AF2122/97
ggcagcuccgccgccga

SEQ ID NO: 1142830 - RNA, 13 nt, Mycobacterium bovis subsp bovis AF2122/97
ggcagcgcgauca

SEQ ID NO: 1142831 - RNA, 21 nt, Mycobacterium bovis subsp bovis AF2122/97
ggcagauugacggaacgauag

SEQ ID NO: 1142832 - RNA, 18 nt, Mycobacterium bovis subsp bovis AF2122/97
ggcagagcacgcgcggcg

SEQ ID NO: 1142833 - RNA, 23 nt, Mycobacterium bovis subsp bovis AF2122/97
ggcagagccgccguugccgccgg

SEQ ID NO: 1142834 - RNA, 22 nt, Mycobacterium bovis subsp bovis AF2122/97
ggcacugugaggucauuggcga

SEQ ID NO: 1142835 - RNA, 19 nt, Mycobacterium bovis subsp bovis AF2122/97
ggcacuuagcccgauggug

SEQ ID NO: 1142836 - RNA, 22 nt, Mycobacterium bovis subsp bovis AF2122/97
ggcagacgcguuucgucgaccg

SEQ ID NO: 1142837 - RNA, 20 nt, Mycobacterium bovis subsp bovis AF2122/97
ggcaggcccgacggcgccca

SEQ ID NO: 1142838 - RNA, 15 nt, Mycobacterium bovis subsp bovis AF2122/97
ggcaggccgcugggc

SEQ ID NO: 1142839 - RNA, 14 nt, Mycobacterium bovis subsp bovis AF2122/97
ggcaggccggccac

SEQ ID NO: 1142840 - RNA, 16 nt, Mycobacterium bovis subsp bovis AF2122/97
ggcaggccggcucgcc

SEQ ID NO: 1142841 - RNA, 15 nt, Mycobacterium bovis subsp bovis AF2122/97
ggcaggccgggcacc

SEQ ID NO: 1142842 - RNA, 16 nt, Mycobacterium bovis subsp bovis AF2122/97
ggcaggcgaaggcggc

SEQ ID NO: 1142843 - RNA, 21 nt, Mycobacterium bovis subsp bovis AF2122/97
ggcaggcgaaggcggcuucgc

SEQ ID NO: 1142844 - RNA, 15 nt, Mycobacterium bovis subsp bovis AF2122/97
ggcaggcggccgccg

SEQ ID NO: 1142845 - RNA, 16 nt, Mycobacterium bovis subsp bovis AF2122/97
ggcaggccucggcgcc

SEQ ID NO: 1142846 - RNA, 18 nt, Mycobacterium bovis subsp bovis AF2122/97
ggcaggcgggggaucggu

SEQ ID NO: 1142847 - RNA, 19 nt, Mycobacterium bovis subsp bovis AF2122/97
ggcaggucuucgcugucga

SEQ ID NO: 1142848 - RNA, 22 nt, Mycobacterium bovis subsp bovis AF2122/97
ggcaggaucuccgggucgaugu

SEQ ID NO: 1142849 - RNA, 16 nt, Mycobacterium bovis subsp bovis AF2122/97
ggcaggcccgacggcg

SEQ ID NO: 1142850 - RNA, 22 nt, Mycobacterium bovis subsp bovis AF2122/97
ggcaggcauggcgccguugccg

SEQ ID NO: 1142851 - RNA, 17 nt, Mycobacterium bovis subsp bovis AF2122/97
ggcaggaaugccgcggg

SEQ ID NO: 1142852 - RNA, 14 nt, Mycobacterium bovis subsp bovis AF2122/97
ggcagcugggcagg

SEQ ID NO: 1142853 - RNA, 18 nt, Mycobacterium bovis subsp bovis AF2122/97
ggcagcuucaacaccggc

SEQ ID NO: 1142854 - RNA, 20 nt, Mycobacterium bovis subsp bovis AF2122/97
ggcagcuucaacaccggcau

SEQ ID NO: 1142855 - RNA, 21 nt, Mycobacterium bovis subsp bovis AF2122/97
ggcagcuucaacaccggcauc

SEQ ID NO: 1142856 - RNA, 21 nt, Mycobacterium bovis subsp bovis AF2122/97
ggcagcuuugacgcccucggc

SEQ ID NO: 1142857 - RNA, 23 nt, Mycobacterium bovis subsp bovis AF2122/97
ggcagcuuugacgcccucggcga

SEQ ID NO: 1142858 - RNA, 22 nt, Mycobacterium bovis subsp bovis AF2122/97
ggcagcuugcagugccgccggc

SEQ ID NO: 1142859 - RNA, 20 nt, Mycobacterium bovis subsp bovis AF2122/97
ggcagcuugccaaucaccgu

SEQ ID NO: 1142860 - RNA, 23 nt, Mycobacterium bovis subsp bovis AF2122/97
ggcaucggugaucaaaccggcgg

SEQ ID NO: 1142861 - RNA, 15 nt, Mycobacterium bovis subsp bovis AF2122/97
ggcaucgucgccgag

SEQ ID NO: 1142862 - RNA, 19 nt, Mycobacterium bovis subsp bovis AF2122/97
ggcauaggaucgcgcccac

SEQ ID NO: 1142863 - RNA, 22 nt, Mycobacterium bovis subsp bovis AF2122/97
ggcaucggucagcgcggcaagc

SEQ ID NO: 1142864 - RNA, 14 nt, Mycobacterium bovis subsp bovis AF2122/97
ggcauacaccguga

SEQ ID NO: 1142865 - RNA, 21 nt, Mycobacterium bovis subsp bovis AF2122/97
ggcauacagcaugucgcggac

SEQ ID NO: 1142866 - RNA, 14 nt, Mycobacterium bovis subsp bovis AF2122/97
ggcauacaucgccu

SEQ ID NO: 1142867 - RNA, 23 nt, Mycobacterium bovis subsp bovis AF2122/97
ggcauacaucgccuugcccagcg

SEQ ID NO: 1142868 - RNA, 21 nt, Mycobacterium bovis subsp bovis AF2122/97
ggcauacauccaggcuguggc

SEQ ID NO: 1142869 - RNA, 13 nt, Mycobacterium bovis subsp bovis AF2122/97
ggcauacccauca

SEQ ID NO: 1142870 - RNA, 17 nt, Mycobacterium bovis subsp bovis AF2122/97
ggcauaccgaacagcac

SEQ ID NO: 1142871 - RNA, 18 nt, Mycobacterium bovis subsp bovis AF2122/97
ggcaucgucgccgagcgg

SEQ ID NO: 1142872 - RNA, 20 nt, Mycobacterium bovis subsp bovis AF2122/97
ggcaucucgcaccgcgccgu

SEQ ID NO: 1142873 - RNA, 20 nt, Mycobacterium bovis subsp bovis AF2122/97
ggcaucgucgucgcugccgc

SEQ ID NO: 1142874 - RNA, 23 nt, Mycobacterium bovis subsp bovis AF2122/97
ggcaucuccaccgucgccgccgg

SEQ ID NO: 1142875 - RNA, 15 nt, Mycobacterium bovis subsp bovis AF2122/97
ggcaguagcuguggc

SEQ ID NO: 1142876 - RNA, 22 nt, Mycobacterium bovis subsp bovis AF2122/97
ggcaguugaacucgaccaccgc

SEQ ID NO: 1142877 - RNA, 20 nt, Mycobacterium bovis subsp bovis AF2122/97
ggcaguugaacucgaccacc

SEQ ID NO: 1142878 - RNA, 21 nt, Mycobacterium bovis subsp bovis AF2122/97
ggcaguagcuguggcccgcgg

SEQ ID NO: 1142879 - RNA, 22 nt, Mycobacterium bovis subsp bovis AF2122/97
ggcaguagcuguggcccgcggu

SEQ ID NO: 1142880 - RNA, 16 nt, Mycobacterium bovis subsp bovis AF2122/97
ggcaguuuggcggcag

SEQ ID NO: 1142881 - RNA, 16 nt, Mycobacterium bovis subsp bovis AF2122/97
ggcauaacccuggccg

SEQ ID NO: 1142882 - RNA, 14 nt, Mycobacterium bovis subsp bovis AF2122/97
ggcaguuuggcggc

SEQ ID NO: 1142883 - RNA, 19 nt, Mycobacterium bovis subsp bovis AF2122/97
ggcagguugcguugcagga

SEQ ID NO: 1142884 - RNA, 15 nt, Mycobacterium bovis subsp bovis AF2122/97
ggcaugggccggcgc

SEQ ID NO: 1142885 - RNA, 21 nt, Mycobacterium bovis subsp bovis AF2122/97
ggcaugggccggcgccgcacc

SEQ ID NO: 1142886 - RNA, 19 nt, Mycobacterium bovis subsp bovis AF2122/97
ggcaugauccccguugacc

SEQ ID NO: 1142887 - RNA, 20 nt, Mycobacterium bovis subsp bovis AF2122/97
ggcaugauuuuucgcaguga

SEQ ID NO: 1142888 - RNA, 22 nt, Mycobacterium bovis subsp bovis AF2122/97
ggcauggcgaacacgucggcca

SEQ ID NO: 1142889 - RNA, 17 nt, Mycobacterium bovis subsp bovis AF2122/97
ggcauguaccgaccgcg

SEQ ID NO: 1142890 - RNA, 20 nt, Mycobacterium bovis subsp bovis AF2122/97
ggcaugucgccgaacgccac

SEQ ID NO: 1142891 - RNA, 23 nt, Mycobacterium bovis subsp bovis AF2122/97
ggcaugugacaucgggccgccga

SEQ ID NO: 1142892 - RNA, 13 nt, Mycobacterium bovis subsp bovis AF2122/97
ggcauguucaucg

SEQ ID NO: 1142893 - RNA, 19 nt, Mycobacterium bovis subsp bovis AF2122/97
ggcauguuccuugcggccg

SEQ ID NO: 1142894 - RNA, 22 nt, Mycobacterium bovis subsp bovis AF2122/97
ggcauguuccuugcggccgcug

SEQ ID NO: 1142895 - RNA, 14 nt, Mycobacterium bovis subsp bovis AF2122/97
ggcauucccgcucg

SEQ ID NO: 1142896 - RNA, 22 nt, Mycobacterium bovis subsp bovis AF2122/97
ggcauuccggugugcuugcucg

SEQ ID NO: 1142897 - RNA, 22 nt, Mycobacterium bovis subsp bovis AF2122/97
ggcauuccuugauaacgacccu

SEQ ID NO: 1142898 - RNA, 17 nt, Mycobacterium bovis subsp bovis AF2122/97
ggccaacaccgccagca

SEQ ID NO: 1142899 - RNA, 18 nt, Mycobacterium bovis subsp bovis AF2122/97
ggccaaauaacgcgggau

SEQ ID NO: 1142900 - RNA, 20 nt, Mycobacterium bovis subsp bovis AF2122/97
ggccaacagucgcagcacgg

SEQ ID NO: 1142901 - RNA, 21 nt, Mycobacterium bovis subsp bovis AF2122/97
ggccaaaccccugcacggugc

SEQ ID NO: 1142902 - RNA, 23 nt, Mycobacterium bovis subsp bovis AF2122/97
ggccaaaauuuugucggccgccu

SEQ ID NO: 1142903 - RNA, 15 nt, Mycobacterium bovis subsp bovis AF2122/97
ggcauuucagcgcgc

SEQ ID NO: 1142904 - RNA, 18 nt, Mycobacterium bovis subsp bovis AF2122/97
ggcauuucagcgcgccgc

SEQ ID NO: 1142905 - RNA, 14 nt, Mycobacterium bovis subsp bovis AF2122/97
ggcauugaccaccg

SEQ ID NO: 1142906 - RNA, 16 nt, Mycobacterium bovis subsp bovis AF2122/97
ggcauugcgcccaccg

SEQ ID NO: 1142907 - RNA, 14 nt, Mycobacterium bovis subsp bovis AF2122/97
ggcauugccgccgu

SEQ ID NO: 1142908 - RNA, 17 nt, Mycobacterium bovis subsp bovis AF2122/97
ggcauugguaccggcuu

SEQ ID NO: 1142909 - RNA, 14 nt, Mycobacterium bovis subsp bovis AF2122/97
ggcaccaccccgag

SEQ ID NO: 1142910 - RNA, 21 nt, Mycobacterium bovis subsp bovis AF2122/97
ggcaccacccgauuggccaac

SEQ ID NO: 1142911 - RNA, 22 nt, Mycobacterium bovis subsp bovis AF2122/97
ggcacccaaccaggccgcgaca

SEQ ID NO: 1142912 - RNA, 19 nt, Mycobacterium bovis subsp bovis AF2122/97
ggcaccaacgccaccgucg

SEQ ID NO: 1142913 - RNA, 20 nt, Mycobacterium bovis subsp bovis AF2122/97
ggcaccaacgccaccgucgc

SEQ ID NO: 1142914 - RNA, 20 nt, Mycobacterium bovis subsp bovis AF2122/97
ggcaccaauaccgcacccgc

SEQ ID NO: 1142915 - RNA, 22 nt, Mycobacterium bovis subsp bovis AF2122/97
ggcaccaauaccgcacccgcuc

SEQ ID NO: 1142916 - RNA, 16 nt, Mycobacterium bovis subsp bovis AF2122/97
ggcacauugaucgacg

SEQ ID NO: 1142917 - RNA, 18 nt, Mycobacterium bovis subsp bovis AF2122/97
ggcacauugaucgacggc

SEQ ID NO: 1142918 - RNA, 18 nt, Mycobacterium bovis subsp bovis AF2122/97
ggcaccaccacaccggag

SEQ ID NO: 1142919 - RNA, 19 nt, Mycobacterium bovis subsp bovis AF2122/97
ggcaccaccacaccggagc

SEQ ID NO: 1142920 - RNA, 20 nt, Mycobacterium bovis subsp bovis AF2122/97
ggcaccaccacaccggagcc

SEQ ID NO: 1142921 - RNA, 14 nt, Mycobacterium bovis subsp bovis AF2122/97
ggcacccgacucgu

SEQ ID NO: 1142922 - RNA, 19 nt, Mycobacterium bovis subsp bovis AF2122/97
ggcacccgcacggccuccg

SEQ ID NO: 1142923 - RNA, 14 nt, Mycobacterium bovis subsp bovis AF2122/97
ggcaccccgaccac

SEQ ID NO: 1142924 - RNA, 12 nt, Mycobacterium bovis subsp bovis AF2122/97
ggcacccgaaaa

SEQ ID NO: 1142925 - RNA, 18 nt, Mycobacterium bovis subsp bovis AF2122/97
ggcacccgacucgucggc

SEQ ID NO: 1142926 - RNA, 13 nt, Mycobacterium bovis subsp bovis AF2122/97
ggcacccgagccg

SEQ ID NO: 1142927 - RNA, 14 nt, Mycobacterium bovis subsp bovis AF2122/97
ggcaccccggccac

SEQ ID NO: 1142928 - RNA, 12 nt, Mycobacterium bovis subsp bovis AF2122/97
ggcaccgccggc

SEQ ID NO: 1142929 - RNA, 17 nt, Mycobacterium bovis subsp bovis AF2122/97
ggcaccgccggcaccgc

SEQ ID NO: 1142930 - RNA, 15 nt, Mycobacterium bovis subsp bovis AF2122/97
ggcaccgccggcgcc

SEQ ID NO: 1142931 - RNA, 16 nt, Mycobacterium bovis subsp bovis AF2122/97
ggcaccgccggcgcca

SEQ ID NO: 1142932 - RNA, 18 nt, Mycobacterium bovis subsp bovis AF2122/97
ggcaccgccggcgccacc

SEQ ID NO: 1142933 - RNA, 22 nt, Mycobacterium bovis subsp bovis AF2122/97
ggcaccgccggcgccaccgucg

SEQ ID NO: 1142934 - RNA, 18 nt, Mycobacterium bovis subsp bovis AF2122/97
ggcaccgccggcgcccag

SEQ ID NO: 1142935 - RNA, 14 nt, Mycobacterium bovis subsp bovis AF2122/97
ggcaccgccggugg

SEQ ID NO: 1142936 - RNA, 15 nt, Mycobacterium bovis subsp bovis AF2122/97
ggcaccgccugcgcc

SEQ ID NO: 1142937 - RNA, 22 nt, Mycobacterium bovis subsp bovis AF2122/97
ggcaccgccugcgccgcccgcg

SEQ ID NO: 1142938 - RNA, 16 nt, Mycobacterium bovis subsp bovis AF2122/97
ggcaccgcgccggcgg

SEQ ID NO: 1142939 - RNA, 13 nt, Mycobacterium bovis subsp bovis AF2122/97
ggcaccgauggcg

SEQ ID NO: 1142940 - RNA, 19 nt, Mycobacterium bovis subsp bovis AF2122/97
ggcaccgauggcgcaccgg

SEQ ID NO: 1142941 - RNA, 20 nt, Mycobacterium bovis subsp bovis AF2122/97
ggcaccgauggcgcaccggc

SEQ ID NO: 1142942 - RNA, 13 nt, Mycobacterium bovis subsp bovis AF2122/97
ggcacccgccgug

SEQ ID NO: 1142943 - RNA, 15 nt, Mycobacterium bovis subsp bovis AF2122/97
ggcacccgccgugcc

SEQ ID NO: 1142944 - RNA, 14 nt, Mycobacterium bovis subsp bovis AF2122/97
ggcacccgcgucga

SEQ ID NO: 1142945 - RNA, 14 nt, Mycobacterium bovis subsp bovis AF2122/97
ggcaccgcugccgc

SEQ ID NO: 1142946 - RNA, 12 nt, Mycobacterium bovis subsp bovis AF2122/97
ggcaccgccgag

SEQ ID NO: 1142947 - RNA, 18 nt, Mycobacterium bovis subsp bovis AF2122/97
ggcaccguguagcugcgg

SEQ ID NO: 1142948 - RNA, 17 nt, Mycobacterium bovis subsp bovis AF2122/97
ggcaccgccgcccccgc

SEQ ID NO: 1142949 - RNA, 23 nt, Mycobacterium bovis subsp bovis AF2122/97
ggcaccgccgcccccgccggccg

SEQ ID NO: 1142950 - RNA, 16 nt, Mycobacterium bovis subsp bovis AF2122/97
ggcaccgcggccagcg

SEQ ID NO: 1142951 - RNA, 23 nt, Mycobacterium bovis subsp bovis AF2122/97
ggcaccuccaauugcgaaccggc

SEQ ID NO: 1142952 - RNA, 15 nt, Mycobacterium bovis subsp bovis AF2122/97
ggcaccuccagcacc

SEQ ID NO: 1142953 - RNA, 19 nt, Mycobacterium bovis subsp bovis AF2122/97
ggcaccuccagcaccaccg

SEQ ID NO: 1142954 - RNA, 18 nt, Mycobacterium bovis subsp bovis AF2122/97
ggcacgacgccggccugg

SEQ ID NO: 1142955 - RNA, 13 nt, Mycobacterium bovis subsp bovis AF2122/97
ggcacgcgcgcuu

SEQ ID NO: 1142956 - RNA, 22 nt, Mycobacterium bovis subsp bovis AF2122/97
ggcacgcggcgaugauggcgcg

SEQ ID NO: 1142957 - RNA, 22 nt, Mycobacterium bovis subsp bovis AF2122/97
ggcacgcgggaagugcacccgg

SEQ ID NO: 1142958 - RNA, 13 nt, Mycobacterium bovis subsp bovis AF2122/97
ggcacgcucgcgc

SEQ ID NO: 1142959 - RNA, 20 nt, Mycobacterium bovis subsp bovis AF2122/97
ggcaccgccagugcccgcac

SEQ ID NO: 1142960 - RNA, 17 nt, Mycobacterium bovis subsp bovis AF2122/97
ggcaccuggauccacca

SEQ ID NO: 1142961 - RNA, 16 nt, Mycobacterium bovis subsp bovis AF2122/97
ggcacgaaauugggcg

SEQ ID NO: 1142962 - RNA, 12 nt, Mycobacterium bovis subsp bovis AF2122/97
ggcacgacccgg

SEQ ID NO: 1142963 - RNA, 12 nt, Mycobacterium bovis subsp bovis AF2122/97
ggcacgaccgcu

SEQ ID NO: 1142964 - RNA, 19 nt, Mycobacterium bovis subsp bovis AF2122/97
ggcacgaccgcucccggug

SEQ ID NO: 1142965 - RNA, 20 nt, Mycobacterium bovis subsp bovis AF2122/97
ggcacuggggucugauggcg

SEQ ID NO: 1142966 - RNA, 22 nt, Mycobacterium bovis subsp bovis AF2122/97
ggcacuggggucugauggcggc

SEQ ID NO: 1142967 - RNA, 16 nt, Mycobacterium bovis subsp bovis AF2122/97
ggcacuggguccacgc

SEQ ID NO: 1142968 - RNA, 22 nt, Mycobacterium bovis subsp bovis AF2122/97
ggcacugcccagcagaccaagu

SEQ ID NO: 1142969 - RNA, 13 nt, Mycobacterium bovis subsp bovis AF2122/97
ggcacugccggca

SEQ ID NO: 1142970 - RNA, 12 nt, Mycobacterium bovis subsp bovis AF2122/97
ggcacugaucgg

SEQ ID NO: 1142971 - RNA, 17 nt, Mycobacterium bovis subsp bovis AF2122/97
ggcacuccgggcucggc

SEQ ID NO: 1142972 - RNA, 20 nt, Mycobacterium bovis subsp bovis AF2122/97
ggcacuccaccgggauagcc

SEQ ID NO: 1142973 - RNA, 18 nt, Mycobacterium bovis subsp bovis AF2122/97
ggcacgcuccagcucggc

SEQ ID NO: 1142974 - RNA, 13 nt, Mycobacterium bovis subsp bovis AF2122/97
ggcacgcugucga

SEQ ID NO: 1142975 - RNA, 22 nt, Mycobacterium bovis subsp bovis AF2122/97
ggcacggaaguacuccacccag

SEQ ID NO: 1142976 - RNA, 18 nt, Mycobacterium bovis subsp bovis AF2122/97
ggcacggaugcgauggcc

SEQ ID NO: 1142977 - RNA, 18 nt, Mycobacterium bovis subsp bovis AF2122/97
ggcacguugugaucguca

SEQ ID NO: 1142978 - RNA, 19 nt, Mycobacterium bovis subsp bovis AF2122/97
ggcacggccccugccacga

SEQ ID NO: 1142979 - RNA, 14 nt, Mycobacterium bovis subsp bovis AF2122/97
ggcacuacgcagcc

SEQ ID NO: 1142980 - RNA, 17 nt, Mycobacterium bovis subsp bovis AF2122/97
ggcacuagcgagccggc

SEQ ID NO: 1142981 - RNA, 22 nt, Mycobacterium bovis subsp bovis AF2122/97
ggcacguuuacauagaccaccg

SEQ ID NO: 1142982 - RNA, 16 nt, Mycobacterium bovis subsp bovis AF2122/97
ggcacuccaccgggau

SEQ ID NO: 1142983 - RNA, 15 nt, Mycobacterium bovis subsp bovis AF2122/97
ggcaaccgcaccgca

SEQ ID NO: 1142984 - RNA, 14 nt, Mycobacterium bovis subsp bovis AF2122/97
ggcaacgccgcgcc

SEQ ID NO: 1142985 - RNA, 20 nt, Mycobacterium bovis subsp bovis AF2122/97
ggcaagaccgaacagcggca

SEQ ID NO: 1142986 - RNA, 15 nt, Mycobacterium bovis subsp bovis AF2122/97
ggcaagaacccggua

SEQ ID NO: 1142987 - RNA, 12 nt, Mycobacterium bovis subsp bovis AF2122/97
ggcaagcacggc

SEQ ID NO: 1142988 - RNA, 21 nt, Mycobacterium bovis subsp bovis AF2122/97
ggcaagcacgguggccgagcc

SEQ ID NO: 1142989 - RNA, 14 nt, Mycobacterium bovis subsp bovis AF2122/97
ggcaagcacaccgc

SEQ ID NO: 1142990 - RNA, 20 nt, Mycobacterium bovis subsp bovis AF2122/97
ggcaagcacaccgccagcgg

SEQ ID NO: 1142991 - RNA, 18 nt, Mycobacterium bovis subsp bovis AF2122/97
ggcaagcacgcgacggcg

SEQ ID NO: 1142992 - RNA, 13 nt, Mycobacterium bovis subsp bovis AF2122/97
ggcaagcagucgg

SEQ ID NO: 1142993 - RNA, 23 nt, Mycobacterium bovis subsp bovis AF2122/97
ggcaagccguucugucccggcgc

SEQ ID NO: 1142994 - RNA, 14 nt, Mycobacterium bovis subsp bovis AF2122/97
ggcaagccagcacu

SEQ ID NO: 1142995 - RNA, 23 nt, Mycobacterium bovis subsp bovis AF2122/97
ggcaagcccaaaaagaccgccgc

SEQ ID NO: 1142996 - RNA, 22 nt, Mycobacterium bovis subsp bovis AF2122/97
ggcaaucucccgaaucgugcgg

SEQ ID NO: 1142997 - RNA, 21 nt, Mycobacterium bovis subsp bovis AF2122/97
ggcaagcgcagacacgacccc

SEQ ID NO: 1142998 - RNA, 17 nt, Mycobacterium bovis subsp bovis AF2122/97
ggcaaugcccgaccggu

SEQ ID NO: 1142999 - RNA, 16 nt, Mycobacterium bovis subsp bovis AF2122/97
ggcaaugccgcggcca

SEQ ID NO: 1143000 - RNA, 15 nt, Mycobacterium bovis subsp bovis AF2122/97
ggcaaugaccccggc

SEQ ID NO: 1143001 - RNA, 17 nt, Mycobacterium bovis subsp bovis AF2122/97
ggcaaugaccccggcgu

SEQ ID NO: 1143002 - RNA, 21 nt, Mycobacterium bovis subsp bovis AF2122/97
ggcaaugaccccggcguugcc

SEQ ID NO: 1143003 - RNA, 15 nt, Mycobacterium bovis subsp bovis AF2122/97
ggcaagacgcggucg

SEQ ID NO: 1143004 - RNA, 22 nt, Mycobacterium bovis subsp bovis AF2122/97
ggcaaugaucaucccggcgcgu

SEQ ID NO: 1143005 - RNA, 15 nt, Mycobacterium bovis subsp bovis AF2122/97
ggcaaugucgacacc

SEQ ID NO: 1143006 - RNA, 17 nt, Mycobacterium bovis subsp bovis AF2122/97
ggcaaugucgacaccgg

SEQ ID NO: 1143007 - RNA, 20 nt, Mycobacterium bovis subsp bovis AF2122/97
ggcaaugucgacaccggcgc

SEQ ID NO: 1143008 - RNA, 14 nt, Mycobacterium bovis subsp bovis AF2122/97
ggcacaguccgcga

SEQ ID NO: 1143009 - RNA, 21 nt, Mycobacterium bovis subsp bovis AF2122/97
ggcaaccgggaggccaccgcg

SEQ ID NO: 1143010 - RNA, 17 nt, Mycobacterium bovis subsp bovis AF2122/97
ggcaacccugcccggcc

SEQ ID NO: 1143011 - RNA, 14 nt, Mycobacterium bovis subsp bovis AF2122/97
ggcaaccgccgcca

SEQ ID NO: 1143012 - RNA, 17 nt, Mycobacterium bovis subsp bovis AF2122/97
ggcaaccgccgccacca

SEQ ID NO: 1143013 - RNA, 24 nt, Mycobacterium bovis subsp bovis AF2122/97
ggcaaccugaauccagaccaugcg

SEQ ID NO: 1143014 - RNA, 16 nt, Mycobacterium bovis subsp bovis AF2122/97
ggcaaccucaugcacg

SEQ ID NO: 1143015 - RNA, 15 nt, Mycobacterium bovis subsp bovis AF2122/97
ggcaacgaucgacac

SEQ ID NO: 1143016 - RNA, 18 nt, Mycobacterium bovis subsp bovis AF2122/97
ggcaacgaucgacaccag

SEQ ID NO: 1143017 - RNA, 16 nt, Mycobacterium bovis subsp bovis AF2122/97
ggcaacgaggucugcg

SEQ ID NO: 1143018 - RNA, 20 nt, Mycobacterium bovis subsp bovis AF2122/97
ggcaacgaggucugcggccg

SEQ ID NO: 1143019 - RNA, 22 nt, Mycobacterium bovis subsp bovis AF2122/97
ggcaacgaagagggcgccgcgc

SEQ ID NO: 1143020 - RNA, 17 nt, Mycobacterium bovis subsp bovis AF2122/97
ggcaacccccgccggcg

SEQ ID NO: 1143021 - RNA, 23 nt, Mycobacterium bovis subsp bovis AF2122/97
ggcaacccccgccggcgcccgag

SEQ ID NO: 1143022 - RNA, 13 nt, Mycobacterium bovis subsp bovis AF2122/97
ggcaaccagcgag

SEQ ID NO: 1143023 - RNA, 15 nt, Mycobacterium bovis subsp bovis AF2122/97
ggcaaaguaucgcag

SEQ ID NO: 1143024 - RNA, 22 nt, Mycobacterium bovis subsp bovis AF2122/97
ggcaaaguaucgcagcaucugc

SEQ ID NO: 1143025 - RNA, 19 nt, Mycobacterium bovis subsp bovis AF2122/97
ggcaaccacguccgcaacc

SEQ ID NO: 1143026 - RNA, 15 nt, Mycobacterium bovis subsp bovis AF2122/97
ggcaaccagcagcag

SEQ ID NO: 1143027 - RNA, 17 nt, Mycobacterium bovis subsp bovis AF2122/97
ggcaaacugggcaccgg

SEQ ID NO: 1143028 - RNA, 19 nt, Mycobacterium bovis subsp bovis AF2122/97
ggcaaacugggcaccggcg

SEQ ID NO: 1143029 - RNA, 20 nt, Mycobacterium bovis subsp bovis AF2122/97
ggcaaacugggcaccggcgg

SEQ ID NO: 1143030 - RNA, 12 nt, Mycobacterium bovis subsp bovis AF2122/97
ggcaaacaccag

SEQ ID NO: 1143031 - RNA, 20 nt, Mycobacterium bovis subsp bovis AF2122/97
ggcaaacaccagcccggcgg

SEQ ID NO: 1143032 - RNA, 23 nt, Mycobacterium bovis subsp bovis AF2122/97
ggauuugccccguugagcagcac

SEQ ID NO: 1143033 - RNA, 18 nt, Mycobacterium bovis subsp bovis AF2122/97
ggauuugggcugcggaug

SEQ ID NO: 1143034 - RNA, 19 nt, Mycobacterium bovis subsp bovis AF2122/97
ggauuuccagcagugcggg

SEQ ID NO: 1143035 - RNA, 19 nt, Mycobacterium bovis subsp bovis AF2122/97
ggauuucgcgucugcucgc

SEQ ID NO: 1143036 - RNA, 16 nt, Mycobacterium bovis subsp bovis AF2122/97
ggauucggcagcggcg

SEQ ID NO: 1143037 - RNA, 15 nt, Mycobacterium bovis subsp bovis AF2122/97
ggauucgggcgccgc

SEQ ID NO: 1143038 - RNA, 15 nt, Mycobacterium bovis subsp bovis AF2122/97
ggauucuucagcgcg

SEQ ID NO: 1143039 - RNA, 13 nt, Mycobacterium bovis subsp bovis AF2122/97
ggauugagcacgc

SEQ ID NO: 1143040 - RNA, 19 nt, Mycobacterium bovis subsp bovis AF2122/97
ggauugcuguacugcggug

SEQ ID NO: 1143041 - RNA, 20 nt, Mycobacterium bovis subsp bovis AF2122/97
ggauugcuguacugcggugc

SEQ ID NO: 1143042 - RNA, 18 nt, Mycobacterium bovis subsp bovis AF2122/97
ggauucggcgcugcggcg

SEQ ID NO: 1143043 - RNA, 17 nt, Mycobacterium bovis subsp bovis AF2122/97
ggauucggcugccaccg

SEQ ID NO: 1143044 - RNA, 20 nt, Mycobacterium bovis subsp bovis AF2122/97
ggauucccgcccagcagcac

SEQ ID NO: 1143045 - RNA, 16 nt, Mycobacterium bovis subsp bovis AF2122/97
ggauucauggcggcau

SEQ ID NO: 1143046 - RNA, 22 nt, Mycobacterium bovis subsp bovis AF2122/97
ggauuccagcagccugcgccgc

SEQ ID NO: 1143047 - RNA, 18 nt, Mycobacterium bovis subsp bovis AF2122/97
ggauucccagucgcggcg

SEQ ID NO: 1143048 - RNA, 20 nt, Mycobacterium bovis subsp bovis AF2122/97
ggaugucgagcccgucgagu

SEQ ID NO: 1143049 - RNA, 15 nt, Mycobacterium bovis subsp bovis AF2122/97
ggauguccgcggcca

SEQ ID NO: 1143050 - RNA, 13 nt, Mycobacterium bovis subsp bovis AF2122/97
ggaugucgauggg

SEQ ID NO: 1143051 - RNA, 20 nt, Mycobacterium bovis subsp bovis AF2122/97
ggauguccuugaaccagcgc

SEQ ID NO: 1143052 - RNA, 22 nt, Mycobacterium bovis subsp bovis AF2122/97
ggauguccuugaaccagcgcgu

SEQ ID NO: 1143053 - RNA, 23 nt, Mycobacterium bovis subsp bovis AF2122/97
ggauguaguuggcgaccugcgcg

SEQ ID NO: 1143054 - RNA, 19 nt, Mycobacterium bovis subsp bovis AF2122/97
ggaugucgacgagcaccgc

SEQ ID NO: 1143055 - RNA, 17 nt, Mycobacterium bovis subsp bovis AF2122/97
ggaugucgucgacgauc

SEQ ID NO: 1143056 - RNA, 19 nt, Mycobacterium bovis subsp bovis AF2122/97
ggaugugguuggugcuggc

SEQ ID NO: 1143057 - RNA, 15 nt, Mycobacterium bovis subsp bovis AF2122/97
ggaugugucggcgag

SEQ ID NO: 1143058 - RNA, 19 nt, Mycobacterium bovis subsp bovis AF2122/97
ggaugugugagucccacgc

SEQ ID NO: 1143059 - RNA, 16 nt, Mycobacterium bovis subsp bovis AF2122/97
ggauggugcggccgcg

SEQ ID NO: 1143060 - RNA, 15 nt, Mycobacterium bovis subsp bovis AF2122/97
ggaugggcucgacgu

SEQ ID NO: 1143061 - RNA, 17 nt, Mycobacterium bovis subsp bovis AF2122/97
ggaugggcugcgcgucg

SEQ ID NO: 1143062 - RNA, 21 nt, Mycobacterium bovis subsp bovis AF2122/97
ggauggcucacccaggcgccg

SEQ ID NO: 1143063 - RNA, 15 nt, Mycobacterium bovis subsp bovis AF2122/97
ggauggcucgccgaa

SEQ ID NO: 1143064 - RNA, 12 nt, Mycobacterium bovis subsp bovis AF2122/97
ggaugccgccgc

SEQ ID NO: 1143065 - RNA, 16 nt, Mycobacterium bovis subsp bovis AF2122/97
ggaugcgaugcgcgcc

SEQ ID NO: 1143066 - RNA, 17 nt, Mycobacterium bovis subsp bovis AF2122/97
ggaugcgaugcgcgccg

SEQ ID NO: 1143067 - RNA, 18 nt, Mycobacterium bovis subsp bovis AF2122/97
ggaugcgauggccgacgc

SEQ ID NO: 1143068 - RNA, 15 nt, Mycobacterium bovis subsp bovis AF2122/97
ggaugcgcaaccgcg

SEQ ID NO: 1143069 - RNA, 13 nt, Mycobacterium bovis subsp bovis AF2122/97
ggaugccgacggc

SEQ ID NO: 1143070 - RNA, 12 nt, Mycobacterium bovis subsp bovis AF2122/97
ggaugcgacccg

SEQ ID NO: 1143071 - RNA, 22 nt, Mycobacterium bovis subsp bovis AF2122/97
ggaugcaugucaaguucgccag

SEQ ID NO: 1143072 - RNA, 17 nt, Mycobacterium bovis subsp bovis AF2122/97
ggaugccgaaccgcgcg

SEQ ID NO: 1143073 - RNA, 23 nt, Mycobacterium bovis subsp bovis AF2122/97
ggauggaaguaaggcacgggugu

SEQ ID NO: 1143074 - RNA, 18 nt, Mycobacterium bovis subsp bovis AF2122/97
ggaugcugucagacggcg

SEQ ID NO: 1143075 - RNA, 21 nt, Mycobacterium bovis subsp bovis AF2122/97
ggauggagccggugacggugu

SEQ ID NO: 1143076 - RNA, 14 nt, Mycobacterium bovis subsp bovis AF2122/97
ggauggcaccaccc

SEQ ID NO: 1143077 - RNA, 14 nt, Mycobacterium bovis subsp bovis AF2122/97
ggauggccgccgac

SEQ ID NO: 1143078 - RNA, 13 nt, Mycobacterium bovis subsp bovis AF2122/97
ggauggcgcccag

SEQ ID NO: 1143079 - RNA, 21 nt, Mycobacterium bovis subsp bovis AF2122/97
ggaugcgcguuacccaucgcc

SEQ ID NO: 1143080 - RNA, 12 nt, Mycobacterium bovis subsp bovis AF2122/97
ggaugcgcggcg

SEQ ID NO: 1143081 - RNA, 13 nt, Mycobacterium bovis subsp bovis AF2122/97
ggaugccggucgg

SEQ ID NO: 1143082 - RNA, 21 nt, Mycobacterium bovis subsp bovis AF2122/97
ggaugcgccgcacggcgacgc

SEQ ID NO: 1143083 - RNA, 16 nt, Mycobacterium bovis subsp bovis AF2122/97
ggaugcugagcgccag

SEQ ID NO: 1143084 - RNA, 22 nt, Mycobacterium bovis subsp bovis AF2122/97
ggaugcucgauccacugccgcg

SEQ ID NO: 1143085 - RNA, 13 nt, Mycobacterium bovis subsp bovis AF2122/97
ggaaaugucgcac

SEQ ID NO: 1143086 - RNA, 22 nt, Mycobacterium bovis subsp bovis AF2122/97
ggaaaucgggaucugcgccgcg

SEQ ID NO: 1143087 - RNA, 17 nt, Mycobacterium bovis subsp bovis AF2122/97
ggaacaaaggcuugcgg

SEQ ID NO: 1143088 - RNA, 21 nt, Mycobacterium bovis subsp bovis AF2122/97
ggaacaacggcguaaucggga

SEQ ID NO: 1143089 - RNA, 20 nt, Mycobacterium bovis subsp bovis AF2122/97
ggaucgccugagcgccgcgg

SEQ ID NO: 1143090 - RNA, 23 nt, Mycobacterium bovis subsp bovis AF2122/97
ggaucgccugagcgccgcggcgg

SEQ ID NO: 1143091 - RNA, 21 nt, Mycobacterium bovis subsp bovis AF2122/97
ggaucgccuuggcgcccgcga

SEQ ID NO: 1143092 - RNA, 24 nt, Mycobacterium bovis subsp bovis AF2122/97
ggaucgcccaggcgcgacguacga

SEQ ID NO: 1143093 - RNA, 17 nt, Mycobacterium bovis subsp bovis AF2122/97
ggaucgccgaaucggca

SEQ ID NO: 1143094 - RNA, 17 nt, Mycobacterium bovis subsp bovis AF2122/97
ggaucgccgagaccgcg

SEQ ID NO: 1143095 - RNA, 16 nt, Mycobacterium bovis subsp bovis AF2122/97
ggaucgaucugcggag

SEQ ID NO: 1143096 - RNA, 19 nt, Mycobacterium bovis subsp bovis AF2122/97
ggaucgauucgucgcggau

SEQ ID NO: 1143097 - RNA, 15 nt, Mycobacterium bovis subsp bovis AF2122/97
ggaucgccaccggcg

SEQ ID NO: 1143098 - RNA, 18 nt, Mycobacterium bovis subsp bovis AF2122/97
ggaucggacaacacggcg

SEQ ID NO: 1143099 - RNA, 15 nt, Mycobacterium bovis subsp bovis AF2122/97
ggaucggcaccccac

SEQ ID NO: 1143100 - RNA, 18 nt, Mycobacterium bovis subsp bovis AF2122/97
ggaucggcggaccgcagc

SEQ ID NO: 1143101 - RNA, 19 nt, Mycobacterium bovis subsp bovis AF2122/97
ggaucggcggaccgcagcg

SEQ ID NO: 1143102 - RNA, 22 nt, Mycobacterium bovis subsp bovis AF2122/97
ggaucggcggccgcgaccagcg

SEQ ID NO: 1143103 - RNA, 23 nt, Mycobacterium bovis subsp bovis AF2122/97
ggaucggcggccgcgaccagcgc

SEQ ID NO: 1143104 - RNA, 15 nt, Mycobacterium bovis subsp bovis AF2122/97
ggaucggcggccggc

SEQ ID NO: 1143105 - RNA, 18 nt, Mycobacterium bovis subsp bovis AF2122/97
ggaucggcggccggcgcc

SEQ ID NO: 1143106 - RNA, 14 nt, Mycobacterium bovis subsp bovis AF2122/97
ggaucgggaccggg

SEQ ID NO: 1143107 - RNA, 21 nt, Mycobacterium bovis subsp bovis AF2122/97
ggaucggcggggucgaacagc

SEQ ID NO: 1143108 - RNA, 16 nt, Mycobacterium bovis subsp bovis AF2122/97
ggaucggcuaccuaac

SEQ ID NO: 1143109 - RNA, 14 nt, Mycobacterium bovis subsp bovis AF2122/97
ggaucgcgcugcgg

SEQ ID NO: 1143110 - RNA, 12 nt, Mycobacterium bovis subsp bovis AF2122/97
ggaucgcggcgg

SEQ ID NO: 1143111 - RNA, 21 nt, Mycobacterium bovis subsp bovis AF2122/97
ggaucgccggggacgccgcgg

SEQ ID NO: 1143112 - RNA, 23 nt, Mycobacterium bovis subsp bovis AF2122/97
ggaucgccggggacgccgcggcg

SEQ ID NO: 1143113 - RNA, 15 nt, Mycobacterium bovis subsp bovis AF2122/97
ggaucgcggcgccgu

SEQ ID NO: 1143114 - RNA, 18 nt, Mycobacterium bovis subsp bovis AF2122/97
ggaucgcggcgccgucgu

SEQ ID NO: 1143115 - RNA, 12 nt, Mycobacterium bovis subsp bovis AF2122/97
ggaucgcggugg

SEQ ID NO: 1143116 - RNA, 18 nt, Mycobacterium bovis subsp bovis AF2122/97
ggaucgcggugggccccg

SEQ ID NO: 1143117 - RNA, 19 nt, Mycobacterium bovis subsp bovis AF2122/97
ggaucgcugccagcggccg

SEQ ID NO: 1143118 - RNA, 16 nt, Mycobacterium bovis subsp bovis AF2122/97
ggaucgcuggccgcga

SEQ ID NO: 1143119 - RNA, 22 nt, Mycobacterium bovis subsp bovis AF2122/97
ggaucggugguacgugcgagcc

SEQ ID NO: 1143120 - RNA, 19 nt, Mycobacterium bovis subsp bovis AF2122/97
ggaucgguuucugcggccc

SEQ ID NO: 1143121 - RNA, 21 nt, Mycobacterium bovis subsp bovis AF2122/97
ggaucgguuucugcggccccg

SEQ ID NO: 1143122 - RNA, 18 nt, Mycobacterium bovis subsp bovis AF2122/97
ggaucggcuccgccgcgg

SEQ ID NO: 1143123 - RNA, 17 nt, Mycobacterium bovis subsp bovis AF2122/97
ggaucgggcccuccggc

SEQ ID NO: 1143124 - RNA, 19 nt, Mycobacterium bovis subsp bovis AF2122/97
ggaucgggcccuccggcgc

SEQ ID NO: 1143125 - RNA, 20 nt, Mycobacterium bovis subsp bovis AF2122/97
ggaucguucgcgugccagcg

SEQ ID NO: 1143126 - RNA, 20 nt, Mycobacterium bovis subsp bovis AF2122/97
ggaucucaccacccgucggc

SEQ ID NO: 1143127 - RNA, 15 nt, Mycobacterium bovis subsp bovis AF2122/97
ggaucgugccggcga

SEQ ID NO: 1143128 - RNA, 15 nt, Mycobacterium bovis subsp bovis AF2122/97
ggaucgucgugcacg

SEQ ID NO: 1143129 - RNA, 19 nt, Mycobacterium bovis subsp bovis AF2122/97
ggaucgucgugcacggcgg

SEQ ID NO: 1143130 - RNA, 17 nt, Mycobacterium bovis subsp bovis AF2122/97
ggaucguccggccgggg

SEQ ID NO: 1143131 - RNA, 20 nt, Mycobacterium bovis subsp bovis AF2122/97
ggaucgucgaacagcaccgc

SEQ ID NO: 1143132 - RNA, 14 nt, Mycobacterium bovis subsp bovis AF2122/97
ggaucugcggaggc

SEQ ID NO: 1143133 - RNA, 16 nt, Mycobacterium bovis subsp bovis AF2122/97
ggaucugcuccgcagc

SEQ ID NO: 1143134 - RNA, 15 nt, Mycobacterium bovis subsp bovis AF2122/97
ggaucugcagcacgc

SEQ ID NO: 1143135 - RNA, 16 nt, Mycobacterium bovis subsp bovis AF2122/97
ggaucucuuucggaug

SEQ ID NO: 1143136 - RNA, 18 nt, Mycobacterium bovis subsp bovis AF2122/97
ggaucuggccuuggcagu

SEQ ID NO: 1143137 - RNA, 17 nt, Mycobacterium bovis subsp bovis AF2122/97
ggaucucgaaggccgcc

SEQ ID NO: 1143138 - RNA, 21 nt, Mycobacterium bovis subsp bovis AF2122/97
ggaucucggugguaauacguc

SEQ ID NO: 1143139 - RNA, 17 nt, Mycobacterium bovis subsp bovis AF2122/97
ggaucugacggcgccgu

SEQ ID NO: 1143140 - RNA, 20 nt, Mycobacterium bovis subsp bovis AF2122/97
ggaucugacggcgccgucga

SEQ ID NO: 1143141 - RNA, 15 nt, Mycobacterium bovis subsp bovis AF2122/97
ggaugaugccggugu

SEQ ID NO: 1143142 - RNA, 21 nt, Mycobacterium bovis subsp bovis AF2122/97
ggaugacgcccagggcgucgg

SEQ ID NO: 1143143 - RNA, 14 nt, Mycobacterium bovis subsp bovis AF2122/97
ggaugagcucggcc

SEQ ID NO: 1143144 - RNA, 20 nt, Mycobacterium bovis subsp bovis AF2122/97
ggaugacgguuugcagcggg

SEQ ID NO: 1143145 - RNA, 16 nt, Mycobacterium bovis subsp bovis AF2122/97
ggaucuuggccagcag

SEQ ID NO: 1143146 - RNA, 19 nt, Mycobacterium bovis subsp bovis AF2122/97
ggaucuuggccagcagcgc

SEQ ID NO: 1143147 - RNA, 19 nt, Mycobacterium bovis subsp bovis AF2122/97
ggaugaagaacgcgagcgc

SEQ ID NO: 1143148 - RNA, 16 nt, Mycobacterium bovis subsp bovis AF2122/97
ggaugaccuuggccgu

SEQ ID NO: 1143149 - RNA, 22 nt, Mycobacterium bovis subsp bovis AF2122/97
ggaugaaguguuuggcguuggg

SEQ ID NO: 1143150 - RNA, 16 nt, Mycobacterium bovis subsp bovis AF2122/97
ggaugacaccgaccgg

SEQ ID NO: 1143151 - RNA, 13 nt, Mycobacterium bovis subsp bovis AF2122/97
ggcgcgaccgcgg

SEQ ID NO: 1143152 - RNA, 14 nt, Mycobacterium bovis subsp bovis AF2122/97
ggcgcgaccggucu

SEQ ID NO: 1143153 - RNA, 13 nt, Mycobacterium bovis subsp bovis AF2122/97
ggcgccucguugc

SEQ ID NO: 1143154 - RNA, 20 nt, Mycobacterium bovis subsp bovis AF2122/97
ggcgccuuccaggcgggcgg

SEQ ID NO: 1143155 - RNA, 14 nt, Mycobacterium bovis subsp bovis AF2122/97
ggcgcgaaacgccg

SEQ ID NO: 1143156 - RNA, 20 nt, Mycobacterium bovis subsp bovis AF2122/97
ggcgccuugguccguagcgc

SEQ ID NO: 1143157 - RNA, 12 nt, Mycobacterium bovis subsp bovis AF2122/97
ggcgcgcuggcg

SEQ ID NO: 1143158 - RNA, 21 nt, Mycobacterium bovis subsp bovis AF2122/97
ggcgcgcugcacggaaucgca

SEQ ID NO: 1143159 - RNA, 13 nt, Mycobacterium bovis subsp bovis AF2122/97
ggcgcgcugcacg

SEQ ID NO: 1143160 - RNA, 14 nt, Mycobacterium bovis subsp bovis AF2122/97
ggcgcgcucaucga

SEQ ID NO: 1143161 - RNA, 21 nt, Mycobacterium bovis subsp bovis AF2122/97
ggcgcgcuaucaugaccaccg

SEQ ID NO: 1143162 - RNA, 19 nt, Mycobacterium bovis subsp bovis AF2122/97
ggcgcgaccagaaucgggc

SEQ ID NO: 1143163 - RNA, 21 nt, Mycobacterium bovis subsp bovis AF2122/97
ggcgcgcggguugucggcgac

SEQ ID NO: 1143164 - RNA, 21 nt, Mycobacterium bovis subsp bovis AF2122/97
ggcgcgcggggaugcgaccgc

SEQ ID NO: 1143165 - RNA, 16 nt, Mycobacterium bovis subsp bovis AF2122/97
ggcgcgcggggccucg

SEQ ID NO: 1143166 - RNA, 20 nt, Mycobacterium bovis subsp bovis AF2122/97
ggcgcgcggggccucgcgag

SEQ ID NO: 1143167 - RNA, 15 nt, Mycobacterium bovis subsp bovis AF2122/97
ggcgcgggucggcga

SEQ ID NO: 1143168 - RNA, 14 nt, Mycobacterium bovis subsp bovis AF2122/97
ggcgcggggccgcc

SEQ ID NO: 1143169 - RNA, 16 nt, Mycobacterium bovis subsp bovis AF2122/97
ggcgcggggcggccug

SEQ ID NO: 1143170 - RNA, 23 nt, Mycobacterium bovis subsp bovis AF2122/97
ggcgcggguccagccaccgaccc

SEQ ID NO: 1143171 - RNA, 24 nt, Mycobacterium bovis subsp bovis AF2122/97
ggcgcgggugaccaggcggcgcgg

SEQ ID NO: 1143172 - RNA, 16 nt, Mycobacterium bovis subsp bovis AF2122/97
ggcgcgggugcgccgg

SEQ ID NO: 1143173 - RNA, 18 nt, Mycobacterium bovis subsp bovis AF2122/97
ggcgcgggugcgccggcg

SEQ ID NO: 1143174 - RNA, 16 nt, Mycobacterium bovis subsp bovis AF2122/97
ggcgcgggugcggauc

SEQ ID NO: 1143175 - RNA, 20 nt, Mycobacterium bovis subsp bovis AF2122/97
ggcgcggucaccgcgucacc

SEQ ID NO: 1143176 - RNA, 16 nt, Mycobacterium bovis subsp bovis AF2122/97
ggcgcgguaccggugu

SEQ ID NO: 1143177 - RNA, 17 nt, Mycobacterium bovis subsp bovis AF2122/97
ggcgcgguaaccacgcg

SEQ ID NO: 1143178 - RNA, 17 nt, Mycobacterium bovis subsp bovis AF2122/97
ggcgcgguaccgcucgg

SEQ ID NO: 1143179 - RNA, 17 nt, Mycobacterium bovis subsp bovis AF2122/97
ggcgcgguuucggcguc

SEQ ID NO: 1143180 - RNA, 22 nt, Mycobacterium bovis subsp bovis AF2122/97
ggcgcguaguaaugcucgacgu

SEQ ID NO: 1143181 - RNA, 18 nt, Mycobacterium bovis subsp bovis AF2122/97
ggcgcggagagccugcuc

SEQ ID NO: 1143182 - RNA, 19 nt, Mycobacterium bovis subsp bovis AF2122/97
ggcgcggagagccugcucg

SEQ ID NO: 1143183 - RNA, 23 nt, Mycobacterium bovis subsp bovis AF2122/97
ggcgcggagagccugcucgcagc

SEQ ID NO: 1143184 - RNA, 18 nt, Mycobacterium bovis subsp bovis AF2122/97
ggcgcggacccgccguga

SEQ ID NO: 1143185 - RNA, 21 nt, Mycobacterium bovis subsp bovis AF2122/97
ggcgcggauacgggcagugaa

SEQ ID NO: 1143186 - RNA, 14 nt, Mycobacterium bovis subsp bovis AF2122/97
ggcgcgggcgccgg

SEQ ID NO: 1143187 - RNA, 18 nt, Mycobacterium bovis subsp bovis AF2122/97
ggcgcgcucaacggcgaa

SEQ ID NO: 1143188 - RNA, 15 nt, Mycobacterium bovis subsp bovis AF2122/97
ggcgcgggccaccac

SEQ ID NO: 1143189 - RNA, 12 nt, Mycobacterium bovis subsp bovis AF2122/97
ggcgcgggccgg

SEQ ID NO: 1143190 - RNA, 18 nt, Mycobacterium bovis subsp bovis AF2122/97
ggcgcgggccggcgacug

SEQ ID NO: 1143191 - RNA, 14 nt, Mycobacterium bovis subsp bovis AF2122/97
ggcgcuggccgucg

SEQ ID NO: 1143192 - RNA, 17 nt, Mycobacterium bovis subsp bovis AF2122/97
ggcgcuggcgggcgauc

SEQ ID NO: 1143193 - RNA, 15 nt, Mycobacterium bovis subsp bovis AF2122/97
ggcgcugcggcgugc

SEQ ID NO: 1143194 - RNA, 17 nt, Mycobacterium bovis subsp bovis AF2122/97
ggcgcugcggcgugccg

SEQ ID NO: 1143195 - RNA, 21 nt, Mycobacterium bovis subsp bovis AF2122/97
ggcgcugcucugagcuugguc

SEQ ID NO: 1143196 - RNA, 12 nt, Mycobacterium bovis subsp bovis AF2122/97
ggcgcugcuggc

SEQ ID NO: 1143197 - RNA, 14 nt, Mycobacterium bovis subsp bovis AF2122/97
ggcgcuggacggcg

SEQ ID NO: 1143198 - RNA, 21 nt, Mycobacterium bovis subsp bovis AF2122/97
ggcgcuggacggcgggccgcg

SEQ ID NO: 1143199 - RNA, 20 nt, Mycobacterium bovis subsp bovis AF2122/97
ggcgcuggaggccaccaccu

SEQ ID NO: 1143200 - RNA, 17 nt, Mycobacterium bovis subsp bovis AF2122/97
ggcgcugaugcgcuggg

SEQ ID NO: 1143201 - RNA, 12 nt, Mycobacterium bovis subsp bovis AF2122/97
ggcgcugaucgc

SEQ ID NO: 1143202 - RNA, 11 nt, Mycobacterium bovis subsp bovis AF2122/97
ggcgcugaucg

SEQ ID NO: 1143203 - RNA, 16 nt, Mycobacterium bovis subsp bovis AF2122/97
ggcgcugaucgcgcgc

SEQ ID NO: 1143204 - RNA, 14 nt, Mycobacterium bovis subsp bovis AF2122/97
ggcgcugaucggca

SEQ ID NO: 1143205 - RNA, 13 nt, Mycobacterium bovis subsp bovis AF2122/97
ggcgcugcagcau

SEQ ID NO: 1143206 - RNA, 16 nt, Mycobacterium bovis subsp bovis AF2122/97
ggcgcugcagcauggc

SEQ ID NO: 1143207 - RNA, 21 nt, Mycobacterium bovis subsp bovis AF2122/97
ggcgcugcccgggcugccgcc

SEQ ID NO: 1143208 - RNA, 17 nt, Mycobacterium bovis subsp bovis AF2122/97
ggcgcucgcgcgcuggg

SEQ ID NO: 1143209 - RNA, 23 nt, Mycobacterium bovis subsp bovis AF2122/97
ggcgcucgcgcgcugggcgcgcu

SEQ ID NO: 1143210 - RNA, 18 nt, Mycobacterium bovis subsp bovis AF2122/97
ggcgcucggccauagcgc

SEQ ID NO: 1143211 - RNA, 13 nt, Mycobacterium bovis subsp bovis AF2122/97
ggcgcucgcgcgc

SEQ ID NO: 1143212 - RNA, 20 nt, Mycobacterium bovis subsp bovis AF2122/97
ggcgcucgcggcggcgcugg

SEQ ID NO: 1143213 - RNA, 17 nt, Mycobacterium bovis subsp bovis AF2122/97
ggcgcucggcgagcaac

SEQ ID NO: 1143214 - RNA, 17 nt, Mycobacterium bovis subsp bovis AF2122/97
ggcgcucgucgcggccc

SEQ ID NO: 1143215 - RNA, 20 nt, Mycobacterium bovis subsp bovis AF2122/97
ggcgcucgucgcggcccgcg

SEQ ID NO: 1143216 - RNA, 15 nt, Mycobacterium bovis subsp bovis AF2122/97
ggcgcugaagccgac

SEQ ID NO: 1143217 - RNA, 17 nt, Mycobacterium bovis subsp bovis AF2122/97
ggcgcugaagccgacga

SEQ ID NO: 1143218 - RNA, 22 nt, Mycobacterium bovis subsp bovis AF2122/97
ggcgcucucguguaucgagcgg

SEQ ID NO: 1143219 - RNA, 23 nt, Mycobacterium bovis subsp bovis AF2122/97
ggcgcucucguguaucgagcggc

SEQ ID NO: 1143220 - RNA, 19 nt, Mycobacterium bovis subsp bovis AF2122/97
ggcgcugaacuagggucgg

SEQ ID NO: 1143221 - RNA, 18 nt, Mycobacterium bovis subsp bovis AF2122/97
ggcgcguugcaccauucg

SEQ ID NO: 1143222 - RNA, 22 nt, Mycobacterium bovis subsp bovis AF2122/97
ggcgcguaggcccaacgacggc

SEQ ID NO: 1143223 - RNA, 16 nt, Mycobacterium bovis subsp bovis AF2122/97
ggcgcguaucgcgucu

SEQ ID NO: 1143224 - RNA, 14 nt, Mycobacterium bovis subsp bovis AF2122/97
ggcgcgucauggcg

SEQ ID NO: 1143225 - RNA, 20 nt, Mycobacterium bovis subsp bovis AF2122/97
ggcgcuaaaacgccagucga

SEQ ID NO: 1143226 - RNA, 13 nt, Mycobacterium bovis subsp bovis AF2122/97
ggcgcuaccagcc

SEQ ID NO: 1143227 - RNA, 23 nt, Mycobacterium bovis subsp bovis AF2122/97
ggcgcuaccagccauagugcggc

SEQ ID NO: 1143228 - RNA, 12 nt, Mycobacterium bovis subsp bovis AF2122/97
ggcggcugucgg

SEQ ID NO: 1143229 - RNA, 14 nt, Mycobacterium bovis subsp bovis AF2122/97
ggcggcugccgguu

SEQ ID NO: 1143230 - RNA, 13 nt, Mycobacterium bovis subsp bovis AF2122/97
ggcggcgggggcg

SEQ ID NO: 1143231 - RNA, 18 nt, Mycobacterium bovis subsp bovis AF2122/97
ggcggcuuccucgagcga

SEQ ID NO: 1143232 - RNA, 19 nt, Mycobacterium bovis subsp bovis AF2122/97
ggcggcuucgacgucggcg

SEQ ID NO: 1143233 - RNA, 19 nt, Mycobacterium bovis subsp bovis AF2122/97
ggcggcuguugcggcggcg

SEQ ID NO: 1143234 - RNA, 20 nt, Mycobacterium bovis subsp bovis AF2122/97
ggcggcuuagaacgugcugg

SEQ ID NO: 1143235 - RNA, 14 nt, Mycobacterium bovis subsp bovis AF2122/97
ggcggcuucgcccc

SEQ ID NO: 1143236 - RNA, 15 nt, Mycobacterium bovis subsp bovis AF2122/97
ggcggcuucgccgac

SEQ ID NO: 1143237 - RNA, 17 nt, Mycobacterium bovis subsp bovis AF2122/97
ggcggcuucgauugcgc

SEQ ID NO: 1143238 - RNA, 23 nt, Mycobacterium bovis subsp bovis AF2122/97
ggcggcuucgauugcgcugcacc

SEQ ID NO: 1143239 - RNA, 14 nt, Mycobacterium bovis subsp bovis AF2122/97
ggcgggccaccgua

SEQ ID NO: 1143240 - RNA, 17 nt, Mycobacterium bovis subsp bovis AF2122/97
ggcggcugucggccggg

SEQ ID NO: 1143241 - RNA, 24 nt, Mycobacterium bovis subsp bovis AF2122/97
ggcggcuugaucagccgccaaccg

SEQ ID NO: 1143242 - RNA, 13 nt, Mycobacterium bovis subsp bovis AF2122/97
ggcggcuuggccg

SEQ ID NO: 1143243 - RNA, 15 nt, Mycobacterium bovis subsp bovis AF2122/97
ggcggcugaacggca

SEQ ID NO: 1143244 - RNA, 18 nt, Mycobacterium bovis subsp bovis AF2122/97
ggcggcugcacgcugcgg

SEQ ID NO: 1143245 - RNA, 17 nt, Mycobacterium bovis subsp bovis AF2122/97
ggcggcugcagccgacc

SEQ ID NO: 1143246 - RNA, 21 nt, Mycobacterium bovis subsp bovis AF2122/97
ggcggcgucgacggcuccucc

SEQ ID NO: 1143247 - RNA, 11 nt, Mycobacterium bovis subsp bovis AF2122/97
ggcggcgucgc

SEQ ID NO: 1143248 - RNA, 15 nt, Mycobacterium bovis subsp bovis AF2122/97
ggcggcgucgcgguu

SEQ ID NO: 1143249 - RNA, 15 nt, Mycobacterium bovis subsp bovis AF2122/97
ggcggcggucggcug

SEQ ID NO: 1143250 - RNA, 15 nt, Mycobacterium bovis subsp bovis AF2122/97
ggcggcggucaccac

SEQ ID NO: 1143251 - RNA, 12 nt, Mycobacterium bovis subsp bovis AF2122/97
ggcggcggucga

SEQ ID NO: 1143252 - RNA, 20 nt, Mycobacterium bovis subsp bovis AF2122/97
ggcggcggugggcgcggacc

SEQ ID NO: 1143253 - RNA, 17 nt, Mycobacterium bovis subsp bovis AF2122/97
ggcggcgguggccagcg

SEQ ID NO: 1143254 - RNA, 12 nt, Mycobacterium bovis subsp bovis AF2122/97
ggcggccgcggc

SEQ ID NO: 1143255 - RNA, 13 nt, Mycobacterium bovis subsp bovis AF2122/97
ggcggccucgggc

SEQ ID NO: 1143256 - RNA, 19 nt, Mycobacterium bovis subsp bovis AF2122/97
ggcggccucggggccggag

SEQ ID NO: 1143257 - RNA, 23 nt, Mycobacterium bovis subsp bovis AF2122/97
ggcggccuggucggccaggucga

SEQ ID NO: 1143258 - RNA, 19 nt, Mycobacterium bovis subsp bovis AF2122/97
ggcggccuucggccggcgu

SEQ ID NO: 1143259 - RNA, 14 nt, Mycobacterium bovis subsp bovis AF2122/97
ggcggccuugccgg

SEQ ID NO: 1143260 - RNA, 22 nt, Mycobacterium bovis subsp bovis AF2122/97
ggcggccuugccgggccgcgcg

SEQ ID NO: 1143261 - RNA, 24 nt, Mycobacterium bovis subsp bovis AF2122/97
ggcggccuugccgggccgcgcggg

SEQ ID NO: 1143262 - RNA, 22 nt, Mycobacterium bovis subsp bovis AF2122/97
ggcggccuugcucagcacgccg

SEQ ID NO: 1143263 - RNA, 19 nt, Mycobacterium bovis subsp bovis AF2122/97
ggcggcgaggcggucgccg

SEQ ID NO: 1143264 - RNA, 22 nt, Mycobacterium bovis subsp bovis AF2122/97
ggcggcgagguauaaacgcggc

SEQ ID NO: 1143265 - RNA, 22 nt, Mycobacterium bovis subsp bovis AF2122/97
ggcggcgcaccuugaccgucgc

SEQ ID NO: 1143266 - RNA, 16 nt, Mycobacterium bovis subsp bovis AF2122/97
ggcggcggcggcaagu

SEQ ID NO: 1143267 - RNA, 14 nt, Mycobacterium bovis subsp bovis AF2122/97
ggcggcggcgucgg

SEQ ID NO: 1143268 - RNA, 23 nt, Mycobacterium bovis subsp bovis AF2122/97
ggcggcggcuguugcggcggcgc

SEQ ID NO: 1143269 - RNA, 13 nt, Mycobacterium bovis subsp bovis AF2122/97
ggcggcgggguga

SEQ ID NO: 1143270 - RNA, 21 nt, Mycobacterium bovis subsp bovis AF2122/97
ggcggcggggacucugccacc

SEQ ID NO: 1143271 - RNA, 12 nt, Mycobacterium bovis subsp bovis AF2122/97
ggcggcgcccgg

SEQ ID NO: 1143272 - RNA, 19 nt, Mycobacterium bovis subsp bovis AF2122/97
ggcggcgcaucaccuccgc

SEQ ID NO: 1143273 - RNA, 18 nt, Mycobacterium bovis subsp bovis AF2122/97
ggcggcgaugaccgggcg

SEQ ID NO: 1143274 - RNA, 20 nt, Mycobacterium bovis subsp bovis AF2122/97
ggcggcgaugguaucgccgc

SEQ ID NO: 1143275 - RNA, 22 nt, Mycobacterium bovis subsp bovis AF2122/97
ggcggaucccgaggcgcccaac

SEQ ID NO: 1143276 - RNA, 14 nt, Mycobacterium bovis subsp bovis AF2122/97
ggcggauucggcgc

SEQ ID NO: 1143277 - RNA, 19 nt, Mycobacterium bovis subsp bovis AF2122/97
ggcggauucggcgcugcgg

SEQ ID NO: 1143278 - RNA, 20 nt, Mycobacterium bovis subsp bovis AF2122/97
ggcggaucgugcccuguccg

SEQ ID NO: 1143279 - RNA, 18 nt, Mycobacterium bovis subsp bovis AF2122/97
ggcggaucugaucggcgc

SEQ ID NO: 1143280 - RNA, 16 nt, Mycobacterium bovis subsp bovis AF2122/97
ggcggaucgcgagcgc

SEQ ID NO: 1143281 - RNA, 22 nt, Mycobacterium bovis subsp bovis AF2122/97
ggcgcuucugcuacccgagccg

SEQ ID NO: 1143282 - RNA, 24 nt, Mycobacterium bovis subsp bovis AF2122/97
ggcgcuucugcuacccgagccggc

SEQ ID NO: 1143283 - RNA, 17 nt, Mycobacterium bovis subsp bovis AF2122/97
ggcgcuggucgcggugg

SEQ ID NO: 1143284 - RNA, 18 nt, Mycobacterium bovis subsp bovis AF2122/97
ggcgcuggugcgccacgc

SEQ ID NO: 1143285 - RNA, 16 nt, Mycobacterium bovis subsp bovis AF2122/97
ggcgcugguuggcacg

SEQ ID NO: 1143286 - RNA, 17 nt, Mycobacterium bovis subsp bovis AF2122/97
ggcgcugggguccgcgu

SEQ ID NO: 1143287 - RNA, 13 nt, Mycobacterium bovis subsp bovis AF2122/97
ggcggcccccggc

SEQ ID NO: 1143288 - RNA, 12 nt, Mycobacterium bovis subsp bovis AF2122/97
ggcggccccggc

SEQ ID NO: 1143289 - RNA, 14 nt, Mycobacterium bovis subsp bovis AF2122/97
ggcggccccggcau

SEQ ID NO: 1143290 - RNA, 12 nt, Mycobacterium bovis subsp bovis AF2122/97
ggcggcccaccg

SEQ ID NO: 1143291 - RNA, 14 nt, Mycobacterium bovis subsp bovis AF2122/97
ggcggcccaccggc

SEQ ID NO: 1143292 - RNA, 15 nt, Mycobacterium bovis subsp bovis AF2122/97
ggcggcccaccggcc

SEQ ID NO: 1143293 - RNA, 19 nt, Mycobacterium bovis subsp bovis AF2122/97
ggcggccauucggucagcc

SEQ ID NO: 1143294 - RNA, 21 nt, Mycobacterium bovis subsp bovis AF2122/97
ggcggcccgcagcccgccggg

SEQ ID NO: 1143295 - RNA, 17 nt, Mycobacterium bovis subsp bovis AF2122/97
ggcggcccggucuacgc

SEQ ID NO: 1143296 - RNA, 19 nt, Mycobacterium bovis subsp bovis AF2122/97
ggcggcccguuugccgguu

SEQ ID NO: 1143297 - RNA, 12 nt, Mycobacterium bovis subsp bovis AF2122/97
ggcggcccgaua

SEQ ID NO: 1143298 - RNA, 13 nt, Mycobacterium bovis subsp bovis AF2122/97
ggcggcccgaucc

SEQ ID NO: 1143299 - RNA, 14 nt, Mycobacterium bovis subsp bovis AF2122/97
ggcggcccggugga

SEQ ID NO: 1143300 - RNA, 22 nt, Mycobacterium bovis subsp bovis AF2122/97
ggcggccccggcauugcccgag

SEQ ID NO: 1143301 - RNA, 19 nt, Mycobacterium bovis subsp bovis AF2122/97
ggcggcccuaaacaccgcg

SEQ ID NO: 1143302 - RNA, 14 nt, Mycobacterium bovis subsp bovis AF2122/97
ggcggccgcagcgg

SEQ ID NO: 1143303 - RNA, 15 nt, Mycobacterium bovis subsp bovis AF2122/97
ggcggccgcagcggc

SEQ ID NO: 1143304 - RNA, 13 nt, Mycobacterium bovis subsp bovis AF2122/97
ggcggccgccgcg

SEQ ID NO: 1143305 - RNA, 13 nt, Mycobacterium bovis subsp bovis AF2122/97
ggcggcaucggcg

SEQ ID NO: 1143306 - RNA, 16 nt, Mycobacterium bovis subsp bovis AF2122/97
ggcggcauccugcacg

SEQ ID NO: 1143307 - RNA, 17 nt, Mycobacterium bovis subsp bovis AF2122/97
ggcggcauacauccagg

SEQ ID NO: 1143308 - RNA, 22 nt, Mycobacterium bovis subsp bovis AF2122/97
ggcggcauagcucagaccggcg

SEQ ID NO: 1143309 - RNA, 14 nt, Mycobacterium bovis subsp bovis AF2122/97
ggcggccaguucgg

SEQ ID NO: 1143310 - RNA, 14 nt, Mycobacterium bovis subsp bovis AF2122/97
ggcggcagcugcug

SEQ ID NO: 1143311 - RNA, 13 nt, Mycobacterium bovis subsp bovis AF2122/97
ggcggcaucgaua

SEQ ID NO: 1143312 - RNA, 23 nt, Mycobacterium bovis subsp bovis AF2122/97
ggcggccaggugcaggcuucugg

SEQ ID NO: 1143313 - RNA, 23 nt, Mycobacterium bovis subsp bovis AF2122/97
ggcggccaucgacgacacguuga

SEQ ID NO: 1143314 - RNA, 16 nt, Mycobacterium bovis subsp bovis AF2122/97
ggcggcagcggcgauc

SEQ ID NO: 1143315 - RNA, 17 nt, Mycobacterium bovis subsp bovis AF2122/97
ggcggcagcggcguagc

SEQ ID NO: 1143316 - RNA, 21 nt, Mycobacterium bovis subsp bovis AF2122/97
ggcggcaggugcggcggcauc

SEQ ID NO: 1143317 - RNA, 14 nt, Mycobacterium bovis subsp bovis AF2122/97
ggcgcccagcucga

SEQ ID NO: 1143318 - RNA, 14 nt, Mycobacterium bovis subsp bovis AF2122/97
ggcgcccagcucgu

SEQ ID NO: 1143319 - RNA, 15 nt, Mycobacterium bovis subsp bovis AF2122/97
ggcgcccagcgcuag

SEQ ID NO: 1143320 - RNA, 17 nt, Mycobacterium bovis subsp bovis AF2122/97
ggcgcccagcucgucga

SEQ ID NO: 1143321 - RNA, 21 nt, Mycobacterium bovis subsp bovis AF2122/97
ggcgccccagggggcgugccg

SEQ ID NO: 1143322 - RNA, 14 nt, Mycobacterium bovis subsp bovis AF2122/97
ggcgccccaccggc

SEQ ID NO: 1143323 - RNA, 14 nt, Mycobacterium bovis subsp bovis AF2122/97
ggcgcccccgacga

SEQ ID NO: 1143324 - RNA, 23 nt, Mycobacterium bovis subsp bovis AF2122/97
ggcgccgaccacauuccgcaguc

SEQ ID NO: 1143325 - RNA, 15 nt, Mycobacterium bovis subsp bovis AF2122/97
ggcgcccgagaccgg

SEQ ID NO: 1143326 - RNA, 21 nt, Mycobacterium bovis subsp bovis AF2122/97
ggcgcccgagauccccaaauc

SEQ ID NO: 1143327 - RNA, 21 nt, Mycobacterium bovis subsp bovis AF2122/97
ggcgcccccgccauugccgcc

SEQ ID NO: 1143328 - RNA, 17 nt, Mycobacterium bovis subsp bovis AF2122/97
ggcgccgacgacuccgg

SEQ ID NO: 1143329 - RNA, 22 nt, Mycobacterium bovis subsp bovis AF2122/97
ggcgccgacgacuccggcaagc

SEQ ID NO: 1143330 - RNA, 19 nt, Mycobacterium bovis subsp bovis AF2122/97
ggcgccgagcagcccgcgg

SEQ ID NO: 1143331 - RNA, 13 nt, Mycobacterium bovis subsp bovis AF2122/97
ggcgccgaggucg

SEQ ID NO: 1143332 - RNA, 22 nt, Mycobacterium bovis subsp bovis AF2122/97
ggcgccgauaccggcggcgagc

SEQ ID NO: 1143333 - RNA, 14 nt, Mycobacterium bovis subsp bovis AF2122/97
ggcgccgaugaccg

SEQ ID NO: 1143334 - RNA, 19 nt, Mycobacterium bovis subsp bovis AF2122/97
ggcgccgaugaccgcaacc

SEQ ID NO: 1143335 - RNA, 17 nt, Mycobacterium bovis subsp bovis AF2122/97
ggcgccgccggcgccgc

SEQ ID NO: 1143336 - RNA, 14 nt, Mycobacterium bovis subsp bovis AF2122/97
ggcgccgccggugc

SEQ ID NO: 1143337 - RNA, 18 nt, Mycobacterium bovis subsp bovis AF2122/97
ggcgccgccggugccacc

SEQ ID NO: 1143338 - RNA, 11 nt, Mycobacterium bovis subsp bovis AF2122/97
ggcgccgccgu

SEQ ID NO: 1143339 - RNA, 18 nt, Mycobacterium bovis subsp bovis AF2122/97
ggcgccgccguugccgcc

SEQ ID NO: 1143340 - RNA, 15 nt, Mycobacterium bovis subsp bovis AF2122/97
ggcgccgccguuacc

SEQ ID NO: 1143341 - RNA, 22 nt, Mycobacterium bovis subsp bovis AF2122/97
ggcgccgccguuaccgccggcg

SEQ ID NO: 1143342 - RNA, 22 nt, Mycobacterium bovis subsp bovis AF2122/97
ggcgccgccguucccgccggcg

SEQ ID NO: 1143343 - RNA, 18 nt, Mycobacterium bovis subsp bovis AF2122/97
ggcgccgccuggacgccg

SEQ ID NO: 1143344 - RNA, 14 nt, Mycobacterium bovis subsp bovis AF2122/97
ggcgccgccgucgc

SEQ ID NO: 1143345 - RNA, 15 nt, Mycobacterium bovis subsp bovis AF2122/97
ggcgccgccgucgcc

SEQ ID NO: 1143346 - RNA, 13 nt, Mycobacterium bovis subsp bovis AF2122/97
ggcgccgcgccga

SEQ ID NO: 1143347 - RNA, 14 nt, Mycobacterium bovis subsp bovis AF2122/97
ggcgccgcggcugg

SEQ ID NO: 1143348 - RNA, 15 nt, Mycobacterium bovis subsp bovis AF2122/97
ggcgccggagccgcc

SEQ ID NO: 1143349 - RNA, 17 nt, Mycobacterium bovis subsp bovis AF2122/97
ggcgccggcaucgguca

SEQ ID NO: 1143350 - RNA, 14 nt, Mycobacterium bovis subsp bovis AF2122/97
ggcgccggccagcc

SEQ ID NO: 1143351 - RNA, 13 nt, Mycobacterium bovis subsp bovis AF2122/97
ggcgccggccagu

SEQ ID NO: 1143352 - RNA, 17 nt, Mycobacterium bovis subsp bovis AF2122/97
ggcgccggggccgccga

SEQ ID NO: 1143353 - RNA, 22 nt, Mycobacterium bovis subsp bovis AF2122/97
ggcgccggggccgccgaugcca

SEQ ID NO: 1143354 - RNA, 19 nt, Mycobacterium bovis subsp bovis AF2122/97
ggcgccggggggcugcugc

SEQ ID NO: 1143355 - RNA, 22 nt, Mycobacterium bovis subsp bovis AF2122/97
ggcgccggaacgagcggccgcg

SEQ ID NO: 1143356 - RNA, 12 nt, Mycobacterium bovis subsp bovis AF2122/97
ggcgccggguca

SEQ ID NO: 1143357 - RNA, 15 nt, Mycobacterium bovis subsp bovis AF2122/97
ggcgccggugccgcc

SEQ ID NO: 1143358 - RNA, 22 nt, Mycobacterium bovis subsp bovis AF2122/97
ggcgccgucaauggaaccgguu

SEQ ID NO: 1143359 - RNA, 12 nt, Mycobacterium bovis subsp bovis AF2122/97
ggcgccgguggu

SEQ ID NO: 1143360 - RNA, 22 nt, Mycobacterium bovis subsp bovis AF2122/97
ggcgccggugguaccggcggcg

SEQ ID NO: 1143361 - RNA, 21 nt, Mycobacterium bovis subsp bovis AF2122/97
ggcgccgguguuuccgaaacc

SEQ ID NO: 1143362 - RNA, 15 nt, Mycobacterium bovis subsp bovis AF2122/97
ggcgccgucgaugac

SEQ ID NO: 1143363 - RNA, 18 nt, Mycobacterium bovis subsp bovis AF2122/97
ggcgccugaugcggccgg

SEQ ID NO: 1143364 - RNA, 19 nt, Mycobacterium bovis subsp bovis AF2122/97
ggcgccugaugcggccggc

SEQ ID NO: 1143365 - RNA, 22 nt, Mycobacterium bovis subsp bovis AF2122/97
ggcgcccagcgacaacaccacg

SEQ ID NO: 1143366 - RNA, 18 nt, Mycobacterium bovis subsp bovis AF2122/97
ggcgccauccccgccggc

SEQ ID NO: 1143367 - RNA, 20 nt, Mycobacterium bovis subsp bovis AF2122/97
ggcgccaucgggucaccccc

SEQ ID NO: 1143368 - RNA, 21 nt, Mycobacterium bovis subsp bovis AF2122/97
ggcgcaugugaaagacaaccc

SEQ ID NO: 1143369 - RNA, 17 nt, Mycobacterium bovis subsp bovis AF2122/97
ggcgcauuccggcgcca

SEQ ID NO: 1143370 - RNA, 21 nt, Mycobacterium bovis subsp bovis AF2122/97
ggcgccauagccgcgacccgc

SEQ ID NO: 1143371 - RNA, 12 nt, Mycobacterium bovis subsp bovis AF2122/97
ggcgcagcgcca

SEQ ID NO: 1143372 - RNA, 13 nt, Mycobacterium bovis subsp bovis AF2122/97
ggcgcagcgccag

SEQ ID NO: 1143373 - RNA, 20 nt, Mycobacterium bovis subsp bovis AF2122/97
ggcgcagccugccgaugacg

SEQ ID NO: 1143374 - RNA, 13 nt, Mycobacterium bovis subsp bovis AF2122/97
ggcgcagcgccau

SEQ ID NO: 1143375 - RNA, 22 nt, Mycobacterium bovis subsp bovis AF2122/97
ggcgcaucagcuuuugcaccgg

SEQ ID NO: 1143376 - RNA, 14 nt, Mycobacterium bovis subsp bovis AF2122/97
ggcgcauaggcggc

SEQ ID NO: 1143377 - RNA, 17 nt, Mycobacterium bovis subsp bovis AF2122/97
ggcgcauagggccaccg

SEQ ID NO: 1143378 - RNA, 13 nt, Mycobacterium bovis subsp bovis AF2122/97
ggcgcaucaccac

SEQ ID NO: 1143379 - RNA, 19 nt, Mycobacterium bovis subsp bovis AF2122/97
ggcgcauuggccugaugca

SEQ ID NO: 1143380 - RNA, 16 nt, Mycobacterium bovis subsp bovis AF2122/97
ggcgcagagucaacgu

SEQ ID NO: 1143381 - RNA, 17 nt, Mycobacterium bovis subsp bovis AF2122/97
ggcgcagcaccgucggc

SEQ ID NO: 1143382 - RNA, 12 nt, Mycobacterium bovis subsp bovis AF2122/97
ggcgcagcaccg

SEQ ID NO: 1143383 - RNA, 15 nt, Mycobacterium bovis subsp bovis AF2122/97
ggcgcagcacggcgg

SEQ ID NO: 1143384 - RNA, 18 nt, Mycobacterium bovis subsp bovis AF2122/97
ggcgcagcaucucgucga

SEQ ID NO: 1143385 - RNA, 20 nt, Mycobacterium bovis subsp bovis AF2122/97
ggcgcagcaucucgucgauc

SEQ ID NO: 1143386 - RNA, 20 nt, Mycobacterium bovis subsp bovis AF2122/97
ggcgcaccggagucgcccgg

SEQ ID NO: 1143387 - RNA, 19 nt, Mycobacterium bovis subsp bovis AF2122/97
ggcgcaccggcgucggcgc

SEQ ID NO: 1143388 - RNA, 23 nt, Mycobacterium bovis subsp bovis AF2122/97
ggcgcaccuccugcgagugcggc

SEQ ID NO: 1143389 - RNA, 18 nt, Mycobacterium bovis subsp bovis AF2122/97
ggcgauugauccgguggc

SEQ ID NO: 1143390 - RNA, 22 nt, Mycobacterium bovis subsp bovis AF2122/97
ggcgcaccaucgcggccgcugg

SEQ ID NO: 1143391 - RNA, 19 nt, Mycobacterium bovis subsp bovis AF2122/97
ggcgcaccugggcugccgg

SEQ ID NO: 1143392 - RNA, 16 nt, Mycobacterium bovis subsp bovis AF2122/97
ggcgcacgaaaccgca

SEQ ID NO: 1143393 - RNA, 17 nt, Mycobacterium bovis subsp bovis AF2122/97
ggcgcacgaaaccgcag

SEQ ID NO: 1143394 - RNA, 18 nt, Mycobacterium bovis subsp bovis AF2122/97
ggcgcacgaaaccgcagc

SEQ ID NO: 1143395 - RNA, 20 nt, Mycobacterium bovis subsp bovis AF2122/97
ggcgcacgaaaccgcagcgc

SEQ ID NO: 1143396 - RNA, 14 nt, Mycobacterium bovis subsp bovis AF2122/97
ggcgcacgauggug

SEQ ID NO: 1143397 - RNA, 12 nt, Mycobacterium bovis subsp bovis AF2122/97
ggcgcaccaccg

SEQ ID NO: 1143398 - RNA, 21 nt, Mycobacterium bovis subsp bovis AF2122/97
ggcgcaacaccucguaugccg

SEQ ID NO: 1143399 - RNA, 21 nt, Mycobacterium bovis subsp bovis AF2122/97
ggcgcaccaccgccccgcgcc

SEQ ID NO: 1143400 - RNA, 15 nt, Mycobacterium bovis subsp bovis AF2122/97
ggcgcaccagggagc

SEQ ID NO: 1143401 - RNA, 20 nt, Mycobacterium bovis subsp bovis AF2122/97
ggcgagguauaaacgcggcg

SEQ ID NO: 1143402 - RNA, 20 nt, Mycobacterium bovis subsp bovis AF2122/97
ggcgagggugaagacaccgg

SEQ ID NO: 1143403 - RNA, 16 nt, Mycobacterium bovis subsp bovis AF2122/97
ggcgaggucccggccg

SEQ ID NO: 1143404 - RNA, 17 nt, Mycobacterium bovis subsp bovis AF2122/97
ggcgaggucccggccga

SEQ ID NO: 1143405 - RNA, 15 nt, Mycobacterium bovis subsp bovis AF2122/97
ggcgagucccggcgg

SEQ ID NO: 1143406 - RNA, 18 nt, Mycobacterium bovis subsp bovis AF2122/97
ggcgaguacaggcgcagc

SEQ ID NO: 1143407 - RNA, 16 nt, Mycobacterium bovis subsp bovis AF2122/97
ggcgaggugcucggau

SEQ ID NO: 1143408 - RNA, 16 nt, Mycobacterium bovis subsp bovis AF2122/97
ggcgagguggucacgc

SEQ ID NO: 1143409 - RNA, 22 nt, Mycobacterium bovis subsp bovis AF2122/97
ggcgagguggucacgcagucgg

SEQ ID NO: 1143410 - RNA, 17 nt, Mycobacterium bovis subsp bovis AF2122/97
ggcgaggauguaguugg

SEQ ID NO: 1143411 - RNA, 21 nt, Mycobacterium bovis subsp bovis AF2122/97
ggcgaggccucggcggccgug

SEQ ID NO: 1143412 - RNA, 22 nt, Mycobacterium bovis subsp bovis AF2122/97
ggcgaggccucggcggccgugg

SEQ ID NO: 1143413 - RNA, 18 nt, Mycobacterium bovis subsp bovis AF2122/97
ggcgaggcgagucaccgg

SEQ ID NO: 1143414 - RNA, 14 nt, Mycobacterium bovis subsp bovis AF2122/97
ggcgaggcagcacc

SEQ ID NO: 1143415 - RNA, 14 nt, Mycobacterium bovis subsp bovis AF2122/97
ggccuggccccggc

SEQ ID NO: 1143416 - RNA, 20 nt, Mycobacterium bovis subsp bovis AF2122/97
ggccuggccccggcugucgg

SEQ ID NO: 1143417 - RNA, 13 nt, Mycobacterium bovis subsp bovis AF2122/97
ggccugggccgca

SEQ ID NO: 1143418 - RNA, 14 nt, Mycobacterium bovis subsp bovis AF2122/97
ggccugggccgcac

SEQ ID NO: 1143419 - RNA, 13 nt, Mycobacterium bovis subsp bovis AF2122/97
ggccuggccugcc

SEQ ID NO: 1143420 - RNA, 14 nt, Mycobacterium bovis subsp bovis AF2122/97
ggccuggcacccgg

SEQ ID NO: 1143421 - RNA, 19 nt, Mycobacterium bovis subsp bovis AF2122/97
ggccugcuugucaacccgg

SEQ ID NO: 1143422 - RNA, 23 nt, Mycobacterium bovis subsp bovis AF2122/97
ggcgauccacaggcugaagacga

SEQ ID NO: 1143423 - RNA, 20 nt, Mycobacterium bovis subsp bovis AF2122/97
ggcgaucgcaagcgcggcga

SEQ ID NO: 1143424 - RNA, 14 nt, Mycobacterium bovis subsp bovis AF2122/97
ggcgaucgcauccg

SEQ ID NO: 1143425 - RNA, 17 nt, Mycobacterium bovis subsp bovis AF2122/97
ggcgaucgcauccgcgg

SEQ ID NO: 1143426 - RNA, 17 nt, Mycobacterium bovis subsp bovis AF2122/97
ggcgauccggucggcca

SEQ ID NO: 1143427 - RNA, 14 nt, Mycobacterium bovis subsp bovis AF2122/97
ggcgaucagcagcc

SEQ ID NO: 1143428 - RNA, 21 nt, Mycobacterium bovis subsp bovis AF2122/97
ggcgaucagcagccgccgaug

SEQ ID NO: 1143429 - RNA, 20 nt, Mycobacterium bovis subsp bovis AF2122/97
ggcgauccagaacaacggcg

SEQ ID NO: 1143430 - RNA, 22 nt, Mycobacterium bovis subsp bovis AF2122/97
ggcgauccagaacaacggcgcg

SEQ ID NO: 1143431 - RNA, 20 nt, Mycobacterium bovis subsp bovis AF2122/97
ggcgauauuggacgcgcaug

SEQ ID NO: 1143432 - RNA, 18 nt, Mycobacterium bovis subsp bovis AF2122/97
ggcgaucaaagccagcac

SEQ ID NO: 1143433 - RNA, 16 nt, Mycobacterium bovis subsp bovis AF2122/97
ggcgaucaaccgcugu

SEQ ID NO: 1143434 - RNA, 15 nt, Mycobacterium bovis subsp bovis AF2122/97
ggcgauaucgcccgg

SEQ ID NO: 1143435 - RNA, 14 nt, Mycobacterium bovis subsp bovis AF2122/97
ggcgauaucggccc

SEQ ID NO: 1143436 - RNA, 18 nt, Mycobacterium bovis subsp bovis AF2122/97
ggcgauagucauucgcuc

SEQ ID NO: 1143437 - RNA, 17 nt, Mycobacterium bovis subsp bovis AF2122/97
ggcgauaucggccccca

SEQ ID NO: 1143438 - RNA, 22 nt, Mycobacterium bovis subsp bovis AF2122/97
ggcgauaaccgacgaucaacgg

SEQ ID NO: 1143439 - RNA, 20 nt, Mycobacterium bovis subsp bovis AF2122/97
ggcgagugggauucugacga

SEQ ID NO: 1143440 - RNA, 24 nt, Mycobacterium bovis subsp bovis AF2122/97
ggcgagugggauucugacgaccgg

SEQ ID NO: 1143441 - RNA, 20 nt, Mycobacterium bovis subsp bovis AF2122/97
ggcgaguuaggccgccagcc

SEQ ID NO: 1143442 - RNA, 23 nt, Mycobacterium bovis subsp bovis AF2122/97
ggcgauaaggaccgcgcccagac

SEQ ID NO: 1143443 - RNA, 21 nt, Mycobacterium bovis subsp bovis AF2122/97
ggcgauacgcgcgucggguau

SEQ ID NO: 1143444 - RNA, 16 nt, Mycobacterium bovis subsp bovis AF2122/97
ggcgaugccgaugucg

SEQ ID NO: 1143445 - RNA, 17 nt, Mycobacterium bovis subsp bovis AF2122/97
ggcgaugcgcaccagca

SEQ ID NO: 1143446 - RNA, 18 nt, Mycobacterium bovis subsp bovis AF2122/97
ggcgaugcguccgcccag

SEQ ID NO: 1143447 - RNA, 14 nt, Mycobacterium bovis subsp bovis AF2122/97
ggcgauggcaccgu

SEQ ID NO: 1143448 - RNA, 14 nt, Mycobacterium bovis subsp bovis AF2122/97
ggcgauggcggcau

SEQ ID NO: 1143449 - RNA, 23 nt, Mycobacterium bovis subsp bovis AF2122/97
ggcgaugggucugguguccaccg

SEQ ID NO: 1143450 - RNA, 13 nt, Mycobacterium bovis subsp bovis AF2122/97
ggcgauggucggg

SEQ ID NO: 1143451 - RNA, 16 nt, Mycobacterium bovis subsp bovis AF2122/97
ggcgauggucuccucg

SEQ ID NO: 1143452 - RNA, 15 nt, Mycobacterium bovis subsp bovis AF2122/97
ggcgauuacggccag

SEQ ID NO: 1143453 - RNA, 18 nt, Mycobacterium bovis subsp bovis AF2122/97
ggcgaugucggcuggugg

SEQ ID NO: 1143454 - RNA, 19 nt, Mycobacterium bovis subsp bovis AF2122/97
ggcgauucugcgucugcuc

SEQ ID NO: 1143455 - RNA, 12 nt, Mycobacterium bovis subsp bovis AF2122/97
ggcgauucccgc

SEQ ID NO: 1143456 - RNA, 23 nt, Mycobacterium bovis subsp bovis AF2122/97
ggcgauucugcgucugcucggcg

SEQ ID NO: 1143457 - RNA, 19 nt, Mycobacterium bovis subsp bovis AF2122/97
ggcgauucugugucugcuc

SEQ ID NO: 1143458 - RNA, 24 nt, Mycobacterium bovis subsp bovis AF2122/97
ggcgauuggcugugaucgagucgc

SEQ ID NO: 1143459 - RNA, 22 nt, Mycobacterium bovis subsp bovis AF2122/97
ggcgauuugcuugcgcguggca

SEQ ID NO: 1143460 - RNA, 22 nt, Mycobacterium bovis subsp bovis AF2122/97
ggcgauuuccaucgcgaccucg

SEQ ID NO: 1143461 - RNA, 20 nt, Mycobacterium bovis subsp bovis AF2122/97
ggcgauuuugcgucugcucg

SEQ ID NO: 1143462 - RNA, 23 nt, Mycobacterium bovis subsp bovis AF2122/97
ggcgauuuugcgucugcucgcca

SEQ ID NO: 1143463 - RNA, 16 nt, Mycobacterium bovis subsp bovis AF2122/97
ggcgcaaaccacccgc

SEQ ID NO: 1143464 - RNA, 17 nt, Mycobacterium bovis subsp bovis AF2122/97
ggcgcaaaccacccgca

SEQ ID NO: 1143465 - RNA, 16 nt, Mycobacterium bovis subsp bovis AF2122/97
ggcgaucucuaccagc

SEQ ID NO: 1143466 - RNA, 14 nt, Mycobacterium bovis subsp bovis AF2122/97
ggcgaucucgacgg

SEQ ID NO: 1143467 - RNA, 16 nt, Mycobacterium bovis subsp bovis AF2122/97
ggcgaucugcucgaga

SEQ ID NO: 1143468 - RNA, 18 nt, Mycobacterium bovis subsp bovis AF2122/97
ggcgaucugggugccggu

SEQ ID NO: 1143469 - RNA, 13 nt, Mycobacterium bovis subsp bovis AF2122/97
ggcgaucuggucg

SEQ ID NO: 1143470 - RNA, 17 nt, Mycobacterium bovis subsp bovis AF2122/97
ggcgaucuggucggcgg

SEQ ID NO: 1143471 - RNA, 19 nt, Mycobacterium bovis subsp bovis AF2122/97
ggcgaucuugcgacgcccg

SEQ ID NO: 1143472 - RNA, 20 nt, Mycobacterium bovis subsp bovis AF2122/97
ggcgaucuuguccagggugg

SEQ ID NO: 1143473 - RNA, 19 nt, Mycobacterium bovis subsp bovis AF2122/97
ggcgaucgcauccgcgguu

SEQ ID NO: 1143474 - RNA, 13 nt, Mycobacterium bovis subsp bovis AF2122/97
ggcgaucgcccgg

SEQ ID NO: 1143475 - RNA, 14 nt, Mycobacterium bovis subsp bovis AF2122/97
ggcgaucgucuccu

SEQ ID NO: 1143476 - RNA, 15 nt, Mycobacterium bovis subsp bovis AF2122/97
ggcgaugcagccggg

SEQ ID NO: 1143477 - RNA, 17 nt, Mycobacterium bovis subsp bovis AF2122/97
ggcgaugcagccgggaa

SEQ ID NO: 1143478 - RNA, 21 nt, Mycobacterium bovis subsp bovis AF2122/97
ggcgaucgccugggcuuggcg

SEQ ID NO: 1143479 - RNA, 21 nt, Mycobacterium bovis subsp bovis AF2122/97
ggcgaugagcgugccgcagcg

SEQ ID NO: 1143480 - RNA, 23 nt, Mycobacterium bovis subsp bovis AF2122/97
ggcgaugagggcuuguggugagc

SEQ ID NO: 1143481 - RNA, 19 nt, Mycobacterium bovis subsp bovis AF2122/97
ggcgaugaucaccagucgc

SEQ ID NO: 1143482 - RNA, 16 nt, Mycobacterium bovis subsp bovis AF2122/97
ggcgaugaugacggcg

SEQ ID NO: 1143483 - RNA, 13 nt, Mycobacterium bovis subsp bovis AF2122/97
ggcgaugacgcca

SEQ ID NO: 1143484 - RNA, 16 nt, Mycobacterium bovis subsp bovis AF2122/97
ggcgaugacaaagcac

SEQ ID NO: 1143485 - RNA, 16 nt, Mycobacterium bovis subsp bovis AF2122/97
ggcgucgacgauuccc

SEQ ID NO: 1143486 - RNA, 12 nt, Mycobacterium bovis subsp bovis AF2122/97
ggcgucgaccac

SEQ ID NO: 1143487 - RNA, 16 nt, Mycobacterium bovis subsp bovis AF2122/97
ggcgucgaccacaggc

SEQ ID NO: 1143488 - RNA, 16 nt, Mycobacterium bovis subsp bovis AF2122/97
ggcgucgaccgcggcc

SEQ ID NO: 1143489 - RNA, 22 nt, Mycobacterium bovis subsp bovis AF2122/97
ggcgucgaccucgcgggcgauc

SEQ ID NO: 1143490 - RNA, 22 nt, Mycobacterium bovis subsp bovis AF2122/97
ggcgucgacugcgugccgcacc

SEQ ID NO: 1143491 - RNA, 14 nt, Mycobacterium bovis subsp bovis AF2122/97
ggcgucgacuggcc

SEQ ID NO: 1143492 - RNA, 16 nt, Mycobacterium bovis subsp bovis AF2122/97
ggcgucgaguucgguu

SEQ ID NO: 1143493 - RNA, 12 nt, Mycobacterium bovis subsp bovis AF2122/97
ggcgucgaccgc

SEQ ID NO: 1143494 - RNA, 20 nt, Mycobacterium bovis subsp bovis AF2122/97
ggcgucgauaaccuggcggu

SEQ ID NO: 1143495 - RNA, 23 nt, Mycobacterium bovis subsp bovis AF2122/97
ggcgucgagcucguccucgucuu

SEQ ID NO: 1143496 - RNA, 19 nt, Mycobacterium bovis subsp bovis AF2122/97
ggcgucgagggagcgccgc

SEQ ID NO: 1143497 - RNA, 23 nt, Mycobacterium bovis subsp bovis AF2122/97
ggcgucgaguaguucgucgacgu

SEQ ID NO: 1143498 - RNA, 23 nt, Mycobacterium bovis subsp bovis AF2122/97
ggcgucgccgccauugccgccgg

SEQ ID NO: 1143499 - RNA, 21 nt, Mycobacterium bovis subsp bovis AF2122/97
ggcgucgccgccauugccgcc

SEQ ID NO: 1143500 - RNA, 14 nt, Mycobacterium bovis subsp bovis AF2122/97
ggcgucgaucucga

SEQ ID NO: 1143501 - RNA, 21 nt, Mycobacterium bovis subsp bovis AF2122/97
ggcgucgaugccggcugccgc

SEQ ID NO: 1143502 - RNA, 15 nt, Mycobacterium bovis subsp bovis AF2122/97
ggcgucgaugucguc

SEQ ID NO: 1143503 - RNA, 17 nt, Mycobacterium bovis subsp bovis AF2122/97
ggcgucgcaacgcgauc

SEQ ID NO: 1143504 - RNA, 18 nt, Mycobacterium bovis subsp bovis AF2122/97
ggcgucgaugguccagcc

SEQ ID NO: 1143505 - RNA, 23 nt, Mycobacterium bovis subsp bovis AF2122/97
ggcgucgaugguccagcccugcg

SEQ ID NO: 1143506 - RNA, 12 nt, Mycobacterium bovis subsp bovis AF2122/97
ggcgucgccggc

SEQ ID NO: 1143507 - RNA, 15 nt, Mycobacterium bovis subsp bovis AF2122/97
ggcgucgccggcacc

SEQ ID NO: 1143508 - RNA, 16 nt, Mycobacterium bovis subsp bovis AF2122/97
ggcgucgccggcaccg

SEQ ID NO: 1143509 - RNA, 17 nt, Mycobacterium bovis subsp bovis AF2122/97
ggcgucggacaugccga

SEQ ID NO: 1143510 - RNA, 17 nt, Mycobacterium bovis subsp bovis AF2122/97
ggcgucgcugcgcuggu

SEQ ID NO: 1143511 - RNA, 12 nt, Mycobacterium bovis subsp bovis AF2122/97
ggcgucgcggua

SEQ ID NO: 1143512 - RNA, 15 nt, Mycobacterium bovis subsp bovis AF2122/97
ggcgucgcucgucgu

SEQ ID NO: 1143513 - RNA, 14 nt, Mycobacterium bovis subsp bovis AF2122/97
ggcgucggccaccc

SEQ ID NO: 1143514 - RNA, 17 nt, Mycobacterium bovis subsp bovis AF2122/97
ggcgucggccacccggu

SEQ ID NO: 1143515 - RNA, 19 nt, Mycobacterium bovis subsp bovis AF2122/97
ggcgucggccacccggucc

SEQ ID NO: 1143516 - RNA, 15 nt, Mycobacterium bovis subsp bovis AF2122/97
ggcgucggcgcccag

SEQ ID NO: 1143517 - RNA, 12 nt, Mycobacterium bovis subsp bovis AF2122/97
ggcgucggcgac

SEQ ID NO: 1143518 - RNA, 14 nt, Mycobacterium bovis subsp bovis AF2122/97
ggcgucggcgcggc

SEQ ID NO: 1143519 - RNA, 13 nt, Mycobacterium bovis subsp bovis AF2122/97
ggcguccgggauc

SEQ ID NO: 1143520 - RNA, 21 nt, Mycobacterium bovis subsp bovis AF2122/97
ggcguccuugcgcagcaccag

SEQ ID NO: 1143521 - RNA, 15 nt, Mycobacterium bovis subsp bovis AF2122/97
ggcguccucgucgag

SEQ ID NO: 1143522 - RNA, 13 nt, Mycobacterium bovis subsp bovis AF2122/97
ggcguccgaccgg

SEQ ID NO: 1143523 - RNA, 21 nt, Mycobacterium bovis subsp bovis AF2122/97
ggcguccgggaucuccccaau

SEQ ID NO: 1143524 - RNA, 22 nt, Mycobacterium bovis subsp bovis AF2122/97
ggcgucgaagaccgccuccacc

SEQ ID NO: 1143525 - RNA, 18 nt, Mycobacterium bovis subsp bovis AF2122/97
ggcgucgaaaccggucuc

SEQ ID NO: 1143526 - RNA, 18 nt, Mycobacterium bovis subsp bovis AF2122/97
ggcgucgaauaggccgcg

SEQ ID NO: 1143527 - RNA, 19 nt, Mycobacterium bovis subsp bovis AF2122/97
ggcgucgaauucagcugca

SEQ ID NO: 1143528 - RNA, 21 nt, Mycobacterium bovis subsp bovis AF2122/97
ggcgucgaauucagcugcacc

SEQ ID NO: 1143529 - RNA, 23 nt, Mycobacterium bovis subsp bovis AF2122/97
ggcgucgaaggugaccaggcgga

SEQ ID NO: 1143530 - RNA, 15 nt, Mycobacterium bovis subsp bovis AF2122/97
ggcgggccgcgcggc

SEQ ID NO: 1143531 - RNA, 13 nt, Mycobacterium bovis subsp bovis AF2122/97
ggcguccgccggc

SEQ ID NO: 1143532 - RNA, 15 nt, Mycobacterium bovis subsp bovis AF2122/97
ggcguccgccggcga

SEQ ID NO: 1143533 - RNA, 14 nt, Mycobacterium bovis subsp bovis AF2122/97
ggcgucccgcccgg

SEQ ID NO: 1143534 - RNA, 14 nt, Mycobacterium bovis subsp bovis AF2122/97
ggcgucccggcggu

SEQ ID NO: 1143535 - RNA, 19 nt, Mycobacterium bovis subsp bovis AF2122/97
ggcgucccggcggucagcg

SEQ ID NO: 1143536 - RNA, 22 nt, Mycobacterium bovis subsp bovis AF2122/97
ggcgucccggcggucagcggcu

SEQ ID NO: 1143537 - RNA, 18 nt, Mycobacterium bovis subsp bovis AF2122/97
ggcguccaucgccaccgc

SEQ ID NO: 1143538 - RNA, 16 nt, Mycobacterium bovis subsp bovis AF2122/97
ggcguccaucgcgcgc

SEQ ID NO: 1143539 - RNA, 13 nt, Mycobacterium bovis subsp bovis AF2122/97
ggcgugccgucgc

SEQ ID NO: 1143540 - RNA, 14 nt, Mycobacterium bovis subsp bovis AF2122/97
ggcgugcgcgguga

SEQ ID NO: 1143541 - RNA, 13 nt, Mycobacterium bovis subsp bovis AF2122/97
ggcgugcucgccg

SEQ ID NO: 1143542 - RNA, 14 nt, Mycobacterium bovis subsp bovis AF2122/97
ggcgugcucgccgg

SEQ ID NO: 1143543 - RNA, 12 nt, Mycobacterium bovis subsp bovis AF2122/97
ggcgugcgugga

SEQ ID NO: 1143544 - RNA, 19 nt, Mycobacterium bovis subsp bovis AF2122/97
ggcgugcucggaggcgauc

SEQ ID NO: 1143545 - RNA, 13 nt, Mycobacterium bovis subsp bovis AF2122/97
ggcgugcugcuag

SEQ ID NO: 1143546 - RNA, 18 nt, Mycobacterium bovis subsp bovis AF2122/97
ggcgugcugugcucacga

SEQ ID NO: 1143547 - RNA, 14 nt, Mycobacterium bovis subsp bovis AF2122/97
ggcguggcgccggc

SEQ ID NO: 1143548 - RNA, 19 nt, Mycobacterium bovis subsp bovis AF2122/97
ggcguggaucuuggccagc

SEQ ID NO: 1143549 - RNA, 16 nt, Mycobacterium bovis subsp bovis AF2122/97
ggcguggaugcccggu

SEQ ID NO: 1143550 - RNA, 17 nt, Mycobacterium bovis subsp bovis AF2122/97
ggcguggcaguacaccg

SEQ ID NO: 1143551 - RNA, 13 nt, Mycobacterium bovis subsp bovis AF2122/97
ggcgugccgccgc

SEQ ID NO: 1143552 - RNA, 17 nt, Mycobacterium bovis subsp bovis AF2122/97
ggcgugcacugaccgcg

SEQ ID NO: 1143553 - RNA, 19 nt, Mycobacterium bovis subsp bovis AF2122/97
ggcgugcacaggucagcgc

SEQ ID NO: 1143554 - RNA, 20 nt, Mycobacterium bovis subsp bovis AF2122/97
ggcgugagcuaugcuggcag

SEQ ID NO: 1143555 - RNA, 18 nt, Mycobacterium bovis subsp bovis AF2122/97
ggcgugaucaccggcauc

SEQ ID NO: 1143556 - RNA, 22 nt, Mycobacterium bovis subsp bovis AF2122/97
ggcgugaucaccggcaucccgg

SEQ ID NO: 1143557 - RNA, 14 nt, Mycobacterium bovis subsp bovis AF2122/97
ggcgucugcgccag

SEQ ID NO: 1143558 - RNA, 21 nt, Mycobacterium bovis subsp bovis AF2122/97
ggcgucuuggaaggcgcgcgc

SEQ ID NO: 1143559 - RNA, 19 nt, Mycobacterium bovis subsp bovis AF2122/97
ggcgugaaaaacgcccgcg

SEQ ID NO: 1143560 - RNA, 14 nt, Mycobacterium bovis subsp bovis AF2122/97
ggcgucgucgguga

SEQ ID NO: 1143561 - RNA, 23 nt, Mycobacterium bovis subsp bovis AF2122/97
ggcgugaccuaccuccucggcgu

SEQ ID NO: 1143562 - RNA, 14 nt, Mycobacterium bovis subsp bovis AF2122/97
ggcgugaccacuga

SEQ ID NO: 1143563 - RNA, 15 nt, Mycobacterium bovis subsp bovis AF2122/97
ggcgugacgggcagg

SEQ ID NO: 1143564 - RNA, 17 nt, Mycobacterium bovis subsp bovis AF2122/97
ggcgucggcuucucgau

SEQ ID NO: 1143565 - RNA, 23 nt, Mycobacterium bovis subsp bovis AF2122/97
ggcgucggcuucucgaucggcgc

SEQ ID NO: 1143566 - RNA, 21 nt, Mycobacterium bovis subsp bovis AF2122/97
ggcgucgggguggcgguccgg

SEQ ID NO: 1143567 - RNA, 15 nt, Mycobacterium bovis subsp bovis AF2122/97
ggcgucggugagcgc

SEQ ID NO: 1143568 - RNA, 23 nt, Mycobacterium bovis subsp bovis AF2122/97
ggcgucguagucgucggccugcg

SEQ ID NO: 1143569 - RNA, 15 nt, Mycobacterium bovis subsp bovis AF2122/97
ggcgucgucgacggc

SEQ ID NO: 1143570 - RNA, 20 nt, Mycobacterium bovis subsp bovis AF2122/97
ggcgucgucgacggcugcgc

SEQ ID NO: 1143571 - RNA, 22 nt, Mycobacterium bovis subsp bovis AF2122/97
ggcgucgucgacggcugcgccg

SEQ ID NO: 1143572 - RNA, 20 nt, Mycobacterium bovis subsp bovis AF2122/97
ggcgucgucgaguuggccau

SEQ ID NO: 1143573 - RNA, 15 nt, Mycobacterium bovis subsp bovis AF2122/97
ggcgucgucgaugau

SEQ ID NO: 1143574 - RNA, 17 nt, Mycobacterium bovis subsp bovis AF2122/97
ggcgucgugcgcggccg

SEQ ID NO: 1143575 - RNA, 14 nt, Mycobacterium bovis subsp bovis AF2122/97
ggcgucgugguggc

SEQ ID NO: 1143576 - RNA, 19 nt, Mycobacterium bovis subsp bovis AF2122/97
ggcgucgugguggccacgg

SEQ ID NO: 1143577 - RNA, 12 nt, Mycobacterium bovis subsp bovis AF2122/97
ggcgucgucggu

SEQ ID NO: 1143578 - RNA, 23 nt, Mycobacterium bovis subsp bovis AF2122/97
ggcgucguucgagaccccgacga

SEQ ID NO: 1143579 - RNA, 18 nt, Mycobacterium bovis subsp bovis AF2122/97
ggcuccgccguugccgcc

SEQ ID NO: 1143580 - RNA, 13 nt, Mycobacterium bovis subsp bovis AF2122/97
ggcuccggcggca

SEQ ID NO: 1143581 - RNA, 18 nt, Mycobacterium bovis subsp bovis AF2122/97
ggcuccggcggcagcggc

SEQ ID NO: 1143582 - RNA, 23 nt, Mycobacterium bovis subsp bovis AF2122/97
ggcuccggcggcagcggcgccgc

SEQ ID NO: 1143583 - RNA, 14 nt, Mycobacterium bovis subsp bovis AF2122/97
ggcuccggcggugc

SEQ ID NO: 1143584 - RNA, 16 nt, Mycobacterium bovis subsp bovis AF2122/97
ggcuccggcggugccg

SEQ ID NO: 1143585 - RNA, 23 nt, Mycobacterium bovis subsp bovis AF2122/97
ggcuccggcggugccgucgccgc

SEQ ID NO: 1143586 - RNA, 14 nt, Mycobacterium bovis subsp bovis AF2122/97
ggcuccucgugcac

SEQ ID NO: 1143587 - RNA, 18 nt, Mycobacterium bovis subsp bovis AF2122/97
ggcuccuccccggcccgc

SEQ ID NO: 1143588 - RNA, 20 nt, Mycobacterium bovis subsp bovis AF2122/97
ggcuccuccgguaucggcga

SEQ ID NO: 1143589 - RNA, 21 nt, Mycobacterium bovis subsp bovis AF2122/97
ggcuccgugguugccgaagcc

SEQ ID NO: 1143590 - RNA, 17 nt, Mycobacterium bovis subsp bovis AF2122/97
ggcuccguuguccagcg

SEQ ID NO: 1143591 - RNA, 21 nt, Mycobacterium bovis subsp bovis AF2122/97
ggcucgaaccgacgcguccgg

SEQ ID NO: 1143592 - RNA, 17 nt, Mycobacterium bovis subsp bovis AF2122/97
ggcucgaaccgacgcgu

SEQ ID NO: 1143593 - RNA, 11 nt, Mycobacterium bovis subsp bovis AF2122/97
ggcucauggca

SEQ ID NO: 1143594 - RNA, 16 nt, Mycobacterium bovis subsp bovis AF2122/97
ggcucauggcauuucc

SEQ ID NO: 1143595 - RNA, 13 nt, Mycobacterium bovis subsp bovis AF2122/97
ggcuccagcgcgc

SEQ ID NO: 1143596 - RNA, 13 nt, Mycobacterium bovis subsp bovis AF2122/97
ggcuccccggcaa

SEQ ID NO: 1143597 - RNA, 21 nt, Mycobacterium bovis subsp bovis AF2122/97
ggcuccccggcaaccgggauc

SEQ ID NO: 1143598 - RNA, 20 nt, Mycobacterium bovis subsp bovis AF2122/97
ggcucccgcaauggggcgca

SEQ ID NO: 1143599 - RNA, 20 nt, Mycobacterium bovis subsp bovis AF2122/97
ggcuccaccgggcccgccgg

SEQ ID NO: 1143600 - RNA, 21 nt, Mycobacterium bovis subsp bovis AF2122/97
ggcuccaccgggcccgccggc

SEQ ID NO: 1143601 - RNA, 21 nt, Mycobacterium bovis subsp bovis AF2122/97
ggcuccaacuccaagaugccg

SEQ ID NO: 1143602 - RNA, 18 nt, Mycobacterium bovis subsp bovis AF2122/97
ggcuccaauugcggccgc

SEQ ID NO: 1143603 - RNA, 16 nt, Mycobacterium bovis subsp bovis AF2122/97
ggcucagcagcgccgc

SEQ ID NO: 1143604 - RNA, 17 nt, Mycobacterium bovis subsp bovis AF2122/97
ggcucacaugugcgcgu

SEQ ID NO: 1143605 - RNA, 17 nt, Mycobacterium bovis subsp bovis AF2122/97
ggcucacgcuccgccgg

SEQ ID NO: 1143606 - RNA, 18 nt, Mycobacterium bovis subsp bovis AF2122/97
ggcucagaacccuccgca

SEQ ID NO: 1143607 - RNA, 20 nt, Mycobacterium bovis subsp bovis AF2122/97
ggcucacaugcccgcaccgu

SEQ ID NO: 1143608 - RNA, 18 nt, Mycobacterium bovis subsp bovis AF2122/97
ggcucaacaccgaguucc

SEQ ID NO: 1143609 - RNA, 21 nt, Mycobacterium bovis subsp bovis AF2122/97
ggcucacagcacagcgcagcc

SEQ ID NO: 1143610 - RNA, 21 nt, Mycobacterium bovis subsp bovis AF2122/97
ggcucaccgaacgcgaugcgc

SEQ ID NO: 1143611 - RNA, 20 nt, Mycobacterium bovis subsp bovis AF2122/97
ggcucaccgaucccgcggcc

SEQ ID NO: 1143612 - RNA, 15 nt, Mycobacterium bovis subsp bovis AF2122/97
ggcucaaggacgcac

SEQ ID NO: 1143613 - RNA, 16 nt, Mycobacterium bovis subsp bovis AF2122/97
ggcucacagcacagcg

SEQ ID NO: 1143614 - RNA, 21 nt, Mycobacterium bovis subsp bovis AF2122/97
ggcucaaacggaauguagccg

SEQ ID NO: 1143615 - RNA, 17 nt, Mycobacterium bovis subsp bovis AF2122/97
ggcuaugcuggcgcagc

SEQ ID NO: 1143616 - RNA, 21 nt, Mycobacterium bovis subsp bovis AF2122/97
ggcuaugcuggcgcagcgcca

SEQ ID NO: 1143617 - RNA, 14 nt, Mycobacterium bovis subsp bovis AF2122/97
ggcuauggcgccgc

SEQ ID NO: 1143618 - RNA, 12 nt, Mycobacterium bovis subsp bovis AF2122/97
ggcuaccgccga

SEQ ID NO: 1143619 - RNA, 17 nt, Mycobacterium bovis subsp bovis AF2122/97
ggcuaccgccgaccgga

SEQ ID NO: 1143620 - RNA, 12 nt, Mycobacterium bovis subsp bovis AF2122/97
ggcuaccgcgcu

SEQ ID NO: 1143621 - RNA, 21 nt, Mycobacterium bovis subsp bovis AF2122/97
ggcuaccgcgcucccggcguc

SEQ ID NO: 1143622 - RNA, 15 nt, Mycobacterium bovis subsp bovis AF2122/97
ggcuaccggcgccgc

SEQ ID NO: 1143623 - RNA, 15 nt, Mycobacterium bovis subsp bovis AF2122/97
ggcuaccuaacccgc

SEQ ID NO: 1143624 - RNA, 16 nt, Mycobacterium bovis subsp bovis AF2122/97
ggcuaccuaacccgca

SEQ ID NO: 1143625 - RNA, 18 nt, Mycobacterium bovis subsp bovis AF2122/97
ggcuaccuaacccgcacc

SEQ ID NO: 1143626 - RNA, 16 nt, Mycobacterium bovis subsp bovis AF2122/97
ggcuaccuaacccgcg

SEQ ID NO: 1143627 - RNA, 18 nt, Mycobacterium bovis subsp bovis AF2122/97
ggcuaccuaacccgcgcc

SEQ ID NO: 1143628 - RNA, 23 nt, Mycobacterium bovis subsp bovis AF2122/97
ggcuaccuaacccgcgccggccg

SEQ ID NO: 1143629 - RNA, 20 nt, Mycobacterium bovis subsp bovis AF2122/97
ggcuacaucggcggcgucga

SEQ ID NO: 1143630 - RNA, 18 nt, Mycobacterium bovis subsp bovis AF2122/97
ggcuacccaccggccggu

SEQ ID NO: 1143631 - RNA, 14 nt, Mycobacterium bovis subsp bovis AF2122/97
ggcuacaucggcgg

SEQ ID NO: 1143632 - RNA, 23 nt, Mycobacterium bovis subsp bovis AF2122/97
ggcuagcugugcuucguugucgg

SEQ ID NO: 1143633 - RNA, 15 nt, Mycobacterium bovis subsp bovis AF2122/97
ggcuaggcaccagcg

SEQ ID NO: 1143634 - RNA, 16 nt, Mycobacterium bovis subsp bovis AF2122/97
ggcuaggccagcacgg

SEQ ID NO: 1143635 - RNA, 13 nt, Mycobacterium bovis subsp bovis AF2122/97
ggcuaggcggcgu

SEQ ID NO: 1143636 - RNA, 22 nt, Mycobacterium bovis subsp bovis AF2122/97
ggcuagauaacccaaccgcgcc

SEQ ID NO: 1143637 - RNA, 17 nt, Mycobacterium bovis subsp bovis AF2122/97
ggcuacgcgcgcccgau

SEQ ID NO: 1143638 - RNA, 13 nt, Mycobacterium bovis subsp bovis AF2122/97
ggcuacggcgaca

SEQ ID NO: 1143639 - RNA, 14 nt, Mycobacterium bovis subsp bovis AF2122/97
ggcuacgggccgcg

SEQ ID NO: 1143640 - RNA, 20 nt, Mycobacterium bovis subsp bovis AF2122/97
ggcguguagccugcggcggu

SEQ ID NO: 1143641 - RNA, 13 nt, Mycobacterium bovis subsp bovis AF2122/97
ggcgugucgccgc

SEQ ID NO: 1143642 - RNA, 17 nt, Mycobacterium bovis subsp bovis AF2122/97
ggcguguaaccccaggc

SEQ ID NO: 1143643 - RNA, 13 nt, Mycobacterium bovis subsp bovis AF2122/97
ggcguguacgucg

SEQ ID NO: 1143644 - RNA, 17 nt, Mycobacterium bovis subsp bovis AF2122/97
ggcgugucgucgcggcc

SEQ ID NO: 1143645 - RNA, 22 nt, Mycobacterium bovis subsp bovis AF2122/97
ggcgugucguugccagggcggg

SEQ ID NO: 1143646 - RNA, 18 nt, Mycobacterium bovis subsp bovis AF2122/97
ggcgugucgccgccacca

SEQ ID NO: 1143647 - RNA, 21 nt, Mycobacterium bovis subsp bovis AF2122/97
ggcgugucgccgccaccagcg

SEQ ID NO: 1143648 - RNA, 15 nt, Mycobacterium bovis subsp bovis AF2122/97
ggcgugucgcgucgc

SEQ ID NO: 1143649 - RNA, 14 nt, Mycobacterium bovis subsp bovis AF2122/97
ggcgugucugcccg

SEQ ID NO: 1143650 - RNA, 22 nt, Mycobacterium bovis subsp bovis AF2122/97
ggcguguggcuuugacugcugg

SEQ ID NO: 1143651 - RNA, 20 nt, Mycobacterium bovis subsp bovis AF2122/97
ggcgugugugcgccuccggg

SEQ ID NO: 1143652 - RNA, 15 nt, Mycobacterium bovis subsp bovis AF2122/97
ggcgugggcaccccg

SEQ ID NO: 1143653 - RNA, 14 nt, Mycobacterium bovis subsp bovis AF2122/97
ggcgugggugucgg

SEQ ID NO: 1143654 - RNA, 17 nt, Mycobacterium bovis subsp bovis AF2122/97
ggcgugggugucggcua

SEQ ID NO: 1143655 - RNA, 22 nt, Mycobacterium bovis subsp bovis AF2122/97
ggcguggugagccucggcgagc

SEQ ID NO: 1143656 - RNA, 16 nt, Mycobacterium bovis subsp bovis AF2122/97
ggcguggucucgguca

SEQ ID NO: 1143657 - RNA, 18 nt, Mycobacterium bovis subsp bovis AF2122/97
ggcguggucucggucagc

SEQ ID NO: 1143658 - RNA, 14 nt, Mycobacterium bovis subsp bovis AF2122/97
ggcgugggccgcug

SEQ ID NO: 1143659 - RNA, 16 nt, Mycobacterium bovis subsp bovis AF2122/97
ggcgugguaucgccgg

SEQ ID NO: 1143660 - RNA, 14 nt, Mycobacterium bovis subsp bovis AF2122/97
ggcguucagcggcc

SEQ ID NO: 1143661 - RNA, 13 nt, Mycobacterium bovis subsp bovis AF2122/97
ggcguucaccacg

SEQ ID NO: 1143662 - RNA, 21 nt, Mycobacterium bovis subsp bovis AF2122/97
ggcguucaccacgaucgcgag

SEQ ID NO: 1143663 - RNA, 15 nt, Mycobacterium bovis subsp bovis AF2122/97
ggcguuagucgauca

SEQ ID NO: 1143664 - RNA, 17 nt, Mycobacterium bovis subsp bovis AF2122/97
ggcguuagucgaucacg

SEQ ID NO: 1143665 - RNA, 22 nt, Mycobacterium bovis subsp bovis AF2122/97
ggcguuaccaccgucaccgccg

SEQ ID NO: 1143666 - RNA, 18 nt, Mycobacterium bovis subsp bovis AF2122/97
ggcgugucgcgucgcagg

SEQ ID NO: 1143667 - RNA, 15 nt, Mycobacterium bovis subsp bovis AF2122/97
ggcguguucugaucg

SEQ ID NO: 1143668 - RNA, 19 nt, Mycobacterium bovis subsp bovis AF2122/97
ggcguucgacucgaccgcg

SEQ ID NO: 1143669 - RNA, 21 nt, Mycobacterium bovis subsp bovis AF2122/97
ggcguucucgauugucgccgc

SEQ ID NO: 1143670 - RNA, 23 nt, Mycobacterium bovis subsp bovis AF2122/97
ggcguucugcgcccguccgcgcg

SEQ ID NO: 1143671 - RNA, 21 nt, Mycobacterium bovis subsp bovis AF2122/97
ggcguucccccggcaccgccg

SEQ ID NO: 1143672 - RNA, 23 nt, Mycobacterium bovis subsp bovis AF2122/97
ggcguugcugaugucgccggugu

SEQ ID NO: 1143673 - RNA, 15 nt, Mycobacterium bovis subsp bovis AF2122/97
ggcguugccgccggc

SEQ ID NO: 1143674 - RNA, 22 nt, Mycobacterium bovis subsp bovis AF2122/97
ggcguugccgccguucccaccc

SEQ ID NO: 1143675 - RNA, 21 nt, Mycobacterium bovis subsp bovis AF2122/97
ggcguugcggaaucagcaccc

SEQ ID NO: 1143676 - RNA, 16 nt, Mycobacterium bovis subsp bovis AF2122/97
ggcguugggaucgcgc

SEQ ID NO: 1143677 - RNA, 20 nt, Mycobacterium bovis subsp bovis AF2122/97
ggcguugggaucgcgcagcg

SEQ ID NO: 1143678 - RNA, 15 nt, Mycobacterium bovis subsp bovis AF2122/97
ggcguuggcgacgaa

SEQ ID NO: 1143679 - RNA, 21 nt, Mycobacterium bovis subsp bovis AF2122/97
ggcguuggcgaucucgacggc

SEQ ID NO: 1143680 - RNA, 16 nt, Mycobacterium bovis subsp bovis AF2122/97
ggcguuggcggcaagg

SEQ ID NO: 1143681 - RNA, 19 nt, Mycobacterium bovis subsp bovis AF2122/97
ggcguuggcggcaagggug

SEQ ID NO: 1143682 - RNA, 17 nt, Mycobacterium bovis subsp bovis AF2122/97
ggcguuggcggcuucgc

SEQ ID NO: 1143683 - RNA, 20 nt, Mycobacterium bovis subsp bovis AF2122/97
ggcguugccgaaacccgagu

SEQ ID NO: 1143684 - RNA, 15 nt, Mycobacterium bovis subsp bovis AF2122/97
ggcguugccaccgga

SEQ ID NO: 1143685 - RNA, 21 nt, Mycobacterium bovis subsp bovis AF2122/97
ggcguugaacugugcggcagc

SEQ ID NO: 1143686 - RNA, 19 nt, Mycobacterium bovis subsp bovis AF2122/97
ggcguugagcuggcgguug

SEQ ID NO: 1143687 - RNA, 22 nt, Mycobacterium bovis subsp bovis AF2122/97
ggcguugaucgacaucaccacc

SEQ ID NO: 1143688 - RNA, 12 nt, Mycobacterium bovis subsp bovis AF2122/97
ggcguugccacc

SEQ ID NO: 1143689 - RNA, 22 nt, Mycobacterium bovis subsp bovis AF2122/97
ggcguugucccccagaugcugg

SEQ ID NO: 1143690 - RNA, 20 nt, Mycobacterium bovis subsp bovis AF2122/97
ggcguugucgguuggcagcc

SEQ ID NO: 1143691 - RNA, 17 nt, Mycobacterium bovis subsp bovis AF2122/97
ggcguuguggcgugugg

SEQ ID NO: 1143692 - RNA, 23 nt, Mycobacterium bovis subsp bovis AF2122/97
ggcguuguuaucgaagcccgagu

SEQ ID NO: 1143693 - RNA, 16 nt, Mycobacterium bovis subsp bovis AF2122/97
ggcguugugaccgccg

SEQ ID NO: 1143694 - RNA, 22 nt, Mycobacterium bovis subsp bovis AF2122/97
ggcguuugagaacaacgggauc

SEQ ID NO: 1143695 - RNA, 16 nt, Mycobacterium bovis subsp bovis AF2122/97
ggcguuugaugcgggc

SEQ ID NO: 1143696 - RNA, 19 nt, Mycobacterium bovis subsp bovis AF2122/97
ggcguuugaugcgggcggc

SEQ ID NO: 1143697 - RNA, 22 nt, Mycobacterium bovis subsp bovis AF2122/97
ggcuaacuggacuggggcgcca

SEQ ID NO: 1143698 - RNA, 23 nt, Mycobacterium bovis subsp bovis AF2122/97
ggcuaaugcgacccgguccacgc

SEQ ID NO: 1143699 - RNA, 20 nt, Mycobacterium bovis subsp bovis AF2122/97
ggcucgugauagggaagggg

SEQ ID NO: 1143700 - RNA, 19 nt, Mycobacterium bovis subsp bovis AF2122/97
ggcucguaggugggcucgu

SEQ ID NO: 1143701 - RNA, 20 nt, Mycobacterium bovis subsp bovis AF2122/97
ggcucgucagguuccgcgac

SEQ ID NO: 1143702 - RNA, 21 nt, Mycobacterium bovis subsp bovis AF2122/97
ggcucguguccgccgucaccc

SEQ ID NO: 1143703 - RNA, 16 nt, Mycobacterium bovis subsp bovis AF2122/97
ggcucguggcgacggc

SEQ ID NO: 1143704 - RNA, 20 nt, Mycobacterium bovis subsp bovis AF2122/97
ggcucuaccgguccgucacc

SEQ ID NO: 1143705 - RNA, 17 nt, Mycobacterium bovis subsp bovis AF2122/97
ggcucuagaucgccgag

SEQ ID NO: 1143706 - RNA, 14 nt, Mycobacterium bovis subsp bovis AF2122/97
ggcucucacgagcg

SEQ ID NO: 1143707 - RNA, 16 nt, Mycobacterium bovis subsp bovis AF2122/97
ggcucucuucgcgcgc

SEQ ID NO: 1143708 - RNA, 19 nt, Mycobacterium bovis subsp bovis AF2122/97
ggcucucuucgcgcgcugg

SEQ ID NO: 1143709 - RNA, 18 nt, Mycobacterium bovis subsp bovis AF2122/97
ggcucugaggucaccggc

SEQ ID NO: 1143710 - RNA, 19 nt, Mycobacterium bovis subsp bovis AF2122/97
ggcucugaggucaccggcg

SEQ ID NO: 1143711 - RNA, 18 nt, Mycobacterium bovis subsp bovis AF2122/97
ggcucuacucgcggccgg

SEQ ID NO: 1143712 - RNA, 22 nt, Mycobacterium bovis subsp bovis AF2122/97
ggcucuacucgcggccggcguc

SEQ ID NO: 1143713 - RNA, 23 nt, Mycobacterium bovis subsp bovis AF2122/97
ggcucucgaguccaggcagcuug

SEQ ID NO: 1143714 - RNA, 13 nt, Mycobacterium bovis subsp bovis AF2122/97
ggcucucggcguc

SEQ ID NO: 1143715 - RNA, 22 nt, Mycobacterium bovis subsp bovis AF2122/97
ggcucugcugccagccgaagcc

SEQ ID NO: 1143716 - RNA, 19 nt, Mycobacterium bovis subsp bovis AF2122/97
ggcucuguagcgucgcacc

SEQ ID NO: 1143717 - RNA, 14 nt, Mycobacterium bovis subsp bovis AF2122/97
ggcucuucgcggau

SEQ ID NO: 1143718 - RNA, 20 nt, Mycobacterium bovis subsp bovis AF2122/97
ggcugacaacgacaacaccc

SEQ ID NO: 1143719 - RNA, 23 nt, Mycobacterium bovis subsp bovis AF2122/97
ggcugacaacgacaacacccacg

SEQ ID NO: 1143720 - RNA, 14 nt, Mycobacterium bovis subsp bovis AF2122/97
ggcugaccaaccca

SEQ ID NO: 1143721 - RNA, 18 nt, Mycobacterium bovis subsp bovis AF2122/97
ggcugaaacauccccgag

SEQ ID NO: 1143722 - RNA, 21 nt, Mycobacterium bovis subsp bovis AF2122/97
ggcugaccggggcgcccggcc

SEQ ID NO: 1143723 - RNA, 22 nt, Mycobacterium bovis subsp bovis AF2122/97
ggcugaccguggcgccggucgc

SEQ ID NO: 1143724 - RNA, 23 nt, Mycobacterium bovis subsp bovis AF2122/97
ggcugaccucccacccccgguuc

SEQ ID NO: 1143725 - RNA, 14 nt, Mycobacterium bovis subsp bovis AF2122/97
ggcugaccgccacc

SEQ ID NO: 1143726 - RNA, 20 nt, Mycobacterium bovis subsp bovis AF2122/97
ggcugaccgaauggccgccg

SEQ ID NO: 1143727 - RNA, 21 nt, Mycobacterium bovis subsp bovis AF2122/97
ggcugaccgaauggccgccgc

SEQ ID NO: 1143728 - RNA, 23 nt, Mycobacterium bovis subsp bovis AF2122/97
ggcugaccgaauggccgccgcag

SEQ ID NO: 1143729 - RNA, 16 nt, Mycobacterium bovis subsp bovis AF2122/97
ggcugaccgacccgga

SEQ ID NO: 1143730 - RNA, 16 nt, Mycobacterium bovis subsp bovis AF2122/97
ggcucgcucgccgagc

SEQ ID NO: 1143731 - RNA, 21 nt, Mycobacterium bovis subsp bovis AF2122/97
ggcucgcucgccgagcugugc

SEQ ID NO: 1143732 - RNA, 16 nt, Mycobacterium bovis subsp bovis AF2122/97
ggcucgcugcaacauc

SEQ ID NO: 1143733 - RNA, 13 nt, Mycobacterium bovis subsp bovis AF2122/97
ggcucggccagcc

SEQ ID NO: 1143734 - RNA, 15 nt, Mycobacterium bovis subsp bovis AF2122/97
ggcucggcgcagcac

SEQ ID NO: 1143735 - RNA, 15 nt, Mycobacterium bovis subsp bovis AF2122/97
ggcucggcggcccgg

SEQ ID NO: 1143736 - RNA, 21 nt, Mycobacterium bovis subsp bovis AF2122/97
ggcucgggugcgcccggccaa

SEQ ID NO: 1143737 - RNA, 21 nt, Mycobacterium bovis subsp bovis AF2122/97
ggcucgggcaaggccaccggc

SEQ ID NO: 1143738 - RNA, 22 nt, Mycobacterium bovis subsp bovis AF2122/97
ggcucgggcaaggccaccggcg

SEQ ID NO: 1143739 - RNA, 18 nt, Mycobacterium bovis subsp bovis AF2122/97
ggcucgggcagcgucacc

SEQ ID NO: 1143740 - RNA, 15 nt, Mycobacterium bovis subsp bovis AF2122/97
ggcucggucggcagc

SEQ ID NO: 1143741 - RNA, 16 nt, Mycobacterium bovis subsp bovis AF2122/97
ggcucgguggcgccgg

SEQ ID NO: 1143742 - RNA, 21 nt, Mycobacterium bovis subsp bovis AF2122/97
ggcucgccgaaaagggcgaca

SEQ ID NO: 1143743 - RNA, 16 nt, Mycobacterium bovis subsp bovis AF2122/97
ggcucgccaguucgcg

SEQ ID NO: 1143744 - RNA, 18 nt, Mycobacterium bovis subsp bovis AF2122/97
ggcucgcauguucuccac

SEQ ID NO: 1143745 - RNA, 20 nt, Mycobacterium bovis subsp bovis AF2122/97
ggcucgcauguucuccacgc

SEQ ID NO: 1143746 - RNA, 16 nt, Mycobacterium bovis subsp bovis AF2122/97
ggcucgcauucggcga

SEQ ID NO: 1143747 - RNA, 18 nt, Mycobacterium bovis subsp bovis AF2122/97
ggcucgcauucggcgagc

SEQ ID NO: 1143748 - RNA, 23 nt, Mycobacterium bovis subsp bovis AF2122/97
ggcucgccgacccgccgcggaca

SEQ ID NO: 1143749 - RNA, 13 nt, Mycobacterium bovis subsp bovis AF2122/97
ggcucgccggcga

SEQ ID NO: 1143750 - RNA, 14 nt, Mycobacterium bovis subsp bovis AF2122/97
ggcucgccggcgac

SEQ ID NO: 1143751 - RNA, 17 nt, Mycobacterium bovis subsp bovis AF2122/97
ggcucgccggcgaccgg

SEQ ID NO: 1143752 - RNA, 18 nt, Mycobacterium bovis subsp bovis AF2122/97
ggcucgccggcgcgcacc

SEQ ID NO: 1143753 - RNA, 16 nt, Mycobacterium bovis subsp bovis AF2122/97
ggcucgccggcggccc

SEQ ID NO: 1143754 - RNA, 20 nt, Mycobacterium bovis subsp bovis AF2122/97
ggcucgccggcggcccgcuc

SEQ ID NO: 1143755 - RNA, 14 nt, Mycobacterium bovis subsp bovis AF2122/97
ggcucgacgaugcg

SEQ ID NO: 1143756 - RNA, 22 nt, Mycobacterium bovis subsp bovis AF2122/97
ggcucgacgaugcggucaacgc

SEQ ID NO: 1143757 - RNA, 16 nt, Mycobacterium bovis subsp bovis AF2122/97
ggcucgagcucggcga

SEQ ID NO: 1143758 - RNA, 15 nt, Mycobacterium bovis subsp bovis AF2122/97
ggcucgacgcgucgc

SEQ ID NO: 1143759 - RNA, 18 nt, Mycobacterium bovis subsp bovis AF2122/97
ggcucgacguauuggcgc

SEQ ID NO: 1143760 - RNA, 21 nt, Mycobacterium bovis subsp bovis AF2122/97
ggcucgacguauuggcgcagc

SEQ ID NO: 1143761 - RNA, 17 nt, Mycobacterium bovis subsp bovis AF2122/97
ggcucgagucgcagcac

SEQ ID NO: 1143762 - RNA, 13 nt, Mycobacterium bovis subsp bovis AF2122/97
ggcucgagccgcc

SEQ ID NO: 1143763 - RNA, 18 nt, Mycobacterium bovis subsp bovis AF2122/97
ggcucgagcucggcgaug

SEQ ID NO: 1143764 - RNA, 22 nt, Mycobacterium bovis subsp bovis AF2122/97
ggcucgagucgcagcacgggug

SEQ ID NO: 1143765 - RNA, 15 nt, Mycobacterium bovis subsp bovis AF2122/97
ggcugcacgcugcgg

SEQ ID NO: 1143766 - RNA, 20 nt, Mycobacterium bovis subsp bovis AF2122/97
ggcugcauccuccucgucga

SEQ ID NO: 1143767 - RNA, 21 nt, Mycobacterium bovis subsp bovis AF2122/97
ggcugcagugacucgaucacc

SEQ ID NO: 1143768 - RNA, 14 nt, Mycobacterium bovis subsp bovis AF2122/97
ggcugcagugccgc

SEQ ID NO: 1143769 - RNA, 15 nt, Mycobacterium bovis subsp bovis AF2122/97
ggcugcagugccgca

SEQ ID NO: 1143770 - RNA, 21 nt, Mycobacterium bovis subsp bovis AF2122/97
ggcugcagugccgcacccaga

SEQ ID NO: 1143771 - RNA, 18 nt, Mycobacterium bovis subsp bovis AF2122/97
ggcugcccguucugccca

SEQ ID NO: 1143772 - RNA, 20 nt, Mycobacterium bovis subsp bovis AF2122/97
ggcugcccaugguggcgauc

SEQ ID NO: 1143773 - RNA, 18 nt, Mycobacterium bovis subsp bovis AF2122/97
ggcugcccaucggugauc

SEQ ID NO: 1143774 - RNA, 13 nt, Mycobacterium bovis subsp bovis AF2122/97
ggcugccaccgca

SEQ ID NO: 1143775 - RNA, 14 nt, Mycobacterium bovis subsp bovis AF2122/97
ggcugccacgaacg

SEQ ID NO: 1143776 - RNA, 22 nt, Mycobacterium bovis subsp bovis AF2122/97
ggcugccaucccgaucccggcc

SEQ ID NO: 1143777 - RNA, 22 nt, Mycobacterium bovis subsp bovis AF2122/97
ggcugccauuccagaucaacgc

SEQ ID NO: 1143778 - RNA, 15 nt, Mycobacterium bovis subsp bovis AF2122/97
ggcugaucccggcca

SEQ ID NO: 1143779 - RNA, 13 nt, Mycobacterium bovis subsp bovis AF2122/97
ggcugauuggccc

SEQ ID NO: 1143780 - RNA, 16 nt, Mycobacterium bovis subsp bovis AF2122/97
ggcugcaaccagcggc

SEQ ID NO: 1143781 - RNA, 17 nt, Mycobacterium bovis subsp bovis AF2122/97
ggcugcaaccagcggca

SEQ ID NO: 1143782 - RNA, 16 nt, Mycobacterium bovis subsp bovis AF2122/97
ggcugagcccgccgcg

SEQ ID NO: 1143783 - RNA, 23 nt, Mycobacterium bovis subsp bovis AF2122/97
ggcugagccgcaucuggccggcg

SEQ ID NO: 1143784 - RNA, 23 nt, Mycobacterium bovis subsp bovis AF2122/97
ggcugaggcggcgacgaccgucg

SEQ ID NO: 1143785 - RNA, 16 nt, Mycobacterium bovis subsp bovis AF2122/97
ggcugagcgugcggug

SEQ ID NO: 1143786 - RNA, 13 nt, Mycobacterium bovis subsp bovis AF2122/97
ggcugagcagcgc

SEQ ID NO: 1143787 - RNA, 19 nt, Mycobacterium bovis subsp bovis AF2122/97
ggcugcgcuacccagcgcg

SEQ ID NO: 1143788 - RNA, 18 nt, Mycobacterium bovis subsp bovis AF2122/97
ggcugcgcucgcccgcgg

SEQ ID NO: 1143789 - RNA, 21 nt, Mycobacterium bovis subsp bovis AF2122/97
ggcugcgcuuugcacagcggc

SEQ ID NO: 1143790 - RNA, 22 nt, Mycobacterium bovis subsp bovis AF2122/97
ggcugcgcuuugcacagcggca

SEQ ID NO: 1143791 - RNA, 20 nt, Mycobacterium bovis subsp bovis AF2122/97
ggcugcgcgucgagcagcac

SEQ ID NO: 1143792 - RNA, 18 nt, Mycobacterium bovis subsp bovis AF2122/97
ggcugcggaggcggguug

SEQ ID NO: 1143793 - RNA, 19 nt, Mycobacterium bovis subsp bovis AF2122/97
ggcugcggaugcgcggcgg

SEQ ID NO: 1143794 - RNA, 13 nt, Mycobacterium bovis subsp bovis AF2122/97
ggcugcucgacgg

SEQ ID NO: 1143795 - RNA, 17 nt, Mycobacterium bovis subsp bovis AF2122/97
ggcugcguucgccggaa

SEQ ID NO: 1143796 - RNA, 22 nt, Mycobacterium bovis subsp bovis AF2122/97
ggcugcgacaggacgucggcga

SEQ ID NO: 1143797 - RNA, 15 nt, Mycobacterium bovis subsp bovis AF2122/97
ggcugccgguucacc

SEQ ID NO: 1143798 - RNA, 17 nt, Mycobacterium bovis subsp bovis AF2122/97
ggcugccuucggcgagc

SEQ ID NO: 1143799 - RNA, 22 nt, Mycobacterium bovis subsp bovis AF2122/97
ggcugcgccgauacccagcggg

SEQ ID NO: 1143800 - RNA, 13 nt, Mycobacterium bovis subsp bovis AF2122/97
ggcugcgcaguga

SEQ ID NO: 1143801 - RNA, 22 nt, Mycobacterium bovis subsp bovis AF2122/97
ggcugcgaaagccacucgcgca

SEQ ID NO: 1143802 - RNA, 22 nt, Mycobacterium bovis subsp bovis AF2122/97
ggcugccgcaaacgcggcgucg

SEQ ID NO: 1143803 - RNA, 23 nt, Mycobacterium bovis subsp bovis AF2122/97
ggcugccgcaaacgcggcgucga

SEQ ID NO: 1143804 - RNA, 15 nt, Mycobacterium bovis subsp bovis AF2122/97
ggcugccgcaccaag

SEQ ID NO: 1143805 - RNA, 20 nt, Mycobacterium bovis subsp bovis AF2122/97
ggcugccgcaugcgcuccgg

SEQ ID NO: 1143806 - RNA, 14 nt, Mycobacterium bovis subsp bovis AF2122/97
ggcugccgccguug

SEQ ID NO: 1143807 - RNA, 12 nt, Mycobacterium bovis subsp bovis AF2122/97
ggcugccggcaa

SEQ ID NO: 1143808 - RNA, 21 nt, Mycobacterium bovis subsp bovis AF2122/97
ggcugccgccguugccgucgu

SEQ ID NO: 1143809 - RNA, 15 nt, Mycobacterium bovis subsp bovis AF2122/97
ggcuucgccgcggga

SEQ ID NO: 1143810 - RNA, 15 nt, Mycobacterium bovis subsp bovis AF2122/97
ggcuucggcagccgc

SEQ ID NO: 1143811 - RNA, 15 nt, Mycobacterium bovis subsp bovis AF2122/97
ggcuucggcgaaccc

SEQ ID NO: 1143812 - RNA, 19 nt, Mycobacterium bovis subsp bovis AF2122/97
ggcuucgucggccagcagc

SEQ ID NO: 1143813 - RNA, 14 nt, Mycobacterium bovis subsp bovis AF2122/97
ggcuucgauugcgc

SEQ ID NO: 1143814 - RNA, 11 nt, Mycobacterium bovis subsp bovis AF2122/97
ggcuucgccga

SEQ ID NO: 1143815 - RNA, 23 nt, Mycobacterium bovis subsp bovis AF2122/97
ggcuucgcuggcuugggccagcg

SEQ ID NO: 1143816 - RNA, 23 nt, Mycobacterium bovis subsp bovis AF2122/97
ggcuucgaagcgaucgccggccg

SEQ ID NO: 1143817 - RNA, 22 nt, Mycobacterium bovis subsp bovis AF2122/97
ggcuucgacgucggcgaccagg

SEQ ID NO: 1143818 - RNA, 14 nt, Mycobacterium bovis subsp bovis AF2122/97
ggcuuccgggguga

SEQ ID NO: 1143819 - RNA, 15 nt, Mycobacterium bovis subsp bovis AF2122/97
ggcuuccccagcagu

SEQ ID NO: 1143820 - RNA, 17 nt, Mycobacterium bovis subsp bovis AF2122/97
ggcuugacugcacacca

SEQ ID NO: 1143821 - RNA, 20 nt, Mycobacterium bovis subsp bovis AF2122/97
ggcuugacgcccgggcaccg

SEQ ID NO: 1143822 - RNA, 19 nt, Mycobacterium bovis subsp bovis AF2122/97
ggcuugacugcacaccacc

SEQ ID NO: 1143823 - RNA, 20 nt, Mycobacterium bovis subsp bovis AF2122/97
ggcuugccgauggcgguggc

SEQ ID NO: 1143824 - RNA, 19 nt, Mycobacterium bovis subsp bovis AF2122/97
ggcuucuugaccacgaacg

SEQ ID NO: 1143825 - RNA, 23 nt, Mycobacterium bovis subsp bovis AF2122/97
ggcuucuugaccacgaacgcgcg

SEQ ID NO: 1143826 - RNA, 13 nt, Mycobacterium bovis subsp bovis AF2122/97
ggcuucgucgaca

SEQ ID NO: 1143827 - RNA, 16 nt, Mycobacterium bovis subsp bovis AF2122/97
ggcuugcgcagcagcg

SEQ ID NO: 1143828 - RNA, 17 nt, Mycobacterium bovis subsp bovis AF2122/97
ggcuugccugcgccgag

SEQ ID NO: 1143829 - RNA, 14 nt, Mycobacterium bovis subsp bovis AF2122/97
ggcuuggaccagcg

SEQ ID NO: 1143830 - RNA, 23 nt, Mycobacterium bovis subsp bovis AF2122/97
ggcuuggaucucauccauguuga

SEQ ID NO: 1143831 - RNA, 14 nt, Mycobacterium bovis subsp bovis AF2122/97
ggcuuggcgggacc

SEQ ID NO: 1143832 - RNA, 13 nt, Mycobacterium bovis subsp bovis AF2122/97
ggcuuggcgucga

SEQ ID NO: 1143833 - RNA, 12 nt, Mycobacterium bovis subsp bovis AF2122/97
ggcuugcgucgc

SEQ ID NO: 1143834 - RNA, 23 nt, Mycobacterium bovis subsp bovis AF2122/97
ggcuuucagcaccggaucgacca

SEQ ID NO: 1143835 - RNA, 15 nt, Mycobacterium bovis subsp bovis AF2122/97
ggcuugucauccccg

SEQ ID NO: 1143836 - RNA, 23 nt, Mycobacterium bovis subsp bovis AF2122/97
ggcuugggcgguagccgacgaca

SEQ ID NO: 1143837 - RNA, 21 nt, Mycobacterium bovis subsp bovis AF2122/97
ggcuuggcgucggccggcagu

SEQ ID NO: 1143838 - RNA, 19 nt, Mycobacterium bovis subsp bovis AF2122/97
ggcuugggaaacccggcca

SEQ ID NO: 1143839 - RNA, 23 nt, Mycobacterium bovis subsp bovis AF2122/97
ggcuuggccguaggcggcgaccc

SEQ ID NO: 1143840 - RNA, 13 nt, Mycobacterium bovis subsp bovis AF2122/97
ggcuuggcgucgg

SEQ ID NO: 1143841 - RNA, 14 nt, Mycobacterium bovis subsp bovis AF2122/97
ggcuugcggcaccc

SEQ ID NO: 1143842 - RNA, 15 nt, Mycobacterium bovis subsp bovis AF2122/97
ggcuugucgaccacg

SEQ ID NO: 1143843 - RNA, 16 nt, Mycobacterium bovis subsp bovis AF2122/97
ggcuugucgccggcau

SEQ ID NO: 1143844 - RNA, 20 nt, Mycobacterium bovis subsp bovis AF2122/97
gggaaccagaugaaccccga

SEQ ID NO: 1143845 - RNA, 19 nt, Mycobacterium bovis subsp bovis AF2122/97
gggaaccauugcccgacga

SEQ ID NO: 1143846 - RNA, 14 nt, Mycobacterium bovis subsp bovis AF2122/97
gggaacgcgcccac

SEQ ID NO: 1143847 - RNA, 18 nt, Mycobacterium bovis subsp bovis AF2122/97
gggaacgcggaagccgcc

SEQ ID NO: 1143848 - RNA, 23 nt, Mycobacterium bovis subsp bovis AF2122/97
gggaacgaugccgccggcgggcg

SEQ ID NO: 1143849 - RNA, 16 nt, Mycobacterium bovis subsp bovis AF2122/97
gggaacgcucgucgac

SEQ ID NO: 1143850 - RNA, 18 nt, Mycobacterium bovis subsp bovis AF2122/97
ggcuuuugcgucugcucg

SEQ ID NO: 1143851 - RNA, 18 nt, Mycobacterium bovis subsp bovis AF2122/97
ggcuggccgacucgaggu

SEQ ID NO: 1143852 - RNA, 14 nt, Mycobacterium bovis subsp bovis AF2122/97
ggcuggccgccacc

SEQ ID NO: 1143853 - RNA, 22 nt, Mycobacterium bovis subsp bovis AF2122/97
ggcuggcgauggccguccgacc

SEQ ID NO: 1143854 - RNA, 14 nt, Mycobacterium bovis subsp bovis AF2122/97
ggcuggcggcgugg

SEQ ID NO: 1143855 - RNA, 13 nt, Mycobacterium bovis subsp bovis AF2122/97
ggcuggcgucacc

SEQ ID NO: 1143856 - RNA, 16 nt, Mycobacterium bovis subsp bovis AF2122/97
ggcuggcgucaccgcg

SEQ ID NO: 1143857 - RNA, 22 nt, Mycobacterium bovis subsp bovis AF2122/97
ggcugggucagguugucggcga

SEQ ID NO: 1143858 - RNA, 15 nt, Mycobacterium bovis subsp bovis AF2122/97
ggcugguagcugcgg

SEQ ID NO: 1143859 - RNA, 16 nt, Mycobacterium bovis subsp bovis AF2122/97
ggcugguaucgagcac

SEQ ID NO: 1143860 - RNA, 16 nt, Mycobacterium bovis subsp bovis AF2122/97
ggcugggcccgccguc

SEQ ID NO: 1143861 - RNA, 19 nt, Mycobacterium bovis subsp bovis AF2122/97
ggcugggcccgccgucacc

SEQ ID NO: 1143862 - RNA, 14 nt, Mycobacterium bovis subsp bovis AF2122/97
ggcugggcgccacc

SEQ ID NO: 1143863 - RNA, 13 nt, Mycobacterium bovis subsp bovis AF2122/97
ggcuggacccgca

SEQ ID NO: 1143864 - RNA, 22 nt, Mycobacterium bovis subsp bovis AF2122/97
ggcuggacccgcauggcgcggg

SEQ ID NO: 1143865 - RNA, 16 nt, Mycobacterium bovis subsp bovis AF2122/97
ggcugcuugcgcccgg

SEQ ID NO: 1143866 - RNA, 16 nt, Mycobacterium bovis subsp bovis AF2122/97
ggcugcuuggucgccc

SEQ ID NO: 1143867 - RNA, 16 nt, Mycobacterium bovis subsp bovis AF2122/97
ggcugcuccgucgccg

SEQ ID NO: 1143868 - RNA, 13 nt, Mycobacterium bovis subsp bovis AF2122/97
ggcugcugcgcgg

SEQ ID NO: 1143869 - RNA, 16 nt, Mycobacterium bovis subsp bovis AF2122/97
ggcugcugcgcggugc

SEQ ID NO: 1143870 - RNA, 23 nt, Mycobacterium bovis subsp bovis AF2122/97
ggcugcugcgcggugccggccgu

SEQ ID NO: 1143871 - RNA, 16 nt, Mycobacterium bovis subsp bovis AF2122/97
ggcuggccagcacgcc

SEQ ID NO: 1143872 - RNA, 20 nt, Mycobacterium bovis subsp bovis AF2122/97
ggcuggucuacccgcggcgc

SEQ ID NO: 1143873 - RNA, 15 nt, Mycobacterium bovis subsp bovis AF2122/97
ggcugguguccagcc

SEQ ID NO: 1143874 - RNA, 21 nt, Mycobacterium bovis subsp bovis AF2122/97
ggcuggugggggagcggccgc

SEQ ID NO: 1143875 - RNA, 13 nt, Mycobacterium bovis subsp bovis AF2122/97
ggcuggugucggg

SEQ ID NO: 1143876 - RNA, 18 nt, Mycobacterium bovis subsp bovis AF2122/97
ggcugguuucggggacca

SEQ ID NO: 1143877 - RNA, 22 nt, Mycobacterium bovis subsp bovis AF2122/97
ggcuguaacacccggccgccga

SEQ ID NO: 1143878 - RNA, 14 nt, Mycobacterium bovis subsp bovis AF2122/97
ggcuguaggcgauc

SEQ ID NO: 1143879 - RNA, 22 nt, Mycobacterium bovis subsp bovis AF2122/97
ggcuguaguccgcuacugcgac

SEQ ID NO: 1143880 - RNA, 19 nt, Mycobacterium bovis subsp bovis AF2122/97
ggcugucacgccugccacc

SEQ ID NO: 1143881 - RNA, 22 nt, Mycobacterium bovis subsp bovis AF2122/97
ggcugucacgccugccaccggc

SEQ ID NO: 1143882 - RNA, 19 nt, Mycobacterium bovis subsp bovis AF2122/97
ggcuguccgaccucgccgc

SEQ ID NO: 1143883 - RNA, 20 nt, Mycobacterium bovis subsp bovis AF2122/97
ggcuguccgcgggccgcgcg

SEQ ID NO: 1143884 - RNA, 20 nt, Mycobacterium bovis subsp bovis AF2122/97
ggcuguccgaccucgccgcg

SEQ ID NO: 1143885 - RNA, 23 nt, Mycobacterium bovis subsp bovis AF2122/97
ggcugucgugauacagcucggug

SEQ ID NO: 1143886 - RNA, 23 nt, Mycobacterium bovis subsp bovis AF2122/97
ggcugugauguuguucagcaggc

SEQ ID NO: 1143887 - RNA, 12 nt, Mycobacterium bovis subsp bovis AF2122/97
ggcugugcaggc

SEQ ID NO: 1143888 - RNA, 13 nt, Mycobacterium bovis subsp bovis AF2122/97
ggcugugccggcc

SEQ ID NO: 1143889 - RNA, 17 nt, Mycobacterium bovis subsp bovis AF2122/97
ggcugugccccagggca

SEQ ID NO: 1143890 - RNA, 18 nt, Mycobacterium bovis subsp bovis AF2122/97
ggcugugcccgaucagcc

SEQ ID NO: 1143891 - RNA, 13 nt, Mycobacterium bovis subsp bovis AF2122/97
ggcuuaccggcgg

SEQ ID NO: 1143892 - RNA, 14 nt, Mycobacterium bovis subsp bovis AF2122/97
ggcuuaccggcggg

SEQ ID NO: 1143893 - RNA, 20 nt, Mycobacterium bovis subsp bovis AF2122/97
ggcuguucggccauggcggc

SEQ ID NO: 1143894 - RNA, 17 nt, Mycobacterium bovis subsp bovis AF2122/97
ggcuguugacgccacga

SEQ ID NO: 1143895 - RNA, 18 nt, Mycobacterium bovis subsp bovis AF2122/97
ggcuguugacgccacgac

SEQ ID NO: 1143896 - RNA, 14 nt, Mycobacterium bovis subsp bovis AF2122/97
ggcuguugcggcgg

SEQ ID NO: 1143897 - RNA, 19 nt, Mycobacterium bovis subsp bovis AF2122/97
gucucgcggugcggcaaca

SEQ ID NO: 1143898 - RNA, 20 nt, Mycobacterium bovis subsp bovis AF2122/97
gucucgcugggaaaucccga

SEQ ID NO: 1143899 - RNA, 23 nt, Mycobacterium bovis subsp bovis AF2122/97
gucucggaggcgaccacgucggc

SEQ ID NO: 1143900 - RNA, 21 nt, Mycobacterium bovis subsp bovis AF2122/97
gucucgggcgcgggugaccag

SEQ ID NO: 1143901 - RNA, 19 nt, Mycobacterium bovis subsp bovis AF2122/97
gucucgggguuguucggca

SEQ ID NO: 1143902 - RNA, 20 nt, Mycobacterium bovis subsp bovis AF2122/97
gucucggccgaggaccagag

SEQ ID NO: 1143903 - RNA, 16 nt, Mycobacterium bovis subsp bovis AF2122/97
gucucgucgccccguu

SEQ ID NO: 1143904 - RNA, 22 nt, Mycobacterium bovis subsp bovis AF2122/97
gucucuagauauggaccgccgc

SEQ ID NO: 1143905 - RNA, 17 nt, Mycobacterium bovis subsp bovis AF2122/97
gucugauggcggcucgu

SEQ ID NO: 1143906 - RNA, 15 nt, Mycobacterium bovis subsp bovis AF2122/97
gucugauggccucgc

SEQ ID NO: 1143907 - RNA, 20 nt, Mycobacterium bovis subsp bovis AF2122/97
gucugaucacucacccgggc

SEQ ID NO: 1143908 - RNA, 14 nt, Mycobacterium bovis subsp bovis AF2122/97
gucugagcgccggc

SEQ ID NO: 1143909 - RNA, 15 nt, Mycobacterium bovis subsp bovis AF2122/97
gucugagcgccggca

SEQ ID NO: 1143910 - RNA, 14 nt, Mycobacterium bovis subsp bovis AF2122/97
gucugacagcaucc

SEQ ID NO: 1143911 - RNA, 23 nt, Mycobacterium bovis subsp bovis AF2122/97
gucugaccccccgaccccgacgg

SEQ ID NO: 1143912 - RNA, 16 nt, Mycobacterium bovis subsp bovis AF2122/97
gucugacagaccgggc

SEQ ID NO: 1143913 - RNA, 17 nt, Mycobacterium bovis subsp bovis AF2122/97
gucugacagaccgggca

SEQ ID NO: 1143914 - RNA, 16 nt, Mycobacterium bovis subsp bovis AF2122/97
gucugcccgacugccg

SEQ ID NO: 1143915 - RNA, 12 nt, Mycobacterium bovis subsp bovis AF2122/97
gucugcccgccc

SEQ ID NO: 1143916 - RNA, 21 nt, Mycobacterium bovis subsp bovis AF2122/97
gucugcccgcccagcccggcg

SEQ ID NO: 1143917 - RNA, 15 nt, Mycobacterium bovis subsp bovis AF2122/97
gucugcagacggucc

SEQ ID NO: 1143918 - RNA, 22 nt, Mycobacterium bovis subsp bovis AF2122/97
gucugccaaaagggcggcagcg

SEQ ID NO: 1143919 - RNA, 12 nt, Mycobacterium bovis subsp bovis AF2122/97
gucugccagcac

SEQ ID NO: 1143920 - RNA, 16 nt, Mycobacterium bovis subsp bovis AF2122/97
gucucgaucgcgguag

SEQ ID NO: 1143921 - RNA, 19 nt, Mycobacterium bovis subsp bovis AF2122/97
gucucgagggugaaguggc

SEQ ID NO: 1143922 - RNA, 19 nt, Mycobacterium bovis subsp bovis AF2122/97
gucucgacggcggccgcga

SEQ ID NO: 1143923 - RNA, 18 nt, Mycobacterium bovis subsp bovis AF2122/97
gucuccuugagcuucucg

SEQ ID NO: 1143924 - RNA, 23 nt, Mycobacterium bovis subsp bovis AF2122/97
gucucgaaagccgcggccgaaac

SEQ ID NO: 1143925 - RNA, 16 nt, Mycobacterium bovis subsp bovis AF2122/97
gucuccuucggcgacu

SEQ ID NO: 1143926 - RNA, 21 nt, Mycobacterium bovis subsp bovis AF2122/97
gucuccuucggcgacugcgca

SEQ ID NO: 1143927 - RNA, 15 nt, Mycobacterium bovis subsp bovis AF2122/97
gucuccggcgucggc

SEQ ID NO: 1143928 - RNA, 15 nt, Mycobacterium bovis subsp bovis AF2122/97
gucuccucggucacc

SEQ ID NO: 1143929 - RNA, 22 nt, Mycobacterium bovis subsp bovis AF2122/97
gucuccgcugaugagccgcaga

SEQ ID NO: 1143930 - RNA, 21 nt, Mycobacterium bovis subsp bovis AF2122/97
gucuccggacgcacgauccgc

SEQ ID NO: 1143931 - RNA, 16 nt, Mycobacterium bovis subsp bovis AF2122/97
gucuccggaucgccga

SEQ ID NO: 1143932 - RNA, 12 nt, Mycobacterium bovis subsp bovis AF2122/97
gucuccggcaag

SEQ ID NO: 1143933 - RNA, 22 nt, Mycobacterium bovis subsp bovis AF2122/97
gucuccuccggaaagcucucgg

SEQ ID NO: 1143934 - RNA, 16 nt, Mycobacterium bovis subsp bovis AF2122/97
gucucccagaggucga

SEQ ID NO: 1143935 - RNA, 13 nt, Mycobacterium bovis subsp bovis AF2122/97
gucucccggccgc

SEQ ID NO: 1143936 - RNA, 21 nt, Mycobacterium bovis subsp bovis AF2122/97
gucuccagacguuccaucacg

SEQ ID NO: 1143937 - RNA, 23 nt, Mycobacterium bovis subsp bovis AF2122/97
gucuagcggccuaggacgccgcc

SEQ ID NO: 1143938 - RNA, 21 nt, Mycobacterium bovis subsp bovis AF2122/97
gucuauuugccugccgcgcaa

SEQ ID NO: 1143939 - RNA, 15 nt, Mycobacterium bovis subsp bovis AF2122/97
gucuaucuggucggg

SEQ ID NO: 1143940 - RNA, 14 nt, Mycobacterium bovis subsp bovis AF2122/97
gucucacggcgcga

SEQ ID NO: 1143941 - RNA, 17 nt, Mycobacterium bovis subsp bovis AF2122/97
gucucacucaucggugu

SEQ ID NO: 1143942 - RNA, 22 nt, Mycobacterium bovis subsp bovis AF2122/97
gucguuucgccagccggccgcg

SEQ ID NO: 1143943 - RNA, 13 nt, Mycobacterium bovis subsp bovis AF2122/97
gucguugcgcggu

SEQ ID NO: 1143944 - RNA, 17 nt, Mycobacterium bovis subsp bovis AF2122/97
gucguugucgucgccgg

SEQ ID NO: 1143945 - RNA, 13 nt, Mycobacterium bovis subsp bovis AF2122/97
gucguugucugcc

SEQ ID NO: 1143946 - RNA, 23 nt, Mycobacterium bovis subsp bovis AF2122/97
gucuaccuuuuuggcacccacgg

SEQ ID NO: 1143947 - RNA, 21 nt, Mycobacterium bovis subsp bovis AF2122/97
gucuacgacgucgcuguaggc

SEQ ID NO: 1143948 - RNA, 17 nt, Mycobacterium bovis subsp bovis AF2122/97
gucguuuucagagccgg

SEQ ID NO: 1143949 - RNA, 15 nt, Mycobacterium bovis subsp bovis AF2122/97
gucugugcugcgcug

SEQ ID NO: 1143950 - RNA, 15 nt, Mycobacterium bovis subsp bovis AF2122/97
gucugugcucacggc

SEQ ID NO: 1143951 - RNA, 19 nt, Mycobacterium bovis subsp bovis AF2122/97
gucugugcucacggcggcg

SEQ ID NO: 1143952 - RNA, 22 nt, Mycobacterium bovis subsp bovis AF2122/97
gucugugcucacggcggcgaac

SEQ ID NO: 1143953 - RNA, 16 nt, Mycobacterium bovis subsp bovis AF2122/97
gucuguucgccgacgc

SEQ ID NO: 1143954 - RNA, 15 nt, Mycobacterium bovis subsp bovis AF2122/97
gucuguuggugacag

SEQ ID NO: 1143955 - RNA, 23 nt, Mycobacterium bovis subsp bovis AF2122/97
gucuggucagccgcggcggcagc

SEQ ID NO: 1143956 - RNA, 22 nt, Mycobacterium bovis subsp bovis AF2122/97
gucugguggucggcgacgucgc

SEQ ID NO: 1143957 - RNA, 16 nt, Mycobacterium bovis subsp bovis AF2122/97
gucugggcaucaucga

SEQ ID NO: 1143958 - RNA, 22 nt, Mycobacterium bovis subsp bovis AF2122/97
gucugcuccaggcgcgccgcac

SEQ ID NO: 1143959 - RNA, 19 nt, Mycobacterium bovis subsp bovis AF2122/97
gucuggacaucggccggcg

SEQ ID NO: 1143960 - RNA, 17 nt, Mycobacterium bovis subsp bovis AF2122/97
gucuggcgaacagugac

SEQ ID NO: 1143961 - RNA, 15 nt, Mycobacterium bovis subsp bovis AF2122/97
gucuggcgguaucga

SEQ ID NO: 1143962 - RNA, 19 nt, Mycobacterium bovis subsp bovis AF2122/97
gucugcugggcacgauggc

SEQ ID NO: 1143963 - RNA, 20 nt, Mycobacterium bovis subsp bovis AF2122/97
gucugcucggcgagcgucgg

SEQ ID NO: 1143964 - RNA, 13 nt, Mycobacterium bovis subsp bovis AF2122/97
gucugcucggcgc

SEQ ID NO: 1143965 - RNA, 15 nt, Mycobacterium bovis subsp bovis AF2122/97
gucugcugaccggag

SEQ ID NO: 1143966 - RNA, 14 nt, Mycobacterium bovis subsp bovis AF2122/97
gucugcucgccgug

SEQ ID NO: 1143967 - RNA, 20 nt, Mycobacterium bovis subsp bovis AF2122/97
gucugcuccuuggcccagcg

SEQ ID NO: 1143968 - RNA, 15 nt, Mycobacterium bovis subsp bovis AF2122/97
gucugcucaccagcg

SEQ ID NO: 1143969 - RNA, 18 nt, Mycobacterium bovis subsp bovis AF2122/97
gucugcucagcgcggccc

SEQ ID NO: 1143970 - RNA, 17 nt, Mycobacterium bovis subsp bovis AF2122/97
gucugcgccgccggcgg

SEQ ID NO: 1143971 - RNA, 12 nt, Mycobacterium bovis subsp bovis AF2122/97
gucugcgccaga

SEQ ID NO: 1143972 - RNA, 24 nt, Mycobacterium bovis subsp bovis AF2122/97
gucugcagacgguccgcuacggcg

SEQ ID NO: 1143973 - RNA, 20 nt, Mycobacterium bovis subsp bovis AF2122/97
gucugcgccaaaauccgccc

SEQ ID NO: 1143974 - RNA, 19 nt, Mycobacterium bovis subsp bovis AF2122/97
gucugcgacccgggccgcg

SEQ ID NO: 1143975 - RNA, 15 nt, Mycobacterium bovis subsp bovis AF2122/97
gucugcgacuggauc

SEQ ID NO: 1143976 - RNA, 13 nt, Mycobacterium bovis subsp bovis AF2122/97
gucugcgcggugc

SEQ ID NO: 1143977 - RNA, 16 nt, Mycobacterium bovis subsp bovis AF2122/97
gucugcgcggugcccg

SEQ ID NO: 1143978 - RNA, 14 nt, Mycobacterium bovis subsp bovis AF2122/97
gucugcgcgucgcg

SEQ ID NO: 1143979 - RNA, 15 nt, Mycobacterium bovis subsp bovis AF2122/97
gucugcggaccggcg

SEQ ID NO: 1143980 - RNA, 18 nt, Mycobacterium bovis subsp bovis AF2122/97
gucugcgccuucgccagc

SEQ ID NO: 1143981 - RNA, 14 nt, Mycobacterium bovis subsp bovis AF2122/97
gucuuccagccagg

SEQ ID NO: 1143982 - RNA, 23 nt, Mycobacterium bovis subsp bovis AF2122/97
gucuuccaggagcgccgucaucg

SEQ ID NO: 1143983 - RNA, 18 nt, Mycobacterium bovis subsp bovis AF2122/97
gucuuacggucggcucca

SEQ ID NO: 1143984 - RNA, 13 nt, Mycobacterium bovis subsp bovis AF2122/97
gucuuaucggcgu

SEQ ID NO: 1143985 - RNA, 16 nt, Mycobacterium bovis subsp bovis AF2122/97
gucuuaucggcgucgu

SEQ ID NO: 1143986 - RNA, 14 nt, Mycobacterium bovis subsp bovis AF2122/97
gucuucgcugucga

SEQ ID NO: 1143987 - RNA, 21 nt, Mycobacterium bovis subsp bovis AF2122/97
gucuucgguuaaggugcgauc

SEQ ID NO: 1143988 - RNA, 23 nt, Mycobacterium bovis subsp bovis AF2122/97
gucuucgccgccaccggcgacgc

SEQ ID NO: 1143989 - RNA, 15 nt, Mycobacterium bovis subsp bovis AF2122/97
gucuuccucggccac

SEQ ID NO: 1143990 - RNA, 15 nt, Mycobacterium bovis subsp bovis AF2122/97
gucuuggcccggcgg

SEQ ID NO: 1143991 - RNA, 13 nt, Mycobacterium bovis subsp bovis AF2122/97
gucuuggcggcgg

SEQ ID NO: 1143992 - RNA, 22 nt, Mycobacterium bovis subsp bovis AF2122/97
gucuuggcggcggugcagcagg

SEQ ID NO: 1143993 - RNA, 16 nt, Mycobacterium bovis subsp bovis AF2122/97
gucuuggaucacgcga

SEQ ID NO: 1143994 - RNA, 17 nt, Mycobacterium bovis subsp bovis AF2122/97
gucuuggacagcagcag

SEQ ID NO: 1143995 - RNA, 20 nt, Mycobacterium bovis subsp bovis AF2122/97
gucuucgucgguguccucgg

SEQ ID NO: 1143996 - RNA, 22 nt, Mycobacterium bovis subsp bovis AF2122/97
gugaaaaacgcccgcgcugccg

SEQ ID NO: 1143997 - RNA, 21 nt, Mycobacterium bovis subsp bovis AF2122/97
gucuuggugcgcgucagccgc

SEQ ID NO: 1143998 - RNA, 20 nt, Mycobacterium bovis subsp bovis AF2122/97
gucuuugucacgcaccgcgg

SEQ ID NO: 1143999 - RNA, 21 nt, Mycobacterium bovis subsp bovis AF2122/97
gucuuucacguagcgaccgcg

SEQ ID NO: 1144000 - RNA, 13 nt, Mycobacterium bovis subsp bovis AF2122/97
gugaccucgaugg

SEQ ID NO: 1144001 - RNA, 15 nt, Mycobacterium bovis subsp bovis AF2122/97
gugaccucggcgacc

SEQ ID NO: 1144002 - RNA, 17 nt, Mycobacterium bovis subsp bovis AF2122/97
gugaccucggcgaccag

SEQ ID NO: 1144003 - RNA, 12 nt, Mycobacterium bovis subsp bovis AF2122/97
gugaccucgucg

SEQ ID NO: 1144004 - RNA, 13 nt, Mycobacterium bovis subsp bovis AF2122/97
gugaccucgucga

SEQ ID NO: 1144005 - RNA, 16 nt, Mycobacterium bovis subsp bovis AF2122/97
gugaccucgucgaccg

SEQ ID NO: 1144006 - RNA, 13 nt, Mycobacterium bovis subsp bovis AF2122/97
gugaccucgucgg

SEQ ID NO: 1144007 - RNA, 16 nt, Mycobacterium bovis subsp bovis AF2122/97
gugacgaaagcgccca

SEQ ID NO: 1144008 - RNA, 21 nt, Mycobacterium bovis subsp bovis AF2122/97
gugacgaccacgucgaggucc

SEQ ID NO: 1144009 - RNA, 14 nt, Mycobacterium bovis subsp bovis AF2122/97
gugacgaccagccc

SEQ ID NO: 1144010 - RNA, 12 nt, Mycobacterium bovis subsp bovis AF2122/97
gugaccgugccg

SEQ ID NO: 1144011 - RNA, 19 nt, Mycobacterium bovis subsp bovis AF2122/97
gugaccguauuucguccac

SEQ ID NO: 1144012 - RNA, 16 nt, Mycobacterium bovis subsp bovis AF2122/97
gugaccgggucgauca

SEQ ID NO: 1144013 - RNA, 22 nt, Mycobacterium bovis subsp bovis AF2122/97
gugaccgggucgaucaccgaca

SEQ ID NO: 1144014 - RNA, 18 nt, Mycobacterium bovis subsp bovis AF2122/97
gugaccggccugcgacga

SEQ ID NO: 1144015 - RNA, 21 nt, Mycobacterium bovis subsp bovis AF2122/97
gugacgccggccagucguacu

SEQ ID NO: 1144016 - RNA, 16 nt, Mycobacterium bovis subsp bovis AF2122/97
gugacgauugccacca

SEQ ID NO: 1144017 - RNA, 18 nt, Mycobacterium bovis subsp bovis AF2122/97
gugacgcaacaucggaug

SEQ ID NO: 1144018 - RNA, 13 nt, Mycobacterium bovis subsp bovis AF2122/97
gugacgcacagca

SEQ ID NO: 1144019 - RNA, 22 nt, Mycobacterium bovis subsp bovis AF2122/97
gugacgcacagcagcaccgcga

SEQ ID NO: 1144020 - RNA, 12 nt, Mycobacterium bovis subsp bovis AF2122/97
gugacgccgcca

SEQ ID NO: 1144021 - RNA, 13 nt, Mycobacterium bovis subsp bovis AF2122/97
gugacgccgccag

SEQ ID NO: 1144022 - RNA, 17 nt, Mycobacterium bovis subsp bovis AF2122/97
gugacgaugaccgcgcg

SEQ ID NO: 1144023 - RNA, 16 nt, Mycobacterium bovis subsp bovis AF2122/97
gugacgaucaagcugg

SEQ ID NO: 1144024 - RNA, 21 nt, Mycobacterium bovis subsp bovis AF2122/97
gugacgaucaggucgccgaga

SEQ ID NO: 1144025 - RNA, 23 nt, Mycobacterium bovis subsp bovis AF2122/97
gugacgaucaggucgccgagacc

SEQ ID NO: 1144026 - RNA, 18 nt, Mycobacterium bovis subsp bovis AF2122/97
gugacgacgucgccgccg

SEQ ID NO: 1144027 - RNA, 19 nt, Mycobacterium bovis subsp bovis AF2122/97
gugacgacgucgccgccgc

SEQ ID NO: 1144028 - RNA, 14 nt, Mycobacterium bovis subsp bovis AF2122/97
gugacgagccacca

SEQ ID NO: 1144029 - RNA, 23 nt, Mycobacterium bovis subsp bovis AF2122/97
gugacgagccaccaccgccgacc

SEQ ID NO: 1144030 - RNA, 17 nt, Mycobacterium bovis subsp bovis AF2122/97
gugacgccucgacaccc

SEQ ID NO: 1144031 - RNA, 16 nt, Mycobacterium bovis subsp bovis AF2122/97
gugagccgguggcccg

SEQ ID NO: 1144032 - RNA, 19 nt, Mycobacterium bovis subsp bovis AF2122/97
gugagccucuuggucaacg

SEQ ID NO: 1144033 - RNA, 21 nt, Mycobacterium bovis subsp bovis AF2122/97
gugagccuuucgugcaccgcg

SEQ ID NO: 1144034 - RNA, 18 nt, Mycobacterium bovis subsp bovis AF2122/97
gugagcgaucgggugcac

SEQ ID NO: 1144035 - RNA, 20 nt, Mycobacterium bovis subsp bovis AF2122/97
gugagccccagcgacgucgc

SEQ ID NO: 1144036 - RNA, 15 nt, Mycobacterium bovis subsp bovis AF2122/97
gugagccaugccgcu

SEQ ID NO: 1144037 - RNA, 18 nt, Mycobacterium bovis subsp bovis AF2122/97
gugagcccgggauaccgc

SEQ ID NO: 1144038 - RNA, 14 nt, Mycobacterium bovis subsp bovis AF2122/97
gugagcaugcgacg

SEQ ID NO: 1144039 - RNA, 19 nt, Mycobacterium bovis subsp bovis AF2122/97
gugagcaugcgacgucagg

SEQ ID NO: 1144040 - RNA, 22 nt, Mycobacterium bovis subsp bovis AF2122/97
gugagcagcucggugacaagcg

SEQ ID NO: 1144041 - RNA, 19 nt, Mycobacterium bovis subsp bovis AF2122/97
gugagcaccagcagcacca

SEQ ID NO: 1144042 - RNA, 17 nt, Mycobacterium bovis subsp bovis AF2122/97
gugaggcccgaguuuga

SEQ ID NO: 1144043 - RNA, 20 nt, Mycobacterium bovis subsp bovis AF2122/97
gugagcgcgcucaggucauc

SEQ ID NO: 1144044 - RNA, 13 nt, Mycobacterium bovis subsp bovis AF2122/97
gugagcgccgcgg

SEQ ID NO: 1144045 - RNA, 14 nt, Mycobacterium bovis subsp bovis AF2122/97
gugagcgccgcggc

SEQ ID NO: 1144046 - RNA, 12 nt, Mycobacterium bovis subsp bovis AF2122/97
gugagcgcgucg

SEQ ID NO: 1144047 - RNA, 15 nt, Mycobacterium bovis subsp bovis AF2122/97
gugagcgcgucgcgg

SEQ ID NO: 1144048 - RNA, 16 nt, Mycobacterium bovis subsp bovis AF2122/97
gugacguagugcaccg

SEQ ID NO: 1144049 - RNA, 23 nt, Mycobacterium bovis subsp bovis AF2122/97
gugacguagaccacgccggugac

SEQ ID NO: 1144050 - RNA, 19 nt, Mycobacterium bovis subsp bovis AF2122/97
gugacguagggcagcgcca

SEQ ID NO: 1144051 - RNA, 22 nt, Mycobacterium bovis subsp bovis AF2122/97
gugacggggcugaccgccaccc

SEQ ID NO: 1144052 - RNA, 19 nt, Mycobacterium bovis subsp bovis AF2122/97
gugacgggguugaccgcca

SEQ ID NO: 1144053 - RNA, 18 nt, Mycobacterium bovis subsp bovis AF2122/97
gugacggcggcaacggcg

SEQ ID NO: 1144054 - RNA, 18 nt, Mycobacterium bovis subsp bovis AF2122/97
gugacgguguuggugacc

SEQ ID NO: 1144055 - RNA, 16 nt, Mycobacterium bovis subsp bovis AF2122/97
gugagcaauggcgcga

SEQ ID NO: 1144056 - RNA, 16 nt, Mycobacterium bovis subsp bovis AF2122/97
gugagcaccagcagca

SEQ ID NO: 1144057 - RNA, 23 nt, Mycobacterium bovis subsp bovis AF2122/97
gugagauaccgacgcgcucggcg

SEQ ID NO: 1144058 - RNA, 23 nt, Mycobacterium bovis subsp bovis AF2122/97
gugagacgaaaagccgcgucgcg

SEQ ID NO: 1144059 - RNA, 19 nt, Mycobacterium bovis subsp bovis AF2122/97
gugacuuggagugcgggug

SEQ ID NO: 1144060 - RNA, 18 nt, Mycobacterium bovis subsp bovis AF2122/97
gugacuuugacccguucc

SEQ ID NO: 1144061 - RNA, 18 nt, Mycobacterium bovis subsp bovis AF2122/97
gugacucagaacguggcc

SEQ ID NO: 1144062 - RNA, 20 nt, Mycobacterium bovis subsp bovis AF2122/97
gugacucggccuccgccgag

SEQ ID NO: 1144063 - RNA, 15 nt, Mycobacterium bovis subsp bovis AF2122/97
gugacuucacucguu

SEQ ID NO: 1144064 - RNA, 17 nt, Mycobacterium bovis subsp bovis AF2122/97
gugacuucgcugcggug

SEQ ID NO: 1144065 - RNA, 12 nt, Mycobacterium bovis subsp bovis AF2122/97
gugacugguggc

SEQ ID NO: 1144066 - RNA, 18 nt, Mycobacterium bovis subsp bovis AF2122/97
gugacugguggcgccaac

SEQ ID NO: 1144067 - RNA, 19 nt, Mycobacterium bovis subsp bovis AF2122/97
gugacuuauccggccagug

SEQ ID NO: 1144068 - RNA, 20 nt, Mycobacterium bovis subsp bovis AF2122/97
gugacccggauaucgaccac

SEQ ID NO: 1144069 - RNA, 22 nt, Mycobacterium bovis subsp bovis AF2122/97
gugacccggauaucgaccaccg

SEQ ID NO: 1144070 - RNA, 15 nt, Mycobacterium bovis subsp bovis AF2122/97
gugacccgcugggcc

SEQ ID NO: 1144071 - RNA, 21 nt, Mycobacterium bovis subsp bovis AF2122/97
gugacccgcugggccgcaucg

SEQ ID NO: 1144072 - RNA, 23 nt, Mycobacterium bovis subsp bovis AF2122/97
gugacccauucucggccggcggc

SEQ ID NO: 1144073 - RNA, 14 nt, Mycobacterium bovis subsp bovis AF2122/97
gugacccgccggcg

SEQ ID NO: 1144074 - RNA, 16 nt, Mycobacterium bovis subsp bovis AF2122/97
gugacccgacaugguc

SEQ ID NO: 1144075 - RNA, 15 nt, Mycobacterium bovis subsp bovis AF2122/97
gugaccaccgccgac

SEQ ID NO: 1144076 - RNA, 17 nt, Mycobacterium bovis subsp bovis AF2122/97
gugaccaggaucgacag

SEQ ID NO: 1144077 - RNA, 15 nt, Mycobacterium bovis subsp bovis AF2122/97
gugaccagaucgacg

SEQ ID NO: 1144078 - RNA, 21 nt, Mycobacterium bovis subsp bovis AF2122/97
gugacccugaugaucguccag

SEQ ID NO: 1144079 - RNA, 19 nt, Mycobacterium bovis subsp bovis AF2122/97
gugaccgacugcggguucg

SEQ ID NO: 1144080 - RNA, 19 nt, Mycobacterium bovis subsp bovis AF2122/97
gugaccgagaagcccaccg

SEQ ID NO: 1144081 - RNA, 20 nt, Mycobacterium bovis subsp bovis AF2122/97
gugaccgagaucgucgcgac

SEQ ID NO: 1144082 - RNA, 13 nt, Mycobacterium bovis subsp bovis AF2122/97
gugaccgccgaug

SEQ ID NO: 1144083 - RNA, 13 nt, Mycobacterium bovis subsp bovis AF2122/97
gugaccgccgcgc

SEQ ID NO: 1144084 - RNA, 20 nt, Mycobacterium bovis subsp bovis AF2122/97
gugaccgccgcgccggcacg

SEQ ID NO: 1144085 - RNA, 22 nt, Mycobacterium bovis subsp bovis AF2122/97
gugaccgccguugucgaccucc

SEQ ID NO: 1144086 - RNA, 17 nt, Mycobacterium bovis subsp bovis AF2122/97
gugaccgacgccgucga

SEQ ID NO: 1144087 - RNA, 16 nt, Mycobacterium bovis subsp bovis AF2122/97
gugaccgccgaugccc

SEQ ID NO: 1144088 - RNA, 22 nt, Mycobacterium bovis subsp bovis AF2122/97
gugacauaccaagggauccgaa

SEQ ID NO: 1144089 - RNA, 23 nt, Mycobacterium bovis subsp bovis AF2122/97
gugacauagaccucgccggugac

SEQ ID NO: 1144090 - RNA, 17 nt, Mycobacterium bovis subsp bovis AF2122/97
gugacaucgcgaggcgu

SEQ ID NO: 1144091 - RNA, 19 nt, Mycobacterium bovis subsp bovis AF2122/97
gugacaucgggccgccgag

SEQ ID NO: 1144092 - RNA, 22 nt, Mycobacterium bovis subsp bovis AF2122/97
gugacaucgggccgccgagcuc

SEQ ID NO: 1144093 - RNA, 17 nt, Mycobacterium bovis subsp bovis AF2122/97
gugaccacgccguggcc

SEQ ID NO: 1144094 - RNA, 23 nt, Mycobacterium bovis subsp bovis AF2122/97
gugacaaggauggucgccugcgg

SEQ ID NO: 1144095 - RNA, 14 nt, Mycobacterium bovis subsp bovis AF2122/97
gugacaccacaucg

SEQ ID NO: 1144096 - RNA, 20 nt, Mycobacterium bovis subsp bovis AF2122/97
gugacagagcggguucgacg

SEQ ID NO: 1144097 - RNA, 14 nt, Mycobacterium bovis subsp bovis AF2122/97
gugaauccgugcag

SEQ ID NO: 1144098 - RNA, 20 nt, Mycobacterium bovis subsp bovis AF2122/97
gugacaccgaggucggccag

SEQ ID NO: 1144099 - RNA, 15 nt, Mycobacterium bovis subsp bovis AF2122/97
gugacagcccgcugg

SEQ ID NO: 1144100 - RNA, 19 nt, Mycobacterium bovis subsp bovis AF2122/97
gugacagcccgcuggccgu

SEQ ID NO: 1144101 - RNA, 21 nt, Mycobacterium bovis subsp bovis AF2122/97
gugaagugggcguuggcggca

SEQ ID NO: 1144102 - RNA, 19 nt, Mycobacterium bovis subsp bovis AF2122/97
gugaauaucucgccguaca

SEQ ID NO: 1144103 - RNA, 20 nt, Mycobacterium bovis subsp bovis AF2122/97
gugaaucgcacgacgcgaca

SEQ ID NO: 1144104 - RNA, 22 nt, Mycobacterium bovis subsp bovis AF2122/97
gugaauguugccgccgcggcgc

SEQ ID NO: 1144105 - RNA, 16 nt, Mycobacterium bovis subsp bovis AF2122/97
gugaauggcagcacga

SEQ ID NO: 1144106 - RNA, 17 nt, Mycobacterium bovis subsp bovis AF2122/97
gugaagcccuggccagc

SEQ ID NO: 1144107 - RNA, 22 nt, Mycobacterium bovis subsp bovis AF2122/97
gugaaguccgagacgucggcgu

SEQ ID NO: 1144108 - RNA, 23 nt, Mycobacterium bovis subsp bovis AF2122/97
gugaaguccuccacgcuggcgcc

SEQ ID NO: 1144109 - RNA, 17 nt, Mycobacterium bovis subsp bovis AF2122/97
gugaaguagucggcgcc

SEQ ID NO: 1144110 - RNA, 16 nt, Mycobacterium bovis subsp bovis AF2122/97
gugaagucacggcggc

SEQ ID NO: 1144111 - RNA, 19 nt, Mycobacterium bovis subsp bovis AF2122/97
gugaagugagcucggcugc

SEQ ID NO: 1144112 - RNA, 16 nt, Mycobacterium bovis subsp bovis AF2122/97
gugaagaucgacaccc

SEQ ID NO: 1144113 - RNA, 19 nt, Mycobacterium bovis subsp bovis AF2122/97
gugaagagaagucucgcgg

SEQ ID NO: 1144114 - RNA, 14 nt, Mycobacterium bovis subsp bovis AF2122/97
gugaagacaccagg

SEQ ID NO: 1144115 - RNA, 14 nt, Mycobacterium bovis subsp bovis AF2122/97
gugaacggcagcac

SEQ ID NO: 1144116 - RNA, 19 nt, Mycobacterium bovis subsp bovis AF2122/97
gugaacuucuccaccagcg

SEQ ID NO: 1144117 - RNA, 23 nt, Mycobacterium bovis subsp bovis AF2122/97
gugaacgacaugggcaggccgcg

SEQ ID NO: 1144118 - RNA, 22 nt, Mycobacterium bovis subsp bovis AF2122/97
gugaacgcgucguugucgucgc

SEQ ID NO: 1144119 - RNA, 16 nt, Mycobacterium bovis subsp bovis AF2122/97
gugaacggcagcacgg

SEQ ID NO: 1144120 - RNA, 20 nt, Mycobacterium bovis subsp bovis AF2122/97
gugaacggcgcgggccacca

SEQ ID NO: 1144121 - RNA, 18 nt, Mycobacterium bovis subsp bovis AF2122/97
gugaacggugucaacggc

SEQ ID NO: 1144122 - RNA, 20 nt, Mycobacterium bovis subsp bovis AF2122/97
gugaacgcggacaccgcggc

SEQ ID NO: 1144123 - RNA, 16 nt, Mycobacterium bovis subsp bovis AF2122/97
gugaaaucgcacagcg

SEQ ID NO: 1144124 - RNA, 17 nt, Mycobacterium bovis subsp bovis AF2122/97
gugaaaugacggcugaa

SEQ ID NO: 1144125 - RNA, 14 nt, Mycobacterium bovis subsp bovis AF2122/97
gugaaaugcgcgau

SEQ ID NO: 1144126 - RNA, 15 nt, Mycobacterium bovis subsp bovis AF2122/97
gugaaauugccgccg

SEQ ID NO: 1144127 - RNA, 16 nt, Mycobacterium bovis subsp bovis AF2122/97
gugaaauugccgccgc

SEQ ID NO: 1144128 - RNA, 22 nt, Mycobacterium bovis subsp bovis AF2122/97
gugaaccaccacuucggcgccg

SEQ ID NO: 1144129 - RNA, 13 nt, Mycobacterium bovis subsp bovis AF2122/97
gugaacagcaggu

SEQ ID NO: 1144130 - RNA, 20 nt, Mycobacterium bovis subsp bovis AF2122/97
gugaacaggccgaggcgagu

SEQ ID NO: 1144131 - RNA, 15 nt, Mycobacterium bovis subsp bovis AF2122/97
gugaaccgcgcggcg

SEQ ID NO: 1144132 - RNA, 16 nt, Mycobacterium bovis subsp bovis AF2122/97
gugaaccgcgcggcga

SEQ ID NO: 1144133 - RNA, 17 nt, Mycobacterium bovis subsp bovis AF2122/97
gugaaccggaccugggu

SEQ ID NO: 1144134 - RNA, 13 nt, Mycobacterium bovis subsp bovis AF2122/97
gugaacccgccgg

SEQ ID NO: 1144135 - RNA, 19 nt, Mycobacterium bovis subsp bovis AF2122/97
gugaaccuggcgacgcgac

SEQ ID NO: 1144136 - RNA, 23 nt, Mycobacterium bovis subsp bovis AF2122/97
gugaaccuuacgacgccguaucg

SEQ ID NO: 1144137 - RNA, 19 nt, Mycobacterium bovis subsp bovis AF2122/97
gucggucaccauggcgccg

SEQ ID NO: 1144138 - RNA, 18 nt, Mycobacterium bovis subsp bovis AF2122/97
gucggucacgacggcacg

SEQ ID NO: 1144139 - RNA, 18 nt, Mycobacterium bovis subsp bovis AF2122/97
gucggucaaaccggugcc

SEQ ID NO: 1144140 - RNA, 15 nt, Mycobacterium bovis subsp bovis AF2122/97
gucggucaccauggc

SEQ ID NO: 1144141 - RNA, 16 nt, Mycobacterium bovis subsp bovis AF2122/97
gucggguugguuggcu

SEQ ID NO: 1144142 - RNA, 19 nt, Mycobacterium bovis subsp bovis AF2122/97
gucggguugguuggcucgc

SEQ ID NO: 1144143 - RNA, 15 nt, Mycobacterium bovis subsp bovis AF2122/97
gucggguuuggccga

SEQ ID NO: 1144144 - RNA, 17 nt, Mycobacterium bovis subsp bovis AF2122/97
gucgguaaagggcucga

SEQ ID NO: 1144145 - RNA, 23 nt, Mycobacterium bovis subsp bovis AF2122/97
gucgguaaagggcucgauggugu

SEQ ID NO: 1144146 - RNA, 17 nt, Mycobacterium bovis subsp bovis AF2122/97
gucgguaacggcggugc

SEQ ID NO: 1144147 - RNA, 22 nt, Mycobacterium bovis subsp bovis AF2122/97
gucgguaccgcccaguugggcc

SEQ ID NO: 1144148 - RNA, 16 nt, Mycobacterium bovis subsp bovis AF2122/97
gucgguaccguccucg

SEQ ID NO: 1144149 - RNA, 17 nt, Mycobacterium bovis subsp bovis AF2122/97
gucggguuccuccucgg

SEQ ID NO: 1144150 - RNA, 16 nt, Mycobacterium bovis subsp bovis AF2122/97
gucgggugugcgcaga

SEQ ID NO: 1144151 - RNA, 18 nt, Mycobacterium bovis subsp bovis AF2122/97
gucgggugugcaggccgc

SEQ ID NO: 1144152 - RNA, 17 nt, Mycobacterium bovis subsp bovis AF2122/97
gucggguugcgacgaac

SEQ ID NO: 1144153 - RNA, 18 nt, Mycobacterium bovis subsp bovis AF2122/97
gucgggucccagccuggc

SEQ ID NO: 1144154 - RNA, 21 nt, Mycobacterium bovis subsp bovis AF2122/97
gucgggguuucaggcggcagg

SEQ ID NO: 1144155 - RNA, 14 nt, Mycobacterium bovis subsp bovis AF2122/97
gucggguaggccgc

SEQ ID NO: 1144156 - RNA, 17 nt, Mycobacterium bovis subsp bovis AF2122/97
gucggguaggccgccgu

SEQ ID NO: 1144157 - RNA, 23 nt, Mycobacterium bovis subsp bovis AF2122/97
gucggguagggcaucgucgccga

SEQ ID NO: 1144158 - RNA, 13 nt, Mycobacterium bovis subsp bovis AF2122/97
gucgggucgcacc

SEQ ID NO: 1144159 - RNA, 14 nt, Mycobacterium bovis subsp bovis AF2122/97
gucgggucgcaccc

SEQ ID NO: 1144160 - RNA, 20 nt, Mycobacterium bovis subsp bovis AF2122/97
gucggucaugucggccaccg

SEQ ID NO: 1144161 - RNA, 19 nt, Mycobacterium bovis subsp bovis AF2122/97
gucggucccagguuggagc

SEQ ID NO: 1144162 - RNA, 21 nt, Mycobacterium bovis subsp bovis AF2122/97
gucggucccagguuggagccc

SEQ ID NO: 1144163 - RNA, 23 nt, Mycobacterium bovis subsp bovis AF2122/97
gucgguccugccaaugcugcagg

SEQ ID NO: 1144164 - RNA, 19 nt, Mycobacterium bovis subsp bovis AF2122/97
gucggucaggucgaggucc

SEQ ID NO: 1144165 - RNA, 18 nt, Mycobacterium bovis subsp bovis AF2122/97
gucggucaucgguugacc

SEQ ID NO: 1144166 - RNA, 18 nt, Mycobacterium bovis subsp bovis AF2122/97
gucggucgcuucagcgcc

SEQ ID NO: 1144167 - RNA, 19 nt, Mycobacterium bovis subsp bovis AF2122/97
gucggugaccucggcgacc

SEQ ID NO: 1144168 - RNA, 20 nt, Mycobacterium bovis subsp bovis AF2122/97
gucggugagccgugccgcca

SEQ ID NO: 1144169 - RNA, 17 nt, Mycobacterium bovis subsp bovis AF2122/97
gucggugaccguucggc

SEQ ID NO: 1144170 - RNA, 16 nt, Mycobacterium bovis subsp bovis AF2122/97
gucggugaaugccguc

SEQ ID NO: 1144171 - RNA, 19 nt, Mycobacterium bovis subsp bovis AF2122/97
gucggugaaugccgucgcc

SEQ ID NO: 1144172 - RNA, 17 nt, Mycobacterium bovis subsp bovis AF2122/97
gucggugaacccgccgg

SEQ ID NO: 1144173 - RNA, 23 nt, Mycobacterium bovis subsp bovis AF2122/97
gucggucuuuggcauugccgcca

SEQ ID NO: 1144174 - RNA, 21 nt, Mycobacterium bovis subsp bovis AF2122/97
gucggugaaaugacggcugaa

SEQ ID NO: 1144175 - RNA, 20 nt, Mycobacterium bovis subsp bovis AF2122/97
gucggugaucaccgcggcgg

SEQ ID NO: 1144176 - RNA, 18 nt, Mycobacterium bovis subsp bovis AF2122/97
gucggugaucacggucgg

SEQ ID NO: 1144177 - RNA, 15 nt, Mycobacterium bovis subsp bovis AF2122/97
gucggugccgagcgc

SEQ ID NO: 1144178 - RNA, 22 nt, Mycobacterium bovis subsp bovis AF2122/97
gucggggccgucgucggucacc

SEQ ID NO: 1144179 - RNA, 22 nt, Mycobacterium bovis subsp bovis AF2122/97
gucgggggcuuuuacgucugcu

SEQ ID NO: 1144180 - RNA, 21 nt, Mycobacterium bovis subsp bovis AF2122/97
gucgggguacaggcugcugcg

SEQ ID NO: 1144181 - RNA, 19 nt, Mycobacterium bovis subsp bovis AF2122/97
gucggggucaacaggccgu

SEQ ID NO: 1144182 - RNA, 24 nt, Mycobacterium bovis subsp bovis AF2122/97
gucggggucaacaggccguggcgg

SEQ ID NO: 1144183 - RNA, 18 nt, Mycobacterium bovis subsp bovis AF2122/97
gucgggguggcgguccgg

SEQ ID NO: 1144184 - RNA, 20 nt, Mycobacterium bovis subsp bovis AF2122/97
gucggggugggacaggucgg

SEQ ID NO: 1144185 - RNA, 22 nt, Mycobacterium bovis subsp bovis AF2122/97
gucgggguguucgaugggugca

SEQ ID NO: 1144186 - RNA, 19 nt, Mycobacterium bovis subsp bovis AF2122/97
gucgggcuggguggccaac

SEQ ID NO: 1144187 - RNA, 14 nt, Mycobacterium bovis subsp bovis AF2122/97
gucgggcucggcga

SEQ ID NO: 1144188 - RNA, 17 nt, Mycobacterium bovis subsp bovis AF2122/97
gucgggcugaguggcga

SEQ ID NO: 1144189 - RNA, 20 nt, Mycobacterium bovis subsp bovis AF2122/97
gucgggcucgcauucggcga

SEQ ID NO: 1144190 - RNA, 22 nt, Mycobacterium bovis subsp bovis AF2122/97
gucgggcucgcauucggcgagc

SEQ ID NO: 1144191 - RNA, 15 nt, Mycobacterium bovis subsp bovis AF2122/97
gucgggcgcgcugcc

SEQ ID NO: 1144192 - RNA, 15 nt, Mycobacterium bovis subsp bovis AF2122/97
gucgggcgcaacggg

SEQ ID NO: 1144193 - RNA, 19 nt, Mycobacterium bovis subsp bovis AF2122/97
gucgggcuaauccagcagc

SEQ ID NO: 1144194 - RNA, 12 nt, Mycobacterium bovis subsp bovis AF2122/97
gucgggcgguaa

SEQ ID NO: 1144195 - RNA, 21 nt, Mycobacterium bovis subsp bovis AF2122/97
gucgggcgucccggcggucag

SEQ ID NO: 1144196 - RNA, 20 nt, Mycobacterium bovis subsp bovis AF2122/97
gucgggcacaccgacgccgc

SEQ ID NO: 1144197 - RNA, 14 nt, Mycobacterium bovis subsp bovis AF2122/97
gucgggcaccgcgc

SEQ ID NO: 1144198 - RNA, 20 nt, Mycobacterium bovis subsp bovis AF2122/97
gucgggcagauaugacggca

SEQ ID NO: 1144199 - RNA, 21 nt, Mycobacterium bovis subsp bovis AF2122/97
gucgggcccgaugucgucgac

SEQ ID NO: 1144200 - RNA, 17 nt, Mycobacterium bovis subsp bovis AF2122/97
gucgggcauggcggcgu

SEQ ID NO: 1144201 - RNA, 14 nt, Mycobacterium bovis subsp bovis AF2122/97
gucgggccaggcga

SEQ ID NO: 1144202 - RNA, 11 nt, Mycobacterium bovis subsp bovis AF2122/97
gucggcggcgu

SEQ ID NO: 1144203 - RNA, 23 nt, Mycobacterium bovis subsp bovis AF2122/97
gucggcggcuuccucgagcgaac

SEQ ID NO: 1144204 - RNA, 22 nt, Mycobacterium bovis subsp bovis AF2122/97
gucggcggccuucuccccgauc

SEQ ID NO: 1144205 - RNA, 16 nt, Mycobacterium bovis subsp bovis AF2122/97
gucggcgggcggcagc

SEQ ID NO: 1144206 - RNA, 22 nt, Mycobacterium bovis subsp bovis AF2122/97
gucggcgggcggcagcgagucg

SEQ ID NO: 1144207 - RNA, 15 nt, Mycobacterium bovis subsp bovis AF2122/97
gucggcgggcgugug

SEQ ID NO: 1144208 - RNA, 14 nt, Mycobacterium bovis subsp bovis AF2122/97
gucggcggcgacgu

SEQ ID NO: 1144209 - RNA, 16 nt, Mycobacterium bovis subsp bovis AF2122/97
gucggcgcgcaccucg

SEQ ID NO: 1144210 - RNA, 23 nt, Mycobacterium bovis subsp bovis AF2122/97
gucggcggguagaaccagcccgg

SEQ ID NO: 1144211 - RNA, 21 nt, Mycobacterium bovis subsp bovis AF2122/97
gucggcgguagccgaccagcg

SEQ ID NO: 1144212 - RNA, 14 nt, Mycobacterium bovis subsp bovis AF2122/97
gucggcgccgagca

SEQ ID NO: 1144213 - RNA, 17 nt, Mycobacterium bovis subsp bovis AF2122/97
gucggcggggcgccgga

SEQ ID NO: 1144214 - RNA, 15 nt, Mycobacterium bovis subsp bovis AF2122/97
gucggcguuggggcu

SEQ ID NO: 1144215 - RNA, 18 nt, Mycobacterium bovis subsp bovis AF2122/97
gucggcguuggggcucgu

SEQ ID NO: 1144216 - RNA, 18 nt, Mycobacterium bovis subsp bovis AF2122/97
gucggcucgagucgcagc

SEQ ID NO: 1144217 - RNA, 16 nt, Mycobacterium bovis subsp bovis AF2122/97
gucggcuaccgccgac

SEQ ID NO: 1144218 - RNA, 18 nt, Mycobacterium bovis subsp bovis AF2122/97
gucggcuaccgccgaccg

SEQ ID NO: 1144219 - RNA, 16 nt, Mycobacterium bovis subsp bovis AF2122/97
gucggcuacggccagu

SEQ ID NO: 1144220 - RNA, 16 nt, Mycobacterium bovis subsp bovis AF2122/97
gucggcuagcaacggg

SEQ ID NO: 1144221 - RNA, 15 nt, Mycobacterium bovis subsp bovis AF2122/97
gucgggacggccaac

SEQ ID NO: 1144222 - RNA, 18 nt, Mycobacterium bovis subsp bovis AF2122/97
gucgggacgccgcccccg

SEQ ID NO: 1144223 - RNA, 15 nt, Mycobacterium bovis subsp bovis AF2122/97
gucgggacgcugccg

SEQ ID NO: 1144224 - RNA, 16 nt, Mycobacterium bovis subsp bovis AF2122/97
gucgggacgcugccgg

SEQ ID NO: 1144225 - RNA, 22 nt, Mycobacterium bovis subsp bovis AF2122/97
gucgggaccggcuugccgccgu

SEQ ID NO: 1144226 - RNA, 18 nt, Mycobacterium bovis subsp bovis AF2122/97
gucgggauggacggcagc

SEQ ID NO: 1144227 - RNA, 21 nt, Mycobacterium bovis subsp bovis AF2122/97
gucgggauggacggcagccag

SEQ ID NO: 1144228 - RNA, 15 nt, Mycobacterium bovis subsp bovis AF2122/97
gucgggcacaccgac

SEQ ID NO: 1144229 - RNA, 17 nt, Mycobacterium bovis subsp bovis AF2122/97
gucgggcacaccgacgc

SEQ ID NO: 1144230 - RNA, 21 nt, Mycobacterium bovis subsp bovis AF2122/97
gucgggcaacuucagcaacgg

SEQ ID NO: 1144231 - RNA, 17 nt, Mycobacterium bovis subsp bovis AF2122/97
gucgggcaaggcggcgg

SEQ ID NO: 1144232 - RNA, 19 nt, Mycobacterium bovis subsp bovis AF2122/97
gucggcucggcccccgaga

SEQ ID NO: 1144233 - RNA, 14 nt, Mycobacterium bovis subsp bovis AF2122/97
gucggcugccgcgg

SEQ ID NO: 1144234 - RNA, 15 nt, Mycobacterium bovis subsp bovis AF2122/97
gucggcugccgcggc

SEQ ID NO: 1144235 - RNA, 16 nt, Mycobacterium bovis subsp bovis AF2122/97
gucggcugccgcggcu

SEQ ID NO: 1144236 - RNA, 13 nt, Mycobacterium bovis subsp bovis AF2122/97
gucggcugucgug

SEQ ID NO: 1144237 - RNA, 17 nt, Mycobacterium bovis subsp bovis AF2122/97
gucggcuggacggcgcc

SEQ ID NO: 1144238 - RNA, 21 nt, Mycobacterium bovis subsp bovis AF2122/97
gucggcugucgugccucucgg

SEQ ID NO: 1144239 - RNA, 21 nt, Mycobacterium bovis subsp bovis AF2122/97
gucggcgaagcacaccguccg

SEQ ID NO: 1144240 - RNA, 23 nt, Mycobacterium bovis subsp bovis AF2122/97
gucggcgaccgagacggcgucgg

SEQ ID NO: 1144241 - RNA, 16 nt, Mycobacterium bovis subsp bovis AF2122/97
gucggcgaauuccucg

SEQ ID NO: 1144242 - RNA, 17 nt, Mycobacterium bovis subsp bovis AF2122/97
gucggcgaccaccccgu

SEQ ID NO: 1144243 - RNA, 13 nt, Mycobacterium bovis subsp bovis AF2122/97
gucggcgaccagg

SEQ ID NO: 1144244 - RNA, 15 nt, Mycobacterium bovis subsp bovis AF2122/97
gucggcgaccgcgcu

SEQ ID NO: 1144245 - RNA, 13 nt, Mycobacterium bovis subsp bovis AF2122/97
gucggcgccgaag

SEQ ID NO: 1144246 - RNA, 13 nt, Mycobacterium bovis subsp bovis AF2122/97
gucggcgccgagc

SEQ ID NO: 1144247 - RNA, 17 nt, Mycobacterium bovis subsp bovis AF2122/97
gucggcgaccccgaaca

SEQ ID NO: 1144248 - RNA, 14 nt, Mycobacterium bovis subsp bovis AF2122/97
gucggcgccgaagc

SEQ ID NO: 1144249 - RNA, 14 nt, Mycobacterium bovis subsp bovis AF2122/97
gucggcgccggcau

SEQ ID NO: 1144250 - RNA, 15 nt, Mycobacterium bovis subsp bovis AF2122/97
gucggcgccggcggc

SEQ ID NO: 1144251 - RNA, 16 nt, Mycobacterium bovis subsp bovis AF2122/97
gucggcgccggcggcc

SEQ ID NO: 1144252 - RNA, 19 nt, Mycobacterium bovis subsp bovis AF2122/97
gucggcgaacgcguccagc

SEQ ID NO: 1144253 - RNA, 19 nt, Mycobacterium bovis subsp bovis AF2122/97
gucggcgaacaaccgccgc

SEQ ID NO: 1144254 - RNA, 21 nt, Mycobacterium bovis subsp bovis AF2122/97
gucggcgaaccacggcagcca

SEQ ID NO: 1144255 - RNA, 17 nt, Mycobacterium bovis subsp bovis AF2122/97
gucgcgggccaccaccg

SEQ ID NO: 1144256 - RNA, 15 nt, Mycobacterium bovis subsp bovis AF2122/97
gucgcgggccaccgc

SEQ ID NO: 1144257 - RNA, 19 nt, Mycobacterium bovis subsp bovis AF2122/97
gucggcgaaaggccagucg

SEQ ID NO: 1144258 - RNA, 22 nt, Mycobacterium bovis subsp bovis AF2122/97
gucgcgggccaagccggagccc

SEQ ID NO: 1144259 - RNA, 16 nt, Mycobacterium bovis subsp bovis AF2122/97
gucgcggaaguagcgc

SEQ ID NO: 1144260 - RNA, 21 nt, Mycobacterium bovis subsp bovis AF2122/97
gucgcgggagaaaacggcggc

SEQ ID NO: 1144261 - RNA, 13 nt, Mycobacterium bovis subsp bovis AF2122/97
gucgcggcguucg

SEQ ID NO: 1144262 - RNA, 22 nt, Mycobacterium bovis subsp bovis AF2122/97
gucgcggcgcuggcugcgguag

SEQ ID NO: 1144263 - RNA, 13 nt, Mycobacterium bovis subsp bovis AF2122/97
gucgcggcggcac

SEQ ID NO: 1144264 - RNA, 15 nt, Mycobacterium bovis subsp bovis AF2122/97
gucgcggcggcacua

SEQ ID NO: 1144265 - RNA, 12 nt, Mycobacterium bovis subsp bovis AF2122/97
gucgucgccgcc

SEQ ID NO: 1144266 - RNA, 14 nt, Mycobacterium bovis subsp bovis AF2122/97
gucgucgccgccga

SEQ ID NO: 1144267 - RNA, 13 nt, Mycobacterium bovis subsp bovis AF2122/97
gucgucgccccgg

SEQ ID NO: 1144268 - RNA, 14 nt, Mycobacterium bovis subsp bovis AF2122/97
gucgucgccggcgg

SEQ ID NO: 1144269 - RNA, 15 nt, Mycobacterium bovis subsp bovis AF2122/97
gucgucgcgauccac

SEQ ID NO: 1144270 - RNA, 17 nt, Mycobacterium bovis subsp bovis AF2122/97
gucgucgcggccgguuc

SEQ ID NO: 1144271 - RNA, 19 nt, Mycobacterium bovis subsp bovis AF2122/97
gucgucggaguaccgcgcg

SEQ ID NO: 1144272 - RNA, 16 nt, Mycobacterium bovis subsp bovis AF2122/97
gucgucggcaugggcc

SEQ ID NO: 1144273 - RNA, 21 nt, Mycobacterium bovis subsp bovis AF2122/97
gucgucggcaugggccggcgc

SEQ ID NO: 1144274 - RNA, 21 nt, Mycobacterium bovis subsp bovis AF2122/97
gucgucggccaaagacccggc

SEQ ID NO: 1144275 - RNA, 18 nt, Mycobacterium bovis subsp bovis AF2122/97
gucgucggccugcgccgg

SEQ ID NO: 1144276 - RNA, 19 nt, Mycobacterium bovis subsp bovis AF2122/97
gucgucguagcuggcgauc

SEQ ID NO: 1144277 - RNA, 16 nt, Mycobacterium bovis subsp bovis AF2122/97
gucgucggcggcgacg

SEQ ID NO: 1144278 - RNA, 18 nt, Mycobacterium bovis subsp bovis AF2122/97
gucgucggcgucccaggg

SEQ ID NO: 1144279 - RNA, 17 nt, Mycobacterium bovis subsp bovis AF2122/97
gucgucgggaacgccga

SEQ ID NO: 1144280 - RNA, 21 nt, Mycobacterium bovis subsp bovis AF2122/97
gucgucggucaugucggccac

SEQ ID NO: 1144281 - RNA, 14 nt, Mycobacterium bovis subsp bovis AF2122/97
gucgucggguucgc

SEQ ID NO: 1144282 - RNA, 22 nt, Mycobacterium bovis subsp bovis AF2122/97
gucgucgguaaugccgggcccu

SEQ ID NO: 1144283 - RNA, 21 nt, Mycobacterium bovis subsp bovis AF2122/97
gucgucguguuggccgggucg

SEQ ID NO: 1144284 - RNA, 22 nt, Mycobacterium bovis subsp bovis AF2122/97
gucgucgucccagggcugccgg

SEQ ID NO: 1144285 - RNA, 17 nt, Mycobacterium bovis subsp bovis AF2122/97
gucgucuuuggucagcc

SEQ ID NO: 1144286 - RNA, 17 nt, Mycobacterium bovis subsp bovis AF2122/97
gucgugacaaccaucgg

SEQ ID NO: 1144287 - RNA, 14 nt, Mycobacterium bovis subsp bovis AF2122/97
gucgugaccggcgg

SEQ ID NO: 1144288 - RNA, 22 nt, Mycobacterium bovis subsp bovis AF2122/97
gucgugagacugggcgcuggag

SEQ ID NO: 1144289 - RNA, 15 nt, Mycobacterium bovis subsp bovis AF2122/97
gucgucuuggcgauc

SEQ ID NO: 1144290 - RNA, 15 nt, Mycobacterium bovis subsp bovis AF2122/97
gucgugaaaccacac

SEQ ID NO: 1144291 - RNA, 22 nt, Mycobacterium bovis subsp bovis AF2122/97
gucguugccagggcgggcgucg

SEQ ID NO: 1144292 - RNA, 20 nt, Mycobacterium bovis subsp bovis AF2122/97
gucguugauuucggcggcga

SEQ ID NO: 1144293 - RNA, 22 nt, Mycobacterium bovis subsp bovis AF2122/97
gucguugcgugcauaggccgcg

SEQ ID NO: 1144294 - RNA, 20 nt, Mycobacterium bovis subsp bovis AF2122/97
gucguugcuggugugcgggu

SEQ ID NO: 1144295 - RNA, 21 nt, Mycobacterium bovis subsp bovis AF2122/97
gucguugccggacaaccuggg

SEQ ID NO: 1144296 - RNA, 21 nt, Mycobacterium bovis subsp bovis AF2122/97
gucguggugcaacacgccggc

SEQ ID NO: 1144297 - RNA, 14 nt, Mycobacterium bovis subsp bovis AF2122/97
gucguggucggcga

SEQ ID NO: 1144298 - RNA, 12 nt, Mycobacterium bovis subsp bovis AF2122/97
gucguggucgau

SEQ ID NO: 1144299 - RNA, 16 nt, Mycobacterium bovis subsp bovis AF2122/97
gucgugucgccgccgu

SEQ ID NO: 1144300 - RNA, 22 nt, Mycobacterium bovis subsp bovis AF2122/97
gucguguggguguugucgucga

SEQ ID NO: 1144301 - RNA, 14 nt, Mycobacterium bovis subsp bovis AF2122/97
gucgugaucggcga

SEQ ID NO: 1144302 - RNA, 20 nt, Mycobacterium bovis subsp bovis AF2122/97
gucgugaucggcgaacccac

SEQ ID NO: 1144303 - RNA, 18 nt, Mycobacterium bovis subsp bovis AF2122/97
gucgugaucggcgucagg

SEQ ID NO: 1144304 - RNA, 16 nt, Mycobacterium bovis subsp bovis AF2122/97
gucgugcgcggccggc

SEQ ID NO: 1144305 - RNA, 20 nt, Mycobacterium bovis subsp bovis AF2122/97
gucgugcgcggccggcacga

SEQ ID NO: 1144306 - RNA, 20 nt, Mycobacterium bovis subsp bovis AF2122/97
gucgugcguugccgucgaga

SEQ ID NO: 1144307 - RNA, 12 nt, Mycobacterium bovis subsp bovis AF2122/97
gucgugccccgg

SEQ ID NO: 1144308 - RNA, 13 nt, Mycobacterium bovis subsp bovis AF2122/97
gucgugccccggc

SEQ ID NO: 1144309 - RNA, 16 nt, Mycobacterium bovis subsp bovis AF2122/97
gucgugccccggcgcg

SEQ ID NO: 1144310 - RNA, 14 nt, Mycobacterium bovis subsp bovis AF2122/97
gucgugcucucggc

SEQ ID NO: 1144311 - RNA, 17 nt, Mycobacterium bovis subsp bovis AF2122/97
gucgugcucucggcgaa

SEQ ID NO: 1144312 - RNA, 18 nt, Mycobacterium bovis subsp bovis AF2122/97
gucgugcucucggcgaau

SEQ ID NO: 1144313 - RNA, 22 nt, Mycobacterium bovis subsp bovis AF2122/97
gucguggggaccggcaggccgg

SEQ ID NO: 1144314 - RNA, 19 nt, Mycobacterium bovis subsp bovis AF2122/97
gucguggcgguggccgucg

SEQ ID NO: 1144315 - RNA, 20 nt, Mycobacterium bovis subsp bovis AF2122/97
gucguggcgguggccgucgg

SEQ ID NO: 1144316 - RNA, 17 nt, Mycobacterium bovis subsp bovis AF2122/97
gucguggcgcucggcga

SEQ ID NO: 1144317 - RNA, 18 nt, Mycobacterium bovis subsp bovis AF2122/97
gucguggcgcucggcgag

SEQ ID NO: 1144318 - RNA, 22 nt, Mycobacterium bovis subsp bovis AF2122/97
gucgugguccuuguuguggugg

SEQ ID NO: 1144319 - RNA, 23 nt, Mycobacterium bovis subsp bovis AF2122/97
gucgguggcaacgggucggcauu

SEQ ID NO: 1144320 - RNA, 12 nt, Mycobacterium bovis subsp bovis AF2122/97
gucggugcggaa

SEQ ID NO: 1144321 - RNA, 20 nt, Mycobacterium bovis subsp bovis AF2122/97
gucggugcggaacacgaugc

SEQ ID NO: 1144322 - RNA, 10 nt, Mycobacterium bovis subsp bovis AF2122/97
gucggugcgg

SEQ ID NO: 1144323 - RNA, 14 nt, Mycobacterium bovis subsp bovis AF2122/97
gucggugccgccgc

SEQ ID NO: 1144324 - RNA, 16 nt, Mycobacterium bovis subsp bovis AF2122/97
gucggugccgccgccg

SEQ ID NO: 1144325 - RNA, 23 nt, Mycobacterium bovis subsp bovis AF2122/97
gucggugccggggcugccgccgu

SEQ ID NO: 1144326 - RNA, 14 nt, Mycobacterium bovis subsp bovis AF2122/97
gucggugccgucga

SEQ ID NO: 1144327 - RNA, 18 nt, Mycobacterium bovis subsp bovis AF2122/97
gucggugcgcgcggcgac

SEQ ID NO: 1144328 - RNA, 21 nt, Mycobacterium bovis subsp bovis AF2122/97
gucggugauggucagcuggcc

SEQ ID NO: 1144329 - RNA, 16 nt, Mycobacterium bovis subsp bovis AF2122/97
gucggugccaccacgc

SEQ ID NO: 1144330 - RNA, 15 nt, Mycobacterium bovis subsp bovis AF2122/97
gucgguggccgcggc

SEQ ID NO: 1144331 - RNA, 18 nt, Mycobacterium bovis subsp bovis AF2122/97
gucggugggcggcgagcg

SEQ ID NO: 1144332 - RNA, 16 nt, Mycobacterium bovis subsp bovis AF2122/97
gucgguguuccgccgc

SEQ ID NO: 1144333 - RNA, 17 nt, Mycobacterium bovis subsp bovis AF2122/97
gucgguguuuggccgcc

SEQ ID NO: 1144334 - RNA, 22 nt, Mycobacterium bovis subsp bovis AF2122/97
gucgguguuuggccgccgaauc

SEQ ID NO: 1144335 - RNA, 19 nt, Mycobacterium bovis subsp bovis AF2122/97
gucggugguaccggcggcg

SEQ ID NO: 1144336 - RNA, 17 nt, Mycobacterium bovis subsp bovis AF2122/97
gucgguggucucgacgg

SEQ ID NO: 1144337 - RNA, 21 nt, Mycobacterium bovis subsp bovis AF2122/97
gucgguguagcaacgguagcg

SEQ ID NO: 1144338 - RNA, 16 nt, Mycobacterium bovis subsp bovis AF2122/97
gucguacucgaccgcg

SEQ ID NO: 1144339 - RNA, 16 nt, Mycobacterium bovis subsp bovis AF2122/97
gucguacucggcggcc

SEQ ID NO: 1144340 - RNA, 14 nt, Mycobacterium bovis subsp bovis AF2122/97
gucguacucgaccg

SEQ ID NO: 1144341 - RNA, 19 nt, Mycobacterium bovis subsp bovis AF2122/97
gucguagagauacgggaac

SEQ ID NO: 1144342 - RNA, 17 nt, Mycobacterium bovis subsp bovis AF2122/97
gucguagcgacgccauc

SEQ ID NO: 1144343 - RNA, 20 nt, Mycobacterium bovis subsp bovis AF2122/97
gucggugugcaucgccggca

SEQ ID NO: 1144344 - RNA, 22 nt, Mycobacterium bovis subsp bovis AF2122/97
gucguagcucgguaggccggca

SEQ ID NO: 1144345 - RNA, 18 nt, Mycobacterium bovis subsp bovis AF2122/97
gucguaggacaccaccgu

SEQ ID NO: 1144346 - RNA, 13 nt, Mycobacterium bovis subsp bovis AF2122/97
gucguaacugccc

SEQ ID NO: 1144347 - RNA, 19 nt, Mycobacterium bovis subsp bovis AF2122/97
gucguaacugcccgcggcg

SEQ ID NO: 1144348 - RNA, 21 nt, Mycobacterium bovis subsp bovis AF2122/97
gucgguugccacgccgccggu

SEQ ID NO: 1144349 - RNA, 21 nt, Mycobacterium bovis subsp bovis AF2122/97
gucgguucagccacgcagcac

SEQ ID NO: 1144350 - RNA, 22 nt, Mycobacterium bovis subsp bovis AF2122/97
gucgguucagccacgcagcacg

SEQ ID NO: 1144351 - RNA, 20 nt, Mycobacterium bovis subsp bovis AF2122/97
gucguacaccucgagcgcgg

SEQ ID NO: 1144352 - RNA, 17 nt, Mycobacterium bovis subsp bovis AF2122/97
gucguacaugggcagau

SEQ ID NO: 1144353 - RNA, 17 nt, Mycobacterium bovis subsp bovis AF2122/97
gucguacaacacgggca

SEQ ID NO: 1144354 - RNA, 18 nt, Mycobacterium bovis subsp bovis AF2122/97
gucguacaacacgggcag

SEQ ID NO: 1144355 - RNA, 22 nt, Mycobacterium bovis subsp bovis AF2122/97
gucguacaacacgggcagcuuc

SEQ ID NO: 1144356 - RNA, 16 nt, Mycobacterium bovis subsp bovis AF2122/97
gucguacccggcaacg

SEQ ID NO: 1144357 - RNA, 18 nt, Mycobacterium bovis subsp bovis AF2122/97
gucguaccgcucggcggc

SEQ ID NO: 1144358 - RNA, 15 nt, Mycobacterium bovis subsp bovis AF2122/97
gucguaccggccuuc

SEQ ID NO: 1144359 - RNA, 20 nt, Mycobacterium bovis subsp bovis AF2122/97
gucguccggaucggucggca

SEQ ID NO: 1144360 - RNA, 18 nt, Mycobacterium bovis subsp bovis AF2122/97
gucguccgcgccaguggc

SEQ ID NO: 1144361 - RNA, 19 nt, Mycobacterium bovis subsp bovis AF2122/97
gucguccggaucggucggc

SEQ ID NO: 1144362 - RNA, 15 nt, Mycobacterium bovis subsp bovis AF2122/97
gucguccccgucgcu

SEQ ID NO: 1144363 - RNA, 16 nt, Mycobacterium bovis subsp bovis AF2122/97
gucgucccgauggcgg

SEQ ID NO: 1144364 - RNA, 22 nt, Mycobacterium bovis subsp bovis AF2122/97
gucgucgaaauggauugcggca

SEQ ID NO: 1144365 - RNA, 14 nt, Mycobacterium bovis subsp bovis AF2122/97
gucgucgagcgcgc

SEQ ID NO: 1144366 - RNA, 22 nt, Mycobacterium bovis subsp bovis AF2122/97
gucgucgagcaccacccgggcc

SEQ ID NO: 1144367 - RNA, 21 nt, Mycobacterium bovis subsp bovis AF2122/97
gucgucgacuugcaggcgucc

SEQ ID NO: 1144368 - RNA, 16 nt, Mycobacterium bovis subsp bovis AF2122/97
gucgucgacggccugg

SEQ ID NO: 1144369 - RNA, 21 nt, Mycobacterium bovis subsp bovis AF2122/97
gucgucgacggcugcgccgaa

SEQ ID NO: 1144370 - RNA, 16 nt, Mycobacterium bovis subsp bovis AF2122/97
gucgucgacacgguga

SEQ ID NO: 1144371 - RNA, 15 nt, Mycobacterium bovis subsp bovis AF2122/97
gucgucgaucgcgga

SEQ ID NO: 1144372 - RNA, 14 nt, Mycobacterium bovis subsp bovis AF2122/97
gucgucgaccacga

SEQ ID NO: 1144373 - RNA, 16 nt, Mycobacterium bovis subsp bovis AF2122/97
gucgucgaguuggcca

SEQ ID NO: 1144374 - RNA, 13 nt, Mycobacterium bovis subsp bovis AF2122/97
gucgucgagguca

SEQ ID NO: 1144375 - RNA, 16 nt, Mycobacterium bovis subsp bovis AF2122/97
gucgucgaugaugccg

SEQ ID NO: 1144376 - RNA, 22 nt, Mycobacterium bovis subsp bovis AF2122/97
gucgucgaugaugccggacagc

SEQ ID NO: 1144377 - RNA, 17 nt, Mycobacterium bovis subsp bovis AF2122/97
gucgucaugccagucgc

SEQ ID NO: 1144378 - RNA, 13 nt, Mycobacterium bovis subsp bovis AF2122/97
gucguccagcacc

SEQ ID NO: 1144379 - RNA, 19 nt, Mycobacterium bovis subsp bovis AF2122/97
gucgucaucgagcgggauc

SEQ ID NO: 1144380 - RNA, 20 nt, Mycobacterium bovis subsp bovis AF2122/97
gucgucaucgagcgggaucg

SEQ ID NO: 1144381 - RNA, 15 nt, Mycobacterium bovis subsp bovis AF2122/97
gucgucagccaccgc

SEQ ID NO: 1144382 - RNA, 18 nt, Mycobacterium bovis subsp bovis AF2122/97
gucgucaugccagucgcc

SEQ ID NO: 1144383 - RNA, 18 nt, Mycobacterium bovis subsp bovis AF2122/97
gucgucauugcccuugac

SEQ ID NO: 1144384 - RNA, 19 nt, Mycobacterium bovis subsp bovis AF2122/97
gucguccagggcgacgaga

SEQ ID NO: 1144385 - RNA, 18 nt, Mycobacterium bovis subsp bovis AF2122/97
gucguagucgguagcuga

SEQ ID NO: 1144386 - RNA, 19 nt, Mycobacterium bovis subsp bovis AF2122/97
gucguaguaggcgccgcga

SEQ ID NO: 1144387 - RNA, 19 nt, Mycobacterium bovis subsp bovis AF2122/97
gucguaguccaggccguag

SEQ ID NO: 1144388 - RNA, 15 nt, Mycobacterium bovis subsp bovis AF2122/97
gucguagucgucggc

SEQ ID NO: 1144389 - RNA, 14 nt, Mycobacterium bovis subsp bovis AF2122/97
gucguaggcgauga

SEQ ID NO: 1144390 - RNA, 19 nt, Mycobacterium bovis subsp bovis AF2122/97
gucguaggacaccaccgug

SEQ ID NO: 1144391 - RNA, 16 nt, Mycobacterium bovis subsp bovis AF2122/97
gucguagcgcucguga

SEQ ID NO: 1144392 - RNA, 13 nt, Mycobacterium bovis subsp bovis AF2122/97
gucguaggccgca

SEQ ID NO: 1144393 - RNA, 18 nt, Mycobacterium bovis subsp bovis AF2122/97
gucgucacgaucgugccg

SEQ ID NO: 1144394 - RNA, 15 nt, Mycobacterium bovis subsp bovis AF2122/97
gucgucaccgaugcg

SEQ ID NO: 1144395 - RNA, 20 nt, Mycobacterium bovis subsp bovis AF2122/97
gucguauugccucaccaggu

SEQ ID NO: 1144396 - RNA, 21 nt, Mycobacterium bovis subsp bovis AF2122/97
gucguaugauucacgcucggc

SEQ ID NO: 1144397 - RNA, 22 nt, Mycobacterium bovis subsp bovis AF2122/97
gucguaugauucacgcucggcg

SEQ ID NO: 1144398 - RNA, 22 nt, Mycobacterium bovis subsp bovis AF2122/97
gucgccgaggacgccggcgccg

SEQ ID NO: 1144399 - RNA, 12 nt, Mycobacterium bovis subsp bovis AF2122/97
gucgccgaggua

SEQ ID NO: 1144400 - RNA, 20 nt, Mycobacterium bovis subsp bovis AF2122/97
gucgccgagguagauggcga

SEQ ID NO: 1144401 - RNA, 13 nt, Mycobacterium bovis subsp bovis AF2122/97
gucgccgaggucg

SEQ ID NO: 1144402 - RNA, 14 nt, Mycobacterium bovis subsp bovis AF2122/97
gucgccgaguaccg

SEQ ID NO: 1144403 - RNA, 20 nt, Mycobacterium bovis subsp bovis AF2122/97
gucgccgacggcgaccaccg

SEQ ID NO: 1144404 - RNA, 23 nt, Mycobacterium bovis subsp bovis AF2122/97
gucgccgaacagugcggucccga

SEQ ID NO: 1144405 - RNA, 16 nt, Mycobacterium bovis subsp bovis AF2122/97
gucgccgaacgccacc

SEQ ID NO: 1144406 - RNA, 18 nt, Mycobacterium bovis subsp bovis AF2122/97
gucgccgacccgggggcg

SEQ ID NO: 1144407 - RNA, 17 nt, Mycobacterium bovis subsp bovis AF2122/97
gucgccgaacgccacca

SEQ ID NO: 1144408 - RNA, 19 nt, Mycobacterium bovis subsp bovis AF2122/97
gucgccgaacgccaccacc

SEQ ID NO: 1144409 - RNA, 20 nt, Mycobacterium bovis subsp bovis AF2122/97
gucgccgaacgccaccaccu

SEQ ID NO: 1144410 - RNA, 16 nt, Mycobacterium bovis subsp bovis AF2122/97
gucgccgaaagggucg

SEQ ID NO: 1144411 - RNA, 13 nt, Mycobacterium bovis subsp bovis AF2122/97
gucgccggcgucg

SEQ ID NO: 1144412 - RNA, 17 nt, Mycobacterium bovis subsp bovis AF2122/97
gucgccgauaucgguga

SEQ ID NO: 1144413 - RNA, 18 nt, Mycobacterium bovis subsp bovis AF2122/97
gucgccggagucgaucag

SEQ ID NO: 1144414 - RNA, 16 nt, Mycobacterium bovis subsp bovis AF2122/97
gucgccggauagcgca

SEQ ID NO: 1144415 - RNA, 22 nt, Mycobacterium bovis subsp bovis AF2122/97
gucgccggauagcgcagcucgc

SEQ ID NO: 1144416 - RNA, 13 nt, Mycobacterium bovis subsp bovis AF2122/97
gucgccggcaccg

SEQ ID NO: 1144417 - RNA, 18 nt, Mycobacterium bovis subsp bovis AF2122/97
gucgccggcauacaccgu

SEQ ID NO: 1144418 - RNA, 19 nt, Mycobacterium bovis subsp bovis AF2122/97
gucgccgguggcacccgcg

SEQ ID NO: 1144419 - RNA, 13 nt, Mycobacterium bovis subsp bovis AF2122/97
gucgccggugacg

SEQ ID NO: 1144420 - RNA, 14 nt, Mycobacterium bovis subsp bovis AF2122/97
gucgccggucaucg

SEQ ID NO: 1144421 - RNA, 16 nt, Mycobacterium bovis subsp bovis AF2122/97
gucgccgucggugccg

SEQ ID NO: 1144422 - RNA, 12 nt, Mycobacterium bovis subsp bovis AF2122/97
gucgccgucgcg

SEQ ID NO: 1144423 - RNA, 16 nt, Mycobacterium bovis subsp bovis AF2122/97
gucgccgucgcggcac

SEQ ID NO: 1144424 - RNA, 17 nt, Mycobacterium bovis subsp bovis AF2122/97
gucgccgucgcggcacg

SEQ ID NO: 1144425 - RNA, 18 nt, Mycobacterium bovis subsp bovis AF2122/97
gucgccguacaaccaccc

SEQ ID NO: 1144426 - RNA, 23 nt, Mycobacterium bovis subsp bovis AF2122/97
gucgcgcgaauggucagcgucgc

SEQ ID NO: 1144427 - RNA, 18 nt, Mycobacterium bovis subsp bovis AF2122/97
gucgcgccaggcuugcgg

SEQ ID NO: 1144428 - RNA, 14 nt, Mycobacterium bovis subsp bovis AF2122/97
gucgcgcggcaccg

SEQ ID NO: 1144429 - RNA, 21 nt, Mycobacterium bovis subsp bovis AF2122/97
gucgcgcggcaccgauggcgc

SEQ ID NO: 1144430 - RNA, 15 nt, Mycobacterium bovis subsp bovis AF2122/97
gucgcgcucgcacca

SEQ ID NO: 1144431 - RNA, 21 nt, Mycobacterium bovis subsp bovis AF2122/97
gucgcgcucgcaccaccacgu

SEQ ID NO: 1144432 - RNA, 16 nt, Mycobacterium bovis subsp bovis AF2122/97
gucgcgcugcugucga

SEQ ID NO: 1144433 - RNA, 23 nt, Mycobacterium bovis subsp bovis AF2122/97
gucgcgcaucgccuccucgacgu

SEQ ID NO: 1144434 - RNA, 19 nt, Mycobacterium bovis subsp bovis AF2122/97
gucgccuucuucgcggcgg

SEQ ID NO: 1144435 - RNA, 13 nt, Mycobacterium bovis subsp bovis AF2122/97
gucgccuucuugg

SEQ ID NO: 1144436 - RNA, 19 nt, Mycobacterium bovis subsp bovis AF2122/97
gucgccuucguaaccacga

SEQ ID NO: 1144437 - RNA, 17 nt, Mycobacterium bovis subsp bovis AF2122/97
gucgccuucccagccga

SEQ ID NO: 1144438 - RNA, 16 nt, Mycobacterium bovis subsp bovis AF2122/97
gucgcgcagguagcgc

SEQ ID NO: 1144439 - RNA, 18 nt, Mycobacterium bovis subsp bovis AF2122/97
gucgcgcauugccgacgc

SEQ ID NO: 1144440 - RNA, 18 nt, Mycobacterium bovis subsp bovis AF2122/97
gucgcgcauuucguggcg

SEQ ID NO: 1144441 - RNA, 21 nt, Mycobacterium bovis subsp bovis AF2122/97
gucgcgcauuucguggcgcgc

SEQ ID NO: 1144442 - RNA, 15 nt, Mycobacterium bovis subsp bovis AF2122/97
gucgcgccacccgcg

SEQ ID NO: 1144443 - RNA, 16 nt, Mycobacterium bovis subsp bovis AF2122/97
gucgcgccacccgcga

SEQ ID NO: 1144444 - RNA, 17 nt, Mycobacterium bovis subsp bovis AF2122/97
gucgccugcccccgcgc

SEQ ID NO: 1144445 - RNA, 15 nt, Mycobacterium bovis subsp bovis AF2122/97
gucgccugccgacga

SEQ ID NO: 1144446 - RNA, 14 nt, Mycobacterium bovis subsp bovis AF2122/97
gucgccugcgggaa

SEQ ID NO: 1144447 - RNA, 22 nt, Mycobacterium bovis subsp bovis AF2122/97
gucgccuccagcagguccgcgg

SEQ ID NO: 1144448 - RNA, 15 nt, Mycobacterium bovis subsp bovis AF2122/97
gucgccucgaugcca

SEQ ID NO: 1144449 - RNA, 20 nt, Mycobacterium bovis subsp bovis AF2122/97
gucgccuccugccgccgcuc

SEQ ID NO: 1144450 - RNA, 19 nt, Mycobacterium bovis subsp bovis AF2122/97
gucgccgucgugccaccgu

SEQ ID NO: 1144451 - RNA, 19 nt, Mycobacterium bovis subsp bovis AF2122/97
gucgcccaggcgugucguc

SEQ ID NO: 1144452 - RNA, 20 nt, Mycobacterium bovis subsp bovis AF2122/97
gucgcccagccgagcguggc

SEQ ID NO: 1144453 - RNA, 15 nt, Mycobacterium bovis subsp bovis AF2122/97
gucgcccccggccau

SEQ ID NO: 1144454 - RNA, 14 nt, Mycobacterium bovis subsp bovis AF2122/97
gucgccccaagcgc

SEQ ID NO: 1144455 - RNA, 16 nt, Mycobacterium bovis subsp bovis AF2122/97
gucgcccuuagggucg

SEQ ID NO: 1144456 - RNA, 19 nt, Mycobacterium bovis subsp bovis AF2122/97
gucgcccuuagggucgccg

SEQ ID NO: 1144457 - RNA, 20 nt, Mycobacterium bovis subsp bovis AF2122/97
gucgcccagccacugacggc

SEQ ID NO: 1144458 - RNA, 22 nt, Mycobacterium bovis subsp bovis AF2122/97
gucgccauuccaucgcgcaccg

SEQ ID NO: 1144459 - RNA, 23 nt, Mycobacterium bovis subsp bovis AF2122/97
gucgcccaacaccgcgccgacga

SEQ ID NO: 1144460 - RNA, 16 nt, Mycobacterium bovis subsp bovis AF2122/97
gucgcccaaccgaacc

SEQ ID NO: 1144461 - RNA, 15 nt, Mycobacterium bovis subsp bovis AF2122/97
gucgccacgaugccg

SEQ ID NO: 1144462 - RNA, 17 nt, Mycobacterium bovis subsp bovis AF2122/97
gucgccacgcccagcgc

SEQ ID NO: 1144463 - RNA, 19 nt, Mycobacterium bovis subsp bovis AF2122/97
gucgccaccaucguugccg

SEQ ID NO: 1144464 - RNA, 13 nt, Mycobacterium bovis subsp bovis AF2122/97
gucgccagaccgc

SEQ ID NO: 1144465 - RNA, 15 nt, Mycobacterium bovis subsp bovis AF2122/97
gucgcacugcgccgg

SEQ ID NO: 1144466 - RNA, 17 nt, Mycobacterium bovis subsp bovis AF2122/97
gucgcacugcgccggcc

SEQ ID NO: 1144467 - RNA, 20 nt, Mycobacterium bovis subsp bovis AF2122/97
gucgcacugcgccggccggc

SEQ ID NO: 1144468 - RNA, 23 nt, Mycobacterium bovis subsp bovis AF2122/97
gucgcacgcgcgcaggccgccgc

SEQ ID NO: 1144469 - RNA, 12 nt, Mycobacterium bovis subsp bovis AF2122/97
gucgcacggugc

SEQ ID NO: 1144470 - RNA, 15 nt, Mycobacterium bovis subsp bovis AF2122/97
gucgcagcacgggug

SEQ ID NO: 1144471 - RNA, 20 nt, Mycobacterium bovis subsp bovis AF2122/97
gucgcagcagaccacaacgc

SEQ ID NO: 1144472 - RNA, 14 nt, Mycobacterium bovis subsp bovis AF2122/97
gucgcacuuggccc

SEQ ID NO: 1144473 - RNA, 20 nt, Mycobacterium bovis subsp bovis AF2122/97
gucgcagaaaccauucggcg

SEQ ID NO: 1144474 - RNA, 17 nt, Mycobacterium bovis subsp bovis AF2122/97
gucgcagaccagacugc

SEQ ID NO: 1144475 - RNA, 15 nt, Mycobacterium bovis subsp bovis AF2122/97
gucgcagccagcuga

SEQ ID NO: 1144476 - RNA, 19 nt, Mycobacterium bovis subsp bovis AF2122/97
gucgccaccgauggcggug

SEQ ID NO: 1144477 - RNA, 20 nt, Mycobacterium bovis subsp bovis AF2122/97
gucgccaccgauggcggugg

SEQ ID NO: 1144478 - RNA, 14 nt, Mycobacterium bovis subsp bovis AF2122/97
gucgccaccgccgg

SEQ ID NO: 1144479 - RNA, 23 nt, Mycobacterium bovis subsp bovis AF2122/97
gucgccaaucgaguagcugaccg

SEQ ID NO: 1144480 - RNA, 19 nt, Mycobacterium bovis subsp bovis AF2122/97
gucgcagaucaggacgcga

SEQ ID NO: 1144481 - RNA, 11 nt, Mycobacterium bovis subsp bovis AF2122/97
gucgccaccau

SEQ ID NO: 1144482 - RNA, 15 nt, Mycobacterium bovis subsp bovis AF2122/97
gucgccacacccgcg

SEQ ID NO: 1144483 - RNA, 20 nt, Mycobacterium bovis subsp bovis AF2122/97
gucgccacaccggggcggcc

SEQ ID NO: 1144484 - RNA, 14 nt, Mycobacterium bovis subsp bovis AF2122/97
gucgaugagucggg

SEQ ID NO: 1144485 - RNA, 18 nt, Mycobacterium bovis subsp bovis AF2122/97
gucgaugagugacggucc

SEQ ID NO: 1144486 - RNA, 18 nt, Mycobacterium bovis subsp bovis AF2122/97
gucgaugaggaucaucga

SEQ ID NO: 1144487 - RNA, 14 nt, Mycobacterium bovis subsp bovis AF2122/97
gucgaugccgcgca

SEQ ID NO: 1144488 - RNA, 17 nt, Mycobacterium bovis subsp bovis AF2122/97
gucgaugccgcgcagcg

SEQ ID NO: 1144489 - RNA, 20 nt, Mycobacterium bovis subsp bovis AF2122/97
gucgaugccgcgcagcgcgg

SEQ ID NO: 1144490 - RNA, 17 nt, Mycobacterium bovis subsp bovis AF2122/97
gucgaugcgggcgacga

SEQ ID NO: 1144491 - RNA, 23 nt, Mycobacterium bovis subsp bovis AF2122/97
gucgaugcgggcugugaacagcg

SEQ ID NO: 1144492 - RNA, 14 nt, Mycobacterium bovis subsp bovis AF2122/97
gucgaugcgcgccg

SEQ ID NO: 1144493 - RNA, 15 nt, Mycobacterium bovis subsp bovis AF2122/97
gucgaugcgcgccgg

SEQ ID NO: 1144494 - RNA, 14 nt, Mycobacterium bovis subsp bovis AF2122/97
gucgaugcgcugcu

SEQ ID NO: 1144495 - RNA, 13 nt, Mycobacterium bovis subsp bovis AF2122/97
gucgaugcgcgcc

SEQ ID NO: 1144496 - RNA, 16 nt, Mycobacterium bovis subsp bovis AF2122/97
gucgaugcgcagcccg

SEQ ID NO: 1144497 - RNA, 19 nt, Mycobacterium bovis subsp bovis AF2122/97
gucgaugcgcagcccgucg

SEQ ID NO: 1144498 - RNA, 15 nt, Mycobacterium bovis subsp bovis AF2122/97
gucgauggcguacag

SEQ ID NO: 1144499 - RNA, 17 nt, Mycobacterium bovis subsp bovis AF2122/97
gucgauggggacggcgg

SEQ ID NO: 1144500 - RNA, 22 nt, Mycobacterium bovis subsp bovis AF2122/97
gucgaugcugaacacgcagccg

SEQ ID NO: 1144501 - RNA, 23 nt, Mycobacterium bovis subsp bovis AF2122/97
gucgaugcugaacacgcagccga

SEQ ID NO: 1144502 - RNA, 15 nt, Mycobacterium bovis subsp bovis AF2122/97
gucgaugcugccagc

SEQ ID NO: 1144503 - RNA, 22 nt, Mycobacterium bovis subsp bovis AF2122/97
gucgaugcgcugcucacgcagc

SEQ ID NO: 1144504 - RNA, 22 nt, Mycobacterium bovis subsp bovis AF2122/97
gucgauggagaaguuagccacc

SEQ ID NO: 1144505 - RNA, 18 nt, Mycobacterium bovis subsp bovis AF2122/97
gucgaugucagccaccau

SEQ ID NO: 1144506 - RNA, 19 nt, Mycobacterium bovis subsp bovis AF2122/97
gucgauguccacgccgugc

SEQ ID NO: 1144507 - RNA, 23 nt, Mycobacterium bovis subsp bovis AF2122/97
gucgauguccgcagcaccgucgg

SEQ ID NO: 1144508 - RNA, 19 nt, Mycobacterium bovis subsp bovis AF2122/97
gucgaugucggggccgucg

SEQ ID NO: 1144509 - RNA, 22 nt, Mycobacterium bovis subsp bovis AF2122/97
gucgaugucggggccgucgucg

SEQ ID NO: 1144510 - RNA, 15 nt, Mycobacterium bovis subsp bovis AF2122/97
gucgaugucgucgac

SEQ ID NO: 1144511 - RNA, 15 nt, Mycobacterium bovis subsp bovis AF2122/97
gucgaugucgacguc

SEQ ID NO: 1144512 - RNA, 18 nt, Mycobacterium bovis subsp bovis AF2122/97
gucgaugucguuggccac

SEQ ID NO: 1144513 - RNA, 16 nt, Mycobacterium bovis subsp bovis AF2122/97
gucgauuucggcggcg

SEQ ID NO: 1144514 - RNA, 19 nt, Mycobacterium bovis subsp bovis AF2122/97
gucgcaaacuucgcgcacg

SEQ ID NO: 1144515 - RNA, 22 nt, Mycobacterium bovis subsp bovis AF2122/97
gucgcacccaacuccaucagcg

SEQ ID NO: 1144516 - RNA, 23 nt, Mycobacterium bovis subsp bovis AF2122/97
gucgcacccaacuccaucagcgc

SEQ ID NO: 1144517 - RNA, 14 nt, Mycobacterium bovis subsp bovis AF2122/97
gucgcaaccgccgc

SEQ ID NO: 1144518 - RNA, 13 nt, Mycobacterium bovis subsp bovis AF2122/97
gucgcaacgcgau

SEQ ID NO: 1144519 - RNA, 22 nt, Mycobacterium bovis subsp bovis AF2122/97
gucgcaauauccggccgagccg

SEQ ID NO: 1144520 - RNA, 15 nt, Mycobacterium bovis subsp bovis AF2122/97
gucgauuucgacgac

SEQ ID NO: 1144521 - RNA, 15 nt, Mycobacterium bovis subsp bovis AF2122/97
gucgauugccaccga

SEQ ID NO: 1144522 - RNA, 17 nt, Mycobacterium bovis subsp bovis AF2122/97
gucgauugccaccgaga

SEQ ID NO: 1144523 - RNA, 17 nt, Mycobacterium bovis subsp bovis AF2122/97
gucgauuucgaugacga

SEQ ID NO: 1144524 - RNA, 15 nt, Mycobacterium bovis subsp bovis AF2122/97
gucgauuucgccguc

SEQ ID NO: 1144525 - RNA, 17 nt, Mycobacterium bovis subsp bovis AF2122/97
gucgauuucgccgucgc

SEQ ID NO: 1144526 - RNA, 18 nt, Mycobacterium bovis subsp bovis AF2122/97
gucgauuucgccgucgcu

SEQ ID NO: 1144527 - RNA, 15 nt, Mycobacterium bovis subsp bovis AF2122/97
gucgauuucggcgac

SEQ ID NO: 1144528 - RNA, 15 nt, Mycobacterium bovis subsp bovis AF2122/97
gucgauuucggcggc

SEQ ID NO: 1144529 - RNA, 20 nt, Mycobacterium bovis subsp bovis AF2122/97
gucgagggagcgccgcaggg

SEQ ID NO: 1144530 - RNA, 19 nt, Mycobacterium bovis subsp bovis AF2122/97
gucgaggcugaccguggcg

SEQ ID NO: 1144531 - RNA, 17 nt, Mycobacterium bovis subsp bovis AF2122/97
gucgaggcaggccucgg

SEQ ID NO: 1144532 - RNA, 20 nt, Mycobacterium bovis subsp bovis AF2122/97
gucgagccacccaccgacau

SEQ ID NO: 1144533 - RNA, 18 nt, Mycobacterium bovis subsp bovis AF2122/97
gucgagcagcucgcacuc

SEQ ID NO: 1144534 - RNA, 20 nt, Mycobacterium bovis subsp bovis AF2122/97
gucgagcaggcccaacgcga

SEQ ID NO: 1144535 - RNA, 18 nt, Mycobacterium bovis subsp bovis AF2122/97
gucgagccacagcgucga

SEQ ID NO: 1144536 - RNA, 15 nt, Mycobacterium bovis subsp bovis AF2122/97
gucgagccgaccgcg

SEQ ID NO: 1144537 - RNA, 17 nt, Mycobacterium bovis subsp bovis AF2122/97
gucgagccgaccgcggg

SEQ ID NO: 1144538 - RNA, 13 nt, Mycobacterium bovis subsp bovis AF2122/97
gucgagguagugg

SEQ ID NO: 1144539 - RNA, 17 nt, Mycobacterium bovis subsp bovis AF2122/97
gucgagguaguggucuu

SEQ ID NO: 1144540 - RNA, 14 nt, Mycobacterium bovis subsp bovis AF2122/97
gucgagguccacca

SEQ ID NO: 1144541 - RNA, 15 nt, Mycobacterium bovis subsp bovis AF2122/97
gucgagguccaccac

SEQ ID NO: 1144542 - RNA, 17 nt, Mycobacterium bovis subsp bovis AF2122/97
gucgagguccaccaccc

SEQ ID NO: 1144543 - RNA, 22 nt, Mycobacterium bovis subsp bovis AF2122/97
gucgagguccuugaggauccgc

SEQ ID NO: 1144544 - RNA, 15 nt, Mycobacterium bovis subsp bovis AF2122/97
gucgaucgcggcccg

SEQ ID NO: 1144545 - RNA, 19 nt, Mycobacterium bovis subsp bovis AF2122/97
gucgaucgcggcccgcagc

SEQ ID NO: 1144546 - RNA, 14 nt, Mycobacterium bovis subsp bovis AF2122/97
gucgaucgccgcgc

SEQ ID NO: 1144547 - RNA, 16 nt, Mycobacterium bovis subsp bovis AF2122/97
gucgaucucggcagag

SEQ ID NO: 1144548 - RNA, 13 nt, Mycobacterium bovis subsp bovis AF2122/97
gucgaucugcccc

SEQ ID NO: 1144549 - RNA, 20 nt, Mycobacterium bovis subsp bovis AF2122/97
gucgaucucgaucgacccgg

SEQ ID NO: 1144550 - RNA, 20 nt, Mycobacterium bovis subsp bovis AF2122/97
gucgacgcagugcccgaucg

SEQ ID NO: 1144551 - RNA, 23 nt, Mycobacterium bovis subsp bovis AF2122/97
gucgacgaugucggcaccauagc

SEQ ID NO: 1144552 - RNA, 18 nt, Mycobacterium bovis subsp bovis AF2122/97
gucgacgagcgccucaag

SEQ ID NO: 1144553 - RNA, 15 nt, Mycobacterium bovis subsp bovis AF2122/97
gucgacgaucagcga

SEQ ID NO: 1144554 - RNA, 13 nt, Mycobacterium bovis subsp bovis AF2122/97
gucgacgacgugg

SEQ ID NO: 1144555 - RNA, 17 nt, Mycobacterium bovis subsp bovis AF2122/97
gucgacgagauccagcg

SEQ ID NO: 1144556 - RNA, 15 nt, Mycobacterium bovis subsp bovis AF2122/97
gucgacgagcaccgc

SEQ ID NO: 1144557 - RNA, 17 nt, Mycobacterium bovis subsp bovis AF2122/97
gucgacgagcaccgcgc

SEQ ID NO: 1144558 - RNA, 21 nt, Mycobacterium bovis subsp bovis AF2122/97
gucgacgagcaccgcgccgcg

SEQ ID NO: 1144559 - RNA, 23 nt, Mycobacterium bovis subsp bovis AF2122/97
gucgacgaugacgguggggucgc

SEQ ID NO: 1144560 - RNA, 13 nt, Mycobacterium bovis subsp bovis AF2122/97
gucgacgccgauc

SEQ ID NO: 1144561 - RNA, 14 nt, Mycobacterium bovis subsp bovis AF2122/97
gucgacgccgcagc

SEQ ID NO: 1144562 - RNA, 15 nt, Mycobacterium bovis subsp bovis AF2122/97
gucgacgccgcagcg

SEQ ID NO: 1144563 - RNA, 15 nt, Mycobacterium bovis subsp bovis AF2122/97
gucgacgcccgauac

SEQ ID NO: 1144564 - RNA, 18 nt, Mycobacterium bovis subsp bovis AF2122/97
gucgacgauucccgcgga

SEQ ID NO: 1144565 - RNA, 19 nt, Mycobacterium bovis subsp bovis AF2122/97
gucgacgcccauggcgucg

SEQ ID NO: 1144566 - RNA, 20 nt, Mycobacterium bovis subsp bovis AF2122/97
gucgacgcccauggcgucga

SEQ ID NO: 1144567 - RNA, 16 nt, Mycobacterium bovis subsp bovis AF2122/97
gucgacgccgaccacc

SEQ ID NO: 1144568 - RNA, 20 nt, Mycobacterium bovis subsp bovis AF2122/97
gucgagcagcgccacccgcg

SEQ ID NO: 1144569 - RNA, 14 nt, Mycobacterium bovis subsp bovis AF2122/97
gucgagcagcgcca

SEQ ID NO: 1144570 - RNA, 16 nt, Mycobacterium bovis subsp bovis AF2122/97
gucgagcacggugagc

SEQ ID NO: 1144571 - RNA, 13 nt, Mycobacterium bovis subsp bovis AF2122/97
gucgagcagccgc

SEQ ID NO: 1144572 - RNA, 18 nt, Mycobacterium bovis subsp bovis AF2122/97
gucgagcaccggcugcgg

SEQ ID NO: 1144573 - RNA, 21 nt, Mycobacterium bovis subsp bovis AF2122/97
gucgagaucucacgugcccgc

SEQ ID NO: 1144574 - RNA, 18 nt, Mycobacterium bovis subsp bovis AF2122/97
gucgagagguucgccguc

SEQ ID NO: 1144575 - RNA, 19 nt, Mycobacterium bovis subsp bovis AF2122/97
gucgagagguucgccgucg

SEQ ID NO: 1144576 - RNA, 17 nt, Mycobacterium bovis subsp bovis AF2122/97
gucgagauagccgacgu

SEQ ID NO: 1144577 - RNA, 20 nt, Mycobacterium bovis subsp bovis AF2122/97
gucgagcacaccgaggucgc

SEQ ID NO: 1144578 - RNA, 15 nt, Mycobacterium bovis subsp bovis AF2122/97
gucgacgcgguccuc

SEQ ID NO: 1144579 - RNA, 15 nt, Mycobacterium bovis subsp bovis AF2122/97
gucgacgcggccggc

SEQ ID NO: 1144580 - RNA, 23 nt, Mycobacterium bovis subsp bovis AF2122/97
gucgacgcccgauacgccaccgg

SEQ ID NO: 1144581 - RNA, 23 nt, Mycobacterium bovis subsp bovis AF2122/97
gucgagagaguuagugacguaga

SEQ ID NO: 1144582 - RNA, 14 nt, Mycobacterium bovis subsp bovis AF2122/97
gucgacgacgucgc

SEQ ID NO: 1144583 - RNA, 16 nt, Mycobacterium bovis subsp bovis AF2122/97
gucgacgacgcccuca

SEQ ID NO: 1144584 - RNA, 16 nt, Mycobacterium bovis subsp bovis AF2122/97
gucgacgacaacgaug

SEQ ID NO: 1144585 - RNA, 22 nt, Mycobacterium bovis subsp bovis AF2122/97
gucgaccccugaaucaccggag

SEQ ID NO: 1144586 - RNA, 21 nt, Mycobacterium bovis subsp bovis AF2122/97
gucgaccuguugucguggcgg

SEQ ID NO: 1144587 - RNA, 20 nt, Mycobacterium bovis subsp bovis AF2122/97
gucgacccccugccacagcg

SEQ ID NO: 1144588 - RNA, 22 nt, Mycobacterium bovis subsp bovis AF2122/97
gucgacccccugccacagcgac

SEQ ID NO: 1144589 - RNA, 12 nt, Mycobacterium bovis subsp bovis AF2122/97
gucgaccaggcc

SEQ ID NO: 1144590 - RNA, 16 nt, Mycobacterium bovis subsp bovis AF2122/97
gucgaccaugagccgg

SEQ ID NO: 1144591 - RNA, 18 nt, Mycobacterium bovis subsp bovis AF2122/97
gucgaccaugagccggcg

SEQ ID NO: 1144592 - RNA, 22 nt, Mycobacterium bovis subsp bovis AF2122/97
gucgaccaugcgaccggcaacg

SEQ ID NO: 1144593 - RNA, 23 nt, Mycobacterium bovis subsp bovis AF2122/97
gucgaccaugcgaccggcaacgc

SEQ ID NO: 1144594 - RNA, 13 nt, Mycobacterium bovis subsp bovis AF2122/97
gucgacccaacgc

SEQ ID NO: 1144595 - RNA, 18 nt, Mycobacterium bovis subsp bovis AF2122/97
gucgacccaacgcagauc

SEQ ID NO: 1144596 - RNA, 22 nt, Mycobacterium bovis subsp bovis AF2122/97
gucgacccacucaucagagcgc

SEQ ID NO: 1144597 - RNA, 14 nt, Mycobacterium bovis subsp bovis AF2122/97
gucgacccaccaug

SEQ ID NO: 1144598 - RNA, 21 nt, Mycobacterium bovis subsp bovis AF2122/97
gucgaccauauuggcgcggcc

SEQ ID NO: 1144599 - RNA, 22 nt, Mycobacterium bovis subsp bovis AF2122/97
gucgaccauauuggcgcggccg

SEQ ID NO: 1144600 - RNA, 17 nt, Mycobacterium bovis subsp bovis AF2122/97
gucgaacagcucgaaca

SEQ ID NO: 1144601 - RNA, 19 nt, Mycobacterium bovis subsp bovis AF2122/97
gucgaacaggaucagcgac

SEQ ID NO: 1144602 - RNA, 15 nt, Mycobacterium bovis subsp bovis AF2122/97
gucgaacaggccggc

SEQ ID NO: 1144603 - RNA, 19 nt, Mycobacterium bovis subsp bovis AF2122/97
gucgaacaggccggccgcg

SEQ ID NO: 1144604 - RNA, 22 nt, Mycobacterium bovis subsp bovis AF2122/97
gucgaacaggccggccgcgauc

SEQ ID NO: 1144605 - RNA, 13 nt, Mycobacterium bovis subsp bovis AF2122/97
gucgaacgccccc

SEQ ID NO: 1144606 - RNA, 19 nt, Mycobacterium bovis subsp bovis AF2122/97
gucgaacgccccccacggc

SEQ ID NO: 1144607 - RNA, 17 nt, Mycobacterium bovis subsp bovis AF2122/97
gucgaaccuaccgugua

SEQ ID NO: 1144608 - RNA, 19 nt, Mycobacterium bovis subsp bovis AF2122/97
gucgaacaugauccgccgg

SEQ ID NO: 1144609 - RNA, 16 nt, Mycobacterium bovis subsp bovis AF2122/97
gucgaacgcguugacc

SEQ ID NO: 1144610 - RNA, 13 nt, Mycobacterium bovis subsp bovis AF2122/97
gucgaaccaggua

SEQ ID NO: 1144611 - RNA, 20 nt, Mycobacterium bovis subsp bovis AF2122/97
gucgaacggcuuggcgucgg

SEQ ID NO: 1144612 - RNA, 21 nt, Mycobacterium bovis subsp bovis AF2122/97
gucgaacugccggacuaccgc

SEQ ID NO: 1144613 - RNA, 17 nt, Mycobacterium bovis subsp bovis AF2122/97
gucgaacagcaccgccg

SEQ ID NO: 1144614 - RNA, 14 nt, Mycobacterium bovis subsp bovis AF2122/97
gucgaacacgucgg

SEQ ID NO: 1144615 - RNA, 14 nt, Mycobacterium bovis subsp bovis AF2122/97
guccuuugccaccu

SEQ ID NO: 1144616 - RNA, 21 nt, Mycobacterium bovis subsp bovis AF2122/97
gucgaaauggauugcggcacg

SEQ ID NO: 1144617 - RNA, 12 nt, Mycobacterium bovis subsp bovis AF2122/97
gucgaaacccac

SEQ ID NO: 1144618 - RNA, 18 nt, Mycobacterium bovis subsp bovis AF2122/97
gucgaaacccacguacgc

SEQ ID NO: 1144619 - RNA, 20 nt, Mycobacterium bovis subsp bovis AF2122/97
guccuuguugaacguucugc

SEQ ID NO: 1144620 - RNA, 15 nt, Mycobacterium bovis subsp bovis AF2122/97
guccuuguuggccag

SEQ ID NO: 1144621 - RNA, 15 nt, Mycobacterium bovis subsp bovis AF2122/97
guccuugcgccagcg

SEQ ID NO: 1144622 - RNA, 17 nt, Mycobacterium bovis subsp bovis AF2122/97
guccuuggacaggucga

SEQ ID NO: 1144623 - RNA, 20 nt, Mycobacterium bovis subsp bovis AF2122/97
guccggggaccucggcgauc

SEQ ID NO: 1144624 - RNA, 13 nt, Mycobacterium bovis subsp bovis AF2122/97
guccggggccgcg

SEQ ID NO: 1144625 - RNA, 18 nt, Mycobacterium bovis subsp bovis AF2122/97
guccggggccgcggccca

SEQ ID NO: 1144626 - RNA, 16 nt, Mycobacterium bovis subsp bovis AF2122/97
guccggcuuaccggcg

SEQ ID NO: 1144627 - RNA, 17 nt, Mycobacterium bovis subsp bovis AF2122/97
guccggcuuaccggcgg

SEQ ID NO: 1144628 - RNA, 18 nt, Mycobacterium bovis subsp bovis AF2122/97
guccggcuucggcgaacc

SEQ ID NO: 1144629 - RNA, 14 nt, Mycobacterium bovis subsp bovis AF2122/97
guccugguggcggg

SEQ ID NO: 1144630 - RNA, 20 nt, Mycobacterium bovis subsp bovis AF2122/97
guccuucagccaguccagcg

SEQ ID NO: 1144631 - RNA, 14 nt, Mycobacterium bovis subsp bovis AF2122/97
guccuucgcuggua

SEQ ID NO: 1144632 - RNA, 13 nt, Mycobacterium bovis subsp bovis AF2122/97
guccggguagcgg

SEQ ID NO: 1144633 - RNA, 16 nt, Mycobacterium bovis subsp bovis AF2122/97
guccggguagcggcgc

SEQ ID NO: 1144634 - RNA, 13 nt, Mycobacterium bovis subsp bovis AF2122/97
guccgggucacca

SEQ ID NO: 1144635 - RNA, 22 nt, Mycobacterium bovis subsp bovis AF2122/97
guccgggggaagcgcguccaac

SEQ ID NO: 1144636 - RNA, 18 nt, Mycobacterium bovis subsp bovis AF2122/97
guccggguggcacaccau

SEQ ID NO: 1144637 - RNA, 23 nt, Mycobacterium bovis subsp bovis AF2122/97
guccggguguagagggagcggcg

SEQ ID NO: 1144638 - RNA, 22 nt, Mycobacterium bovis subsp bovis AF2122/97
gucaggcaguccaccgcgcggc

SEQ ID NO: 1144639 - RNA, 17 nt, Mycobacterium bovis subsp bovis AF2122/97
gucaggcacaacgcgac

SEQ ID NO: 1144640 - RNA, 14 nt, Mycobacterium bovis subsp bovis AF2122/97
gucagguacauccc

SEQ ID NO: 1144641 - RNA, 14 nt, Mycobacterium bovis subsp bovis AF2122/97
gucaguaccgcacg

SEQ ID NO: 1144642 - RNA, 19 nt, Mycobacterium bovis subsp bovis AF2122/97
gucagguucuaccaaaucg

SEQ ID NO: 1144643 - RNA, 20 nt, Mycobacterium bovis subsp bovis AF2122/97
gucaguagccacgcccacag

SEQ ID NO: 1144644 - RNA, 22 nt, Mycobacterium bovis subsp bovis AF2122/97
gucaguaggcggaucuuggugu

SEQ ID NO: 1144645 - RNA, 16 nt, Mycobacterium bovis subsp bovis AF2122/97
gucagguugucggcga

SEQ ID NO: 1144646 - RNA, 17 nt, Mycobacterium bovis subsp bovis AF2122/97
gucagguugucggcgau

SEQ ID NO: 1144647 - RNA, 18 nt, Mycobacterium bovis subsp bovis AF2122/97
gucaggugcgcgaccagg

SEQ ID NO: 1144648 - RNA, 16 nt, Mycobacterium bovis subsp bovis AF2122/97
guaucgagggcagccg

SEQ ID NO: 1144649 - RNA, 18 nt, Mycobacterium bovis subsp bovis AF2122/97
guaucgagggcagccgcc

SEQ ID NO: 1144650 - RNA, 19 nt, Mycobacterium bovis subsp bovis AF2122/97
guaucgcagcaucugcggg

SEQ ID NO: 1144651 - RNA, 20 nt, Mycobacterium bovis subsp bovis AF2122/97
guaucgccagccaaccgucc

SEQ ID NO: 1144652 - RNA, 19 nt, Mycobacterium bovis subsp bovis AF2122/97
guaucgccaaauccggugc

SEQ ID NO: 1144653 - RNA, 19 nt, Mycobacterium bovis subsp bovis AF2122/97
guaucgccgcuacgccggc

SEQ ID NO: 1144654 - RNA, 22 nt, Mycobacterium bovis subsp bovis AF2122/97
guaucgccggaguuccgccauu

SEQ ID NO: 1144655 - RNA, 14 nt, Mycobacterium bovis subsp bovis AF2122/97
guaucgacggcggc

SEQ ID NO: 1144656 - RNA, 20 nt, Mycobacterium bovis subsp bovis AF2122/97
guaucgacggcggccuucgg

SEQ ID NO: 1144657 - RNA, 18 nt, Mycobacterium bovis subsp bovis AF2122/97
guaucgacccuccagcac

SEQ ID NO: 1144658 - RNA, 21 nt, Mycobacterium bovis subsp bovis AF2122/97
guaucgacccuccagcacgcc

SEQ ID NO: 1144659 - RNA, 20 nt, Mycobacterium bovis subsp bovis AF2122/97
gucaggaaccacccaccggc

SEQ ID NO: 1144660 - RNA, 22 nt, Mycobacterium bovis subsp bovis AF2122/97
gucaggaacaaguagccgucgu

SEQ ID NO: 1144661 - RNA, 12 nt, Mycobacterium bovis subsp bovis AF2122/97
gucaggaaaccg

SEQ ID NO: 1144662 - RNA, 17 nt, Mycobacterium bovis subsp bovis AF2122/97
gucaggaaaccggcgcg

SEQ ID NO: 1144663 - RNA, 18 nt, Mycobacterium bovis subsp bovis AF2122/97
gucagcuguuugccggcu

SEQ ID NO: 1144664 - RNA, 17 nt, Mycobacterium bovis subsp bovis AF2122/97
gucagcuuuaucggccc

SEQ ID NO: 1144665 - RNA, 16 nt, Mycobacterium bovis subsp bovis AF2122/97
gucagcuggccgcggc

SEQ ID NO: 1144666 - RNA, 14 nt, Mycobacterium bovis subsp bovis AF2122/97
gucagcucgaccug

SEQ ID NO: 1144667 - RNA, 15 nt, Mycobacterium bovis subsp bovis AF2122/97
gucagcucgaucacg

SEQ ID NO: 1144668 - RNA, 12 nt, Mycobacterium bovis subsp bovis AF2122/97
gucagcucggca

SEQ ID NO: 1144669 - RNA, 15 nt, Mycobacterium bovis subsp bovis AF2122/97
gucagcucggcagca

SEQ ID NO: 1144670 - RNA, 15 nt, Mycobacterium bovis subsp bovis AF2122/97
gucagcucgucggcg

SEQ ID NO: 1144671 - RNA, 19 nt, Mycobacterium bovis subsp bovis AF2122/97
gucauacccagcucgucgc

SEQ ID NO: 1144672 - RNA, 22 nt, Mycobacterium bovis subsp bovis AF2122/97
gucaguugugcguugcgcugcg

SEQ ID NO: 1144673 - RNA, 20 nt, Mycobacterium bovis subsp bovis AF2122/97
gucaucgggcagcggcaucg

SEQ ID NO: 1144674 - RNA, 18 nt, Mycobacterium bovis subsp bovis AF2122/97
gucaucuccgacucgaua

SEQ ID NO: 1144675 - RNA, 23 nt, Mycobacterium bovis subsp bovis AF2122/97
gucaucggcuggccgcgccucgg

SEQ ID NO: 1144676 - RNA, 17 nt, Mycobacterium bovis subsp bovis AF2122/97
gucaucgggcagcggca

SEQ ID NO: 1144677 - RNA, 22 nt, Mycobacterium bovis subsp bovis AF2122/97
gucaguuacgcaucgucagcga

SEQ ID NO: 1144678 - RNA, 19 nt, Mycobacterium bovis subsp bovis AF2122/97
gucaguucggugugcggcg

SEQ ID NO: 1144679 - RNA, 21 nt, Mycobacterium bovis subsp bovis AF2122/97
gucaguccgacaccacggacc

SEQ ID NO: 1144680 - RNA, 22 nt, Mycobacterium bovis subsp bovis AF2122/97
gucaguccucaucgagcgcgcg

SEQ ID NO: 1144681 - RNA, 18 nt, Mycobacterium bovis subsp bovis AF2122/97
gucagugcgaugcggugu

SEQ ID NO: 1144682 - RNA, 22 nt, Mycobacterium bovis subsp bovis AF2122/97
gucauggccggccaucgcccga

SEQ ID NO: 1144683 - RNA, 14 nt, Mycobacterium bovis subsp bovis AF2122/97
gucaugggcgcgua

SEQ ID NO: 1144684 - RNA, 17 nt, Mycobacterium bovis subsp bovis AF2122/97
gucauggcccgaucgac

SEQ ID NO: 1144685 - RNA, 17 nt, Mycobacterium bovis subsp bovis AF2122/97
gucaucuugccaccgcu

SEQ ID NO: 1144686 - RNA, 17 nt, Mycobacterium bovis subsp bovis AF2122/97
gucaugccagucgccga

SEQ ID NO: 1144687 - RNA, 14 nt, Mycobacterium bovis subsp bovis AF2122/97
guccaccggaucgu

SEQ ID NO: 1144688 - RNA, 15 nt, Mycobacterium bovis subsp bovis AF2122/97
guccaccggaucguc

SEQ ID NO: 1144689 - RNA, 17 nt, Mycobacterium bovis subsp bovis AF2122/97
guccaccggaucgucga

SEQ ID NO: 1144690 - RNA, 17 nt, Mycobacterium bovis subsp bovis AF2122/97
guccacgaccccggcgg

SEQ ID NO: 1144691 - RNA, 11 nt, Mycobacterium bovis subsp bovis AF2122/97
guccaccccgc

SEQ ID NO: 1144692 - RNA, 17 nt, Mycobacterium bovis subsp bovis AF2122/97
guccaccuuggucgcca

SEQ ID NO: 1144693 - RNA, 19 nt, Mycobacterium bovis subsp bovis AF2122/97
guccacgccgacggcaccg

SEQ ID NO: 1144694 - RNA, 19 nt, Mycobacterium bovis subsp bovis AF2122/97
guccacgugagugccggcg

SEQ ID NO: 1144695 - RNA, 14 nt, Mycobacterium bovis subsp bovis AF2122/97
guccacguucggcu

SEQ ID NO: 1144696 - RNA, 20 nt, Mycobacterium bovis subsp bovis AF2122/97
guccagcaaaugcggcgcgu

SEQ ID NO: 1144697 - RNA, 21 nt, Mycobacterium bovis subsp bovis AF2122/97
guccagcaaaugcggcgcguu

SEQ ID NO: 1144698 - RNA, 14 nt, Mycobacterium bovis subsp bovis AF2122/97
guccagcaacagcg

SEQ ID NO: 1144699 - RNA, 22 nt, Mycobacterium bovis subsp bovis AF2122/97
guccagcaauaccugagcgcgc

SEQ ID NO: 1144700 - RNA, 14 nt, Mycobacterium bovis subsp bovis AF2122/97
guccacugccaccg

SEQ ID NO: 1144701 - RNA, 15 nt, Mycobacterium bovis subsp bovis AF2122/97
guccacugccaccgc

SEQ ID NO: 1144702 - RNA, 18 nt, Mycobacterium bovis subsp bovis AF2122/97
guccacugaucaggccga

SEQ ID NO: 1144703 - RNA, 17 nt, Mycobacterium bovis subsp bovis AF2122/97
guccagaacggcgauca

SEQ ID NO: 1144704 - RNA, 21 nt, Mycobacterium bovis subsp bovis AF2122/97
guccagaacggcgaucaccga

SEQ ID NO: 1144705 - RNA, 19 nt, Mycobacterium bovis subsp bovis AF2122/97
guccagaacgguggcgcgg

SEQ ID NO: 1144706 - RNA, 21 nt, Mycobacterium bovis subsp bovis AF2122/97
guccagauaucgaagcgucgg

SEQ ID NO: 1144707 - RNA, 19 nt, Mycobacterium bovis subsp bovis AF2122/97
guccacaacgcccgcaucg

SEQ ID NO: 1144708 - RNA, 17 nt, Mycobacterium bovis subsp bovis AF2122/97
guccacagccggcggcu

SEQ ID NO: 1144709 - RNA, 19 nt, Mycobacterium bovis subsp bovis AF2122/97
guccacaaguaccgcaucg

SEQ ID NO: 1144710 - RNA, 23 nt, Mycobacterium bovis subsp bovis AF2122/97
guccacauccagggugccgguca

SEQ ID NO: 1144711 - RNA, 16 nt, Mycobacterium bovis subsp bovis AF2122/97
guccaccgcgaugccc

SEQ ID NO: 1144712 - RNA, 18 nt, Mycobacterium bovis subsp bovis AF2122/97
guccaccgcgaugcccca

SEQ ID NO: 1144713 - RNA, 22 nt, Mycobacterium bovis subsp bovis AF2122/97
guccaccgaccuaccgucgacc

SEQ ID NO: 1144714 - RNA, 13 nt, Mycobacterium bovis subsp bovis AF2122/97
guccaccgccacc

SEQ ID NO: 1144715 - RNA, 15 nt, Mycobacterium bovis subsp bovis AF2122/97
guccaccgccaccac

SEQ ID NO: 1144716 - RNA, 16 nt, Mycobacterium bovis subsp bovis AF2122/97
guccaccgacguggcc

SEQ ID NO: 1144717 - RNA, 13 nt, Mycobacterium bovis subsp bovis AF2122/97
guccaccgauacc

SEQ ID NO: 1144718 - RNA, 20 nt, Mycobacterium bovis subsp bovis AF2122/97
guccaccgauacccccggca

SEQ ID NO: 1144719 - RNA, 14 nt, Mycobacterium bovis subsp bovis AF2122/97
guccaccccgccga

SEQ ID NO: 1144720 - RNA, 15 nt, Mycobacterium bovis subsp bovis AF2122/97
guccaccccgccgau

SEQ ID NO: 1144721 - RNA, 23 nt, Mycobacterium bovis subsp bovis AF2122/97
guccacccaagcucggucaacgc

SEQ ID NO: 1144722 - RNA, 12 nt, Mycobacterium bovis subsp bovis AF2122/97
guccaccaccgg

SEQ ID NO: 1144723 - RNA, 20 nt, Mycobacterium bovis subsp bovis AF2122/97
guccaccaccuggccggcca

SEQ ID NO: 1144724 - RNA, 18 nt, Mycobacterium bovis subsp bovis AF2122/97
guccaccacaccugcggc

SEQ ID NO: 1144725 - RNA, 13 nt, Mycobacterium bovis subsp bovis AF2122/97
guccaacucggcc

SEQ ID NO: 1144726 - RNA, 17 nt, Mycobacterium bovis subsp bovis AF2122/97
guccaaccgggccggcu

SEQ ID NO: 1144727 - RNA, 21 nt, Mycobacterium bovis subsp bovis AF2122/97
guccaacgacuguggcgccgc

SEQ ID NO: 1144728 - RNA, 17 nt, Mycobacterium bovis subsp bovis AF2122/97
guccaaaacaccgccag

SEQ ID NO: 1144729 - RNA, 17 nt, Mycobacterium bovis subsp bovis AF2122/97
guccaaccacgagcauc

SEQ ID NO: 1144730 - RNA, 15 nt, Mycobacterium bovis subsp bovis AF2122/97
guccaaccagcacca

SEQ ID NO: 1144731 - RNA, 21 nt, Mycobacterium bovis subsp bovis AF2122/97
guccaauuggcgucgucggcg

SEQ ID NO: 1144732 - RNA, 16 nt, Mycobacterium bovis subsp bovis AF2122/97
guccaauugucaagcc

SEQ ID NO: 1144733 - RNA, 16 nt, Mycobacterium bovis subsp bovis AF2122/97
guccaauuggcgucgu

SEQ ID NO: 1144734 - RNA, 17 nt, Mycobacterium bovis subsp bovis AF2122/97
guccaauuccgcagaga

SEQ ID NO: 1144735 - RNA, 17 nt, Mycobacterium bovis subsp bovis AF2122/97
guccaagugggccggcg

SEQ ID NO: 1144736 - RNA, 22 nt, Mycobacterium bovis subsp bovis AF2122/97
guccaauuccagcucacgaugu

SEQ ID NO: 1144737 - RNA, 13 nt, Mycobacterium bovis subsp bovis AF2122/97
gucauugccggcg

SEQ ID NO: 1144738 - RNA, 13 nt, Mycobacterium bovis subsp bovis AF2122/97
gucauucaccgcg

SEQ ID NO: 1144739 - RNA, 19 nt, Mycobacterium bovis subsp bovis AF2122/97
gucauguccugggccgccg

SEQ ID NO: 1144740 - RNA, 20 nt, Mycobacterium bovis subsp bovis AF2122/97
gucauguccugggccgccgc

SEQ ID NO: 1144741 - RNA, 16 nt, Mycobacterium bovis subsp bovis AF2122/97
gucaugucggccaccg

SEQ ID NO: 1144742 - RNA, 14 nt, Mycobacterium bovis subsp bovis AF2122/97
gucccacgccagcg

SEQ ID NO: 1144743 - RNA, 12 nt, Mycobacterium bovis subsp bovis AF2122/97
gucccccgcacg

SEQ ID NO: 1144744 - RNA, 19 nt, Mycobacterium bovis subsp bovis AF2122/97
guccccaggugggcagcag

SEQ ID NO: 1144745 - RNA, 21 nt, Mycobacterium bovis subsp bovis AF2122/97
guccccaugcagcgcgucgcc

SEQ ID NO: 1144746 - RNA, 15 nt, Mycobacterium bovis subsp bovis AF2122/97
gucccaacacggcga

SEQ ID NO: 1144747 - RNA, 17 nt, Mycobacterium bovis subsp bovis AF2122/97
gucccaacacggcgaca

SEQ ID NO: 1144748 - RNA, 15 nt, Mycobacterium bovis subsp bovis AF2122/97
gucccaaggcguugg

SEQ ID NO: 1144749 - RNA, 16 nt, Mycobacterium bovis subsp bovis AF2122/97
gucccaaucgucggcc

SEQ ID NO: 1144750 - RNA, 18 nt, Mycobacterium bovis subsp bovis AF2122/97
gucccaaucgucggccag

SEQ ID NO: 1144751 - RNA, 21 nt, Mycobacterium bovis subsp bovis AF2122/97
gucccacauccaucgccagug

SEQ ID NO: 1144752 - RNA, 17 nt, Mycobacterium bovis subsp bovis AF2122/97
guccauggacggccagg

SEQ ID NO: 1144753 - RNA, 21 nt, Mycobacterium bovis subsp bovis AF2122/97
guccauguggggucagugcgg

SEQ ID NO: 1144754 - RNA, 23 nt, Mycobacterium bovis subsp bovis AF2122/97
guccauguuuugcugcaugccga

SEQ ID NO: 1144755 - RNA, 13 nt, Mycobacterium bovis subsp bovis AF2122/97
guccaggugaccg

SEQ ID NO: 1144756 - RNA, 20 nt, Mycobacterium bovis subsp bovis AF2122/97
guccagcggccgccgcggcu

SEQ ID NO: 1144757 - RNA, 15 nt, Mycobacterium bovis subsp bovis AF2122/97
guccagguggcgcgg

SEQ ID NO: 1144758 - RNA, 16 nt, Mycobacterium bovis subsp bovis AF2122/97
guccagguggcgcgga

SEQ ID NO: 1144759 - RNA, 19 nt, Mycobacterium bovis subsp bovis AF2122/97
guccaggcgcgcaccaccg

SEQ ID NO: 1144760 - RNA, 15 nt, Mycobacterium bovis subsp bovis AF2122/97
guccaggccggcacc

SEQ ID NO: 1144761 - RNA, 16 nt, Mycobacterium bovis subsp bovis AF2122/97
guccaggccggcaccc

SEQ ID NO: 1144762 - RNA, 20 nt, Mycobacterium bovis subsp bovis AF2122/97
guccagcgggcauaacccgc

SEQ ID NO: 1144763 - RNA, 13 nt, Mycobacterium bovis subsp bovis AF2122/97
guccagcgcggcc

SEQ ID NO: 1144764 - RNA, 15 nt, Mycobacterium bovis subsp bovis AF2122/97
guccagcgccgcggc

SEQ ID NO: 1144765 - RNA, 17 nt, Mycobacterium bovis subsp bovis AF2122/97
guccagcgccgcggccc

SEQ ID NO: 1144766 - RNA, 19 nt, Mycobacterium bovis subsp bovis AF2122/97
guccagcgccggaagcuuc

SEQ ID NO: 1144767 - RNA, 17 nt, Mycobacterium bovis subsp bovis AF2122/97
guccagcgucgccgcca

SEQ ID NO: 1144768 - RNA, 23 nt, Mycobacterium bovis subsp bovis AF2122/97
guccaggaacuugugccgggcga

SEQ ID NO: 1144769 - RNA, 16 nt, Mycobacterium bovis subsp bovis AF2122/97
guccaggacggaucgu

SEQ ID NO: 1144770 - RNA, 18 nt, Mycobacterium bovis subsp bovis AF2122/97
guccaggacggaucgucg

SEQ ID NO: 1144771 - RNA, 15 nt, Mycobacterium bovis subsp bovis AF2122/97
guccagcagcgacgc

SEQ ID NO: 1144772 - RNA, 14 nt, Mycobacterium bovis subsp bovis AF2122/97
guccagcagcucgg

SEQ ID NO: 1144773 - RNA, 22 nt, Mycobacterium bovis subsp bovis AF2122/97
guccagcagcucggccgaggcg

SEQ ID NO: 1144774 - RNA, 13 nt, Mycobacterium bovis subsp bovis AF2122/97
guccagccaccgc

SEQ ID NO: 1144775 - RNA, 15 nt, Mycobacterium bovis subsp bovis AF2122/97
guccagccaggcgau

SEQ ID NO: 1144776 - RNA, 14 nt, Mycobacterium bovis subsp bovis AF2122/97
guccagcccggaac

SEQ ID NO: 1144777 - RNA, 19 nt, Mycobacterium bovis subsp bovis AF2122/97
guccagcagcgacgcugcc

SEQ ID NO: 1144778 - RNA, 14 nt, Mycobacterium bovis subsp bovis AF2122/97
guccagccggucca

SEQ ID NO: 1144779 - RNA, 18 nt, Mycobacterium bovis subsp bovis AF2122/97
guccagccuuuuucggcg

SEQ ID NO: 1144780 - RNA, 13 nt, Mycobacterium bovis subsp bovis AF2122/97
guccagccggcgc

SEQ ID NO: 1144781 - RNA, 12 nt, Mycobacterium bovis subsp bovis AF2122/97
guccggcggccg

SEQ ID NO: 1144782 - RNA, 16 nt, Mycobacterium bovis subsp bovis AF2122/97
guccggcggccgccau

SEQ ID NO: 1144783 - RNA, 23 nt, Mycobacterium bovis subsp bovis AF2122/97
guccggcguacucggugaucgcg

SEQ ID NO: 1144784 - RNA, 20 nt, Mycobacterium bovis subsp bovis AF2122/97
guccggcguacucggugauc

SEQ ID NO: 1144785 - RNA, 16 nt, Mycobacterium bovis subsp bovis AF2122/97
guccggcgugggcacc

SEQ ID NO: 1144786 - RNA, 14 nt, Mycobacterium bovis subsp bovis AF2122/97
guccgcgccggcgg

SEQ ID NO: 1144787 - RNA, 14 nt, Mycobacterium bovis subsp bovis AF2122/97
guccgcgccgacgg

SEQ ID NO: 1144788 - RNA, 16 nt, Mycobacterium bovis subsp bovis AF2122/97
guccgcgccgacggcc

SEQ ID NO: 1144789 - RNA, 17 nt, Mycobacterium bovis subsp bovis AF2122/97
guccgcgccgagcccgg

SEQ ID NO: 1144790 - RNA, 17 nt, Mycobacterium bovis subsp bovis AF2122/97
guccgcgcgcaagucga

SEQ ID NO: 1144791 - RNA, 18 nt, Mycobacterium bovis subsp bovis AF2122/97
guccggcgaacugcgauc

SEQ ID NO: 1144792 - RNA, 23 nt, Mycobacterium bovis subsp bovis AF2122/97
guccggcgaacugcgaucggccg

SEQ ID NO: 1144793 - RNA, 15 nt, Mycobacterium bovis subsp bovis AF2122/97
guccgcgcgccgacc

SEQ ID NO: 1144794 - RNA, 22 nt, Mycobacterium bovis subsp bovis AF2122/97
guccgcgcucagcuccggcgac

SEQ ID NO: 1144795 - RNA, 17 nt, Mycobacterium bovis subsp bovis AF2122/97
guccgccauuggcgccg

SEQ ID NO: 1144796 - RNA, 22 nt, Mycobacterium bovis subsp bovis AF2122/97
guccgccauuggcgccgucacc

SEQ ID NO: 1144797 - RNA, 16 nt, Mycobacterium bovis subsp bovis AF2122/97
guccgccagcgcgaac

SEQ ID NO: 1144798 - RNA, 17 nt, Mycobacterium bovis subsp bovis AF2122/97
guccgccagcgcgaacc

SEQ ID NO: 1144799 - RNA, 14 nt, Mycobacterium bovis subsp bovis AF2122/97
guccgcgcaccgca

SEQ ID NO: 1144800 - RNA, 16 nt, Mycobacterium bovis subsp bovis AF2122/97
guccgcgauggccgcg

SEQ ID NO: 1144801 - RNA, 13 nt, Mycobacterium bovis subsp bovis AF2122/97
guccgcgacggcc

SEQ ID NO: 1144802 - RNA, 20 nt, Mycobacterium bovis subsp bovis AF2122/97
guccgcgaucugcagcgcgg

SEQ ID NO: 1144803 - RNA, 22 nt, Mycobacterium bovis subsp bovis AF2122/97
guccgcagacgacaaccgagcu

SEQ ID NO: 1144804 - RNA, 22 nt, Mycobacterium bovis subsp bovis AF2122/97
guccgcacaacgauaguucggc

SEQ ID NO: 1144805 - RNA, 23 nt, Mycobacterium bovis subsp bovis AF2122/97
guccgcacaacgauaguucggcu

SEQ ID NO: 1144806 - RNA, 13 nt, Mycobacterium bovis subsp bovis AF2122/97
guccgcagcgucc

SEQ ID NO: 1144807 - RNA, 17 nt, Mycobacterium bovis subsp bovis AF2122/97
guccgcagcaccgucgg

SEQ ID NO: 1144808 - RNA, 16 nt, Mycobacterium bovis subsp bovis AF2122/97
guccgcaguucggucg

SEQ ID NO: 1144809 - RNA, 12 nt, Mycobacterium bovis subsp bovis AF2122/97
guccgcaugguc

SEQ ID NO: 1144810 - RNA, 21 nt, Mycobacterium bovis subsp bovis AF2122/97
guccgcauggucagcuaggua

SEQ ID NO: 1144811 - RNA, 20 nt, Mycobacterium bovis subsp bovis AF2122/97
guccgcauccgcgacggcgc

SEQ ID NO: 1144812 - RNA, 19 nt, Mycobacterium bovis subsp bovis AF2122/97
guccccgccgucgccacca

SEQ ID NO: 1144813 - RNA, 22 nt, Mycobacterium bovis subsp bovis AF2122/97
gucccuauugaucuggcaacgc

SEQ ID NO: 1144814 - RNA, 20 nt, Mycobacterium bovis subsp bovis AF2122/97
gucccugcgccgucaacacc

SEQ ID NO: 1144815 - RNA, 17 nt, Mycobacterium bovis subsp bovis AF2122/97
guccccgcagcucgacc

SEQ ID NO: 1144816 - RNA, 22 nt, Mycobacterium bovis subsp bovis AF2122/97
gucccguggcgaauucgaccac

SEQ ID NO: 1144817 - RNA, 22 nt, Mycobacterium bovis subsp bovis AF2122/97
gucccggugggcggcucgucga

SEQ ID NO: 1144818 - RNA, 13 nt, Mycobacterium bovis subsp bovis AF2122/97
guccccgccggcc

SEQ ID NO: 1144819 - RNA, 15 nt, Mycobacterium bovis subsp bovis AF2122/97
guccccgccggcggg

SEQ ID NO: 1144820 - RNA, 15 nt, Mycobacterium bovis subsp bovis AF2122/97
guccccgccgucgcc

SEQ ID NO: 1144821 - RNA, 16 nt, Mycobacterium bovis subsp bovis AF2122/97
guccccgccgucgcca

SEQ ID NO: 1144822 - RNA, 16 nt, Mycobacterium bovis subsp bovis AF2122/97
guccccggcggcagca

SEQ ID NO: 1144823 - RNA, 13 nt, Mycobacterium bovis subsp bovis AF2122/97
guccgacgcgugu

SEQ ID NO: 1144824 - RNA, 19 nt, Mycobacterium bovis subsp bovis AF2122/97
guccgagacgucggcguag

SEQ ID NO: 1144825 - RNA, 12 nt, Mycobacterium bovis subsp bovis AF2122/97
guccgacgggcc

SEQ ID NO: 1144826 - RNA, 15 nt, Mycobacterium bovis subsp bovis AF2122/97
guccgagggcgucgc

SEQ ID NO: 1144827 - RNA, 15 nt, Mycobacterium bovis subsp bovis AF2122/97
guccgauaccgcgau

SEQ ID NO: 1144828 - RNA, 19 nt, Mycobacterium bovis subsp bovis AF2122/97
guccgaucaugucggccgg

SEQ ID NO: 1144829 - RNA, 19 nt, Mycobacterium bovis subsp bovis AF2122/97
guccgaucggcgcgccgau

SEQ ID NO: 1144830 - RNA, 21 nt, Mycobacterium bovis subsp bovis AF2122/97
guccgacgguguagccgccgg

SEQ ID NO: 1144831 - RNA, 20 nt, Mycobacterium bovis subsp bovis AF2122/97
guccgaucggcgcgccgauc

SEQ ID NO: 1144832 - RNA, 16 nt, Mycobacterium bovis subsp bovis AF2122/97
guccgaugcgcgcggc

SEQ ID NO: 1144833 - RNA, 18 nt, Mycobacterium bovis subsp bovis AF2122/97
guccgaugcgcgcggcgc

SEQ ID NO: 1144834 - RNA, 22 nt, Mycobacterium bovis subsp bovis AF2122/97
guccgaugcgcgcggcgcgauc

SEQ ID NO: 1144835 - RNA, 18 nt, Mycobacterium bovis subsp bovis AF2122/97
guccgacgggccgucgcc

SEQ ID NO: 1144836 - RNA, 14 nt, Mycobacterium bovis subsp bovis AF2122/97
guccgaucgguguc

SEQ ID NO: 1144837 - RNA, 18 nt, Mycobacterium bovis subsp bovis AF2122/97
guccgcaaccucgccguc

SEQ ID NO: 1144838 - RNA, 13 nt, Mycobacterium bovis subsp bovis AF2122/97
guccgcacaacga

SEQ ID NO: 1144839 - RNA, 14 nt, Mycobacterium bovis subsp bovis AF2122/97
ggucucgacggcgg

SEQ ID NO: 1144840 - RNA, 17 nt, Mycobacterium bovis subsp bovis AF2122/97
ggucucgacggcggccg

SEQ ID NO: 1144841 - RNA, 14 nt, Mycobacterium bovis subsp bovis AF2122/97
ggucucggugcggc

SEQ ID NO: 1144842 - RNA, 20 nt, Mycobacterium bovis subsp bovis AF2122/97
ggucucgucgcggguccagg

SEQ ID NO: 1144843 - RNA, 17 nt, Mycobacterium bovis subsp bovis AF2122/97
ggucugacaucggccaa

SEQ ID NO: 1144844 - RNA, 19 nt, Mycobacterium bovis subsp bovis AF2122/97
ggucgucuuccaggagcgc

SEQ ID NO: 1144845 - RNA, 13 nt, Mycobacterium bovis subsp bovis AF2122/97
ggucgucggcguc

SEQ ID NO: 1144846 - RNA, 13 nt, Mycobacterium bovis subsp bovis AF2122/97
ggucuccggcgca

SEQ ID NO: 1144847 - RNA, 17 nt, Mycobacterium bovis subsp bovis AF2122/97
ggucgugccccggcgcg

SEQ ID NO: 1144848 - RNA, 21 nt, Mycobacterium bovis subsp bovis AF2122/97
ggucuccggacgcacgauccg

SEQ ID NO: 1144849 - RNA, 14 nt, Mycobacterium bovis subsp bovis AF2122/97
ggucgugcaggcga

SEQ ID NO: 1144850 - RNA, 15 nt, Mycobacterium bovis subsp bovis AF2122/97
ggucgugcaggcgac

SEQ ID NO: 1144851 - RNA, 19 nt, Mycobacterium bovis subsp bovis AF2122/97
ggucgugcaggcgacggcu

SEQ ID NO: 1144852 - RNA, 15 nt, Mycobacterium bovis subsp bovis AF2122/97
ggucucgaccgcgcc

SEQ ID NO: 1144853 - RNA, 15 nt, Mycobacterium bovis subsp bovis AF2122/97
ggucucgaccuucgg

SEQ ID NO: 1144854 - RNA, 12 nt, Mycobacterium bovis subsp bovis AF2122/97
ggugaccucggc

SEQ ID NO: 1144855 - RNA, 19 nt, Mycobacterium bovis subsp bovis AF2122/97
ggugaccguggcggggaaa

SEQ ID NO: 1144856 - RNA, 14 nt, Mycobacterium bovis subsp bovis AF2122/97
ggugaccguucggc

SEQ ID NO: 1144857 - RNA, 21 nt, Mycobacterium bovis subsp bovis AF2122/97
ggugaacaugugaccggcgau

SEQ ID NO: 1144858 - RNA, 16 nt, Mycobacterium bovis subsp bovis AF2122/97
ggugaaauucgcggcg

SEQ ID NO: 1144859 - RNA, 16 nt, Mycobacterium bovis subsp bovis AF2122/97
ggugaagacaccggcg

SEQ ID NO: 1144860 - RNA, 22 nt, Mycobacterium bovis subsp bovis AF2122/97
ggugaacgcgucguugucgucg

SEQ ID NO: 1144861 - RNA, 21 nt, Mycobacterium bovis subsp bovis AF2122/97
ggugaacggcaaggucgcggc

SEQ ID NO: 1144862 - RNA, 13 nt, Mycobacterium bovis subsp bovis AF2122/97
ggugaaccaccac

SEQ ID NO: 1144863 - RNA, 21 nt, Mycobacterium bovis subsp bovis AF2122/97
ggugaaccaccacuucggcgc

SEQ ID NO: 1144864 - RNA, 13 nt, Mycobacterium bovis subsp bovis AF2122/97
ggugaacccgccg

SEQ ID NO: 1144865 - RNA, 23 nt, Mycobacterium bovis subsp bovis AF2122/97
ggugaacgacaugggcaggccgc

SEQ ID NO: 1144866 - RNA, 15 nt, Mycobacterium bovis subsp bovis AF2122/97
ggugaaccgcgcggc

SEQ ID NO: 1144867 - RNA, 21 nt, Mycobacterium bovis subsp bovis AF2122/97
ggugaaccgcgcggcgaucga

SEQ ID NO: 1144868 - RNA, 22 nt, Mycobacterium bovis subsp bovis AF2122/97
ggugaaaccggccuucucgccg

SEQ ID NO: 1144869 - RNA, 15 nt, Mycobacterium bovis subsp bovis AF2122/97
ggugaaacgauggcg

SEQ ID NO: 1144870 - RNA, 19 nt, Mycobacterium bovis subsp bovis AF2122/97
ggugagguuggagcgccag

SEQ ID NO: 1144871 - RNA, 19 nt, Mycobacterium bovis subsp bovis AF2122/97
ggugagguugacccccggg

SEQ ID NO: 1144872 - RNA, 23 nt, Mycobacterium bovis subsp bovis AF2122/97
ggugagguugacccccggguaga

SEQ ID NO: 1144873 - RNA, 16 nt, Mycobacterium bovis subsp bovis AF2122/97
ggugagugcgucucgg

SEQ ID NO: 1144874 - RNA, 18 nt, Mycobacterium bovis subsp bovis AF2122/97
ggugagugcgucucggug

SEQ ID NO: 1144875 - RNA, 13 nt, Mycobacterium bovis subsp bovis AF2122/97
ggugaucaccgcg

SEQ ID NO: 1144876 - RNA, 15 nt, Mycobacterium bovis subsp bovis AF2122/97
ggugaucacgucggc

SEQ ID NO: 1144877 - RNA, 19 nt, Mycobacterium bovis subsp bovis AF2122/97
ggugaucuuggcgcccgcc

SEQ ID NO: 1144878 - RNA, 17 nt, Mycobacterium bovis subsp bovis AF2122/97
ggugaggugaccaacgg

SEQ ID NO: 1144879 - RNA, 17 nt, Mycobacterium bovis subsp bovis AF2122/97
ggugaggcgggucgccg

SEQ ID NO: 1144880 - RNA, 17 nt, Mycobacterium bovis subsp bovis AF2122/97
ggugacgauugccacca

SEQ ID NO: 1144881 - RNA, 18 nt, Mycobacterium bovis subsp bovis AF2122/97
ggugacgaugaccgcgcg

SEQ ID NO: 1144882 - RNA, 18 nt, Mycobacterium bovis subsp bovis AF2122/97
ggugacgcacagcagcac

SEQ ID NO: 1144883 - RNA, 22 nt, Mycobacterium bovis subsp bovis AF2122/97
ggugacgaucaggccgucgccg

SEQ ID NO: 1144884 - RNA, 14 nt, Mycobacterium bovis subsp bovis AF2122/97
ggugacgaucgaca

SEQ ID NO: 1144885 - RNA, 17 nt, Mycobacterium bovis subsp bovis AF2122/97
ggugacgaucgacagcc

SEQ ID NO: 1144886 - RNA, 22 nt, Mycobacterium bovis subsp bovis AF2122/97
ggugacgagcacaugcucgacg

SEQ ID NO: 1144887 - RNA, 23 nt, Mycobacterium bovis subsp bovis AF2122/97
ggugacgagcacaugcucgacgc

SEQ ID NO: 1144888 - RNA, 21 nt, Mycobacterium bovis subsp bovis AF2122/97
ggugacgagccaccaccgccg

SEQ ID NO: 1144889 - RNA, 23 nt, Mycobacterium bovis subsp bovis AF2122/97
ggugacgagccaccaccgccgac

SEQ ID NO: 1144890 - RNA, 13 nt, Mycobacterium bovis subsp bovis AF2122/97
ggugacgaucagg

SEQ ID NO: 1144891 - RNA, 14 nt, Mycobacterium bovis subsp bovis AF2122/97
ggugaccucgucga

SEQ ID NO: 1144892 - RNA, 12 nt, Mycobacterium bovis subsp bovis AF2122/97
ggugaccggguu

SEQ ID NO: 1144893 - RNA, 19 nt, Mycobacterium bovis subsp bovis AF2122/97
ggugacgacgagggcggga

SEQ ID NO: 1144894 - RNA, 22 nt, Mycobacterium bovis subsp bovis AF2122/97
ggugacgaagagcaccgcgccc

SEQ ID NO: 1144895 - RNA, 21 nt, Mycobacterium bovis subsp bovis AF2122/97
ggugaccucgucgaccgggaa

SEQ ID NO: 1144896 - RNA, 22 nt, Mycobacterium bovis subsp bovis AF2122/97
ggugacgggaaacuccgcggcg

SEQ ID NO: 1144897 - RNA, 19 nt, Mycobacterium bovis subsp bovis AF2122/97
ggugacgguguuggugacc

SEQ ID NO: 1144898 - RNA, 21 nt, Mycobacterium bovis subsp bovis AF2122/97
ggugacgguguuggugaccgg

SEQ ID NO: 1144899 - RNA, 21 nt, Mycobacterium bovis subsp bovis AF2122/97
ggugacgguguugguggccgg

SEQ ID NO: 1144900 - RNA, 16 nt, Mycobacterium bovis subsp bovis AF2122/97
ggugacgggguugacc

SEQ ID NO: 1144901 - RNA, 23 nt, Mycobacterium bovis subsp bovis AF2122/97
ggugacggucaaaugaaugguga

SEQ ID NO: 1144902 - RNA, 12 nt, Mycobacterium bovis subsp bovis AF2122/97
ggugacggcggc

SEQ ID NO: 1144903 - RNA, 14 nt, Mycobacterium bovis subsp bovis AF2122/97
ggugacggcggcaa

SEQ ID NO: 1144904 - RNA, 19 nt, Mycobacterium bovis subsp bovis AF2122/97
ggugacggcggcaacggcg

SEQ ID NO: 1144905 - RNA, 12 nt, Mycobacterium bovis subsp bovis AF2122/97
ggugacgcgccg

SEQ ID NO: 1144906 - RNA, 15 nt, Mycobacterium bovis subsp bovis AF2122/97
ggugacgccgccagc

SEQ ID NO: 1144907 - RNA, 18 nt, Mycobacterium bovis subsp bovis AF2122/97
ggugacgccgccagcacc

SEQ ID NO: 1144908 - RNA, 20 nt, Mycobacterium bovis subsp bovis AF2122/97
ggucggccacgcgcacucga

SEQ ID NO: 1144909 - RNA, 15 nt, Mycobacterium bovis subsp bovis AF2122/97
ggucggccaccaacu

SEQ ID NO: 1144910 - RNA, 13 nt, Mycobacterium bovis subsp bovis AF2122/97
ggucggcagcuuc

SEQ ID NO: 1144911 - RNA, 22 nt, Mycobacterium bovis subsp bovis AF2122/97
ggucggcgaugaugacggcggc

SEQ ID NO: 1144912 - RNA, 14 nt, Mycobacterium bovis subsp bovis AF2122/97
ggucggcgauggcg

SEQ ID NO: 1144913 - RNA, 12 nt, Mycobacterium bovis subsp bovis AF2122/97
ggucggcgccga

SEQ ID NO: 1144914 - RNA, 14 nt, Mycobacterium bovis subsp bovis AF2122/97
ggucggcgcgccgu

SEQ ID NO: 1144915 - RNA, 15 nt, Mycobacterium bovis subsp bovis AF2122/97
ggucggcggccgcca

SEQ ID NO: 1144916 - RNA, 13 nt, Mycobacterium bovis subsp bovis AF2122/97
ggucggcgguagc

SEQ ID NO: 1144917 - RNA, 14 nt, Mycobacterium bovis subsp bovis AF2122/97
ggucggcggugccg

SEQ ID NO: 1144918 - RNA, 22 nt, Mycobacterium bovis subsp bovis AF2122/97
ggucggcuacggccagugccau

SEQ ID NO: 1144919 - RNA, 15 nt, Mycobacterium bovis subsp bovis AF2122/97
ggucggcuccgcgac

SEQ ID NO: 1144920 - RNA, 22 nt, Mycobacterium bovis subsp bovis AF2122/97
ggucggcugauuggcccaccgc

SEQ ID NO: 1144921 - RNA, 13 nt, Mycobacterium bovis subsp bovis AF2122/97
ggucggcugucac

SEQ ID NO: 1144922 - RNA, 19 nt, Mycobacterium bovis subsp bovis AF2122/97
ggucggugaacccgccggc

SEQ ID NO: 1144923 - RNA, 14 nt, Mycobacterium bovis subsp bovis AF2122/97
ggucggugagccgu

SEQ ID NO: 1144924 - RNA, 20 nt, Mycobacterium bovis subsp bovis AF2122/97
ggucggugaggucgaugccg

SEQ ID NO: 1144925 - RNA, 15 nt, Mycobacterium bovis subsp bovis AF2122/97
ggucggugacgaaga

SEQ ID NO: 1144926 - RNA, 16 nt, Mycobacterium bovis subsp bovis AF2122/97
ggucggugacgaagag

SEQ ID NO: 1144927 - RNA, 22 nt, Mycobacterium bovis subsp bovis AF2122/97
ggucggugacgaagagcaccgc

SEQ ID NO: 1144928 - RNA, 22 nt, Mycobacterium bovis subsp bovis AF2122/97
ggucggugcggaacacgaugcg

SEQ ID NO: 1144929 - RNA, 14 nt, Mycobacterium bovis subsp bovis AF2122/97
ggucgguuccggug

SEQ ID NO: 1144930 - RNA, 21 nt, Mycobacterium bovis subsp bovis AF2122/97
ggucggugcugaccccgccgg

SEQ ID NO: 1144931 - RNA, 19 nt, Mycobacterium bovis subsp bovis AF2122/97
ggucgguggucucgacggc

SEQ ID NO: 1144932 - RNA, 20 nt, Mycobacterium bovis subsp bovis AF2122/97
ggucgguggucucgacggcg

SEQ ID NO: 1144933 - RNA, 20 nt, Mycobacterium bovis subsp bovis AF2122/97
ggucguacaacacgggcagc

SEQ ID NO: 1144934 - RNA, 20 nt, Mycobacterium bovis subsp bovis AF2122/97
ggucggugugcaucgccggc

SEQ ID NO: 1144935 - RNA, 21 nt, Mycobacterium bovis subsp bovis AF2122/97
ggucguccgccugcaccgccg

SEQ ID NO: 1144936 - RNA, 22 nt, Mycobacterium bovis subsp bovis AF2122/97
ggucgucgaaauggauugcggc

SEQ ID NO: 1144937 - RNA, 14 nt, Mycobacterium bovis subsp bovis AF2122/97
ggucgucgaacggc

SEQ ID NO: 1144938 - RNA, 15 nt, Mycobacterium bovis subsp bovis AF2122/97
ggucgucaugccagu

SEQ ID NO: 1144939 - RNA, 21 nt, Mycobacterium bovis subsp bovis AF2122/97
ggucguccccgucgcuggccg

SEQ ID NO: 1144940 - RNA, 16 nt, Mycobacterium bovis subsp bovis AF2122/97
ggucgucccgauggcg

SEQ ID NO: 1144941 - RNA, 17 nt, Mycobacterium bovis subsp bovis AF2122/97
ggucgucccgauggcgg

SEQ ID NO: 1144942 - RNA, 19 nt, Mycobacterium bovis subsp bovis AF2122/97
ggucgucccgauggcggug

SEQ ID NO: 1144943 - RNA, 14 nt, Mycobacterium bovis subsp bovis AF2122/97
ggucgguccgguga

SEQ ID NO: 1144944 - RNA, 19 nt, Mycobacterium bovis subsp bovis AF2122/97
ggucgucacggaccgccac

SEQ ID NO: 1144945 - RNA, 22 nt, Mycobacterium bovis subsp bovis AF2122/97
ggucgucaguaauucggccauc

SEQ ID NO: 1144946 - RNA, 22 nt, Mycobacterium bovis subsp bovis AF2122/97
ggucgcgcggcaccgauggcgc

SEQ ID NO: 1144947 - RNA, 17 nt, Mycobacterium bovis subsp bovis AF2122/97
ggucgcguccacccacg

SEQ ID NO: 1144948 - RNA, 22 nt, Mycobacterium bovis subsp bovis AF2122/97
ggucgcguccacccacgaucag

SEQ ID NO: 1144949 - RNA, 20 nt, Mycobacterium bovis subsp bovis AF2122/97
ggucgcggcuauggcgccgc

SEQ ID NO: 1144950 - RNA, 13 nt, Mycobacterium bovis subsp bovis AF2122/97
ggucgcggggccg

SEQ ID NO: 1144951 - RNA, 19 nt, Mycobacterium bovis subsp bovis AF2122/97
ggucgcgggguaggcccag

SEQ ID NO: 1144952 - RNA, 21 nt, Mycobacterium bovis subsp bovis AF2122/97
ggucgcgggguaggcccagca

SEQ ID NO: 1144953 - RNA, 11 nt, Mycobacterium bovis subsp bovis AF2122/97
ggucgcucgcg

SEQ ID NO: 1144954 - RNA, 15 nt, Mycobacterium bovis subsp bovis AF2122/97
ggucgcucgcgguca

SEQ ID NO: 1144955 - RNA, 18 nt, Mycobacterium bovis subsp bovis AF2122/97
ggucgcguuucgcagccg

SEQ ID NO: 1144956 - RNA, 21 nt, Mycobacterium bovis subsp bovis AF2122/97
ggucgcguuucgcagccgcac

SEQ ID NO: 1144957 - RNA, 16 nt, Mycobacterium bovis subsp bovis AF2122/97
ggucgcgucggcugcc

SEQ ID NO: 1144958 - RNA, 14 nt, Mycobacterium bovis subsp bovis AF2122/97
ggucgcugcugccg

SEQ ID NO: 1144959 - RNA, 16 nt, Mycobacterium bovis subsp bovis AF2122/97
ggucgcugcugccgca

SEQ ID NO: 1144960 - RNA, 23 nt, Mycobacterium bovis subsp bovis AF2122/97
ggucgcugcugccgcaccggugc

SEQ ID NO: 1144961 - RNA, 16 nt, Mycobacterium bovis subsp bovis AF2122/97
ggucgcugcugcgauc

SEQ ID NO: 1144962 - RNA, 20 nt, Mycobacterium bovis subsp bovis AF2122/97
ggucgcugcugcgaucgccg

SEQ ID NO: 1144963 - RNA, 15 nt, Mycobacterium bovis subsp bovis AF2122/97
ggucgcugccgccgu

SEQ ID NO: 1144964 - RNA, 18 nt, Mycobacterium bovis subsp bovis AF2122/97
ggucgcugccgccgucgc

SEQ ID NO: 1144965 - RNA, 19 nt, Mycobacterium bovis subsp bovis AF2122/97
ggucgcugccgccgucgcc

SEQ ID NO: 1144966 - RNA, 13 nt, Mycobacterium bovis subsp bovis AF2122/97
ggucgcugcgaug

SEQ ID NO: 1144967 - RNA, 16 nt, Mycobacterium bovis subsp bovis AF2122/97
ggucggcacgacccgg

SEQ ID NO: 1144968 - RNA, 14 nt, Mycobacterium bovis subsp bovis AF2122/97
ggucggcagcgacg

SEQ ID NO: 1144969 - RNA, 19 nt, Mycobacterium bovis subsp bovis AF2122/97
ggucggcagcgacgccggc

SEQ ID NO: 1144970 - RNA, 17 nt, Mycobacterium bovis subsp bovis AF2122/97
ggucggcacgacccggg

SEQ ID NO: 1144971 - RNA, 19 nt, Mycobacterium bovis subsp bovis AF2122/97
ggucggcacgacccgggaa

SEQ ID NO: 1144972 - RNA, 22 nt, Mycobacterium bovis subsp bovis AF2122/97
ggucggcaaugucuucgauacc

SEQ ID NO: 1144973 - RNA, 14 nt, Mycobacterium bovis subsp bovis AF2122/97
ggucggaucggcgc

SEQ ID NO: 1144974 - RNA, 16 nt, Mycobacterium bovis subsp bovis AF2122/97
ggucggcaccaccacg

SEQ ID NO: 1144975 - RNA, 22 nt, Mycobacterium bovis subsp bovis AF2122/97
ggucggcaccaccacgccgacc

SEQ ID NO: 1144976 - RNA, 13 nt, Mycobacterium bovis subsp bovis AF2122/97
ggucggaucggcg

SEQ ID NO: 1144977 - RNA, 17 nt, Mycobacterium bovis subsp bovis AF2122/97
ggucgcugcuugcgggc

SEQ ID NO: 1144978 - RNA, 12 nt, Mycobacterium bovis subsp bovis AF2122/97
ggucgcugucgg

SEQ ID NO: 1144979 - RNA, 17 nt, Mycobacterium bovis subsp bovis AF2122/97
ggucgcugugcagcggg

SEQ ID NO: 1144980 - RNA, 16 nt, Mycobacterium bovis subsp bovis AF2122/97
ggucggagcggugccg

SEQ ID NO: 1144981 - RNA, 19 nt, Mycobacterium bovis subsp bovis AF2122/97
ggucggaaugccgucgccg

SEQ ID NO: 1144982 - RNA, 15 nt, Mycobacterium bovis subsp bovis AF2122/97
ggucggacagcgucu

SEQ ID NO: 1144983 - RNA, 17 nt, Mycobacterium bovis subsp bovis AF2122/97
ggucggaaugccgucgc

SEQ ID NO: 1144984 - RNA, 14 nt, Mycobacterium bovis subsp bovis AF2122/97
gguccgccacggcg

SEQ ID NO: 1144985 - RNA, 20 nt, Mycobacterium bovis subsp bovis AF2122/97
gguccgcacgaucugcaggc

SEQ ID NO: 1144986 - RNA, 14 nt, Mycobacterium bovis subsp bovis AF2122/97
gguccgccagcgcg

SEQ ID NO: 1144987 - RNA, 19 nt, Mycobacterium bovis subsp bovis AF2122/97
gguccgccauuggcgccgu

SEQ ID NO: 1144988 - RNA, 18 nt, Mycobacterium bovis subsp bovis AF2122/97
gguccgaugcgcgcggcg

SEQ ID NO: 1144989 - RNA, 12 nt, Mycobacterium bovis subsp bovis AF2122/97
ggucccacggcg

SEQ ID NO: 1144990 - RNA, 21 nt, Mycobacterium bovis subsp bovis AF2122/97
gguccgaucaugucggccggg

SEQ ID NO: 1144991 - RNA, 15 nt, Mycobacterium bovis subsp bovis AF2122/97
gguccaucgcgcugc

SEQ ID NO: 1144992 - RNA, 16 nt, Mycobacterium bovis subsp bovis AF2122/97
ggucaugccgccgccg

SEQ ID NO: 1144993 - RNA, 18 nt, Mycobacterium bovis subsp bovis AF2122/97
gguccaucgcgcugcggc

SEQ ID NO: 1144994 - RNA, 23 nt, Mycobacterium bovis subsp bovis AF2122/97
gguccgacgguguagccgccggc

SEQ ID NO: 1144995 - RNA, 16 nt, Mycobacterium bovis subsp bovis AF2122/97
gguccgagcggcaucg

SEQ ID NO: 1144996 - RNA, 19 nt, Mycobacterium bovis subsp bovis AF2122/97
gguccgagcggcaucgguc

SEQ ID NO: 1144997 - RNA, 20 nt, Mycobacterium bovis subsp bovis AF2122/97
ggucccaaucgucggccagc

SEQ ID NO: 1144998 - RNA, 18 nt, Mycobacterium bovis subsp bovis AF2122/97
ggucccacaccuccucga

SEQ ID NO: 1144999 - RNA, 14 nt, Mycobacterium bovis subsp bovis AF2122/97
gguccagccgguga

SEQ ID NO: 1145000 - RNA, 12 nt, Mycobacterium bovis subsp bovis AF2122/97
gguccagcgagg

SEQ ID NO: 1145001 - RNA, 14 nt, Mycobacterium bovis subsp bovis AF2122/97
gguccagccaccgc

SEQ ID NO: 1145002 - RNA, 12 nt, Mycobacterium bovis subsp bovis AF2122/97
gguccagcgccg

SEQ ID NO: 1145003 - RNA, 18 nt, Mycobacterium bovis subsp bovis AF2122/97
gguccagcggccgccgcg

SEQ ID NO: 1145004 - RNA, 17 nt, Mycobacterium bovis subsp bovis AF2122/97
gguccaucagcacggug

SEQ ID NO: 1145005 - RNA, 17 nt, Mycobacterium bovis subsp bovis AF2122/97
gguccagugggaugacc

SEQ ID NO: 1145006 - RNA, 22 nt, Mycobacterium bovis subsp bovis AF2122/97
gguccaggcguuggaucccagc

SEQ ID NO: 1145007 - RNA, 19 nt, Mycobacterium bovis subsp bovis AF2122/97
gguccaggccggcacccac

SEQ ID NO: 1145008 - RNA, 20 nt, Mycobacterium bovis subsp bovis AF2122/97
gguccaggccggcacccacc

SEQ ID NO: 1145009 - RNA, 22 nt, Mycobacterium bovis subsp bovis AF2122/97
ggucaggugauucgcgcagcgc

SEQ ID NO: 1145010 - RNA, 20 nt, Mycobacterium bovis subsp bovis AF2122/97
ggucaucgccagcggcaauc

SEQ ID NO: 1145011 - RNA, 15 nt, Mycobacterium bovis subsp bovis AF2122/97
ggucaugauccgaac

SEQ ID NO: 1145012 - RNA, 21 nt, Mycobacterium bovis subsp bovis AF2122/97
gguccaaccaccgguccagcg

SEQ ID NO: 1145013 - RNA, 18 nt, Mycobacterium bovis subsp bovis AF2122/97
gguccagccaacgggaac

SEQ ID NO: 1145014 - RNA, 15 nt, Mycobacterium bovis subsp bovis AF2122/97
ggucauugccggcga

SEQ ID NO: 1145015 - RNA, 16 nt, Mycobacterium bovis subsp bovis AF2122/97
ggucaugucggccacc

SEQ ID NO: 1145016 - RNA, 21 nt, Mycobacterium bovis subsp bovis AF2122/97
ggucauguucggggcgcacca

SEQ ID NO: 1145017 - RNA, 22 nt, Mycobacterium bovis subsp bovis AF2122/97
ggucagcggauccaggccucgc

SEQ ID NO: 1145018 - RNA, 11 nt, Mycobacterium bovis subsp bovis AF2122/97
ggucagcggcc

SEQ ID NO: 1145019 - RNA, 19 nt, Mycobacterium bovis subsp bovis AF2122/97
ggucagcgcugccaccgcg

SEQ ID NO: 1145020 - RNA, 20 nt, Mycobacterium bovis subsp bovis AF2122/97
ggucagcucggugaugucgg

SEQ ID NO: 1145021 - RNA, 23 nt, Mycobacterium bovis subsp bovis AF2122/97
ggucagcuagguauugccgcaga

SEQ ID NO: 1145022 - RNA, 15 nt, Mycobacterium bovis subsp bovis AF2122/97
ggucagcucgucggc

SEQ ID NO: 1145023 - RNA, 14 nt, Mycobacterium bovis subsp bovis AF2122/97
ggucaggcggccgu

SEQ ID NO: 1145024 - RNA, 19 nt, Mycobacterium bovis subsp bovis AF2122/97
ggucaggcggccgucgucg

SEQ ID NO: 1145025 - RNA, 21 nt, Mycobacterium bovis subsp bovis AF2122/97
ggucaggcuaguugccaacac

SEQ ID NO: 1145026 - RNA, 22 nt, Mycobacterium bovis subsp bovis AF2122/97
ggucaggcaggaggcguccggc

SEQ ID NO: 1145027 - RNA, 18 nt, Mycobacterium bovis subsp bovis AF2122/97
ggucaggcaguccaccgc

SEQ ID NO: 1145028 - RNA, 17 nt, Mycobacterium bovis subsp bovis AF2122/97
ggucagcugacgggccg

SEQ ID NO: 1145029 - RNA, 14 nt, Mycobacterium bovis subsp bovis AF2122/97
ggucaggccgccgc

SEQ ID NO: 1145030 - RNA, 19 nt, Mycobacterium bovis subsp bovis AF2122/97
ggucaggccgccgcggcga

SEQ ID NO: 1145031 - RNA, 13 nt, Mycobacterium bovis subsp bovis AF2122/97
ggucaggccgacg

SEQ ID NO: 1145032 - RNA, 15 nt, Mycobacterium bovis subsp bovis AF2122/97
ggucaggaucgcacc

SEQ ID NO: 1145033 - RNA, 15 nt, Mycobacterium bovis subsp bovis AF2122/97
ggucaggaacacucg

SEQ ID NO: 1145034 - RNA, 15 nt, Mycobacterium bovis subsp bovis AF2122/97
gguaguggucuucgg

SEQ ID NO: 1145035 - RNA, 16 nt, Mycobacterium bovis subsp bovis AF2122/97
gguagucgcgaccgcg

SEQ ID NO: 1145036 - RNA, 18 nt, Mycobacterium bovis subsp bovis AF2122/97
ggucagcggcugggcggu

SEQ ID NO: 1145037 - RNA, 14 nt, Mycobacterium bovis subsp bovis AF2122/97
gguaggugucgugg

SEQ ID NO: 1145038 - RNA, 15 nt, Mycobacterium bovis subsp bovis AF2122/97
gguaguagcugacca

SEQ ID NO: 1145039 - RNA, 22 nt, Mycobacterium bovis subsp bovis AF2122/97
gguaggucgccgccgccacggc

SEQ ID NO: 1145040 - RNA, 14 nt, Mycobacterium bovis subsp bovis AF2122/97
ggucgcgcggcacc

SEQ ID NO: 1145041 - RNA, 23 nt, Mycobacterium bovis subsp bovis AF2122/97
ggucgcgcccucagccgcggcca

SEQ ID NO: 1145042 - RNA, 14 nt, Mycobacterium bovis subsp bovis AF2122/97
ggucgccugccauc

SEQ ID NO: 1145043 - RNA, 20 nt, Mycobacterium bovis subsp bovis AF2122/97
ggucgccugcccccgcgcgc

SEQ ID NO: 1145044 - RNA, 22 nt, Mycobacterium bovis subsp bovis AF2122/97
ggucgccugcgggaacgcggcg

SEQ ID NO: 1145045 - RNA, 15 nt, Mycobacterium bovis subsp bovis AF2122/97
ggucgccgagaccgg

SEQ ID NO: 1145046 - RNA, 16 nt, Mycobacterium bovis subsp bovis AF2122/97
ggucgccgacggcgac

SEQ ID NO: 1145047 - RNA, 21 nt, Mycobacterium bovis subsp bovis AF2122/97
ggucgccgacggcgaccaccg

SEQ ID NO: 1145048 - RNA, 19 nt, Mycobacterium bovis subsp bovis AF2122/97
ggucgccuucccagccgac

SEQ ID NO: 1145049 - RNA, 19 nt, Mycobacterium bovis subsp bovis AF2122/97
ggucgcgauagccgccgcg

SEQ ID NO: 1145050 - RNA, 12 nt, Mycobacterium bovis subsp bovis AF2122/97
ggucgauccggu

SEQ ID NO: 1145051 - RNA, 18 nt, Mycobacterium bovis subsp bovis AF2122/97
ggucgauccggugccgaa

SEQ ID NO: 1145052 - RNA, 16 nt, Mycobacterium bovis subsp bovis AF2122/97
ggucgaucauggcggc

SEQ ID NO: 1145053 - RNA, 19 nt, Mycobacterium bovis subsp bovis AF2122/97
ggucgauccacucggcgau

SEQ ID NO: 1145054 - RNA, 20 nt, Mycobacterium bovis subsp bovis AF2122/97
ggucgauccacucggcgauc

SEQ ID NO: 1145055 - RNA, 21 nt, Mycobacterium bovis subsp bovis AF2122/97
ggucgaucaggggcccacccg

SEQ ID NO: 1145056 - RNA, 19 nt, Mycobacterium bovis subsp bovis AF2122/97
ggucgaucaugacgagccg

SEQ ID NO: 1145057 - RNA, 23 nt, Mycobacterium bovis subsp bovis AF2122/97
ggucgaugacgccgucagcggcc

SEQ ID NO: 1145058 - RNA, 15 nt, Mycobacterium bovis subsp bovis AF2122/97
ggucgaugaccucca

SEQ ID NO: 1145059 - RNA, 21 nt, Mycobacterium bovis subsp bovis AF2122/97
ggucgaucugacugacgguca

SEQ ID NO: 1145060 - RNA, 21 nt, Mycobacterium bovis subsp bovis AF2122/97
ggucgccaacgccagcaccag

SEQ ID NO: 1145061 - RNA, 23 nt, Mycobacterium bovis subsp bovis AF2122/97
ggucgccaacgccagcaccagcg

SEQ ID NO: 1145062 - RNA, 13 nt, Mycobacterium bovis subsp bovis AF2122/97
ggucgccaagauc

SEQ ID NO: 1145063 - RNA, 23 nt, Mycobacterium bovis subsp bovis AF2122/97
ggucgaucgaauugcguucgccg

SEQ ID NO: 1145064 - RNA, 13 nt, Mycobacterium bovis subsp bovis AF2122/97
ggucgccacaccc

SEQ ID NO: 1145065 - RNA, 19 nt, Mycobacterium bovis subsp bovis AF2122/97
ggucgcccaacaccgcgcc

SEQ ID NO: 1145066 - RNA, 17 nt, Mycobacterium bovis subsp bovis AF2122/97
ggucgccaccgccggca

SEQ ID NO: 1145067 - RNA, 20 nt, Mycobacterium bovis subsp bovis AF2122/97
ggucgcccgaucggcggauc

SEQ ID NO: 1145068 - RNA, 21 nt, Mycobacterium bovis subsp bovis AF2122/97
ggucgacggaaucgucggcgc

SEQ ID NO: 1145069 - RNA, 15 nt, Mycobacterium bovis subsp bovis AF2122/97
ggucgacggccacgg

SEQ ID NO: 1145070 - RNA, 21 nt, Mycobacterium bovis subsp bovis AF2122/97
ggucgacgaucucgccggcga

SEQ ID NO: 1145071 - RNA, 16 nt, Mycobacterium bovis subsp bovis AF2122/97
ggucgacgccgagacc

SEQ ID NO: 1145072 - RNA, 22 nt, Mycobacterium bovis subsp bovis AF2122/97
ggucgaacuugaucaccgcgua

SEQ ID NO: 1145073 - RNA, 19 nt, Mycobacterium bovis subsp bovis AF2122/97
ggucgaagaccaagagcgc

SEQ ID NO: 1145074 - RNA, 23 nt, Mycobacterium bovis subsp bovis AF2122/97
ggucgaagaccaagagcgcgcag

SEQ ID NO: 1145075 - RNA, 15 nt, Mycobacterium bovis subsp bovis AF2122/97
ggucgacgucggugu

SEQ ID NO: 1145076 - RNA, 12 nt, Mycobacterium bovis subsp bovis AF2122/97
ggucgacgggca

SEQ ID NO: 1145077 - RNA, 17 nt, Mycobacterium bovis subsp bovis AF2122/97
ggucgacgggucggcgc

SEQ ID NO: 1145078 - RNA, 16 nt, Mycobacterium bovis subsp bovis AF2122/97
ggucgacuccagcacc

SEQ ID NO: 1145079 - RNA, 18 nt, Mycobacterium bovis subsp bovis AF2122/97
ggucgacuccagcaccag

SEQ ID NO: 1145080 - RNA, 23 nt, Mycobacterium bovis subsp bovis AF2122/97
ggucgagcacgcugcugcgggug

SEQ ID NO: 1145081 - RNA, 18 nt, Mycobacterium bovis subsp bovis AF2122/97
ggucgaucaacaccaacg

SEQ ID NO: 1145082 - RNA, 13 nt, Mycobacterium bovis subsp bovis AF2122/97
ggucgaucaccga

SEQ ID NO: 1145083 - RNA, 21 nt, Mycobacterium bovis subsp bovis AF2122/97
ggucgagcagugccucggcga

SEQ ID NO: 1145084 - RNA, 22 nt, Mycobacterium bovis subsp bovis AF2122/97
ggucgagcagugccucggcgau

SEQ ID NO: 1145085 - RNA, 15 nt, Mycobacterium bovis subsp bovis AF2122/97
ggucgauaccggcgu

SEQ ID NO: 1145086 - RNA, 17 nt, Mycobacterium bovis subsp bovis AF2122/97
ggucgauaccggcgugc

SEQ ID NO: 1145087 - RNA, 15 nt, Mycobacterium bovis subsp bovis AF2122/97
ggucgaucaccgaca

SEQ ID NO: 1145088 - RNA, 17 nt, Mycobacterium bovis subsp bovis AF2122/97
ggucgaucaccgacacc

SEQ ID NO: 1145089 - RNA, 20 nt, Mycobacterium bovis subsp bovis AF2122/97
ggucgaucaccgacaccgug

SEQ ID NO: 1145090 - RNA, 16 nt, Mycobacterium bovis subsp bovis AF2122/97
gguccgcgugcugccg

SEQ ID NO: 1145091 - RNA, 12 nt, Mycobacterium bovis subsp bovis AF2122/97
gguccgcggccg

SEQ ID NO: 1145092 - RNA, 13 nt, Mycobacterium bovis subsp bovis AF2122/97
gguccgcggccgc

SEQ ID NO: 1145093 - RNA, 15 nt, Mycobacterium bovis subsp bovis AF2122/97
gguccgccggugccg

SEQ ID NO: 1145094 - RNA, 20 nt, Mycobacterium bovis subsp bovis AF2122/97
gguccgccggugccgccguc

SEQ ID NO: 1145095 - RNA, 13 nt, Mycobacterium bovis subsp bovis AF2122/97
gguccgccgucga

SEQ ID NO: 1145096 - RNA, 15 nt, Mycobacterium bovis subsp bovis AF2122/97
gguccggaaccggua

SEQ ID NO: 1145097 - RNA, 19 nt, Mycobacterium bovis subsp bovis AF2122/97
gguccugggauccggcggc

SEQ ID NO: 1145098 - RNA, 17 nt, Mycobacterium bovis subsp bovis AF2122/97
gguccgcuacggcgucc

SEQ ID NO: 1145099 - RNA, 22 nt, Mycobacterium bovis subsp bovis AF2122/97
gguccggaugcgcaaccgcggc

SEQ ID NO: 1145100 - RNA, 21 nt, Mycobacterium bovis subsp bovis AF2122/97
gguccuugaggauccgcacca

SEQ ID NO: 1145101 - RNA, 18 nt, Mycobacterium bovis subsp bovis AF2122/97
gguccugguguagccgag

SEQ ID NO: 1145102 - RNA, 20 nt, Mycobacterium bovis subsp bovis AF2122/97
gguccuugccguagaagcgc

SEQ ID NO: 1145103 - RNA, 15 nt, Mycobacterium bovis subsp bovis AF2122/97
ggucgaaccgccggc

SEQ ID NO: 1145104 - RNA, 19 nt, Mycobacterium bovis subsp bovis AF2122/97
ggucgaacuugaucaccgc

SEQ ID NO: 1145105 - RNA, 16 nt, Mycobacterium bovis subsp bovis AF2122/97
ggggucgaacagcucg

SEQ ID NO: 1145106 - RNA, 20 nt, Mycobacterium bovis subsp bovis AF2122/97
gggguaucgacccuccagca

SEQ ID NO: 1145107 - RNA, 18 nt, Mycobacterium bovis subsp bovis AF2122/97
ggggucacccaucucgaa

SEQ ID NO: 1145108 - RNA, 11 nt, Mycobacterium bovis subsp bovis AF2122/97
gggguccagcg

SEQ ID NO: 1145109 - RNA, 14 nt, Mycobacterium bovis subsp bovis AF2122/97
ggggucguucgccg

SEQ ID NO: 1145110 - RNA, 15 nt, Mycobacterium bovis subsp bovis AF2122/97
ggggucgcaggccag

SEQ ID NO: 1145111 - RNA, 14 nt, Mycobacterium bovis subsp bovis AF2122/97
gggguggugguagc

SEQ ID NO: 1145112 - RNA, 21 nt, Mycobacterium bovis subsp bovis AF2122/97
ggggugcacgccuugagccga

SEQ ID NO: 1145113 - RNA, 13 nt, Mycobacterium bovis subsp bovis AF2122/97
ggggcgcucgcgc

SEQ ID NO: 1145114 - RNA, 16 nt, Mycobacterium bovis subsp bovis AF2122/97
ggggcgcucgcgcgcu

SEQ ID NO: 1145115 - RNA, 16 nt, Mycobacterium bovis subsp bovis AF2122/97
ggggcuacaacugccg

SEQ ID NO: 1145116 - RNA, 10 nt, Mycobacterium bovis subsp bovis AF2122/97
ggggcgucgc

SEQ ID NO: 1145117 - RNA, 13 nt, Mycobacterium bovis subsp bovis AF2122/97
aaguaggcggcga

SEQ ID NO: 1145118 - RNA, 20 nt, Mycobacterium bovis subsp bovis AF2122/97
gggggcuuuugcgucugcug

SEQ ID NO: 1145119 - RNA, 13 nt, Mycobacterium bovis subsp bovis AF2122/97
gggguagccgccg

SEQ ID NO: 1145120 - RNA, 15 nt, Mycobacterium bovis subsp bovis AF2122/97
ggggcugaccgccac

SEQ ID NO: 1145121 - RNA, 13 nt, Mycobacterium bovis subsp bovis AF2122/97
ggggcugcacgcu

SEQ ID NO: 1145122 - RNA, 23 nt, Mycobacterium bovis subsp bovis AF2122/97
ggggcuuaugcgucugcucgccg

SEQ ID NO: 1145123 - RNA, 20 nt, Mycobacterium bovis subsp bovis AF2122/97
ggggcuuauguguccgcucg

SEQ ID NO: 1145124 - RNA, 11 nt, Mycobacterium bovis subsp bovis AF2122/97
gggaccaccgg

SEQ ID NO: 1145125 - RNA, 14 nt, Mycobacterium bovis subsp bovis AF2122/97
ggggcagucaacuc

SEQ ID NO: 1145126 - RNA, 20 nt, Mycobacterium bovis subsp bovis AF2122/97
ggggcagguccgccccguug

SEQ ID NO: 1145127 - RNA, 13 nt, Mycobacterium bovis subsp bovis AF2122/97
ggggcgccggcgc

SEQ ID NO: 1145128 - RNA, 18 nt, Mycobacterium bovis subsp bovis AF2122/97
ggggcgccuuaggcgucc

SEQ ID NO: 1145129 - RNA, 15 nt, Mycobacterium bovis subsp bovis AF2122/97
ggggccccaugccga

SEQ ID NO: 1145130 - RNA, 18 nt, Mycobacterium bovis subsp bovis AF2122/97
ggggccccaugccgaccg

SEQ ID NO: 1145131 - RNA, 20 nt, Mycobacterium bovis subsp bovis AF2122/97
ggggccccgcggcgccgcca

SEQ ID NO: 1145132 - RNA, 14 nt, Mycobacterium bovis subsp bovis AF2122/97
ggggcagcgacggc

SEQ ID NO: 1145133 - RNA, 13 nt, Mycobacterium bovis subsp bovis AF2122/97
ggggcagcgcggc

SEQ ID NO: 1145134 - RNA, 14 nt, Mycobacterium bovis subsp bovis AF2122/97
ggggcagcucaucg

SEQ ID NO: 1145135 - RNA, 19 nt, Mycobacterium bovis subsp bovis AF2122/97
ggggcaccagcgaauccag

SEQ ID NO: 1145136 - RNA, 23 nt, Mycobacterium bovis subsp bovis AF2122/97
ggggcaccguuaccgccgucgcc

SEQ ID NO: 1145137 - RNA, 18 nt, Mycobacterium bovis subsp bovis AF2122/97
gggaccccgcugcgacgu

SEQ ID NO: 1145138 - RNA, 14 nt, Mycobacterium bovis subsp bovis AF2122/97
gggacaguucgcgc

SEQ ID NO: 1145139 - RNA, 20 nt, Mycobacterium bovis subsp bovis AF2122/97
gggaccacccgguccugcuc

SEQ ID NO: 1145140 - RNA, 20 nt, Mycobacterium bovis subsp bovis AF2122/97
gggaaugucgaaacccacgu

SEQ ID NO: 1145141 - RNA, 18 nt, Mycobacterium bovis subsp bovis AF2122/97
gggaaucagugaagacac

SEQ ID NO: 1145142 - RNA, 14 nt, Mycobacterium bovis subsp bovis AF2122/97
gggaaucgcucgcg

SEQ ID NO: 1145143 - RNA, 22 nt, Mycobacterium bovis subsp bovis AF2122/97
gggacaaagccgaacgacagca

SEQ ID NO: 1145144 - RNA, 14 nt, Mycobacterium bovis subsp bovis AF2122/97
gggacaacucgcgu

SEQ ID NO: 1145145 - RNA, 21 nt, Mycobacterium bovis subsp bovis AF2122/97
gggacaacucgcguggcaccg

SEQ ID NO: 1145146 - RNA, 15 nt, Mycobacterium bovis subsp bovis AF2122/97
gggacaaucguccac

SEQ ID NO: 1145147 - RNA, 18 nt, Mycobacterium bovis subsp bovis AF2122/97
gggacaaucucggccgca

SEQ ID NO: 1145148 - RNA, 22 nt, Mycobacterium bovis subsp bovis AF2122/97
gggacacaauccacgucgcggc

SEQ ID NO: 1145149 - RNA, 20 nt, Mycobacterium bovis subsp bovis AF2122/97
gggacaccaucuccgccguc

SEQ ID NO: 1145150 - RNA, 17 nt, Mycobacterium bovis subsp bovis AF2122/97
gggaaggcucaccacgg

SEQ ID NO: 1145151 - RNA, 16 nt, Mycobacterium bovis subsp bovis AF2122/97
gggaaggaaccgggca

SEQ ID NO: 1145152 - RNA, 13 nt, Mycobacterium bovis subsp bovis AF2122/97
gggaagcgccaaa

SEQ ID NO: 1145153 - RNA, 12 nt, Mycobacterium bovis subsp bovis AF2122/97
gggaagccugcg

SEQ ID NO: 1145154 - RNA, 14 nt, Mycobacterium bovis subsp bovis AF2122/97
gggaagagccgggc

SEQ ID NO: 1145155 - RNA, 20 nt, Mycobacterium bovis subsp bovis AF2122/97
gggaagaaguaugcgggacu

SEQ ID NO: 1145156 - RNA, 18 nt, Mycobacterium bovis subsp bovis AF2122/97
gggaacguccgcgccgag

SEQ ID NO: 1145157 - RNA, 14 nt, Mycobacterium bovis subsp bovis AF2122/97
ggguccggcggccg

SEQ ID NO: 1145158 - RNA, 16 nt, Mycobacterium bovis subsp bovis AF2122/97
ggguccggcggccgcc

SEQ ID NO: 1145159 - RNA, 19 nt, Mycobacterium bovis subsp bovis AF2122/97
ggguccggcggccgccauc

SEQ ID NO: 1145160 - RNA, 15 nt, Mycobacterium bovis subsp bovis AF2122/97
ggguccgggcggccg

SEQ ID NO: 1145161 - RNA, 16 nt, Mycobacterium bovis subsp bovis AF2122/97
ggguccgggcggccgc

SEQ ID NO: 1145162 - RNA, 13 nt, Mycobacterium bovis subsp bovis AF2122/97
ggguccgcggaga

SEQ ID NO: 1145163 - RNA, 22 nt, Mycobacterium bovis subsp bovis AF2122/97
ggguccgcgucggcggcgaccg

SEQ ID NO: 1145164 - RNA, 17 nt, Mycobacterium bovis subsp bovis AF2122/97
ggguccgacgggccacg

SEQ ID NO: 1145165 - RNA, 22 nt, Mycobacterium bovis subsp bovis AF2122/97
ggguccgaaguacuggccgccg

SEQ ID NO: 1145166 - RNA, 16 nt, Mycobacterium bovis subsp bovis AF2122/97
gggucagggguucgag

SEQ ID NO: 1145167 - RNA, 20 nt, Mycobacterium bovis subsp bovis AF2122/97
ggguccaucggggccgucgg

SEQ ID NO: 1145168 - RNA, 13 nt, Mycobacterium bovis subsp bovis AF2122/97
gggucccgccacc

SEQ ID NO: 1145169 - RNA, 13 nt, Mycobacterium bovis subsp bovis AF2122/97
gggucccgcuggc

SEQ ID NO: 1145170 - RNA, 15 nt, Mycobacterium bovis subsp bovis AF2122/97
gggucagcucgguga

SEQ ID NO: 1145171 - RNA, 17 nt, Mycobacterium bovis subsp bovis AF2122/97
gggucagguugucggcg

SEQ ID NO: 1145172 - RNA, 17 nt, Mycobacterium bovis subsp bovis AF2122/97
ggguccacgcgcucggu

SEQ ID NO: 1145173 - RNA, 22 nt, Mycobacterium bovis subsp bovis AF2122/97
ggguccagcccggaacccgagc

SEQ ID NO: 1145174 - RNA, 16 nt, Mycobacterium bovis subsp bovis AF2122/97
gggucaucgccagcgg

SEQ ID NO: 1145175 - RNA, 18 nt, Mycobacterium bovis subsp bovis AF2122/97
gggucaucgccagcggca

SEQ ID NO: 1145176 - RNA, 13 nt, Mycobacterium bovis subsp bovis AF2122/97
gggucaucgccag

SEQ ID NO: 1145177 - RNA, 12 nt, Mycobacterium bovis subsp bovis AF2122/97
gggucaugccgu

SEQ ID NO: 1145178 - RNA, 20 nt, Mycobacterium bovis subsp bovis AF2122/97
ggguccacaacgcccgcauc

SEQ ID NO: 1145179 - RNA, 16 nt, Mycobacterium bovis subsp bovis AF2122/97
gggucgaccccggcca

SEQ ID NO: 1145180 - RNA, 12 nt, Mycobacterium bovis subsp bovis AF2122/97
gggucgaccgga

SEQ ID NO: 1145181 - RNA, 20 nt, Mycobacterium bovis subsp bovis AF2122/97
gggucgaccggaaugcccgg

SEQ ID NO: 1145182 - RNA, 20 nt, Mycobacterium bovis subsp bovis AF2122/97
gggucgaacuugaucaccgc

SEQ ID NO: 1145183 - RNA, 21 nt, Mycobacterium bovis subsp bovis AF2122/97
ggguccgucgagucgccgagg

SEQ ID NO: 1145184 - RNA, 19 nt, Mycobacterium bovis subsp bovis AF2122/97
ggguccucgagcggcagau

SEQ ID NO: 1145185 - RNA, 16 nt, Mycobacterium bovis subsp bovis AF2122/97
ggguccuggaucagcc

SEQ ID NO: 1145186 - RNA, 18 nt, Mycobacterium bovis subsp bovis AF2122/97
gggucgaacaggccggcc

SEQ ID NO: 1145187 - RNA, 20 nt, Mycobacterium bovis subsp bovis AF2122/97
gggucgaacaggccggccgc

SEQ ID NO: 1145188 - RNA, 14 nt, Mycobacterium bovis subsp bovis AF2122/97
gggucgccgccauc

SEQ ID NO: 1145189 - RNA, 21 nt, Mycobacterium bovis subsp bovis AF2122/97
gggucgcgcuggcgccggcca

SEQ ID NO: 1145190 - RNA, 22 nt, Mycobacterium bovis subsp bovis AF2122/97
gggucgacguaggacugccagc

SEQ ID NO: 1145191 - RNA, 15 nt, Mycobacterium bovis subsp bovis AF2122/97
gggucgauccggugc

SEQ ID NO: 1145192 - RNA, 17 nt, Mycobacterium bovis subsp bovis AF2122/97
gggucgcaaccgccgcc

SEQ ID NO: 1145193 - RNA, 18 nt, Mycobacterium bovis subsp bovis AF2122/97
gggucgcaaccgccgcca

SEQ ID NO: 1145194 - RNA, 22 nt, Mycobacterium bovis subsp bovis AF2122/97
gggucgauggguaccgcgggga

SEQ ID NO: 1145195 - RNA, 16 nt, Mycobacterium bovis subsp bovis AF2122/97
gggucaagaucggugc

SEQ ID NO: 1145196 - RNA, 22 nt, Mycobacterium bovis subsp bovis AF2122/97
gggucagacaacaacacggggc

SEQ ID NO: 1145197 - RNA, 14 nt, Mycobacterium bovis subsp bovis AF2122/97
gggucaacgccauc

SEQ ID NO: 1145198 - RNA, 17 nt, Mycobacterium bovis subsp bovis AF2122/97
ggguauccacgccgggc

SEQ ID NO: 1145199 - RNA, 15 nt, Mycobacterium bovis subsp bovis AF2122/97
ggguagcggaucaag

SEQ ID NO: 1145200 - RNA, 12 nt, Mycobacterium bovis subsp bovis AF2122/97
ggguagcggcgc

SEQ ID NO: 1145201 - RNA, 13 nt, Mycobacterium bovis subsp bovis AF2122/97
ggguagcggcgcc

SEQ ID NO: 1145202 - RNA, 14 nt, Mycobacterium bovis subsp bovis AF2122/97
ggguaucgccagcc

SEQ ID NO: 1145203 - RNA, 14 nt, Mycobacterium bovis subsp bovis AF2122/97
ggguauggcggcga

SEQ ID NO: 1145204 - RNA, 21 nt, Mycobacterium bovis subsp bovis AF2122/97
gggucaaugcuggcagcggcc

SEQ ID NO: 1145205 - RNA, 14 nt, Mycobacterium bovis subsp bovis AF2122/97
ggguaccaggcgcc

SEQ ID NO: 1145206 - RNA, 16 nt, Mycobacterium bovis subsp bovis AF2122/97
ggguacccaucugcuc

SEQ ID NO: 1145207 - RNA, 21 nt, Mycobacterium bovis subsp bovis AF2122/97
ggguaauucuugacgccgaug

SEQ ID NO: 1145208 - RNA, 16 nt, Mycobacterium bovis subsp bovis AF2122/97
ggguacgcaucucgag

SEQ ID NO: 1145209 - RNA, 16 nt, Mycobacterium bovis subsp bovis AF2122/97
ggguacaggcugcugc

SEQ ID NO: 1145210 - RNA, 17 nt, Mycobacterium bovis subsp bovis AF2122/97
ggguaccacgcuggcgc

SEQ ID NO: 1145211 - RNA, 17 nt, Mycobacterium bovis subsp bovis AF2122/97
ggguacccaucugcuca

SEQ ID NO: 1145212 - RNA, 19 nt, Mycobacterium bovis subsp bovis AF2122/97
ggguagcgcgagcagacgu

SEQ ID NO: 1145213 - RNA, 23 nt, Mycobacterium bovis subsp bovis AF2122/97
ggguagccaucggcuaggccggc

SEQ ID NO: 1145214 - RNA, 17 nt, Mycobacterium bovis subsp bovis AF2122/97
ggguagccgccggcgcc

SEQ ID NO: 1145215 - RNA, 15 nt, Mycobacterium bovis subsp bovis AF2122/97
ggguagacaccgcga

SEQ ID NO: 1145216 - RNA, 16 nt, Mycobacterium bovis subsp bovis AF2122/97
ggguagaccuucucgc

SEQ ID NO: 1145217 - RNA, 19 nt, Mycobacterium bovis subsp bovis AF2122/97
ggguacggucucacggcgc

SEQ ID NO: 1145218 - RNA, 16 nt, Mycobacterium bovis subsp bovis AF2122/97
gggguguugaggccgg

SEQ ID NO: 1145219 - RNA, 15 nt, Mycobacterium bovis subsp bovis AF2122/97
ggguaauacggcgcc

SEQ ID NO: 1145220 - RNA, 16 nt, Mycobacterium bovis subsp bovis AF2122/97
ggguaacguguucacg

SEQ ID NO: 1145221 - RNA, 22 nt, Mycobacterium bovis subsp bovis AF2122/97
ggguaacguguucacggccgca

SEQ ID NO: 1145222 - RNA, 22 nt, Mycobacterium bovis subsp bovis AF2122/97
ggguaagcgaccgacgccauug

SEQ ID NO: 1145223 - RNA, 19 nt, Mycobacterium bovis subsp bovis AF2122/97
gggucggccugcggcaccg

SEQ ID NO: 1145224 - RNA, 12 nt, Mycobacterium bovis subsp bovis AF2122/97
gggucggcgaug

SEQ ID NO: 1145225 - RNA, 13 nt, Mycobacterium bovis subsp bovis AF2122/97
gggucgcugccgc

SEQ ID NO: 1145226 - RNA, 14 nt, Mycobacterium bovis subsp bovis AF2122/97
gggucgcugccgcc

SEQ ID NO: 1145227 - RNA, 12 nt, Mycobacterium bovis subsp bovis AF2122/97
gggucgcggugu

SEQ ID NO: 1145228 - RNA, 20 nt, Mycobacterium bovis subsp bovis AF2122/97
gggucggcauugaucggugc

SEQ ID NO: 1145229 - RNA, 16 nt, Mycobacterium bovis subsp bovis AF2122/97
gggucguacaacacgg

SEQ ID NO: 1145230 - RNA, 17 nt, Mycobacterium bovis subsp bovis AF2122/97
gggucgggguccgcggc

SEQ ID NO: 1145231 - RNA, 21 nt, Mycobacterium bovis subsp bovis AF2122/97
gggucggucacgacggcacgc

SEQ ID NO: 1145232 - RNA, 17 nt, Mycobacterium bovis subsp bovis AF2122/97
gggucggcuuccggugc

SEQ ID NO: 1145233 - RNA, 20 nt, Mycobacterium bovis subsp bovis AF2122/97
gggucggggaagacgaccgu

SEQ ID NO: 1145234 - RNA, 17 nt, Mycobacterium bovis subsp bovis AF2122/97
gggucgucaugccaguc

SEQ ID NO: 1145235 - RNA, 19 nt, Mycobacterium bovis subsp bovis AF2122/97
gggucguccgccugcaccg

SEQ ID NO: 1145236 - RNA, 13 nt, Mycobacterium bovis subsp bovis AF2122/97
gggucgugccagc

SEQ ID NO: 1145237 - RNA, 14 nt, Mycobacterium bovis subsp bovis AF2122/97
gggucguucgccga

SEQ ID NO: 1145238 - RNA, 19 nt, Mycobacterium bovis subsp bovis AF2122/97
gggucguugaggccgguga

SEQ ID NO: 1145239 - RNA, 12 nt, Mycobacterium bovis subsp bovis AF2122/97
gggucgugcgac

SEQ ID NO: 1145240 - RNA, 17 nt, Mycobacterium bovis subsp bovis AF2122/97
gggugagugaccacgcu

SEQ ID NO: 1145241 - RNA, 18 nt, Mycobacterium bovis subsp bovis AF2122/97
gggugaguucggcguaga

SEQ ID NO: 1145242 - RNA, 14 nt, Mycobacterium bovis subsp bovis AF2122/97
gggugagcccggga

SEQ ID NO: 1145243 - RNA, 17 nt, Mycobacterium bovis subsp bovis AF2122/97
gggugaccaggccgagc

SEQ ID NO: 1145244 - RNA, 15 nt, Mycobacterium bovis subsp bovis AF2122/97
gggugaccaggcggc

SEQ ID NO: 1145245 - RNA, 19 nt, Mycobacterium bovis subsp bovis AF2122/97
gggugaaucgacaccgccc

SEQ ID NO: 1145246 - RNA, 21 nt, Mycobacterium bovis subsp bovis AF2122/97
gggugacaucgcgaggcguca

SEQ ID NO: 1145247 - RNA, 21 nt, Mycobacterium bovis subsp bovis AF2122/97
gggugaaguggcgcagcaccg

SEQ ID NO: 1145248 - RNA, 21 nt, Mycobacterium bovis subsp bovis AF2122/97
gggugaagacaccggcgucga

SEQ ID NO: 1145249 - RNA, 15 nt, Mycobacterium bovis subsp bovis AF2122/97
gggucuuugcccgcc

SEQ ID NO: 1145250 - RNA, 17 nt, Mycobacterium bovis subsp bovis AF2122/97
gggucuuugcccgccac

SEQ ID NO: 1145251 - RNA, 14 nt, Mycobacterium bovis subsp bovis AF2122/97
gggucugcgccgcc

SEQ ID NO: 1145252 - RNA, 18 nt, Mycobacterium bovis subsp bovis AF2122/97
gggucugcucagcgcggc

SEQ ID NO: 1145253 - RNA, 17 nt, Mycobacterium bovis subsp bovis AF2122/97
gggucuugacggcgcca

SEQ ID NO: 1145254 - RNA, 14 nt, Mycobacterium bovis subsp bovis AF2122/97
gggucuugacggcg

SEQ ID NO: 1145255 - RNA, 22 nt, Mycobacterium bovis subsp bovis AF2122/97
gggugcaccgaagauggccagc

SEQ ID NO: 1145256 - RNA, 12 nt, Mycobacterium bovis subsp bovis AF2122/97
gggugcagcacg

SEQ ID NO: 1145257 - RNA, 13 nt, Mycobacterium bovis subsp bovis AF2122/97
gggugcagcacgg

SEQ ID NO: 1145258 - RNA, 17 nt, Mycobacterium bovis subsp bovis AF2122/97
gggugcagcacggcgcc

SEQ ID NO: 1145259 - RNA, 18 nt, Mycobacterium bovis subsp bovis AF2122/97
gggugcagcacggcgccg

SEQ ID NO: 1145260 - RNA, 22 nt, Mycobacterium bovis subsp bovis AF2122/97
gggugcagcacggcgccgccac

SEQ ID NO: 1145261 - RNA, 14 nt, Mycobacterium bovis subsp bovis AF2122/97
gggugccggcagcg

SEQ ID NO: 1145262 - RNA, 13 nt, Mycobacterium bovis subsp bovis AF2122/97
gggugccggcgcc

SEQ ID NO: 1145263 - RNA, 16 nt, Mycobacterium bovis subsp bovis AF2122/97
gggugccggcgucgcu

SEQ ID NO: 1145264 - RNA, 23 nt, Mycobacterium bovis subsp bovis AF2122/97
gggugccggcgucgcuggccagg

SEQ ID NO: 1145265 - RNA, 15 nt, Mycobacterium bovis subsp bovis AF2122/97
gggugcgacgcgacc

SEQ ID NO: 1145266 - RNA, 18 nt, Mycobacterium bovis subsp bovis AF2122/97
gggugccgguguugccgc

SEQ ID NO: 1145267 - RNA, 12 nt, Mycobacterium bovis subsp bovis AF2122/97
gggugccgucgg

SEQ ID NO: 1145268 - RNA, 18 nt, Mycobacterium bovis subsp bovis AF2122/97
gggugcgcccggccaagc

SEQ ID NO: 1145269 - RNA, 13 nt, Mycobacterium bovis subsp bovis AF2122/97
gggugcgccguca

SEQ ID NO: 1145270 - RNA, 20 nt, Mycobacterium bovis subsp bovis AF2122/97
gggugcgcgcgaccauaccc

SEQ ID NO: 1145271 - RNA, 22 nt, Mycobacterium bovis subsp bovis AF2122/97
gggugcgcgcgaccauacccgc

SEQ ID NO: 1145272 - RNA, 18 nt, Mycobacterium bovis subsp bovis AF2122/97
gggugugcaggccgcgga

SEQ ID NO: 1145273 - RNA, 15 nt, Mycobacterium bovis subsp bovis AF2122/97
gggugucggugucga

SEQ ID NO: 1145274 - RNA, 14 nt, Mycobacterium bovis subsp bovis AF2122/97
ggguggcgcgggcc

SEQ ID NO: 1145275 - RNA, 13 nt, Mycobacterium bovis subsp bovis AF2122/97
ggguggcgcggua

SEQ ID NO: 1145276 - RNA, 11 nt, Mycobacterium bovis subsp bovis AF2122/97
gggugcuggca

SEQ ID NO: 1145277 - RNA, 13 nt, Mycobacterium bovis subsp bovis AF2122/97
gggugcugcgcgc

SEQ ID NO: 1145278 - RNA, 17 nt, Mycobacterium bovis subsp bovis AF2122/97
gggugcgucgacccagc

SEQ ID NO: 1145279 - RNA, 19 nt, Mycobacterium bovis subsp bovis AF2122/97
ggguggccgacgauagcgg

SEQ ID NO: 1145280 - RNA, 12 nt, Mycobacterium bovis subsp bovis AF2122/97
ggguggccagca

SEQ ID NO: 1145281 - RNA, 20 nt, Mycobacterium bovis subsp bovis AF2122/97
ggguggccagcaacugccgc

SEQ ID NO: 1145282 - RNA, 17 nt, Mycobacterium bovis subsp bovis AF2122/97
ggguggauuggugccgg

SEQ ID NO: 1145283 - RNA, 13 nt, Mycobacterium bovis subsp bovis AF2122/97
ggguugugccgcc

SEQ ID NO: 1145284 - RNA, 22 nt, Mycobacterium bovis subsp bovis AF2122/97
ggguuuccaagucggagcgggg

SEQ ID NO: 1145285 - RNA, 20 nt, Mycobacterium bovis subsp bovis AF2122/97
ggguuucgcucgcaccgccc

SEQ ID NO: 1145286 - RNA, 14 nt, Mycobacterium bovis subsp bovis AF2122/97
ggguguucgauggg

SEQ ID NO: 1145287 - RNA, 18 nt, Mycobacterium bovis subsp bovis AF2122/97
ggguguucgcgcgcgacu

SEQ ID NO: 1145288 - RNA, 18 nt, Mycobacterium bovis subsp bovis AF2122/97
ggguguugaucucgccgg

SEQ ID NO: 1145289 - RNA, 15 nt, Mycobacterium bovis subsp bovis AF2122/97
ggguguugcuggccg

SEQ ID NO: 1145290 - RNA, 18 nt, Mycobacterium bovis subsp bovis AF2122/97
ggguguugcuggccgcga

SEQ ID NO: 1145291 - RNA, 20 nt, Mycobacterium bovis subsp bovis AF2122/97
ggguguugucgucgagcgcg

SEQ ID NO: 1145292 - RNA, 19 nt, Mycobacterium bovis subsp bovis AF2122/97
ggguguuugucgcgguggu

SEQ ID NO: 1145293 - RNA, 19 nt, Mycobacterium bovis subsp bovis AF2122/97
ggguuacccgcagcgugcc

SEQ ID NO: 1145294 - RNA, 15 nt, Mycobacterium bovis subsp bovis AF2122/97
ggguugguuggcucg

SEQ ID NO: 1145295 - RNA, 12 nt, Mycobacterium bovis subsp bovis AF2122/97
ggguuggucccg

SEQ ID NO: 1145296 - RNA, 21 nt, Mycobacterium bovis subsp bovis AF2122/97
ggguugcggagcucacgccgg

SEQ ID NO: 1145297 - RNA, 22 nt, Mycobacterium bovis subsp bovis AF2122/97
ggguuggccgaacagcugcccg

SEQ ID NO: 1145298 - RNA, 17 nt, Mycobacterium bovis subsp bovis AF2122/97
ggguuacucgcagcgcc

SEQ ID NO: 1145299 - RNA, 14 nt, Mycobacterium bovis subsp bovis AF2122/97
ggguucacugccgg

SEQ ID NO: 1145300 - RNA, 21 nt, Mycobacterium bovis subsp bovis AF2122/97
gguacagcgcuucacgggccg

SEQ ID NO: 1145301 - RNA, 16 nt, Mycobacterium bovis subsp bovis AF2122/97
gguacaucaccacgau

SEQ ID NO: 1145302 - RNA, 15 nt, Mycobacterium bovis subsp bovis AF2122/97
gguacauccagagac

SEQ ID NO: 1145303 - RNA, 22 nt, Mycobacterium bovis subsp bovis AF2122/97
gguacaucccggugucgaugcg

SEQ ID NO: 1145304 - RNA, 13 nt, Mycobacterium bovis subsp bovis AF2122/97
gguacacccgcuc

SEQ ID NO: 1145305 - RNA, 15 nt, Mycobacterium bovis subsp bovis AF2122/97
gguaccaaccugcgc

SEQ ID NO: 1145306 - RNA, 13 nt, Mycobacterium bovis subsp bovis AF2122/97
gguaccaccggca

SEQ ID NO: 1145307 - RNA, 23 nt, Mycobacterium bovis subsp bovis AF2122/97
gguaccggugucaguccgacacc

SEQ ID NO: 1145308 - RNA, 20 nt, Mycobacterium bovis subsp bovis AF2122/97
gguaccucaacaccaggccg

SEQ ID NO: 1145309 - RNA, 21 nt, Mycobacterium bovis subsp bovis AF2122/97
gguagaacuccucgcugucga

SEQ ID NO: 1145310 - RNA, 18 nt, Mycobacterium bovis subsp bovis AF2122/97
gguacugugggcgaucgg

SEQ ID NO: 1145311 - RNA, 20 nt, Mycobacterium bovis subsp bovis AF2122/97
gguacucgccccacuugccg

SEQ ID NO: 1145312 - RNA, 20 nt, Mycobacterium bovis subsp bovis AF2122/97
gguacuccccguugccuucg

SEQ ID NO: 1145313 - RNA, 14 nt, Mycobacterium bovis subsp bovis AF2122/97
gguacucccgcgau

SEQ ID NO: 1145314 - RNA, 15 nt, Mycobacterium bovis subsp bovis AF2122/97
gguacgcgaucagcg

SEQ ID NO: 1145315 - RNA, 16 nt, Mycobacterium bovis subsp bovis AF2122/97
gguacgcgaucagcgc

SEQ ID NO: 1145316 - RNA, 18 nt, Mycobacterium bovis subsp bovis AF2122/97
gguacgcgaucagcgcgc

SEQ ID NO: 1145317 - RNA, 15 nt, Mycobacterium bovis subsp bovis AF2122/97
gguacgcaucucgag

SEQ ID NO: 1145318 - RNA, 17 nt, Mycobacterium bovis subsp bovis AF2122/97
gguaccaaccugcgcgg

SEQ ID NO: 1145319 - RNA, 20 nt, Mycobacterium bovis subsp bovis AF2122/97
gguaccaaccugcgcggcga

SEQ ID NO: 1145320 - RNA, 20 nt, Mycobacterium bovis subsp bovis AF2122/97
gguacgcaaccaaccgucgg

SEQ ID NO: 1145321 - RNA, 23 nt, Mycobacterium bovis subsp bovis AF2122/97
gguacgcaaccaaccgucgguga

SEQ ID NO: 1145322 - RNA, 16 nt, Mycobacterium bovis subsp bovis AF2122/97
gguacggguaacgcac

SEQ ID NO: 1145323 - RNA, 17 nt, Mycobacterium bovis subsp bovis AF2122/97
gguacggucucacggcg

SEQ ID NO: 1145324 - RNA, 14 nt, Mycobacterium bovis subsp bovis AF2122/97
gguacguaaucgag

SEQ ID NO: 1145325 - RNA, 17 nt, Mycobacterium bovis subsp bovis AF2122/97
gguacguaaucgagcgc

SEQ ID NO: 1145326 - RNA, 19 nt, Mycobacterium bovis subsp bovis AF2122/97
gguacgacaccgcagcggg

SEQ ID NO: 1145327 - RNA, 23 nt, Mycobacterium bovis subsp bovis AF2122/97
gguacgcgcugaaucaccccggc

SEQ ID NO: 1145328 - RNA, 12 nt, Mycobacterium bovis subsp bovis AF2122/97
gguagccggcga

SEQ ID NO: 1145329 - RNA, 13 nt, Mycobacterium bovis subsp bovis AF2122/97
gguagccggcgac

SEQ ID NO: 1145330 - RNA, 14 nt, Mycobacterium bovis subsp bovis AF2122/97
gguagccggcgugc

SEQ ID NO: 1145331 - RNA, 22 nt, Mycobacterium bovis subsp bovis AF2122/97
gguagccgggaacgcugacgcc

SEQ ID NO: 1145332 - RNA, 13 nt, Mycobacterium bovis subsp bovis AF2122/97
gguagccgggcac

SEQ ID NO: 1145333 - RNA, 15 nt, Mycobacterium bovis subsp bovis AF2122/97
gguagccugaccagc

SEQ ID NO: 1145334 - RNA, 14 nt, Mycobacterium bovis subsp bovis AF2122/97
gguagcggcgccgc

SEQ ID NO: 1145335 - RNA, 15 nt, Mycobacterium bovis subsp bovis AF2122/97
gguagcggaccugcg

SEQ ID NO: 1145336 - RNA, 13 nt, Mycobacterium bovis subsp bovis AF2122/97
gguagccgcccag

SEQ ID NO: 1145337 - RNA, 14 nt, Mycobacterium bovis subsp bovis AF2122/97
gguagccgcccagc

SEQ ID NO: 1145338 - RNA, 14 nt, Mycobacterium bovis subsp bovis AF2122/97
gguagccgccggcg

SEQ ID NO: 1145339 - RNA, 15 nt, Mycobacterium bovis subsp bovis AF2122/97
gguagccgccggcgc

SEQ ID NO: 1145340 - RNA, 14 nt, Mycobacterium bovis subsp bovis AF2122/97
gguagacgccgccg

SEQ ID NO: 1145341 - RNA, 20 nt, Mycobacterium bovis subsp bovis AF2122/97
gguagaccuucucgccgccg

SEQ ID NO: 1145342 - RNA, 19 nt, Mycobacterium bovis subsp bovis AF2122/97
gguagacaugggugaaucg

SEQ ID NO: 1145343 - RNA, 13 nt, Mycobacterium bovis subsp bovis AF2122/97
gguucaucgccgg

SEQ ID NO: 1145344 - RNA, 16 nt, Mycobacterium bovis subsp bovis AF2122/97
gguucaugaacaucgg

SEQ ID NO: 1145345 - RNA, 22 nt, Mycobacterium bovis subsp bovis AF2122/97
gguucaucaagguguugcggug

SEQ ID NO: 1145346 - RNA, 21 nt, Mycobacterium bovis subsp bovis AF2122/97
gguucagccugagcacguuca

SEQ ID NO: 1145347 - RNA, 23 nt, Mycobacterium bovis subsp bovis AF2122/97
gguuccaagggaauucccgcagg

SEQ ID NO: 1145348 - RNA, 17 nt, Mycobacterium bovis subsp bovis AF2122/97
gguuccagcggcaccgc

SEQ ID NO: 1145349 - RNA, 18 nt, Mycobacterium bovis subsp bovis AF2122/97
gguucaugaacaucggcc

SEQ ID NO: 1145350 - RNA, 15 nt, Mycobacterium bovis subsp bovis AF2122/97
gguuagccgcggccc

SEQ ID NO: 1145351 - RNA, 15 nt, Mycobacterium bovis subsp bovis AF2122/97
gguucaaagcagcgc

SEQ ID NO: 1145352 - RNA, 20 nt, Mycobacterium bovis subsp bovis AF2122/97
gguucaaccggacgaccgga

SEQ ID NO: 1145353 - RNA, 16 nt, Mycobacterium bovis subsp bovis AF2122/97
gguucgucagguccgg

SEQ ID NO: 1145354 - RNA, 23 nt, Mycobacterium bovis subsp bovis AF2122/97
gguucgucgaacggaucucggug

SEQ ID NO: 1145355 - RNA, 15 nt, Mycobacterium bovis subsp bovis AF2122/97
gguucgugcacggcg

SEQ ID NO: 1145356 - RNA, 16 nt, Mycobacterium bovis subsp bovis AF2122/97
gguucggugaucgggc

SEQ ID NO: 1145357 - RNA, 19 nt, Mycobacterium bovis subsp bovis AF2122/97
gguucggcgucgacccaga

SEQ ID NO: 1145358 - RNA, 17 nt, Mycobacterium bovis subsp bovis AF2122/97
gguucggccggagccgc

SEQ ID NO: 1145359 - RNA, 13 nt, Mycobacterium bovis subsp bovis AF2122/97
gguucggcgucga

SEQ ID NO: 1145360 - RNA, 22 nt, Mycobacterium bovis subsp bovis AF2122/97
gguuccggcuucguccaccgcg

SEQ ID NO: 1145361 - RNA, 23 nt, Mycobacterium bovis subsp bovis AF2122/97
gguuccgcaaugaccuggccgcc

SEQ ID NO: 1145362 - RNA, 14 nt, Mycobacterium bovis subsp bovis AF2122/97
gguuccgcugucga

SEQ ID NO: 1145363 - RNA, 15 nt, Mycobacterium bovis subsp bovis AF2122/97
gguucccgacaucgu

SEQ ID NO: 1145364 - RNA, 19 nt, Mycobacterium bovis subsp bovis AF2122/97
gguucccuuguucccgaaa

SEQ ID NO: 1145365 - RNA, 20 nt, Mycobacterium bovis subsp bovis AF2122/97
gguucgaacgcgaucgaccu

SEQ ID NO: 1145366 - RNA, 17 nt, Mycobacterium bovis subsp bovis AF2122/97
gguucgaaucccaucgg

SEQ ID NO: 1145367 - RNA, 13 nt, Mycobacterium bovis subsp bovis AF2122/97
gguucgaggguga

SEQ ID NO: 1145368 - RNA, 15 nt, Mycobacterium bovis subsp bovis AF2122/97
gguucgagggugacc

SEQ ID NO: 1145369 - RNA, 14 nt, Mycobacterium bovis subsp bovis AF2122/97
ggugugcaucgccg

SEQ ID NO: 1145370 - RNA, 14 nt, Mycobacterium bovis subsp bovis AF2122/97
ggugugacgauccc

SEQ ID NO: 1145371 - RNA, 17 nt, Mycobacterium bovis subsp bovis AF2122/97
ggugugcugccaccggc

SEQ ID NO: 1145372 - RNA, 22 nt, Mycobacterium bovis subsp bovis AF2122/97
gguguggaauacgcugcugguc

SEQ ID NO: 1145373 - RNA, 15 nt, Mycobacterium bovis subsp bovis AF2122/97
ggugugcgacgacgg

SEQ ID NO: 1145374 - RNA, 16 nt, Mycobacterium bovis subsp bovis AF2122/97
ggugugcugccaccgg

SEQ ID NO: 1145375 - RNA, 16 nt, Mycobacterium bovis subsp bovis AF2122/97
ggugugcgggcggugc

SEQ ID NO: 1145376 - RNA, 14 nt, Mycobacterium bovis subsp bovis AF2122/97
ggugugcucgccga

SEQ ID NO: 1145377 - RNA, 16 nt, Mycobacterium bovis subsp bovis AF2122/97
ggugugcucgccgacc

SEQ ID NO: 1145378 - RNA, 21 nt, Mycobacterium bovis subsp bovis AF2122/97
ggugugcucgccgaccagcuu

SEQ ID NO: 1145379 - RNA, 13 nt, Mycobacterium bovis subsp bovis AF2122/97
gguguggucacca

SEQ ID NO: 1145380 - RNA, 15 nt, Mycobacterium bovis subsp bovis AF2122/97
gguguggucaccagg

SEQ ID NO: 1145381 - RNA, 19 nt, Mycobacterium bovis subsp bovis AF2122/97
gguguguauucgccgacgu

SEQ ID NO: 1145382 - RNA, 13 nt, Mycobacterium bovis subsp bovis AF2122/97
ggugugucccggg

SEQ ID NO: 1145383 - RNA, 13 nt, Mycobacterium bovis subsp bovis AF2122/97
gguguggccgugg

SEQ ID NO: 1145384 - RNA, 17 nt, Mycobacterium bovis subsp bovis AF2122/97
gguguggccucgucccg

SEQ ID NO: 1145385 - RNA, 21 nt, Mycobacterium bovis subsp bovis AF2122/97
gguguggccuugcgucaucgg

SEQ ID NO: 1145386 - RNA, 14 nt, Mycobacterium bovis subsp bovis AF2122/97
gguguggucggugg

SEQ ID NO: 1145387 - RNA, 15 nt, Mycobacterium bovis subsp bovis AF2122/97
gguguguucggcccg

SEQ ID NO: 1145388 - RNA, 16 nt, Mycobacterium bovis subsp bovis AF2122/97
gguguuaaugaccgcg

SEQ ID NO: 1145389 - RNA, 20 nt, Mycobacterium bovis subsp bovis AF2122/97
gguguuauugaugcccgacu

SEQ ID NO: 1145390 - RNA, 22 nt, Mycobacterium bovis subsp bovis AF2122/97
gguguuauugaugcccgacuga

SEQ ID NO: 1145391 - RNA, 17 nt, Mycobacterium bovis subsp bovis AF2122/97
gguguucgggucgauca

SEQ ID NO: 1145392 - RNA, 21 nt, Mycobacterium bovis subsp bovis AF2122/97
gguguucgggucgaucaccga

SEQ ID NO: 1145393 - RNA, 17 nt, Mycobacterium bovis subsp bovis AF2122/97
gguguucgggcagcugg

SEQ ID NO: 1145394 - RNA, 14 nt, Mycobacterium bovis subsp bovis AF2122/97
gguguugccggaga

SEQ ID NO: 1145395 - RNA, 20 nt, Mycobacterium bovis subsp bovis AF2122/97
gguguugagcgaacccgcgu

SEQ ID NO: 1145396 - RNA, 16 nt, Mycobacterium bovis subsp bovis AF2122/97
gguguugacgauccgg

SEQ ID NO: 1145397 - RNA, 17 nt, Mycobacterium bovis subsp bovis AF2122/97
gguguugagaucgcccg

SEQ ID NO: 1145398 - RNA, 18 nt, Mycobacterium bovis subsp bovis AF2122/97
gguguugucgucgagcgc

SEQ ID NO: 1145399 - RNA, 19 nt, Mycobacterium bovis subsp bovis AF2122/97
gguguugucgucgagcgcg

SEQ ID NO: 1145400 - RNA, 20 nt, Mycobacterium bovis subsp bovis AF2122/97
gguguuggaagucccgccgu

SEQ ID NO: 1145401 - RNA, 15 nt, Mycobacterium bovis subsp bovis AF2122/97
gguguuggugcgggg

SEQ ID NO: 1145402 - RNA, 22 nt, Mycobacterium bovis subsp bovis AF2122/97
gguguuuccgaaacccgccgcg

SEQ ID NO: 1145403 - RNA, 17 nt, Mycobacterium bovis subsp bovis AF2122/97
gguguuugucgcggugg

SEQ ID NO: 1145404 - RNA, 18 nt, Mycobacterium bovis subsp bovis AF2122/97
gguuacaacuggacgggg

SEQ ID NO: 1145405 - RNA, 19 nt, Mycobacterium bovis subsp bovis AF2122/97
gguugcgccaggaaccgca

SEQ ID NO: 1145406 - RNA, 12 nt, Mycobacterium bovis subsp bovis AF2122/97
gguugcgacgaa

SEQ ID NO: 1145407 - RNA, 21 nt, Mycobacterium bovis subsp bovis AF2122/97
gguugcgacgugaccggcaau

SEQ ID NO: 1145408 - RNA, 18 nt, Mycobacterium bovis subsp bovis AF2122/97
gguugccuuugcggcggg

SEQ ID NO: 1145409 - RNA, 15 nt, Mycobacterium bovis subsp bovis AF2122/97
gguugccccggcgac

SEQ ID NO: 1145410 - RNA, 21 nt, Mycobacterium bovis subsp bovis AF2122/97
gguugccccggcgacccgguc

SEQ ID NO: 1145411 - RNA, 23 nt, Mycobacterium bovis subsp bovis AF2122/97
gguugcccgagcggcugagccgc

SEQ ID NO: 1145412 - RNA, 21 nt, Mycobacterium bovis subsp bovis AF2122/97
gguugccgaucucgcccagcg

SEQ ID NO: 1145413 - RNA, 18 nt, Mycobacterium bovis subsp bovis AF2122/97
gguugagauggucaccgg

SEQ ID NO: 1145414 - RNA, 12 nt, Mycobacterium bovis subsp bovis AF2122/97
gguugaucgcgc

SEQ ID NO: 1145415 - RNA, 12 nt, Mycobacterium bovis subsp bovis AF2122/97
gguugaucggcc

SEQ ID NO: 1145416 - RNA, 17 nt, Mycobacterium bovis subsp bovis AF2122/97
gguugaucugucagcgc

SEQ ID NO: 1145417 - RNA, 18 nt, Mycobacterium bovis subsp bovis AF2122/97
gguugaugacggcgucga

SEQ ID NO: 1145418 - RNA, 15 nt, Mycobacterium bovis subsp bovis AF2122/97
gguugcauaccgccg

SEQ ID NO: 1145419 - RNA, 22 nt, Mycobacterium bovis subsp bovis AF2122/97
gguugaccguggucggaggugg

SEQ ID NO: 1145420 - RNA, 18 nt, Mycobacterium bovis subsp bovis AF2122/97
gguugacccggcagcccg

SEQ ID NO: 1145421 - RNA, 16 nt, Mycobacterium bovis subsp bovis AF2122/97
gguugacccccgggua

SEQ ID NO: 1145422 - RNA, 13 nt, Mycobacterium bovis subsp bovis AF2122/97
gguugagccgccg

SEQ ID NO: 1145423 - RNA, 18 nt, Mycobacterium bovis subsp bovis AF2122/97
gguugacgccgguccccg

SEQ ID NO: 1145424 - RNA, 24 nt, Mycobacterium bovis subsp bovis AF2122/97
gguugacggcgaagucgagugccg

SEQ ID NO: 1145425 - RNA, 15 nt, Mycobacterium bovis subsp bovis AF2122/97
gguugacgggcucgg

SEQ ID NO: 1145426 - RNA, 18 nt, Mycobacterium bovis subsp bovis AF2122/97
gguugaggaucccggccg

SEQ ID NO: 1145427 - RNA, 18 nt, Mycobacterium bovis subsp bovis AF2122/97
gguugaggucacccggua

SEQ ID NO: 1145428 - RNA, 15 nt, Mycobacterium bovis subsp bovis AF2122/97
gguucugggccugcg

SEQ ID NO: 1145429 - RNA, 19 nt, Mycobacterium bovis subsp bovis AF2122/97
gguucugcgcccacccgcg

SEQ ID NO: 1145430 - RNA, 21 nt, Mycobacterium bovis subsp bovis AF2122/97
gguucuucaacuccgggaccg

SEQ ID NO: 1145431 - RNA, 19 nt, Mycobacterium bovis subsp bovis AF2122/97
gguucuucuccaccaccgu

SEQ ID NO: 1145432 - RNA, 15 nt, Mycobacterium bovis subsp bovis AF2122/97
gguucuugaccagca

SEQ ID NO: 1145433 - RNA, 17 nt, Mycobacterium bovis subsp bovis AF2122/97
gguugaacuggcggugc

SEQ ID NO: 1145434 - RNA, 17 nt, Mycobacterium bovis subsp bovis AF2122/97
gguugaaguugggaagu

SEQ ID NO: 1145435 - RNA, 17 nt, Mycobacterium bovis subsp bovis AF2122/97
gguugaacauguccagu

SEQ ID NO: 1145436 - RNA, 17 nt, Mycobacterium bovis subsp bovis AF2122/97
gguugcugugucguggu

SEQ ID NO: 1145437 - RNA, 21 nt, Mycobacterium bovis subsp bovis AF2122/97
gguuggcaagcacggcgucga

SEQ ID NO: 1145438 - RNA, 23 nt, Mycobacterium bovis subsp bovis AF2122/97
gguuggcacgcaacaccgccaac

SEQ ID NO: 1145439 - RNA, 21 nt, Mycobacterium bovis subsp bovis AF2122/97
gguugcgcgguagcucgucga

SEQ ID NO: 1145440 - RNA, 18 nt, Mycobacterium bovis subsp bovis AF2122/97
gguugcucgagcgguggc

SEQ ID NO: 1145441 - RNA, 23 nt, Mycobacterium bovis subsp bovis AF2122/97
gguugcucgagcgguggcgucgu

SEQ ID NO: 1145442 - RNA, 16 nt, Mycobacterium bovis subsp bovis AF2122/97
gguugcucgcgaucgc

SEQ ID NO: 1145443 - RNA, 13 nt, Mycobacterium bovis subsp bovis AF2122/97
gguugcugcgcga

SEQ ID NO: 1145444 - RNA, 19 nt, Mycobacterium bovis subsp bovis AF2122/97
gguuggccguggucgaggu

SEQ ID NO: 1145445 - RNA, 20 nt, Mycobacterium bovis subsp bovis AF2122/97
gguuggccguggucgaggug

SEQ ID NO: 1145446 - RNA, 11 nt, Mycobacterium bovis subsp bovis AF2122/97
gguuggccagu

SEQ ID NO: 1145447 - RNA, 13 nt, Mycobacterium bovis subsp bovis AF2122/97
gguuggccaccag

SEQ ID NO: 1145448 - RNA, 14 nt, Mycobacterium bovis subsp bovis AF2122/97
gguuggccaccagc

SEQ ID NO: 1145449 - RNA, 15 nt, Mycobacterium bovis subsp bovis AF2122/97
gguuggccaccagcu

SEQ ID NO: 1145450 - RNA, 15 nt, Mycobacterium bovis subsp bovis AF2122/97
gguuggcggcgaugg

SEQ ID NO: 1145451 - RNA, 14 nt, Mycobacterium bovis subsp bovis AF2122/97
gguuggucccgaug

SEQ ID NO: 1145452 - RNA, 21 nt, Mycobacterium bovis subsp bovis AF2122/97
gguuggcucggcgcagcacau

SEQ ID NO: 1145453 - RNA, 15 nt, Mycobacterium bovis subsp bovis AF2122/97
gguugggguggcggu

SEQ ID NO: 1145454 - RNA, 15 nt, Mycobacterium bovis subsp bovis AF2122/97
gguuggcucggcgca

SEQ ID NO: 1145455 - RNA, 16 nt, Mycobacterium bovis subsp bovis AF2122/97
gguugguuggcucgcu

SEQ ID NO: 1145456 - RNA, 19 nt, Mycobacterium bovis subsp bovis AF2122/97
gguuguagacggcaccccc

SEQ ID NO: 1145457 - RNA, 15 nt, Mycobacterium bovis subsp bovis AF2122/97
gguuggucgucgcgu

SEQ ID NO: 1145458 - RNA, 16 nt, Mycobacterium bovis subsp bovis AF2122/97
gguuggucgucgcgug

SEQ ID NO: 1145459 - RNA, 21 nt, Mycobacterium bovis subsp bovis AF2122/97
gguuggugacguagauguugc

SEQ ID NO: 1145460 - RNA, 19 nt, Mycobacterium bovis subsp bovis AF2122/97
gguuggugauugcggccgc

SEQ ID NO: 1145461 - RNA, 17 nt, Mycobacterium bovis subsp bovis AF2122/97
gguugucggcgaccccg

SEQ ID NO: 1145462 - RNA, 13 nt, Mycobacterium bovis subsp bovis AF2122/97
gguugucggcgau

SEQ ID NO: 1145463 - RNA, 23 nt, Mycobacterium bovis subsp bovis AF2122/97
gguuguucaacucgggcagcuuc

SEQ ID NO: 1145464 - RNA, 19 nt, Mycobacterium bovis subsp bovis AF2122/97
gguggccucauccaccgau

SEQ ID NO: 1145465 - RNA, 17 nt, Mycobacterium bovis subsp bovis AF2122/97
gguggccucccacggcg

SEQ ID NO: 1145466 - RNA, 18 nt, Mycobacterium bovis subsp bovis AF2122/97
gguggccucccacggcgc

SEQ ID NO: 1145467 - RNA, 12 nt, Mycobacterium bovis subsp bovis AF2122/97
gguggccgucgc

SEQ ID NO: 1145468 - RNA, 14 nt, Mycobacterium bovis subsp bovis AF2122/97
gguggccgucgccg

SEQ ID NO: 1145469 - RNA, 21 nt, Mycobacterium bovis subsp bovis AF2122/97
gguggccggggugccggcgau

SEQ ID NO: 1145470 - RNA, 21 nt, Mycobacterium bovis subsp bovis AF2122/97
gguggccgggucgaucaccga

SEQ ID NO: 1145471 - RNA, 12 nt, Mycobacterium bovis subsp bovis AF2122/97
gguggccgccac

SEQ ID NO: 1145472 - RNA, 17 nt, Mycobacterium bovis subsp bovis AF2122/97
gguggacgaggcggucg

SEQ ID NO: 1145473 - RNA, 19 nt, Mycobacterium bovis subsp bovis AF2122/97
gguggacgcagagucaacg

SEQ ID NO: 1145474 - RNA, 20 nt, Mycobacterium bovis subsp bovis AF2122/97
gguggccggcaacggcgcgc

SEQ ID NO: 1145475 - RNA, 22 nt, Mycobacterium bovis subsp bovis AF2122/97
gguggccggcaacggcgcgccg

SEQ ID NO: 1145476 - RNA, 13 nt, Mycobacterium bovis subsp bovis AF2122/97
gguggccgcugcc

SEQ ID NO: 1145477 - RNA, 17 nt, Mycobacterium bovis subsp bovis AF2122/97
gguggcgaucaucggcc

SEQ ID NO: 1145478 - RNA, 17 nt, Mycobacterium bovis subsp bovis AF2122/97
gguggcgauccacaggc

SEQ ID NO: 1145479 - RNA, 14 nt, Mycobacterium bovis subsp bovis AF2122/97
gguggcgccaacgc

SEQ ID NO: 1145480 - RNA, 21 nt, Mycobacterium bovis subsp bovis AF2122/97
gguggcgccauccccgccggc

SEQ ID NO: 1145481 - RNA, 23 nt, Mycobacterium bovis subsp bovis AF2122/97
gguggcgccauccccgccggcgc

SEQ ID NO: 1145482 - RNA, 11 nt, Mycobacterium bovis subsp bovis AF2122/97
gguggcggcag

SEQ ID NO: 1145483 - RNA, 16 nt, Mycobacterium bovis subsp bovis AF2122/97
gguggcggcagcagcg

SEQ ID NO: 1145484 - RNA, 18 nt, Mycobacterium bovis subsp bovis AF2122/97
gguggcggcggcggcaac

SEQ ID NO: 1145485 - RNA, 20 nt, Mycobacterium bovis subsp bovis AF2122/97
gguggcguggcccucggcga

SEQ ID NO: 1145486 - RNA, 21 nt, Mycobacterium bovis subsp bovis AF2122/97
gguggcguggcccucggcgau

SEQ ID NO: 1145487 - RNA, 23 nt, Mycobacterium bovis subsp bovis AF2122/97
gguggcguaauugucgauguccg

SEQ ID NO: 1145488 - RNA, 16 nt, Mycobacterium bovis subsp bovis AF2122/97
gguggcgggcuugccg

SEQ ID NO: 1145489 - RNA, 11 nt, Mycobacterium bovis subsp bovis AF2122/97
gguggcgccgu

SEQ ID NO: 1145490 - RNA, 14 nt, Mycobacterium bovis subsp bovis AF2122/97
gguggcgccgucgg

SEQ ID NO: 1145491 - RNA, 19 nt, Mycobacterium bovis subsp bovis AF2122/97
gguggcgcggacccgccgu

SEQ ID NO: 1145492 - RNA, 18 nt, Mycobacterium bovis subsp bovis AF2122/97
gguggcgcgggccggcga

SEQ ID NO: 1145493 - RNA, 18 nt, Mycobacterium bovis subsp bovis AF2122/97
gguggcgcggggccgccg

SEQ ID NO: 1145494 - RNA, 13 nt, Mycobacterium bovis subsp bovis AF2122/97
gguggcgcggugc

SEQ ID NO: 1145495 - RNA, 15 nt, Mycobacterium bovis subsp bovis AF2122/97
gguggcgcggugccg

SEQ ID NO: 1145496 - RNA, 11 nt, Mycobacterium bovis subsp bovis AF2122/97
gguggcgccgg

SEQ ID NO: 1145497 - RNA, 14 nt, Mycobacterium bovis subsp bovis AF2122/97
gguggcgccggccg

SEQ ID NO: 1145498 - RNA, 15 nt, Mycobacterium bovis subsp bovis AF2122/97
gguggaaaaagcccg

SEQ ID NO: 1145499 - RNA, 20 nt, Mycobacterium bovis subsp bovis AF2122/97
gguggaaaagccacggcugc

SEQ ID NO: 1145500 - RNA, 14 nt, Mycobacterium bovis subsp bovis AF2122/97
gguggacgaccgcg

SEQ ID NO: 1145501 - RNA, 16 nt, Mycobacterium bovis subsp bovis AF2122/97
gguggacgaccgcgcg

SEQ ID NO: 1145502 - RNA, 12 nt, Mycobacterium bovis subsp bovis AF2122/97
gguggacccggc

SEQ ID NO: 1145503 - RNA, 15 nt, Mycobacterium bovis subsp bovis AF2122/97
gguggacccggcggu

SEQ ID NO: 1145504 - RNA, 15 nt, Mycobacterium bovis subsp bovis AF2122/97
gguggaccgccgauc

SEQ ID NO: 1145505 - RNA, 12 nt, Mycobacterium bovis subsp bovis AF2122/97
ggugcugcgcgg

SEQ ID NO: 1145506 - RNA, 15 nt, Mycobacterium bovis subsp bovis AF2122/97
ggugcugcggcgucc

SEQ ID NO: 1145507 - RNA, 17 nt, Mycobacterium bovis subsp bovis AF2122/97
ggugcugguggcggcac

SEQ ID NO: 1145508 - RNA, 17 nt, Mycobacterium bovis subsp bovis AF2122/97
ggugcugguauagccgg

SEQ ID NO: 1145509 - RNA, 23 nt, Mycobacterium bovis subsp bovis AF2122/97
ggugcuggucaacagcggcaaga

SEQ ID NO: 1145510 - RNA, 14 nt, Mycobacterium bovis subsp bovis AF2122/97
ggugcuugucgccg

SEQ ID NO: 1145511 - RNA, 14 nt, Mycobacterium bovis subsp bovis AF2122/97
ggugcuuccacacg

SEQ ID NO: 1145512 - RNA, 11 nt, Mycobacterium bovis subsp bovis AF2122/97
ggugaugguga

SEQ ID NO: 1145513 - RNA, 15 nt, Mycobacterium bovis subsp bovis AF2122/97
ggugauggccgacgu

SEQ ID NO: 1145514 - RNA, 11 nt, Mycobacterium bovis subsp bovis AF2122/97
ggugauggugc

SEQ ID NO: 1145515 - RNA, 17 nt, Mycobacterium bovis subsp bovis AF2122/97
ggugcucggucgaugcu

SEQ ID NO: 1145516 - RNA, 20 nt, Mycobacterium bovis subsp bovis AF2122/97
ggugcucgucggugucgguu

SEQ ID NO: 1145517 - RNA, 21 nt, Mycobacterium bovis subsp bovis AF2122/97
ggugcugaucgguccggcgaa

SEQ ID NO: 1145518 - RNA, 22 nt, Mycobacterium bovis subsp bovis AF2122/97
ggugcugacauuuccaccacgc

SEQ ID NO: 1145519 - RNA, 22 nt, Mycobacterium bovis subsp bovis AF2122/97
ggugcucuucggcaccaccgcg

SEQ ID NO: 1145520 - RNA, 18 nt, Mycobacterium bovis subsp bovis AF2122/97
ggugauguagggcugcuc

SEQ ID NO: 1145521 - RNA, 20 nt, Mycobacterium bovis subsp bovis AF2122/97
ggugaugggcaugguggugg

SEQ ID NO: 1145522 - RNA, 18 nt, Mycobacterium bovis subsp bovis AF2122/97
ggugaugguaccgccacu

SEQ ID NO: 1145523 - RNA, 22 nt, Mycobacterium bovis subsp bovis AF2122/97
ggugaugguaccgccacuggcg

SEQ ID NO: 1145524 - RNA, 18 nt, Mycobacterium bovis subsp bovis AF2122/97
ggugaugagucaggcgcc

SEQ ID NO: 1145525 - RNA, 20 nt, Mycobacterium bovis subsp bovis AF2122/97
ggugaugagucaggcgccgc

SEQ ID NO: 1145526 - RNA, 21 nt, Mycobacterium bovis subsp bovis AF2122/97
ggugaugagcgcuucgaggug

SEQ ID NO: 1145527 - RNA, 18 nt, Mycobacterium bovis subsp bovis AF2122/97
ggugaugacgccgucggc

SEQ ID NO: 1145528 - RNA, 22 nt, Mycobacterium bovis subsp bovis AF2122/97
gguguacauaucgaagcucgcg

SEQ ID NO: 1145529 - RNA, 20 nt, Mycobacterium bovis subsp bovis AF2122/97
gguguagaagcgggcgucgc

SEQ ID NO: 1145530 - RNA, 23 nt, Mycobacterium bovis subsp bovis AF2122/97
ggugucacgcccaugaccggccg

SEQ ID NO: 1145531 - RNA, 17 nt, Mycobacterium bovis subsp bovis AF2122/97
ggugucagccaccggug

SEQ ID NO: 1145532 - RNA, 14 nt, Mycobacterium bovis subsp bovis AF2122/97
ggugucaacgcgcg

SEQ ID NO: 1145533 - RNA, 18 nt, Mycobacterium bovis subsp bovis AF2122/97
gguguagagcgcaccgcg

SEQ ID NO: 1145534 - RNA, 13 nt, Mycobacterium bovis subsp bovis AF2122/97
gguguagcagcgc

SEQ ID NO: 1145535 - RNA, 21 nt, Mycobacterium bovis subsp bovis AF2122/97
gguguagcccagccgggugga

SEQ ID NO: 1145536 - RNA, 20 nt, Mycobacterium bovis subsp bovis AF2122/97
ggugguuucacuacgggucu

SEQ ID NO: 1145537 - RNA, 18 nt, Mycobacterium bovis subsp bovis AF2122/97
ggugguuuucccgucgcc

SEQ ID NO: 1145538 - RNA, 13 nt, Mycobacterium bovis subsp bovis AF2122/97
ggugguggcggug

SEQ ID NO: 1145539 - RNA, 13 nt, Mycobacterium bovis subsp bovis AF2122/97
ggugguggcgucg

SEQ ID NO: 1145540 - RNA, 14 nt, Mycobacterium bovis subsp bovis AF2122/97
gguggugucgcucg

SEQ ID NO: 1145541 - RNA, 13 nt, Mycobacterium bovis subsp bovis AF2122/97
gguggugucgcuc

SEQ ID NO: 1145542 - RNA, 17 nt, Mycobacterium bovis subsp bovis AF2122/97
gguguaauugccgacgc

SEQ ID NO: 1145543 - RNA, 14 nt, Mycobacterium bovis subsp bovis AF2122/97
ggugguuccgcgcg

SEQ ID NO: 1145544 - RNA, 18 nt, Mycobacterium bovis subsp bovis AF2122/97
ggugguuccggcuggugg

SEQ ID NO: 1145545 - RNA, 13 nt, Mycobacterium bovis subsp bovis AF2122/97
ggugucgacgcgg

SEQ ID NO: 1145546 - RNA, 14 nt, Mycobacterium bovis subsp bovis AF2122/97
gguguccuuggccg

SEQ ID NO: 1145547 - RNA, 16 nt, Mycobacterium bovis subsp bovis AF2122/97
gguguccaccaccggc

SEQ ID NO: 1145548 - RNA, 17 nt, Mycobacterium bovis subsp bovis AF2122/97
gguguccaccaccggca

SEQ ID NO: 1145549 - RNA, 14 nt, Mycobacterium bovis subsp bovis AF2122/97
gguguccucgucga

SEQ ID NO: 1145550 - RNA, 19 nt, Mycobacterium bovis subsp bovis AF2122/97
ggugucaugaacgaccgga

SEQ ID NO: 1145551 - RNA, 13 nt, Mycobacterium bovis subsp bovis AF2122/97
ggugucgcugcug

SEQ ID NO: 1145552 - RNA, 17 nt, Mycobacterium bovis subsp bovis AF2122/97
ggugucggaaugggcgc

SEQ ID NO: 1145553 - RNA, 17 nt, Mycobacterium bovis subsp bovis AF2122/97
ggugucgaucguugccg

SEQ ID NO: 1145554 - RNA, 17 nt, Mycobacterium bovis subsp bovis AF2122/97
ggugucgaugcgcagcc

SEQ ID NO: 1145555 - RNA, 17 nt, Mycobacterium bovis subsp bovis AF2122/97
ggugucgcgcucagccg

SEQ ID NO: 1145556 - RNA, 14 nt, Mycobacterium bovis subsp bovis AF2122/97
ggugucggcgccga

SEQ ID NO: 1145557 - RNA, 21 nt, Mycobacterium bovis subsp bovis AF2122/97
ggugucggcgagagggcgggg

SEQ ID NO: 1145558 - RNA, 13 nt, Mycobacterium bovis subsp bovis AF2122/97
ggugucggcgugg

SEQ ID NO: 1145559 - RNA, 15 nt, Mycobacterium bovis subsp bovis AF2122/97
ggugucggcucgagu

SEQ ID NO: 1145560 - RNA, 17 nt, Mycobacterium bovis subsp bovis AF2122/97
ggugucgucaucggggc

SEQ ID NO: 1145561 - RNA, 17 nt, Mycobacterium bovis subsp bovis AF2122/97
ggugucggugucgacgu

SEQ ID NO: 1145562 - RNA, 16 nt, Mycobacterium bovis subsp bovis AF2122/97
ggugucggcuggucgc

SEQ ID NO: 1145563 - RNA, 18 nt, Mycobacterium bovis subsp bovis AF2122/97
ggugucggugcgcggcaa

SEQ ID NO: 1145564 - RNA, 16 nt, Mycobacterium bovis subsp bovis AF2122/97
ggugucuugggcgucc

SEQ ID NO: 1145565 - RNA, 16 nt, Mycobacterium bovis subsp bovis AF2122/97
ggugucucuaccacgg

SEQ ID NO: 1145566 - RNA, 21 nt, Mycobacterium bovis subsp bovis AF2122/97
ggugguagcggacagcucgcg

SEQ ID NO: 1145567 - RNA, 14 nt, Mycobacterium bovis subsp bovis AF2122/97
ggugguagcggcgg

SEQ ID NO: 1145568 - RNA, 22 nt, Mycobacterium bovis subsp bovis AF2122/97
gguggucaguccgacaccggcg

SEQ ID NO: 1145569 - RNA, 17 nt, Mycobacterium bovis subsp bovis AF2122/97
gguggucaguccgucgg

SEQ ID NO: 1145570 - RNA, 14 nt, Mycobacterium bovis subsp bovis AF2122/97
ggugguaccggcgc

SEQ ID NO: 1145571 - RNA, 23 nt, Mycobacterium bovis subsp bovis AF2122/97
ggugggucggggcggcauuggcg

SEQ ID NO: 1145572 - RNA, 13 nt, Mycobacterium bovis subsp bovis AF2122/97
ggugggucggcuu

SEQ ID NO: 1145573 - RNA, 18 nt, Mycobacterium bovis subsp bovis AF2122/97
gguggucuuggcccggcg

SEQ ID NO: 1145574 - RNA, 21 nt, Mycobacterium bovis subsp bovis AF2122/97
gguggugcgcaaucgacacca

SEQ ID NO: 1145575 - RNA, 21 nt, Mycobacterium bovis subsp bovis AF2122/97
ggugguggccggggugccggc

SEQ ID NO: 1145576 - RNA, 22 nt, Mycobacterium bovis subsp bovis AF2122/97
gguggucugccaaaagggcggc

SEQ ID NO: 1145577 - RNA, 21 nt, Mycobacterium bovis subsp bovis AF2122/97
gguggucgggucgaucaccga

SEQ ID NO: 1145578 - RNA, 13 nt, Mycobacterium bovis subsp bovis AF2122/97
gguggucgucccg

SEQ ID NO: 1145579 - RNA, 16 nt, Mycobacterium bovis subsp bovis AF2122/97
gguggucgucccgaug

SEQ ID NO: 1145580 - RNA, 12 nt, Mycobacterium bovis subsp bovis AF2122/97
ggugguccuggc

SEQ ID NO: 1145581 - RNA, 16 nt, Mycobacterium bovis subsp bovis AF2122/97
gguggucgcaccgccg

SEQ ID NO: 1145582 - RNA, 20 nt, Mycobacterium bovis subsp bovis AF2122/97
gguggucgcgaccgaccgca

SEQ ID NO: 1145583 - RNA, 16 nt, Mycobacterium bovis subsp bovis AF2122/97
ggugggcacaccggug

SEQ ID NO: 1145584 - RNA, 14 nt, Mycobacterium bovis subsp bovis AF2122/97
ggugggagcagccg

SEQ ID NO: 1145585 - RNA, 12 nt, Mycobacterium bovis subsp bovis AF2122/97
gguggcugcugg

SEQ ID NO: 1145586 - RNA, 13 nt, Mycobacterium bovis subsp bovis AF2122/97
gguggcucgggug

SEQ ID NO: 1145587 - RNA, 19 nt, Mycobacterium bovis subsp bovis AF2122/97
gguggcucuguagcgucgc

SEQ ID NO: 1145588 - RNA, 20 nt, Mycobacterium bovis subsp bovis AF2122/97
gguggcugaucaccguugcg

SEQ ID NO: 1145589 - RNA, 16 nt, Mycobacterium bovis subsp bovis AF2122/97
gguggcuucaacccgg

SEQ ID NO: 1145590 - RNA, 21 nt, Mycobacterium bovis subsp bovis AF2122/97
gguggcuucaacccgggcagc

SEQ ID NO: 1145591 - RNA, 20 nt, Mycobacterium bovis subsp bovis AF2122/97
gguggcuuuugcgucugcuc

SEQ ID NO: 1145592 - RNA, 21 nt, Mycobacterium bovis subsp bovis AF2122/97
gguggcgguaccuagccgcag

SEQ ID NO: 1145593 - RNA, 16 nt, Mycobacterium bovis subsp bovis AF2122/97
gguggcgucaccgccg

SEQ ID NO: 1145594 - RNA, 22 nt, Mycobacterium bovis subsp bovis AF2122/97
ggugggcgccgcaaccgccgcg

SEQ ID NO: 1145595 - RNA, 19 nt, Mycobacterium bovis subsp bovis AF2122/97
ggugggcgcagagucaacg

SEQ ID NO: 1145596 - RNA, 21 nt, Mycobacterium bovis subsp bovis AF2122/97
ggugggcgugacgggcaggag

SEQ ID NO: 1145597 - RNA, 15 nt, Mycobacterium bovis subsp bovis AF2122/97
ggugggggcaucagg

SEQ ID NO: 1145598 - RNA, 14 nt, Mycobacterium bovis subsp bovis AF2122/97
gguggggccggcgg

SEQ ID NO: 1145599 - RNA, 17 nt, Mycobacterium bovis subsp bovis AF2122/97
gguggggccggcgucga

SEQ ID NO: 1145600 - RNA, 14 nt, Mycobacterium bovis subsp bovis AF2122/97
gguggggauggcgc

SEQ ID NO: 1145601 - RNA, 23 nt, Mycobacterium bovis subsp bovis AF2122/97
gguggggagcuauucggugucgc

SEQ ID NO: 1145602 - RNA, 14 nt, Mycobacterium bovis subsp bovis AF2122/97
guaggggugauccc

SEQ ID NO: 1145603 - RNA, 14 nt, Mycobacterium bovis subsp bovis AF2122/97
guagggcugcuccu

SEQ ID NO: 1145604 - RNA, 18 nt, Mycobacterium bovis subsp bovis AF2122/97
guagggcggcguugagcu

SEQ ID NO: 1145605 - RNA, 21 nt, Mycobacterium bovis subsp bovis AF2122/97
guagguccuugucggccccgg

SEQ ID NO: 1145606 - RNA, 15 nt, Mycobacterium bovis subsp bovis AF2122/97
guaggcggccagcgc

SEQ ID NO: 1145607 - RNA, 16 nt, Mycobacterium bovis subsp bovis AF2122/97
guaggcggcggcccgc

SEQ ID NO: 1145608 - RNA, 13 nt, Mycobacterium bovis subsp bovis AF2122/97
guaggcggugacc

SEQ ID NO: 1145609 - RNA, 14 nt, Mycobacterium bovis subsp bovis AF2122/97
guaggcggugaccc

SEQ ID NO: 1145610 - RNA, 12 nt, Mycobacterium bovis subsp bovis AF2122/97
guagggcaucgu

SEQ ID NO: 1145611 - RNA, 15 nt, Mycobacterium bovis subsp bovis AF2122/97
guagggcaucgucgc

SEQ ID NO: 1145612 - RNA, 14 nt, Mycobacterium bovis subsp bovis AF2122/97
guauccgacgucgg

SEQ ID NO: 1145613 - RNA, 23 nt, Mycobacterium bovis subsp bovis AF2122/97
guauccgacgucggugaccucgg

SEQ ID NO: 1145614 - RNA, 15 nt, Mycobacterium bovis subsp bovis AF2122/97
guaucccggucucgg

SEQ ID NO: 1145615 - RNA, 21 nt, Mycobacterium bovis subsp bovis AF2122/97
guaguucgaugacugaaucga

SEQ ID NO: 1145616 - RNA, 19 nt, Mycobacterium bovis subsp bovis AF2122/97
guauaccgagggucgggca

SEQ ID NO: 1145617 - RNA, 13 nt, Mycobacterium bovis subsp bovis AF2122/97
guauagccggcgc

SEQ ID NO: 1145618 - RNA, 22 nt, Mycobacterium bovis subsp bovis AF2122/97
guauagccgguugucgcagcgc

SEQ ID NO: 1145619 - RNA, 13 nt, Mycobacterium bovis subsp bovis AF2122/97
guaguucaccgcg

SEQ ID NO: 1145620 - RNA, 22 nt, Mycobacterium bovis subsp bovis AF2122/97
guaguucaccaacgcgggaacg

SEQ ID NO: 1145621 - RNA, 17 nt, Mycobacterium bovis subsp bovis AF2122/97
guaguuggcgaccugcg

SEQ ID NO: 1145622 - RNA, 17 nt, Mycobacterium bovis subsp bovis AF2122/97
guaguuggugaacaugu

SEQ ID NO: 1145623 - RNA, 14 nt, Mycobacterium bovis subsp bovis AF2122/97
guaguucgaugacu

SEQ ID NO: 1145624 - RNA, 15 nt, Mycobacterium bovis subsp bovis AF2122/97
guauaaacgcggcgc

SEQ ID NO: 1145625 - RNA, 21 nt, Mycobacterium bovis subsp bovis AF2122/97
guauaauucgagauaaccacc

SEQ ID NO: 1145626 - RNA, 13 nt, Mycobacterium bovis subsp bovis AF2122/97
guaggccgggccg

SEQ ID NO: 1145627 - RNA, 17 nt, Mycobacterium bovis subsp bovis AF2122/97
guaggccggggcgucgc

SEQ ID NO: 1145628 - RNA, 13 nt, Mycobacterium bovis subsp bovis AF2122/97
guaggccucggca

SEQ ID NO: 1145629 - RNA, 17 nt, Mycobacterium bovis subsp bovis AF2122/97
guagcguccgcgcccga

SEQ ID NO: 1145630 - RNA, 16 nt, Mycobacterium bovis subsp bovis AF2122/97
guaggcccagcaaccg

SEQ ID NO: 1145631 - RNA, 22 nt, Mycobacterium bovis subsp bovis AF2122/97
guaggcccagcaaccgcucggc

SEQ ID NO: 1145632 - RNA, 17 nt, Mycobacterium bovis subsp bovis AF2122/97
aagucccgaguggccgg

SEQ ID NO: 1145633 - RNA, 20 nt, Mycobacterium bovis subsp bovis AF2122/97
guaggccagcccggcgugca

SEQ ID NO: 1145634 - RNA, 19 nt, Mycobacterium bovis subsp bovis AF2122/97
guaggcaaccuuuggccgc

SEQ ID NO: 1145635 - RNA, 20 nt, Mycobacterium bovis subsp bovis AF2122/97
guagccgggaacgcugacgc

SEQ ID NO: 1145636 - RNA, 22 nt, Mycobacterium bovis subsp bovis AF2122/97
guagccgggaacgcugacgccc

SEQ ID NO: 1145637 - RNA, 13 nt, Mycobacterium bovis subsp bovis AF2122/97
guagccggcgaca

SEQ ID NO: 1145638 - RNA, 18 nt, Mycobacterium bovis subsp bovis AF2122/97
guagcggcccuucgacga

SEQ ID NO: 1145639 - RNA, 14 nt, Mycobacterium bovis subsp bovis AF2122/97
guagcggcgauacc

SEQ ID NO: 1145640 - RNA, 15 nt, Mycobacterium bovis subsp bovis AF2122/97
guagcggcgccgccc

SEQ ID NO: 1145641 - RNA, 21 nt, Mycobacterium bovis subsp bovis AF2122/97
guagcggcccuucgacgagga

SEQ ID NO: 1145642 - RNA, 20 nt, Mycobacterium bovis subsp bovis AF2122/97
guagcggccgcaggcgaaca

SEQ ID NO: 1145643 - RNA, 13 nt, Mycobacterium bovis subsp bovis AF2122/97
guagcggccggga

SEQ ID NO: 1145644 - RNA, 18 nt, Mycobacterium bovis subsp bovis AF2122/97
guagcgguccagcgucgc

SEQ ID NO: 1145645 - RNA, 13 nt, Mycobacterium bovis subsp bovis AF2122/97
guagcguucggcg

SEQ ID NO: 1145646 - RNA, 23 nt, Mycobacterium bovis subsp bovis AF2122/97
guagcguucgucguaguccaggc

SEQ ID NO: 1145647 - RNA, 20 nt, Mycobacterium bovis subsp bovis AF2122/97
guagcccaaaaacggcagca

SEQ ID NO: 1145648 - RNA, 17 nt, Mycobacterium bovis subsp bovis AF2122/97
guagcccaugccgaugc

SEQ ID NO: 1145649 - RNA, 22 nt, Mycobacterium bovis subsp bovis AF2122/97
guagccccgucgaccuccacca

SEQ ID NO: 1145650 - RNA, 16 nt, Mycobacterium bovis subsp bovis AF2122/97
guagcccggaccgccc

SEQ ID NO: 1145651 - RNA, 21 nt, Mycobacterium bovis subsp bovis AF2122/97
guagccgaaucccgcgaugcg

SEQ ID NO: 1145652 - RNA, 20 nt, Mycobacterium bovis subsp bovis AF2122/97
guagccgcuaggaucggaug

SEQ ID NO: 1145653 - RNA, 18 nt, Mycobacterium bovis subsp bovis AF2122/97
guagccgcggccacaaug

SEQ ID NO: 1145654 - RNA, 19 nt, Mycobacterium bovis subsp bovis AF2122/97
guagccgcugcacguggcc

SEQ ID NO: 1145655 - RNA, 14 nt, Mycobacterium bovis subsp bovis AF2122/97
guagccgccgucgc

SEQ ID NO: 1145656 - RNA, 23 nt, Mycobacterium bovis subsp bovis AF2122/97
guagccgaccaggaccaccgcau

SEQ ID NO: 1145657 - RNA, 14 nt, Mycobacterium bovis subsp bovis AF2122/97
guagccgccggcgc

SEQ ID NO: 1145658 - RNA, 15 nt, Mycobacterium bovis subsp bovis AF2122/97
guagccgccggcgcc

SEQ ID NO: 1145659 - RNA, 13 nt, Mycobacterium bovis subsp bovis AF2122/97
guagccgaggucg

SEQ ID NO: 1145660 - RNA, 15 nt, Mycobacterium bovis subsp bovis AF2122/97
guacuccaccgcgcc

SEQ ID NO: 1145661 - RNA, 18 nt, Mycobacterium bovis subsp bovis AF2122/97
guacucgcggcgcggccg

SEQ ID NO: 1145662 - RNA, 22 nt, Mycobacterium bovis subsp bovis AF2122/97
guacucgcggcgcggccgcagc

SEQ ID NO: 1145663 - RNA, 16 nt, Mycobacterium bovis subsp bovis AF2122/97
guacucccaggccgcc

SEQ ID NO: 1145664 - RNA, 20 nt, Mycobacterium bovis subsp bovis AF2122/97
guagacaccgcgaucaccac

SEQ ID NO: 1145665 - RNA, 13 nt, Mycobacterium bovis subsp bovis AF2122/97
guagacaccgcga

SEQ ID NO: 1145666 - RNA, 17 nt, Mycobacterium bovis subsp bovis AF2122/97
guagacaagucggcgcu

SEQ ID NO: 1145667 - RNA, 18 nt, Mycobacterium bovis subsp bovis AF2122/97
guagacaagucggcgcug

SEQ ID NO: 1145668 - RNA, 17 nt, Mycobacterium bovis subsp bovis AF2122/97
guagaaugcgccgucgg

SEQ ID NO: 1145669 - RNA, 16 nt, Mycobacterium bovis subsp bovis AF2122/97
guagaaguaggcggcg

SEQ ID NO: 1145670 - RNA, 22 nt, Mycobacterium bovis subsp bovis AF2122/97
guagaaguaggcggcgacgccg

SEQ ID NO: 1145671 - RNA, 22 nt, Mycobacterium bovis subsp bovis AF2122/97
guagaagauggcaccgcccccg

SEQ ID NO: 1145672 - RNA, 22 nt, Mycobacterium bovis subsp bovis AF2122/97
guagaaggaccgcucgucgccg

SEQ ID NO: 1145673 - RNA, 17 nt, Mycobacterium bovis subsp bovis AF2122/97
guagaacgcuagcgcca

SEQ ID NO: 1145674 - RNA, 16 nt, Mycobacterium bovis subsp bovis AF2122/97
guagaucagcgccugg

SEQ ID NO: 1145675 - RNA, 15 nt, Mycobacterium bovis subsp bovis AF2122/97
guagagggagcggcg

SEQ ID NO: 1145676 - RNA, 14 nt, Mycobacterium bovis subsp bovis AF2122/97
guagccagcgcgcu

SEQ ID NO: 1145677 - RNA, 16 nt, Mycobacterium bovis subsp bovis AF2122/97
guagccaggcgcgcua

SEQ ID NO: 1145678 - RNA, 21 nt, Mycobacterium bovis subsp bovis AF2122/97
guagccacgcccacaggggca

SEQ ID NO: 1145679 - RNA, 22 nt, Mycobacterium bovis subsp bovis AF2122/97
guagacgucguagacaccuucg

SEQ ID NO: 1145680 - RNA, 17 nt, Mycobacterium bovis subsp bovis AF2122/97
guagagcucaccgucga

SEQ ID NO: 1145681 - RNA, 21 nt, Mycobacterium bovis subsp bovis AF2122/97
guagacgucgaccgugucacc

SEQ ID NO: 1145682 - RNA, 19 nt, Mycobacterium bovis subsp bovis AF2122/97
guagagcaugccgcccgcg

SEQ ID NO: 1145683 - RNA, 15 nt, Mycobacterium bovis subsp bovis AF2122/97
guacuccagccgcaa

SEQ ID NO: 1145684 - RNA, 21 nt, Mycobacterium bovis subsp bovis AF2122/97
guacucagguggaagugcacc

SEQ ID NO: 1145685 - RNA, 21 nt, Mycobacterium bovis subsp bovis AF2122/97
guacuaacaacaccaccagca

SEQ ID NO: 1145686 - RNA, 14 nt, Mycobacterium bovis subsp bovis AF2122/97
guacggccaacauc

SEQ ID NO: 1145687 - RNA, 17 nt, Mycobacterium bovis subsp bovis AF2122/97
guacggaccguggcagc

SEQ ID NO: 1145688 - RNA, 14 nt, Mycobacterium bovis subsp bovis AF2122/97
guacggaccgucgc

SEQ ID NO: 1145689 - RNA, 20 nt, Mycobacterium bovis subsp bovis AF2122/97
guaccggucgacccacucau

SEQ ID NO: 1145690 - RNA, 23 nt, Mycobacterium bovis subsp bovis AF2122/97
guacgaucgugagacgccgucga

SEQ ID NO: 1145691 - RNA, 20 nt, Mycobacterium bovis subsp bovis AF2122/97
guacgccaggugcagcacca

SEQ ID NO: 1145692 - RNA, 23 nt, Mycobacterium bovis subsp bovis AF2122/97
guacgccaggugcagcaccagcc

SEQ ID NO: 1145693 - RNA, 17 nt, Mycobacterium bovis subsp bovis AF2122/97
guacgcgacgggccgcg

SEQ ID NO: 1145694 - RNA, 21 nt, Mycobacterium bovis subsp bovis AF2122/97
guacgccguaucggggcacca

SEQ ID NO: 1145695 - RNA, 13 nt, Mycobacterium bovis subsp bovis AF2122/97
guacgccgccgau

SEQ ID NO: 1145696 - RNA, 13 nt, Mycobacterium bovis subsp bovis AF2122/97
guacgccgcgccg

SEQ ID NO: 1145697 - RNA, 15 nt, Mycobacterium bovis subsp bovis AF2122/97
guacgccgcgccgaa

SEQ ID NO: 1145698 - RNA, 19 nt, Mycobacterium bovis subsp bovis AF2122/97
guacgccgcgccgaaucgc

SEQ ID NO: 1145699 - RNA, 20 nt, Mycobacterium bovis subsp bovis AF2122/97
guacgccgcgccgaaucgcg

SEQ ID NO: 1145700 - RNA, 16 nt, Mycobacterium bovis subsp bovis AF2122/97
guacgcgucggugacc

SEQ ID NO: 1145701 - RNA, 13 nt, Mycobacterium bovis subsp bovis AF2122/97
guaccaccggcac

SEQ ID NO: 1145702 - RNA, 15 nt, Mycobacterium bovis subsp bovis AF2122/97
guaccaccggcaccg

SEQ ID NO: 1145703 - RNA, 18 nt, Mycobacterium bovis subsp bovis AF2122/97
guaccaccggcaccggcc

SEQ ID NO: 1145704 - RNA, 15 nt, Mycobacterium bovis subsp bovis AF2122/97
guaccggaaucggcg

SEQ ID NO: 1145705 - RNA, 23 nt, Mycobacterium bovis subsp bovis AF2122/97
guaccgccacuggcgcugaucgc

SEQ ID NO: 1145706 - RNA, 21 nt, Mycobacterium bovis subsp bovis AF2122/97
guaccgccacuucccccgggu

SEQ ID NO: 1145707 - RNA, 17 nt, Mycobacterium bovis subsp bovis AF2122/97
guaccggaaucggcggc

SEQ ID NO: 1145708 - RNA, 18 nt, Mycobacterium bovis subsp bovis AF2122/97
guaccggaaucggcggcg

SEQ ID NO: 1145709 - RNA, 20 nt, Mycobacterium bovis subsp bovis AF2122/97
guaccggaaucggcggcgga

SEQ ID NO: 1145710 - RNA, 16 nt, Mycobacterium bovis subsp bovis AF2122/97
guaccggagcggugug

SEQ ID NO: 1145711 - RNA, 16 nt, Mycobacterium bovis subsp bovis AF2122/97
guaccggccagccgcg

SEQ ID NO: 1145712 - RNA, 20 nt, Mycobacterium bovis subsp bovis AF2122/97
guaccgggcgagucccggcg

SEQ ID NO: 1145713 - RNA, 19 nt, Mycobacterium bovis subsp bovis AF2122/97
guaccgggcgagucccggc

SEQ ID NO: 1145714 - RNA, 18 nt, Mycobacterium bovis subsp bovis AF2122/97
guaccggcuucgucggcc

SEQ ID NO: 1145715 - RNA, 23 nt, Mycobacterium bovis subsp bovis AF2122/97
guaccgcaaucauccgaucgccg

SEQ ID NO: 1145716 - RNA, 18 nt, Mycobacterium bovis subsp bovis AF2122/97
guaccagguggaccggcc

SEQ ID NO: 1145717 - RNA, 14 nt, Mycobacterium bovis subsp bovis AF2122/97
guaccgccacggcg

SEQ ID NO: 1145718 - RNA, 17 nt, Mycobacterium bovis subsp bovis AF2122/97
guaccagcccaccggcg

SEQ ID NO: 1145719 - RNA, 21 nt, Mycobacterium bovis subsp bovis AF2122/97
gguuucgaggcgaagcgguga

SEQ ID NO: 1145720 - RNA, 14 nt, Mycobacterium bovis subsp bovis AF2122/97
gguuucggggacca

SEQ ID NO: 1145721 - RNA, 21 nt, Mycobacterium bovis subsp bovis AF2122/97
gguuuccggccugcacggcgc

SEQ ID NO: 1145722 - RNA, 22 nt, Mycobacterium bovis subsp bovis AF2122/97
gguuucgaauguuucggcgaua

SEQ ID NO: 1145723 - RNA, 13 nt, Mycobacterium bovis subsp bovis AF2122/97
gguuugccggcgg

SEQ ID NO: 1145724 - RNA, 17 nt, Mycobacterium bovis subsp bovis AF2122/97
gguuugccggcgguggc

SEQ ID NO: 1145725 - RNA, 17 nt, Mycobacterium bovis subsp bovis AF2122/97
gguuugccggugcggug

SEQ ID NO: 1145726 - RNA, 18 nt, Mycobacterium bovis subsp bovis AF2122/97
guaaaccgauaucgcugc

SEQ ID NO: 1145727 - RNA, 22 nt, Mycobacterium bovis subsp bovis AF2122/97
guaaacaaacccaacaccagca

SEQ ID NO: 1145728 - RNA, 14 nt, Mycobacterium bovis subsp bovis AF2122/97
guaaacagcgcgcc

SEQ ID NO: 1145729 - RNA, 17 nt, Mycobacterium bovis subsp bovis AF2122/97
guaaacagcgcgccggc

SEQ ID NO: 1145730 - RNA, 18 nt, Mycobacterium bovis subsp bovis AF2122/97
guaacacccggccgccga

SEQ ID NO: 1145731 - RNA, 15 nt, Mycobacterium bovis subsp bovis AF2122/97
guaaccacgacgacg

SEQ ID NO: 1145732 - RNA, 22 nt, Mycobacterium bovis subsp bovis AF2122/97
guaaacgucggucggggauccg

SEQ ID NO: 1145733 - RNA, 22 nt, Mycobacterium bovis subsp bovis AF2122/97
guaaacgaggucgccgcaacau

SEQ ID NO: 1145734 - RNA, 22 nt, Mycobacterium bovis subsp bovis AF2122/97
guaaagaucuugucgcguucgg

SEQ ID NO: 1145735 - RNA, 16 nt, Mycobacterium bovis subsp bovis AF2122/97
guaaccgcgucgaccg

SEQ ID NO: 1145736 - RNA, 14 nt, Mycobacterium bovis subsp bovis AF2122/97
guaacgcagcggca

SEQ ID NO: 1145737 - RNA, 21 nt, Mycobacterium bovis subsp bovis AF2122/97
guaacgacgguuccgccaccg

SEQ ID NO: 1145738 - RNA, 14 nt, Mycobacterium bovis subsp bovis AF2122/97
guaaccguccgcgg

SEQ ID NO: 1145739 - RNA, 20 nt, Mycobacterium bovis subsp bovis AF2122/97
guaacggcgaaacucgucga

SEQ ID NO: 1145740 - RNA, 20 nt, Mycobacterium bovis subsp bovis AF2122/97
guaacgguaaccggcccgau

SEQ ID NO: 1145741 - RNA, 12 nt, Mycobacterium bovis subsp bovis AF2122/97
guaauugcaggu

SEQ ID NO: 1145742 - RNA, 11 nt, Mycobacterium bovis subsp bovis AF2122/97
guaauggccgc

SEQ ID NO: 1145743 - RNA, 15 nt, Mycobacterium bovis subsp bovis AF2122/97
guaaugccagcggca

SEQ ID NO: 1145744 - RNA, 14 nt, Mycobacterium bovis subsp bovis AF2122/97
guaaugcgcugccg

SEQ ID NO: 1145745 - RNA, 17 nt, Mycobacterium bovis subsp bovis AF2122/97
guaaugcgcugccgccg

SEQ ID NO: 1145746 - RNA, 23 nt, Mycobacterium bovis subsp bovis AF2122/97
gcgcguuugguuuucccggcguc

SEQ ID NO: 1145747 - RNA, 21 nt, Mycobacterium bovis subsp bovis AF2122/97
gcgcuagccgggcgcgccggc

SEQ ID NO: 1145748 - RNA, 15 nt, Mycobacterium bovis subsp bovis AF2122/97
gcgcuagcgccgcgc

SEQ ID NO: 1145749 - RNA, 16 nt, Mycobacterium bovis subsp bovis AF2122/97
gcgcuacgucaagccg

SEQ ID NO: 1145750 - RNA, 15 nt, Mycobacterium bovis subsp bovis AF2122/97
gcgcucaccggggcc

SEQ ID NO: 1145751 - RNA, 19 nt, Mycobacterium bovis subsp bovis AF2122/97
gcgcucaccggggccgucg

SEQ ID NO: 1145752 - RNA, 20 nt, Mycobacterium bovis subsp bovis AF2122/97
gcgcucaccggggccgucgg

SEQ ID NO: 1145753 - RNA, 14 nt, Mycobacterium bovis subsp bovis AF2122/97
gcgcucacccgccg

SEQ ID NO: 1145754 - RNA, 15 nt, Mycobacterium bovis subsp bovis AF2122/97
gcgcucacccgccgc

SEQ ID NO: 1145755 - RNA, 16 nt, Mycobacterium bovis subsp bovis AF2122/97
gcgcucaccgacgcug

SEQ ID NO: 1145756 - RNA, 17 nt, Mycobacterium bovis subsp bovis AF2122/97
gcgcucaccgacgcuga

SEQ ID NO: 1145757 - RNA, 21 nt, Mycobacterium bovis subsp bovis AF2122/97
gcgcucacugcagcgccucga

SEQ ID NO: 1145758 - RNA, 19 nt, Mycobacterium bovis subsp bovis AF2122/97
gcgcucaaugcggucaacg

SEQ ID NO: 1145759 - RNA, 15 nt, Mycobacterium bovis subsp bovis AF2122/97
gcgcucaacggcgaa

SEQ ID NO: 1145760 - RNA, 16 nt, Mycobacterium bovis subsp bovis AF2122/97
gcgcucaacggcgaaa

SEQ ID NO: 1145761 - RNA, 14 nt, Mycobacterium bovis subsp bovis AF2122/97
gcgcuauaggccgc

SEQ ID NO: 1145762 - RNA, 15 nt, Mycobacterium bovis subsp bovis AF2122/97
gcgcuaucaugacca

SEQ ID NO: 1145763 - RNA, 19 nt, Mycobacterium bovis subsp bovis AF2122/97
gcgcuaucaugaccaccga

SEQ ID NO: 1145764 - RNA, 23 nt, Mycobacterium bovis subsp bovis AF2122/97
gcgcucagcuccggcgacucugu

SEQ ID NO: 1145765 - RNA, 12 nt, Mycobacterium bovis subsp bovis AF2122/97
gcgcucagguca

SEQ ID NO: 1145766 - RNA, 22 nt, Mycobacterium bovis subsp bovis AF2122/97
gcgcucaggucaucggcggcgg

SEQ ID NO: 1145767 - RNA, 17 nt, Mycobacterium bovis subsp bovis AF2122/97
gcgcucauaggccggcg

SEQ ID NO: 1145768 - RNA, 19 nt, Mycobacterium bovis subsp bovis AF2122/97
gcgcucaucgaccgcggcc

SEQ ID NO: 1145769 - RNA, 20 nt, Mycobacterium bovis subsp bovis AF2122/97
gcgcucauguucucgaccgc

SEQ ID NO: 1145770 - RNA, 14 nt, Mycobacterium bovis subsp bovis AF2122/97
gcgcucaucgaccg

SEQ ID NO: 1145771 - RNA, 19 nt, Mycobacterium bovis subsp bovis AF2122/97
gcgcuccaacaacuccagc

SEQ ID NO: 1145772 - RNA, 17 nt, Mycobacterium bovis subsp bovis AF2122/97
gcgcuccacugaccagg

SEQ ID NO: 1145773 - RNA, 19 nt, Mycobacterium bovis subsp bovis AF2122/97
gcgcuccacugaccagguc

SEQ ID NO: 1145774 - RNA, 15 nt, Mycobacterium bovis subsp bovis AF2122/97
gcgcuccagcacccg

SEQ ID NO: 1145775 - RNA, 20 nt, Mycobacterium bovis subsp bovis AF2122/97
gcgcuccagcacccgcgcga

SEQ ID NO: 1145776 - RNA, 22 nt, Mycobacterium bovis subsp bovis AF2122/97
gcgcuccuucagggcgucgaac

SEQ ID NO: 1145777 - RNA, 22 nt, Mycobacterium bovis subsp bovis AF2122/97
gcgcucgacaaagccacgcaga

SEQ ID NO: 1145778 - RNA, 17 nt, Mycobacterium bovis subsp bovis AF2122/97
gcgcuccggcgcgacgc

SEQ ID NO: 1145779 - RNA, 14 nt, Mycobacterium bovis subsp bovis AF2122/97
gcgcucccggcguc

SEQ ID NO: 1145780 - RNA, 13 nt, Mycobacterium bovis subsp bovis AF2122/97
gcgcucccguacg

SEQ ID NO: 1145781 - RNA, 21 nt, Mycobacterium bovis subsp bovis AF2122/97
gcgcuccagccgcgcguccgg

SEQ ID NO: 1145782 - RNA, 17 nt, Mycobacterium bovis subsp bovis AF2122/97
gcgcuccagccgcgcgu

SEQ ID NO: 1145783 - RNA, 17 nt, Mycobacterium bovis subsp bovis AF2122/97
gcgcuccagcugagcgg

SEQ ID NO: 1145784 - RNA, 21 nt, Mycobacterium bovis subsp bovis AF2122/97
gcgcuccagcugagcggccgg

SEQ ID NO: 1145785 - RNA, 23 nt, Mycobacterium bovis subsp bovis AF2122/97
gcgcuccagcugagcggccggca

SEQ ID NO: 1145786 - RNA, 15 nt, Mycobacterium bovis subsp bovis AF2122/97
gcgcguucggcaccu

SEQ ID NO: 1145787 - RNA, 20 nt, Mycobacterium bovis subsp bovis AF2122/97
gcgcguucggcgcugaucgc

SEQ ID NO: 1145788 - RNA, 19 nt, Mycobacterium bovis subsp bovis AF2122/97
gcgcguucgucgucgcuga

SEQ ID NO: 1145789 - RNA, 21 nt, Mycobacterium bovis subsp bovis AF2122/97
gcgcguuuagucuccggcguc

SEQ ID NO: 1145790 - RNA, 14 nt, Mycobacterium bovis subsp bovis AF2122/97
gcgcgugcuuggca

SEQ ID NO: 1145791 - RNA, 15 nt, Mycobacterium bovis subsp bovis AF2122/97
gcgcgugguaccgcu

SEQ ID NO: 1145792 - RNA, 16 nt, Mycobacterium bovis subsp bovis AF2122/97
gcgcguggucgccccg

SEQ ID NO: 1145793 - RNA, 22 nt, Mycobacterium bovis subsp bovis AF2122/97
gcgcguggucgccccgaugacc

SEQ ID NO: 1145794 - RNA, 18 nt, Mycobacterium bovis subsp bovis AF2122/97
gcgcgugugcgucgcacg

SEQ ID NO: 1145795 - RNA, 19 nt, Mycobacterium bovis subsp bovis AF2122/97
gcgcguggcagugcaggcg

SEQ ID NO: 1145796 - RNA, 22 nt, Mycobacterium bovis subsp bovis AF2122/97
gcgcguuacccaucgccacacc

SEQ ID NO: 1145797 - RNA, 15 nt, Mycobacterium bovis subsp bovis AF2122/97
gcgcgugcucgacgc

SEQ ID NO: 1145798 - RNA, 17 nt, Mycobacterium bovis subsp bovis AF2122/97
gcgcgugcucgacgcgc

SEQ ID NO: 1145799 - RNA, 14 nt, Mycobacterium bovis subsp bovis AF2122/97
gcgcgugcugcgga

SEQ ID NO: 1145800 - RNA, 16 nt, Mycobacterium bovis subsp bovis AF2122/97
gcgcgucgggaugcgc

SEQ ID NO: 1145801 - RNA, 15 nt, Mycobacterium bovis subsp bovis AF2122/97
gcgcgucggucaccg

SEQ ID NO: 1145802 - RNA, 14 nt, Mycobacterium bovis subsp bovis AF2122/97
gcgcgucgucgcgc

SEQ ID NO: 1145803 - RNA, 22 nt, Mycobacterium bovis subsp bovis AF2122/97
gcgcgucggugggucucggcgu

SEQ ID NO: 1145804 - RNA, 15 nt, Mycobacterium bovis subsp bovis AF2122/97
gcgcgucgucgcgcu

SEQ ID NO: 1145805 - RNA, 12 nt, Mycobacterium bovis subsp bovis AF2122/97
gcgcgugcagcc

SEQ ID NO: 1145806 - RNA, 13 nt, Mycobacterium bovis subsp bovis AF2122/97
gcgcgugcagcgg

SEQ ID NO: 1145807 - RNA, 16 nt, Mycobacterium bovis subsp bovis AF2122/97
gcgcgugcagcggcgc

SEQ ID NO: 1145808 - RNA, 13 nt, Mycobacterium bovis subsp bovis AF2122/97
gcgcgugacgacc

SEQ ID NO: 1145809 - RNA, 17 nt, Mycobacterium bovis subsp bovis AF2122/97
gcgcgugacgaccagcc

SEQ ID NO: 1145810 - RNA, 18 nt, Mycobacterium bovis subsp bovis AF2122/97
gcgcgucucgagcgcgcc

SEQ ID NO: 1145811 - RNA, 22 nt, Mycobacterium bovis subsp bovis AF2122/97
gcgcgucgcgaaauagcugcgg

SEQ ID NO: 1145812 - RNA, 21 nt, Mycobacterium bovis subsp bovis AF2122/97
gcgcgucgcccagugcgcaac

SEQ ID NO: 1145813 - RNA, 13 nt, Mycobacterium bovis subsp bovis AF2122/97
gcgcgucgccgaa

SEQ ID NO: 1145814 - RNA, 17 nt, Mycobacterium bovis subsp bovis AF2122/97
gcgcgucggcaccgauc

SEQ ID NO: 1145815 - RNA, 13 nt, Mycobacterium bovis subsp bovis AF2122/97
gcgcgucgcgugg

SEQ ID NO: 1145816 - RNA, 16 nt, Mycobacterium bovis subsp bovis AF2122/97
gcgcgucgcgugggau

SEQ ID NO: 1145817 - RNA, 19 nt, Mycobacterium bovis subsp bovis AF2122/97
gcgcguccccagcgccacc

SEQ ID NO: 1145818 - RNA, 15 nt, Mycobacterium bovis subsp bovis AF2122/97
gcgcgucgagcgacc

SEQ ID NO: 1145819 - RNA, 23 nt, Mycobacterium bovis subsp bovis AF2122/97
gcgcgucgaucguuccgcuggac

SEQ ID NO: 1145820 - RNA, 17 nt, Mycobacterium bovis subsp bovis AF2122/97
gcgcggugccgccaccg

SEQ ID NO: 1145821 - RNA, 15 nt, Mycobacterium bovis subsp bovis AF2122/97
gcgcggugcccugcc

SEQ ID NO: 1145822 - RNA, 15 nt, Mycobacterium bovis subsp bovis AF2122/97
gcgcggugacgagcc

SEQ ID NO: 1145823 - RNA, 16 nt, Mycobacterium bovis subsp bovis AF2122/97
gcgcggugacgagcca

SEQ ID NO: 1145824 - RNA, 20 nt, Mycobacterium bovis subsp bovis AF2122/97
gcgcggugacgagccaccac

SEQ ID NO: 1145825 - RNA, 21 nt, Mycobacterium bovis subsp bovis AF2122/97
gcgcggugacgagccaccacc

SEQ ID NO: 1145826 - RNA, 22 nt, Mycobacterium bovis subsp bovis AF2122/97
gcgcggugcgcgugacgaccag

SEQ ID NO: 1145827 - RNA, 22 nt, Mycobacterium bovis subsp bovis AF2122/97
gcgcggugcggccacucgcccg

SEQ ID NO: 1145828 - RNA, 21 nt, Mycobacterium bovis subsp bovis AF2122/97
gcgcggucaccgcgucaccgg

SEQ ID NO: 1145829 - RNA, 14 nt, Mycobacterium bovis subsp bovis AF2122/97
gcgcggugccggcg

SEQ ID NO: 1145830 - RNA, 17 nt, Mycobacterium bovis subsp bovis AF2122/97
gcgcggugccggccguu

SEQ ID NO: 1145831 - RNA, 15 nt, Mycobacterium bovis subsp bovis AF2122/97
gcgcgguggcggucg

SEQ ID NO: 1145832 - RNA, 16 nt, Mycobacterium bovis subsp bovis AF2122/97
gcgcgguggcggucgc

SEQ ID NO: 1145833 - RNA, 19 nt, Mycobacterium bovis subsp bovis AF2122/97
gcgcgguggcggucgccac

SEQ ID NO: 1145834 - RNA, 21 nt, Mycobacterium bovis subsp bovis AF2122/97
gcgcgguggcggucgccacac

SEQ ID NO: 1145835 - RNA, 22 nt, Mycobacterium bovis subsp bovis AF2122/97
gcgcgguggcggucgccacacc

SEQ ID NO: 1145836 - RNA, 20 nt, Mycobacterium bovis subsp bovis AF2122/97
gcgcgguguagagcgcaccg

SEQ ID NO: 1145837 - RNA, 19 nt, Mycobacterium bovis subsp bovis AF2122/97
gcgcgguggggcgcgccgg

SEQ ID NO: 1145838 - RNA, 20 nt, Mycobacterium bovis subsp bovis AF2122/97
gcgcgguggggcgcgccggc

SEQ ID NO: 1145839 - RNA, 19 nt, Mycobacterium bovis subsp bovis AF2122/97
gcgcgguuuccagacgacc

SEQ ID NO: 1145840 - RNA, 15 nt, Mycobacterium bovis subsp bovis AF2122/97
gcgcguagcgggcgc

SEQ ID NO: 1145841 - RNA, 13 nt, Mycobacterium bovis subsp bovis AF2122/97
gcgcguagccaau

SEQ ID NO: 1145842 - RNA, 19 nt, Mycobacterium bovis subsp bovis AF2122/97
gcgcguacccgaucagcga

SEQ ID NO: 1145843 - RNA, 22 nt, Mycobacterium bovis subsp bovis AF2122/97
gcgcgguuucggcgucaccgug

SEQ ID NO: 1145844 - RNA, 24 nt, Mycobacterium bovis subsp bovis AF2122/97
gcgcgguuuucggcugccgcucga

SEQ ID NO: 1145845 - RNA, 22 nt, Mycobacterium bovis subsp bovis AF2122/97
gcgcgucaggccagcgcucacc

SEQ ID NO: 1145846 - RNA, 15 nt, Mycobacterium bovis subsp bovis AF2122/97
gcgcgucacauccga

SEQ ID NO: 1145847 - RNA, 19 nt, Mycobacterium bovis subsp bovis AF2122/97
gcgcgggcucgguggcgga

SEQ ID NO: 1145848 - RNA, 15 nt, Mycobacterium bovis subsp bovis AF2122/97
gcgcggggccgccgc

SEQ ID NO: 1145849 - RNA, 16 nt, Mycobacterium bovis subsp bovis AF2122/97
gcgcggggccgccgcg

SEQ ID NO: 1145850 - RNA, 19 nt, Mycobacterium bovis subsp bovis AF2122/97
gcgcggggccgccgcggcc

SEQ ID NO: 1145851 - RNA, 15 nt, Mycobacterium bovis subsp bovis AF2122/97
gcgcgggggugggcg

SEQ ID NO: 1145852 - RNA, 14 nt, Mycobacterium bovis subsp bovis AF2122/97
gcgcggggccucgc

SEQ ID NO: 1145853 - RNA, 21 nt, Mycobacterium bovis subsp bovis AF2122/97
gcgcggguacuuacgggucgc

SEQ ID NO: 1145854 - RNA, 22 nt, Mycobacterium bovis subsp bovis AF2122/97
gcgcggguacuuacgggucgcg

SEQ ID NO: 1145855 - RNA, 16 nt, Mycobacterium bovis subsp bovis AF2122/97
gcgcgggucggcgacc

SEQ ID NO: 1145856 - RNA, 24 nt, Mycobacterium bovis subsp bovis AF2122/97
gcgcgggugguucaccucggcgac

SEQ ID NO: 1145857 - RNA, 17 nt, Mycobacterium bovis subsp bovis AF2122/97
gcgcgggugaccaggcg

SEQ ID NO: 1145858 - RNA, 17 nt, Mycobacterium bovis subsp bovis AF2122/97
gcgcgggugcgccggcg

SEQ ID NO: 1145859 - RNA, 20 nt, Mycobacterium bovis subsp bovis AF2122/97
gcgcggguggcagcggcgau

SEQ ID NO: 1145860 - RNA, 22 nt, Mycobacterium bovis subsp bovis AF2122/97
gcgcggguuugcgguaguccgc

SEQ ID NO: 1145861 - RNA, 21 nt, Mycobacterium bovis subsp bovis AF2122/97
gcgcggguuacccgcagcgug

SEQ ID NO: 1145862 - RNA, 17 nt, Mycobacterium bovis subsp bovis AF2122/97
gcgcgguagcucgucga

SEQ ID NO: 1145863 - RNA, 19 nt, Mycobacterium bovis subsp bovis AF2122/97
gcgcggucucggaaacgga

SEQ ID NO: 1145864 - RNA, 14 nt, Mycobacterium bovis subsp bovis AF2122/97
gcgcggucucgagu

SEQ ID NO: 1145865 - RNA, 14 nt, Mycobacterium bovis subsp bovis AF2122/97
gcgcggucgcgcga

SEQ ID NO: 1145866 - RNA, 16 nt, Mycobacterium bovis subsp bovis AF2122/97
gcgcgguacugcgcag

SEQ ID NO: 1145867 - RNA, 16 nt, Mycobacterium bovis subsp bovis AF2122/97
gcgcgguaccgcucgg

SEQ ID NO: 1145868 - RNA, 15 nt, Mycobacterium bovis subsp bovis AF2122/97
gcgcgguccaucccg

SEQ ID NO: 1145869 - RNA, 23 nt, Mycobacterium bovis subsp bovis AF2122/97
gcgcggcuggggccccgcgccgg

SEQ ID NO: 1145870 - RNA, 21 nt, Mycobacterium bovis subsp bovis AF2122/97
gcgcggcuuguaccgcaauca

SEQ ID NO: 1145871 - RNA, 14 nt, Mycobacterium bovis subsp bovis AF2122/97
gcgcgggccaccac

SEQ ID NO: 1145872 - RNA, 18 nt, Mycobacterium bovis subsp bovis AF2122/97
gcgcgggccaccacgcgc

SEQ ID NO: 1145873 - RNA, 15 nt, Mycobacterium bovis subsp bovis AF2122/97
gcgcgggccggcgac

SEQ ID NO: 1145874 - RNA, 16 nt, Mycobacterium bovis subsp bovis AF2122/97
gcgcgggccggcgacu

SEQ ID NO: 1145875 - RNA, 23 nt, Mycobacterium bovis subsp bovis AF2122/97
gcgcggcuugggcuugcgccgga

SEQ ID NO: 1145876 - RNA, 13 nt, Mycobacterium bovis subsp bovis AF2122/97
gcgcgggcgagcg

SEQ ID NO: 1145877 - RNA, 17 nt, Mycobacterium bovis subsp bovis AF2122/97
gcgcgggcgccgggaag

SEQ ID NO: 1145878 - RNA, 21 nt, Mycobacterium bovis subsp bovis AF2122/97
gcgcgggcgccgggaagcccc

SEQ ID NO: 1145879 - RNA, 15 nt, Mycobacterium bovis subsp bovis AF2122/97
gcgcgggcggaucgc

SEQ ID NO: 1145880 - RNA, 17 nt, Mycobacterium bovis subsp bovis AF2122/97
gcgcgggcggaucgccg

SEQ ID NO: 1145881 - RNA, 13 nt, Mycobacterium bovis subsp bovis AF2122/97
gcgcggcggcauc

SEQ ID NO: 1145882 - RNA, 13 nt, Mycobacterium bovis subsp bovis AF2122/97
gcgcggcggcgcc

SEQ ID NO: 1145883 - RNA, 16 nt, Mycobacterium bovis subsp bovis AF2122/97
gcgcggcggcgccggc

SEQ ID NO: 1145884 - RNA, 12 nt, Mycobacterium bovis subsp bovis AF2122/97
gcgcggcggcgg

SEQ ID NO: 1145885 - RNA, 14 nt, Mycobacterium bovis subsp bovis AF2122/97
gcgcggcggccgcg

SEQ ID NO: 1145886 - RNA, 21 nt, Mycobacterium bovis subsp bovis AF2122/97
gcgcggcggcggaggcugggc

SEQ ID NO: 1145887 - RNA, 14 nt, Mycobacterium bovis subsp bovis AF2122/97
gcgcggcggcgucg

SEQ ID NO: 1145888 - RNA, 17 nt, Mycobacterium bovis subsp bovis AF2122/97
gcgcggcggcguccacc

SEQ ID NO: 1145889 - RNA, 21 nt, Mycobacterium bovis subsp bovis AF2122/97
gcgcggcggggguucgcucug

SEQ ID NO: 1145890 - RNA, 13 nt, Mycobacterium bovis subsp bovis AF2122/97
gcgcggcgucgug

SEQ ID NO: 1145891 - RNA, 14 nt, Mycobacterium bovis subsp bovis AF2122/97
gcgcggccggcacg

SEQ ID NO: 1145892 - RNA, 19 nt, Mycobacterium bovis subsp bovis AF2122/97
gcgcggccggccgcucacc

SEQ ID NO: 1145893 - RNA, 13 nt, Mycobacterium bovis subsp bovis AF2122/97
gcgcggccgggcg

SEQ ID NO: 1145894 - RNA, 22 nt, Mycobacterium bovis subsp bovis AF2122/97
gcgcggccggcacgaccgcucc

SEQ ID NO: 1145895 - RNA, 14 nt, Mycobacterium bovis subsp bovis AF2122/97
gcgcggccgggcgc

SEQ ID NO: 1145896 - RNA, 19 nt, Mycobacterium bovis subsp bovis AF2122/97
gcgcggccgugaacggcgc

SEQ ID NO: 1145897 - RNA, 18 nt, Mycobacterium bovis subsp bovis AF2122/97
gcgcggccugcaccagcg

SEQ ID NO: 1145898 - RNA, 16 nt, Mycobacterium bovis subsp bovis AF2122/97
gcgcggcgacgacggc

SEQ ID NO: 1145899 - RNA, 19 nt, Mycobacterium bovis subsp bovis AF2122/97
gcgcggcgagagccucggc

SEQ ID NO: 1145900 - RNA, 12 nt, Mycobacterium bovis subsp bovis AF2122/97
gcgcggcgagca

SEQ ID NO: 1145901 - RNA, 14 nt, Mycobacterium bovis subsp bovis AF2122/97
gcgcggcgagcacg

SEQ ID NO: 1145902 - RNA, 14 nt, Mycobacterium bovis subsp bovis AF2122/97
gcgcggcgagggcg

SEQ ID NO: 1145903 - RNA, 20 nt, Mycobacterium bovis subsp bovis AF2122/97
gcgcggcgagggcggucagc

SEQ ID NO: 1145904 - RNA, 11 nt, Mycobacterium bovis subsp bovis AF2122/97
gcgcggcgauc

SEQ ID NO: 1145905 - RNA, 20 nt, Mycobacterium bovis subsp bovis AF2122/97
gcgcggccggccgcucaccc

SEQ ID NO: 1145906 - RNA, 13 nt, Mycobacterium bovis subsp bovis AF2122/97
gcgcggcgcgaca

SEQ ID NO: 1145907 - RNA, 15 nt, Mycobacterium bovis subsp bovis AF2122/97
gcgcggcgcgaucgu

SEQ ID NO: 1145908 - RNA, 17 nt, Mycobacterium bovis subsp bovis AF2122/97
gcgcggcgcgaucgucg

SEQ ID NO: 1145909 - RNA, 16 nt, Mycobacterium bovis subsp bovis AF2122/97
gcgcggcgccgcaaug

SEQ ID NO: 1145910 - RNA, 15 nt, Mycobacterium bovis subsp bovis AF2122/97
gcgcggcgcauuccg

SEQ ID NO: 1145911 - RNA, 13 nt, Mycobacterium bovis subsp bovis AF2122/97
gcgcggcgcagca

SEQ ID NO: 1145912 - RNA, 15 nt, Mycobacterium bovis subsp bovis AF2122/97
gcgcggcgcagcacc

SEQ ID NO: 1145913 - RNA, 21 nt, Mycobacterium bovis subsp bovis AF2122/97
gcgcggcgcagcaccgucggc

SEQ ID NO: 1145914 - RNA, 21 nt, Mycobacterium bovis subsp bovis AF2122/97
gcgcggcgaucgcuccgcggc

SEQ ID NO: 1145915 - RNA, 13 nt, Mycobacterium bovis subsp bovis AF2122/97
gcgcggcgcacaa

SEQ ID NO: 1145916 - RNA, 22 nt, Mycobacterium bovis subsp bovis AF2122/97
gcgcgacguccaccagccgguu

SEQ ID NO: 1145917 - RNA, 15 nt, Mycobacterium bovis subsp bovis AF2122/97
gcgcgagaacacccg

SEQ ID NO: 1145918 - RNA, 14 nt, Mycobacterium bovis subsp bovis AF2122/97
gcgcgagccgcacg

SEQ ID NO: 1145919 - RNA, 16 nt, Mycobacterium bovis subsp bovis AF2122/97
gcgcgagccgcuccaa

SEQ ID NO: 1145920 - RNA, 20 nt, Mycobacterium bovis subsp bovis AF2122/97
gcgcgagccggcucagacga

SEQ ID NO: 1145921 - RNA, 15 nt, Mycobacterium bovis subsp bovis AF2122/97
gcgcgagcgauggga

SEQ ID NO: 1145922 - RNA, 12 nt, Mycobacterium bovis subsp bovis AF2122/97
gcgcgaucaccg

SEQ ID NO: 1145923 - RNA, 21 nt, Mycobacterium bovis subsp bovis AF2122/97
gcgcgaucagguaccggcgga

SEQ ID NO: 1145924 - RNA, 17 nt, Mycobacterium bovis subsp bovis AF2122/97
gcgcgauccccgcgcug

SEQ ID NO: 1145925 - RNA, 18 nt, Mycobacterium bovis subsp bovis AF2122/97
gcgcgaucgacgcucggc

SEQ ID NO: 1145926 - RNA, 21 nt, Mycobacterium bovis subsp bovis AF2122/97
gcgcgaucgauuccgcucguu

SEQ ID NO: 1145927 - RNA, 17 nt, Mycobacterium bovis subsp bovis AF2122/97
gcgcgaucgggccggcg

SEQ ID NO: 1145928 - RNA, 14 nt, Mycobacterium bovis subsp bovis AF2122/97
gcgcgaucggugcc

SEQ ID NO: 1145929 - RNA, 21 nt, Mycobacterium bovis subsp bovis AF2122/97
gcgcgcaacacauccaguaac

SEQ ID NO: 1145930 - RNA, 19 nt, Mycobacterium bovis subsp bovis AF2122/97
gcgcgcaacgagauucguc

SEQ ID NO: 1145931 - RNA, 22 nt, Mycobacterium bovis subsp bovis AF2122/97
gcgcgcaacccugccgcgauga

SEQ ID NO: 1145932 - RNA, 18 nt, Mycobacterium bovis subsp bovis AF2122/97
gcgcgcaaccgcucaucg

SEQ ID NO: 1145933 - RNA, 13 nt, Mycobacterium bovis subsp bovis AF2122/97
gcgcgcaacccug

SEQ ID NO: 1145934 - RNA, 14 nt, Mycobacterium bovis subsp bovis AF2122/97
gcgcgcaacccugc

SEQ ID NO: 1145935 - RNA, 13 nt, Mycobacterium bovis subsp bovis AF2122/97
gcgcgcaccaccg

SEQ ID NO: 1145936 - RNA, 21 nt, Mycobacterium bovis subsp bovis AF2122/97
gcgcgcaaucgugguucggcg

SEQ ID NO: 1145937 - RNA, 14 nt, Mycobacterium bovis subsp bovis AF2122/97
gcgcgcaccaccgc

SEQ ID NO: 1145938 - RNA, 15 nt, Mycobacterium bovis subsp bovis AF2122/97
gcgcgcacacggcua

SEQ ID NO: 1145939 - RNA, 22 nt, Mycobacterium bovis subsp bovis AF2122/97
gcgcgcaacguacgcacgcagc

SEQ ID NO: 1145940 - RNA, 21 nt, Mycobacterium bovis subsp bovis AF2122/97
gcgcgcaacguagccagcagc

SEQ ID NO: 1145941 - RNA, 22 nt, Mycobacterium bovis subsp bovis AF2122/97
gcgcgcaagugcuggccgaaga

SEQ ID NO: 1145942 - RNA, 16 nt, Mycobacterium bovis subsp bovis AF2122/97
gcgccgucucgaucgc

SEQ ID NO: 1145943 - RNA, 17 nt, Mycobacterium bovis subsp bovis AF2122/97
gcgccgucucgaucgcg

SEQ ID NO: 1145944 - RNA, 14 nt, Mycobacterium bovis subsp bovis AF2122/97
gcgccgucucgcgg

SEQ ID NO: 1145945 - RNA, 13 nt, Mycobacterium bovis subsp bovis AF2122/97
gcgccgugaccca

SEQ ID NO: 1145946 - RNA, 14 nt, Mycobacterium bovis subsp bovis AF2122/97
gcgccgugacccau

SEQ ID NO: 1145947 - RNA, 20 nt, Mycobacterium bovis subsp bovis AF2122/97
gcgccgucucgaagcucagc

SEQ ID NO: 1145948 - RNA, 18 nt, Mycobacterium bovis subsp bovis AF2122/97
gcgcgaagucuugaccgc

SEQ ID NO: 1145949 - RNA, 21 nt, Mycobacterium bovis subsp bovis AF2122/97
gcgcgaaguuugcgacgacgc

SEQ ID NO: 1145950 - RNA, 22 nt, Mycobacterium bovis subsp bovis AF2122/97
gcgcgaagucuugaccgcaccg

SEQ ID NO: 1145951 - RNA, 23 nt, Mycobacterium bovis subsp bovis AF2122/97
gcgcgaaguuugcgacgacgcca

SEQ ID NO: 1145952 - RNA, 14 nt, Mycobacterium bovis subsp bovis AF2122/97
gcgcgaaucgcguc

SEQ ID NO: 1145953 - RNA, 15 nt, Mycobacterium bovis subsp bovis AF2122/97
gcgcgaauucguagg

SEQ ID NO: 1145954 - RNA, 15 nt, Mycobacterium bovis subsp bovis AF2122/97
gcgcgacaacccggc

SEQ ID NO: 1145955 - RNA, 18 nt, Mycobacterium bovis subsp bovis AF2122/97
gcgcgacagacagcaccg

SEQ ID NO: 1145956 - RNA, 22 nt, Mycobacterium bovis subsp bovis AF2122/97
gcgcgacagacagcaccgccgg

SEQ ID NO: 1145957 - RNA, 17 nt, Mycobacterium bovis subsp bovis AF2122/97
gcgcgacaacccggcgu

SEQ ID NO: 1145958 - RNA, 19 nt, Mycobacterium bovis subsp bovis AF2122/97
gcgcgacaacccggcgucg

SEQ ID NO: 1145959 - RNA, 20 nt, Mycobacterium bovis subsp bovis AF2122/97
gcgcgacaacccggcgucga

SEQ ID NO: 1145960 - RNA, 14 nt, Mycobacterium bovis subsp bovis AF2122/97
gcgcgaccuggucg

SEQ ID NO: 1145961 - RNA, 14 nt, Mycobacterium bovis subsp bovis AF2122/97
gcgcgacgcccgaa

SEQ ID NO: 1145962 - RNA, 13 nt, Mycobacterium bovis subsp bovis AF2122/97
gcgcgacgccgcg

SEQ ID NO: 1145963 - RNA, 13 nt, Mycobacterium bovis subsp bovis AF2122/97
gcgcgacggacca

SEQ ID NO: 1145964 - RNA, 18 nt, Mycobacterium bovis subsp bovis AF2122/97
gcgcgacggcaacgucgc

SEQ ID NO: 1145965 - RNA, 18 nt, Mycobacterium bovis subsp bovis AF2122/97
gcgcgacggccgggacaa

SEQ ID NO: 1145966 - RNA, 21 nt, Mycobacterium bovis subsp bovis AF2122/97
gcgcgacugauccucgaugac

SEQ ID NO: 1145967 - RNA, 16 nt, Mycobacterium bovis subsp bovis AF2122/97
gcgcgccaaucgccca

SEQ ID NO: 1145968 - RNA, 22 nt, Mycobacterium bovis subsp bovis AF2122/97
gcgcgccagaacgacaccgcuu

SEQ ID NO: 1145969 - RNA, 13 nt, Mycobacterium bovis subsp bovis AF2122/97
gcgcgccacgagc

SEQ ID NO: 1145970 - RNA, 12 nt, Mycobacterium bovis subsp bovis AF2122/97
gcgcgccagcuu

SEQ ID NO: 1145971 - RNA, 13 nt, Mycobacterium bovis subsp bovis AF2122/97
gcgcgccagcucg

SEQ ID NO: 1145972 - RNA, 14 nt, Mycobacterium bovis subsp bovis AF2122/97
gcgcgccagcucgg

SEQ ID NO: 1145973 - RNA, 20 nt, Mycobacterium bovis subsp bovis AF2122/97
gcgcgccagcucggcggcag

SEQ ID NO: 1145974 - RNA, 21 nt, Mycobacterium bovis subsp bovis AF2122/97
gcgcgccagcucggcggcagc

SEQ ID NO: 1145975 - RNA, 20 nt, Mycobacterium bovis subsp bovis AF2122/97
gcgcgcccaccgggcggcgg

SEQ ID NO: 1145976 - RNA, 19 nt, Mycobacterium bovis subsp bovis AF2122/97
gcgcgccauuggcgccgcc

SEQ ID NO: 1145977 - RNA, 22 nt, Mycobacterium bovis subsp bovis AF2122/97
gcgcgcccacagcccgggcgga

SEQ ID NO: 1145978 - RNA, 15 nt, Mycobacterium bovis subsp bovis AF2122/97
gcgcgccaggcucga

SEQ ID NO: 1145979 - RNA, 14 nt, Mycobacterium bovis subsp bovis AF2122/97
gcgcgccgcacccg

SEQ ID NO: 1145980 - RNA, 20 nt, Mycobacterium bovis subsp bovis AF2122/97
gcgcgccgcaucggcgaaca

SEQ ID NO: 1145981 - RNA, 12 nt, Mycobacterium bovis subsp bovis AF2122/97
gcgcgccgcgac

SEQ ID NO: 1145982 - RNA, 14 nt, Mycobacterium bovis subsp bovis AF2122/97
gcgcgccgcugggu

SEQ ID NO: 1145983 - RNA, 23 nt, Mycobacterium bovis subsp bovis AF2122/97
gcgcgcccauuggguaaccagcg

SEQ ID NO: 1145984 - RNA, 13 nt, Mycobacterium bovis subsp bovis AF2122/97
gcgcgccccaccg

SEQ ID NO: 1145985 - RNA, 12 nt, Mycobacterium bovis subsp bovis AF2122/97
gcgcgcccgaau

SEQ ID NO: 1145986 - RNA, 14 nt, Mycobacterium bovis subsp bovis AF2122/97
gcgcgcccgcggcc

SEQ ID NO: 1145987 - RNA, 15 nt, Mycobacterium bovis subsp bovis AF2122/97
gcgcgcccgacaccc

SEQ ID NO: 1145988 - RNA, 14 nt, Mycobacterium bovis subsp bovis AF2122/97
gcgcgcccgggcgg

SEQ ID NO: 1145989 - RNA, 14 nt, Mycobacterium bovis subsp bovis AF2122/97
gcgcgccgaccacc

SEQ ID NO: 1145990 - RNA, 20 nt, Mycobacterium bovis subsp bovis AF2122/97
gcgcgccgaccaccgcugcg

SEQ ID NO: 1145991 - RNA, 21 nt, Mycobacterium bovis subsp bovis AF2122/97
gcgcgccgauaugcgugagcu

SEQ ID NO: 1145992 - RNA, 14 nt, Mycobacterium bovis subsp bovis AF2122/97
gcgcgccgaucacg

SEQ ID NO: 1145993 - RNA, 18 nt, Mycobacterium bovis subsp bovis AF2122/97
gcgcgccgaaggccgcca

SEQ ID NO: 1145994 - RNA, 23 nt, Mycobacterium bovis subsp bovis AF2122/97
gcgcggccaccucaucgccaucg

SEQ ID NO: 1145995 - RNA, 17 nt, Mycobacterium bovis subsp bovis AF2122/97
gcgcggccacccgcgac

SEQ ID NO: 1145996 - RNA, 23 nt, Mycobacterium bovis subsp bovis AF2122/97
gcgcggccaaucagcccgccgga

SEQ ID NO: 1145997 - RNA, 21 nt, Mycobacterium bovis subsp bovis AF2122/97
gcgcggccacgccgaucaaca

SEQ ID NO: 1145998 - RNA, 20 nt, Mycobacterium bovis subsp bovis AF2122/97
gcgcggccaauugcgccgcc

SEQ ID NO: 1145999 - RNA, 12 nt, Mycobacterium bovis subsp bovis AF2122/97
gcgcggccagca

SEQ ID NO: 1146000 - RNA, 13 nt, Mycobacterium bovis subsp bovis AF2122/97
gcgcggccagccc

SEQ ID NO: 1146001 - RNA, 20 nt, Mycobacterium bovis subsp bovis AF2122/97
gcgcggccagcccacucguc

SEQ ID NO: 1146002 - RNA, 14 nt, Mycobacterium bovis subsp bovis AF2122/97
gcgcggccgcagcc

SEQ ID NO: 1146003 - RNA, 23 nt, Mycobacterium bovis subsp bovis AF2122/97
gcgcggccauggcagcgcgcuga

SEQ ID NO: 1146004 - RNA, 15 nt, Mycobacterium bovis subsp bovis AF2122/97
gcgcggcccgccgag

SEQ ID NO: 1146005 - RNA, 16 nt, Mycobacterium bovis subsp bovis AF2122/97
gcgcggcccgccgagu

SEQ ID NO: 1146006 - RNA, 21 nt, Mycobacterium bovis subsp bovis AF2122/97
gcgcggccacuuggaugcgac

SEQ ID NO: 1146007 - RNA, 21 nt, Mycobacterium bovis subsp bovis AF2122/97
gcgcggaugaggaauucgauc

SEQ ID NO: 1146008 - RNA, 20 nt, Mycobacterium bovis subsp bovis AF2122/97
gcgcggauggccucggcgau

SEQ ID NO: 1146009 - RNA, 18 nt, Mycobacterium bovis subsp bovis AF2122/97
gcgcggauuucgccguga

SEQ ID NO: 1146010 - RNA, 14 nt, Mycobacterium bovis subsp bovis AF2122/97
gcgcggcacccggu

SEQ ID NO: 1146011 - RNA, 18 nt, Mycobacterium bovis subsp bovis AF2122/97
gcgcggcacccggucggc

SEQ ID NO: 1146012 - RNA, 17 nt, Mycobacterium bovis subsp bovis AF2122/97
gcgcggcaccgauggcg

SEQ ID NO: 1146013 - RNA, 23 nt, Mycobacterium bovis subsp bovis AF2122/97
gcgcggcaccgauggcgcaccgg

SEQ ID NO: 1146014 - RNA, 16 nt, Mycobacterium bovis subsp bovis AF2122/97
gcgcggcaaccgucga

SEQ ID NO: 1146015 - RNA, 15 nt, Mycobacterium bovis subsp bovis AF2122/97
gcgcggccacccgcg

SEQ ID NO: 1146016 - RNA, 17 nt, Mycobacterium bovis subsp bovis AF2122/97
gcgcggcaggccuggcg

SEQ ID NO: 1146017 - RNA, 21 nt, Mycobacterium bovis subsp bovis AF2122/97
gcgcggcaucccgccacacca

SEQ ID NO: 1146018 - RNA, 23 nt, Mycobacterium bovis subsp bovis AF2122/97
gcgcggcacuuuguagcccgcga

SEQ ID NO: 1146019 - RNA, 11 nt, Mycobacterium bovis subsp bovis AF2122/97
gcgcggcaggc

SEQ ID NO: 1146020 - RNA, 13 nt, Mycobacterium bovis subsp bovis AF2122/97
gcgcgcucaucga

SEQ ID NO: 1146021 - RNA, 18 nt, Mycobacterium bovis subsp bovis AF2122/97
gcgcgcucaucgaccggg

SEQ ID NO: 1146022 - RNA, 14 nt, Mycobacterium bovis subsp bovis AF2122/97
gcgcgcucagguca

SEQ ID NO: 1146023 - RNA, 17 nt, Mycobacterium bovis subsp bovis AF2122/97
gcgcgcucaggucaucg

SEQ ID NO: 1146024 - RNA, 12 nt, Mycobacterium bovis subsp bovis AF2122/97
gcgcgcucgccc

SEQ ID NO: 1146025 - RNA, 15 nt, Mycobacterium bovis subsp bovis AF2122/97
gcgcgcucgcucacc

SEQ ID NO: 1146026 - RNA, 18 nt, Mycobacterium bovis subsp bovis AF2122/97
gcgcgcucguggucgacg

SEQ ID NO: 1146027 - RNA, 14 nt, Mycobacterium bovis subsp bovis AF2122/97
gcgcgcugagcucg

SEQ ID NO: 1146028 - RNA, 13 nt, Mycobacterium bovis subsp bovis AF2122/97
gcgcgcugcgcag

SEQ ID NO: 1146029 - RNA, 14 nt, Mycobacterium bovis subsp bovis AF2122/97
gcgcgcugcgcgac

SEQ ID NO: 1146030 - RNA, 21 nt, Mycobacterium bovis subsp bovis AF2122/97
gcgcgcugcggaucguggcgc

SEQ ID NO: 1146031 - RNA, 16 nt, Mycobacterium bovis subsp bovis AF2122/97
gcgcgcugggcccgag

SEQ ID NO: 1146032 - RNA, 17 nt, Mycobacterium bovis subsp bovis AF2122/97
gcgcgcugggcccgagc

SEQ ID NO: 1146033 - RNA, 13 nt, Mycobacterium bovis subsp bovis AF2122/97
gcgcgcuggaccu

SEQ ID NO: 1146034 - RNA, 19 nt, Mycobacterium bovis subsp bovis AF2122/97
gcgcgcuucaugagccgcu

SEQ ID NO: 1146035 - RNA, 21 nt, Mycobacterium bovis subsp bovis AF2122/97
gcgcgcuucaugagccgcugc

SEQ ID NO: 1146036 - RNA, 21 nt, Mycobacterium bovis subsp bovis AF2122/97
gcgcggaucaacaggccggcu

SEQ ID NO: 1146037 - RNA, 18 nt, Mycobacterium bovis subsp bovis AF2122/97
gcgcggaucggcggccgc

SEQ ID NO: 1146038 - RNA, 19 nt, Mycobacterium bovis subsp bovis AF2122/97
gcgcggaucggcggccgcg

SEQ ID NO: 1146039 - RNA, 21 nt, Mycobacterium bovis subsp bovis AF2122/97
gcgcggaccagagugguggcg

SEQ ID NO: 1146040 - RNA, 22 nt, Mycobacterium bovis subsp bovis AF2122/97
gcgcggacaccuuucuccacac

SEQ ID NO: 1146041 - RNA, 13 nt, Mycobacterium bovis subsp bovis AF2122/97
gcgcgccggcgac

SEQ ID NO: 1146042 - RNA, 13 nt, Mycobacterium bovis subsp bovis AF2122/97
gcgcgccggcggu

SEQ ID NO: 1146043 - RNA, 21 nt, Mycobacterium bovis subsp bovis AF2122/97
gcgcgccggcgguagucggcc

SEQ ID NO: 1146044 - RNA, 15 nt, Mycobacterium bovis subsp bovis AF2122/97
gcgcgccggcgucgg

SEQ ID NO: 1146045 - RNA, 16 nt, Mycobacterium bovis subsp bovis AF2122/97
gcgcgccggcgacccg

SEQ ID NO: 1146046 - RNA, 11 nt, Mycobacterium bovis subsp bovis AF2122/97
gcgcgccggcu

SEQ ID NO: 1146047 - RNA, 12 nt, Mycobacterium bovis subsp bovis AF2122/97
gcgcgccgggcg

SEQ ID NO: 1146048 - RNA, 13 nt, Mycobacterium bovis subsp bovis AF2122/97
gcgcgccggugcu

SEQ ID NO: 1146049 - RNA, 15 nt, Mycobacterium bovis subsp bovis AF2122/97
gcgcgccucgcccag

SEQ ID NO: 1146050 - RNA, 17 nt, Mycobacterium bovis subsp bovis AF2122/97
gcgcgccucgcccagca

SEQ ID NO: 1146051 - RNA, 22 nt, Mycobacterium bovis subsp bovis AF2122/97
gcgcgccucgcccagcaaggcc

SEQ ID NO: 1146052 - RNA, 12 nt, Mycobacterium bovis subsp bovis AF2122/97
gcgcgccugcgc

SEQ ID NO: 1146053 - RNA, 19 nt, Mycobacterium bovis subsp bovis AF2122/97
gcgcgcgaaccccagccga

SEQ ID NO: 1146054 - RNA, 17 nt, Mycobacterium bovis subsp bovis AF2122/97
gcgcgccugugccaccg

SEQ ID NO: 1146055 - RNA, 18 nt, Mycobacterium bovis subsp bovis AF2122/97
gcgcgccugugccaccgc

SEQ ID NO: 1146056 - RNA, 23 nt, Mycobacterium bovis subsp bovis AF2122/97
gcgcgccuucacgcuggccucca

SEQ ID NO: 1146057 - RNA, 13 nt, Mycobacterium bovis subsp bovis AF2122/97
gcgcgcgauggcg

SEQ ID NO: 1146058 - RNA, 14 nt, Mycobacterium bovis subsp bovis AF2122/97
gcgcgcgauggcgc

SEQ ID NO: 1146059 - RNA, 14 nt, Mycobacterium bovis subsp bovis AF2122/97
gcgcgcgccgcagc

SEQ ID NO: 1146060 - RNA, 13 nt, Mycobacterium bovis subsp bovis AF2122/97
gcgcgcgcccgaa

SEQ ID NO: 1146061 - RNA, 15 nt, Mycobacterium bovis subsp bovis AF2122/97
gcgcgcgccgcuggg

SEQ ID NO: 1146062 - RNA, 20 nt, Mycobacterium bovis subsp bovis AF2122/97
gcgcgcgccgcugggugacc

SEQ ID NO: 1146063 - RNA, 13 nt, Mycobacterium bovis subsp bovis AF2122/97
gcgcgcgcggugc

SEQ ID NO: 1146064 - RNA, 21 nt, Mycobacterium bovis subsp bovis AF2122/97
gcgcgcggauggguacgacac

SEQ ID NO: 1146065 - RNA, 12 nt, Mycobacterium bovis subsp bovis AF2122/97
gcgcgcggcaac

SEQ ID NO: 1146066 - RNA, 14 nt, Mycobacterium bovis subsp bovis AF2122/97
gcgcgcggcgacga

SEQ ID NO: 1146067 - RNA, 12 nt, Mycobacterium bovis subsp bovis AF2122/97
gcgcgcggcgcc

SEQ ID NO: 1146068 - RNA, 17 nt, Mycobacterium bovis subsp bovis AF2122/97
gcgcgcggggccucgcg

SEQ ID NO: 1146069 - RNA, 17 nt, Mycobacterium bovis subsp bovis AF2122/97
gcgcgcggugcggccac

SEQ ID NO: 1146070 - RNA, 12 nt, Mycobacterium bovis subsp bovis AF2122/97
gcgcgcggucga

SEQ ID NO: 1146071 - RNA, 14 nt, Mycobacterium bovis subsp bovis AF2122/97
gcgcgcgucacauc

SEQ ID NO: 1146072 - RNA, 15 nt, Mycobacterium bovis subsp bovis AF2122/97
gcgcccaccgaaacc

SEQ ID NO: 1146073 - RNA, 15 nt, Mycobacterium bovis subsp bovis AF2122/97
gcgcccacccgcgcc

SEQ ID NO: 1146074 - RNA, 15 nt, Mycobacterium bovis subsp bovis AF2122/97
gcgcccaccgaugcg

SEQ ID NO: 1146075 - RNA, 13 nt, Mycobacterium bovis subsp bovis AF2122/97
gcgcccagcucga

SEQ ID NO: 1146076 - RNA, 13 nt, Mycobacterium bovis subsp bovis AF2122/97
gcgcccacccgcg

SEQ ID NO: 1146077 - RNA, 14 nt, Mycobacterium bovis subsp bovis AF2122/97
gcgcccacccgcgc

SEQ ID NO: 1146078 - RNA, 18 nt, Mycobacterium bovis subsp bovis AF2122/97
gcgcccaccagcggcggc

SEQ ID NO: 1146079 - RNA, 21 nt, Mycobacterium bovis subsp bovis AF2122/97
gcgcccaccagcggcggcaac

SEQ ID NO: 1146080 - RNA, 16 nt, Mycobacterium bovis subsp bovis AF2122/97
gcgccauuggcgccgc

SEQ ID NO: 1146081 - RNA, 17 nt, Mycobacterium bovis subsp bovis AF2122/97
gcgccauucccgguggc

SEQ ID NO: 1146082 - RNA, 17 nt, Mycobacterium bovis subsp bovis AF2122/97
gcgccccggagccucga

SEQ ID NO: 1146083 - RNA, 17 nt, Mycobacterium bovis subsp bovis AF2122/97
gcgcccgaaugcgacgu

SEQ ID NO: 1146084 - RNA, 15 nt, Mycobacterium bovis subsp bovis AF2122/97
gcgcccgacggaguu

SEQ ID NO: 1146085 - RNA, 20 nt, Mycobacterium bovis subsp bovis AF2122/97
gcgcccgacggaguucgacg

SEQ ID NO: 1146086 - RNA, 17 nt, Mycobacterium bovis subsp bovis AF2122/97
gcgcccgacgaacagcg

SEQ ID NO: 1146087 - RNA, 23 nt, Mycobacterium bovis subsp bovis AF2122/97
gcgcccauagcugccggcccacc

SEQ ID NO: 1146088 - RNA, 13 nt, Mycobacterium bovis subsp bovis AF2122/97
gcgccccgccgca

SEQ ID NO: 1146089 - RNA, 14 nt, Mycobacterium bovis subsp bovis AF2122/97
gcgccaucucgacg

SEQ ID NO: 1146090 - RNA, 16 nt, Mycobacterium bovis subsp bovis AF2122/97
gcgccaucgggucacc

SEQ ID NO: 1146091 - RNA, 14 nt, Mycobacterium bovis subsp bovis AF2122/97
gcgccaucgucgcg

SEQ ID NO: 1146092 - RNA, 15 nt, Mycobacterium bovis subsp bovis AF2122/97
gcgccaugaagccgg

SEQ ID NO: 1146093 - RNA, 15 nt, Mycobacterium bovis subsp bovis AF2122/97
gcgccauuccaagac

SEQ ID NO: 1146094 - RNA, 20 nt, Mycobacterium bovis subsp bovis AF2122/97
gcgccauuccaagacguugc

SEQ ID NO: 1146095 - RNA, 14 nt, Mycobacterium bovis subsp bovis AF2122/97
gcgccauccccgcc

SEQ ID NO: 1146096 - RNA, 18 nt, Mycobacterium bovis subsp bovis AF2122/97
gcgccauccccgccggcg

SEQ ID NO: 1146097 - RNA, 20 nt, Mycobacterium bovis subsp bovis AF2122/97
gcgccauccccgccggcgcc

SEQ ID NO: 1146098 - RNA, 17 nt, Mycobacterium bovis subsp bovis AF2122/97
gcgccaucccgccgccc

SEQ ID NO: 1146099 - RNA, 22 nt, Mycobacterium bovis subsp bovis AF2122/97
gcgccauagccgcgacccgcgc

SEQ ID NO: 1146100 - RNA, 20 nt, Mycobacterium bovis subsp bovis AF2122/97
gcgccauaauauugccgccu

SEQ ID NO: 1146101 - RNA, 22 nt, Mycobacterium bovis subsp bovis AF2122/97
gcgccauaauauugccgccucc

SEQ ID NO: 1146102 - RNA, 22 nt, Mycobacterium bovis subsp bovis AF2122/97
gcgccauacuggcgguccgaug

SEQ ID NO: 1146103 - RNA, 15 nt, Mycobacterium bovis subsp bovis AF2122/97
gcgccauagccgcga

SEQ ID NO: 1146104 - RNA, 16 nt, Mycobacterium bovis subsp bovis AF2122/97
gcgccauagccgcgac

SEQ ID NO: 1146105 - RNA, 20 nt, Mycobacterium bovis subsp bovis AF2122/97
gcgccaguagcacguugacg

SEQ ID NO: 1146106 - RNA, 18 nt, Mycobacterium bovis subsp bovis AF2122/97
gcgccaguguggugcggc

SEQ ID NO: 1146107 - RNA, 20 nt, Mycobacterium bovis subsp bovis AF2122/97
gcgccaguucgcggcugcgu

SEQ ID NO: 1146108 - RNA, 17 nt, Mycobacterium bovis subsp bovis AF2122/97
gcgccacgucgacgguc

SEQ ID NO: 1146109 - RNA, 13 nt, Mycobacterium bovis subsp bovis AF2122/97
gcgccacugaccg

SEQ ID NO: 1146110 - RNA, 17 nt, Mycobacterium bovis subsp bovis AF2122/97
gcgccagaacgacaccg

SEQ ID NO: 1146111 - RNA, 23 nt, Mycobacterium bovis subsp bovis AF2122/97
gcgccagaacgacaccgcuugug

SEQ ID NO: 1146112 - RNA, 14 nt, Mycobacterium bovis subsp bovis AF2122/97
gcgccagaucgacg

SEQ ID NO: 1146113 - RNA, 18 nt, Mycobacterium bovis subsp bovis AF2122/97
gcgccgaucaccaccggc

SEQ ID NO: 1146114 - RNA, 19 nt, Mycobacterium bovis subsp bovis AF2122/97
gcgccgaugaccgcaaccg

SEQ ID NO: 1146115 - RNA, 17 nt, Mycobacterium bovis subsp bovis AF2122/97
gcgccgcaccaucggcg

SEQ ID NO: 1146116 - RNA, 14 nt, Mycobacterium bovis subsp bovis AF2122/97
gcgccgcacgccga

SEQ ID NO: 1146117 - RNA, 15 nt, Mycobacterium bovis subsp bovis AF2122/97
gcgccgcacccggga

SEQ ID NO: 1146118 - RNA, 17 nt, Mycobacterium bovis subsp bovis AF2122/97
gcgccgcacggcgacgc

SEQ ID NO: 1146119 - RNA, 19 nt, Mycobacterium bovis subsp bovis AF2122/97
gcgccgcagcaggugcauc

SEQ ID NO: 1146120 - RNA, 21 nt, Mycobacterium bovis subsp bovis AF2122/97
gcgccgcagaucaccgccagc

SEQ ID NO: 1146121 - RNA, 17 nt, Mycobacterium bovis subsp bovis AF2122/97
gcgccgcagaucaccgc

SEQ ID NO: 1146122 - RNA, 17 nt, Mycobacterium bovis subsp bovis AF2122/97
gcgccgaugaacguggc

SEQ ID NO: 1146123 - RNA, 19 nt, Mycobacterium bovis subsp bovis AF2122/97
gcgccgaugaacguggcga

SEQ ID NO: 1146124 - RNA, 20 nt, Mycobacterium bovis subsp bovis AF2122/97
gcgccgaugaacguggcgac

SEQ ID NO: 1146125 - RNA, 16 nt, Mycobacterium bovis subsp bovis AF2122/97
gcgccgaucggcaccg

SEQ ID NO: 1146126 - RNA, 18 nt, Mycobacterium bovis subsp bovis AF2122/97
gcgccgaucacggcaccg

SEQ ID NO: 1146127 - RNA, 22 nt, Mycobacterium bovis subsp bovis AF2122/97
gcgccgaucacggugggcgccg

SEQ ID NO: 1146128 - RNA, 13 nt, Mycobacterium bovis subsp bovis AF2122/97
gcgccgaucagcg

SEQ ID NO: 1146129 - RNA, 14 nt, Mycobacterium bovis subsp bovis AF2122/97
gcgccgaucagcga

SEQ ID NO: 1146130 - RNA, 15 nt, Mycobacterium bovis subsp bovis AF2122/97
gcgccgaucaccacc

SEQ ID NO: 1146131 - RNA, 17 nt, Mycobacterium bovis subsp bovis AF2122/97
gcgccgaucaccaccgg

SEQ ID NO: 1146132 - RNA, 16 nt, Mycobacterium bovis subsp bovis AF2122/97
gcgccgauaccagcca

SEQ ID NO: 1146133 - RNA, 15 nt, Mycobacterium bovis subsp bovis AF2122/97
gcgccgauacccagc

SEQ ID NO: 1146134 - RNA, 23 nt, Mycobacterium bovis subsp bovis AF2122/97
gcgccgauacccagcgggucgcg

SEQ ID NO: 1146135 - RNA, 18 nt, Mycobacterium bovis subsp bovis AF2122/97
gcgccgauaccggcggcg

SEQ ID NO: 1146136 - RNA, 21 nt, Mycobacterium bovis subsp bovis AF2122/97
gcgccgacgaaaucgucgggu

SEQ ID NO: 1146137 - RNA, 18 nt, Mycobacterium bovis subsp bovis AF2122/97
gcgccgacgacuccggca

SEQ ID NO: 1146138 - RNA, 13 nt, Mycobacterium bovis subsp bovis AF2122/97
gcgccgaggucga

SEQ ID NO: 1146139 - RNA, 13 nt, Mycobacterium bovis subsp bovis AF2122/97
gcgccgacccgcg

SEQ ID NO: 1146140 - RNA, 19 nt, Mycobacterium bovis subsp bovis AF2122/97
gcgccgacccgcgcgccgg

SEQ ID NO: 1146141 - RNA, 20 nt, Mycobacterium bovis subsp bovis AF2122/97
gcgccgacccgcgcgccggc

SEQ ID NO: 1146142 - RNA, 23 nt, Mycobacterium bovis subsp bovis AF2122/97
gcgccgacccgcgcgccggcgac

SEQ ID NO: 1146143 - RNA, 18 nt, Mycobacterium bovis subsp bovis AF2122/97
gcgccgacccaacccgau

SEQ ID NO: 1146144 - RNA, 19 nt, Mycobacterium bovis subsp bovis AF2122/97
gcgccgacccguaccagcc

SEQ ID NO: 1146145 - RNA, 18 nt, Mycobacterium bovis subsp bovis AF2122/97
gcgccgaacaccggcucc

SEQ ID NO: 1146146 - RNA, 14 nt, Mycobacterium bovis subsp bovis AF2122/97
gcgccgaacacgca

SEQ ID NO: 1146147 - RNA, 13 nt, Mycobacterium bovis subsp bovis AF2122/97
gcgcccggcgcaa

SEQ ID NO: 1146148 - RNA, 18 nt, Mycobacterium bovis subsp bovis AF2122/97
gcgcccggcgcaagcgcc

SEQ ID NO: 1146149 - RNA, 15 nt, Mycobacterium bovis subsp bovis AF2122/97
gcgcccggcccgcca

SEQ ID NO: 1146150 - RNA, 16 nt, Mycobacterium bovis subsp bovis AF2122/97
gcgcccuucagcacgg

SEQ ID NO: 1146151 - RNA, 16 nt, Mycobacterium bovis subsp bovis AF2122/97
gcgccgaacaccacac

SEQ ID NO: 1146152 - RNA, 17 nt, Mycobacterium bovis subsp bovis AF2122/97
gcgccgaaacagcaccc

SEQ ID NO: 1146153 - RNA, 15 nt, Mycobacterium bovis subsp bovis AF2122/97
gcgcccgcaccaccg

SEQ ID NO: 1146154 - RNA, 16 nt, Mycobacterium bovis subsp bovis AF2122/97
gcgcccgcaccaccgg

SEQ ID NO: 1146155 - RNA, 18 nt, Mycobacterium bovis subsp bovis AF2122/97
gcgcccgcaccaccggcc

SEQ ID NO: 1146156 - RNA, 14 nt, Mycobacterium bovis subsp bovis AF2122/97
gcgcccgcaggugg

SEQ ID NO: 1146157 - RNA, 17 nt, Mycobacterium bovis subsp bovis AF2122/97
gcgcccggauguccgcc

SEQ ID NO: 1146158 - RNA, 14 nt, Mycobacterium bovis subsp bovis AF2122/97
gcgcccggccaagc

SEQ ID NO: 1146159 - RNA, 12 nt, Mycobacterium bovis subsp bovis AF2122/97
gcgcccgccgcg

SEQ ID NO: 1146160 - RNA, 22 nt, Mycobacterium bovis subsp bovis AF2122/97
gcgcccgcccgagccgcugcga

SEQ ID NO: 1146161 - RNA, 23 nt, Mycobacterium bovis subsp bovis AF2122/97
gcgccggaccgucuuuggugccg

SEQ ID NO: 1146162 - RNA, 14 nt, Mycobacterium bovis subsp bovis AF2122/97
gcgccggaccagcu

SEQ ID NO: 1146163 - RNA, 16 nt, Mycobacterium bovis subsp bovis AF2122/97
gcgccggagaucgucg

SEQ ID NO: 1146164 - RNA, 18 nt, Mycobacterium bovis subsp bovis AF2122/97
gcgccggagaucgucgcg

SEQ ID NO: 1146165 - RNA, 23 nt, Mycobacterium bovis subsp bovis AF2122/97
gcgccggagccgcccaagccgcc

SEQ ID NO: 1146166 - RNA, 16 nt, Mycobacterium bovis subsp bovis AF2122/97
gcgccggauccacacc

SEQ ID NO: 1146167 - RNA, 18 nt, Mycobacterium bovis subsp bovis AF2122/97
gcgccggauccacaccga

SEQ ID NO: 1146168 - RNA, 23 nt, Mycobacterium bovis subsp bovis AF2122/97
gcgccggauggguggccagcaac

SEQ ID NO: 1146169 - RNA, 18 nt, Mycobacterium bovis subsp bovis AF2122/97
gcgccggcgcgucggcac

SEQ ID NO: 1146170 - RNA, 13 nt, Mycobacterium bovis subsp bovis AF2122/97
gcgccggcgcugc

SEQ ID NO: 1146171 - RNA, 15 nt, Mycobacterium bovis subsp bovis AF2122/97
gcgccggcgcugcug

SEQ ID NO: 1146172 - RNA, 20 nt, Mycobacterium bovis subsp bovis AF2122/97
gcgccggcggaccccucgac

SEQ ID NO: 1146173 - RNA, 15 nt, Mycobacterium bovis subsp bovis AF2122/97
gcgccggcggccacc

SEQ ID NO: 1146174 - RNA, 24 nt, Mycobacterium bovis subsp bovis AF2122/97
gcgccggcggaccccucgaccgau

SEQ ID NO: 1146175 - RNA, 20 nt, Mycobacterium bovis subsp bovis AF2122/97
gcgccggcgcgucggcaccg

SEQ ID NO: 1146176 - RNA, 11 nt, Mycobacterium bovis subsp bovis AF2122/97
gcgccggcggc

SEQ ID NO: 1146177 - RNA, 15 nt, Mycobacterium bovis subsp bovis AF2122/97
gcgccggcggccgcg

SEQ ID NO: 1146178 - RNA, 16 nt, Mycobacterium bovis subsp bovis AF2122/97
gcgccggcggccaccu

SEQ ID NO: 1146179 - RNA, 14 nt, Mycobacterium bovis subsp bovis AF2122/97
gcgccggcggccgc

SEQ ID NO: 1146180 - RNA, 13 nt, Mycobacterium bovis subsp bovis AF2122/97
gcgccggcgggcg

SEQ ID NO: 1146181 - RNA, 16 nt, Mycobacterium bovis subsp bovis AF2122/97
gcgccggcgucggcgc

SEQ ID NO: 1146182 - RNA, 21 nt, Mycobacterium bovis subsp bovis AF2122/97
gcgccggcgucggucgucggg

SEQ ID NO: 1146183 - RNA, 14 nt, Mycobacterium bovis subsp bovis AF2122/97
gcgccgggcggcgc

SEQ ID NO: 1146184 - RNA, 19 nt, Mycobacterium bovis subsp bovis AF2122/97
gcgccgggcguccgccggc

SEQ ID NO: 1146185 - RNA, 20 nt, Mycobacterium bovis subsp bovis AF2122/97
gcgccggggccgccgaugcc

SEQ ID NO: 1146186 - RNA, 15 nt, Mycobacterium bovis subsp bovis AF2122/97
gcgccggggaccacg

SEQ ID NO: 1146187 - RNA, 19 nt, Mycobacterium bovis subsp bovis AF2122/97
gcgccggggauaccgguca

SEQ ID NO: 1146188 - RNA, 16 nt, Mycobacterium bovis subsp bovis AF2122/97
gcgccggggccgccga

SEQ ID NO: 1146189 - RNA, 17 nt, Mycobacterium bovis subsp bovis AF2122/97
gcgccggggccgccgau

SEQ ID NO: 1146190 - RNA, 14 nt, Mycobacterium bovis subsp bovis AF2122/97
gcgccguagugcgc

SEQ ID NO: 1146191 - RNA, 17 nt, Mycobacterium bovis subsp bovis AF2122/97
gcgccguacagcggcgg

SEQ ID NO: 1146192 - RNA, 19 nt, Mycobacterium bovis subsp bovis AF2122/97
gcgccguacagcggcggcg

SEQ ID NO: 1146193 - RNA, 21 nt, Mycobacterium bovis subsp bovis AF2122/97
gcgccguacagcggcggcguc

SEQ ID NO: 1146194 - RNA, 22 nt, Mycobacterium bovis subsp bovis AF2122/97
gcgccguacguucaccaccgca

SEQ ID NO: 1146195 - RNA, 14 nt, Mycobacterium bovis subsp bovis AF2122/97
gcgccgucaccgau

SEQ ID NO: 1146196 - RNA, 16 nt, Mycobacterium bovis subsp bovis AF2122/97
gcgccgucaccgaucg

SEQ ID NO: 1146197 - RNA, 12 nt, Mycobacterium bovis subsp bovis AF2122/97
gcgccgucagcc

SEQ ID NO: 1146198 - RNA, 20 nt, Mycobacterium bovis subsp bovis AF2122/97
gcgccgucccgaaacgccgg

SEQ ID NO: 1146199 - RNA, 13 nt, Mycobacterium bovis subsp bovis AF2122/97
gcgccgucgucga

SEQ ID NO: 1146200 - RNA, 22 nt, Mycobacterium bovis subsp bovis AF2122/97
gcgccgucguugugccggucga

SEQ ID NO: 1146201 - RNA, 22 nt, Mycobacterium bovis subsp bovis AF2122/97
gcgccgucgucgagcaccaccc

SEQ ID NO: 1146202 - RNA, 14 nt, Mycobacterium bovis subsp bovis AF2122/97
gcgccgucgucgcg

SEQ ID NO: 1146203 - RNA, 18 nt, Mycobacterium bovis subsp bovis AF2122/97
gcgccgucgucgaccacg

SEQ ID NO: 1146204 - RNA, 21 nt, Mycobacterium bovis subsp bovis AF2122/97
gcgccgucgucgagcaccacc

SEQ ID NO: 1146205 - RNA, 14 nt, Mycobacterium bovis subsp bovis AF2122/97
gcgccggugccgcc

SEQ ID NO: 1146206 - RNA, 17 nt, Mycobacterium bovis subsp bovis AF2122/97
gcgccggugccgccggg

SEQ ID NO: 1146207 - RNA, 22 nt, Mycobacterium bovis subsp bovis AF2122/97
gcgccgguuacccggaccgucg

SEQ ID NO: 1146208 - RNA, 20 nt, Mycobacterium bovis subsp bovis AF2122/97
gcgccggugugcgcaccccg

SEQ ID NO: 1146209 - RNA, 21 nt, Mycobacterium bovis subsp bovis AF2122/97
gcgccggugugcgcaccccgc

SEQ ID NO: 1146210 - RNA, 22 nt, Mycobacterium bovis subsp bovis AF2122/97
gcgccguaaagccaacuggucg

SEQ ID NO: 1146211 - RNA, 18 nt, Mycobacterium bovis subsp bovis AF2122/97
gcgccggugguaccggcg

SEQ ID NO: 1146212 - RNA, 19 nt, Mycobacterium bovis subsp bovis AF2122/97
gcgccggugccggccaucg

SEQ ID NO: 1146213 - RNA, 23 nt, Mycobacterium bovis subsp bovis AF2122/97
gcgccgguuacccggaccgucgu

SEQ ID NO: 1146214 - RNA, 13 nt, Mycobacterium bovis subsp bovis AF2122/97
gcgccggugccgc

SEQ ID NO: 1146215 - RNA, 20 nt, Mycobacterium bovis subsp bovis AF2122/97
gcgccggugaggcgaccgga

SEQ ID NO: 1146216 - RNA, 13 nt, Mycobacterium bovis subsp bovis AF2122/97
gcgccggucguca

SEQ ID NO: 1146217 - RNA, 18 nt, Mycobacterium bovis subsp bovis AF2122/97
gcgccggguccgcggaga

SEQ ID NO: 1146218 - RNA, 15 nt, Mycobacterium bovis subsp bovis AF2122/97
gcgccgccgccacca

SEQ ID NO: 1146219 - RNA, 14 nt, Mycobacterium bovis subsp bovis AF2122/97
gcgccgccgaugcc

SEQ ID NO: 1146220 - RNA, 18 nt, Mycobacterium bovis subsp bovis AF2122/97
gcgccgcccgcgccaccg

SEQ ID NO: 1146221 - RNA, 19 nt, Mycobacterium bovis subsp bovis AF2122/97
gcgccgcccgcgcccccgg

SEQ ID NO: 1146222 - RNA, 22 nt, Mycobacterium bovis subsp bovis AF2122/97
gcgccgcccgcgcccccggugc

SEQ ID NO: 1146223 - RNA, 14 nt, Mycobacterium bovis subsp bovis AF2122/97
gcgccgcccgcucc

SEQ ID NO: 1146224 - RNA, 18 nt, Mycobacterium bovis subsp bovis AF2122/97
gcgccgcccgcuccuccg

SEQ ID NO: 1146225 - RNA, 20 nt, Mycobacterium bovis subsp bovis AF2122/97
gcgccgcccgcuccuccggc

SEQ ID NO: 1146226 - RNA, 14 nt, Mycobacterium bovis subsp bovis AF2122/97
gcgccgccggcacc

SEQ ID NO: 1146227 - RNA, 15 nt, Mycobacterium bovis subsp bovis AF2122/97
gcgccgccggcaccg

SEQ ID NO: 1146228 - RNA, 15 nt, Mycobacterium bovis subsp bovis AF2122/97
gcgccgccggcgcgu

SEQ ID NO: 1146229 - RNA, 15 nt, Mycobacterium bovis subsp bovis AF2122/97
gcgccgccggcggcg

SEQ ID NO: 1146230 - RNA, 16 nt, Mycobacterium bovis subsp bovis AF2122/97
gcgccgccggcggcgg

SEQ ID NO: 1146231 - RNA, 14 nt, Mycobacterium bovis subsp bovis AF2122/97
gcgccgccgccgac

SEQ ID NO: 1146232 - RNA, 17 nt, Mycobacterium bovis subsp bovis AF2122/97
gcgccgccgccgacgaa

SEQ ID NO: 1146233 - RNA, 14 nt, Mycobacterium bovis subsp bovis AF2122/97
gcgccgccgcuacc

SEQ ID NO: 1146234 - RNA, 18 nt, Mycobacterium bovis subsp bovis AF2122/97
gcgccgcccaacgcgagc

SEQ ID NO: 1146235 - RNA, 22 nt, Mycobacterium bovis subsp bovis AF2122/97
gcgccgccauugccauacagca

SEQ ID NO: 1146236 - RNA, 18 nt, Mycobacterium bovis subsp bovis AF2122/97
gcgccgccauugucgcca

SEQ ID NO: 1146237 - RNA, 18 nt, Mycobacterium bovis subsp bovis AF2122/97
gcgccgcccgcgccacca

SEQ ID NO: 1146238 - RNA, 16 nt, Mycobacterium bovis subsp bovis AF2122/97
gcgccgccccgcucgg

SEQ ID NO: 1146239 - RNA, 23 nt, Mycobacterium bovis subsp bovis AF2122/97
gcgccgcccaugccuccagaacc

SEQ ID NO: 1146240 - RNA, 20 nt, Mycobacterium bovis subsp bovis AF2122/97
gcgccgccccauacuugcgc

SEQ ID NO: 1146241 - RNA, 16 nt, Mycobacterium bovis subsp bovis AF2122/97
gcgccgcaucggcgaa

SEQ ID NO: 1146242 - RNA, 15 nt, Mycobacterium bovis subsp bovis AF2122/97
gcgccgccagucguc

SEQ ID NO: 1146243 - RNA, 14 nt, Mycobacterium bovis subsp bovis AF2122/97
gcgccgcaucggcg

SEQ ID NO: 1146244 - RNA, 16 nt, Mycobacterium bovis subsp bovis AF2122/97
gcgccgcagggccgcg

SEQ ID NO: 1146245 - RNA, 17 nt, Mycobacterium bovis subsp bovis AF2122/97
gcgccgcauaccaguac

SEQ ID NO: 1146246 - RNA, 14 nt, Mycobacterium bovis subsp bovis AF2122/97
gcgccgcgcuugcg

SEQ ID NO: 1146247 - RNA, 13 nt, Mycobacterium bovis subsp bovis AF2122/97
gcgccgcgcgcgg

SEQ ID NO: 1146248 - RNA, 17 nt, Mycobacterium bovis subsp bovis AF2122/97
gcgccgcgcucgccgau

SEQ ID NO: 1146249 - RNA, 13 nt, Mycobacterium bovis subsp bovis AF2122/97
gcgccgcgcucga

SEQ ID NO: 1146250 - RNA, 21 nt, Mycobacterium bovis subsp bovis AF2122/97
gcgccgcgcuugcgaucggca

SEQ ID NO: 1146251 - RNA, 12 nt, Mycobacterium bovis subsp bovis AF2122/97
gcgccgcggcga

SEQ ID NO: 1146252 - RNA, 14 nt, Mycobacterium bovis subsp bovis AF2122/97
gcgccgcggcgacg

SEQ ID NO: 1146253 - RNA, 18 nt, Mycobacterium bovis subsp bovis AF2122/97
gcgccgcggcggauggcg

SEQ ID NO: 1146254 - RNA, 21 nt, Mycobacterium bovis subsp bovis AF2122/97
gcgccgccggcucgccggcga

SEQ ID NO: 1146255 - RNA, 14 nt, Mycobacterium bovis subsp bovis AF2122/97
gcgccgccggugcc

SEQ ID NO: 1146256 - RNA, 14 nt, Mycobacterium bovis subsp bovis AF2122/97
gcgccgccgucgcc

SEQ ID NO: 1146257 - RNA, 13 nt, Mycobacterium bovis subsp bovis AF2122/97
gcgccgccggcgg

SEQ ID NO: 1146258 - RNA, 18 nt, Mycobacterium bovis subsp bovis AF2122/97
gcgccgccggugccaccg

SEQ ID NO: 1146259 - RNA, 12 nt, Mycobacterium bovis subsp bovis AF2122/97
gcgccgccguug

SEQ ID NO: 1146260 - RNA, 14 nt, Mycobacterium bovis subsp bovis AF2122/97
gcgccgccguugcc

SEQ ID NO: 1146261 - RNA, 20 nt, Mycobacterium bovis subsp bovis AF2122/97
gcgccgccuggacgccgccg

SEQ ID NO: 1146262 - RNA, 16 nt, Mycobacterium bovis subsp bovis AF2122/97
gcgccgccgucgccgc

SEQ ID NO: 1146263 - RNA, 22 nt, Mycobacterium bovis subsp bovis AF2122/97
gcgccgcgacaaaucggucgac

SEQ ID NO: 1146264 - RNA, 15 nt, Mycobacterium bovis subsp bovis AF2122/97
gcgccgcgaggcacc

SEQ ID NO: 1146265 - RNA, 15 nt, Mycobacterium bovis subsp bovis AF2122/97
gcgcaaugccgacgc

SEQ ID NO: 1146266 - RNA, 16 nt, Mycobacterium bovis subsp bovis AF2122/97
gcgcaaugccgacgcc

SEQ ID NO: 1146267 - RNA, 16 nt, Mycobacterium bovis subsp bovis AF2122/97
gcgcacaacccgucga

SEQ ID NO: 1146268 - RNA, 15 nt, Mycobacterium bovis subsp bovis AF2122/97
gcgcaaugcgcgacg

SEQ ID NO: 1146269 - RNA, 16 nt, Mycobacterium bovis subsp bovis AF2122/97
gcgcacaucgcgaaac

SEQ ID NO: 1146270 - RNA, 20 nt, Mycobacterium bovis subsp bovis AF2122/97
gcgcacacuaccgccgcgac

SEQ ID NO: 1146271 - RNA, 18 nt, Mycobacterium bovis subsp bovis AF2122/97
gcgcacauaggcgaucgc

SEQ ID NO: 1146272 - RNA, 14 nt, Mycobacterium bovis subsp bovis AF2122/97
gcgaguugagcaug

SEQ ID NO: 1146273 - RNA, 18 nt, Mycobacterium bovis subsp bovis AF2122/97
gcgaguuucugcucgacc

SEQ ID NO: 1146274 - RNA, 14 nt, Mycobacterium bovis subsp bovis AF2122/97
gcgauagccgccgc

SEQ ID NO: 1146275 - RNA, 15 nt, Mycobacterium bovis subsp bovis AF2122/97
gcgauaggugcucgc

SEQ ID NO: 1146276 - RNA, 19 nt, Mycobacterium bovis subsp bovis AF2122/97
gcgauauaggacgccgcgc

SEQ ID NO: 1146277 - RNA, 16 nt, Mycobacterium bovis subsp bovis AF2122/97
gcgauauccacaaucc

SEQ ID NO: 1146278 - RNA, 21 nt, Mycobacterium bovis subsp bovis AF2122/97
gcgauauccacaauccgcucg

SEQ ID NO: 1146279 - RNA, 13 nt, Mycobacterium bovis subsp bovis AF2122/97
gcgcacccagccc

SEQ ID NO: 1146280 - RNA, 14 nt, Mycobacterium bovis subsp bovis AF2122/97
gcgcacccagccca

SEQ ID NO: 1146281 - RNA, 19 nt, Mycobacterium bovis subsp bovis AF2122/97
gcgcacccagcccagccgu

SEQ ID NO: 1146282 - RNA, 21 nt, Mycobacterium bovis subsp bovis AF2122/97
gcgcaccccgcuugcgcggcu

SEQ ID NO: 1146283 - RNA, 18 nt, Mycobacterium bovis subsp bovis AF2122/97
gcgcacccguccgccgca

SEQ ID NO: 1146284 - RNA, 15 nt, Mycobacterium bovis subsp bovis AF2122/97
gcgcacccgcggguc

SEQ ID NO: 1146285 - RNA, 13 nt, Mycobacterium bovis subsp bovis AF2122/97
gcgcaccggcguc

SEQ ID NO: 1146286 - RNA, 15 nt, Mycobacterium bovis subsp bovis AF2122/97
gcgcaccggcgucgg

SEQ ID NO: 1146287 - RNA, 16 nt, Mycobacterium bovis subsp bovis AF2122/97
gcgcaccggcgucggc

SEQ ID NO: 1146288 - RNA, 20 nt, Mycobacterium bovis subsp bovis AF2122/97
gcgcaccggucaacguggau

SEQ ID NO: 1146289 - RNA, 18 nt, Mycobacterium bovis subsp bovis AF2122/97
gcgcaccggcgucggcgc

SEQ ID NO: 1146290 - RNA, 18 nt, Mycobacterium bovis subsp bovis AF2122/97
gcgcacggcgccgacccg

SEQ ID NO: 1146291 - RNA, 14 nt, Mycobacterium bovis subsp bovis AF2122/97
gcgcacggcgucgg

SEQ ID NO: 1146292 - RNA, 15 nt, Mycobacterium bovis subsp bovis AF2122/97
gcgcacggcccgagc

SEQ ID NO: 1146293 - RNA, 22 nt, Mycobacterium bovis subsp bovis AF2122/97
gcgcacggcccgagccgcgugg

SEQ ID NO: 1146294 - RNA, 15 nt, Mycobacterium bovis subsp bovis AF2122/97
gcgcagaacgaucgc

SEQ ID NO: 1146295 - RNA, 16 nt, Mycobacterium bovis subsp bovis AF2122/97
gcgcacggaccaucgc

SEQ ID NO: 1146296 - RNA, 17 nt, Mycobacterium bovis subsp bovis AF2122/97
gcgcaccuggcgcgcgc

SEQ ID NO: 1146297 - RNA, 22 nt, Mycobacterium bovis subsp bovis AF2122/97
gcgcaccugaucggucaacucg

SEQ ID NO: 1146298 - RNA, 15 nt, Mycobacterium bovis subsp bovis AF2122/97
gcgcaccucggcgaa

SEQ ID NO: 1146299 - RNA, 18 nt, Mycobacterium bovis subsp bovis AF2122/97
gcgcaccgucgcggguca

SEQ ID NO: 1146300 - RNA, 20 nt, Mycobacterium bovis subsp bovis AF2122/97
gcgcagaucgugcacaaucg

SEQ ID NO: 1146301 - RNA, 20 nt, Mycobacterium bovis subsp bovis AF2122/97
gcgcagaugagcgcggcgac

SEQ ID NO: 1146302 - RNA, 21 nt, Mycobacterium bovis subsp bovis AF2122/97
gcgcagaucguccaccgccga

SEQ ID NO: 1146303 - RNA, 21 nt, Mycobacterium bovis subsp bovis AF2122/97
gcgcagaucgaaaucagcccg

SEQ ID NO: 1146304 - RNA, 22 nt, Mycobacterium bovis subsp bovis AF2122/97
gcgcagaucguccaccgccgac

SEQ ID NO: 1146305 - RNA, 18 nt, Mycobacterium bovis subsp bovis AF2122/97
gcgcagauauuccucguc

SEQ ID NO: 1146306 - RNA, 15 nt, Mycobacterium bovis subsp bovis AF2122/97
gcgcagauacgcgug

SEQ ID NO: 1146307 - RNA, 17 nt, Mycobacterium bovis subsp bovis AF2122/97
gcgcagacucgccaccg

SEQ ID NO: 1146308 - RNA, 22 nt, Mycobacterium bovis subsp bovis AF2122/97
gcgcagacucgccaccgcggcg

SEQ ID NO: 1146309 - RNA, 23 nt, Mycobacterium bovis subsp bovis AF2122/97
gcgcagacucgccaccgcggcga

SEQ ID NO: 1146310 - RNA, 20 nt, Mycobacterium bovis subsp bovis AF2122/97
gcgcagagcguuccgcucga

SEQ ID NO: 1146311 - RNA, 16 nt, Mycobacterium bovis subsp bovis AF2122/97
gcgcagaacgaucgcg

SEQ ID NO: 1146312 - RNA, 14 nt, Mycobacterium bovis subsp bovis AF2122/97
gcgcagaaucgccu

SEQ ID NO: 1146313 - RNA, 22 nt, Mycobacterium bovis subsp bovis AF2122/97
gcgcagaacgaucgcgcuggcg

SEQ ID NO: 1146314 - RNA, 14 nt, Mycobacterium bovis subsp bovis AF2122/97
gcgcagcaacucga

SEQ ID NO: 1146315 - RNA, 19 nt, Mycobacterium bovis subsp bovis AF2122/97
gcgcagcaacucgacguca

SEQ ID NO: 1146316 - RNA, 16 nt, Mycobacterium bovis subsp bovis AF2122/97
gcgcagcaacugggcg

SEQ ID NO: 1146317 - RNA, 16 nt, Mycobacterium bovis subsp bovis AF2122/97
gcgcagcacggcggcc

SEQ ID NO: 1146318 - RNA, 16 nt, Mycobacterium bovis subsp bovis AF2122/97
gcgcagcaccggcucg

SEQ ID NO: 1146319 - RNA, 17 nt, Mycobacterium bovis subsp bovis AF2122/97
gcgcagcaccggcucga

SEQ ID NO: 1146320 - RNA, 14 nt, Mycobacterium bovis subsp bovis AF2122/97
gcgcagcacugcgg

SEQ ID NO: 1146321 - RNA, 13 nt, Mycobacterium bovis subsp bovis AF2122/97
gcgcagcagcgug

SEQ ID NO: 1146322 - RNA, 19 nt, Mycobacterium bovis subsp bovis AF2122/97
gcgcagcaucuccgccggu

SEQ ID NO: 1146323 - RNA, 20 nt, Mycobacterium bovis subsp bovis AF2122/97
gcgcagcauaaagaggucgg

SEQ ID NO: 1146324 - RNA, 19 nt, Mycobacterium bovis subsp bovis AF2122/97
gcgcagcauggugcggcgg

SEQ ID NO: 1146325 - RNA, 21 nt, Mycobacterium bovis subsp bovis AF2122/97
gcgcagcauggugcggcggcg

SEQ ID NO: 1146326 - RNA, 24 nt, Mycobacterium bovis subsp bovis AF2122/97
gcgcagauggcauugcgcccaccg

SEQ ID NO: 1146327 - RNA, 15 nt, Mycobacterium bovis subsp bovis AF2122/97
gcgcagccgccgcgc

SEQ ID NO: 1146328 - RNA, 20 nt, Mycobacterium bovis subsp bovis AF2122/97
gcgcagccgcagccgguuaa

SEQ ID NO: 1146329 - RNA, 17 nt, Mycobacterium bovis subsp bovis AF2122/97
gcgcagccggcccgucg

SEQ ID NO: 1146330 - RNA, 20 nt, Mycobacterium bovis subsp bovis AF2122/97
gcgcagccggcccgucgcgu

SEQ ID NO: 1146331 - RNA, 14 nt, Mycobacterium bovis subsp bovis AF2122/97
gcgcagccgcucga

SEQ ID NO: 1146332 - RNA, 19 nt, Mycobacterium bovis subsp bovis AF2122/97
gcgcagccgggcaccgaac

SEQ ID NO: 1146333 - RNA, 17 nt, Mycobacterium bovis subsp bovis AF2122/97
gcgcagccgcucgacgg

SEQ ID NO: 1146334 - RNA, 19 nt, Mycobacterium bovis subsp bovis AF2122/97
gcgcagccuggucgcgcag

SEQ ID NO: 1146335 - RNA, 20 nt, Mycobacterium bovis subsp bovis AF2122/97
gcgcagccuucucgcugacc

SEQ ID NO: 1146336 - RNA, 14 nt, Mycobacterium bovis subsp bovis AF2122/97
gcgcagcgcaacau

SEQ ID NO: 1146337 - RNA, 17 nt, Mycobacterium bovis subsp bovis AF2122/97
gcgcagcgcaacaucga

SEQ ID NO: 1146338 - RNA, 13 nt, Mycobacterium bovis subsp bovis AF2122/97
gcgcagcgaccgg

SEQ ID NO: 1146339 - RNA, 15 nt, Mycobacterium bovis subsp bovis AF2122/97
gcgcagcgccgccac

SEQ ID NO: 1146340 - RNA, 20 nt, Mycobacterium bovis subsp bovis AF2122/97
gcgcagcgccaucgaggucg

SEQ ID NO: 1146341 - RNA, 16 nt, Mycobacterium bovis subsp bovis AF2122/97
gcgcaucgccuccucg

SEQ ID NO: 1146342 - RNA, 15 nt, Mycobacterium bovis subsp bovis AF2122/97
gcgcaguuuggcggc

SEQ ID NO: 1146343 - RNA, 17 nt, Mycobacterium bovis subsp bovis AF2122/97
gcgcauaccggcgucgu

SEQ ID NO: 1146344 - RNA, 18 nt, Mycobacterium bovis subsp bovis AF2122/97
gcgcauaccggcgucguu

SEQ ID NO: 1146345 - RNA, 21 nt, Mycobacterium bovis subsp bovis AF2122/97
gcgcauaccuacccgagaacg

SEQ ID NO: 1146346 - RNA, 20 nt, Mycobacterium bovis subsp bovis AF2122/97
gcgcaucgccgcuggccagc

SEQ ID NO: 1146347 - RNA, 22 nt, Mycobacterium bovis subsp bovis AF2122/97
gcgcagugacgccucgacaccc

SEQ ID NO: 1146348 - RNA, 16 nt, Mycobacterium bovis subsp bovis AF2122/97
gcgcagugacgccucg

SEQ ID NO: 1146349 - RNA, 15 nt, Mycobacterium bovis subsp bovis AF2122/97
gcgcagugcaccgcg

SEQ ID NO: 1146350 - RNA, 18 nt, Mycobacterium bovis subsp bovis AF2122/97
gcgcaguucgucguggau

SEQ ID NO: 1146351 - RNA, 14 nt, Mycobacterium bovis subsp bovis AF2122/97
gcgcaucgucgaaa

SEQ ID NO: 1146352 - RNA, 19 nt, Mycobacterium bovis subsp bovis AF2122/97
gcgcagugcgacucugcgu

SEQ ID NO: 1146353 - RNA, 18 nt, Mycobacterium bovis subsp bovis AF2122/97
gcgcauucgccgggcggc

SEQ ID NO: 1146354 - RNA, 15 nt, Mycobacterium bovis subsp bovis AF2122/97
gcgcauugccgacgc

SEQ ID NO: 1146355 - RNA, 21 nt, Mycobacterium bovis subsp bovis AF2122/97
gcgcauugccgacgcgcggcc

SEQ ID NO: 1146356 - RNA, 22 nt, Mycobacterium bovis subsp bovis AF2122/97
gcgcauugcgcuuccaacacca

SEQ ID NO: 1146357 - RNA, 15 nt, Mycobacterium bovis subsp bovis AF2122/97
gcgcauucccuuguc

SEQ ID NO: 1146358 - RNA, 16 nt, Mycobacterium bovis subsp bovis AF2122/97
gcgcauuucaccgggg

SEQ ID NO: 1146359 - RNA, 22 nt, Mycobacterium bovis subsp bovis AF2122/97
gcgcauguuaugagcgcucggg

SEQ ID NO: 1146360 - RNA, 19 nt, Mycobacterium bovis subsp bovis AF2122/97
gcgcauguugcaggcgcag

SEQ ID NO: 1146361 - RNA, 14 nt, Mycobacterium bovis subsp bovis AF2122/97
gcgccacccgcgcc

SEQ ID NO: 1146362 - RNA, 16 nt, Mycobacterium bovis subsp bovis AF2122/97
gcgccacccgcgccgc

SEQ ID NO: 1146363 - RNA, 18 nt, Mycobacterium bovis subsp bovis AF2122/97
gcgccacccgcgccgccc

SEQ ID NO: 1146364 - RNA, 21 nt, Mycobacterium bovis subsp bovis AF2122/97
gcgccacccgaucgggcguca

SEQ ID NO: 1146365 - RNA, 15 nt, Mycobacterium bovis subsp bovis AF2122/97
gcgccaccggccgcg

SEQ ID NO: 1146366 - RNA, 15 nt, Mycobacterium bovis subsp bovis AF2122/97
gcgccaccggcgccg

SEQ ID NO: 1146367 - RNA, 18 nt, Mycobacterium bovis subsp bovis AF2122/97
gcgccaccggcgccgccc

SEQ ID NO: 1146368 - RNA, 21 nt, Mycobacterium bovis subsp bovis AF2122/97
gcgccaccggcgccgcccgcg

SEQ ID NO: 1146369 - RNA, 24 nt, Mycobacterium bovis subsp bovis AF2122/97
gcgccaccggcguuguugaccagc

SEQ ID NO: 1146370 - RNA, 15 nt, Mycobacterium bovis subsp bovis AF2122/97
gcgccaccgauaccg

SEQ ID NO: 1146371 - RNA, 22 nt, Mycobacterium bovis subsp bovis AF2122/97
gcgccaccgauaccgucagcgc

SEQ ID NO: 1146372 - RNA, 12 nt, Mycobacterium bovis subsp bovis AF2122/97
gcgccaccgccg

SEQ ID NO: 1146373 - RNA, 13 nt, Mycobacterium bovis subsp bovis AF2122/97
gcgccaccgccgc

SEQ ID NO: 1146374 - RNA, 20 nt, Mycobacterium bovis subsp bovis AF2122/97
gcgccaccgucaccgccguu

SEQ ID NO: 1146375 - RNA, 21 nt, Mycobacterium bovis subsp bovis AF2122/97
gcgccaccgucaccgccguug

SEQ ID NO: 1146376 - RNA, 19 nt, Mycobacterium bovis subsp bovis AF2122/97
gcgccaccgucgccguaca

SEQ ID NO: 1146377 - RNA, 18 nt, Mycobacterium bovis subsp bovis AF2122/97
gcgccaccgugguggacg

SEQ ID NO: 1146378 - RNA, 17 nt, Mycobacterium bovis subsp bovis AF2122/97
gcgccaccguugccgaa

SEQ ID NO: 1146379 - RNA, 21 nt, Mycobacterium bovis subsp bovis AF2122/97
gcgccaccguuugcgcaccgg

SEQ ID NO: 1146380 - RNA, 13 nt, Mycobacterium bovis subsp bovis AF2122/97
gcgccaccgagcc

SEQ ID NO: 1146381 - RNA, 15 nt, Mycobacterium bovis subsp bovis AF2122/97
gcgccacgucgacgg

SEQ ID NO: 1146382 - RNA, 17 nt, Mycobacterium bovis subsp bovis AF2122/97
gcgccacugcuuccgga

SEQ ID NO: 1146383 - RNA, 21 nt, Mycobacterium bovis subsp bovis AF2122/97
gcgccacuguagggcuuccag

SEQ ID NO: 1146384 - RNA, 12 nt, Mycobacterium bovis subsp bovis AF2122/97
gcgccaccaccc

SEQ ID NO: 1146385 - RNA, 12 nt, Mycobacterium bovis subsp bovis AF2122/97
gcgccaccagca

SEQ ID NO: 1146386 - RNA, 18 nt, Mycobacterium bovis subsp bovis AF2122/97
gcgccacccagcaccagg

SEQ ID NO: 1146387 - RNA, 20 nt, Mycobacterium bovis subsp bovis AF2122/97
gcgccaccagucacgcccac

SEQ ID NO: 1146388 - RNA, 17 nt, Mycobacterium bovis subsp bovis AF2122/97
gcgccacagcagcguug

SEQ ID NO: 1146389 - RNA, 18 nt, Mycobacterium bovis subsp bovis AF2122/97
gcgccacauacaccggcc

SEQ ID NO: 1146390 - RNA, 19 nt, Mycobacterium bovis subsp bovis AF2122/97
gcgccacauacaccggccg

SEQ ID NO: 1146391 - RNA, 21 nt, Mycobacterium bovis subsp bovis AF2122/97
gcgcauuuuucgccagcugac

SEQ ID NO: 1146392 - RNA, 15 nt, Mycobacterium bovis subsp bovis AF2122/97
gcgcagggcgacauu

SEQ ID NO: 1146393 - RNA, 15 nt, Mycobacterium bovis subsp bovis AF2122/97
gcgcagggcgucggc

SEQ ID NO: 1146394 - RNA, 21 nt, Mycobacterium bovis subsp bovis AF2122/97
gcgcagguaucgguauaacga

SEQ ID NO: 1146395 - RNA, 15 nt, Mycobacterium bovis subsp bovis AF2122/97
gcgcagguacgccuc

SEQ ID NO: 1146396 - RNA, 17 nt, Mycobacterium bovis subsp bovis AF2122/97
gcgcagguagccaucgg

SEQ ID NO: 1146397 - RNA, 19 nt, Mycobacterium bovis subsp bovis AF2122/97
gcgcagguagcgccgcacu

SEQ ID NO: 1146398 - RNA, 15 nt, Mycobacterium bovis subsp bovis AF2122/97
gcgcagguagucgac

SEQ ID NO: 1146399 - RNA, 22 nt, Mycobacterium bovis subsp bovis AF2122/97
gcgcagguagucgacgacgugg

SEQ ID NO: 1146400 - RNA, 20 nt, Mycobacterium bovis subsp bovis AF2122/97
gcgcaggcuuccagccacag

SEQ ID NO: 1146401 - RNA, 16 nt, Mycobacterium bovis subsp bovis AF2122/97
gcgcaggaagccggcg

SEQ ID NO: 1146402 - RNA, 12 nt, Mycobacterium bovis subsp bovis AF2122/97
gcgcaggccgcc

SEQ ID NO: 1146403 - RNA, 15 nt, Mycobacterium bovis subsp bovis AF2122/97
gcgcagcugacguca

SEQ ID NO: 1146404 - RNA, 21 nt, Mycobacterium bovis subsp bovis AF2122/97
gcgcaggaagcccacgaucgc

SEQ ID NO: 1146405 - RNA, 23 nt, Mycobacterium bovis subsp bovis AF2122/97
gcgcaggaagcccacgaucgcgu

SEQ ID NO: 1146406 - RNA, 18 nt, Mycobacterium bovis subsp bovis AF2122/97
gcgcagcuuggccagcca

SEQ ID NO: 1146407 - RNA, 19 nt, Mycobacterium bovis subsp bovis AF2122/97
gcgcagcuuggccagccac

SEQ ID NO: 1146408 - RNA, 14 nt, Mycobacterium bovis subsp bovis AF2122/97
gcgcaggccgccgc

SEQ ID NO: 1146409 - RNA, 22 nt, Mycobacterium bovis subsp bovis AF2122/97
gcgcagcuccaccgugacggcc

SEQ ID NO: 1146410 - RNA, 22 nt, Mycobacterium bovis subsp bovis AF2122/97
gcgcagcuaugucaccugggcc

SEQ ID NO: 1146411 - RNA, 19 nt, Mycobacterium bovis subsp bovis AF2122/97
gcgcagcuaacccgccacg

SEQ ID NO: 1146412 - RNA, 16 nt, Mycobacterium bovis subsp bovis AF2122/97
gcgcagcgugcgaugc

SEQ ID NO: 1146413 - RNA, 17 nt, Mycobacterium bovis subsp bovis AF2122/97
gcgcagcgcggcggcau

SEQ ID NO: 1146414 - RNA, 19 nt, Mycobacterium bovis subsp bovis AF2122/97
gcgcagcgcggcggcaucu

SEQ ID NO: 1146415 - RNA, 12 nt, Mycobacterium bovis subsp bovis AF2122/97
gcgcagcgcggc

SEQ ID NO: 1146416 - RNA, 18 nt, Mycobacterium bovis subsp bovis AF2122/97
gccgguugucgcagcgca

SEQ ID NO: 1146417 - RNA, 14 nt, Mycobacterium bovis subsp bovis AF2122/97
gccgguuggccagc

SEQ ID NO: 1146418 - RNA, 17 nt, Mycobacterium bovis subsp bovis AF2122/97
gccgguuggccagccac

SEQ ID NO: 1146419 - RNA, 14 nt, Mycobacterium bovis subsp bovis AF2122/97
gccgguugcggcug

SEQ ID NO: 1146420 - RNA, 23 nt, Mycobacterium bovis subsp bovis AF2122/97
gccgguucgcccagcaggcccuu

SEQ ID NO: 1146421 - RNA, 15 nt, Mycobacterium bovis subsp bovis AF2122/97
gccgguuccgccggc

SEQ ID NO: 1146422 - RNA, 21 nt, Mycobacterium bovis subsp bovis AF2122/97
gccgguuccgccggccccacc

SEQ ID NO: 1146423 - RNA, 14 nt, Mycobacterium bovis subsp bovis AF2122/97
gccgguugccaccu

SEQ ID NO: 1146424 - RNA, 14 nt, Mycobacterium bovis subsp bovis AF2122/97
gccguaaagccaac

SEQ ID NO: 1146425 - RNA, 21 nt, Mycobacterium bovis subsp bovis AF2122/97
gccguaaagccaacuggucgc

SEQ ID NO: 1146426 - RNA, 17 nt, Mycobacterium bovis subsp bovis AF2122/97
gccgguuggcugccggc

SEQ ID NO: 1146427 - RNA, 19 nt, Mycobacterium bovis subsp bovis AF2122/97
gccguagguugcgccccga

SEQ ID NO: 1146428 - RNA, 18 nt, Mycobacterium bovis subsp bovis AF2122/97
gccguaguaaggagccgg

SEQ ID NO: 1146429 - RNA, 17 nt, Mycobacterium bovis subsp bovis AF2122/97
gccguaguaguggccgc

SEQ ID NO: 1146430 - RNA, 16 nt, Mycobacterium bovis subsp bovis AF2122/97
gccguagcgcagcgcc

SEQ ID NO: 1146431 - RNA, 13 nt, Mycobacterium bovis subsp bovis AF2122/97
gccguagccgccg

SEQ ID NO: 1146432 - RNA, 14 nt, Mycobacterium bovis subsp bovis AF2122/97
gccguagccgccgu

SEQ ID NO: 1146433 - RNA, 17 nt, Mycobacterium bovis subsp bovis AF2122/97
gccguagcccacgacga

SEQ ID NO: 1146434 - RNA, 18 nt, Mycobacterium bovis subsp bovis AF2122/97
gccguacagcccggccuu

SEQ ID NO: 1146435 - RNA, 15 nt, Mycobacterium bovis subsp bovis AF2122/97
gccguacagcgcaaa

SEQ ID NO: 1146436 - RNA, 19 nt, Mycobacterium bovis subsp bovis AF2122/97
gccguacaucagcgcgaac

SEQ ID NO: 1146437 - RNA, 14 nt, Mycobacterium bovis subsp bovis AF2122/97
gccggucggugcgg

SEQ ID NO: 1146438 - RNA, 17 nt, Mycobacterium bovis subsp bovis AF2122/97
gccggucggugcggaac

SEQ ID NO: 1146439 - RNA, 12 nt, Mycobacterium bovis subsp bovis AF2122/97
gccggucggcgu

SEQ ID NO: 1146440 - RNA, 14 nt, Mycobacterium bovis subsp bovis AF2122/97
gccggucggcgucg

SEQ ID NO: 1146441 - RNA, 23 nt, Mycobacterium bovis subsp bovis AF2122/97
gccggucgucaguaauucggcca

SEQ ID NO: 1146442 - RNA, 14 nt, Mycobacterium bovis subsp bovis AF2122/97
gccggucggcacca

SEQ ID NO: 1146443 - RNA, 17 nt, Mycobacterium bovis subsp bovis AF2122/97
gccggucuccgaacggg

SEQ ID NO: 1146444 - RNA, 21 nt, Mycobacterium bovis subsp bovis AF2122/97
gccggucguuugcgccaggag

SEQ ID NO: 1146445 - RNA, 18 nt, Mycobacterium bovis subsp bovis AF2122/97
gccggugccgggcaccac

SEQ ID NO: 1146446 - RNA, 14 nt, Mycobacterium bovis subsp bovis AF2122/97
gccggugccggcgc

SEQ ID NO: 1146447 - RNA, 16 nt, Mycobacterium bovis subsp bovis AF2122/97
gccggugccggcgcac

SEQ ID NO: 1146448 - RNA, 15 nt, Mycobacterium bovis subsp bovis AF2122/97
gccggugccgccggg

SEQ ID NO: 1146449 - RNA, 14 nt, Mycobacterium bovis subsp bovis AF2122/97
gccggugccgccgu

SEQ ID NO: 1146450 - RNA, 16 nt, Mycobacterium bovis subsp bovis AF2122/97
gccggugccgccuccg

SEQ ID NO: 1146451 - RNA, 13 nt, Mycobacterium bovis subsp bovis AF2122/97
gccggugccggcg

SEQ ID NO: 1146452 - RNA, 14 nt, Mycobacterium bovis subsp bovis AF2122/97
gccggugccgccgg

SEQ ID NO: 1146453 - RNA, 12 nt, Mycobacterium bovis subsp bovis AF2122/97
gccggugccgcc

SEQ ID NO: 1146454 - RNA, 13 nt, Mycobacterium bovis subsp bovis AF2122/97
gccggugccgcca

SEQ ID NO: 1146455 - RNA, 18 nt, Mycobacterium bovis subsp bovis AF2122/97
gccggugccgccgcggcc

SEQ ID NO: 1146456 - RNA, 19 nt, Mycobacterium bovis subsp bovis AF2122/97
gccggugccgccgcggcca

SEQ ID NO: 1146457 - RNA, 18 nt, Mycobacterium bovis subsp bovis AF2122/97
gccggugccgacggcgcc

SEQ ID NO: 1146458 - RNA, 20 nt, Mycobacterium bovis subsp bovis AF2122/97
gccggugccgacggcgccga

SEQ ID NO: 1146459 - RNA, 16 nt, Mycobacterium bovis subsp bovis AF2122/97
gccggugccgaucagc

SEQ ID NO: 1146460 - RNA, 19 nt, Mycobacterium bovis subsp bovis AF2122/97
gccggugugcaggaucacg

SEQ ID NO: 1146461 - RNA, 15 nt, Mycobacterium bovis subsp bovis AF2122/97
gccggugugcgcacc

SEQ ID NO: 1146462 - RNA, 16 nt, Mycobacterium bovis subsp bovis AF2122/97
gccggugugcgcaccc

SEQ ID NO: 1146463 - RNA, 17 nt, Mycobacterium bovis subsp bovis AF2122/97
gccggugugcggcguac

SEQ ID NO: 1146464 - RNA, 15 nt, Mycobacterium bovis subsp bovis AF2122/97
gccgguguguccagc

SEQ ID NO: 1146465 - RNA, 21 nt, Mycobacterium bovis subsp bovis AF2122/97
gccgguguguccagcggaucg

SEQ ID NO: 1146466 - RNA, 13 nt, Mycobacterium bovis subsp bovis AF2122/97
gccggugcgcccu

SEQ ID NO: 1146467 - RNA, 22 nt, Mycobacterium bovis subsp bovis AF2122/97
gccggugcgcccugcgauacca

SEQ ID NO: 1146468 - RNA, 13 nt, Mycobacterium bovis subsp bovis AF2122/97
gccggugcgcacc

SEQ ID NO: 1146469 - RNA, 14 nt, Mycobacterium bovis subsp bovis AF2122/97
gccggugcgcacca

SEQ ID NO: 1146470 - RNA, 23 nt, Mycobacterium bovis subsp bovis AF2122/97
gccggugucucccuugccgccau

SEQ ID NO: 1146471 - RNA, 16 nt, Mycobacterium bovis subsp bovis AF2122/97
gccgguguugccgccg

SEQ ID NO: 1146472 - RNA, 23 nt, Mycobacterium bovis subsp bovis AF2122/97
gccgguguugccguuaccgccaa

SEQ ID NO: 1146473 - RNA, 21 nt, Mycobacterium bovis subsp bovis AF2122/97
gccgguguuguaggccgggcc

SEQ ID NO: 1146474 - RNA, 21 nt, Mycobacterium bovis subsp bovis AF2122/97
gccgguguuuccgaaacccgc

SEQ ID NO: 1146475 - RNA, 17 nt, Mycobacterium bovis subsp bovis AF2122/97
gccgguguuagccccga

SEQ ID NO: 1146476 - RNA, 12 nt, Mycobacterium bovis subsp bovis AF2122/97
gccgguucggcg

SEQ ID NO: 1146477 - RNA, 13 nt, Mycobacterium bovis subsp bovis AF2122/97
gccgguucggcga

SEQ ID NO: 1146478 - RNA, 14 nt, Mycobacterium bovis subsp bovis AF2122/97
gccgguucggcgau

SEQ ID NO: 1146479 - RNA, 21 nt, Mycobacterium bovis subsp bovis AF2122/97
gccgguucaccaugucggcca

SEQ ID NO: 1146480 - RNA, 23 nt, Mycobacterium bovis subsp bovis AF2122/97
gccgguucccuuguucccgaaac

SEQ ID NO: 1146481 - RNA, 20 nt, Mycobacterium bovis subsp bovis AF2122/97
gccgggggcaccguuaccgc

SEQ ID NO: 1146482 - RNA, 15 nt, Mycobacterium bovis subsp bovis AF2122/97
gccgggggcgccgcc

SEQ ID NO: 1146483 - RNA, 17 nt, Mycobacterium bovis subsp bovis AF2122/97
gccgggggcgccgccgu

SEQ ID NO: 1146484 - RNA, 22 nt, Mycobacterium bovis subsp bovis AF2122/97
gccgggguaggggucgaggucu

SEQ ID NO: 1146485 - RNA, 14 nt, Mycobacterium bovis subsp bovis AF2122/97
gccggggcugccga

SEQ ID NO: 1146486 - RNA, 17 nt, Mycobacterium bovis subsp bovis AF2122/97
gccggggcugccgaaca

SEQ ID NO: 1146487 - RNA, 13 nt, Mycobacterium bovis subsp bovis AF2122/97
gccggggccaccc

SEQ ID NO: 1146488 - RNA, 19 nt, Mycobacterium bovis subsp bovis AF2122/97
gccggggccccaugccgac

SEQ ID NO: 1146489 - RNA, 21 nt, Mycobacterium bovis subsp bovis AF2122/97
gccggggccccaugccgaccg

SEQ ID NO: 1146490 - RNA, 14 nt, Mycobacterium bovis subsp bovis AF2122/97
gccggggccgccga

SEQ ID NO: 1146491 - RNA, 15 nt, Mycobacterium bovis subsp bovis AF2122/97
gccggggccgccgau

SEQ ID NO: 1146492 - RNA, 16 nt, Mycobacterium bovis subsp bovis AF2122/97
gccggggccgccgaug

SEQ ID NO: 1146493 - RNA, 17 nt, Mycobacterium bovis subsp bovis AF2122/97
gccggggcgaugucggc

SEQ ID NO: 1146494 - RNA, 13 nt, Mycobacterium bovis subsp bovis AF2122/97
gccggggcaacga

SEQ ID NO: 1146495 - RNA, 16 nt, Mycobacterium bovis subsp bovis AF2122/97
gccggggccgcuggcg

SEQ ID NO: 1146496 - RNA, 14 nt, Mycobacterium bovis subsp bovis AF2122/97
gccggguccgccgg

SEQ ID NO: 1146497 - RNA, 18 nt, Mycobacterium bovis subsp bovis AF2122/97
gccggguccgcggagaac

SEQ ID NO: 1146498 - RNA, 21 nt, Mycobacterium bovis subsp bovis AF2122/97
gccgggucgaacaggccggcc

SEQ ID NO: 1146499 - RNA, 15 nt, Mycobacterium bovis subsp bovis AF2122/97
gccgggucgaucacc

SEQ ID NO: 1146500 - RNA, 18 nt, Mycobacterium bovis subsp bovis AF2122/97
gccgggucgaucaccgac

SEQ ID NO: 1146501 - RNA, 16 nt, Mycobacterium bovis subsp bovis AF2122/97
gccgggucgcgcuggc

SEQ ID NO: 1146502 - RNA, 17 nt, Mycobacterium bovis subsp bovis AF2122/97
gccgggucgcgcuggcg

SEQ ID NO: 1146503 - RNA, 14 nt, Mycobacterium bovis subsp bovis AF2122/97
gccgggucaccgau

SEQ ID NO: 1146504 - RNA, 17 nt, Mycobacterium bovis subsp bovis AF2122/97
gccgggucacgugggcc

SEQ ID NO: 1146505 - RNA, 19 nt, Mycobacterium bovis subsp bovis AF2122/97
gccgggucacgugggccau

SEQ ID NO: 1146506 - RNA, 15 nt, Mycobacterium bovis subsp bovis AF2122/97
gccgggguggcgcgc

SEQ ID NO: 1146507 - RNA, 19 nt, Mycobacterium bovis subsp bovis AF2122/97
gccgggguggcgcgccaac

SEQ ID NO: 1146508 - RNA, 17 nt, Mycobacterium bovis subsp bovis AF2122/97
gccgggguucaccgucg

SEQ ID NO: 1146509 - RNA, 13 nt, Mycobacterium bovis subsp bovis AF2122/97
gccggggucgaac

SEQ ID NO: 1146510 - RNA, 18 nt, Mycobacterium bovis subsp bovis AF2122/97
gccgggguagacgccccg

SEQ ID NO: 1146511 - RNA, 14 nt, Mycobacterium bovis subsp bovis AF2122/97
gccgguaggcggcc

SEQ ID NO: 1146512 - RNA, 20 nt, Mycobacterium bovis subsp bovis AF2122/97
gccgguagcugucgccuuug

SEQ ID NO: 1146513 - RNA, 16 nt, Mycobacterium bovis subsp bovis AF2122/97
gccggucaggccgccg

SEQ ID NO: 1146514 - RNA, 20 nt, Mycobacterium bovis subsp bovis AF2122/97
gccggucaggccgccgcggc

SEQ ID NO: 1146515 - RNA, 21 nt, Mycobacterium bovis subsp bovis AF2122/97
gccggucaggccgccgcggcg

SEQ ID NO: 1146516 - RNA, 16 nt, Mycobacterium bovis subsp bovis AF2122/97
gccgguaggcggccag

SEQ ID NO: 1146517 - RNA, 22 nt, Mycobacterium bovis subsp bovis AF2122/97
gccggucaggcaguccaccgcg

SEQ ID NO: 1146518 - RNA, 20 nt, Mycobacterium bovis subsp bovis AF2122/97
gccggucauuucaacguauc

SEQ ID NO: 1146519 - RNA, 17 nt, Mycobacterium bovis subsp bovis AF2122/97
gccgguccagacccagc

SEQ ID NO: 1146520 - RNA, 22 nt, Mycobacterium bovis subsp bovis AF2122/97
gccgguccagacccagcucguc

SEQ ID NO: 1146521 - RNA, 18 nt, Mycobacterium bovis subsp bovis AF2122/97
gccgguccagcagcucgg

SEQ ID NO: 1146522 - RNA, 20 nt, Mycobacterium bovis subsp bovis AF2122/97
gccgguccagcagcucggcc

SEQ ID NO: 1146523 - RNA, 21 nt, Mycobacterium bovis subsp bovis AF2122/97
gccgguccagcagcucggccg

SEQ ID NO: 1146524 - RNA, 21 nt, Mycobacterium bovis subsp bovis AF2122/97
gccggucauccgggcgaccac

SEQ ID NO: 1146525 - RNA, 23 nt, Mycobacterium bovis subsp bovis AF2122/97
gccggucauccgggcgaccacca

SEQ ID NO: 1146526 - RNA, 22 nt, Mycobacterium bovis subsp bovis AF2122/97
gccggucaugauccgaacuucg

SEQ ID NO: 1146527 - RNA, 18 nt, Mycobacterium bovis subsp bovis AF2122/97
gccggucaguauggcgac

SEQ ID NO: 1146528 - RNA, 19 nt, Mycobacterium bovis subsp bovis AF2122/97
gccgguccauggacggcca

SEQ ID NO: 1146529 - RNA, 23 nt, Mycobacterium bovis subsp bovis AF2122/97
gccgguccccccguugccgccgu

SEQ ID NO: 1146530 - RNA, 16 nt, Mycobacterium bovis subsp bovis AF2122/97
gccgguccccgccggc

SEQ ID NO: 1146531 - RNA, 17 nt, Mycobacterium bovis subsp bovis AF2122/97
gccgguccccgccggcg

SEQ ID NO: 1146532 - RNA, 18 nt, Mycobacterium bovis subsp bovis AF2122/97
gccgguccccgccggcgg

SEQ ID NO: 1146533 - RNA, 13 nt, Mycobacterium bovis subsp bovis AF2122/97
gccggucgccggc

SEQ ID NO: 1146534 - RNA, 18 nt, Mycobacterium bovis subsp bovis AF2122/97
gccggucgccggcugggg

SEQ ID NO: 1146535 - RNA, 13 nt, Mycobacterium bovis subsp bovis AF2122/97
gccggucggaucg

SEQ ID NO: 1146536 - RNA, 13 nt, Mycobacterium bovis subsp bovis AF2122/97
gccgguaccggcg

SEQ ID NO: 1146537 - RNA, 23 nt, Mycobacterium bovis subsp bovis AF2122/97
gccgguaccgggacgaaucccgc

SEQ ID NO: 1146538 - RNA, 19 nt, Mycobacterium bovis subsp bovis AF2122/97
gccgggucguacaacacgg

SEQ ID NO: 1146539 - RNA, 14 nt, Mycobacterium bovis subsp bovis AF2122/97
gccgggucggugac

SEQ ID NO: 1146540 - RNA, 14 nt, Mycobacterium bovis subsp bovis AF2122/97
gccgggugcaggcg

SEQ ID NO: 1146541 - RNA, 15 nt, Mycobacterium bovis subsp bovis AF2122/97
gccgggugccacaac

SEQ ID NO: 1146542 - RNA, 15 nt, Mycobacterium bovis subsp bovis AF2122/97
gccgggugccgccac

SEQ ID NO: 1146543 - RNA, 13 nt, Mycobacterium bovis subsp bovis AF2122/97
gccggguggccac

SEQ ID NO: 1146544 - RNA, 21 nt, Mycobacterium bovis subsp bovis AF2122/97
gccggguggccacgcccaggc

SEQ ID NO: 1146545 - RNA, 23 nt, Mycobacterium bovis subsp bovis AF2122/97
gccgguacacguccaguggcagc

SEQ ID NO: 1146546 - RNA, 16 nt, Mycobacterium bovis subsp bovis AF2122/97
gccggguccagcccgg

SEQ ID NO: 1146547 - RNA, 23 nt, Mycobacterium bovis subsp bovis AF2122/97
gccgggugaggcggugacgaagc

SEQ ID NO: 1146548 - RNA, 23 nt, Mycobacterium bovis subsp bovis AF2122/97
gccgggugcgccguugccgccgu

SEQ ID NO: 1146549 - RNA, 22 nt, Mycobacterium bovis subsp bovis AF2122/97
gccgggugcgugcgcgucggug

SEQ ID NO: 1146550 - RNA, 13 nt, Mycobacterium bovis subsp bovis AF2122/97
gccgggcguccgc

SEQ ID NO: 1146551 - RNA, 18 nt, Mycobacterium bovis subsp bovis AF2122/97
gccgggcguccgccggcg

SEQ ID NO: 1146552 - RNA, 19 nt, Mycobacterium bovis subsp bovis AF2122/97
gccgggcguccgccggcga

SEQ ID NO: 1146553 - RNA, 12 nt, Mycobacterium bovis subsp bovis AF2122/97
gccgggcgguag

SEQ ID NO: 1146554 - RNA, 21 nt, Mycobacterium bovis subsp bovis AF2122/97
gccgggcggccaggcgcgacg

SEQ ID NO: 1146555 - RNA, 22 nt, Mycobacterium bovis subsp bovis AF2122/97
gccgggcgcuugcaccaggggc

SEQ ID NO: 1146556 - RNA, 22 nt, Mycobacterium bovis subsp bovis AF2122/97
gccgggcggccucguugaccgg

SEQ ID NO: 1146557 - RNA, 13 nt, Mycobacterium bovis subsp bovis AF2122/97
gccgggcggcagc

SEQ ID NO: 1146558 - RNA, 17 nt, Mycobacterium bovis subsp bovis AF2122/97
gccgggcgucgcuggug

SEQ ID NO: 1146559 - RNA, 18 nt, Mycobacterium bovis subsp bovis AF2122/97
gccgggcuccccaagucg

SEQ ID NO: 1146560 - RNA, 18 nt, Mycobacterium bovis subsp bovis AF2122/97
gccgggcugaggcggcga

SEQ ID NO: 1146561 - RNA, 19 nt, Mycobacterium bovis subsp bovis AF2122/97
gccgggcuuaggccgcggc

SEQ ID NO: 1146562 - RNA, 21 nt, Mycobacterium bovis subsp bovis AF2122/97
gccgggcuuaggccgcggcac

SEQ ID NO: 1146563 - RNA, 21 nt, Mycobacterium bovis subsp bovis AF2122/97
gccggggaguggaaacccgcc

SEQ ID NO: 1146564 - RNA, 20 nt, Mycobacterium bovis subsp bovis AF2122/97
gccggggacgccgcggcgcc

SEQ ID NO: 1146565 - RNA, 19 nt, Mycobacterium bovis subsp bovis AF2122/97
gccggggaacuuaccgagg

SEQ ID NO: 1146566 - RNA, 16 nt, Mycobacterium bovis subsp bovis AF2122/97
gccggggaccacggug

SEQ ID NO: 1146567 - RNA, 13 nt, Mycobacterium bovis subsp bovis AF2122/97
gccgggcuuggcc

SEQ ID NO: 1146568 - RNA, 15 nt, Mycobacterium bovis subsp bovis AF2122/97
gccgggcuuggccgc

SEQ ID NO: 1146569 - RNA, 16 nt, Mycobacterium bovis subsp bovis AF2122/97
gccgggcuuggccgcg

SEQ ID NO: 1146570 - RNA, 12 nt, Mycobacterium bovis subsp bovis AF2122/97
gccgggccgucc

SEQ ID NO: 1146571 - RNA, 19 nt, Mycobacterium bovis subsp bovis AF2122/97
gccgggccguguccgccgg

SEQ ID NO: 1146572 - RNA, 19 nt, Mycobacterium bovis subsp bovis AF2122/97
gccgggccugcaccacggc

SEQ ID NO: 1146573 - RNA, 22 nt, Mycobacterium bovis subsp bovis AF2122/97
gccgggcgacgguuucgaccac

SEQ ID NO: 1146574 - RNA, 18 nt, Mycobacterium bovis subsp bovis AF2122/97
gccgggcgaguacaggcg

SEQ ID NO: 1146575 - RNA, 17 nt, Mycobacterium bovis subsp bovis AF2122/97
gccgggcgaugcugggc

SEQ ID NO: 1146576 - RNA, 19 nt, Mycobacterium bovis subsp bovis AF2122/97
gccgggcgcaagcagcccg

SEQ ID NO: 1146577 - RNA, 22 nt, Mycobacterium bovis subsp bovis AF2122/97
gccgggcgaguacaggcgcagc

SEQ ID NO: 1146578 - RNA, 15 nt, Mycobacterium bovis subsp bovis AF2122/97
gccgggcgcuggacg

SEQ ID NO: 1146579 - RNA, 15 nt, Mycobacterium bovis subsp bovis AF2122/97
gccgggcgcgccggc

SEQ ID NO: 1146580 - RNA, 15 nt, Mycobacterium bovis subsp bovis AF2122/97
gccgggccaggccga

SEQ ID NO: 1146581 - RNA, 13 nt, Mycobacterium bovis subsp bovis AF2122/97
gccgggcccagca

SEQ ID NO: 1146582 - RNA, 17 nt, Mycobacterium bovis subsp bovis AF2122/97
gccgggccgagugccca

SEQ ID NO: 1146583 - RNA, 15 nt, Mycobacterium bovis subsp bovis AF2122/97
gccgggccgccgagc

SEQ ID NO: 1146584 - RNA, 22 nt, Mycobacterium bovis subsp bovis AF2122/97
gccgggccgcgcgggccgccgc

SEQ ID NO: 1146585 - RNA, 20 nt, Mycobacterium bovis subsp bovis AF2122/97
gccgggcaguguggucauug

SEQ ID NO: 1146586 - RNA, 18 nt, Mycobacterium bovis subsp bovis AF2122/97
gccgggccacggcugacc

SEQ ID NO: 1146587 - RNA, 17 nt, Mycobacterium bovis subsp bovis AF2122/97
gccgggcagucaggccu

SEQ ID NO: 1146588 - RNA, 22 nt, Mycobacterium bovis subsp bovis AF2122/97
gccgcugaauuggcgccgauga

SEQ ID NO: 1146589 - RNA, 18 nt, Mycobacterium bovis subsp bovis AF2122/97
gccgcugacuccugcggc

SEQ ID NO: 1146590 - RNA, 20 nt, Mycobacterium bovis subsp bovis AF2122/97
gccgcugacuccugcggcac

SEQ ID NO: 1146591 - RNA, 14 nt, Mycobacterium bovis subsp bovis AF2122/97
gccgcugaucaaca

SEQ ID NO: 1146592 - RNA, 18 nt, Mycobacterium bovis subsp bovis AF2122/97
gccgcugaucugccgccg

SEQ ID NO: 1146593 - RNA, 19 nt, Mycobacterium bovis subsp bovis AF2122/97
gccggcguagaucaucagc

SEQ ID NO: 1146594 - RNA, 24 nt, Mycobacterium bovis subsp bovis AF2122/97
gccggcgucagccccgacugcgcc

SEQ ID NO: 1146595 - RNA, 16 nt, Mycobacterium bovis subsp bovis AF2122/97
gccggcguagcggcga

SEQ ID NO: 1146596 - RNA, 17 nt, Mycobacterium bovis subsp bovis AF2122/97
gccggcguagcggcgau

SEQ ID NO: 1146597 - RNA, 19 nt, Mycobacterium bovis subsp bovis AF2122/97
gccggcguagcggcgauac

SEQ ID NO: 1146598 - RNA, 15 nt, Mycobacterium bovis subsp bovis AF2122/97
gccggcgucgagccg

SEQ ID NO: 1146599 - RNA, 15 nt, Mycobacterium bovis subsp bovis AF2122/97
gccggcgucgcuggc

SEQ ID NO: 1146600 - RNA, 16 nt, Mycobacterium bovis subsp bovis AF2122/97
gccggcgucgcuggcc

SEQ ID NO: 1146601 - RNA, 21 nt, Mycobacterium bovis subsp bovis AF2122/97
gccggcgucgaugacgacgcc

SEQ ID NO: 1146602 - RNA, 16 nt, Mycobacterium bovis subsp bovis AF2122/97
gccggcguugccgaaa

SEQ ID NO: 1146603 - RNA, 22 nt, Mycobacterium bovis subsp bovis AF2122/97
gccggcguugccgaaacccgag

SEQ ID NO: 1146604 - RNA, 16 nt, Mycobacterium bovis subsp bovis AF2122/97
gccggcguugccgccg

SEQ ID NO: 1146605 - RNA, 18 nt, Mycobacterium bovis subsp bovis AF2122/97
gccggcguugccgccguc

SEQ ID NO: 1146606 - RNA, 13 nt, Mycobacterium bovis subsp bovis AF2122/97
gccggcguuggcc

SEQ ID NO: 1146607 - RNA, 20 nt, Mycobacterium bovis subsp bovis AF2122/97
gccggcguuggccauggcca

SEQ ID NO: 1146608 - RNA, 23 nt, Mycobacterium bovis subsp bovis AF2122/97
gccggcguuggccauggccagug

SEQ ID NO: 1146609 - RNA, 19 nt, Mycobacterium bovis subsp bovis AF2122/97
gccggcuaccgcgcucccg

SEQ ID NO: 1146610 - RNA, 21 nt, Mycobacterium bovis subsp bovis AF2122/97
gccggcuagauaacccaaccg

SEQ ID NO: 1146611 - RNA, 22 nt, Mycobacterium bovis subsp bovis AF2122/97
gccggcuagcucggcggcuacc

SEQ ID NO: 1146612 - RNA, 12 nt, Mycobacterium bovis subsp bovis AF2122/97
gccggcuagggc

SEQ ID NO: 1146613 - RNA, 18 nt, Mycobacterium bovis subsp bovis AF2122/97
gccggcuagggcagcagc

SEQ ID NO: 1146614 - RNA, 15 nt, Mycobacterium bovis subsp bovis AF2122/97
gccggcuagggcccu

SEQ ID NO: 1146615 - RNA, 23 nt, Mycobacterium bovis subsp bovis AF2122/97
gccggcuaccgccuugucggcga

SEQ ID NO: 1146616 - RNA, 22 nt, Mycobacterium bovis subsp bovis AF2122/97
gccggcuaccgccuugucggcg

SEQ ID NO: 1146617 - RNA, 22 nt, Mycobacterium bovis subsp bovis AF2122/97
gccggcucaggugugugacgau

SEQ ID NO: 1146618 - RNA, 17 nt, Mycobacterium bovis subsp bovis AF2122/97
gccggcuccacccuugc

SEQ ID NO: 1146619 - RNA, 20 nt, Mycobacterium bovis subsp bovis AF2122/97
gccggcuccacccuugccgc

SEQ ID NO: 1146620 - RNA, 16 nt, Mycobacterium bovis subsp bovis AF2122/97
gccggcucaacaccga

SEQ ID NO: 1146621 - RNA, 17 nt, Mycobacterium bovis subsp bovis AF2122/97
gccggcuugggcgguag

SEQ ID NO: 1146622 - RNA, 18 nt, Mycobacterium bovis subsp bovis AF2122/97
gccggcuugucgaccacg

SEQ ID NO: 1146623 - RNA, 23 nt, Mycobacterium bovis subsp bovis AF2122/97
gccggcuuggccuuugccgucga

SEQ ID NO: 1146624 - RNA, 13 nt, Mycobacterium bovis subsp bovis AF2122/97
gccggcuugggcg

SEQ ID NO: 1146625 - RNA, 16 nt, Mycobacterium bovis subsp bovis AF2122/97
gccgggaacgcugacg

SEQ ID NO: 1146626 - RNA, 19 nt, Mycobacterium bovis subsp bovis AF2122/97
gccggcuugucgaccacga

SEQ ID NO: 1146627 - RNA, 14 nt, Mycobacterium bovis subsp bovis AF2122/97
gccgggaaccucgc

SEQ ID NO: 1146628 - RNA, 19 nt, Mycobacterium bovis subsp bovis AF2122/97
gccgggaaccaacaccagg

SEQ ID NO: 1146629 - RNA, 16 nt, Mycobacterium bovis subsp bovis AF2122/97
gccgggaaacaccggc

SEQ ID NO: 1146630 - RNA, 14 nt, Mycobacterium bovis subsp bovis AF2122/97
gccggcuucggcga

SEQ ID NO: 1146631 - RNA, 16 nt, Mycobacterium bovis subsp bovis AF2122/97
gccggcuucggugagc

SEQ ID NO: 1146632 - RNA, 15 nt, Mycobacterium bovis subsp bovis AF2122/97
gccggcuucgcccag

SEQ ID NO: 1146633 - RNA, 23 nt, Mycobacterium bovis subsp bovis AF2122/97
gccggcuugcagugaggucaucg

SEQ ID NO: 1146634 - RNA, 23 nt, Mycobacterium bovis subsp bovis AF2122/97
gccggcuguuaggcgauaucgca

SEQ ID NO: 1146635 - RNA, 22 nt, Mycobacterium bovis subsp bovis AF2122/97
gccggcuuaaggcccuggccgc

SEQ ID NO: 1146636 - RNA, 22 nt, Mycobacterium bovis subsp bovis AF2122/97
gccgggcacccacuuuucggug

SEQ ID NO: 1146637 - RNA, 16 nt, Mycobacterium bovis subsp bovis AF2122/97
gccgggcacgcgaggc

SEQ ID NO: 1146638 - RNA, 19 nt, Mycobacterium bovis subsp bovis AF2122/97
gccgggcaccaccacaccg

SEQ ID NO: 1146639 - RNA, 13 nt, Mycobacterium bovis subsp bovis AF2122/97
gccgggcaccacc

SEQ ID NO: 1146640 - RNA, 18 nt, Mycobacterium bovis subsp bovis AF2122/97
gccgggauaacccagcac

SEQ ID NO: 1146641 - RNA, 19 nt, Mycobacterium bovis subsp bovis AF2122/97
gccgggaauuucgacacga

SEQ ID NO: 1146642 - RNA, 23 nt, Mycobacterium bovis subsp bovis AF2122/97
gccgggcaaggccaccgucgcgg

SEQ ID NO: 1146643 - RNA, 17 nt, Mycobacterium bovis subsp bovis AF2122/97
gccgggaguguguccga

SEQ ID NO: 1146644 - RNA, 20 nt, Mycobacterium bovis subsp bovis AF2122/97
gccgggaccgccccggccag

SEQ ID NO: 1146645 - RNA, 15 nt, Mycobacterium bovis subsp bovis AF2122/97
gccgggaccggugug

SEQ ID NO: 1146646 - RNA, 22 nt, Mycobacterium bovis subsp bovis AF2122/97
gccgggaccggugugcacgcgg

SEQ ID NO: 1146647 - RNA, 18 nt, Mycobacterium bovis subsp bovis AF2122/97
gccgggaauuucgacacg

SEQ ID NO: 1146648 - RNA, 14 nt, Mycobacterium bovis subsp bovis AF2122/97
gccgggacagcgcc

SEQ ID NO: 1146649 - RNA, 16 nt, Mycobacterium bovis subsp bovis AF2122/97
gccgggacagcgccgg

SEQ ID NO: 1146650 - RNA, 21 nt, Mycobacterium bovis subsp bovis AF2122/97
gccgucggcaauacuccgcug

SEQ ID NO: 1146651 - RNA, 17 nt, Mycobacterium bovis subsp bovis AF2122/97
gccgucggccucggcgg

SEQ ID NO: 1146652 - RNA, 12 nt, Mycobacterium bovis subsp bovis AF2122/97
gccgucggccgg

SEQ ID NO: 1146653 - RNA, 13 nt, Mycobacterium bovis subsp bovis AF2122/97
gccgucggccggc

SEQ ID NO: 1146654 - RNA, 14 nt, Mycobacterium bovis subsp bovis AF2122/97
gccgucggccggca

SEQ ID NO: 1146655 - RNA, 16 nt, Mycobacterium bovis subsp bovis AF2122/97
gccgucggccggcaac

SEQ ID NO: 1146656 - RNA, 14 nt, Mycobacterium bovis subsp bovis AF2122/97
gccgucggcgccgg

SEQ ID NO: 1146657 - RNA, 16 nt, Mycobacterium bovis subsp bovis AF2122/97
gccgucggcgccucgg

SEQ ID NO: 1146658 - RNA, 13 nt, Mycobacterium bovis subsp bovis AF2122/97
gccgucggcgagc

SEQ ID NO: 1146659 - RNA, 18 nt, Mycobacterium bovis subsp bovis AF2122/97
gccgucggcgagcagacg

SEQ ID NO: 1146660 - RNA, 12 nt, Mycobacterium bovis subsp bovis AF2122/97
gccgucggcgcu

SEQ ID NO: 1146661 - RNA, 14 nt, Mycobacterium bovis subsp bovis AF2122/97
gccgucgugccacc

SEQ ID NO: 1146662 - RNA, 15 nt, Mycobacterium bovis subsp bovis AF2122/97
gccgucggcgcugcg

SEQ ID NO: 1146663 - RNA, 20 nt, Mycobacterium bovis subsp bovis AF2122/97
gccgucguugcccgacccgc

SEQ ID NO: 1146664 - RNA, 14 nt, Mycobacterium bovis subsp bovis AF2122/97
gccgucguugccgg

SEQ ID NO: 1146665 - RNA, 15 nt, Mycobacterium bovis subsp bovis AF2122/97
gccgucgugccaccg

SEQ ID NO: 1146666 - RNA, 21 nt, Mycobacterium bovis subsp bovis AF2122/97
gccgucgugccaccguugggc

SEQ ID NO: 1146667 - RNA, 22 nt, Mycobacterium bovis subsp bovis AF2122/97
gccgugaguucacguucggcgc

SEQ ID NO: 1146668 - RNA, 20 nt, Mycobacterium bovis subsp bovis AF2122/97
gccgugauauccguacaguc

SEQ ID NO: 1146669 - RNA, 17 nt, Mycobacterium bovis subsp bovis AF2122/97
gccgugaucagcucgcg

SEQ ID NO: 1146670 - RNA, 21 nt, Mycobacterium bovis subsp bovis AF2122/97
gccgucucgcggugcggcaac

SEQ ID NO: 1146671 - RNA, 19 nt, Mycobacterium bovis subsp bovis AF2122/97
gccgucuccuggucaaccg

SEQ ID NO: 1146672 - RNA, 15 nt, Mycobacterium bovis subsp bovis AF2122/97
gccgucucgaucgcg

SEQ ID NO: 1146673 - RNA, 16 nt, Mycobacterium bovis subsp bovis AF2122/97
gccgucucgaucgcgg

SEQ ID NO: 1146674 - RNA, 19 nt, Mycobacterium bovis subsp bovis AF2122/97
gccgucucgcggugcggca

SEQ ID NO: 1146675 - RNA, 15 nt, Mycobacterium bovis subsp bovis AF2122/97
gccgugaucggcgcc

SEQ ID NO: 1146676 - RNA, 14 nt, Mycobacterium bovis subsp bovis AF2122/97
gccgugcagcucgg

SEQ ID NO: 1146677 - RNA, 17 nt, Mycobacterium bovis subsp bovis AF2122/97
gccgugcagcucgguca

SEQ ID NO: 1146678 - RNA, 14 nt, Mycobacterium bovis subsp bovis AF2122/97
gccgucgcaccaga

SEQ ID NO: 1146679 - RNA, 22 nt, Mycobacterium bovis subsp bovis AF2122/97
gccgucgauguggcgcuccggc

SEQ ID NO: 1146680 - RNA, 15 nt, Mycobacterium bovis subsp bovis AF2122/97
gccgucgaucuucuc

SEQ ID NO: 1146681 - RNA, 23 nt, Mycobacterium bovis subsp bovis AF2122/97
gccgucgaugaccagcacaccgc

SEQ ID NO: 1146682 - RNA, 12 nt, Mycobacterium bovis subsp bovis AF2122/97
gccgucgcagcc

SEQ ID NO: 1146683 - RNA, 15 nt, Mycobacterium bovis subsp bovis AF2122/97
gccgucgcagccagc

SEQ ID NO: 1146684 - RNA, 14 nt, Mycobacterium bovis subsp bovis AF2122/97
gccgucgccggugc

SEQ ID NO: 1146685 - RNA, 15 nt, Mycobacterium bovis subsp bovis AF2122/97
gccgucgccggugcc

SEQ ID NO: 1146686 - RNA, 14 nt, Mycobacterium bovis subsp bovis AF2122/97
gccgucgccgucca

SEQ ID NO: 1146687 - RNA, 13 nt, Mycobacterium bovis subsp bovis AF2122/97
gccgucgccucca

SEQ ID NO: 1146688 - RNA, 16 nt, Mycobacterium bovis subsp bovis AF2122/97
gccgucgccugcaagc

SEQ ID NO: 1146689 - RNA, 15 nt, Mycobacterium bovis subsp bovis AF2122/97
gccgucgcgacgucg

SEQ ID NO: 1146690 - RNA, 13 nt, Mycobacterium bovis subsp bovis AF2122/97
gccgucgcuggug

SEQ ID NO: 1146691 - RNA, 15 nt, Mycobacterium bovis subsp bovis AF2122/97
gccgucgcugguggc

SEQ ID NO: 1146692 - RNA, 17 nt, Mycobacterium bovis subsp bovis AF2122/97
gccgucggagaccagcu

SEQ ID NO: 1146693 - RNA, 20 nt, Mycobacterium bovis subsp bovis AF2122/97
gccgucggagaccagcucgu

SEQ ID NO: 1146694 - RNA, 19 nt, Mycobacterium bovis subsp bovis AF2122/97
gccgucggagccggccacc

SEQ ID NO: 1146695 - RNA, 15 nt, Mycobacterium bovis subsp bovis AF2122/97
gccgucgacgucgau

SEQ ID NO: 1146696 - RNA, 21 nt, Mycobacterium bovis subsp bovis AF2122/97
gccgucgacgucgauggugcg

SEQ ID NO: 1146697 - RNA, 22 nt, Mycobacterium bovis subsp bovis AF2122/97
gccgucacgcacgccgcgugcc

SEQ ID NO: 1146698 - RNA, 16 nt, Mycobacterium bovis subsp bovis AF2122/97
gccgucaccggucggc

SEQ ID NO: 1146699 - RNA, 15 nt, Mycobacterium bovis subsp bovis AF2122/97
gccgucgagcacggu

SEQ ID NO: 1146700 - RNA, 23 nt, Mycobacterium bovis subsp bovis AF2122/97
gccgucgacgucgauggugcggc

SEQ ID NO: 1146701 - RNA, 22 nt, Mycobacterium bovis subsp bovis AF2122/97
gccgucgagcucccacaggacc

SEQ ID NO: 1146702 - RNA, 17 nt, Mycobacterium bovis subsp bovis AF2122/97
gccgucacggcaguacc

SEQ ID NO: 1146703 - RNA, 20 nt, Mycobacterium bovis subsp bovis AF2122/97
gccgucacggcaguacccca

SEQ ID NO: 1146704 - RNA, 20 nt, Mycobacterium bovis subsp bovis AF2122/97
gccgucaccgcccuugccgc

SEQ ID NO: 1146705 - RNA, 23 nt, Mycobacterium bovis subsp bovis AF2122/97
gccgucaccgcccuugccgccgg

SEQ ID NO: 1146706 - RNA, 13 nt, Mycobacterium bovis subsp bovis AF2122/97
gccgucaccgccg

SEQ ID NO: 1146707 - RNA, 21 nt, Mycobacterium bovis subsp bovis AF2122/97
gccgucaccgccguugccgau

SEQ ID NO: 1146708 - RNA, 21 nt, Mycobacterium bovis subsp bovis AF2122/97
gccgucaccgccguugccgcc

SEQ ID NO: 1146709 - RNA, 13 nt, Mycobacterium bovis subsp bovis AF2122/97
gccgucacccccg

SEQ ID NO: 1146710 - RNA, 16 nt, Mycobacterium bovis subsp bovis AF2122/97
gccgucacccccgaua

SEQ ID NO: 1146711 - RNA, 23 nt, Mycobacterium bovis subsp bovis AF2122/97
gccgucaccgacgcacaggcgac

SEQ ID NO: 1146712 - RNA, 21 nt, Mycobacterium bovis subsp bovis AF2122/97
gccgucaccgaucgaacagug

SEQ ID NO: 1146713 - RNA, 22 nt, Mycobacterium bovis subsp bovis AF2122/97
gccgucaccgaucgaacagugc

SEQ ID NO: 1146714 - RNA, 18 nt, Mycobacterium bovis subsp bovis AF2122/97
gccguggcauguugcgga

SEQ ID NO: 1146715 - RNA, 19 nt, Mycobacterium bovis subsp bovis AF2122/97
gccguggcgaaugacggcc

SEQ ID NO: 1146716 - RNA, 23 nt, Mycobacterium bovis subsp bovis AF2122/97
gccguggcggcgggccucggcga

SEQ ID NO: 1146717 - RNA, 15 nt, Mycobacterium bovis subsp bovis AF2122/97
gccguggcgcggucg

SEQ ID NO: 1146718 - RNA, 14 nt, Mycobacterium bovis subsp bovis AF2122/97
gccguggcggcagc

SEQ ID NO: 1146719 - RNA, 17 nt, Mycobacterium bovis subsp bovis AF2122/97
gccgugucgggcgcgaa

SEQ ID NO: 1146720 - RNA, 18 nt, Mycobacterium bovis subsp bovis AF2122/97
gccgugucgggcgcgaaa

SEQ ID NO: 1146721 - RNA, 16 nt, Mycobacterium bovis subsp bovis AF2122/97
gccguggcgucggcgu

SEQ ID NO: 1146722 - RNA, 17 nt, Mycobacterium bovis subsp bovis AF2122/97
gccguggcgucggcguc

SEQ ID NO: 1146723 - RNA, 18 nt, Mycobacterium bovis subsp bovis AF2122/97
gccguucaaccggacgcc

SEQ ID NO: 1146724 - RNA, 21 nt, Mycobacterium bovis subsp bovis AF2122/97
gccguucaacguggaaaccgc

SEQ ID NO: 1146725 - RNA, 21 nt, Mycobacterium bovis subsp bovis AF2122/97
gccguuaccgccaaacgcugc

SEQ ID NO: 1146726 - RNA, 18 nt, Mycobacterium bovis subsp bovis AF2122/97
gccguggcgucggcguca

SEQ ID NO: 1146727 - RNA, 21 nt, Mycobacterium bovis subsp bovis AF2122/97
gccguuaccgccgcugccgau

SEQ ID NO: 1146728 - RNA, 17 nt, Mycobacterium bovis subsp bovis AF2122/97
gccguuaccgccggcgc

SEQ ID NO: 1146729 - RNA, 21 nt, Mycobacterium bovis subsp bovis AF2122/97
gccgugugugcgauccagggc

SEQ ID NO: 1146730 - RNA, 20 nt, Mycobacterium bovis subsp bovis AF2122/97
gccguguucgggggcggucg

SEQ ID NO: 1146731 - RNA, 21 nt, Mycobacterium bovis subsp bovis AF2122/97
gccguguucgggggcggucgc

SEQ ID NO: 1146732 - RNA, 13 nt, Mycobacterium bovis subsp bovis AF2122/97
gccguguucgggg

SEQ ID NO: 1146733 - RNA, 20 nt, Mycobacterium bovis subsp bovis AF2122/97
gccgugugcaucggcgaccg

SEQ ID NO: 1146734 - RNA, 21 nt, Mycobacterium bovis subsp bovis AF2122/97
gccgugugcaucggcgaccgc

SEQ ID NO: 1146735 - RNA, 14 nt, Mycobacterium bovis subsp bovis AF2122/97
gccgugcccccggc

SEQ ID NO: 1146736 - RNA, 14 nt, Mycobacterium bovis subsp bovis AF2122/97
gccgugcccggugc

SEQ ID NO: 1146737 - RNA, 16 nt, Mycobacterium bovis subsp bovis AF2122/97
gccgugcccggugcgg

SEQ ID NO: 1146738 - RNA, 19 nt, Mycobacterium bovis subsp bovis AF2122/97
gccgugcccggugcggugc

SEQ ID NO: 1146739 - RNA, 13 nt, Mycobacterium bovis subsp bovis AF2122/97
gccgugccgccga

SEQ ID NO: 1146740 - RNA, 14 nt, Mycobacterium bovis subsp bovis AF2122/97
gccgugccgccgac

SEQ ID NO: 1146741 - RNA, 17 nt, Mycobacterium bovis subsp bovis AF2122/97
gccguggcagucgcacg

SEQ ID NO: 1146742 - RNA, 18 nt, Mycobacterium bovis subsp bovis AF2122/97
gccguggcagucgcacgg

SEQ ID NO: 1146743 - RNA, 13 nt, Mycobacterium bovis subsp bovis AF2122/97
gccguggcaucgc

SEQ ID NO: 1146744 - RNA, 17 nt, Mycobacterium bovis subsp bovis AF2122/97
gccgugcccaggccacc

SEQ ID NO: 1146745 - RNA, 18 nt, Mycobacterium bovis subsp bovis AF2122/97
gccgugcccaggccaccg

SEQ ID NO: 1146746 - RNA, 19 nt, Mycobacterium bovis subsp bovis AF2122/97
gccgugcaugggacaucca

SEQ ID NO: 1146747 - RNA, 17 nt, Mycobacterium bovis subsp bovis AF2122/97
gccgugccagcccaggc

SEQ ID NO: 1146748 - RNA, 15 nt, Mycobacterium bovis subsp bovis AF2122/97
gccgugcaccagcga

SEQ ID NO: 1146749 - RNA, 16 nt, Mycobacterium bovis subsp bovis AF2122/97
gccgugcaccagcgac

SEQ ID NO: 1146750 - RNA, 18 nt, Mycobacterium bovis subsp bovis AF2122/97
gccgugcaccagcgacca

SEQ ID NO: 1146751 - RNA, 21 nt, Mycobacterium bovis subsp bovis AF2122/97
gccguuccagcaucggugcgg

SEQ ID NO: 1146752 - RNA, 23 nt, Mycobacterium bovis subsp bovis AF2122/97
gccguucccaccaccaccgccgg

SEQ ID NO: 1146753 - RNA, 16 nt, Mycobacterium bovis subsp bovis AF2122/97
gccguucccgccggcg

SEQ ID NO: 1146754 - RNA, 13 nt, Mycobacterium bovis subsp bovis AF2122/97
gccguucggcgcc

SEQ ID NO: 1146755 - RNA, 21 nt, Mycobacterium bovis subsp bovis AF2122/97
gccguucggcgcccgcucggc

SEQ ID NO: 1146756 - RNA, 18 nt, Mycobacterium bovis subsp bovis AF2122/97
gccguuguagacggcggc

SEQ ID NO: 1146757 - RNA, 15 nt, Mycobacterium bovis subsp bovis AF2122/97
gccguuggugccgcc

SEQ ID NO: 1146758 - RNA, 19 nt, Mycobacterium bovis subsp bovis AF2122/97
gccguucggcugccgcgcg

SEQ ID NO: 1146759 - RNA, 16 nt, Mycobacterium bovis subsp bovis AF2122/97
gccguuuccgccgccg

SEQ ID NO: 1146760 - RNA, 14 nt, Mycobacterium bovis subsp bovis AF2122/97
gccguuucggcgcc

SEQ ID NO: 1146761 - RNA, 13 nt, Mycobacterium bovis subsp bovis AF2122/97
gccuagcgcggcg

SEQ ID NO: 1146762 - RNA, 18 nt, Mycobacterium bovis subsp bovis AF2122/97
gccuagcgcgggcucggu

SEQ ID NO: 1146763 - RNA, 23 nt, Mycobacterium bovis subsp bovis AF2122/97
gccuacugauagacccugggguc

SEQ ID NO: 1146764 - RNA, 21 nt, Mycobacterium bovis subsp bovis AF2122/97
gccugaaacgauugcugcggc

SEQ ID NO: 1146765 - RNA, 18 nt, Mycobacterium bovis subsp bovis AF2122/97
gccucuggaucacgucga

SEQ ID NO: 1146766 - RNA, 14 nt, Mycobacterium bovis subsp bovis AF2122/97
gccucugaccagcc

SEQ ID NO: 1146767 - RNA, 16 nt, Mycobacterium bovis subsp bovis AF2122/97
gccucugaccagccgg

SEQ ID NO: 1146768 - RNA, 14 nt, Mycobacterium bovis subsp bovis AF2122/97
gccucucagcacgg

SEQ ID NO: 1146769 - RNA, 15 nt, Mycobacterium bovis subsp bovis AF2122/97
gccucucgguccaca

SEQ ID NO: 1146770 - RNA, 19 nt, Mycobacterium bovis subsp bovis AF2122/97
gccucguuguagccgaauc

SEQ ID NO: 1146771 - RNA, 21 nt, Mycobacterium bovis subsp bovis AF2122/97
gccucuagcuugacaacccug

SEQ ID NO: 1146772 - RNA, 13 nt, Mycobacterium bovis subsp bovis AF2122/97
gccugagcgggga

SEQ ID NO: 1146773 - RNA, 18 nt, Mycobacterium bovis subsp bovis AF2122/97
gccugaugcagggcccgc

SEQ ID NO: 1146774 - RNA, 15 nt, Mycobacterium bovis subsp bovis AF2122/97
gccugcaccgccgcc

SEQ ID NO: 1146775 - RNA, 17 nt, Mycobacterium bovis subsp bovis AF2122/97
gccugcaccgccgccgc

SEQ ID NO: 1146776 - RNA, 17 nt, Mycobacterium bovis subsp bovis AF2122/97
gccugcaccacggcggc

SEQ ID NO: 1146777 - RNA, 20 nt, Mycobacterium bovis subsp bovis AF2122/97
gccugaguuuaugcccggca

SEQ ID NO: 1146778 - RNA, 20 nt, Mycobacterium bovis subsp bovis AF2122/97
gccugauaaagcccggcggc

SEQ ID NO: 1146779 - RNA, 16 nt, Mycobacterium bovis subsp bovis AF2122/97
gccugagcggccucgg

SEQ ID NO: 1146780 - RNA, 16 nt, Mycobacterium bovis subsp bovis AF2122/97
gccugagcgccgcggc

SEQ ID NO: 1146781 - RNA, 17 nt, Mycobacterium bovis subsp bovis AF2122/97
gccugagcgccgcggcg

SEQ ID NO: 1146782 - RNA, 16 nt, Mycobacterium bovis subsp bovis AF2122/97
gccugagcacguucac

SEQ ID NO: 1146783 - RNA, 14 nt, Mycobacterium bovis subsp bovis AF2122/97
gccugagccaccaa

SEQ ID NO: 1146784 - RNA, 16 nt, Mycobacterium bovis subsp bovis AF2122/97
gccucgcagcgacacg

SEQ ID NO: 1146785 - RNA, 20 nt, Mycobacterium bovis subsp bovis AF2122/97
gccucgauguccgauaccgc

SEQ ID NO: 1146786 - RNA, 18 nt, Mycobacterium bovis subsp bovis AF2122/97
gccucgcaccggauccac

SEQ ID NO: 1146787 - RNA, 21 nt, Mycobacterium bovis subsp bovis AF2122/97
gccucgccauccaugauggcc

SEQ ID NO: 1146788 - RNA, 18 nt, Mycobacterium bovis subsp bovis AF2122/97
gccucgccggcgcgcagc

SEQ ID NO: 1146789 - RNA, 16 nt, Mycobacterium bovis subsp bovis AF2122/97
gccucgccggccacca

SEQ ID NO: 1146790 - RNA, 19 nt, Mycobacterium bovis subsp bovis AF2122/97
gccucgguggucuuggccc

SEQ ID NO: 1146791 - RNA, 17 nt, Mycobacterium bovis subsp bovis AF2122/97
gccucgucgauguucgc

SEQ ID NO: 1146792 - RNA, 22 nt, Mycobacterium bovis subsp bovis AF2122/97
gccucguugaccgggucgccga

SEQ ID NO: 1146793 - RNA, 13 nt, Mycobacterium bovis subsp bovis AF2122/97
gccucgucgccgc

SEQ ID NO: 1146794 - RNA, 18 nt, Mycobacterium bovis subsp bovis AF2122/97
gccucgucgccgcgguag

SEQ ID NO: 1146795 - RNA, 15 nt, Mycobacterium bovis subsp bovis AF2122/97
gccucgucccggaca

SEQ ID NO: 1146796 - RNA, 21 nt, Mycobacterium bovis subsp bovis AF2122/97
gccucgguggucuuggcccgg

SEQ ID NO: 1146797 - RNA, 23 nt, Mycobacterium bovis subsp bovis AF2122/97
gccuaguugcaacggguacaccc

SEQ ID NO: 1146798 - RNA, 17 nt, Mycobacterium bovis subsp bovis AF2122/97
gccuagggcggcggcgc

SEQ ID NO: 1146799 - RNA, 22 nt, Mycobacterium bovis subsp bovis AF2122/97
gccuaguccggcacugcggcca

SEQ ID NO: 1146800 - RNA, 18 nt, Mycobacterium bovis subsp bovis AF2122/97
gccuaguccuggcucggc

SEQ ID NO: 1146801 - RNA, 17 nt, Mycobacterium bovis subsp bovis AF2122/97
gccuaggucgacgccga

SEQ ID NO: 1146802 - RNA, 14 nt, Mycobacterium bovis subsp bovis AF2122/97
gccucaaugaccac

SEQ ID NO: 1146803 - RNA, 15 nt, Mycobacterium bovis subsp bovis AF2122/97
gccucaagcucgccg

SEQ ID NO: 1146804 - RNA, 16 nt, Mycobacterium bovis subsp bovis AF2122/97
gccucagcccggccag

SEQ ID NO: 1146805 - RNA, 17 nt, Mycobacterium bovis subsp bovis AF2122/97
gccucagcccggccagc

SEQ ID NO: 1146806 - RNA, 16 nt, Mycobacterium bovis subsp bovis AF2122/97
gccucagaaccggguc

SEQ ID NO: 1146807 - RNA, 13 nt, Mycobacterium bovis subsp bovis AF2122/97
gccucaccggcgc

SEQ ID NO: 1146808 - RNA, 22 nt, Mycobacterium bovis subsp bovis AF2122/97
gccucaccggcgcgagcagacg

SEQ ID NO: 1146809 - RNA, 22 nt, Mycobacterium bovis subsp bovis AF2122/97
gccucaccaggucuucgaccac

SEQ ID NO: 1146810 - RNA, 12 nt, Mycobacterium bovis subsp bovis AF2122/97
gccuccaccagg

SEQ ID NO: 1146811 - RNA, 15 nt, Mycobacterium bovis subsp bovis AF2122/97
gccuccaccgccgcg

SEQ ID NO: 1146812 - RNA, 12 nt, Mycobacterium bovis subsp bovis AF2122/97
gccuccaccgcg

SEQ ID NO: 1146813 - RNA, 20 nt, Mycobacterium bovis subsp bovis AF2122/97
gccuccacucuucgggcggc

SEQ ID NO: 1146814 - RNA, 22 nt, Mycobacterium bovis subsp bovis AF2122/97
gccuccacucuucgggcggcgu

SEQ ID NO: 1146815 - RNA, 15 nt, Mycobacterium bovis subsp bovis AF2122/97
gccuccagcacccgg

SEQ ID NO: 1146816 - RNA, 17 nt, Mycobacterium bovis subsp bovis AF2122/97
gccuccagcacccgguc

SEQ ID NO: 1146817 - RNA, 15 nt, Mycobacterium bovis subsp bovis AF2122/97
gccuccagccggcga

SEQ ID NO: 1146818 - RNA, 20 nt, Mycobacterium bovis subsp bovis AF2122/97
gccuccaaaaucgcggccac

SEQ ID NO: 1146819 - RNA, 15 nt, Mycobacterium bovis subsp bovis AF2122/97
gccuccaagcccgcc

SEQ ID NO: 1146820 - RNA, 21 nt, Mycobacterium bovis subsp bovis AF2122/97
gccuccagcagguccgcggcc

SEQ ID NO: 1146821 - RNA, 13 nt, Mycobacterium bovis subsp bovis AF2122/97
gccucaccgccgc

SEQ ID NO: 1146822 - RNA, 18 nt, Mycobacterium bovis subsp bovis AF2122/97
gccucagcccggccagcc

SEQ ID NO: 1146823 - RNA, 22 nt, Mycobacterium bovis subsp bovis AF2122/97
gccucaguacagcgcguuggcg

SEQ ID NO: 1146824 - RNA, 14 nt, Mycobacterium bovis subsp bovis AF2122/97
gccucauccaccga

SEQ ID NO: 1146825 - RNA, 19 nt, Mycobacterium bovis subsp bovis AF2122/97
gccucauccaccgauggcg

SEQ ID NO: 1146826 - RNA, 12 nt, Mycobacterium bovis subsp bovis AF2122/97
gccucccgggcc

SEQ ID NO: 1146827 - RNA, 15 nt, Mycobacterium bovis subsp bovis AF2122/97
gccucccgggccgcc

SEQ ID NO: 1146828 - RNA, 17 nt, Mycobacterium bovis subsp bovis AF2122/97
gccucccgggccgccgc

SEQ ID NO: 1146829 - RNA, 12 nt, Mycobacterium bovis subsp bovis AF2122/97
gccuccgccgag

SEQ ID NO: 1146830 - RNA, 15 nt, Mycobacterium bovis subsp bovis AF2122/97
gccuccgccgaggcc

SEQ ID NO: 1146831 - RNA, 16 nt, Mycobacterium bovis subsp bovis AF2122/97
gccucccgcgccggcg

SEQ ID NO: 1146832 - RNA, 16 nt, Mycobacterium bovis subsp bovis AF2122/97
gccuccgccugcccca

SEQ ID NO: 1146833 - RNA, 16 nt, Mycobacterium bovis subsp bovis AF2122/97
gccuccagcgcaccgg

SEQ ID NO: 1146834 - RNA, 13 nt, Mycobacterium bovis subsp bovis AF2122/97
gccuccaggcgcc

SEQ ID NO: 1146835 - RNA, 16 nt, Mycobacterium bovis subsp bovis AF2122/97
gccuccaggcgccacc

SEQ ID NO: 1146836 - RNA, 17 nt, Mycobacterium bovis subsp bovis AF2122/97
gccuccaggcgccaccc

SEQ ID NO: 1146837 - RNA, 19 nt, Mycobacterium bovis subsp bovis AF2122/97
gccuccauuucgucggaga

SEQ ID NO: 1146838 - RNA, 20 nt, Mycobacterium bovis subsp bovis AF2122/97
gccuccauuucgucggagaa

SEQ ID NO: 1146839 - RNA, 13 nt, Mycobacterium bovis subsp bovis AF2122/97
gccuccaucgcga

SEQ ID NO: 1146840 - RNA, 23 nt, Mycobacterium bovis subsp bovis AF2122/97
gccucgaacgccgcccgcugggc

SEQ ID NO: 1146841 - RNA, 18 nt, Mycobacterium bovis subsp bovis AF2122/97
gccuccuggaaggaggcc

SEQ ID NO: 1146842 - RNA, 22 nt, Mycobacterium bovis subsp bovis AF2122/97
gccucgaagggcuugucgccgg

SEQ ID NO: 1146843 - RNA, 14 nt, Mycobacterium bovis subsp bovis AF2122/97
gccuccuccccgac

SEQ ID NO: 1146844 - RNA, 15 nt, Mycobacterium bovis subsp bovis AF2122/97
gccuccucgauagcg

SEQ ID NO: 1146845 - RNA, 18 nt, Mycobacterium bovis subsp bovis AF2122/97
gccuccucgucgcucccg

SEQ ID NO: 1146846 - RNA, 19 nt, Mycobacterium bovis subsp bovis AF2122/97
gccuccucgucgcucccgg

SEQ ID NO: 1146847 - RNA, 19 nt, Mycobacterium bovis subsp bovis AF2122/97
gccuccuccccgaccgcca

SEQ ID NO: 1146848 - RNA, 15 nt, Mycobacterium bovis subsp bovis AF2122/97
gccuccugccgccgc

SEQ ID NO: 1146849 - RNA, 16 nt, Mycobacterium bovis subsp bovis AF2122/97
gccuccguugccccca

SEQ ID NO: 1146850 - RNA, 16 nt, Mycobacterium bovis subsp bovis AF2122/97
aagccaccagaauccu

SEQ ID NO: 1146851 - RNA, 15 nt, Mycobacterium bovis subsp bovis AF2122/97
gccuccgcugccgcc

SEQ ID NO: 1146852 - RNA, 24 nt, Mycobacterium bovis subsp bovis AF2122/97
gcgacgccgcgguuuucgccggau

SEQ ID NO: 1146853 - RNA, 23 nt, Mycobacterium bovis subsp bovis AF2122/97
gcgacgccgcucccgcacaagcc

SEQ ID NO: 1146854 - RNA, 13 nt, Mycobacterium bovis subsp bovis AF2122/97
gcgacgccggccc

SEQ ID NO: 1146855 - RNA, 17 nt, Mycobacterium bovis subsp bovis AF2122/97
gcgacgcccgccuucga

SEQ ID NO: 1146856 - RNA, 17 nt, Mycobacterium bovis subsp bovis AF2122/97
gcgacgccgaaaaugcc

SEQ ID NO: 1146857 - RNA, 20 nt, Mycobacterium bovis subsp bovis AF2122/97
gcgacgauccagggucaccu

SEQ ID NO: 1146858 - RNA, 15 nt, Mycobacterium bovis subsp bovis AF2122/97
gcgacgauccgcacg

SEQ ID NO: 1146859 - RNA, 14 nt, Mycobacterium bovis subsp bovis AF2122/97
gcgacgagcgcagc

SEQ ID NO: 1146860 - RNA, 16 nt, Mycobacterium bovis subsp bovis AF2122/97
gcgacgagcggccgug

SEQ ID NO: 1146861 - RNA, 18 nt, Mycobacterium bovis subsp bovis AF2122/97
gcgacgagcggccguggc

SEQ ID NO: 1146862 - RNA, 21 nt, Mycobacterium bovis subsp bovis AF2122/97
gcgacgaggcgacgucguucu

SEQ ID NO: 1146863 - RNA, 23 nt, Mycobacterium bovis subsp bovis AF2122/97
gcgacgagaucagccucgcgggc

SEQ ID NO: 1146864 - RNA, 19 nt, Mycobacterium bovis subsp bovis AF2122/97
gcgacgagcaacgccaccc

SEQ ID NO: 1146865 - RNA, 14 nt, Mycobacterium bovis subsp bovis AF2122/97
gcgacgagcccacc

SEQ ID NO: 1146866 - RNA, 15 nt, Mycobacterium bovis subsp bovis AF2122/97
gcgacgagcccaccg

SEQ ID NO: 1146867 - RNA, 14 nt, Mycobacterium bovis subsp bovis AF2122/97
gcgacgacggcgcc

SEQ ID NO: 1146868 - RNA, 15 nt, Mycobacterium bovis subsp bovis AF2122/97
gcgacgacggcgccg

SEQ ID NO: 1146869 - RNA, 11 nt, Mycobacterium bovis subsp bovis AF2122/97
gcgacgacgag

SEQ ID NO: 1146870 - RNA, 19 nt, Mycobacterium bovis subsp bovis AF2122/97
gcgacgaccgucggcucca

SEQ ID NO: 1146871 - RNA, 15 nt, Mycobacterium bovis subsp bovis AF2122/97
gcgaccuugcccgcu

SEQ ID NO: 1146872 - RNA, 18 nt, Mycobacterium bovis subsp bovis AF2122/97
gcgaccuugcccgcuagc

SEQ ID NO: 1146873 - RNA, 19 nt, Mycobacterium bovis subsp bovis AF2122/97
gcgaccuugcccgcuagcg

SEQ ID NO: 1146874 - RNA, 13 nt, Mycobacterium bovis subsp bovis AF2122/97
gcgaccugcucgc

SEQ ID NO: 1146875 - RNA, 13 nt, Mycobacterium bovis subsp bovis AF2122/97
gcgaccgucccgg

SEQ ID NO: 1146876 - RNA, 15 nt, Mycobacterium bovis subsp bovis AF2122/97
gcgaccgucccggcc

SEQ ID NO: 1146877 - RNA, 18 nt, Mycobacterium bovis subsp bovis AF2122/97
gcgaccgucccggccucg

SEQ ID NO: 1146878 - RNA, 22 nt, Mycobacterium bovis subsp bovis AF2122/97
gcgaccgucgauuucgacgacc

SEQ ID NO: 1146879 - RNA, 16 nt, Mycobacterium bovis subsp bovis AF2122/97
gcgaccuggucgaacu

SEQ ID NO: 1146880 - RNA, 22 nt, Mycobacterium bovis subsp bovis AF2122/97
gcgaccuggcucaucgaugcga

SEQ ID NO: 1146881 - RNA, 16 nt, Mycobacterium bovis subsp bovis AF2122/97
gcgacccgggccgcgg

SEQ ID NO: 1146882 - RNA, 13 nt, Mycobacterium bovis subsp bovis AF2122/97
gcgacccgggcgu

SEQ ID NO: 1146883 - RNA, 19 nt, Mycobacterium bovis subsp bovis AF2122/97
gcgacccggguagacaccg

SEQ ID NO: 1146884 - RNA, 21 nt, Mycobacterium bovis subsp bovis AF2122/97
gcgacccggguagacaccgcg

SEQ ID NO: 1146885 - RNA, 16 nt, Mycobacterium bovis subsp bovis AF2122/97
gcgacccgguccacgc

SEQ ID NO: 1146886 - RNA, 19 nt, Mycobacterium bovis subsp bovis AF2122/97
gcgacccguagcuuggcga

SEQ ID NO: 1146887 - RNA, 16 nt, Mycobacterium bovis subsp bovis AF2122/97
gcgacccgucccccgc

SEQ ID NO: 1146888 - RNA, 20 nt, Mycobacterium bovis subsp bovis AF2122/97
gcgacccgucccccgcacgc

SEQ ID NO: 1146889 - RNA, 12 nt, Mycobacterium bovis subsp bovis AF2122/97
gcgacccgucga

SEQ ID NO: 1146890 - RNA, 14 nt, Mycobacterium bovis subsp bovis AF2122/97
gcgaccgcgauccc

SEQ ID NO: 1146891 - RNA, 14 nt, Mycobacterium bovis subsp bovis AF2122/97
gcgaccgaccagcc

SEQ ID NO: 1146892 - RNA, 18 nt, Mycobacterium bovis subsp bovis AF2122/97
gcgacccguugaacucga

SEQ ID NO: 1146893 - RNA, 16 nt, Mycobacterium bovis subsp bovis AF2122/97
gcgaccggacgagcgu

SEQ ID NO: 1146894 - RNA, 12 nt, Mycobacterium bovis subsp bovis AF2122/97
gcgaccgcgggc

SEQ ID NO: 1146895 - RNA, 18 nt, Mycobacterium bovis subsp bovis AF2122/97
gcgaccgcggucgcugcg

SEQ ID NO: 1146896 - RNA, 20 nt, Mycobacterium bovis subsp bovis AF2122/97
gcgaccgcggucgcugcgau

SEQ ID NO: 1146897 - RNA, 21 nt, Mycobacterium bovis subsp bovis AF2122/97
gcgacccgucgaacgcgcgcg

SEQ ID NO: 1146898 - RNA, 15 nt, Mycobacterium bovis subsp bovis AF2122/97
gcgaccgcgcacggc

SEQ ID NO: 1146899 - RNA, 13 nt, Mycobacterium bovis subsp bovis AF2122/97
gcgaccgcggcga

SEQ ID NO: 1146900 - RNA, 11 nt, Mycobacterium bovis subsp bovis AF2122/97
gcgaccggcuc

SEQ ID NO: 1146901 - RNA, 16 nt, Mycobacterium bovis subsp bovis AF2122/97
gcgaccgggaucggcu

SEQ ID NO: 1146902 - RNA, 23 nt, Mycobacterium bovis subsp bovis AF2122/97
gcgaccgggaucggcuccgccgc

SEQ ID NO: 1146903 - RNA, 18 nt, Mycobacterium bovis subsp bovis AF2122/97
gcgaccggcaacgcggcc

SEQ ID NO: 1146904 - RNA, 20 nt, Mycobacterium bovis subsp bovis AF2122/97
gcgaccggccggccgcgggc

SEQ ID NO: 1146905 - RNA, 13 nt, Mycobacterium bovis subsp bovis AF2122/97
gcgaccggcguaa

SEQ ID NO: 1146906 - RNA, 13 nt, Mycobacterium bovis subsp bovis AF2122/97
gcgacccggccag

SEQ ID NO: 1146907 - RNA, 15 nt, Mycobacterium bovis subsp bovis AF2122/97
gcgacccggccagcg

SEQ ID NO: 1146908 - RNA, 18 nt, Mycobacterium bovis subsp bovis AF2122/97
gcgaccauacccgcgcgc

SEQ ID NO: 1146909 - RNA, 21 nt, Mycobacterium bovis subsp bovis AF2122/97
gcgaccaucugaucgggcccg

SEQ ID NO: 1146910 - RNA, 22 nt, Mycobacterium bovis subsp bovis AF2122/97
gcgacccgaucgcgccaggcca

SEQ ID NO: 1146911 - RNA, 16 nt, Mycobacterium bovis subsp bovis AF2122/97
gcgacccggcccagcg

SEQ ID NO: 1146912 - RNA, 19 nt, Mycobacterium bovis subsp bovis AF2122/97
gcgacccggcccagcgccc

SEQ ID NO: 1146913 - RNA, 20 nt, Mycobacterium bovis subsp bovis AF2122/97
gcgacccggcccagcgcccc

SEQ ID NO: 1146914 - RNA, 18 nt, Mycobacterium bovis subsp bovis AF2122/97
gcgaccagugguggccga

SEQ ID NO: 1146915 - RNA, 18 nt, Mycobacterium bovis subsp bovis AF2122/97
gcgaccauccgaguuguc

SEQ ID NO: 1146916 - RNA, 23 nt, Mycobacterium bovis subsp bovis AF2122/97
gcgaccauccgaguugucgccgg

SEQ ID NO: 1146917 - RNA, 16 nt, Mycobacterium bovis subsp bovis AF2122/97
gcgaccaucgcgacgg

SEQ ID NO: 1146918 - RNA, 18 nt, Mycobacterium bovis subsp bovis AF2122/97
gcgaccaucgcgacggca

SEQ ID NO: 1146919 - RNA, 15 nt, Mycobacterium bovis subsp bovis AF2122/97
gcgaccaucucgacg

SEQ ID NO: 1146920 - RNA, 16 nt, Mycobacterium bovis subsp bovis AF2122/97
gcgaccaucucgacgu

SEQ ID NO: 1146921 - RNA, 18 nt, Mycobacterium bovis subsp bovis AF2122/97
gcgaccaggcgcggcgac

SEQ ID NO: 1146922 - RNA, 14 nt, Mycobacterium bovis subsp bovis AF2122/97
gcgaccaguggugg

SEQ ID NO: 1146923 - RNA, 14 nt, Mycobacterium bovis subsp bovis AF2122/97
gcgaccagcucagc

SEQ ID NO: 1146924 - RNA, 19 nt, Mycobacterium bovis subsp bovis AF2122/97
gcgaccagcucagcugcgg

SEQ ID NO: 1146925 - RNA, 21 nt, Mycobacterium bovis subsp bovis AF2122/97
gcgaccagcucagcugcggau

SEQ ID NO: 1146926 - RNA, 22 nt, Mycobacterium bovis subsp bovis AF2122/97
gcgaccagcucagcugcggauu

SEQ ID NO: 1146927 - RNA, 20 nt, Mycobacterium bovis subsp bovis AF2122/97
aagcccucgacacgccgugc

SEQ ID NO: 1146928 - RNA, 14 nt, Mycobacterium bovis subsp bovis AF2122/97
aagcccgucgcggc

SEQ ID NO: 1146929 - RNA, 15 nt, Mycobacterium bovis subsp bovis AF2122/97
gcgaaucgguggucg

SEQ ID NO: 1146930 - RNA, 21 nt, Mycobacterium bovis subsp bovis AF2122/97
gcgaaucgcgucgagcgccgg

SEQ ID NO: 1146931 - RNA, 24 nt, Mycobacterium bovis subsp bovis AF2122/97
gcgaaucgcgucgagcgccggccg

SEQ ID NO: 1146932 - RNA, 21 nt, Mycobacterium bovis subsp bovis AF2122/97
gcgaaucggcccgugccacag

SEQ ID NO: 1146933 - RNA, 22 nt, Mycobacterium bovis subsp bovis AF2122/97
gcgaaucggcccgugccacagc

SEQ ID NO: 1146934 - RNA, 15 nt, Mycobacterium bovis subsp bovis AF2122/97
gcgaauccgccgccu

SEQ ID NO: 1146935 - RNA, 17 nt, Mycobacterium bovis subsp bovis AF2122/97
gcgaauccuggcgggug

SEQ ID NO: 1146936 - RNA, 14 nt, Mycobacterium bovis subsp bovis AF2122/97
gcgaaugucgccgc

SEQ ID NO: 1146937 - RNA, 17 nt, Mycobacterium bovis subsp bovis AF2122/97
gcgaaugcggccccgac

SEQ ID NO: 1146938 - RNA, 22 nt, Mycobacterium bovis subsp bovis AF2122/97
gcgaaugcggccccgacacagc

SEQ ID NO: 1146939 - RNA, 22 nt, Mycobacterium bovis subsp bovis AF2122/97
gcgaaucuuugguagucugcac

SEQ ID NO: 1146940 - RNA, 23 nt, Mycobacterium bovis subsp bovis AF2122/97
gcgaaucuuugguagucugcacg

SEQ ID NO: 1146941 - RNA, 16 nt, Mycobacterium bovis subsp bovis AF2122/97
gcgaaugaagcccucg

SEQ ID NO: 1146942 - RNA, 15 nt, Mycobacterium bovis subsp bovis AF2122/97
gcgaaugacggccag

SEQ ID NO: 1146943 - RNA, 16 nt, Mycobacterium bovis subsp bovis AF2122/97
gcgaaugacggccagu

SEQ ID NO: 1146944 - RNA, 20 nt, Mycobacterium bovis subsp bovis AF2122/97
gcgaaugcauuggcggugcg

SEQ ID NO: 1146945 - RNA, 22 nt, Mycobacterium bovis subsp bovis AF2122/97
gcgacaacccggcgucgacgau

SEQ ID NO: 1146946 - RNA, 22 nt, Mycobacterium bovis subsp bovis AF2122/97
gcgacacgccgauucgccgucg

SEQ ID NO: 1146947 - RNA, 16 nt, Mycobacterium bovis subsp bovis AF2122/97
gcgacacgccggcggg

SEQ ID NO: 1146948 - RNA, 19 nt, Mycobacterium bovis subsp bovis AF2122/97
gcgacacgccggcgggcug

SEQ ID NO: 1146949 - RNA, 16 nt, Mycobacterium bovis subsp bovis AF2122/97
gcgacaaggucgucga

SEQ ID NO: 1146950 - RNA, 17 nt, Mycobacterium bovis subsp bovis AF2122/97
gcgacaagaccggcggg

SEQ ID NO: 1146951 - RNA, 20 nt, Mycobacterium bovis subsp bovis AF2122/97
gcgacaagaccggcgggcag

SEQ ID NO: 1146952 - RNA, 21 nt, Mycobacterium bovis subsp bovis AF2122/97
gcgacaacagcacguacugcu

SEQ ID NO: 1146953 - RNA, 17 nt, Mycobacterium bovis subsp bovis AF2122/97
gcgacaaaucggucgac

SEQ ID NO: 1146954 - RNA, 23 nt, Mycobacterium bovis subsp bovis AF2122/97
gcgacaacaacucuucggcggac

SEQ ID NO: 1146955 - RNA, 15 nt, Mycobacterium bovis subsp bovis AF2122/97
gcgacaacaccacgg

SEQ ID NO: 1146956 - RNA, 18 nt, Mycobacterium bovis subsp bovis AF2122/97
gcgacaacaccacggugc

SEQ ID NO: 1146957 - RNA, 16 nt, Mycobacterium bovis subsp bovis AF2122/97
gcgaauuccucuguac

SEQ ID NO: 1146958 - RNA, 22 nt, Mycobacterium bovis subsp bovis AF2122/97
gcgaaugugaucacccgcaucg

SEQ ID NO: 1146959 - RNA, 16 nt, Mycobacterium bovis subsp bovis AF2122/97
gcgaaugucgccgccu

SEQ ID NO: 1146960 - RNA, 15 nt, Mycobacterium bovis subsp bovis AF2122/97
gcgaaugucgcgcug

SEQ ID NO: 1146961 - RNA, 22 nt, Mycobacterium bovis subsp bovis AF2122/97
aagccccgcuccgcgccgcccc

SEQ ID NO: 1146962 - RNA, 16 nt, Mycobacterium bovis subsp bovis AF2122/97
aagccccccgagcugu

SEQ ID NO: 1146963 - RNA, 20 nt, Mycobacterium bovis subsp bovis AF2122/97
aagcccccgacacgccgugc

SEQ ID NO: 1146964 - RNA, 13 nt, Mycobacterium bovis subsp bovis AF2122/97
aagcccgacuggu

SEQ ID NO: 1146965 - RNA, 21 nt, Mycobacterium bovis subsp bovis AF2122/97
aagcccgaguugaaggugccg

SEQ ID NO: 1146966 - RNA, 18 nt, Mycobacterium bovis subsp bovis AF2122/97
aagcccgauucagcgccc

SEQ ID NO: 1146967 - RNA, 19 nt, Mycobacterium bovis subsp bovis AF2122/97
gcgaccacgcaccgccccg

SEQ ID NO: 1146968 - RNA, 13 nt, Mycobacterium bovis subsp bovis AF2122/97
gcgaccacgcacc

SEQ ID NO: 1146969 - RNA, 16 nt, Mycobacterium bovis subsp bovis AF2122/97
gcgaccaacacgucga

SEQ ID NO: 1146970 - RNA, 19 nt, Mycobacterium bovis subsp bovis AF2122/97
gcgacaugaucugccaccg

SEQ ID NO: 1146971 - RNA, 14 nt, Mycobacterium bovis subsp bovis AF2122/97
gcgacaucggcccg

SEQ ID NO: 1146972 - RNA, 14 nt, Mycobacterium bovis subsp bovis AF2122/97
gcgacagccguggc

SEQ ID NO: 1146973 - RNA, 14 nt, Mycobacterium bovis subsp bovis AF2122/97
gcgacagcgcggcg

SEQ ID NO: 1146974 - RNA, 15 nt, Mycobacterium bovis subsp bovis AF2122/97
gcgacagcgcggcgc

SEQ ID NO: 1146975 - RNA, 18 nt, Mycobacterium bovis subsp bovis AF2122/97
gcgacagcgcggcggucg

SEQ ID NO: 1146976 - RNA, 15 nt, Mycobacterium bovis subsp bovis AF2122/97
gcgacagccaccucg

SEQ ID NO: 1146977 - RNA, 18 nt, Mycobacterium bovis subsp bovis AF2122/97
gcgacagcacgugcccca

SEQ ID NO: 1146978 - RNA, 21 nt, Mycobacterium bovis subsp bovis AF2122/97
gcgacacgccagccgugccgg

SEQ ID NO: 1146979 - RNA, 19 nt, Mycobacterium bovis subsp bovis AF2122/97
gcgacagacagcaccgccg

SEQ ID NO: 1146980 - RNA, 20 nt, Mycobacterium bovis subsp bovis AF2122/97
gcgacagacagcaccgccgg

SEQ ID NO: 1146981 - RNA, 21 nt, Mycobacterium bovis subsp bovis AF2122/97
gcgacagacagcaccgccggu

SEQ ID NO: 1146982 - RNA, 14 nt, Mycobacterium bovis subsp bovis AF2122/97
gcgacugcagcgaa

SEQ ID NO: 1146983 - RNA, 18 nt, Mycobacterium bovis subsp bovis AF2122/97
gcgacugcagcggcgcau

SEQ ID NO: 1146984 - RNA, 20 nt, Mycobacterium bovis subsp bovis AF2122/97
gcgacugagaucgcuucccg

SEQ ID NO: 1146985 - RNA, 17 nt, Mycobacterium bovis subsp bovis AF2122/97
gcgacuuggugacaccg

SEQ ID NO: 1146986 - RNA, 16 nt, Mycobacterium bovis subsp bovis AF2122/97
gcgacuuucugcgcgu

SEQ ID NO: 1146987 - RNA, 18 nt, Mycobacterium bovis subsp bovis AF2122/97
gcgacuuucugcgcgugg

SEQ ID NO: 1146988 - RNA, 18 nt, Mycobacterium bovis subsp bovis AF2122/97
gcgagaacccacgcaugc

SEQ ID NO: 1146989 - RNA, 18 nt, Mycobacterium bovis subsp bovis AF2122/97
gcgacuuggugacaccga

SEQ ID NO: 1146990 - RNA, 23 nt, Mycobacterium bovis subsp bovis AF2122/97
gcgagacauugacgaggcgagcg

SEQ ID NO: 1146991 - RNA, 19 nt, Mycobacterium bovis subsp bovis AF2122/97
gcgagaaucacggucaucu

SEQ ID NO: 1146992 - RNA, 15 nt, Mycobacterium bovis subsp bovis AF2122/97
gcgagaaggugcugc

SEQ ID NO: 1146993 - RNA, 23 nt, Mycobacterium bovis subsp bovis AF2122/97
gcgagaagucaaggugucaacgc

SEQ ID NO: 1146994 - RNA, 13 nt, Mycobacterium bovis subsp bovis AF2122/97
gcgagaagcaggg

SEQ ID NO: 1146995 - RNA, 16 nt, Mycobacterium bovis subsp bovis AF2122/97
gcgacgucgcgcaggu

SEQ ID NO: 1146996 - RNA, 22 nt, Mycobacterium bovis subsp bovis AF2122/97
gcgacgucgcaauaugccacag

SEQ ID NO: 1146997 - RNA, 16 nt, Mycobacterium bovis subsp bovis AF2122/97
gcgacgucaucgccga

SEQ ID NO: 1146998 - RNA, 17 nt, Mycobacterium bovis subsp bovis AF2122/97
gcgacguccaccagccg

SEQ ID NO: 1146999 - RNA, 23 nt, Mycobacterium bovis subsp bovis AF2122/97
gcgacguccaccagccgguuggc

SEQ ID NO: 1147000 - RNA, 13 nt, Mycobacterium bovis subsp bovis AF2122/97
gcgacgucggcgg

SEQ ID NO: 1147001 - RNA, 21 nt, Mycobacterium bovis subsp bovis AF2122/97
gcgacucgaggaccugcucgg

SEQ ID NO: 1147002 - RNA, 20 nt, Mycobacterium bovis subsp bovis AF2122/97
gcgacucgaggaccugcucg

SEQ ID NO: 1147003 - RNA, 15 nt, Mycobacterium bovis subsp bovis AF2122/97
gcgacucgccggcga

SEQ ID NO: 1147004 - RNA, 21 nt, Mycobacterium bovis subsp bovis AF2122/97
gcgacucgccggcgaauccgc

SEQ ID NO: 1147005 - RNA, 19 nt, Mycobacterium bovis subsp bovis AF2122/97
gcgacucgugucugccucg

SEQ ID NO: 1147006 - RNA, 13 nt, Mycobacterium bovis subsp bovis AF2122/97
gcgacucggugcg

SEQ ID NO: 1147007 - RNA, 14 nt, Mycobacterium bovis subsp bovis AF2122/97
gcgacugagaucgc

SEQ ID NO: 1147008 - RNA, 14 nt, Mycobacterium bovis subsp bovis AF2122/97
gcgacuccagcgcc

SEQ ID NO: 1147009 - RNA, 18 nt, Mycobacterium bovis subsp bovis AF2122/97
gcgacucugcgucugcuc

SEQ ID NO: 1147010 - RNA, 15 nt, Mycobacterium bovis subsp bovis AF2122/97
gcgacgggccgcgaa

SEQ ID NO: 1147011 - RNA, 15 nt, Mycobacterium bovis subsp bovis AF2122/97
gcgacggucccggca

SEQ ID NO: 1147012 - RNA, 19 nt, Mycobacterium bovis subsp bovis AF2122/97
gcgacggucgugaucggcg

SEQ ID NO: 1147013 - RNA, 16 nt, Mycobacterium bovis subsp bovis AF2122/97
gcgacggggucgcgau

SEQ ID NO: 1147014 - RNA, 18 nt, Mycobacterium bovis subsp bovis AF2122/97
gcgacggggucgcgaugc

SEQ ID NO: 1147015 - RNA, 17 nt, Mycobacterium bovis subsp bovis AF2122/97
gcgacggcucuaccggu

SEQ ID NO: 1147016 - RNA, 15 nt, Mycobacterium bovis subsp bovis AF2122/97
gcgacggugccaccg

SEQ ID NO: 1147017 - RNA, 16 nt, Mycobacterium bovis subsp bovis AF2122/97
gcgacggugccaccgc

SEQ ID NO: 1147018 - RNA, 17 nt, Mycobacterium bovis subsp bovis AF2122/97
gcgacggugccaccgcg

SEQ ID NO: 1147019 - RNA, 21 nt, Mycobacterium bovis subsp bovis AF2122/97
gcgacggugccaccgcgacgg

SEQ ID NO: 1147020 - RNA, 22 nt, Mycobacterium bovis subsp bovis AF2122/97
gcgacggugagggcgucgucga

SEQ ID NO: 1147021 - RNA, 16 nt, Mycobacterium bovis subsp bovis AF2122/97
gcgacguagacgacgu

SEQ ID NO: 1147022 - RNA, 18 nt, Mycobacterium bovis subsp bovis AF2122/97
gcgacguagacgacgucg

SEQ ID NO: 1147023 - RNA, 19 nt, Mycobacterium bovis subsp bovis AF2122/97
gcgacgguuucgaccacca

SEQ ID NO: 1147024 - RNA, 18 nt, Mycobacterium bovis subsp bovis AF2122/97
gcgacguaguagcgaugc

SEQ ID NO: 1147025 - RNA, 21 nt, Mycobacterium bovis subsp bovis AF2122/97
gcgacguaguugccggcuucg

SEQ ID NO: 1147026 - RNA, 18 nt, Mycobacterium bovis subsp bovis AF2122/97
gcgacguauuucgccccc

SEQ ID NO: 1147027 - RNA, 17 nt, Mycobacterium bovis subsp bovis AF2122/97
gcgacgucaucgccgac

SEQ ID NO: 1147028 - RNA, 18 nt, Mycobacterium bovis subsp bovis AF2122/97
gcgacgucaucgccgacc

SEQ ID NO: 1147029 - RNA, 19 nt, Mycobacterium bovis subsp bovis AF2122/97
gcgacgucaucgccgaccc

SEQ ID NO: 1147030 - RNA, 16 nt, Mycobacterium bovis subsp bovis AF2122/97
gcgacguccaccagcc

SEQ ID NO: 1147031 - RNA, 14 nt, Mycobacterium bovis subsp bovis AF2122/97
gcgacgcucgcugc

SEQ ID NO: 1147032 - RNA, 23 nt, Mycobacterium bovis subsp bovis AF2122/97
gcgacgcggggcucaaccccguc

SEQ ID NO: 1147033 - RNA, 15 nt, Mycobacterium bovis subsp bovis AF2122/97
gcgacgcggucaucg

SEQ ID NO: 1147034 - RNA, 17 nt, Mycobacterium bovis subsp bovis AF2122/97
gcgacgcucgcugcagc

SEQ ID NO: 1147035 - RNA, 14 nt, Mycobacterium bovis subsp bovis AF2122/97
gcgacgcgaccgcg

SEQ ID NO: 1147036 - RNA, 12 nt, Mycobacterium bovis subsp bovis AF2122/97
gcgacgcgacgg

SEQ ID NO: 1147037 - RNA, 14 nt, Mycobacterium bovis subsp bovis AF2122/97
gcgacgcggccagc

SEQ ID NO: 1147038 - RNA, 12 nt, Mycobacterium bovis subsp bovis AF2122/97
gcgacgcggcgc

SEQ ID NO: 1147039 - RNA, 14 nt, Mycobacterium bovis subsp bovis AF2122/97
gcgacgcggcgccg

SEQ ID NO: 1147040 - RNA, 19 nt, Mycobacterium bovis subsp bovis AF2122/97
gcgacgcggaguccgucga

SEQ ID NO: 1147041 - RNA, 23 nt, Mycobacterium bovis subsp bovis AF2122/97
gcgacgcgacacacgccgccggu

SEQ ID NO: 1147042 - RNA, 24 nt, Mycobacterium bovis subsp bovis AF2122/97
gcgagcacacuccuagccaacgag

SEQ ID NO: 1147043 - RNA, 21 nt, Mycobacterium bovis subsp bovis AF2122/97
gcgagcacccguugaucgcgg

SEQ ID NO: 1147044 - RNA, 21 nt, Mycobacterium bovis subsp bovis AF2122/97
gcgagcagacacagaaucgcc

SEQ ID NO: 1147045 - RNA, 19 nt, Mycobacterium bovis subsp bovis AF2122/97
gcgagcacaugcugccgcu

SEQ ID NO: 1147046 - RNA, 13 nt, Mycobacterium bovis subsp bovis AF2122/97
gcgagcaccaccc

SEQ ID NO: 1147047 - RNA, 15 nt, Mycobacterium bovis subsp bovis AF2122/97
gcgagcaccacccca

SEQ ID NO: 1147048 - RNA, 17 nt, Mycobacterium bovis subsp bovis AF2122/97
gcgagcaccaccccagc

SEQ ID NO: 1147049 - RNA, 18 nt, Mycobacterium bovis subsp bovis AF2122/97
gcgagcaccaccccagcg

SEQ ID NO: 1147050 - RNA, 13 nt, Mycobacterium bovis subsp bovis AF2122/97
gcgagcaacucgu

SEQ ID NO: 1147051 - RNA, 15 nt, Mycobacterium bovis subsp bovis AF2122/97
gcgagcaacaccagg

SEQ ID NO: 1147052 - RNA, 21 nt, Mycobacterium bovis subsp bovis AF2122/97
gcgagcagacgcagaaucgca

SEQ ID NO: 1147053 - RNA, 20 nt, Mycobacterium bovis subsp bovis AF2122/97
gcgagcagacgcaaaaucgc

SEQ ID NO: 1147054 - RNA, 21 nt, Mycobacterium bovis subsp bovis AF2122/97
gcgagcagacgcaaaaucgca

SEQ ID NO: 1147055 - RNA, 23 nt, Mycobacterium bovis subsp bovis AF2122/97
gcgagcacccguugaucgcggac

SEQ ID NO: 1147056 - RNA, 12 nt, Mycobacterium bovis subsp bovis AF2122/97
gcgagcgcagcg

SEQ ID NO: 1147057 - RNA, 19 nt, Mycobacterium bovis subsp bovis AF2122/97
gcgagcggauccgugucgc

SEQ ID NO: 1147058 - RNA, 13 nt, Mycobacterium bovis subsp bovis AF2122/97
gcgagcgcgcgua

SEQ ID NO: 1147059 - RNA, 20 nt, Mycobacterium bovis subsp bovis AF2122/97
gcgagcgccuuucggucacg

SEQ ID NO: 1147060 - RNA, 18 nt, Mycobacterium bovis subsp bovis AF2122/97
gcgagcugcgggucgcgu

SEQ ID NO: 1147061 - RNA, 23 nt, Mycobacterium bovis subsp bovis AF2122/97
gcgagcugcuuggcggucugcgc

SEQ ID NO: 1147062 - RNA, 20 nt, Mycobacterium bovis subsp bovis AF2122/97
gcgagcgccggccgcggcgg

SEQ ID NO: 1147063 - RNA, 21 nt, Mycobacterium bovis subsp bovis AF2122/97
gcgagcucagcgaugcggccc

SEQ ID NO: 1147064 - RNA, 21 nt, Mycobacterium bovis subsp bovis AF2122/97
gcgagcugcgggucgcguuuc

SEQ ID NO: 1147065 - RNA, 17 nt, Mycobacterium bovis subsp bovis AF2122/97
gcgagcuguaggucagc

SEQ ID NO: 1147066 - RNA, 18 nt, Mycobacterium bovis subsp bovis AF2122/97
gcgagcggccuccagcac

SEQ ID NO: 1147067 - RNA, 19 nt, Mycobacterium bovis subsp bovis AF2122/97
gcgagcgccuuuggcggug

SEQ ID NO: 1147068 - RNA, 12 nt, Mycobacterium bovis subsp bovis AF2122/97
gcgagcgcgccg

SEQ ID NO: 1147069 - RNA, 13 nt, Mycobacterium bovis subsp bovis AF2122/97
gcgagcggcacca

SEQ ID NO: 1147070 - RNA, 15 nt, Mycobacterium bovis subsp bovis AF2122/97
gcgagcggucgacgu

SEQ ID NO: 1147071 - RNA, 18 nt, Mycobacterium bovis subsp bovis AF2122/97
gcgagcuaacacccgagc

SEQ ID NO: 1147072 - RNA, 22 nt, Mycobacterium bovis subsp bovis AF2122/97
gcgagcuggcguucccgcucgg

SEQ ID NO: 1147073 - RNA, 18 nt, Mycobacterium bovis subsp bovis AF2122/97
gcgaggcgucaccccggu

SEQ ID NO: 1147074 - RNA, 16 nt, Mycobacterium bovis subsp bovis AF2122/97
gcgaggcggucgccga

SEQ ID NO: 1147075 - RNA, 15 nt, Mycobacterium bovis subsp bovis AF2122/97
gcgaguacaggcgca

SEQ ID NO: 1147076 - RNA, 18 nt, Mycobacterium bovis subsp bovis AF2122/97
gcgaguacaggcgcagcg

SEQ ID NO: 1147077 - RNA, 18 nt, Mycobacterium bovis subsp bovis AF2122/97
gcgagggcuaccggcgcc

SEQ ID NO: 1147078 - RNA, 19 nt, Mycobacterium bovis subsp bovis AF2122/97
gcgagggcuaccggcgccg

SEQ ID NO: 1147079 - RNA, 14 nt, Mycobacterium bovis subsp bovis AF2122/97
gcgagggcgcgccg

SEQ ID NO: 1147080 - RNA, 21 nt, Mycobacterium bovis subsp bovis AF2122/97
gcgaggcucgcguggccgccg

SEQ ID NO: 1147081 - RNA, 17 nt, Mycobacterium bovis subsp bovis AF2122/97
gcgaggcucguggcgac

SEQ ID NO: 1147082 - RNA, 19 nt, Mycobacterium bovis subsp bovis AF2122/97
gcgaguccacaaguaccgc

SEQ ID NO: 1147083 - RNA, 20 nt, Mycobacterium bovis subsp bovis AF2122/97
gcgaguccaggcugaucccg

SEQ ID NO: 1147084 - RNA, 17 nt, Mycobacterium bovis subsp bovis AF2122/97
gcgagucccggcgguug

SEQ ID NO: 1147085 - RNA, 23 nt, Mycobacterium bovis subsp bovis AF2122/97
gcgaguaggacacguggugggcg

SEQ ID NO: 1147086 - RNA, 21 nt, Mycobacterium bovis subsp bovis AF2122/97
gcgaguacggccugccgcucg

SEQ ID NO: 1147087 - RNA, 16 nt, Mycobacterium bovis subsp bovis AF2122/97
gcgagucgaacccgcg

SEQ ID NO: 1147088 - RNA, 20 nt, Mycobacterium bovis subsp bovis AF2122/97
gcgagucgaacccgcgagca

SEQ ID NO: 1147089 - RNA, 16 nt, Mycobacterium bovis subsp bovis AF2122/97
gcgagugguccagcca

SEQ ID NO: 1147090 - RNA, 18 nt, Mycobacterium bovis subsp bovis AF2122/97
gcgagugucuuagccagc

SEQ ID NO: 1147091 - RNA, 21 nt, Mycobacterium bovis subsp bovis AF2122/97
gcgagugucuuagccagcagc

SEQ ID NO: 1147092 - RNA, 19 nt, Mycobacterium bovis subsp bovis AF2122/97
gcgaguuaggccgccagcc

SEQ ID NO: 1147093 - RNA, 20 nt, Mycobacterium bovis subsp bovis AF2122/97
gcgaguuaggccgccagccg

SEQ ID NO: 1147094 - RNA, 21 nt, Mycobacterium bovis subsp bovis AF2122/97
gcgaguuaggccgccagccgg

SEQ ID NO: 1147095 - RNA, 12 nt, Mycobacterium bovis subsp bovis AF2122/97
gcgagucgcacu

SEQ ID NO: 1147096 - RNA, 18 nt, Mycobacterium bovis subsp bovis AF2122/97
gcgaagucgagugccgcg

SEQ ID NO: 1147097 - RNA, 13 nt, Mycobacterium bovis subsp bovis AF2122/97
gcgaagucgcaug

SEQ ID NO: 1147098 - RNA, 13 nt, Mycobacterium bovis subsp bovis AF2122/97
gcgaagucgucga

SEQ ID NO: 1147099 - RNA, 18 nt, Mycobacterium bovis subsp bovis AF2122/97
gcgaagucgacucgccac

SEQ ID NO: 1147100 - RNA, 21 nt, Mycobacterium bovis subsp bovis AF2122/97
gcgaagucacgcacccggcgc

SEQ ID NO: 1147101 - RNA, 12 nt, Mycobacterium bovis subsp bovis AF2122/97
gcgaaggcggcu

SEQ ID NO: 1147102 - RNA, 15 nt, Mycobacterium bovis subsp bovis AF2122/97
gcgaagggcaccggc

SEQ ID NO: 1147103 - RNA, 16 nt, Mycobacterium bovis subsp bovis AF2122/97
gcgaagggcaccggcg

SEQ ID NO: 1147104 - RNA, 14 nt, Mycobacterium bovis subsp bovis AF2122/97
gcgaaggggugccc

SEQ ID NO: 1147105 - RNA, 20 nt, Mycobacterium bovis subsp bovis AF2122/97
gcgaaggggugcccggcggc

SEQ ID NO: 1147106 - RNA, 15 nt, Mycobacterium bovis subsp bovis AF2122/97
gcgaaggucagcgac

SEQ ID NO: 1147107 - RNA, 20 nt, Mycobacterium bovis subsp bovis AF2122/97
gcgaagguccgugccgaugc

SEQ ID NO: 1147108 - RNA, 16 nt, Mycobacterium bovis subsp bovis AF2122/97
gcgaagcgugcgccga

SEQ ID NO: 1147109 - RNA, 16 nt, Mycobacterium bovis subsp bovis AF2122/97
gcgaagcuagagccag

SEQ ID NO: 1147110 - RNA, 17 nt, Mycobacterium bovis subsp bovis AF2122/97
gcgaagcugaccagaca

SEQ ID NO: 1147111 - RNA, 12 nt, Mycobacterium bovis subsp bovis AF2122/97
gcgaaggcgccg

SEQ ID NO: 1147112 - RNA, 15 nt, Mycobacterium bovis subsp bovis AF2122/97
gcgaaggcgccgaac

SEQ ID NO: 1147113 - RNA, 21 nt, Mycobacterium bovis subsp bovis AF2122/97
gcgaaucacccgcgagaucgg

SEQ ID NO: 1147114 - RNA, 19 nt, Mycobacterium bovis subsp bovis AF2122/97
gcgaauccagccgcgcgcc

SEQ ID NO: 1147115 - RNA, 21 nt, Mycobacterium bovis subsp bovis AF2122/97
gcgaauccagccgcgcgccgg

SEQ ID NO: 1147116 - RNA, 17 nt, Mycobacterium bovis subsp bovis AF2122/97
gcgaaguugcgcgacgg

SEQ ID NO: 1147117 - RNA, 14 nt, Mycobacterium bovis subsp bovis AF2122/97
gcgaauagccacca

SEQ ID NO: 1147118 - RNA, 15 nt, Mycobacterium bovis subsp bovis AF2122/97
gcgaagugcgcgcug

SEQ ID NO: 1147119 - RNA, 18 nt, Mycobacterium bovis subsp bovis AF2122/97
gcgaaguggaucuggcgc

SEQ ID NO: 1147120 - RNA, 15 nt, Mycobacterium bovis subsp bovis AF2122/97
gcgaagucuugaccg

SEQ ID NO: 1147121 - RNA, 18 nt, Mycobacterium bovis subsp bovis AF2122/97
gcgaagucuugaccgcac

SEQ ID NO: 1147122 - RNA, 19 nt, Mycobacterium bovis subsp bovis AF2122/97
gcgaagucuugaccgcacc

SEQ ID NO: 1147123 - RNA, 22 nt, Mycobacterium bovis subsp bovis AF2122/97
gcgaagucuugaccgcaccggc

SEQ ID NO: 1147124 - RNA, 20 nt, Mycobacterium bovis subsp bovis AF2122/97
gcgaagucuuucucccccau

SEQ ID NO: 1147125 - RNA, 14 nt, Mycobacterium bovis subsp bovis AF2122/97
gcgaauaccagacc

SEQ ID NO: 1147126 - RNA, 21 nt, Mycobacterium bovis subsp bovis AF2122/97
gcgaauaccagaccggccgac

SEQ ID NO: 1147127 - RNA, 22 nt, Mycobacterium bovis subsp bovis AF2122/97
gcgaauaccagaccggccgacg

SEQ ID NO: 1147128 - RNA, 19 nt, Mycobacterium bovis subsp bovis AF2122/97
gcgaaguuugcgacgacgc

SEQ ID NO: 1147129 - RNA, 16 nt, Mycobacterium bovis subsp bovis AF2122/97
gcgaacgggucgggac

SEQ ID NO: 1147130 - RNA, 14 nt, Mycobacterium bovis subsp bovis AF2122/97
gcgaacgucaaccg

SEQ ID NO: 1147131 - RNA, 23 nt, Mycobacterium bovis subsp bovis AF2122/97
gcgaacgucaaccgggcggcguu

SEQ ID NO: 1147132 - RNA, 22 nt, Mycobacterium bovis subsp bovis AF2122/97
gcgaacgucagugccccgcagc

SEQ ID NO: 1147133 - RNA, 20 nt, Mycobacterium bovis subsp bovis AF2122/97
gcgaacuccagcagcccggu

SEQ ID NO: 1147134 - RNA, 21 nt, Mycobacterium bovis subsp bovis AF2122/97
gcgaacucgcgccgagccagc

SEQ ID NO: 1147135 - RNA, 23 nt, Mycobacterium bovis subsp bovis AF2122/97
gcgaacgggucgggacgcugccg

SEQ ID NO: 1147136 - RNA, 18 nt, Mycobacterium bovis subsp bovis AF2122/97
gcgaacucgaggucgagc

SEQ ID NO: 1147137 - RNA, 17 nt, Mycobacterium bovis subsp bovis AF2122/97
gcgaagaacugggcaau

SEQ ID NO: 1147138 - RNA, 20 nt, Mycobacterium bovis subsp bovis AF2122/97
gcgaagaccagcggcggcgg

SEQ ID NO: 1147139 - RNA, 18 nt, Mycobacterium bovis subsp bovis AF2122/97
gcgaagaacgacgccacc

SEQ ID NO: 1147140 - RNA, 19 nt, Mycobacterium bovis subsp bovis AF2122/97
gcgaagaacgacgccaccg

SEQ ID NO: 1147141 - RNA, 21 nt, Mycobacterium bovis subsp bovis AF2122/97
gcgaagaacgacgccaccgcg

SEQ ID NO: 1147142 - RNA, 23 nt, Mycobacterium bovis subsp bovis AF2122/97
gcgaagaacgacgccaccgcgac

SEQ ID NO: 1147143 - RNA, 13 nt, Mycobacterium bovis subsp bovis AF2122/97
gcgaagccaccag

SEQ ID NO: 1147144 - RNA, 18 nt, Mycobacterium bovis subsp bovis AF2122/97
gcgaagcacaccguccgu

SEQ ID NO: 1147145 - RNA, 16 nt, Mycobacterium bovis subsp bovis AF2122/97
gcgaagccaccagguc

SEQ ID NO: 1147146 - RNA, 14 nt, Mycobacterium bovis subsp bovis AF2122/97
gcgaagcccgagau

SEQ ID NO: 1147147 - RNA, 12 nt, Mycobacterium bovis subsp bovis AF2122/97
gcgaagccgggu

SEQ ID NO: 1147148 - RNA, 18 nt, Mycobacterium bovis subsp bovis AF2122/97
gcgaagccgguucgccca

SEQ ID NO: 1147149 - RNA, 22 nt, Mycobacterium bovis subsp bovis AF2122/97
gcgaagccgguucgcccagcag

SEQ ID NO: 1147150 - RNA, 19 nt, Mycobacterium bovis subsp bovis AF2122/97
gcgaaagcuugggcgaucg

SEQ ID NO: 1147151 - RNA, 19 nt, Mycobacterium bovis subsp bovis AF2122/97
gcgaaauauuggcccguca

SEQ ID NO: 1147152 - RNA, 15 nt, Mycobacterium bovis subsp bovis AF2122/97
gcgaaagcgucgagc

SEQ ID NO: 1147153 - RNA, 23 nt, Mycobacterium bovis subsp bovis AF2122/97
gcgaaaucggaagagucgacgcu

SEQ ID NO: 1147154 - RNA, 18 nt, Mycobacterium bovis subsp bovis AF2122/97
gcgaaaugccugcgcgau

SEQ ID NO: 1147155 - RNA, 15 nt, Mycobacterium bovis subsp bovis AF2122/97
gcgaaaucgacagca

SEQ ID NO: 1147156 - RNA, 16 nt, Mycobacterium bovis subsp bovis AF2122/97
gcgaaaucgacagcag

SEQ ID NO: 1147157 - RNA, 18 nt, Mycobacterium bovis subsp bovis AF2122/97
gcgaaaucgacagcagcg

SEQ ID NO: 1147158 - RNA, 21 nt, Mycobacterium bovis subsp bovis AF2122/97
gcgaacaaccugccgguguac

SEQ ID NO: 1147159 - RNA, 16 nt, Mycobacterium bovis subsp bovis AF2122/97
gcgaacaacgcggacu

SEQ ID NO: 1147160 - RNA, 15 nt, Mycobacterium bovis subsp bovis AF2122/97
gcgaaauuccgggcc

SEQ ID NO: 1147161 - RNA, 13 nt, Mycobacterium bovis subsp bovis AF2122/97
gcgaacaaccacg

SEQ ID NO: 1147162 - RNA, 18 nt, Mycobacterium bovis subsp bovis AF2122/97
gcgaacaaccacgcacgg

SEQ ID NO: 1147163 - RNA, 14 nt, Mycobacterium bovis subsp bovis AF2122/97
gcgaacaccagaug

SEQ ID NO: 1147164 - RNA, 19 nt, Mycobacterium bovis subsp bovis AF2122/97
gcgaacagacgcaaaaagc

SEQ ID NO: 1147165 - RNA, 16 nt, Mycobacterium bovis subsp bovis AF2122/97
gcgaacacgcgaugau

SEQ ID NO: 1147166 - RNA, 22 nt, Mycobacterium bovis subsp bovis AF2122/97
gcgaacagcacauaugugcccg

SEQ ID NO: 1147167 - RNA, 17 nt, Mycobacterium bovis subsp bovis AF2122/97
gcgaacagugacgccac

SEQ ID NO: 1147168 - RNA, 14 nt, Mycobacterium bovis subsp bovis AF2122/97
gcgaacaggcgacc

SEQ ID NO: 1147169 - RNA, 15 nt, Mycobacterium bovis subsp bovis AF2122/97
gcgaacaggcgaccg

SEQ ID NO: 1147170 - RNA, 21 nt, Mycobacterium bovis subsp bovis AF2122/97
gcgaacagggcugcgaugcgg

SEQ ID NO: 1147171 - RNA, 15 nt, Mycobacterium bovis subsp bovis AF2122/97
gcgaacgcggccacc

SEQ ID NO: 1147172 - RNA, 22 nt, Mycobacterium bovis subsp bovis AF2122/97
gcgaacgcguccagcgcggccu

SEQ ID NO: 1147173 - RNA, 16 nt, Mycobacterium bovis subsp bovis AF2122/97
gcgaacgcgacagcca

SEQ ID NO: 1147174 - RNA, 22 nt, Mycobacterium bovis subsp bovis AF2122/97
gcgaacgcgacagccaccucga

SEQ ID NO: 1147175 - RNA, 23 nt, Mycobacterium bovis subsp bovis AF2122/97
gcgaacgcgacagccaccucgac

SEQ ID NO: 1147176 - RNA, 21 nt, Mycobacterium bovis subsp bovis AF2122/97
gcgaacggauucccgcccagc

SEQ ID NO: 1147177 - RNA, 22 nt, Mycobacterium bovis subsp bovis AF2122/97
gcgaacggauucccgcccagca

SEQ ID NO: 1147178 - RNA, 13 nt, Mycobacterium bovis subsp bovis AF2122/97
gcgaacggcaccg

SEQ ID NO: 1147179 - RNA, 14 nt, Mycobacterium bovis subsp bovis AF2122/97
gcgaacggcaccgc

SEQ ID NO: 1147180 - RNA, 17 nt, Mycobacterium bovis subsp bovis AF2122/97
gcgaacggcaccgcgcc

SEQ ID NO: 1147181 - RNA, 13 nt, Mycobacterium bovis subsp bovis AF2122/97
gcgaacggcgcag

SEQ ID NO: 1147182 - RNA, 15 nt, Mycobacterium bovis subsp bovis AF2122/97
gcgaacgccugcugg

SEQ ID NO: 1147183 - RNA, 23 nt, Mycobacterium bovis subsp bovis AF2122/97
gcgaaccggcugggcgccaccau

SEQ ID NO: 1147184 - RNA, 12 nt, Mycobacterium bovis subsp bovis AF2122/97
gcgaacgccagu

SEQ ID NO: 1147185 - RNA, 16 nt, Mycobacterium bovis subsp bovis AF2122/97
gcgaaccggccgucga

SEQ ID NO: 1147186 - RNA, 18 nt, Mycobacterium bovis subsp bovis AF2122/97
gcgaaccgucagcgcgcc

SEQ ID NO: 1147187 - RNA, 19 nt, Mycobacterium bovis subsp bovis AF2122/97
gcgaaccgucagcgcgccg

SEQ ID NO: 1147188 - RNA, 20 nt, Mycobacterium bovis subsp bovis AF2122/97
gcgaaccgucucggcgaccg

SEQ ID NO: 1147189 - RNA, 17 nt, Mycobacterium bovis subsp bovis AF2122/97
gcgaaccuugguugcca

SEQ ID NO: 1147190 - RNA, 16 nt, Mycobacterium bovis subsp bovis AF2122/97
gcgaacaucgccagcg

SEQ ID NO: 1147191 - RNA, 14 nt, Mycobacterium bovis subsp bovis AF2122/97
gcgaaccaccggcg

SEQ ID NO: 1147192 - RNA, 15 nt, Mycobacterium bovis subsp bovis AF2122/97
gcgaaccaccggcgc

SEQ ID NO: 1147193 - RNA, 16 nt, Mycobacterium bovis subsp bovis AF2122/97
gcgaaccaccggcgcc

SEQ ID NO: 1147194 - RNA, 20 nt, Mycobacterium bovis subsp bovis AF2122/97
gcgaaccaccggcgccgccg

SEQ ID NO: 1147195 - RNA, 15 nt, Mycobacterium bovis subsp bovis AF2122/97
gcgaaccacggcagc

SEQ ID NO: 1147196 - RNA, 22 nt, Mycobacterium bovis subsp bovis AF2122/97
gcgaacccgcagucggucacgc

SEQ ID NO: 1147197 - RNA, 12 nt, Mycobacterium bovis subsp bovis AF2122/97
gcgaacccgccg

SEQ ID NO: 1147198 - RNA, 22 nt, Mycobacterium bovis subsp bovis AF2122/97
gcgaacccgcgagguugaccac

SEQ ID NO: 1147199 - RNA, 18 nt, Mycobacterium bovis subsp bovis AF2122/97
gcgaacccgagccgccgu

SEQ ID NO: 1147200 - RNA, 14 nt, Mycobacterium bovis subsp bovis AF2122/97
gcgaacccccgccg

SEQ ID NO: 1147201 - RNA, 16 nt, Mycobacterium bovis subsp bovis AF2122/97
gcgaacccccgccgcg

SEQ ID NO: 1147202 - RNA, 17 nt, Mycobacterium bovis subsp bovis AF2122/97
gcgaacccccgccgcgc

SEQ ID NO: 1147203 - RNA, 16 nt, Mycobacterium bovis subsp bovis AF2122/97
gcgaacccugcgcacu

SEQ ID NO: 1147204 - RNA, 18 nt, Mycobacterium bovis subsp bovis AF2122/97
gcgaaccgccggcaccgc

SEQ ID NO: 1147205 - RNA, 21 nt, Mycobacterium bovis subsp bovis AF2122/97
gcgaaccgccggcaccgccgc

SEQ ID NO: 1147206 - RNA, 22 nt, Mycobacterium bovis subsp bovis AF2122/97
gcgaaccgccggcaccgccgcc

SEQ ID NO: 1147207 - RNA, 15 nt, Mycobacterium bovis subsp bovis AF2122/97
gcgaaccgcuccaca

SEQ ID NO: 1147208 - RNA, 15 nt, Mycobacterium bovis subsp bovis AF2122/97
gcgaaccgccggcac

SEQ ID NO: 1147209 - RNA, 14 nt, Mycobacterium bovis subsp bovis AF2122/97
gccuugacgaucga

SEQ ID NO: 1147210 - RNA, 13 nt, Mycobacterium bovis subsp bovis AF2122/97
gccuugagccgcc

SEQ ID NO: 1147211 - RNA, 16 nt, Mycobacterium bovis subsp bovis AF2122/97
gccuugaagcggugga

SEQ ID NO: 1147212 - RNA, 14 nt, Mycobacterium bovis subsp bovis AF2122/97
gccuugaaacggug

SEQ ID NO: 1147213 - RNA, 20 nt, Mycobacterium bovis subsp bovis AF2122/97
gccuucuccaucgucggcaa

SEQ ID NO: 1147214 - RNA, 18 nt, Mycobacterium bovis subsp bovis AF2122/97
gccuucucccgcacggcc

SEQ ID NO: 1147215 - RNA, 23 nt, Mycobacterium bovis subsp bovis AF2122/97
gccuucggugucgccgaacaccg

SEQ ID NO: 1147216 - RNA, 14 nt, Mycobacterium bovis subsp bovis AF2122/97
gccuucggugucgc

SEQ ID NO: 1147217 - RNA, 17 nt, Mycobacterium bovis subsp bovis AF2122/97
gccuucggugucgccga

SEQ ID NO: 1147218 - RNA, 20 nt, Mycobacterium bovis subsp bovis AF2122/97
gccuucggugucgccgaaca

SEQ ID NO: 1147219 - RNA, 15 nt, Mycobacterium bovis subsp bovis AF2122/97
gccuucagcggucgc

SEQ ID NO: 1147220 - RNA, 17 nt, Mycobacterium bovis subsp bovis AF2122/97
gccuucagcggucgcag

SEQ ID NO: 1147221 - RNA, 18 nt, Mycobacterium bovis subsp bovis AF2122/97
gccuucagcggucgcagc

SEQ ID NO: 1147222 - RNA, 15 nt, Mycobacterium bovis subsp bovis AF2122/97
gccuguugcgaccau

SEQ ID NO: 1147223 - RNA, 21 nt, Mycobacterium bovis subsp bovis AF2122/97
gccuucaaggaagccgcggcc

SEQ ID NO: 1147224 - RNA, 16 nt, Mycobacterium bovis subsp bovis AF2122/97
gccuucggugccggaa

SEQ ID NO: 1147225 - RNA, 21 nt, Mycobacterium bovis subsp bovis AF2122/97
gccuucgggccaggauccgac

SEQ ID NO: 1147226 - RNA, 18 nt, Mycobacterium bovis subsp bovis AF2122/97
gccugcagcgaugacgac

SEQ ID NO: 1147227 - RNA, 15 nt, Mycobacterium bovis subsp bovis AF2122/97
gccugcacgcccggc

SEQ ID NO: 1147228 - RNA, 14 nt, Mycobacterium bovis subsp bovis AF2122/97
gccugcacgccggc

SEQ ID NO: 1147229 - RNA, 14 nt, Mycobacterium bovis subsp bovis AF2122/97
gccugcagcgcgac

SEQ ID NO: 1147230 - RNA, 17 nt, Mycobacterium bovis subsp bovis AF2122/97
gccugcagcgcgacccg

SEQ ID NO: 1147231 - RNA, 14 nt, Mycobacterium bovis subsp bovis AF2122/97
gccugcaggccgcc

SEQ ID NO: 1147232 - RNA, 22 nt, Mycobacterium bovis subsp bovis AF2122/97
gccugcagguuuccggccugca

SEQ ID NO: 1147233 - RNA, 21 nt, Mycobacterium bovis subsp bovis AF2122/97
gccugugccaccgcuggaucg

SEQ ID NO: 1147234 - RNA, 13 nt, Mycobacterium bovis subsp bovis AF2122/97
gccugccacccgg

SEQ ID NO: 1147235 - RNA, 15 nt, Mycobacterium bovis subsp bovis AF2122/97
gccugccacccggcc

SEQ ID NO: 1147236 - RNA, 14 nt, Mycobacterium bovis subsp bovis AF2122/97
gccugugcgcggug

SEQ ID NO: 1147237 - RNA, 23 nt, Mycobacterium bovis subsp bovis AF2122/97
gccugugcgcggugacgagccac

SEQ ID NO: 1147238 - RNA, 21 nt, Mycobacterium bovis subsp bovis AF2122/97
gccuguucggcggcugccagc

SEQ ID NO: 1147239 - RNA, 21 nt, Mycobacterium bovis subsp bovis AF2122/97
gccuguucaacuccggcaccg

SEQ ID NO: 1147240 - RNA, 14 nt, Mycobacterium bovis subsp bovis AF2122/97
gccuugauugccgc

SEQ ID NO: 1147241 - RNA, 14 nt, Mycobacterium bovis subsp bovis AF2122/97
gccuugaucaccgu

SEQ ID NO: 1147242 - RNA, 14 nt, Mycobacterium bovis subsp bovis AF2122/97
gccuugaucggcga

SEQ ID NO: 1147243 - RNA, 16 nt, Mycobacterium bovis subsp bovis AF2122/97
gccuugaucggcgagg

SEQ ID NO: 1147244 - RNA, 19 nt, Mycobacterium bovis subsp bovis AF2122/97
gccuugcagcgcguucggc

SEQ ID NO: 1147245 - RNA, 17 nt, Mycobacterium bovis subsp bovis AF2122/97
gccuugcgcacaggcgc

SEQ ID NO: 1147246 - RNA, 19 nt, Mycobacterium bovis subsp bovis AF2122/97
gccuugcgcacaggcgcga

SEQ ID NO: 1147247 - RNA, 23 nt, Mycobacterium bovis subsp bovis AF2122/97
gccuugcgcacaggcgcgaucgc

SEQ ID NO: 1147248 - RNA, 15 nt, Mycobacterium bovis subsp bovis AF2122/97
gccuugccgggccgc

SEQ ID NO: 1147249 - RNA, 20 nt, Mycobacterium bovis subsp bovis AF2122/97
gccuugccgucgagcuccca

SEQ ID NO: 1147250 - RNA, 13 nt, Mycobacterium bovis subsp bovis AF2122/97
gccuugccgccgg

SEQ ID NO: 1147251 - RNA, 14 nt, Mycobacterium bovis subsp bovis AF2122/97
gccuugccgccggc

SEQ ID NO: 1147252 - RNA, 15 nt, Mycobacterium bovis subsp bovis AF2122/97
gccuugccgccggcg

SEQ ID NO: 1147253 - RNA, 21 nt, Mycobacterium bovis subsp bovis AF2122/97
gccuugccgccggcgccgccg

SEQ ID NO: 1147254 - RNA, 21 nt, Mycobacterium bovis subsp bovis AF2122/97
gccuugccaccgguaccgccg

SEQ ID NO: 1147255 - RNA, 21 nt, Mycobacterium bovis subsp bovis AF2122/97
gccuugcccucaacggcggca

SEQ ID NO: 1147256 - RNA, 13 nt, Mycobacterium bovis subsp bovis AF2122/97
gccuuggcggcca

SEQ ID NO: 1147257 - RNA, 16 nt, Mycobacterium bovis subsp bovis AF2122/97
gccuuggcggccgcga

SEQ ID NO: 1147258 - RNA, 15 nt, Mycobacterium bovis subsp bovis AF2122/97
gccuuggcggcggca

SEQ ID NO: 1147259 - RNA, 22 nt, Mycobacterium bovis subsp bovis AF2122/97
gccuuggguaggcaauggcgug

SEQ ID NO: 1147260 - RNA, 17 nt, Mycobacterium bovis subsp bovis AF2122/97
gccuuggucgccgccuu

SEQ ID NO: 1147261 - RNA, 14 nt, Mycobacterium bovis subsp bovis AF2122/97
gccuugggcggcac

SEQ ID NO: 1147262 - RNA, 16 nt, Mycobacterium bovis subsp bovis AF2122/97
gccuugggaccgcgcc

SEQ ID NO: 1147263 - RNA, 17 nt, Mycobacterium bovis subsp bovis AF2122/97
gccuuggucgcgucggc

SEQ ID NO: 1147264 - RNA, 22 nt, Mycobacterium bovis subsp bovis AF2122/97
gccuuggucgcgucggcugccg

SEQ ID NO: 1147265 - RNA, 13 nt, Mycobacterium bovis subsp bovis AF2122/97
gccuugucggcga

SEQ ID NO: 1147266 - RNA, 14 nt, Mycobacterium bovis subsp bovis AF2122/97
gccuugucggcgau

SEQ ID NO: 1147267 - RNA, 18 nt, Mycobacterium bovis subsp bovis AF2122/97
gccuugucggcgugucgc

SEQ ID NO: 1147268 - RNA, 13 nt, Mycobacterium bovis subsp bovis AF2122/97
gccuuggccggcu

SEQ ID NO: 1147269 - RNA, 22 nt, Mycobacterium bovis subsp bovis AF2122/97
gccuugcuuccgggacuaccac

SEQ ID NO: 1147270 - RNA, 16 nt, Mycobacterium bovis subsp bovis AF2122/97
gccuuggacgugcgcg

SEQ ID NO: 1147271 - RNA, 16 nt, Mycobacterium bovis subsp bovis AF2122/97
gccuuggcaguccagc

SEQ ID NO: 1147272 - RNA, 15 nt, Mycobacterium bovis subsp bovis AF2122/97
gccuugcucagccgg

SEQ ID NO: 1147273 - RNA, 21 nt, Mycobacterium bovis subsp bovis AF2122/97
gcgaaaauucggucucgaccg

SEQ ID NO: 1147274 - RNA, 22 nt, Mycobacterium bovis subsp bovis AF2122/97
gcgaaacagcuugcugcgcacc

SEQ ID NO: 1147275 - RNA, 12 nt, Mycobacterium bovis subsp bovis AF2122/97
gcgaaacgccac

SEQ ID NO: 1147276 - RNA, 19 nt, Mycobacterium bovis subsp bovis AF2122/97
gcgaaacgcccgggcggcg

SEQ ID NO: 1147277 - RNA, 20 nt, Mycobacterium bovis subsp bovis AF2122/97
gcgaaacgcccgggcggcgu

SEQ ID NO: 1147278 - RNA, 23 nt, Mycobacterium bovis subsp bovis AF2122/97
gcgaaacgccgcaauggaccgaa

SEQ ID NO: 1147279 - RNA, 16 nt, Mycobacterium bovis subsp bovis AF2122/97
gcgaaacgcuggccac

SEQ ID NO: 1147280 - RNA, 20 nt, Mycobacterium bovis subsp bovis AF2122/97
gcgaaaagacugcgccgccg

SEQ ID NO: 1147281 - RNA, 21 nt, Mycobacterium bovis subsp bovis AF2122/97
gcgaaaagacugcgccgccgg

SEQ ID NO: 1147282 - RNA, 14 nt, Mycobacterium bovis subsp bovis AF2122/97
gcgaaaaucccgcu

SEQ ID NO: 1147283 - RNA, 17 nt, Mycobacterium bovis subsp bovis AF2122/97
gccuuguuggcgcccgg

SEQ ID NO: 1147284 - RNA, 22 nt, Mycobacterium bovis subsp bovis AF2122/97
gccuuguuguccuucagccagu

SEQ ID NO: 1147285 - RNA, 15 nt, Mycobacterium bovis subsp bovis AF2122/97
gccuuguugccgccg

SEQ ID NO: 1147286 - RNA, 20 nt, Mycobacterium bovis subsp bovis AF2122/97
gccuuguggcacacccgcac

SEQ ID NO: 1147287 - RNA, 20 nt, Mycobacterium bovis subsp bovis AF2122/97
gccuuucgugcaccgcgacc

SEQ ID NO: 1147288 - RNA, 22 nt, Mycobacterium bovis subsp bovis AF2122/97
gccuuugagcccgcgaucacca

SEQ ID NO: 1147289 - RNA, 17 nt, Mycobacterium bovis subsp bovis AF2122/97
gccuuugagggcgacga

SEQ ID NO: 1147290 - RNA, 14 nt, Mycobacterium bovis subsp bovis AF2122/97
gccuuugccgccgg

SEQ ID NO: 1147291 - RNA, 16 nt, Mycobacterium bovis subsp bovis AF2122/97
gccuuugccgccggca

SEQ ID NO: 1147292 - RNA, 16 nt, Mycobacterium bovis subsp bovis AF2122/97
gccuuugcccgccgcg

SEQ ID NO: 1147293 - RNA, 15 nt, Mycobacterium bovis subsp bovis AF2122/97
gcggccagcacgucg

SEQ ID NO: 1147294 - RNA, 15 nt, Mycobacterium bovis subsp bovis AF2122/97
gcggccagcccagcc

SEQ ID NO: 1147295 - RNA, 20 nt, Mycobacterium bovis subsp bovis AF2122/97
gcggccagcagcaacgaccc

SEQ ID NO: 1147296 - RNA, 19 nt, Mycobacterium bovis subsp bovis AF2122/97
gcggccagcaucguguggu

SEQ ID NO: 1147297 - RNA, 15 nt, Mycobacterium bovis subsp bovis AF2122/97
gcggccagcgcaccg

SEQ ID NO: 1147298 - RNA, 19 nt, Mycobacterium bovis subsp bovis AF2122/97
gcggccagcgagaucagca

SEQ ID NO: 1147299 - RNA, 12 nt, Mycobacterium bovis subsp bovis AF2122/97
gcggccagcgaa

SEQ ID NO: 1147300 - RNA, 16 nt, Mycobacterium bovis subsp bovis AF2122/97
gcggccagcgcgcgcg

SEQ ID NO: 1147301 - RNA, 17 nt, Mycobacterium bovis subsp bovis AF2122/97
gcggccagcgcgcgcgg

SEQ ID NO: 1147302 - RNA, 16 nt, Mycobacterium bovis subsp bovis AF2122/97
gcggccagcgcggcgc

SEQ ID NO: 1147303 - RNA, 17 nt, Mycobacterium bovis subsp bovis AF2122/97
gcggccagcucggccag

SEQ ID NO: 1147304 - RNA, 21 nt, Mycobacterium bovis subsp bovis AF2122/97
gcggccagggcacccaucccg

SEQ ID NO: 1147305 - RNA, 13 nt, Mycobacterium bovis subsp bovis AF2122/97
gcggccaggcggu

SEQ ID NO: 1147306 - RNA, 17 nt, Mycobacterium bovis subsp bovis AF2122/97
gcggccaggcgcgacgu

SEQ ID NO: 1147307 - RNA, 16 nt, Mycobacterium bovis subsp bovis AF2122/97
gcggccaguacgaucu

SEQ ID NO: 1147308 - RNA, 18 nt, Mycobacterium bovis subsp bovis AF2122/97
gcggccaguacgucgauc

SEQ ID NO: 1147309 - RNA, 15 nt, Mycobacterium bovis subsp bovis AF2122/97
gcggccagugcucgc

SEQ ID NO: 1147310 - RNA, 22 nt, Mycobacterium bovis subsp bovis AF2122/97
gcggccagucaggaaaccggcg

SEQ ID NO: 1147311 - RNA, 20 nt, Mycobacterium bovis subsp bovis AF2122/97
gcggccaccagaucgcacac

SEQ ID NO: 1147312 - RNA, 22 nt, Mycobacterium bovis subsp bovis AF2122/97
gcggccaccagaucgcacacca

SEQ ID NO: 1147313 - RNA, 21 nt, Mycobacterium bovis subsp bovis AF2122/97
gcggccaccgucagcgcgacc

SEQ ID NO: 1147314 - RNA, 19 nt, Mycobacterium bovis subsp bovis AF2122/97
gcggccaccgaggcguuca

SEQ ID NO: 1147315 - RNA, 15 nt, Mycobacterium bovis subsp bovis AF2122/97
gcggccaccgcacgc

SEQ ID NO: 1147316 - RNA, 20 nt, Mycobacterium bovis subsp bovis AF2122/97
gcggccaccgcacgcuggcg

SEQ ID NO: 1147317 - RNA, 15 nt, Mycobacterium bovis subsp bovis AF2122/97
gcggccaccgccgcc

SEQ ID NO: 1147318 - RNA, 16 nt, Mycobacterium bovis subsp bovis AF2122/97
gcggccaccgccgccg

SEQ ID NO: 1147319 - RNA, 16 nt, Mycobacterium bovis subsp bovis AF2122/97
gcggccaccugcuggc

SEQ ID NO: 1147320 - RNA, 15 nt, Mycobacterium bovis subsp bovis AF2122/97
gcggccacccgcgac

SEQ ID NO: 1147321 - RNA, 17 nt, Mycobacterium bovis subsp bovis AF2122/97
gcggccacccgcgacga

SEQ ID NO: 1147322 - RNA, 22 nt, Mycobacterium bovis subsp bovis AF2122/97
gcggccaccgccgccgccgacg

SEQ ID NO: 1147323 - RNA, 17 nt, Mycobacterium bovis subsp bovis AF2122/97
gcggccaccugcuggcc

SEQ ID NO: 1147324 - RNA, 23 nt, Mycobacterium bovis subsp bovis AF2122/97
gcggccacuuggaugcgacccgu

SEQ ID NO: 1147325 - RNA, 12 nt, Mycobacterium bovis subsp bovis AF2122/97
gcggccagcacg

SEQ ID NO: 1147326 - RNA, 17 nt, Mycobacterium bovis subsp bovis AF2122/97
aagcgccaaacccggcg

SEQ ID NO: 1147327 - RNA, 23 nt, Mycobacterium bovis subsp bovis AF2122/97
gcggccacaccuuggccgccggc

SEQ ID NO: 1147328 - RNA, 24 nt, Mycobacterium bovis subsp bovis AF2122/97
gcggccacauaccaccacguggcc

SEQ ID NO: 1147329 - RNA, 13 nt, Mycobacterium bovis subsp bovis AF2122/97
gcggccaccaccg

SEQ ID NO: 1147330 - RNA, 19 nt, Mycobacterium bovis subsp bovis AF2122/97
gcggccaaugacgucggac

SEQ ID NO: 1147331 - RNA, 18 nt, Mycobacterium bovis subsp bovis AF2122/97
gcggccaauggccgcggc

SEQ ID NO: 1147332 - RNA, 18 nt, Mycobacterium bovis subsp bovis AF2122/97
gcggccaauggugggcga

SEQ ID NO: 1147333 - RNA, 18 nt, Mycobacterium bovis subsp bovis AF2122/97
gcggccaauugcgccgcc

SEQ ID NO: 1147334 - RNA, 17 nt, Mycobacterium bovis subsp bovis AF2122/97
gcggccaaggucgaccc

SEQ ID NO: 1147335 - RNA, 14 nt, Mycobacterium bovis subsp bovis AF2122/97
gcggccaagucacc

SEQ ID NO: 1147336 - RNA, 21 nt, Mycobacterium bovis subsp bovis AF2122/97
gcggcaggaaucgggucagca

SEQ ID NO: 1147337 - RNA, 23 nt, Mycobacterium bovis subsp bovis AF2122/97
gcggcaggaaucgggucagcacc

SEQ ID NO: 1147338 - RNA, 13 nt, Mycobacterium bovis subsp bovis AF2122/97
aagcgaucgccgg

SEQ ID NO: 1147339 - RNA, 14 nt, Mycobacterium bovis subsp bovis AF2122/97
gcggcagcuggcgc

SEQ ID NO: 1147340 - RNA, 17 nt, Mycobacterium bovis subsp bovis AF2122/97
gcggcagcuggcgcagc

SEQ ID NO: 1147341 - RNA, 19 nt, Mycobacterium bovis subsp bovis AF2122/97
gcggcaggccggccaccga

SEQ ID NO: 1147342 - RNA, 19 nt, Mycobacterium bovis subsp bovis AF2122/97
gcggcaggccuggcgagcc

SEQ ID NO: 1147343 - RNA, 14 nt, Mycobacterium bovis subsp bovis AF2122/97
gcggcaucgccgag

SEQ ID NO: 1147344 - RNA, 16 nt, Mycobacterium bovis subsp bovis AF2122/97
gcggcaucgacgcggc

SEQ ID NO: 1147345 - RNA, 20 nt, Mycobacterium bovis subsp bovis AF2122/97
aagcgaucgccggccgcgug

SEQ ID NO: 1147346 - RNA, 18 nt, Mycobacterium bovis subsp bovis AF2122/97
aagcgaugagggugcucg

SEQ ID NO: 1147347 - RNA, 22 nt, Mycobacterium bovis subsp bovis AF2122/97
aagcgcacaaacgacucgcggu

SEQ ID NO: 1147348 - RNA, 17 nt, Mycobacterium bovis subsp bovis AF2122/97
gcggcaucccgccacac

SEQ ID NO: 1147349 - RNA, 24 nt, Mycobacterium bovis subsp bovis AF2122/97
gcggcauauggauguuggugaacg

SEQ ID NO: 1147350 - RNA, 17 nt, Mycobacterium bovis subsp bovis AF2122/97
gcggcaucaccuggcgu

SEQ ID NO: 1147351 - RNA, 19 nt, Mycobacterium bovis subsp bovis AF2122/97
gcggcauagccgaacagcg

SEQ ID NO: 1147352 - RNA, 16 nt, Mycobacterium bovis subsp bovis AF2122/97
gcggcauagcggguca

SEQ ID NO: 1147353 - RNA, 21 nt, Mycobacterium bovis subsp bovis AF2122/97
gcggcauagcucagaccggcg

SEQ ID NO: 1147354 - RNA, 22 nt, Mycobacterium bovis subsp bovis AF2122/97
gcggcauagcucagaccggcgc

SEQ ID NO: 1147355 - RNA, 23 nt, Mycobacterium bovis subsp bovis AF2122/97
gcggcauagcucagaccggcgcc

SEQ ID NO: 1147356 - RNA, 21 nt, Mycobacterium bovis subsp bovis AF2122/97
gcggcauaaacaucgguggcg

SEQ ID NO: 1147357 - RNA, 22 nt, Mycobacterium bovis subsp bovis AF2122/97
gcggcauaaacaucgguggcgc

SEQ ID NO: 1147358 - RNA, 19 nt, Mycobacterium bovis subsp bovis AF2122/97
gcggcaguuguggcgcugc

SEQ ID NO: 1147359 - RNA, 15 nt, Mycobacterium bovis subsp bovis AF2122/97
gcggcauacauccag

SEQ ID NO: 1147360 - RNA, 24 nt, Mycobacterium bovis subsp bovis AF2122/97
gcggcauacauccaggcuguggcc

SEQ ID NO: 1147361 - RNA, 16 nt, Mycobacterium bovis subsp bovis AF2122/97
gcgcucgcccgcggcc

SEQ ID NO: 1147362 - RNA, 19 nt, Mycobacterium bovis subsp bovis AF2122/97
gcgcucgcccgcggccgug

SEQ ID NO: 1147363 - RNA, 15 nt, Mycobacterium bovis subsp bovis AF2122/97
gcgcucgcaccacca

SEQ ID NO: 1147364 - RNA, 20 nt, Mycobacterium bovis subsp bovis AF2122/97
gcgcucgcacccgcucggcg

SEQ ID NO: 1147365 - RNA, 13 nt, Mycobacterium bovis subsp bovis AF2122/97
gcggcacgcugac

SEQ ID NO: 1147366 - RNA, 20 nt, Mycobacterium bovis subsp bovis AF2122/97
gcggcacgggcggccauggc

SEQ ID NO: 1147367 - RNA, 17 nt, Mycobacterium bovis subsp bovis AF2122/97
gcgcucgcacccgcucg

SEQ ID NO: 1147368 - RNA, 18 nt, Mycobacterium bovis subsp bovis AF2122/97
gcgcucgcacccgcucgg

SEQ ID NO: 1147369 - RNA, 18 nt, Mycobacterium bovis subsp bovis AF2122/97
gcgcucgauggcggccac

SEQ ID NO: 1147370 - RNA, 23 nt, Mycobacterium bovis subsp bovis AF2122/97
gcgcucgauggcggccaccagcg

SEQ ID NO: 1147371 - RNA, 13 nt, Mycobacterium bovis subsp bovis AF2122/97
gcgcucgaucacg

SEQ ID NO: 1147372 - RNA, 18 nt, Mycobacterium bovis subsp bovis AF2122/97
gcggcacggaugcgaugg

SEQ ID NO: 1147373 - RNA, 19 nt, Mycobacterium bovis subsp bovis AF2122/97
gcggcagaccaagcccguc

SEQ ID NO: 1147374 - RNA, 21 nt, Mycobacterium bovis subsp bovis AF2122/97
aagcgaaaucaguucccgaac

SEQ ID NO: 1147375 - RNA, 17 nt, Mycobacterium bovis subsp bovis AF2122/97
gcggcacuggauccggg

SEQ ID NO: 1147376 - RNA, 16 nt, Mycobacterium bovis subsp bovis AF2122/97
gcggcacuggccccgg

SEQ ID NO: 1147377 - RNA, 23 nt, Mycobacterium bovis subsp bovis AF2122/97
gcggcacugaucugcguugcggc

SEQ ID NO: 1147378 - RNA, 17 nt, Mycobacterium bovis subsp bovis AF2122/97
gcggcacuacgcagccg

SEQ ID NO: 1147379 - RNA, 21 nt, Mycobacterium bovis subsp bovis AF2122/97
gcggcacuacgcagccguagc

SEQ ID NO: 1147380 - RNA, 16 nt, Mycobacterium bovis subsp bovis AF2122/97
aagcgagucgacgaac

SEQ ID NO: 1147381 - RNA, 20 nt, Mycobacterium bovis subsp bovis AF2122/97
gcggccgaaacuucgcccgg

SEQ ID NO: 1147382 - RNA, 19 nt, Mycobacterium bovis subsp bovis AF2122/97
gcggccgaaagagccagcg

SEQ ID NO: 1147383 - RNA, 23 nt, Mycobacterium bovis subsp bovis AF2122/97
gcggcccucgaauucggccggcg

SEQ ID NO: 1147384 - RNA, 17 nt, Mycobacterium bovis subsp bovis AF2122/97
gcggcccucgagcagug

SEQ ID NO: 1147385 - RNA, 20 nt, Mycobacterium bovis subsp bovis AF2122/97
gcggcccugcuugcaggcga

SEQ ID NO: 1147386 - RNA, 15 nt, Mycobacterium bovis subsp bovis AF2122/97
gcggccgcgaccagc

SEQ ID NO: 1147387 - RNA, 20 nt, Mycobacterium bovis subsp bovis AF2122/97
gcggccgcgaccagcgccgc

SEQ ID NO: 1147388 - RNA, 15 nt, Mycobacterium bovis subsp bovis AF2122/97
gcggccgagacggcg

SEQ ID NO: 1147389 - RNA, 14 nt, Mycobacterium bovis subsp bovis AF2122/97
gcggccgaccgcga

SEQ ID NO: 1147390 - RNA, 23 nt, Mycobacterium bovis subsp bovis AF2122/97
gcggccgcgaccagcgccgcacc

SEQ ID NO: 1147391 - RNA, 14 nt, Mycobacterium bovis subsp bovis AF2122/97
gcggccgcggcgau

SEQ ID NO: 1147392 - RNA, 16 nt, Mycobacterium bovis subsp bovis AF2122/97
gcggccgcgucgucga

SEQ ID NO: 1147393 - RNA, 14 nt, Mycobacterium bovis subsp bovis AF2122/97
gcggccgcggucga

SEQ ID NO: 1147394 - RNA, 15 nt, Mycobacterium bovis subsp bovis AF2122/97
gcggccggccgcuca

SEQ ID NO: 1147395 - RNA, 17 nt, Mycobacterium bovis subsp bovis AF2122/97
gcggccgcgugccgccc

SEQ ID NO: 1147396 - RNA, 18 nt, Mycobacterium bovis subsp bovis AF2122/97
gcggccgcgugccgcccg

SEQ ID NO: 1147397 - RNA, 20 nt, Mycobacterium bovis subsp bovis AF2122/97
gcggccgcgugccgcccgcc

SEQ ID NO: 1147398 - RNA, 13 nt, Mycobacterium bovis subsp bovis AF2122/97
gcggccgcgugcu

SEQ ID NO: 1147399 - RNA, 20 nt, Mycobacterium bovis subsp bovis AF2122/97
gcggccggccgcccgcucga

SEQ ID NO: 1147400 - RNA, 12 nt, Mycobacterium bovis subsp bovis AF2122/97
gcggccggcgcc

SEQ ID NO: 1147401 - RNA, 14 nt, Mycobacterium bovis subsp bovis AF2122/97
gcggccggcgccgg

SEQ ID NO: 1147402 - RNA, 19 nt, Mycobacterium bovis subsp bovis AF2122/97
gcggccggcgugccagcac

SEQ ID NO: 1147403 - RNA, 12 nt, Mycobacterium bovis subsp bovis AF2122/97
gcggccggcgcu

SEQ ID NO: 1147404 - RNA, 23 nt, Mycobacterium bovis subsp bovis AF2122/97
gcggccggcgcucgcggcggcgc

SEQ ID NO: 1147405 - RNA, 14 nt, Mycobacterium bovis subsp bovis AF2122/97
gcggccgggccgcu

SEQ ID NO: 1147406 - RNA, 13 nt, Mycobacterium bovis subsp bovis AF2122/97
gcggccgucggga

SEQ ID NO: 1147407 - RNA, 17 nt, Mycobacterium bovis subsp bovis AF2122/97
gcggccgucgucggcca

SEQ ID NO: 1147408 - RNA, 12 nt, Mycobacterium bovis subsp bovis AF2122/97
gcggccgugaac

SEQ ID NO: 1147409 - RNA, 20 nt, Mycobacterium bovis subsp bovis AF2122/97
gcggccguggcguggcuugg

SEQ ID NO: 1147410 - RNA, 14 nt, Mycobacterium bovis subsp bovis AF2122/97
gcggccuaggacgc

SEQ ID NO: 1147411 - RNA, 20 nt, Mycobacterium bovis subsp bovis AF2122/97
gcggccuagggcggcggcgc

SEQ ID NO: 1147412 - RNA, 17 nt, Mycobacterium bovis subsp bovis AF2122/97
gcggccuccccgaccug

SEQ ID NO: 1147413 - RNA, 14 nt, Mycobacterium bovis subsp bovis AF2122/97
gcggccuccaccac

SEQ ID NO: 1147414 - RNA, 19 nt, Mycobacterium bovis subsp bovis AF2122/97
gcggccuccagcacccggu

SEQ ID NO: 1147415 - RNA, 16 nt, Mycobacterium bovis subsp bovis AF2122/97
gcggccguggccucga

SEQ ID NO: 1147416 - RNA, 15 nt, Mycobacterium bovis subsp bovis AF2122/97
gcggccucccgggcc

SEQ ID NO: 1147417 - RNA, 13 nt, Mycobacterium bovis subsp bovis AF2122/97
gcggccugcucga

SEQ ID NO: 1147418 - RNA, 15 nt, Mycobacterium bovis subsp bovis AF2122/97
gcggccugcucgacc

SEQ ID NO: 1147419 - RNA, 15 nt, Mycobacterium bovis subsp bovis AF2122/97
gcggccucgaccucu

SEQ ID NO: 1147420 - RNA, 21 nt, Mycobacterium bovis subsp bovis AF2122/97
gcggccuggucggccaggucg

SEQ ID NO: 1147421 - RNA, 16 nt, Mycobacterium bovis subsp bovis AF2122/97
gcggccugggccagcc

SEQ ID NO: 1147422 - RNA, 14 nt, Mycobacterium bovis subsp bovis AF2122/97
gcggccuucggccg

SEQ ID NO: 1147423 - RNA, 20 nt, Mycobacterium bovis subsp bovis AF2122/97
gcggccuugcgcacaggcgc

SEQ ID NO: 1147424 - RNA, 13 nt, Mycobacterium bovis subsp bovis AF2122/97
gcggccugcucgg

SEQ ID NO: 1147425 - RNA, 15 nt, Mycobacterium bovis subsp bovis AF2122/97
gcggccuugccgggc

SEQ ID NO: 1147426 - RNA, 15 nt, Mycobacterium bovis subsp bovis AF2122/97
gcggccuugcucagc

SEQ ID NO: 1147427 - RNA, 18 nt, Mycobacterium bovis subsp bovis AF2122/97
gcggccuugcucagcacg

SEQ ID NO: 1147428 - RNA, 19 nt, Mycobacterium bovis subsp bovis AF2122/97
gcggccuuggcgacgucgc

SEQ ID NO: 1147429 - RNA, 15 nt, Mycobacterium bovis subsp bovis AF2122/97
gcggccaguucggcg

SEQ ID NO: 1147430 - RNA, 21 nt, Mycobacterium bovis subsp bovis AF2122/97
gcggccaguucggcggccgcc

SEQ ID NO: 1147431 - RNA, 18 nt, Mycobacterium bovis subsp bovis AF2122/97
gcggccauaucgcccacc

SEQ ID NO: 1147432 - RNA, 14 nt, Mycobacterium bovis subsp bovis AF2122/97
gcggccaucgccga

SEQ ID NO: 1147433 - RNA, 18 nt, Mycobacterium bovis subsp bovis AF2122/97
gcggccaucgccgacacc

SEQ ID NO: 1147434 - RNA, 17 nt, Mycobacterium bovis subsp bovis AF2122/97
gcggccauccggcggcg

SEQ ID NO: 1147435 - RNA, 20 nt, Mycobacterium bovis subsp bovis AF2122/97
gcggccauccggcggcggcc

SEQ ID NO: 1147436 - RNA, 22 nt, Mycobacterium bovis subsp bovis AF2122/97
gcggccauccggcggcggccag

SEQ ID NO: 1147437 - RNA, 17 nt, Mycobacterium bovis subsp bovis AF2122/97
gcggccaucccgcguuc

SEQ ID NO: 1147438 - RNA, 19 nt, Mycobacterium bovis subsp bovis AF2122/97
gcggccauuagcagcaccc

SEQ ID NO: 1147439 - RNA, 20 nt, Mycobacterium bovis subsp bovis AF2122/97
gcggccauuagcagcacccg

SEQ ID NO: 1147440 - RNA, 19 nt, Mycobacterium bovis subsp bovis AF2122/97
gcggcccaaccggucgugg

SEQ ID NO: 1147441 - RNA, 19 nt, Mycobacterium bovis subsp bovis AF2122/97
gcggcccaucgggcgccca

SEQ ID NO: 1147442 - RNA, 20 nt, Mycobacterium bovis subsp bovis AF2122/97
gcggcccaucgggcgcccau

SEQ ID NO: 1147443 - RNA, 14 nt, Mycobacterium bovis subsp bovis AF2122/97
gcggccccgacaua

SEQ ID NO: 1147444 - RNA, 21 nt, Mycobacterium bovis subsp bovis AF2122/97
gcggccccgacauacgucggg

SEQ ID NO: 1147445 - RNA, 20 nt, Mycobacterium bovis subsp bovis AF2122/97
gcggcccaugaucucggcga

SEQ ID NO: 1147446 - RNA, 22 nt, Mycobacterium bovis subsp bovis AF2122/97
gcggcccaugaucucggcgaac

SEQ ID NO: 1147447 - RNA, 22 nt, Mycobacterium bovis subsp bovis AF2122/97
gcggccccgccguugccgccga

SEQ ID NO: 1147448 - RNA, 19 nt, Mycobacterium bovis subsp bovis AF2122/97
gcggccccgacugccgcgg

SEQ ID NO: 1147449 - RNA, 17 nt, Mycobacterium bovis subsp bovis AF2122/97
gcggcccagguccgcgu

SEQ ID NO: 1147450 - RNA, 14 nt, Mycobacterium bovis subsp bovis AF2122/97
aagcgcgguggucg

SEQ ID NO: 1147451 - RNA, 19 nt, Mycobacterium bovis subsp bovis AF2122/97
aagcgcgguuucggcgaug

SEQ ID NO: 1147452 - RNA, 21 nt, Mycobacterium bovis subsp bovis AF2122/97
gcggccccggcauugcccgag

SEQ ID NO: 1147453 - RNA, 20 nt, Mycobacterium bovis subsp bovis AF2122/97
aagcgcuuuagcgguguggg

SEQ ID NO: 1147454 - RNA, 21 nt, Mycobacterium bovis subsp bovis AF2122/97
aagcgcucaaugaucgcggcg

SEQ ID NO: 1147455 - RNA, 21 nt, Mycobacterium bovis subsp bovis AF2122/97
aagcgcgguuucggcgaugaa

SEQ ID NO: 1147456 - RNA, 13 nt, Mycobacterium bovis subsp bovis AF2122/97
gcggcccgccucg

SEQ ID NO: 1147457 - RNA, 13 nt, Mycobacterium bovis subsp bovis AF2122/97
gcggcccgcucga

SEQ ID NO: 1147458 - RNA, 19 nt, Mycobacterium bovis subsp bovis AF2122/97
gcggcccggacgucggcgg

SEQ ID NO: 1147459 - RNA, 13 nt, Mycobacterium bovis subsp bovis AF2122/97
gcggcccgcucgg

SEQ ID NO: 1147460 - RNA, 17 nt, Mycobacterium bovis subsp bovis AF2122/97
gcggcccgggcucggcg

SEQ ID NO: 1147461 - RNA, 16 nt, Mycobacterium bovis subsp bovis AF2122/97
gcggcccggguggccc

SEQ ID NO: 1147462 - RNA, 21 nt, Mycobacterium bovis subsp bovis AF2122/97
gcggcccggucuacgccaccg

SEQ ID NO: 1147463 - RNA, 14 nt, Mycobacterium bovis subsp bovis AF2122/97
gcggcccgucaccg

SEQ ID NO: 1147464 - RNA, 15 nt, Mycobacterium bovis subsp bovis AF2122/97
gcggcccgcagcccg

SEQ ID NO: 1147465 - RNA, 14 nt, Mycobacterium bovis subsp bovis AF2122/97
gcggcccgaucacc

SEQ ID NO: 1147466 - RNA, 21 nt, Mycobacterium bovis subsp bovis AF2122/97
gcggcccgauagaucgcgugg

SEQ ID NO: 1147467 - RNA, 16 nt, Mycobacterium bovis subsp bovis AF2122/97
aagcgggcgucgcggu

SEQ ID NO: 1147468 - RNA, 19 nt, Mycobacterium bovis subsp bovis AF2122/97
gcggcccgaggcucgggcc

SEQ ID NO: 1147469 - RNA, 21 nt, Mycobacterium bovis subsp bovis AF2122/97
gcggcccgacccggccgaugg

SEQ ID NO: 1147470 - RNA, 13 nt, Mycobacterium bovis subsp bovis AF2122/97
aagcgggcgucgc

SEQ ID NO: 1147471 - RNA, 14 nt, Mycobacterium bovis subsp bovis AF2122/97
gcggccccgucgcc

SEQ ID NO: 1147472 - RNA, 16 nt, Mycobacterium bovis subsp bovis AF2122/97
gcggccccgucgccga

SEQ ID NO: 1147473 - RNA, 18 nt, Mycobacterium bovis subsp bovis AF2122/97
aagcggcugcugcgcggu

SEQ ID NO: 1147474 - RNA, 23 nt, Mycobacterium bovis subsp bovis AF2122/97
aagcggccgguggaaaccgggcg

SEQ ID NO: 1147475 - RNA, 21 nt, Mycobacterium bovis subsp bovis AF2122/97
aagcggccaccgccgccgcca

SEQ ID NO: 1147476 - RNA, 13 nt, Mycobacterium bovis subsp bovis AF2122/97
aagcggcccgcug

SEQ ID NO: 1147477 - RNA, 18 nt, Mycobacterium bovis subsp bovis AF2122/97
gcggcuccguuguccagc

SEQ ID NO: 1147478 - RNA, 15 nt, Mycobacterium bovis subsp bovis AF2122/97
gcggcucgccggcgg

SEQ ID NO: 1147479 - RNA, 14 nt, Mycobacterium bovis subsp bovis AF2122/97
gcggcucggcggcg

SEQ ID NO: 1147480 - RNA, 15 nt, Mycobacterium bovis subsp bovis AF2122/97
gcggcucggcggcgc

SEQ ID NO: 1147481 - RNA, 18 nt, Mycobacterium bovis subsp bovis AF2122/97
gcggcucgggugcgcccg

SEQ ID NO: 1147482 - RNA, 17 nt, Mycobacterium bovis subsp bovis AF2122/97
gcggcuccggcggcagc

SEQ ID NO: 1147483 - RNA, 13 nt, Mycobacterium bovis subsp bovis AF2122/97
gcggcugaaccgc

SEQ ID NO: 1147484 - RNA, 17 nt, Mycobacterium bovis subsp bovis AF2122/97
gcggcugaaccgcuggg

SEQ ID NO: 1147485 - RNA, 21 nt, Mycobacterium bovis subsp bovis AF2122/97
gcggcugaaccgcugggacaa

SEQ ID NO: 1147486 - RNA, 17 nt, Mycobacterium bovis subsp bovis AF2122/97
gcggcguuccgggccga

SEQ ID NO: 1147487 - RNA, 22 nt, Mycobacterium bovis subsp bovis AF2122/97
gcggcguuccgggccgaucacc

SEQ ID NO: 1147488 - RNA, 16 nt, Mycobacterium bovis subsp bovis AF2122/97
gcggcuccaccgggcc

SEQ ID NO: 1147489 - RNA, 18 nt, Mycobacterium bovis subsp bovis AF2122/97
gcggcuccaccgggcccg

SEQ ID NO: 1147490 - RNA, 23 nt, Mycobacterium bovis subsp bovis AF2122/97
gcggcuccaccgggcccgccggc

SEQ ID NO: 1147491 - RNA, 12 nt, Mycobacterium bovis subsp bovis AF2122/97
gcggcguggcgc

SEQ ID NO: 1147492 - RNA, 19 nt, Mycobacterium bovis subsp bovis AF2122/97
gcggcguuccaacucgguu

SEQ ID NO: 1147493 - RNA, 15 nt, Mycobacterium bovis subsp bovis AF2122/97
gcggcguuccccgag

SEQ ID NO: 1147494 - RNA, 22 nt, Mycobacterium bovis subsp bovis AF2122/97
gcggcguuccccgagaacggcg

SEQ ID NO: 1147495 - RNA, 19 nt, Mycobacterium bovis subsp bovis AF2122/97
gcggcgugggagguggcgc

SEQ ID NO: 1147496 - RNA, 16 nt, Mycobacterium bovis subsp bovis AF2122/97
gcggcguguacgucga

SEQ ID NO: 1147497 - RNA, 18 nt, Mycobacterium bovis subsp bovis AF2122/97
gcggcugggggauaccgc

SEQ ID NO: 1147498 - RNA, 22 nt, Mycobacterium bovis subsp bovis AF2122/97
gcggcugggggauaccgcuggg

SEQ ID NO: 1147499 - RNA, 20 nt, Mycobacterium bovis subsp bovis AF2122/97
gcggcugucacgccugccac

SEQ ID NO: 1147500 - RNA, 15 nt, Mycobacterium bovis subsp bovis AF2122/97
gcggcugugcccgau

SEQ ID NO: 1147501 - RNA, 16 nt, Mycobacterium bovis subsp bovis AF2122/97
gcggcuguugaagagg

SEQ ID NO: 1147502 - RNA, 22 nt, Mycobacterium bovis subsp bovis AF2122/97
gcggcugucacgccugccaccg

SEQ ID NO: 1147503 - RNA, 21 nt, Mycobacterium bovis subsp bovis AF2122/97
gcggcuggggccccgcgccgg

SEQ ID NO: 1147504 - RNA, 21 nt, Mycobacterium bovis subsp bovis AF2122/97
gcggcugucacgccugccacc

SEQ ID NO: 1147505 - RNA, 18 nt, Mycobacterium bovis subsp bovis AF2122/97
gcggcugaccucccaccc

SEQ ID NO: 1147506 - RNA, 17 nt, Mycobacterium bovis subsp bovis AF2122/97
gcggcugcagccgaccg

SEQ ID NO: 1147507 - RNA, 17 nt, Mycobacterium bovis subsp bovis AF2122/97
gcggcugcacgcugcgg

SEQ ID NO: 1147508 - RNA, 14 nt, Mycobacterium bovis subsp bovis AF2122/97
gcggcugcagccga

SEQ ID NO: 1147509 - RNA, 17 nt, Mycobacterium bovis subsp bovis AF2122/97
gcggcugcccgagaucg

SEQ ID NO: 1147510 - RNA, 23 nt, Mycobacterium bovis subsp bovis AF2122/97
gcggcugcccgagaucgcgugcg

SEQ ID NO: 1147511 - RNA, 16 nt, Mycobacterium bovis subsp bovis AF2122/97
gcggcugcuuggucgc

SEQ ID NO: 1147512 - RNA, 15 nt, Mycobacterium bovis subsp bovis AF2122/97
gcggcuggcccgcau

SEQ ID NO: 1147513 - RNA, 22 nt, Mycobacterium bovis subsp bovis AF2122/97
gcggcugcuuggucgcccagcc

SEQ ID NO: 1147514 - RNA, 19 nt, Mycobacterium bovis subsp bovis AF2122/97
gcggcuggcccgcaugccg

SEQ ID NO: 1147515 - RNA, 17 nt, Mycobacterium bovis subsp bovis AF2122/97
gcggcugcuccgucgcc

SEQ ID NO: 1147516 - RNA, 19 nt, Mycobacterium bovis subsp bovis AF2122/97
gcggcugcuccgucgccga

SEQ ID NO: 1147517 - RNA, 21 nt, Mycobacterium bovis subsp bovis AF2122/97
gcggcugcuccgucgccgaac

SEQ ID NO: 1147518 - RNA, 17 nt, Mycobacterium bovis subsp bovis AF2122/97
gcgggccaccacgcgcc

SEQ ID NO: 1147519 - RNA, 16 nt, Mycobacterium bovis subsp bovis AF2122/97
gcgggccaccgcuguc

SEQ ID NO: 1147520 - RNA, 17 nt, Mycobacterium bovis subsp bovis AF2122/97
gcgggccaaagccguca

SEQ ID NO: 1147521 - RNA, 13 nt, Mycobacterium bovis subsp bovis AF2122/97
gcgggccaacucg

SEQ ID NO: 1147522 - RNA, 15 nt, Mycobacterium bovis subsp bovis AF2122/97
gcgggcaugccggcg

SEQ ID NO: 1147523 - RNA, 16 nt, Mycobacterium bovis subsp bovis AF2122/97
gcgggcaugccggcga

SEQ ID NO: 1147524 - RNA, 13 nt, Mycobacterium bovis subsp bovis AF2122/97
gcgggccagcacc

SEQ ID NO: 1147525 - RNA, 15 nt, Mycobacterium bovis subsp bovis AF2122/97
gcgggccagcacccg

SEQ ID NO: 1147526 - RNA, 18 nt, Mycobacterium bovis subsp bovis AF2122/97
gcgggccgaggccgucgc

SEQ ID NO: 1147527 - RNA, 20 nt, Mycobacterium bovis subsp bovis AF2122/97
gcgggccgaggccgucgcga

SEQ ID NO: 1147528 - RNA, 19 nt, Mycobacterium bovis subsp bovis AF2122/97
gcgggccgccaggcggccg

SEQ ID NO: 1147529 - RNA, 14 nt, Mycobacterium bovis subsp bovis AF2122/97
gcgggccgcgcggc

SEQ ID NO: 1147530 - RNA, 16 nt, Mycobacterium bovis subsp bovis AF2122/97
gcgggccgcgcggcga

SEQ ID NO: 1147531 - RNA, 14 nt, Mycobacterium bovis subsp bovis AF2122/97
gcgggccggugaac

SEQ ID NO: 1147532 - RNA, 14 nt, Mycobacterium bovis subsp bovis AF2122/97
gcgggcgaacgcuu

SEQ ID NO: 1147533 - RNA, 13 nt, Mycobacterium bovis subsp bovis AF2122/97
gcgggccgccgca

SEQ ID NO: 1147534 - RNA, 19 nt, Mycobacterium bovis subsp bovis AF2122/97
gcggcuguugcggcggcgc

SEQ ID NO: 1147535 - RNA, 14 nt, Mycobacterium bovis subsp bovis AF2122/97
gcggcuucgacguc

SEQ ID NO: 1147536 - RNA, 15 nt, Mycobacterium bovis subsp bovis AF2122/97
gcggcuucgacgucg

SEQ ID NO: 1147537 - RNA, 17 nt, Mycobacterium bovis subsp bovis AF2122/97
gcggcuucgacgucggc

SEQ ID NO: 1147538 - RNA, 20 nt, Mycobacterium bovis subsp bovis AF2122/97
gcggcuucgacgucggcgac

SEQ ID NO: 1147539 - RNA, 13 nt, Mycobacterium bovis subsp bovis AF2122/97
gcggcuucgcccc

SEQ ID NO: 1147540 - RNA, 15 nt, Mycobacterium bovis subsp bovis AF2122/97
gcggcuucgccgacg

SEQ ID NO: 1147541 - RNA, 18 nt, Mycobacterium bovis subsp bovis AF2122/97
gcggcuucgucgacaucg

SEQ ID NO: 1147542 - RNA, 21 nt, Mycobacterium bovis subsp bovis AF2122/97
gcgggaaaauauaugcgcacu

SEQ ID NO: 1147543 - RNA, 23 nt, Mycobacterium bovis subsp bovis AF2122/97
gcgggaaacccaugcaugcguug

SEQ ID NO: 1147544 - RNA, 20 nt, Mycobacterium bovis subsp bovis AF2122/97
gcgggaagaacaucaccucg

SEQ ID NO: 1147545 - RNA, 18 nt, Mycobacterium bovis subsp bovis AF2122/97
gcgggaacgaugccgccg

SEQ ID NO: 1147546 - RNA, 19 nt, Mycobacterium bovis subsp bovis AF2122/97
gcgggaacgaugccgccgg

SEQ ID NO: 1147547 - RNA, 14 nt, Mycobacterium bovis subsp bovis AF2122/97
gcgggaacgcggcg

SEQ ID NO: 1147548 - RNA, 17 nt, Mycobacterium bovis subsp bovis AF2122/97
gcgggaacgagccacgc

SEQ ID NO: 1147549 - RNA, 18 nt, Mycobacterium bovis subsp bovis AF2122/97
gcgggcaacugcagcaug

SEQ ID NO: 1147550 - RNA, 19 nt, Mycobacterium bovis subsp bovis AF2122/97
gcgggcaacugcagcaugg

SEQ ID NO: 1147551 - RNA, 19 nt, Mycobacterium bovis subsp bovis AF2122/97
gcggcuucgucgacaucgc

SEQ ID NO: 1147552 - RNA, 20 nt, Mycobacterium bovis subsp bovis AF2122/97
gcgggcaagucgcccagccg

SEQ ID NO: 1147553 - RNA, 17 nt, Mycobacterium bovis subsp bovis AF2122/97
gcgggcaaucaccgccg

SEQ ID NO: 1147554 - RNA, 19 nt, Mycobacterium bovis subsp bovis AF2122/97
gcgggcaaucaccgccggc

SEQ ID NO: 1147555 - RNA, 20 nt, Mycobacterium bovis subsp bovis AF2122/97
gcgggcaaucaccgccggcg

SEQ ID NO: 1147556 - RNA, 13 nt, Mycobacterium bovis subsp bovis AF2122/97
gcgggauugcgcg

SEQ ID NO: 1147557 - RNA, 20 nt, Mycobacterium bovis subsp bovis AF2122/97
gcgggaagucccgaguggcc

SEQ ID NO: 1147558 - RNA, 21 nt, Mycobacterium bovis subsp bovis AF2122/97
gcgggaaguucgccggucccc

SEQ ID NO: 1147559 - RNA, 15 nt, Mycobacterium bovis subsp bovis AF2122/97
gcgggaagacgucgg

SEQ ID NO: 1147560 - RNA, 21 nt, Mycobacterium bovis subsp bovis AF2122/97
gcgggaagacgucgggaucgc

SEQ ID NO: 1147561 - RNA, 15 nt, Mycobacterium bovis subsp bovis AF2122/97
gcgggauggccgccg

SEQ ID NO: 1147562 - RNA, 17 nt, Mycobacterium bovis subsp bovis AF2122/97
gcgggauggccgccgac

SEQ ID NO: 1147563 - RNA, 18 nt, Mycobacterium bovis subsp bovis AF2122/97
gcgggauggggcccgcau

SEQ ID NO: 1147564 - RNA, 15 nt, Mycobacterium bovis subsp bovis AF2122/97
gcgggaucugagggc

SEQ ID NO: 1147565 - RNA, 22 nt, Mycobacterium bovis subsp bovis AF2122/97
gcgggaucugagggcucggugg

SEQ ID NO: 1147566 - RNA, 19 nt, Mycobacterium bovis subsp bovis AF2122/97
gcgggaaggcucaccacgg

SEQ ID NO: 1147567 - RNA, 23 nt, Mycobacterium bovis subsp bovis AF2122/97
gcggcgaccgucgauuucgacga

SEQ ID NO: 1147568 - RNA, 18 nt, Mycobacterium bovis subsp bovis AF2122/97
gcggcgaccucggcggcg

SEQ ID NO: 1147569 - RNA, 19 nt, Mycobacterium bovis subsp bovis AF2122/97
gcggcgaccucggcggcgg

SEQ ID NO: 1147570 - RNA, 20 nt, Mycobacterium bovis subsp bovis AF2122/97
gcggcgaccucggcggcggc

SEQ ID NO: 1147571 - RNA, 15 nt, Mycobacterium bovis subsp bovis AF2122/97
gcggcgaccuguccg

SEQ ID NO: 1147572 - RNA, 14 nt, Mycobacterium bovis subsp bovis AF2122/97
gcggcgaccgucga

SEQ ID NO: 1147573 - RNA, 18 nt, Mycobacterium bovis subsp bovis AF2122/97
gcggcgacggccgcucgg

SEQ ID NO: 1147574 - RNA, 18 nt, Mycobacterium bovis subsp bovis AF2122/97
gcggcgacuacccagcca

SEQ ID NO: 1147575 - RNA, 18 nt, Mycobacterium bovis subsp bovis AF2122/97
gcggcgacuacggccucg

SEQ ID NO: 1147576 - RNA, 14 nt, Mycobacterium bovis subsp bovis AF2122/97
gcggcgacguggcg

SEQ ID NO: 1147577 - RNA, 15 nt, Mycobacterium bovis subsp bovis AF2122/97
gcggcgacguggcgc

SEQ ID NO: 1147578 - RNA, 14 nt, Mycobacterium bovis subsp bovis AF2122/97
gcggcgacggcgga

SEQ ID NO: 1147579 - RNA, 15 nt, Mycobacterium bovis subsp bovis AF2122/97
gcggcgacggcggag

SEQ ID NO: 1147580 - RNA, 16 nt, Mycobacterium bovis subsp bovis AF2122/97
gcggcgacggcggcac

SEQ ID NO: 1147581 - RNA, 14 nt, Mycobacterium bovis subsp bovis AF2122/97
gcggcgacgagcgc

SEQ ID NO: 1147582 - RNA, 13 nt, Mycobacterium bovis subsp bovis AF2122/97
gcggcgacggugc

SEQ ID NO: 1147583 - RNA, 14 nt, Mycobacterium bovis subsp bovis AF2122/97
gcggcgacggugcc

SEQ ID NO: 1147584 - RNA, 19 nt, Mycobacterium bovis subsp bovis AF2122/97
gcggcgcccaucgcgacgg

SEQ ID NO: 1147585 - RNA, 19 nt, Mycobacterium bovis subsp bovis AF2122/97
gcggcgccaguauggccgc

SEQ ID NO: 1147586 - RNA, 21 nt, Mycobacterium bovis subsp bovis AF2122/97
gcggcgccggggggcugcugc

SEQ ID NO: 1147587 - RNA, 13 nt, Mycobacterium bovis subsp bovis AF2122/97
gcggcgccgucga

SEQ ID NO: 1147588 - RNA, 14 nt, Mycobacterium bovis subsp bovis AF2122/97
gcggcgcccgccac

SEQ ID NO: 1147589 - RNA, 21 nt, Mycobacterium bovis subsp bovis AF2122/97
gcggcgccggugggcgguccg

SEQ ID NO: 1147590 - RNA, 17 nt, Mycobacterium bovis subsp bovis AF2122/97
gcggcgccguugccacc

SEQ ID NO: 1147591 - RNA, 13 nt, Mycobacterium bovis subsp bovis AF2122/97
gcggcgccgucgu

SEQ ID NO: 1147592 - RNA, 13 nt, Mycobacterium bovis subsp bovis AF2122/97
gcggcgcucggcc

SEQ ID NO: 1147593 - RNA, 14 nt, Mycobacterium bovis subsp bovis AF2122/97
gcggcgcucggcca

SEQ ID NO: 1147594 - RNA, 13 nt, Mycobacterium bovis subsp bovis AF2122/97
gcggcgcucggcg

SEQ ID NO: 1147595 - RNA, 21 nt, Mycobacterium bovis subsp bovis AF2122/97
gcggcgcucggcgccacggug

SEQ ID NO: 1147596 - RNA, 23 nt, Mycobacterium bovis subsp bovis AF2122/97
aagcgucuggucagccgcggcgg

SEQ ID NO: 1147597 - RNA, 14 nt, Mycobacterium bovis subsp bovis AF2122/97
aagcgugcgccgac

SEQ ID NO: 1147598 - RNA, 15 nt, Mycobacterium bovis subsp bovis AF2122/97
gcggcgcuggccagc

SEQ ID NO: 1147599 - RNA, 22 nt, Mycobacterium bovis subsp bovis AF2122/97
gcggcgccuguucgggagcuga

SEQ ID NO: 1147600 - RNA, 21 nt, Mycobacterium bovis subsp bovis AF2122/97
gcggcgcgacagacagcaccg

SEQ ID NO: 1147601 - RNA, 22 nt, Mycobacterium bovis subsp bovis AF2122/97
gcggcgcgaagucuugaccgca

SEQ ID NO: 1147602 - RNA, 21 nt, Mycobacterium bovis subsp bovis AF2122/97
gcggcgcggagagccugcucg

SEQ ID NO: 1147603 - RNA, 13 nt, Mycobacterium bovis subsp bovis AF2122/97
gcggcgcgagcag

SEQ ID NO: 1147604 - RNA, 15 nt, Mycobacterium bovis subsp bovis AF2122/97
aagcgguuguccggu

SEQ ID NO: 1147605 - RNA, 23 nt, Mycobacterium bovis subsp bovis AF2122/97
aagcgguuauguauccgcgccgc

SEQ ID NO: 1147606 - RNA, 13 nt, Mycobacterium bovis subsp bovis AF2122/97
gcggcggcgacga

SEQ ID NO: 1147607 - RNA, 13 nt, Mycobacterium bovis subsp bovis AF2122/97
gcggcggcgacua

SEQ ID NO: 1147608 - RNA, 15 nt, Mycobacterium bovis subsp bovis AF2122/97
gcggcggcgcccggc

SEQ ID NO: 1147609 - RNA, 15 nt, Mycobacterium bovis subsp bovis AF2122/97
gcggcggcgcucguc

SEQ ID NO: 1147610 - RNA, 16 nt, Mycobacterium bovis subsp bovis AF2122/97
gcggcggcgcucgucg

SEQ ID NO: 1147611 - RNA, 19 nt, Mycobacterium bovis subsp bovis AF2122/97
gcggcggcgcgaucgacgc

SEQ ID NO: 1147612 - RNA, 16 nt, Mycobacterium bovis subsp bovis AF2122/97
gcggcggcgcgaucga

SEQ ID NO: 1147613 - RNA, 18 nt, Mycobacterium bovis subsp bovis AF2122/97
gcggcggcgcgaucgacg

SEQ ID NO: 1147614 - RNA, 22 nt, Mycobacterium bovis subsp bovis AF2122/97
gcggcggcaacccugcccggcc

SEQ ID NO: 1147615 - RNA, 19 nt, Mycobacterium bovis subsp bovis AF2122/97
gcggcggcaucucgcaccg

SEQ ID NO: 1147616 - RNA, 19 nt, Mycobacterium bovis subsp bovis AF2122/97
gcggcggauuccggcaucg

SEQ ID NO: 1147617 - RNA, 14 nt, Mycobacterium bovis subsp bovis AF2122/97
gcggcggcggccau

SEQ ID NO: 1147618 - RNA, 15 nt, Mycobacterium bovis subsp bovis AF2122/97
gcggcggcgcuggcg

SEQ ID NO: 1147619 - RNA, 17 nt, Mycobacterium bovis subsp bovis AF2122/97
gcggcgggggcggcggc

SEQ ID NO: 1147620 - RNA, 20 nt, Mycobacterium bovis subsp bovis AF2122/97
gcggcgggggcgucgccgcc

SEQ ID NO: 1147621 - RNA, 21 nt, Mycobacterium bovis subsp bovis AF2122/97
gcggcgggggcgucgccgccg

SEQ ID NO: 1147622 - RNA, 23 nt, Mycobacterium bovis subsp bovis AF2122/97
gcggcggggggugaucgccaccg

SEQ ID NO: 1147623 - RNA, 16 nt, Mycobacterium bovis subsp bovis AF2122/97
gcggcgguggcgaaca

SEQ ID NO: 1147624 - RNA, 18 nt, Mycobacterium bovis subsp bovis AF2122/97
gcggcgguggccagcguc

SEQ ID NO: 1147625 - RNA, 22 nt, Mycobacterium bovis subsp bovis AF2122/97
gcggcgguaugcucgcuggcgc

SEQ ID NO: 1147626 - RNA, 14 nt, Mycobacterium bovis subsp bovis AF2122/97
gcggcgguaguacu

SEQ ID NO: 1147627 - RNA, 14 nt, Mycobacterium bovis subsp bovis AF2122/97
gcggcggguccucg

SEQ ID NO: 1147628 - RNA, 23 nt, Mycobacterium bovis subsp bovis AF2122/97
gcggcgguaaaccuggcuaucgc

SEQ ID NO: 1147629 - RNA, 18 nt, Mycobacterium bovis subsp bovis AF2122/97
gcggcguauugcggccug

SEQ ID NO: 1147630 - RNA, 13 nt, Mycobacterium bovis subsp bovis AF2122/97
gcggcguccagca

SEQ ID NO: 1147631 - RNA, 19 nt, Mycobacterium bovis subsp bovis AF2122/97
gcggcguccaucgcgcgcc

SEQ ID NO: 1147632 - RNA, 21 nt, Mycobacterium bovis subsp bovis AF2122/97
gcggcguccaucgcgcgccga

SEQ ID NO: 1147633 - RNA, 16 nt, Mycobacterium bovis subsp bovis AF2122/97
gcggcgucuucgucgg

SEQ ID NO: 1147634 - RNA, 16 nt, Mycobacterium bovis subsp bovis AF2122/97
gcggcgucgucgucga

SEQ ID NO: 1147635 - RNA, 24 nt, Mycobacterium bovis subsp bovis AF2122/97
gcggcguccaucgcgcgccgaccg

SEQ ID NO: 1147636 - RNA, 21 nt, Mycobacterium bovis subsp bovis AF2122/97
gcggcgugcuuaacacaugca

SEQ ID NO: 1147637 - RNA, 18 nt, Mycobacterium bovis subsp bovis AF2122/97
gcggcguggcgccggcca

SEQ ID NO: 1147638 - RNA, 18 nt, Mycobacterium bovis subsp bovis AF2122/97
aagcuaaccgcuuggugu

SEQ ID NO: 1147639 - RNA, 22 nt, Mycobacterium bovis subsp bovis AF2122/97
gcggcguagcagaaggccgcgg

SEQ ID NO: 1147640 - RNA, 16 nt, Mycobacterium bovis subsp bovis AF2122/97
gcggcgguggugucgc

SEQ ID NO: 1147641 - RNA, 21 nt, Mycobacterium bovis subsp bovis AF2122/97
gcggcggugucacgacccaag

SEQ ID NO: 1147642 - RNA, 15 nt, Mycobacterium bovis subsp bovis AF2122/97
gcgucggcugccgcg

SEQ ID NO: 1147643 - RNA, 23 nt, Mycobacterium bovis subsp bovis AF2122/97
gcgucggcggcuuccucgagcga

SEQ ID NO: 1147644 - RNA, 14 nt, Mycobacterium bovis subsp bovis AF2122/97
gcgucggcggcgac

SEQ ID NO: 1147645 - RNA, 15 nt, Mycobacterium bovis subsp bovis AF2122/97
gcgucggcggccagu

SEQ ID NO: 1147646 - RNA, 17 nt, Mycobacterium bovis subsp bovis AF2122/97
gcgucggcggccaguac

SEQ ID NO: 1147647 - RNA, 13 nt, Mycobacterium bovis subsp bovis AF2122/97
gcgucgggcucgg

SEQ ID NO: 1147648 - RNA, 13 nt, Mycobacterium bovis subsp bovis AF2122/97
gcgucggucaccg

SEQ ID NO: 1147649 - RNA, 14 nt, Mycobacterium bovis subsp bovis AF2122/97
gcgucggucaccga

SEQ ID NO: 1147650 - RNA, 16 nt, Mycobacterium bovis subsp bovis AF2122/97
gcgucgggcucggcga

SEQ ID NO: 1147651 - RNA, 17 nt, Mycobacterium bovis subsp bovis AF2122/97
gcgucgggcucggcgaa

SEQ ID NO: 1147652 - RNA, 14 nt, Mycobacterium bovis subsp bovis AF2122/97
gcgucgggcucggc

SEQ ID NO: 1147653 - RNA, 21 nt, Mycobacterium bovis subsp bovis AF2122/97
gcgucgcgccugcccggguga

SEQ ID NO: 1147654 - RNA, 13 nt, Mycobacterium bovis subsp bovis AF2122/97
gcgucgcggccac

SEQ ID NO: 1147655 - RNA, 23 nt, Mycobacterium bovis subsp bovis AF2122/97
gcgucgcgggucuuggcgaucuc

SEQ ID NO: 1147656 - RNA, 17 nt, Mycobacterium bovis subsp bovis AF2122/97
gcgucgcgggauugcgc

SEQ ID NO: 1147657 - RNA, 20 nt, Mycobacterium bovis subsp bovis AF2122/97
gcgucgcuaucgugcgccga

SEQ ID NO: 1147658 - RNA, 14 nt, Mycobacterium bovis subsp bovis AF2122/97
gcgucgcucgucgu

SEQ ID NO: 1147659 - RNA, 15 nt, Mycobacterium bovis subsp bovis AF2122/97
gcgucgcugaccgcg

SEQ ID NO: 1147660 - RNA, 13 nt, Mycobacterium bovis subsp bovis AF2122/97
gcgucgcgcgcgg

SEQ ID NO: 1147661 - RNA, 16 nt, Mycobacterium bovis subsp bovis AF2122/97
gcgucgcgcgcggcau

SEQ ID NO: 1147662 - RNA, 15 nt, Mycobacterium bovis subsp bovis AF2122/97
gcguccggugcuggu

SEQ ID NO: 1147663 - RNA, 14 nt, Mycobacterium bovis subsp bovis AF2122/97
gcguccgucggcga

SEQ ID NO: 1147664 - RNA, 15 nt, Mycobacterium bovis subsp bovis AF2122/97
gcguccgucggcgaa

SEQ ID NO: 1147665 - RNA, 15 nt, Mycobacterium bovis subsp bovis AF2122/97
gcguccgucgucggc

SEQ ID NO: 1147666 - RNA, 17 nt, Mycobacterium bovis subsp bovis AF2122/97
gcguccgucgucggcgu

SEQ ID NO: 1147667 - RNA, 19 nt, Mycobacterium bovis subsp bovis AF2122/97
gcguccgucucgcaggcgc

SEQ ID NO: 1147668 - RNA, 17 nt, Mycobacterium bovis subsp bovis AF2122/97
gcgucccggcggucagc

SEQ ID NO: 1147669 - RNA, 15 nt, Mycobacterium bovis subsp bovis AF2122/97
gcgucgaccacaggc

SEQ ID NO: 1147670 - RNA, 14 nt, Mycobacterium bovis subsp bovis AF2122/97
gcguccugcucgcg

SEQ ID NO: 1147671 - RNA, 14 nt, Mycobacterium bovis subsp bovis AF2122/97
gcgucgaccacgca

SEQ ID NO: 1147672 - RNA, 13 nt, Mycobacterium bovis subsp bovis AF2122/97
gcgucgaccacgc

SEQ ID NO: 1147673 - RNA, 15 nt, Mycobacterium bovis subsp bovis AF2122/97
gcgucgaccggacaa

SEQ ID NO: 1147674 - RNA, 14 nt, Mycobacterium bovis subsp bovis AF2122/97
gcgucgaccgcggc

SEQ ID NO: 1147675 - RNA, 18 nt, Mycobacterium bovis subsp bovis AF2122/97
gcgucgaccgcggcccgg

SEQ ID NO: 1147676 - RNA, 14 nt, Mycobacterium bovis subsp bovis AF2122/97
gcgucgacuggccg

SEQ ID NO: 1147677 - RNA, 21 nt, Mycobacterium bovis subsp bovis AF2122/97
gcgucgacuggccguuucggc

SEQ ID NO: 1147678 - RNA, 14 nt, Mycobacterium bovis subsp bovis AF2122/97
gcgucgacgucgac

SEQ ID NO: 1147679 - RNA, 18 nt, Mycobacterium bovis subsp bovis AF2122/97
gcgucgcaggauucccag

SEQ ID NO: 1147680 - RNA, 23 nt, Mycobacterium bovis subsp bovis AF2122/97
gcgucgaccucgcgggcgaucgg

SEQ ID NO: 1147681 - RNA, 17 nt, Mycobacterium bovis subsp bovis AF2122/97
gcguccccagcgccacc

SEQ ID NO: 1147682 - RNA, 15 nt, Mycobacterium bovis subsp bovis AF2122/97
gcguccccagcgcca

SEQ ID NO: 1147683 - RNA, 22 nt, Mycobacterium bovis subsp bovis AF2122/97
gcgucccaaucgggaucgcugc

SEQ ID NO: 1147684 - RNA, 23 nt, Mycobacterium bovis subsp bovis AF2122/97
gcgucccaaucgggaucgcugcc

SEQ ID NO: 1147685 - RNA, 16 nt, Mycobacterium bovis subsp bovis AF2122/97
gcgucccggucgccaa

SEQ ID NO: 1147686 - RNA, 14 nt, Mycobacterium bovis subsp bovis AF2122/97
gcguccaucaccag

SEQ ID NO: 1147687 - RNA, 16 nt, Mycobacterium bovis subsp bovis AF2122/97
gcguccaucaccagca

SEQ ID NO: 1147688 - RNA, 20 nt, Mycobacterium bovis subsp bovis AF2122/97
gcguccauggucgcgccacc

SEQ ID NO: 1147689 - RNA, 18 nt, Mycobacterium bovis subsp bovis AF2122/97
gcguccaguccgaucacc

SEQ ID NO: 1147690 - RNA, 18 nt, Mycobacterium bovis subsp bovis AF2122/97
gcguccaucgccaccgcg

SEQ ID NO: 1147691 - RNA, 16 nt, Mycobacterium bovis subsp bovis AF2122/97
gcguccauccgcagca

SEQ ID NO: 1147692 - RNA, 20 nt, Mycobacterium bovis subsp bovis AF2122/97
gcguccaucgcgcgccgacc

SEQ ID NO: 1147693 - RNA, 18 nt, Mycobacterium bovis subsp bovis AF2122/97
gcgucaggcacaacgcga

SEQ ID NO: 1147694 - RNA, 20 nt, Mycobacterium bovis subsp bovis AF2122/97
gcgucaggccagagucgccc

SEQ ID NO: 1147695 - RNA, 13 nt, Mycobacterium bovis subsp bovis AF2122/97
gcgucaggccagc

SEQ ID NO: 1147696 - RNA, 17 nt, Mycobacterium bovis subsp bovis AF2122/97
gcguccagcgcggccuu

SEQ ID NO: 1147697 - RNA, 18 nt, Mycobacterium bovis subsp bovis AF2122/97
gcguccaggccagggcgg

SEQ ID NO: 1147698 - RNA, 19 nt, Mycobacterium bovis subsp bovis AF2122/97
gcgucacccugucgcgcac

SEQ ID NO: 1147699 - RNA, 22 nt, Mycobacterium bovis subsp bovis AF2122/97
gcgucacccugucgcgcaccgg

SEQ ID NO: 1147700 - RNA, 19 nt, Mycobacterium bovis subsp bovis AF2122/97
gcgucaccgccggugcuga

SEQ ID NO: 1147701 - RNA, 18 nt, Mycobacterium bovis subsp bovis AF2122/97
gcgucagccgcaccccgc

SEQ ID NO: 1147702 - RNA, 22 nt, Mycobacterium bovis subsp bovis AF2122/97
gcgucagccgcaccccgcccga

SEQ ID NO: 1147703 - RNA, 15 nt, Mycobacterium bovis subsp bovis AF2122/97
gcgucaggcacaacg

SEQ ID NO: 1147704 - RNA, 16 nt, Mycobacterium bovis subsp bovis AF2122/97
gcgucaggcacaacgc

SEQ ID NO: 1147705 - RNA, 18 nt, Mycobacterium bovis subsp bovis AF2122/97
gcgucaccggaggccgcc

SEQ ID NO: 1147706 - RNA, 14 nt, Mycobacterium bovis subsp bovis AF2122/97
gcgucagcggcgag

SEQ ID NO: 1147707 - RNA, 17 nt, Mycobacterium bovis subsp bovis AF2122/97
gcgucaacgcuguuguc

SEQ ID NO: 1147708 - RNA, 17 nt, Mycobacterium bovis subsp bovis AF2122/97
gcgucaaguccgagucg

SEQ ID NO: 1147709 - RNA, 23 nt, Mycobacterium bovis subsp bovis AF2122/97
gcgucacauccgacagcagccgg

SEQ ID NO: 1147710 - RNA, 23 nt, Mycobacterium bovis subsp bovis AF2122/97
gcgucaccccggucccgccgacc

SEQ ID NO: 1147711 - RNA, 13 nt, Mycobacterium bovis subsp bovis AF2122/97
gcgucacccgcaa

SEQ ID NO: 1147712 - RNA, 21 nt, Mycobacterium bovis subsp bovis AF2122/97
gcgucaccccggucccgccga

SEQ ID NO: 1147713 - RNA, 15 nt, Mycobacterium bovis subsp bovis AF2122/97
gcgucaacgcuguug

SEQ ID NO: 1147714 - RNA, 19 nt, Mycobacterium bovis subsp bovis AF2122/97
gcgucaaccgaucggucgu

SEQ ID NO: 1147715 - RNA, 21 nt, Mycobacterium bovis subsp bovis AF2122/97
gcgucaaccgaucggucgucc

SEQ ID NO: 1147716 - RNA, 21 nt, Mycobacterium bovis subsp bovis AF2122/97
gcgucaaccacggccgccgcg

SEQ ID NO: 1147717 - RNA, 20 nt, Mycobacterium bovis subsp bovis AF2122/97
gcguagugcucgccggcacc

SEQ ID NO: 1147718 - RNA, 20 nt, Mycobacterium bovis subsp bovis AF2122/97
gcguauagcaugccgcggcg

SEQ ID NO: 1147719 - RNA, 21 nt, Mycobacterium bovis subsp bovis AF2122/97
gcguauagcaugccgcggcgg

SEQ ID NO: 1147720 - RNA, 19 nt, Mycobacterium bovis subsp bovis AF2122/97
gcguaguccaggccgucgu

SEQ ID NO: 1147721 - RNA, 17 nt, Mycobacterium bovis subsp bovis AF2122/97
gcguaguccaggccguc

SEQ ID NO: 1147722 - RNA, 13 nt, Mycobacterium bovis subsp bovis AF2122/97
gcguaguccaggc

SEQ ID NO: 1147723 - RNA, 16 nt, Mycobacterium bovis subsp bovis AF2122/97
gcguaguccaggccgu

SEQ ID NO: 1147724 - RNA, 19 nt, Mycobacterium bovis subsp bovis AF2122/97
gcguagcaggucgacggcc

SEQ ID NO: 1147725 - RNA, 20 nt, Mycobacterium bovis subsp bovis AF2122/97
gcguagcccaugccgaugcc

SEQ ID NO: 1147726 - RNA, 17 nt, Mycobacterium bovis subsp bovis AF2122/97
gcguaguaaugcucgac

SEQ ID NO: 1147727 - RNA, 18 nt, Mycobacterium bovis subsp bovis AF2122/97
gcguaguaaugcucgacg

SEQ ID NO: 1147728 - RNA, 19 nt, Mycobacterium bovis subsp bovis AF2122/97
gcguaguaaugcucgacgu

SEQ ID NO: 1147729 - RNA, 16 nt, Mycobacterium bovis subsp bovis AF2122/97
gcguagguggcacagu

SEQ ID NO: 1147730 - RNA, 13 nt, Mycobacterium bovis subsp bovis AF2122/97
gcguagagcagca

SEQ ID NO: 1147731 - RNA, 15 nt, Mycobacterium bovis subsp bovis AF2122/97
gcguagagcagcagc

SEQ ID NO: 1147732 - RNA, 17 nt, Mycobacterium bovis subsp bovis AF2122/97
gcguagagcagcagcgg

SEQ ID NO: 1147733 - RNA, 17 nt, Mycobacterium bovis subsp bovis AF2122/97
gcguagacguagaaugc

SEQ ID NO: 1147734 - RNA, 20 nt, Mycobacterium bovis subsp bovis AF2122/97
gcguagacguccgcggucgc

SEQ ID NO: 1147735 - RNA, 18 nt, Mycobacterium bovis subsp bovis AF2122/97
gcguagaucaucagcgac

SEQ ID NO: 1147736 - RNA, 13 nt, Mycobacterium bovis subsp bovis AF2122/97
gcguagcaaccca

SEQ ID NO: 1147737 - RNA, 18 nt, Mycobacterium bovis subsp bovis AF2122/97
gcguacucgugcaccguc

SEQ ID NO: 1147738 - RNA, 14 nt, Mycobacterium bovis subsp bovis AF2122/97
gcgugaucuggccg

SEQ ID NO: 1147739 - RNA, 15 nt, Mycobacterium bovis subsp bovis AF2122/97
gcgugauggcggcgc

SEQ ID NO: 1147740 - RNA, 15 nt, Mycobacterium bovis subsp bovis AF2122/97
gcgugaugguugcuc

SEQ ID NO: 1147741 - RNA, 20 nt, Mycobacterium bovis subsp bovis AF2122/97
gcgugcaccauacucaccga

SEQ ID NO: 1147742 - RNA, 16 nt, Mycobacterium bovis subsp bovis AF2122/97
gcgugcacugaccgcg

SEQ ID NO: 1147743 - RNA, 14 nt, Mycobacterium bovis subsp bovis AF2122/97
gcgugcagcaggaa

SEQ ID NO: 1147744 - RNA, 14 nt, Mycobacterium bovis subsp bovis AF2122/97
gcgugcaccgcauc

SEQ ID NO: 1147745 - RNA, 15 nt, Mycobacterium bovis subsp bovis AF2122/97
gcgugcagacccggu

SEQ ID NO: 1147746 - RNA, 19 nt, Mycobacterium bovis subsp bovis AF2122/97
gcgugcgggggacgggucg

SEQ ID NO: 1147747 - RNA, 20 nt, Mycobacterium bovis subsp bovis AF2122/97
gcgugcggcgaggacgcgcc

SEQ ID NO: 1147748 - RNA, 17 nt, Mycobacterium bovis subsp bovis AF2122/97
gcgugcggcggcccauc

SEQ ID NO: 1147749 - RNA, 21 nt, Mycobacterium bovis subsp bovis AF2122/97
gcgugcggcguuaucgucggc

SEQ ID NO: 1147750 - RNA, 13 nt, Mycobacterium bovis subsp bovis AF2122/97
gcgugcucgacgc

SEQ ID NO: 1147751 - RNA, 15 nt, Mycobacterium bovis subsp bovis AF2122/97
gcgugcucgacgcgc

SEQ ID NO: 1147752 - RNA, 16 nt, Mycobacterium bovis subsp bovis AF2122/97
gcgugcucgacgcgca

SEQ ID NO: 1147753 - RNA, 20 nt, Mycobacterium bovis subsp bovis AF2122/97
gcgugcucgagcaccucggc

SEQ ID NO: 1147754 - RNA, 14 nt, Mycobacterium bovis subsp bovis AF2122/97
gcgugcgguggcgc

SEQ ID NO: 1147755 - RNA, 15 nt, Mycobacterium bovis subsp bovis AF2122/97
gcgugcgguggcgcg

SEQ ID NO: 1147756 - RNA, 16 nt, Mycobacterium bovis subsp bovis AF2122/97
gcgugcgguggcgcgc

SEQ ID NO: 1147757 - RNA, 15 nt, Mycobacterium bovis subsp bovis AF2122/97
gcgugcucggccugu

SEQ ID NO: 1147758 - RNA, 16 nt, Mycobacterium bovis subsp bovis AF2122/97
gcgugcugguaaccaa

SEQ ID NO: 1147759 - RNA, 14 nt, Mycobacterium bovis subsp bovis AF2122/97
gcgugcuuggcagc

SEQ ID NO: 1147760 - RNA, 22 nt, Mycobacterium bovis subsp bovis AF2122/97
gcguggaaaccggugguagcga

SEQ ID NO: 1147761 - RNA, 22 nt, Mycobacterium bovis subsp bovis AF2122/97
gcguggaucuuggccagcagcg

SEQ ID NO: 1147762 - RNA, 23 nt, Mycobacterium bovis subsp bovis AF2122/97
gcguggaguggugauccagccgu

SEQ ID NO: 1147763 - RNA, 15 nt, Mycobacterium bovis subsp bovis AF2122/97
gcguggacgcccgcc

SEQ ID NO: 1147764 - RNA, 22 nt, Mycobacterium bovis subsp bovis AF2122/97
gcguggacgcccgcccgcacga

SEQ ID NO: 1147765 - RNA, 20 nt, Mycobacterium bovis subsp bovis AF2122/97
gcgugcuguggaugccgacg

SEQ ID NO: 1147766 - RNA, 22 nt, Mycobacterium bovis subsp bovis AF2122/97
gcguggaagccgacgaccagca

SEQ ID NO: 1147767 - RNA, 18 nt, Mycobacterium bovis subsp bovis AF2122/97
gcguggaauggcgccggc

SEQ ID NO: 1147768 - RNA, 16 nt, Mycobacterium bovis subsp bovis AF2122/97
gcguggaucuuggcca

SEQ ID NO: 1147769 - RNA, 18 nt, Mycobacterium bovis subsp bovis AF2122/97
gcguggaucuuggccagc

SEQ ID NO: 1147770 - RNA, 13 nt, Mycobacterium bovis subsp bovis AF2122/97
gcguggccccacc

SEQ ID NO: 1147771 - RNA, 23 nt, Mycobacterium bovis subsp bovis AF2122/97
gcguggccaacucuucagcaagc

SEQ ID NO: 1147772 - RNA, 19 nt, Mycobacterium bovis subsp bovis AF2122/97
gcguggccaauccggcggc

SEQ ID NO: 1147773 - RNA, 21 nt, Mycobacterium bovis subsp bovis AF2122/97
gcguggccaauccggcggcga

SEQ ID NO: 1147774 - RNA, 22 nt, Mycobacterium bovis subsp bovis AF2122/97
gcguggcugccuucggcgagcg

SEQ ID NO: 1147775 - RNA, 20 nt, Mycobacterium bovis subsp bovis AF2122/97
gcgugggcacuugcccgucg

SEQ ID NO: 1147776 - RNA, 15 nt, Mycobacterium bovis subsp bovis AF2122/97
gcgugggcauucccg

SEQ ID NO: 1147777 - RNA, 18 nt, Mycobacterium bovis subsp bovis AF2122/97
gcguggcuggcggcgacc

SEQ ID NO: 1147778 - RNA, 19 nt, Mycobacterium bovis subsp bovis AF2122/97
gcguggcuggcggcgaccg

SEQ ID NO: 1147779 - RNA, 13 nt, Mycobacterium bovis subsp bovis AF2122/97
gcgugggcacagc

SEQ ID NO: 1147780 - RNA, 20 nt, Mycobacterium bovis subsp bovis AF2122/97
gcgugggcauucccgcucgc

SEQ ID NO: 1147781 - RNA, 19 nt, Mycobacterium bovis subsp bovis AF2122/97
gcguggggccgccaccagc

SEQ ID NO: 1147782 - RNA, 15 nt, Mycobacterium bovis subsp bovis AF2122/97
gcgugggugucggcg

SEQ ID NO: 1147783 - RNA, 13 nt, Mycobacterium bovis subsp bovis AF2122/97
gcgugggcgcggc

SEQ ID NO: 1147784 - RNA, 16 nt, Mycobacterium bovis subsp bovis AF2122/97
gcgugguauccgccgu

SEQ ID NO: 1147785 - RNA, 21 nt, Mycobacterium bovis subsp bovis AF2122/97
gcgugguacuuucacgcucgu

SEQ ID NO: 1147786 - RNA, 16 nt, Mycobacterium bovis subsp bovis AF2122/97
gcgugggugucggcua

SEQ ID NO: 1147787 - RNA, 14 nt, Mycobacterium bovis subsp bovis AF2122/97
gcguuaucgucggc

SEQ ID NO: 1147788 - RNA, 19 nt, Mycobacterium bovis subsp bovis AF2122/97
gcguucaacaccgccgacc

SEQ ID NO: 1147789 - RNA, 23 nt, Mycobacterium bovis subsp bovis AF2122/97
gcguucaacaccgccgaccuagu

SEQ ID NO: 1147790 - RNA, 19 nt, Mycobacterium bovis subsp bovis AF2122/97
gcguucaaggucuccagac

SEQ ID NO: 1147791 - RNA, 18 nt, Mycobacterium bovis subsp bovis AF2122/97
gcguucaccugcgucggc

SEQ ID NO: 1147792 - RNA, 21 nt, Mycobacterium bovis subsp bovis AF2122/97
gcguuacccaucgccacaccc

SEQ ID NO: 1147793 - RNA, 22 nt, Mycobacterium bovis subsp bovis AF2122/97
gcguggguucgaaucccaucgg

SEQ ID NO: 1147794 - RNA, 12 nt, Mycobacterium bovis subsp bovis AF2122/97
gcguuacgccgc

SEQ ID NO: 1147795 - RNA, 18 nt, Mycobacterium bovis subsp bovis AF2122/97
gcgucuucggucgcggcc

SEQ ID NO: 1147796 - RNA, 16 nt, Mycobacterium bovis subsp bovis AF2122/97
gcgucuuccucggcca

SEQ ID NO: 1147797 - RNA, 14 nt, Mycobacterium bovis subsp bovis AF2122/97
gcgucuggucagcc

SEQ ID NO: 1147798 - RNA, 16 nt, Mycobacterium bovis subsp bovis AF2122/97
gcgucuggucagccgc

SEQ ID NO: 1147799 - RNA, 14 nt, Mycobacterium bovis subsp bovis AF2122/97
gcgucuguaccacg

SEQ ID NO: 1147800 - RNA, 15 nt, Mycobacterium bovis subsp bovis AF2122/97
gcgucugcucggcgu

SEQ ID NO: 1147801 - RNA, 15 nt, Mycobacterium bovis subsp bovis AF2122/97
gcgucugcucggcgg

SEQ ID NO: 1147802 - RNA, 18 nt, Mycobacterium bovis subsp bovis AF2122/97
gcgucugcucggcaucgg

SEQ ID NO: 1147803 - RNA, 15 nt, Mycobacterium bovis subsp bovis AF2122/97
gcgucugcucggcgc

SEQ ID NO: 1147804 - RNA, 16 nt, Mycobacterium bovis subsp bovis AF2122/97
gcgucugcucggcauc

SEQ ID NO: 1147805 - RNA, 12 nt, Mycobacterium bovis subsp bovis AF2122/97
gcgucugcucgg

SEQ ID NO: 1147806 - RNA, 14 nt, Mycobacterium bovis subsp bovis AF2122/97
gcgucugcuggcgc

SEQ ID NO: 1147807 - RNA, 14 nt, Mycobacterium bovis subsp bovis AF2122/97
gcgucuggcgacau

SEQ ID NO: 1147808 - RNA, 16 nt, Mycobacterium bovis subsp bovis AF2122/97
gcgucggugccaccac

SEQ ID NO: 1147809 - RNA, 18 nt, Mycobacterium bovis subsp bovis AF2122/97
gcgucggugccaccacgc

SEQ ID NO: 1147810 - RNA, 23 nt, Mycobacterium bovis subsp bovis AF2122/97
gcgucggucaccuggcgauaacc

SEQ ID NO: 1147811 - RNA, 19 nt, Mycobacterium bovis subsp bovis AF2122/97
gcgucggcgucauccaccg

SEQ ID NO: 1147812 - RNA, 19 nt, Mycobacterium bovis subsp bovis AF2122/97
gcgucggugagcgcgucgc

SEQ ID NO: 1147813 - RNA, 23 nt, Mycobacterium bovis subsp bovis AF2122/97
gcgucggugaaugccgucgccgg

SEQ ID NO: 1147814 - RNA, 15 nt, Mycobacterium bovis subsp bovis AF2122/97
gcgucggugucgaug

SEQ ID NO: 1147815 - RNA, 16 nt, Mycobacterium bovis subsp bovis AF2122/97
gcgucggugucgaugc

SEQ ID NO: 1147816 - RNA, 19 nt, Mycobacterium bovis subsp bovis AF2122/97
gcgucggugugguccucga

SEQ ID NO: 1147817 - RNA, 16 nt, Mycobacterium bovis subsp bovis AF2122/97
gcgucguaaccgucgc

SEQ ID NO: 1147818 - RNA, 20 nt, Mycobacterium bovis subsp bovis AF2122/97
gcgucgguggcaacgggucg

SEQ ID NO: 1147819 - RNA, 13 nt, Mycobacterium bovis subsp bovis AF2122/97
gcgucugcucgcg

SEQ ID NO: 1147820 - RNA, 19 nt, Mycobacterium bovis subsp bovis AF2122/97
gcgucugcucgcgccggug

SEQ ID NO: 1147821 - RNA, 15 nt, Mycobacterium bovis subsp bovis AF2122/97
gcgucguagaacgug

SEQ ID NO: 1147822 - RNA, 16 nt, Mycobacterium bovis subsp bovis AF2122/97
gcgucgucgacgacaa

SEQ ID NO: 1147823 - RNA, 20 nt, Mycobacterium bovis subsp bovis AF2122/97
gcgucgucgagaaucggcau

SEQ ID NO: 1147824 - RNA, 17 nt, Mycobacterium bovis subsp bovis AF2122/97
gcgucguagcgcucgug

SEQ ID NO: 1147825 - RNA, 16 nt, Mycobacterium bovis subsp bovis AF2122/97
gcgucgucacgaucgu

SEQ ID NO: 1147826 - RNA, 19 nt, Mycobacterium bovis subsp bovis AF2122/97
gcgucguccagggcgacga

SEQ ID NO: 1147827 - RNA, 15 nt, Mycobacterium bovis subsp bovis AF2122/97
gcgugacgaccagcc

SEQ ID NO: 1147828 - RNA, 19 nt, Mycobacterium bovis subsp bovis AF2122/97
gcgugacucggccgacgag

SEQ ID NO: 1147829 - RNA, 23 nt, Mycobacterium bovis subsp bovis AF2122/97
gcgugacguaccacggcgauccg

SEQ ID NO: 1147830 - RNA, 16 nt, Mycobacterium bovis subsp bovis AF2122/97
gcgugagcagacgcaa

SEQ ID NO: 1147831 - RNA, 17 nt, Mycobacterium bovis subsp bovis AF2122/97
gcgugagcgccgcggcg

SEQ ID NO: 1147832 - RNA, 18 nt, Mycobacterium bovis subsp bovis AF2122/97
gcgugagcgccgcggcga

SEQ ID NO: 1147833 - RNA, 14 nt, Mycobacterium bovis subsp bovis AF2122/97
gcgugagcagacgc

SEQ ID NO: 1147834 - RNA, 21 nt, Mycobacterium bovis subsp bovis AF2122/97
gcgugagccaugccgcucggc

SEQ ID NO: 1147835 - RNA, 23 nt, Mycobacterium bovis subsp bovis AF2122/97
gcgugaaaaacgcccgcgcugcc

SEQ ID NO: 1147836 - RNA, 22 nt, Mycobacterium bovis subsp bovis AF2122/97
gcgugaacaagauucgcucacc

SEQ ID NO: 1147837 - RNA, 19 nt, Mycobacterium bovis subsp bovis AF2122/97
gcgugaaaugcacgaucgc

SEQ ID NO: 1147838 - RNA, 19 nt, Mycobacterium bovis subsp bovis AF2122/97
aaggaccgcucgucgccgg

SEQ ID NO: 1147839 - RNA, 16 nt, Mycobacterium bovis subsp bovis AF2122/97
gcgucuuggaaggcgc

SEQ ID NO: 1147840 - RNA, 20 nt, Mycobacterium bovis subsp bovis AF2122/97
gcgucuuggaaggcgcgcgc

SEQ ID NO: 1147841 - RNA, 22 nt, Mycobacterium bovis subsp bovis AF2122/97
gcgugacgcuaacgucgaucuc

SEQ ID NO: 1147842 - RNA, 17 nt, Mycobacterium bovis subsp bovis AF2122/97
gcgugaccgugccgucg

SEQ ID NO: 1147843 - RNA, 19 nt, Mycobacterium bovis subsp bovis AF2122/97
gcgugaccgugccgucggc

SEQ ID NO: 1147844 - RNA, 15 nt, Mycobacterium bovis subsp bovis AF2122/97
aaggaccugugcggc

SEQ ID NO: 1147845 - RNA, 13 nt, Mycobacterium bovis subsp bovis AF2122/97
aaggacgacaccg

SEQ ID NO: 1147846 - RNA, 20 nt, Mycobacterium bovis subsp bovis AF2122/97
gcgugaccuaccuccucggc

SEQ ID NO: 1147847 - RNA, 13 nt, Mycobacterium bovis subsp bovis AF2122/97
gcgguccagcguc

SEQ ID NO: 1147848 - RNA, 15 nt, Mycobacterium bovis subsp bovis AF2122/97
gcgguccagcgucgc

SEQ ID NO: 1147849 - RNA, 20 nt, Mycobacterium bovis subsp bovis AF2122/97
gcgguccagcgucgccgcca

SEQ ID NO: 1147850 - RNA, 15 nt, Mycobacterium bovis subsp bovis AF2122/97
gcgguccagccaccg

SEQ ID NO: 1147851 - RNA, 18 nt, Mycobacterium bovis subsp bovis AF2122/97
gcgguccaggccggcacc

SEQ ID NO: 1147852 - RNA, 19 nt, Mycobacterium bovis subsp bovis AF2122/97
gcgguccaggccggcaccc

SEQ ID NO: 1147853 - RNA, 19 nt, Mycobacterium bovis subsp bovis AF2122/97
gcggucccugaagccagcg

SEQ ID NO: 1147854 - RNA, 18 nt, Mycobacterium bovis subsp bovis AF2122/97
gcgguccgagcggcaucg

SEQ ID NO: 1147855 - RNA, 13 nt, Mycobacterium bovis subsp bovis AF2122/97
gcggucccgcaua

SEQ ID NO: 1147856 - RNA, 22 nt, Mycobacterium bovis subsp bovis AF2122/97
gcggucgauguccgcagcaccg

SEQ ID NO: 1147857 - RNA, 13 nt, Mycobacterium bovis subsp bovis AF2122/97
gcgguccgcugcc

SEQ ID NO: 1147858 - RNA, 21 nt, Mycobacterium bovis subsp bovis AF2122/97
gcggucgaucauggcggcagc

SEQ ID NO: 1147859 - RNA, 17 nt, Mycobacterium bovis subsp bovis AF2122/97
gcggucagauucggcga

SEQ ID NO: 1147860 - RNA, 17 nt, Mycobacterium bovis subsp bovis AF2122/97
gcggucagcagcgccgu

SEQ ID NO: 1147861 - RNA, 21 nt, Mycobacterium bovis subsp bovis AF2122/97
gcggucaggcuaguugccaac

SEQ ID NO: 1147862 - RNA, 22 nt, Mycobacterium bovis subsp bovis AF2122/97
gcggucaggauggggaccacua

SEQ ID NO: 1147863 - RNA, 16 nt, Mycobacterium bovis subsp bovis AF2122/97
gcggucagcggccaac

SEQ ID NO: 1147864 - RNA, 20 nt, Mycobacterium bovis subsp bovis AF2122/97
gcggucagcggccaacccau

SEQ ID NO: 1147865 - RNA, 18 nt, Mycobacterium bovis subsp bovis AF2122/97
gcggucagcggcucggcg

SEQ ID NO: 1147866 - RNA, 18 nt, Mycobacterium bovis subsp bovis AF2122/97
gcggucagcggcugggcg

SEQ ID NO: 1147867 - RNA, 23 nt, Mycobacterium bovis subsp bovis AF2122/97
gcggucaccaccgacccgcugcc

SEQ ID NO: 1147868 - RNA, 22 nt, Mycobacterium bovis subsp bovis AF2122/97
gcggucaccaccguggcgcccg

SEQ ID NO: 1147869 - RNA, 22 nt, Mycobacterium bovis subsp bovis AF2122/97
gcggucaauguggcgcuucggc

SEQ ID NO: 1147870 - RNA, 21 nt, Mycobacterium bovis subsp bovis AF2122/97
gcggucaccccggcucggcca

SEQ ID NO: 1147871 - RNA, 16 nt, Mycobacterium bovis subsp bovis AF2122/97
gcggucaccgacgcag

SEQ ID NO: 1147872 - RNA, 17 nt, Mycobacterium bovis subsp bovis AF2122/97
gcggucaccgacgcaga

SEQ ID NO: 1147873 - RNA, 14 nt, Mycobacterium bovis subsp bovis AF2122/97
gcgguaguugcagu

SEQ ID NO: 1147874 - RNA, 18 nt, Mycobacterium bovis subsp bovis AF2122/97
gcgguaguugucccgccg

SEQ ID NO: 1147875 - RNA, 19 nt, Mycobacterium bovis subsp bovis AF2122/97
gcgguaguugucccgccgc

SEQ ID NO: 1147876 - RNA, 16 nt, Mycobacterium bovis subsp bovis AF2122/97
gcgguaguccgcugcg

SEQ ID NO: 1147877 - RNA, 14 nt, Mycobacterium bovis subsp bovis AF2122/97
gcgguagucgccga

SEQ ID NO: 1147878 - RNA, 17 nt, Mycobacterium bovis subsp bovis AF2122/97
gcgguagucggccagcu

SEQ ID NO: 1147879 - RNA, 21 nt, Mycobacterium bovis subsp bovis AF2122/97
gcgguaaucgcgagaccaaca

SEQ ID NO: 1147880 - RNA, 13 nt, Mycobacterium bovis subsp bovis AF2122/97
gcgguaccgccgc

SEQ ID NO: 1147881 - RNA, 17 nt, Mycobacterium bovis subsp bovis AF2122/97
gcgguaccgccgcugcc

SEQ ID NO: 1147882 - RNA, 21 nt, Mycobacterium bovis subsp bovis AF2122/97
gcgguaccccccagcgacggc

SEQ ID NO: 1147883 - RNA, 14 nt, Mycobacterium bovis subsp bovis AF2122/97
gcgguacccgaugu

SEQ ID NO: 1147884 - RNA, 18 nt, Mycobacterium bovis subsp bovis AF2122/97
gcgguaccaucaccgcgc

SEQ ID NO: 1147885 - RNA, 22 nt, Mycobacterium bovis subsp bovis AF2122/97
gcgguacccaccucccgcagcc

SEQ ID NO: 1147886 - RNA, 14 nt, Mycobacterium bovis subsp bovis AF2122/97
gcgguaaugccagc

SEQ ID NO: 1147887 - RNA, 14 nt, Mycobacterium bovis subsp bovis AF2122/97
gcgguaauggcgug

SEQ ID NO: 1147888 - RNA, 20 nt, Mycobacterium bovis subsp bovis AF2122/97
gcgguacaccgacacgccgu

SEQ ID NO: 1147889 - RNA, 14 nt, Mycobacterium bovis subsp bovis AF2122/97
gcgguaggcgggag

SEQ ID NO: 1147890 - RNA, 15 nt, Mycobacterium bovis subsp bovis AF2122/97
gcgguaggcgggaga

SEQ ID NO: 1147891 - RNA, 17 nt, Mycobacterium bovis subsp bovis AF2122/97
gcgguaggcggugaccc

SEQ ID NO: 1147892 - RNA, 16 nt, Mycobacterium bovis subsp bovis AF2122/97
gcgguacaccgacacg

SEQ ID NO: 1147893 - RNA, 17 nt, Mycobacterium bovis subsp bovis AF2122/97
gcgguagcggaccugcg

SEQ ID NO: 1147894 - RNA, 15 nt, Mycobacterium bovis subsp bovis AF2122/97
gcgguagcucgucga

SEQ ID NO: 1147895 - RNA, 17 nt, Mycobacterium bovis subsp bovis AF2122/97
gcgguagcuuccgcgac

SEQ ID NO: 1147896 - RNA, 22 nt, Mycobacterium bovis subsp bovis AF2122/97
gcgguagcuuccgcgacgcucg

SEQ ID NO: 1147897 - RNA, 16 nt, Mycobacterium bovis subsp bovis AF2122/97
gcgguaggagcgggug

SEQ ID NO: 1147898 - RNA, 16 nt, Mycobacterium bovis subsp bovis AF2122/97
gcgggccugcacgccg

SEQ ID NO: 1147899 - RNA, 15 nt, Mycobacterium bovis subsp bovis AF2122/97
gcgggccuggcccac

SEQ ID NO: 1147900 - RNA, 12 nt, Mycobacterium bovis subsp bovis AF2122/97
gcgggcgccuug

SEQ ID NO: 1147901 - RNA, 21 nt, Mycobacterium bovis subsp bovis AF2122/97
gcgggcgacaucgagaucgcc

SEQ ID NO: 1147902 - RNA, 22 nt, Mycobacterium bovis subsp bovis AF2122/97
gcgggcgccuuggucgccgccu

SEQ ID NO: 1147903 - RNA, 23 nt, Mycobacterium bovis subsp bovis AF2122/97
gcgggcgcgcuaucaugaccacc

SEQ ID NO: 1147904 - RNA, 13 nt, Mycobacterium bovis subsp bovis AF2122/97
gcgggcgcuguag

SEQ ID NO: 1147905 - RNA, 20 nt, Mycobacterium bovis subsp bovis AF2122/97
gcgggcgcuguagucgcgcc

SEQ ID NO: 1147906 - RNA, 21 nt, Mycobacterium bovis subsp bovis AF2122/97
gcgggcgcuugccggggugug

SEQ ID NO: 1147907 - RNA, 15 nt, Mycobacterium bovis subsp bovis AF2122/97
gcgguaagggcgggc

SEQ ID NO: 1147908 - RNA, 17 nt, Mycobacterium bovis subsp bovis AF2122/97
gcgguaaucgccaccgc

SEQ ID NO: 1147909 - RNA, 17 nt, Mycobacterium bovis subsp bovis AF2122/97
gcggugccacgaucggc

SEQ ID NO: 1147910 - RNA, 23 nt, Mycobacterium bovis subsp bovis AF2122/97
gcggugcaggauucggcggucgc

SEQ ID NO: 1147911 - RNA, 17 nt, Mycobacterium bovis subsp bovis AF2122/97
gcggugaucccacgagc

SEQ ID NO: 1147912 - RNA, 19 nt, Mycobacterium bovis subsp bovis AF2122/97
gcggugaucccacgagcgg

SEQ ID NO: 1147913 - RNA, 19 nt, Mycobacterium bovis subsp bovis AF2122/97
gcggugaguccgcugagcg

SEQ ID NO: 1147914 - RNA, 22 nt, Mycobacterium bovis subsp bovis AF2122/97
gcggugacccguucagcgacgg

SEQ ID NO: 1147915 - RNA, 19 nt, Mycobacterium bovis subsp bovis AF2122/97
gcggugagauggcggugag

SEQ ID NO: 1147916 - RNA, 20 nt, Mycobacterium bovis subsp bovis AF2122/97
gcggugagauggcggugagc

SEQ ID NO: 1147917 - RNA, 19 nt, Mycobacterium bovis subsp bovis AF2122/97
gcggugaccggcucggcgg

SEQ ID NO: 1147918 - RNA, 22 nt, Mycobacterium bovis subsp bovis AF2122/97
gcggugaccggcucggcggugc

SEQ ID NO: 1147919 - RNA, 13 nt, Mycobacterium bovis subsp bovis AF2122/97
gcggugacggcgg

SEQ ID NO: 1147920 - RNA, 14 nt, Mycobacterium bovis subsp bovis AF2122/97
gcggugacggcggc

SEQ ID NO: 1147921 - RNA, 15 nt, Mycobacterium bovis subsp bovis AF2122/97
gcggugacggcggca

SEQ ID NO: 1147922 - RNA, 16 nt, Mycobacterium bovis subsp bovis AF2122/97
gcggugacgaagccga

SEQ ID NO: 1147923 - RNA, 19 nt, Mycobacterium bovis subsp bovis AF2122/97
gcggugacgagccaccacc

SEQ ID NO: 1147924 - RNA, 15 nt, Mycobacterium bovis subsp bovis AF2122/97
gcggugacgccagcc

SEQ ID NO: 1147925 - RNA, 20 nt, Mycobacterium bovis subsp bovis AF2122/97
gcggucuucuucaccgccuu

SEQ ID NO: 1147926 - RNA, 16 nt, Mycobacterium bovis subsp bovis AF2122/97
gcggucuugccgcagg

SEQ ID NO: 1147927 - RNA, 21 nt, Mycobacterium bovis subsp bovis AF2122/97
gcggugaauccgugcagggca

SEQ ID NO: 1147928 - RNA, 20 nt, Mycobacterium bovis subsp bovis AF2122/97
gcggugaagugggcguuggc

SEQ ID NO: 1147929 - RNA, 19 nt, Mycobacterium bovis subsp bovis AF2122/97
gcggugaaaucgcacagcg

SEQ ID NO: 1147930 - RNA, 21 nt, Mycobacterium bovis subsp bovis AF2122/97
gcggugaacuucuccaccagc

SEQ ID NO: 1147931 - RNA, 22 nt, Mycobacterium bovis subsp bovis AF2122/97
gcggugaacuucuccaccagcg

SEQ ID NO: 1147932 - RNA, 23 nt, Mycobacterium bovis subsp bovis AF2122/97
gcggugaaggccccgccgguggc

SEQ ID NO: 1147933 - RNA, 16 nt, Mycobacterium bovis subsp bovis AF2122/97
gcggucggcagcgacg

SEQ ID NO: 1147934 - RNA, 19 nt, Mycobacterium bovis subsp bovis AF2122/97
gcggucggaaugccgucgc

SEQ ID NO: 1147935 - RNA, 13 nt, Mycobacterium bovis subsp bovis AF2122/97
gcggucgcuaucc

SEQ ID NO: 1147936 - RNA, 11 nt, Mycobacterium bovis subsp bovis AF2122/97
gcggucgcgga

SEQ ID NO: 1147937 - RNA, 18 nt, Mycobacterium bovis subsp bovis AF2122/97
gcggucgccacacccgcg

SEQ ID NO: 1147938 - RNA, 19 nt, Mycobacterium bovis subsp bovis AF2122/97
gcggucgcuauccggcggc

SEQ ID NO: 1147939 - RNA, 19 nt, Mycobacterium bovis subsp bovis AF2122/97
gcggucggcgaccaccagc

SEQ ID NO: 1147940 - RNA, 14 nt, Mycobacterium bovis subsp bovis AF2122/97
gcggucggcgacgu

SEQ ID NO: 1147941 - RNA, 22 nt, Mycobacterium bovis subsp bovis AF2122/97
gcggucggcgacguagacgguc

SEQ ID NO: 1147942 - RNA, 15 nt, Mycobacterium bovis subsp bovis AF2122/97
gcggucggcggccgc

SEQ ID NO: 1147943 - RNA, 17 nt, Mycobacterium bovis subsp bovis AF2122/97
gcggucggcggccgcca

SEQ ID NO: 1147944 - RNA, 13 nt, Mycobacterium bovis subsp bovis AF2122/97
gcggucgccaccg

SEQ ID NO: 1147945 - RNA, 12 nt, Mycobacterium bovis subsp bovis AF2122/97
gcggucgcccag

SEQ ID NO: 1147946 - RNA, 18 nt, Mycobacterium bovis subsp bovis AF2122/97
gcggucugcgcgucgcgu

SEQ ID NO: 1147947 - RNA, 22 nt, Mycobacterium bovis subsp bovis AF2122/97
gcggucuggacaucggccggcg

SEQ ID NO: 1147948 - RNA, 14 nt, Mycobacterium bovis subsp bovis AF2122/97
gcggucugguuguc

SEQ ID NO: 1147949 - RNA, 19 nt, Mycobacterium bovis subsp bovis AF2122/97
gcggucugcgccuucgcca

SEQ ID NO: 1147950 - RNA, 16 nt, Mycobacterium bovis subsp bovis AF2122/97
gcggucugcgcgucgc

SEQ ID NO: 1147951 - RNA, 22 nt, Mycobacterium bovis subsp bovis AF2122/97
gcggucgugccccgcggucucg

SEQ ID NO: 1147952 - RNA, 21 nt, Mycobacterium bovis subsp bovis AF2122/97
gcggucguccccgucgcuggc

SEQ ID NO: 1147953 - RNA, 23 nt, Mycobacterium bovis subsp bovis AF2122/97
gcggucguugauuucggcggcga

SEQ ID NO: 1147954 - RNA, 15 nt, Mycobacterium bovis subsp bovis AF2122/97
gcggucguugccgac

SEQ ID NO: 1147955 - RNA, 17 nt, Mycobacterium bovis subsp bovis AF2122/97
gcggucguugccgaccg

SEQ ID NO: 1147956 - RNA, 22 nt, Mycobacterium bovis subsp bovis AF2122/97
gcggucguuggauauggucacc

SEQ ID NO: 1147957 - RNA, 14 nt, Mycobacterium bovis subsp bovis AF2122/97
gcggucguuggcga

SEQ ID NO: 1147958 - RNA, 19 nt, Mycobacterium bovis subsp bovis AF2122/97
gcggucuccccagagcugg

SEQ ID NO: 1147959 - RNA, 14 nt, Mycobacterium bovis subsp bovis AF2122/97
gcgguuaucgccga

SEQ ID NO: 1147960 - RNA, 15 nt, Mycobacterium bovis subsp bovis AF2122/97
gcgguuaucgccgag

SEQ ID NO: 1147961 - RNA, 22 nt, Mycobacterium bovis subsp bovis AF2122/97
gcgguuauguauccgcgccgca

SEQ ID NO: 1147962 - RNA, 16 nt, Mycobacterium bovis subsp bovis AF2122/97
gcgguuagaucacccg

SEQ ID NO: 1147963 - RNA, 20 nt, Mycobacterium bovis subsp bovis AF2122/97
gcgguuagaucacccgcagc

SEQ ID NO: 1147964 - RNA, 21 nt, Mycobacterium bovis subsp bovis AF2122/97
gcgguuagaucacccgcagcc

SEQ ID NO: 1147965 - RNA, 18 nt, Mycobacterium bovis subsp bovis AF2122/97
gcgguuagcagccgcuga

SEQ ID NO: 1147966 - RNA, 22 nt, Mycobacterium bovis subsp bovis AF2122/97
gcgguguggcuugcgucgcgga

SEQ ID NO: 1147967 - RNA, 13 nt, Mycobacterium bovis subsp bovis AF2122/97
gcggugugccgag

SEQ ID NO: 1147968 - RNA, 18 nt, Mycobacterium bovis subsp bovis AF2122/97
gcggugugcggcagcccg

SEQ ID NO: 1147969 - RNA, 19 nt, Mycobacterium bovis subsp bovis AF2122/97
gcggugugcggcagcccgc

SEQ ID NO: 1147970 - RNA, 15 nt, Mycobacterium bovis subsp bovis AF2122/97
gcgguguugcccgac

SEQ ID NO: 1147971 - RNA, 17 nt, Mycobacterium bovis subsp bovis AF2122/97
gcgguguugcucccggc

SEQ ID NO: 1147972 - RNA, 21 nt, Mycobacterium bovis subsp bovis AF2122/97
gcgguguugcucccggccgcc

SEQ ID NO: 1147973 - RNA, 18 nt, Mycobacterium bovis subsp bovis AF2122/97
gcggugugugcaagccga

SEQ ID NO: 1147974 - RNA, 22 nt, Mycobacterium bovis subsp bovis AF2122/97
gcgguguuggacgcgggccgac

SEQ ID NO: 1147975 - RNA, 21 nt, Mycobacterium bovis subsp bovis AF2122/97
gcgguguuggacgcgggccga

SEQ ID NO: 1147976 - RNA, 18 nt, Mycobacterium bovis subsp bovis AF2122/97
gcgguguagaagcgggcg

SEQ ID NO: 1147977 - RNA, 22 nt, Mycobacterium bovis subsp bovis AF2122/97
gcgguguaacccggaaccagcc

SEQ ID NO: 1147978 - RNA, 12 nt, Mycobacterium bovis subsp bovis AF2122/97
gcgguggugagu

SEQ ID NO: 1147979 - RNA, 14 nt, Mycobacterium bovis subsp bovis AF2122/97
gcgguggugccgcg

SEQ ID NO: 1147980 - RNA, 16 nt, Mycobacterium bovis subsp bovis AF2122/97
gcgguggucgcgaccg

SEQ ID NO: 1147981 - RNA, 14 nt, Mycobacterium bovis subsp bovis AF2122/97
gcggugggucgucg

SEQ ID NO: 1147982 - RNA, 19 nt, Mycobacterium bovis subsp bovis AF2122/97
gcggugggccccgaucccg

SEQ ID NO: 1147983 - RNA, 16 nt, Mycobacterium bovis subsp bovis AF2122/97
gcggugguaccggcgc

SEQ ID NO: 1147984 - RNA, 20 nt, Mycobacterium bovis subsp bovis AF2122/97
gcggugguaggacgccagca

SEQ ID NO: 1147985 - RNA, 20 nt, Mycobacterium bovis subsp bovis AF2122/97
gcgguggucagcaccggcgc

SEQ ID NO: 1147986 - RNA, 15 nt, Mycobacterium bovis subsp bovis AF2122/97
gcggugggcagcagc

SEQ ID NO: 1147987 - RNA, 22 nt, Mycobacterium bovis subsp bovis AF2122/97
gcggugggccagguuuugccgc

SEQ ID NO: 1147988 - RNA, 15 nt, Mycobacterium bovis subsp bovis AF2122/97
gcgguggggccggcg

SEQ ID NO: 1147989 - RNA, 18 nt, Mycobacterium bovis subsp bovis AF2122/97
gcgguggggccggcgucg

SEQ ID NO: 1147990 - RNA, 16 nt, Mycobacterium bovis subsp bovis AF2122/97
gcgguggggucgacgc

SEQ ID NO: 1147991 - RNA, 14 nt, Mycobacterium bovis subsp bovis AF2122/97
gcggugucacgacc

SEQ ID NO: 1147992 - RNA, 23 nt, Mycobacterium bovis subsp bovis AF2122/97
gcgguguccagaacgguggcgcg

SEQ ID NO: 1147993 - RNA, 22 nt, Mycobacterium bovis subsp bovis AF2122/97
gcgguggucccgauggcgaugc

SEQ ID NO: 1147994 - RNA, 18 nt, Mycobacterium bovis subsp bovis AF2122/97
gcgguguagagcgcaccg

SEQ ID NO: 1147995 - RNA, 20 nt, Mycobacterium bovis subsp bovis AF2122/97
gcgguguagccggcgccgcc

SEQ ID NO: 1147996 - RNA, 22 nt, Mycobacterium bovis subsp bovis AF2122/97
gcgguguagccggcgccgccgu

SEQ ID NO: 1147997 - RNA, 16 nt, Mycobacterium bovis subsp bovis AF2122/97
gcgguguagggcggcg

SEQ ID NO: 1147998 - RNA, 17 nt, Mycobacterium bovis subsp bovis AF2122/97
gcgguguagggcggcgu

SEQ ID NO: 1147999 - RNA, 20 nt, Mycobacterium bovis subsp bovis AF2122/97
gcggugucggggcccccgcc

SEQ ID NO: 1148000 - RNA, 16 nt, Mycobacterium bovis subsp bovis AF2122/97
gcggugucggcgccga

SEQ ID NO: 1148001 - RNA, 14 nt, Mycobacterium bovis subsp bovis AF2122/97
gcgguggucggcgc

SEQ ID NO: 1148002 - RNA, 14 nt, Mycobacterium bovis subsp bovis AF2122/97
gcgguggaccaccg

SEQ ID NO: 1148003 - RNA, 16 nt, Mycobacterium bovis subsp bovis AF2122/97
gcgguggaccgcucga

SEQ ID NO: 1148004 - RNA, 14 nt, Mycobacterium bovis subsp bovis AF2122/97
gcggugcugguggc

SEQ ID NO: 1148005 - RNA, 12 nt, Mycobacterium bovis subsp bovis AF2122/97
gcgguggccaga

SEQ ID NO: 1148006 - RNA, 23 nt, Mycobacterium bovis subsp bovis AF2122/97
gcgguggaugcgaugcgcgccga

SEQ ID NO: 1148007 - RNA, 13 nt, Mycobacterium bovis subsp bovis AF2122/97
gcgguggacgagc

SEQ ID NO: 1148008 - RNA, 23 nt, Mycobacterium bovis subsp bovis AF2122/97
gcggugcggcagauacucggcga

SEQ ID NO: 1148009 - RNA, 20 nt, Mycobacterium bovis subsp bovis AF2122/97
gcgguggccacccggccgcg

SEQ ID NO: 1148010 - RNA, 12 nt, Mycobacterium bovis subsp bovis AF2122/97
gcgguggccagc

SEQ ID NO: 1148011 - RNA, 18 nt, Mycobacterium bovis subsp bovis AF2122/97
gcgguggccagcgucgcg

SEQ ID NO: 1148012 - RNA, 14 nt, Mycobacterium bovis subsp bovis AF2122/97
gcggugggcagcag

SEQ ID NO: 1148013 - RNA, 18 nt, Mycobacterium bovis subsp bovis AF2122/97
gcgguggcuugccccgcc

SEQ ID NO: 1148014 - RNA, 19 nt, Mycobacterium bovis subsp bovis AF2122/97
gcgguggcgucgucggcgg

SEQ ID NO: 1148015 - RNA, 13 nt, Mycobacterium bovis subsp bovis AF2122/97
gcgguggcggcgg

SEQ ID NO: 1148016 - RNA, 19 nt, Mycobacterium bovis subsp bovis AF2122/97
gcgguggcggucuugccgc

SEQ ID NO: 1148017 - RNA, 15 nt, Mycobacterium bovis subsp bovis AF2122/97
gcgguggccugucga

SEQ ID NO: 1148018 - RNA, 18 nt, Mycobacterium bovis subsp bovis AF2122/97
gcgguggccugucgaaga

SEQ ID NO: 1148019 - RNA, 22 nt, Mycobacterium bovis subsp bovis AF2122/97
gcgguggccucccacggcgcgu

SEQ ID NO: 1148020 - RNA, 13 nt, Mycobacterium bovis subsp bovis AF2122/97
gcgguggcgcgca

SEQ ID NO: 1148021 - RNA, 15 nt, Mycobacterium bovis subsp bovis AF2122/97
gcgguggcggcgagc

SEQ ID NO: 1148022 - RNA, 17 nt, Mycobacterium bovis subsp bovis AF2122/97
gcgguggcggcgagcag

SEQ ID NO: 1148023 - RNA, 22 nt, Mycobacterium bovis subsp bovis AF2122/97
gcggugcgcagcuuggccagcc

SEQ ID NO: 1148024 - RNA, 13 nt, Mycobacterium bovis subsp bovis AF2122/97
gcggugcggcaac

SEQ ID NO: 1148025 - RNA, 14 nt, Mycobacterium bovis subsp bovis AF2122/97
gcggugcgcgguug

SEQ ID NO: 1148026 - RNA, 18 nt, Mycobacterium bovis subsp bovis AF2122/97
gcggugcgcucacuggcg

SEQ ID NO: 1148027 - RNA, 12 nt, Mycobacterium bovis subsp bovis AF2122/97
gcggugcgcggu

SEQ ID NO: 1148028 - RNA, 18 nt, Mycobacterium bovis subsp bovis AF2122/97
gcggugcggguggugccg

SEQ ID NO: 1148029 - RNA, 12 nt, Mycobacterium bovis subsp bovis AF2122/97
gcggugccgcca

SEQ ID NO: 1148030 - RNA, 20 nt, Mycobacterium bovis subsp bovis AF2122/97
gcggugccgccaccggcguc

SEQ ID NO: 1148031 - RNA, 13 nt, Mycobacterium bovis subsp bovis AF2122/97
gcggugccgccgg

SEQ ID NO: 1148032 - RNA, 19 nt, Mycobacterium bovis subsp bovis AF2122/97
gcggugccgccggaaucga

SEQ ID NO: 1148033 - RNA, 13 nt, Mycobacterium bovis subsp bovis AF2122/97
gcggugccgcggc

SEQ ID NO: 1148034 - RNA, 21 nt, Mycobacterium bovis subsp bovis AF2122/97
gcggugccggcccugcucggc

SEQ ID NO: 1148035 - RNA, 17 nt, Mycobacterium bovis subsp bovis AF2122/97
gcggugccggccguucg

SEQ ID NO: 1148036 - RNA, 16 nt, Mycobacterium bovis subsp bovis AF2122/97
gcggugccggcggcgc

SEQ ID NO: 1148037 - RNA, 15 nt, Mycobacterium bovis subsp bovis AF2122/97
gcggugccgggaucg

SEQ ID NO: 1148038 - RNA, 14 nt, Mycobacterium bovis subsp bovis AF2122/97
gcggugccgucagc

SEQ ID NO: 1148039 - RNA, 13 nt, Mycobacterium bovis subsp bovis AF2122/97
gcggugcccagca

SEQ ID NO: 1148040 - RNA, 15 nt, Mycobacterium bovis subsp bovis AF2122/97
gcgguuuggcgacgu

SEQ ID NO: 1148041 - RNA, 14 nt, Mycobacterium bovis subsp bovis AF2122/97
gcgguuuucgccgg

SEQ ID NO: 1148042 - RNA, 18 nt, Mycobacterium bovis subsp bovis AF2122/97
gcgguuuucgccggaucg

SEQ ID NO: 1148043 - RNA, 21 nt, Mycobacterium bovis subsp bovis AF2122/97
gcgguugccgucugcggucga

SEQ ID NO: 1148044 - RNA, 14 nt, Mycobacterium bovis subsp bovis AF2122/97
gcgguuggcggcga

SEQ ID NO: 1148045 - RNA, 16 nt, Mycobacterium bovis subsp bovis AF2122/97
gcgguuggcggcgaug

SEQ ID NO: 1148046 - RNA, 17 nt, Mycobacterium bovis subsp bovis AF2122/97
gcgguuguggcugaucc

SEQ ID NO: 1148047 - RNA, 19 nt, Mycobacterium bovis subsp bovis AF2122/97
gcgguucgaacgcgaucga

SEQ ID NO: 1148048 - RNA, 14 nt, Mycobacterium bovis subsp bovis AF2122/97
gcgguucgcugcgg

SEQ ID NO: 1148049 - RNA, 18 nt, Mycobacterium bovis subsp bovis AF2122/97
gcgguucgcugcggcggu

SEQ ID NO: 1148050 - RNA, 20 nt, Mycobacterium bovis subsp bovis AF2122/97
gcgguugaguugcagaccgg

SEQ ID NO: 1148051 - RNA, 13 nt, Mycobacterium bovis subsp bovis AF2122/97
gcgguugccccga

SEQ ID NO: 1148052 - RNA, 16 nt, Mycobacterium bovis subsp bovis AF2122/97
gcgguugcccgagcgg

SEQ ID NO: 1148053 - RNA, 19 nt, Mycobacterium bovis subsp bovis AF2122/97
gcgguugcaaaccgcugcg

SEQ ID NO: 1148054 - RNA, 16 nt, Mycobacterium bovis subsp bovis AF2122/97
gcgguugauucgugcg

SEQ ID NO: 1148055 - RNA, 17 nt, Mycobacterium bovis subsp bovis AF2122/97
gcguacagcgccugggu

SEQ ID NO: 1148056 - RNA, 22 nt, Mycobacterium bovis subsp bovis AF2122/97
gcguacauucgggcgugcucgc

SEQ ID NO: 1148057 - RNA, 16 nt, Mycobacterium bovis subsp bovis AF2122/97
gcguacaaaccgucgg

SEQ ID NO: 1148058 - RNA, 18 nt, Mycobacterium bovis subsp bovis AF2122/97
gcguacaggccggccacc

SEQ ID NO: 1148059 - RNA, 23 nt, Mycobacterium bovis subsp bovis AF2122/97
gcguaccaauucccgcgcggcgu

SEQ ID NO: 1148060 - RNA, 18 nt, Mycobacterium bovis subsp bovis AF2122/97
gcguaccagcuggccacu

SEQ ID NO: 1148061 - RNA, 23 nt, Mycobacterium bovis subsp bovis AF2122/97
gcguacucccccgaaccugcggc

SEQ ID NO: 1148062 - RNA, 16 nt, Mycobacterium bovis subsp bovis AF2122/97
gcguacucggugaucg

SEQ ID NO: 1148063 - RNA, 16 nt, Mycobacterium bovis subsp bovis AF2122/97
gcguacccgaucagcg

SEQ ID NO: 1148064 - RNA, 18 nt, Mycobacterium bovis subsp bovis AF2122/97
gcguacccgaucagcgac

SEQ ID NO: 1148065 - RNA, 19 nt, Mycobacterium bovis subsp bovis AF2122/97
gcguacccgaucagcgacg

SEQ ID NO: 1148066 - RNA, 20 nt, Mycobacterium bovis subsp bovis AF2122/97
gcguacccguuaugcgccgc

SEQ ID NO: 1148067 - RNA, 21 nt, Mycobacterium bovis subsp bovis AF2122/97
gcguacccguuaugcgccgcc

SEQ ID NO: 1148068 - RNA, 12 nt, Mycobacterium bovis subsp bovis AF2122/97
gcguacagcgcc

SEQ ID NO: 1148069 - RNA, 16 nt, Mycobacterium bovis subsp bovis AF2122/97
gcguaauucgacuucg

SEQ ID NO: 1148070 - RNA, 15 nt, Mycobacterium bovis subsp bovis AF2122/97
gcguaaugcugcugc

SEQ ID NO: 1148071 - RNA, 23 nt, Mycobacterium bovis subsp bovis AF2122/97
gcguaauccacacacagccggug

SEQ ID NO: 1148072 - RNA, 22 nt, Mycobacterium bovis subsp bovis AF2122/97
gcguaauccgagcgcggcggcg

SEQ ID NO: 1148073 - RNA, 15 nt, Mycobacterium bovis subsp bovis AF2122/97
gcucagcgcagcauc

SEQ ID NO: 1148074 - RNA, 19 nt, Mycobacterium bovis subsp bovis AF2122/97
gcucagccguccgggcggc

SEQ ID NO: 1148075 - RNA, 21 nt, Mycobacterium bovis subsp bovis AF2122/97
gcucagccguccgggcggccu

SEQ ID NO: 1148076 - RNA, 13 nt, Mycobacterium bovis subsp bovis AF2122/97
gcucagcgcgcgc

SEQ ID NO: 1148077 - RNA, 14 nt, Mycobacterium bovis subsp bovis AF2122/97
gcucagcgcgcgcc

SEQ ID NO: 1148078 - RNA, 15 nt, Mycobacterium bovis subsp bovis AF2122/97
gcucagcgcgcgccg

SEQ ID NO: 1148079 - RNA, 16 nt, Mycobacterium bovis subsp bovis AF2122/97
gcucagcuccggcgac

SEQ ID NO: 1148080 - RNA, 15 nt, Mycobacterium bovis subsp bovis AF2122/97
gcucagcugcggauu

SEQ ID NO: 1148081 - RNA, 14 nt, Mycobacterium bovis subsp bovis AF2122/97
gcucagcggcgacc

SEQ ID NO: 1148082 - RNA, 16 nt, Mycobacterium bovis subsp bovis AF2122/97
gcucagcgcggccacg

SEQ ID NO: 1148083 - RNA, 20 nt, Mycobacterium bovis subsp bovis AF2122/97
gcucagcgcggccacgccga

SEQ ID NO: 1148084 - RNA, 16 nt, Mycobacterium bovis subsp bovis AF2122/97
gcguuccagcacaccc

SEQ ID NO: 1148085 - RNA, 17 nt, Mycobacterium bovis subsp bovis AF2122/97
gcucagcaaguucgucg

SEQ ID NO: 1148086 - RNA, 22 nt, Mycobacterium bovis subsp bovis AF2122/97
gcucagcaaguucgucgggauc

SEQ ID NO: 1148087 - RNA, 19 nt, Mycobacterium bovis subsp bovis AF2122/97
gcucagcagcgccgcgcgg

SEQ ID NO: 1148088 - RNA, 13 nt, Mycobacterium bovis subsp bovis AF2122/97
gcucagcauucac

SEQ ID NO: 1148089 - RNA, 21 nt, Mycobacterium bovis subsp bovis AF2122/97
gcucagcaacgucacgucgac

SEQ ID NO: 1148090 - RNA, 22 nt, Mycobacterium bovis subsp bovis AF2122/97
gcucagcaacgucacgucgacg

SEQ ID NO: 1148091 - RNA, 14 nt, Mycobacterium bovis subsp bovis AF2122/97
gcucagaccggcgc

SEQ ID NO: 1148092 - RNA, 23 nt, Mycobacterium bovis subsp bovis AF2122/97
gcucagaccggcgccguagccga

SEQ ID NO: 1148093 - RNA, 16 nt, Mycobacterium bovis subsp bovis AF2122/97
gcguuccacacagauc

SEQ ID NO: 1148094 - RNA, 15 nt, Mycobacterium bovis subsp bovis AF2122/97
gcucauaggccggcg

SEQ ID NO: 1148095 - RNA, 16 nt, Mycobacterium bovis subsp bovis AF2122/97
gcucaguuuggcgggu

SEQ ID NO: 1148096 - RNA, 13 nt, Mycobacterium bovis subsp bovis AF2122/97
gcucauccgccgg

SEQ ID NO: 1148097 - RNA, 16 nt, Mycobacterium bovis subsp bovis AF2122/97
gcucauccgccgggcc

SEQ ID NO: 1148098 - RNA, 20 nt, Mycobacterium bovis subsp bovis AF2122/97
gcucaucacccagcgccgac

SEQ ID NO: 1148099 - RNA, 14 nt, Mycobacterium bovis subsp bovis AF2122/97
gcucaucaccggcg

SEQ ID NO: 1148100 - RNA, 16 nt, Mycobacterium bovis subsp bovis AF2122/97
gcucaucaccggcgca

SEQ ID NO: 1148101 - RNA, 16 nt, Mycobacterium bovis subsp bovis AF2122/97
gcucaucgacgagccg

SEQ ID NO: 1148102 - RNA, 18 nt, Mycobacterium bovis subsp bovis AF2122/97
gcucaucgaagcuucggc

SEQ ID NO: 1148103 - RNA, 19 nt, Mycobacterium bovis subsp bovis AF2122/97
gcucauccauucggcggcg

SEQ ID NO: 1148104 - RNA, 17 nt, Mycobacterium bovis subsp bovis AF2122/97
gcucaucgccgcuaccg

SEQ ID NO: 1148105 - RNA, 13 nt, Mycobacterium bovis subsp bovis AF2122/97
gcucaucgcggcg

SEQ ID NO: 1148106 - RNA, 14 nt, Mycobacterium bovis subsp bovis AF2122/97
gcucaucgcggcga

SEQ ID NO: 1148107 - RNA, 15 nt, Mycobacterium bovis subsp bovis AF2122/97
gcucaucgcggcgaa

SEQ ID NO: 1148108 - RNA, 17 nt, Mycobacterium bovis subsp bovis AF2122/97
gcucagcuggucggcuu

SEQ ID NO: 1148109 - RNA, 14 nt, Mycobacterium bovis subsp bovis AF2122/97
gcucagcgcggcca

SEQ ID NO: 1148110 - RNA, 12 nt, Mycobacterium bovis subsp bovis AF2122/97
gcucaggugcuc

SEQ ID NO: 1148111 - RNA, 20 nt, Mycobacterium bovis subsp bovis AF2122/97
gcucaggguguucacguuca

SEQ ID NO: 1148112 - RNA, 22 nt, Mycobacterium bovis subsp bovis AF2122/97
gcucagggugcgccgcagcagg

SEQ ID NO: 1148113 - RNA, 21 nt, Mycobacterium bovis subsp bovis AF2122/97
gcucaggucaucggcggcggg

SEQ ID NO: 1148114 - RNA, 23 nt, Mycobacterium bovis subsp bovis AF2122/97
gcuccagcaaaacccgcuccacc

SEQ ID NO: 1148115 - RNA, 20 nt, Mycobacterium bovis subsp bovis AF2122/97
gcuccagcacccgcgcgacg

SEQ ID NO: 1148116 - RNA, 22 nt, Mycobacterium bovis subsp bovis AF2122/97
gcuccagcaccgugacccugau

SEQ ID NO: 1148117 - RNA, 18 nt, Mycobacterium bovis subsp bovis AF2122/97
gcuccacguacgcggcug

SEQ ID NO: 1148118 - RNA, 14 nt, Mycobacterium bovis subsp bovis AF2122/97
gcuccacugaccag

SEQ ID NO: 1148119 - RNA, 17 nt, Mycobacterium bovis subsp bovis AF2122/97
gcucauguucucgaccg

SEQ ID NO: 1148120 - RNA, 15 nt, Mycobacterium bovis subsp bovis AF2122/97
gcucaucugcgcgcg

SEQ ID NO: 1148121 - RNA, 16 nt, Mycobacterium bovis subsp bovis AF2122/97
gcucaugaccgcucgg

SEQ ID NO: 1148122 - RNA, 18 nt, Mycobacterium bovis subsp bovis AF2122/97
gcuccaacaaugccagcu

SEQ ID NO: 1148123 - RNA, 15 nt, Mycobacterium bovis subsp bovis AF2122/97
gcuccaacacccgcc

SEQ ID NO: 1148124 - RNA, 22 nt, Mycobacterium bovis subsp bovis AF2122/97
gcuccaacuccaagaugccgcc

SEQ ID NO: 1148125 - RNA, 14 nt, Mycobacterium bovis subsp bovis AF2122/97
gcucauugccgauu

SEQ ID NO: 1148126 - RNA, 23 nt, Mycobacterium bovis subsp bovis AF2122/97
gcuccaaauccuucggcguggcg

SEQ ID NO: 1148127 - RNA, 15 nt, Mycobacterium bovis subsp bovis AF2122/97
gcuccaaaucggcau

SEQ ID NO: 1148128 - RNA, 23 nt, Mycobacterium bovis subsp bovis AF2122/97
gcuccaaaucggcaucggcgacg

SEQ ID NO: 1148129 - RNA, 15 nt, Mycobacterium bovis subsp bovis AF2122/97
gcucauuagcccccg

SEQ ID NO: 1148130 - RNA, 11 nt, Mycobacterium bovis subsp bovis AF2122/97
gcucccacggc

SEQ ID NO: 1148131 - RNA, 19 nt, Mycobacterium bovis subsp bovis AF2122/97
gcuccccggauuccucguc

SEQ ID NO: 1148132 - RNA, 18 nt, Mycobacterium bovis subsp bovis AF2122/97
gcucccgcaauggggcgc

SEQ ID NO: 1148133 - RNA, 16 nt, Mycobacterium bovis subsp bovis AF2122/97
gcuccaguagucggcc

SEQ ID NO: 1148134 - RNA, 13 nt, Mycobacterium bovis subsp bovis AF2122/97
gcuccaggcgcgc

SEQ ID NO: 1148135 - RNA, 15 nt, Mycobacterium bovis subsp bovis AF2122/97
gcuccaggcgcgccg

SEQ ID NO: 1148136 - RNA, 19 nt, Mycobacterium bovis subsp bovis AF2122/97
gcuccaggcgcgccgcacc

SEQ ID NO: 1148137 - RNA, 22 nt, Mycobacterium bovis subsp bovis AF2122/97
gcuccagcucggccagugccgg

SEQ ID NO: 1148138 - RNA, 14 nt, Mycobacterium bovis subsp bovis AF2122/97
gcuccagcucggcg

SEQ ID NO: 1148139 - RNA, 18 nt, Mycobacterium bovis subsp bovis AF2122/97
gcuccagcugagcggccg

SEQ ID NO: 1148140 - RNA, 19 nt, Mycobacterium bovis subsp bovis AF2122/97
gcuccagcugagcggccgg

SEQ ID NO: 1148141 - RNA, 13 nt, Mycobacterium bovis subsp bovis AF2122/97
gcucgaggcccgg

SEQ ID NO: 1148142 - RNA, 13 nt, Mycobacterium bovis subsp bovis AF2122/97
gcucgaggaccac

SEQ ID NO: 1148143 - RNA, 15 nt, Mycobacterium bovis subsp bovis AF2122/97
gcucgaggaccaccu

SEQ ID NO: 1148144 - RNA, 15 nt, Mycobacterium bovis subsp bovis AF2122/97
gcucgaugcgacgaa

SEQ ID NO: 1148145 - RNA, 21 nt, Mycobacterium bovis subsp bovis AF2122/97
gcucgaguguggccgaaagcc

SEQ ID NO: 1148146 - RNA, 17 nt, Mycobacterium bovis subsp bovis AF2122/97
gcucgagucgcagcacg

SEQ ID NO: 1148147 - RNA, 15 nt, Mycobacterium bovis subsp bovis AF2122/97
gcucgcaaucguugg

SEQ ID NO: 1148148 - RNA, 14 nt, Mycobacterium bovis subsp bovis AF2122/97
gcucgcacagcacc

SEQ ID NO: 1148149 - RNA, 15 nt, Mycobacterium bovis subsp bovis AF2122/97
gcucgcacagcacca

SEQ ID NO: 1148150 - RNA, 13 nt, Mycobacterium bovis subsp bovis AF2122/97
gcucgcaccacca

SEQ ID NO: 1148151 - RNA, 18 nt, Mycobacterium bovis subsp bovis AF2122/97
gcucgcacccgcucggcg

SEQ ID NO: 1148152 - RNA, 22 nt, Mycobacterium bovis subsp bovis AF2122/97
gcucgcacccgcucggcgcgcg

SEQ ID NO: 1148153 - RNA, 17 nt, Mycobacterium bovis subsp bovis AF2122/97
gcucgcacucguugccg

SEQ ID NO: 1148154 - RNA, 18 nt, Mycobacterium bovis subsp bovis AF2122/97
gcucgauggcggccacca

SEQ ID NO: 1148155 - RNA, 21 nt, Mycobacterium bovis subsp bovis AF2122/97
gcucgauggcggccaccagcg

SEQ ID NO: 1148156 - RNA, 13 nt, Mycobacterium bovis subsp bovis AF2122/97
gcucgaugccgug

SEQ ID NO: 1148157 - RNA, 15 nt, Mycobacterium bovis subsp bovis AF2122/97
gcucgaccaugccgu

SEQ ID NO: 1148158 - RNA, 21 nt, Mycobacterium bovis subsp bovis AF2122/97
gcucgaccaugccgucgucgg

SEQ ID NO: 1148159 - RNA, 22 nt, Mycobacterium bovis subsp bovis AF2122/97
gcucgaccaugccgucgucggc

SEQ ID NO: 1148160 - RNA, 16 nt, Mycobacterium bovis subsp bovis AF2122/97
gcucgagcucggcgau

SEQ ID NO: 1148161 - RNA, 15 nt, Mycobacterium bovis subsp bovis AF2122/97
gcucgagcucggcga

SEQ ID NO: 1148162 - RNA, 15 nt, Mycobacterium bovis subsp bovis AF2122/97
gcucgagcagcgcgc

SEQ ID NO: 1148163 - RNA, 14 nt, Mycobacterium bovis subsp bovis AF2122/97
gcucgagcucggcg

SEQ ID NO: 1148164 - RNA, 14 nt, Mycobacterium bovis subsp bovis AF2122/97
gcucgaagcccgga

SEQ ID NO: 1148165 - RNA, 15 nt, Mycobacterium bovis subsp bovis AF2122/97
gcucgacaaagccac

SEQ ID NO: 1148166 - RNA, 21 nt, Mycobacterium bovis subsp bovis AF2122/97
gcucgacaaagccacgcagaa

SEQ ID NO: 1148167 - RNA, 21 nt, Mycobacterium bovis subsp bovis AF2122/97
gcucgaccaggaacggcucgg

SEQ ID NO: 1148168 - RNA, 22 nt, Mycobacterium bovis subsp bovis AF2122/97
gcucgaccaggaacggcucggc

SEQ ID NO: 1148169 - RNA, 16 nt, Mycobacterium bovis subsp bovis AF2122/97
gcucgaaucgucacgg

SEQ ID NO: 1148170 - RNA, 15 nt, Mycobacterium bovis subsp bovis AF2122/97
gcuccgggucgacga

SEQ ID NO: 1148171 - RNA, 19 nt, Mycobacterium bovis subsp bovis AF2122/97
gcuccggcccugccgccgg

SEQ ID NO: 1148172 - RNA, 22 nt, Mycobacterium bovis subsp bovis AF2122/97
gcuccgggucgacgacgucgcg

SEQ ID NO: 1148173 - RNA, 23 nt, Mycobacterium bovis subsp bovis AF2122/97
gcuccuggaaguacacggcggcc

SEQ ID NO: 1148174 - RNA, 18 nt, Mycobacterium bovis subsp bovis AF2122/97
gcuccgggaauggcgacc

SEQ ID NO: 1148175 - RNA, 14 nt, Mycobacterium bovis subsp bovis AF2122/97
gcuccggcggugcc

SEQ ID NO: 1148176 - RNA, 16 nt, Mycobacterium bovis subsp bovis AF2122/97
gcuccggcggugccgu

SEQ ID NO: 1148177 - RNA, 15 nt, Mycobacterium bovis subsp bovis AF2122/97
gcuccgggacgguga

SEQ ID NO: 1148178 - RNA, 15 nt, Mycobacterium bovis subsp bovis AF2122/97
gcuccgggcgcucgg

SEQ ID NO: 1148179 - RNA, 17 nt, Mycobacterium bovis subsp bovis AF2122/97
gcucgaaagcgucgauc

SEQ ID NO: 1148180 - RNA, 18 nt, Mycobacterium bovis subsp bovis AF2122/97
gcuccuucagggcgucga

SEQ ID NO: 1148181 - RNA, 14 nt, Mycobacterium bovis subsp bovis AF2122/97
gcucgaacagcucg

SEQ ID NO: 1148182 - RNA, 22 nt, Mycobacterium bovis subsp bovis AF2122/97
gcucgaacuccccggucgccgc

SEQ ID NO: 1148183 - RNA, 23 nt, Mycobacterium bovis subsp bovis AF2122/97
gcucgaacuccccggucgccgcg

SEQ ID NO: 1148184 - RNA, 16 nt, Mycobacterium bovis subsp bovis AF2122/97
gcucccucuacacccg

SEQ ID NO: 1148185 - RNA, 16 nt, Mycobacterium bovis subsp bovis AF2122/97
gcucccugggcgucga

SEQ ID NO: 1148186 - RNA, 19 nt, Mycobacterium bovis subsp bovis AF2122/97
gcuccgaaguccacgcacc

SEQ ID NO: 1148187 - RNA, 22 nt, Mycobacterium bovis subsp bovis AF2122/97
gcuccgaaguccacgcaccacg

SEQ ID NO: 1148188 - RNA, 19 nt, Mycobacterium bovis subsp bovis AF2122/97
gcucccggggguuccacuc

SEQ ID NO: 1148189 - RNA, 22 nt, Mycobacterium bovis subsp bovis AF2122/97
gcucccgguugggguggcggug

SEQ ID NO: 1148190 - RNA, 14 nt, Mycobacterium bovis subsp bovis AF2122/97
gcucccguacgccg

SEQ ID NO: 1148191 - RNA, 19 nt, Mycobacterium bovis subsp bovis AF2122/97
gcucccgugcuggcgccga

SEQ ID NO: 1148192 - RNA, 22 nt, Mycobacterium bovis subsp bovis AF2122/97
gcucccuacgagcccacgcgcc

SEQ ID NO: 1148193 - RNA, 15 nt, Mycobacterium bovis subsp bovis AF2122/97
gcuccggcggcagcg

SEQ ID NO: 1148194 - RNA, 14 nt, Mycobacterium bovis subsp bovis AF2122/97
gcuccggcgcgacg

SEQ ID NO: 1148195 - RNA, 15 nt, Mycobacterium bovis subsp bovis AF2122/97
gcuccggcgcgacgc

SEQ ID NO: 1148196 - RNA, 17 nt, Mycobacterium bovis subsp bovis AF2122/97
gcuccggcgcgacgccc

SEQ ID NO: 1148197 - RNA, 16 nt, Mycobacterium bovis subsp bovis AF2122/97
gcuccggccggccagc

SEQ ID NO: 1148198 - RNA, 18 nt, Mycobacterium bovis subsp bovis AF2122/97
gcuccggccggccagcac

SEQ ID NO: 1148199 - RNA, 22 nt, Mycobacterium bovis subsp bovis AF2122/97
gcucggccgucaggguguugcg

SEQ ID NO: 1148200 - RNA, 16 nt, Mycobacterium bovis subsp bovis AF2122/97
gcucggccgcagccag

SEQ ID NO: 1148201 - RNA, 22 nt, Mycobacterium bovis subsp bovis AF2122/97
gcucggccgcagccagcgguag

SEQ ID NO: 1148202 - RNA, 16 nt, Mycobacterium bovis subsp bovis AF2122/97
gcucggccgccggguc

SEQ ID NO: 1148203 - RNA, 18 nt, Mycobacterium bovis subsp bovis AF2122/97
gcucggcgaaggccgcgc

SEQ ID NO: 1148204 - RNA, 19 nt, Mycobacterium bovis subsp bovis AF2122/97
gcucggcgaaggccgcgcg

SEQ ID NO: 1148205 - RNA, 16 nt, Mycobacterium bovis subsp bovis AF2122/97
gcucggccuguucggc

SEQ ID NO: 1148206 - RNA, 17 nt, Mycobacterium bovis subsp bovis AF2122/97
gcucggcgaaacccggg

SEQ ID NO: 1148207 - RNA, 18 nt, Mycobacterium bovis subsp bovis AF2122/97
gcucggcgaaacccggga

SEQ ID NO: 1148208 - RNA, 21 nt, Mycobacterium bovis subsp bovis AF2122/97
gcucggcgaaacccgggauca

SEQ ID NO: 1148209 - RNA, 21 nt, Mycobacterium bovis subsp bovis AF2122/97
gcucggcggguauauggugcg

SEQ ID NO: 1148210 - RNA, 17 nt, Mycobacterium bovis subsp bovis AF2122/97
gcucggcggcgcgugcg

SEQ ID NO: 1148211 - RNA, 14 nt, Mycobacterium bovis subsp bovis AF2122/97
gcucggcgcugacu

SEQ ID NO: 1148212 - RNA, 22 nt, Mycobacterium bovis subsp bovis AF2122/97
gcucggcggagaaaagcgcgcu

SEQ ID NO: 1148213 - RNA, 11 nt, Mycobacterium bovis subsp bovis AF2122/97
gcucggcgaag

SEQ ID NO: 1148214 - RNA, 16 nt, Mycobacterium bovis subsp bovis AF2122/97
gcucggcggcccggcc

SEQ ID NO: 1148215 - RNA, 20 nt, Mycobacterium bovis subsp bovis AF2122/97
gcucggcaucgagcagcccg

SEQ ID NO: 1148216 - RNA, 18 nt, Mycobacterium bovis subsp bovis AF2122/97
gcucggcaugagucgaac

SEQ ID NO: 1148217 - RNA, 22 nt, Mycobacterium bovis subsp bovis AF2122/97
gcucggcagcaucuccgucggc

SEQ ID NO: 1148218 - RNA, 13 nt, Mycobacterium bovis subsp bovis AF2122/97
gcucggauccggc

SEQ ID NO: 1148219 - RNA, 16 nt, Mycobacterium bovis subsp bovis AF2122/97
gcucggaucggcucgc

SEQ ID NO: 1148220 - RNA, 18 nt, Mycobacterium bovis subsp bovis AF2122/97
gcucggaucggcucgcca

SEQ ID NO: 1148221 - RNA, 17 nt, Mycobacterium bovis subsp bovis AF2122/97
gcucggccaccagcgcc

SEQ ID NO: 1148222 - RNA, 15 nt, Mycobacterium bovis subsp bovis AF2122/97
gcucggccgaggcgg

SEQ ID NO: 1148223 - RNA, 18 nt, Mycobacterium bovis subsp bovis AF2122/97
gcucgcuucaggcaccgg

SEQ ID NO: 1148224 - RNA, 11 nt, Mycobacterium bovis subsp bovis AF2122/97
gcucgcggugg

SEQ ID NO: 1148225 - RNA, 15 nt, Mycobacterium bovis subsp bovis AF2122/97
gcucggagaucgcca

SEQ ID NO: 1148226 - RNA, 17 nt, Mycobacterium bovis subsp bovis AF2122/97
gcucggagaugagcagc

SEQ ID NO: 1148227 - RNA, 19 nt, Mycobacterium bovis subsp bovis AF2122/97
gcucgcggcggcgcuggcg

SEQ ID NO: 1148228 - RNA, 14 nt, Mycobacterium bovis subsp bovis AF2122/97
gcucgcggcgacca

SEQ ID NO: 1148229 - RNA, 13 nt, Mycobacterium bovis subsp bovis AF2122/97
gcucgcggucaug

SEQ ID NO: 1148230 - RNA, 20 nt, Mycobacterium bovis subsp bovis AF2122/97
gcucgcgcaagcggacccga

SEQ ID NO: 1148231 - RNA, 16 nt, Mycobacterium bovis subsp bovis AF2122/97
gcucgcgcaaggcgcc

SEQ ID NO: 1148232 - RNA, 19 nt, Mycobacterium bovis subsp bovis AF2122/97
gcucgcgcacccagcccag

SEQ ID NO: 1148233 - RNA, 20 nt, Mycobacterium bovis subsp bovis AF2122/97
gcucgcgcacccagcccagc

SEQ ID NO: 1148234 - RNA, 18 nt, Mycobacterium bovis subsp bovis AF2122/97
gcucgcgcacccugcgug

SEQ ID NO: 1148235 - RNA, 23 nt, Mycobacterium bovis subsp bovis AF2122/97
gcucgcgcacccugcgugcggcg

SEQ ID NO: 1148236 - RNA, 23 nt, Mycobacterium bovis subsp bovis AF2122/97
gcucgcgaggcucgcguggccgc

SEQ ID NO: 1148237 - RNA, 15 nt, Mycobacterium bovis subsp bovis AF2122/97
gcucgcgaucgcagu

SEQ ID NO: 1148238 - RNA, 17 nt, Mycobacterium bovis subsp bovis AF2122/97
gcucgcgaucgcaguga

SEQ ID NO: 1148239 - RNA, 22 nt, Mycobacterium bovis subsp bovis AF2122/97
gcucgcgaucgcagugagcagc

SEQ ID NO: 1148240 - RNA, 20 nt, Mycobacterium bovis subsp bovis AF2122/97
gcucgccgucguacucgacc

SEQ ID NO: 1148241 - RNA, 13 nt, Mycobacterium bovis subsp bovis AF2122/97
gcucgccgugacc

SEQ ID NO: 1148242 - RNA, 16 nt, Mycobacterium bovis subsp bovis AF2122/97
gcucgccgugaccagg

SEQ ID NO: 1148243 - RNA, 20 nt, Mycobacterium bovis subsp bovis AF2122/97
gcucgccguugaugucggca

SEQ ID NO: 1148244 - RNA, 17 nt, Mycobacterium bovis subsp bovis AF2122/97
gcucgccucgauggcgu

SEQ ID NO: 1148245 - RNA, 19 nt, Mycobacterium bovis subsp bovis AF2122/97
gcucgccucgauggcguag

SEQ ID NO: 1148246 - RNA, 15 nt, Mycobacterium bovis subsp bovis AF2122/97
gcucgcccgccgcca

SEQ ID NO: 1148247 - RNA, 17 nt, Mycobacterium bovis subsp bovis AF2122/97
gcucgcccgccgccacc

SEQ ID NO: 1148248 - RNA, 18 nt, Mycobacterium bovis subsp bovis AF2122/97
gcucgcccgccgccacca

SEQ ID NO: 1148249 - RNA, 19 nt, Mycobacterium bovis subsp bovis AF2122/97
gcucgcccgccgccaccag

SEQ ID NO: 1148250 - RNA, 12 nt, Mycobacterium bovis subsp bovis AF2122/97
gcucgccaggcc

SEQ ID NO: 1148251 - RNA, 15 nt, Mycobacterium bovis subsp bovis AF2122/97
gcucgccaguucgcg

SEQ ID NO: 1148252 - RNA, 19 nt, Mycobacterium bovis subsp bovis AF2122/97
gcucgccaguucgcgccac

SEQ ID NO: 1148253 - RNA, 19 nt, Mycobacterium bovis subsp bovis AF2122/97
gcucgcauguucuccacgc

SEQ ID NO: 1148254 - RNA, 22 nt, Mycobacterium bovis subsp bovis AF2122/97
gcucgcauguucuccacgccga

SEQ ID NO: 1148255 - RNA, 23 nt, Mycobacterium bovis subsp bovis AF2122/97
gcucgcauguucuccacgccgau

SEQ ID NO: 1148256 - RNA, 14 nt, Mycobacterium bovis subsp bovis AF2122/97
gcucgcauucggcg

SEQ ID NO: 1148257 - RNA, 17 nt, Mycobacterium bovis subsp bovis AF2122/97
gcucgcauucggcgagc

SEQ ID NO: 1148258 - RNA, 19 nt, Mycobacterium bovis subsp bovis AF2122/97
gcucgcauucggcgagccg

SEQ ID NO: 1148259 - RNA, 22 nt, Mycobacterium bovis subsp bovis AF2122/97
gcucgccaaacccaugucggcg

SEQ ID NO: 1148260 - RNA, 23 nt, Mycobacterium bovis subsp bovis AF2122/97
gcucgauggcggccaccagcgcc

SEQ ID NO: 1148261 - RNA, 15 nt, Mycobacterium bovis subsp bovis AF2122/97
gcucgcaggccggcg

SEQ ID NO: 1148262 - RNA, 16 nt, Mycobacterium bovis subsp bovis AF2122/97
gcucgcaaucguuggc

SEQ ID NO: 1148263 - RNA, 17 nt, Mycobacterium bovis subsp bovis AF2122/97
gcucgcagccacgcaaa

SEQ ID NO: 1148264 - RNA, 13 nt, Mycobacterium bovis subsp bovis AF2122/97
gcucgcaggccgg

SEQ ID NO: 1148265 - RNA, 17 nt, Mycobacterium bovis subsp bovis AF2122/97
gcugaauucggcgagcg

SEQ ID NO: 1148266 - RNA, 22 nt, Mycobacterium bovis subsp bovis AF2122/97
gcugacacccgcagcuguggcc

SEQ ID NO: 1148267 - RNA, 16 nt, Mycobacterium bovis subsp bovis AF2122/97
gcugacaccgaaccgc

SEQ ID NO: 1148268 - RNA, 20 nt, Mycobacterium bovis subsp bovis AF2122/97
gcugacaccgaaccgccgcu

SEQ ID NO: 1148269 - RNA, 23 nt, Mycobacterium bovis subsp bovis AF2122/97
gcugacaccgauccggccgccga

SEQ ID NO: 1148270 - RNA, 13 nt, Mycobacterium bovis subsp bovis AF2122/97
gcugacccgcggu

SEQ ID NO: 1148271 - RNA, 16 nt, Mycobacterium bovis subsp bovis AF2122/97
gcugacccgcgguagc

SEQ ID NO: 1148272 - RNA, 16 nt, Mycobacterium bovis subsp bovis AF2122/97
gcugaccccgccggcu

SEQ ID NO: 1148273 - RNA, 21 nt, Mycobacterium bovis subsp bovis AF2122/97
gcugaccagcguccagccgcc

SEQ ID NO: 1148274 - RNA, 22 nt, Mycobacterium bovis subsp bovis AF2122/97
gcugaccagcguccagccgccc

SEQ ID NO: 1148275 - RNA, 18 nt, Mycobacterium bovis subsp bovis AF2122/97
gcugagcacggcgcggcg

SEQ ID NO: 1148276 - RNA, 15 nt, Mycobacterium bovis subsp bovis AF2122/97
gcugagcccgccgcg

SEQ ID NO: 1148277 - RNA, 17 nt, Mycobacterium bovis subsp bovis AF2122/97
gcugagcccgccgcgac

SEQ ID NO: 1148278 - RNA, 22 nt, Mycobacterium bovis subsp bovis AF2122/97
gcugagcccugcgccucggcgg

SEQ ID NO: 1148279 - RNA, 16 nt, Mycobacterium bovis subsp bovis AF2122/97
gcugagcagcgccgcg

SEQ ID NO: 1148280 - RNA, 15 nt, Mycobacterium bovis subsp bovis AF2122/97
gcugagcggacucga

SEQ ID NO: 1148281 - RNA, 17 nt, Mycobacterium bovis subsp bovis AF2122/97
gcugagcggccagcauc

SEQ ID NO: 1148282 - RNA, 16 nt, Mycobacterium bovis subsp bovis AF2122/97
gcugagccggucauag

SEQ ID NO: 1148283 - RNA, 21 nt, Mycobacterium bovis subsp bovis AF2122/97
gcugagccguagugucggcgu

SEQ ID NO: 1148284 - RNA, 13 nt, Mycobacterium bovis subsp bovis AF2122/97
gcugagccgucgg

SEQ ID NO: 1148285 - RNA, 16 nt, Mycobacterium bovis subsp bovis AF2122/97
gcugagccgucggcgc

SEQ ID NO: 1148286 - RNA, 22 nt, Mycobacterium bovis subsp bovis AF2122/97
gcugagccgcaucuggccggcg

SEQ ID NO: 1148287 - RNA, 22 nt, Mycobacterium bovis subsp bovis AF2122/97
gcugagcgcgcggguggcggcg

SEQ ID NO: 1148288 - RNA, 20 nt, Mycobacterium bovis subsp bovis AF2122/97
gcugagcgacugcagcggcg

SEQ ID NO: 1148289 - RNA, 22 nt, Mycobacterium bovis subsp bovis AF2122/97
gcugaguccccaggugggcagc

SEQ ID NO: 1148290 - RNA, 20 nt, Mycobacterium bovis subsp bovis AF2122/97
gcugagguggcggugcggcg

SEQ ID NO: 1148291 - RNA, 20 nt, Mycobacterium bovis subsp bovis AF2122/97
gcugagguauugggcgcggc

SEQ ID NO: 1148292 - RNA, 15 nt, Mycobacterium bovis subsp bovis AF2122/97
gcugaggcggcgacg

SEQ ID NO: 1148293 - RNA, 16 nt, Mycobacterium bovis subsp bovis AF2122/97
gcugaggcggcgacga

SEQ ID NO: 1148294 - RNA, 18 nt, Mycobacterium bovis subsp bovis AF2122/97
gcugagcugcucgccggc

SEQ ID NO: 1148295 - RNA, 19 nt, Mycobacterium bovis subsp bovis AF2122/97
gcugaggaagcggcggcaa

SEQ ID NO: 1148296 - RNA, 20 nt, Mycobacterium bovis subsp bovis AF2122/97
gcugaggaagcggcggcaac

SEQ ID NO: 1148297 - RNA, 15 nt, Mycobacterium bovis subsp bovis AF2122/97
gcugauaguggcgcg

SEQ ID NO: 1148298 - RNA, 17 nt, Mycobacterium bovis subsp bovis AF2122/97
gcugauaguggcgcgcg

SEQ ID NO: 1148299 - RNA, 20 nt, Mycobacterium bovis subsp bovis AF2122/97
gcugauaguggcgcgcggcg

SEQ ID NO: 1148300 - RNA, 21 nt, Mycobacterium bovis subsp bovis AF2122/97
gcugauaguggcgcgcggcgc

SEQ ID NO: 1148301 - RNA, 19 nt, Mycobacterium bovis subsp bovis AF2122/97
gcugaucccggccaggccg

SEQ ID NO: 1148302 - RNA, 19 nt, Mycobacterium bovis subsp bovis AF2122/97
gcugaucccagaucggcgu

SEQ ID NO: 1148303 - RNA, 12 nt, Mycobacterium bovis subsp bovis AF2122/97
gcugauccaagu

SEQ ID NO: 1148304 - RNA, 16 nt, Mycobacterium bovis subsp bovis AF2122/97
gcugaucaggucuucg

SEQ ID NO: 1148305 - RNA, 21 nt, Mycobacterium bovis subsp bovis AF2122/97
gcugaucagcaugcggccaug

SEQ ID NO: 1148306 - RNA, 19 nt, Mycobacterium bovis subsp bovis AF2122/97
gcugaucaaggcgcucccg

SEQ ID NO: 1148307 - RNA, 17 nt, Mycobacterium bovis subsp bovis AF2122/97
gcugaucgcgcgcaccg

SEQ ID NO: 1148308 - RNA, 19 nt, Mycobacterium bovis subsp bovis AF2122/97
gcugaucgcgcgcaccggg

SEQ ID NO: 1148309 - RNA, 17 nt, Mycobacterium bovis subsp bovis AF2122/97
gcucucuucgcgcgcug

SEQ ID NO: 1148310 - RNA, 22 nt, Mycobacterium bovis subsp bovis AF2122/97
gcucugaugguguacacgucgc

SEQ ID NO: 1148311 - RNA, 14 nt, Mycobacterium bovis subsp bovis AF2122/97
gcucucguguaucg

SEQ ID NO: 1148312 - RNA, 15 nt, Mycobacterium bovis subsp bovis AF2122/97
gcucucggcacccgg

SEQ ID NO: 1148313 - RNA, 23 nt, Mycobacterium bovis subsp bovis AF2122/97
gcucucggcgauuuugcgucgcg

SEQ ID NO: 1148314 - RNA, 17 nt, Mycobacterium bovis subsp bovis AF2122/97
gcugaacacgcagccga

SEQ ID NO: 1148315 - RNA, 16 nt, Mycobacterium bovis subsp bovis AF2122/97
gcugaacaccgcgggc

SEQ ID NO: 1148316 - RNA, 19 nt, Mycobacterium bovis subsp bovis AF2122/97
gcugaacaccgcgggcagu

SEQ ID NO: 1148317 - RNA, 17 nt, Mycobacterium bovis subsp bovis AF2122/97
gcugaauuggcgccgau

SEQ ID NO: 1148318 - RNA, 18 nt, Mycobacterium bovis subsp bovis AF2122/97
gcugaauuggcgccgaug

SEQ ID NO: 1148319 - RNA, 22 nt, Mycobacterium bovis subsp bovis AF2122/97
gcugaauguugguuugccggcg

SEQ ID NO: 1148320 - RNA, 15 nt, Mycobacterium bovis subsp bovis AF2122/97
gcugaauucggcgag

SEQ ID NO: 1148321 - RNA, 15 nt, Mycobacterium bovis subsp bovis AF2122/97
gcugaaggcccguug

SEQ ID NO: 1148322 - RNA, 23 nt, Mycobacterium bovis subsp bovis AF2122/97
gcugaaggcccguugucgaccga

SEQ ID NO: 1148323 - RNA, 21 nt, Mycobacterium bovis subsp bovis AF2122/97
gcugaaggccgguagcgcggg

SEQ ID NO: 1148324 - RNA, 14 nt, Mycobacterium bovis subsp bovis AF2122/97
gcugaacgcgagca

SEQ ID NO: 1148325 - RNA, 20 nt, Mycobacterium bovis subsp bovis AF2122/97
gcugaagcuguaggcgacca

SEQ ID NO: 1148326 - RNA, 18 nt, Mycobacterium bovis subsp bovis AF2122/97
gcugaacagacggcucag

SEQ ID NO: 1148327 - RNA, 19 nt, Mycobacterium bovis subsp bovis AF2122/97
gcucggcguccgcccagca

SEQ ID NO: 1148328 - RNA, 17 nt, Mycobacterium bovis subsp bovis AF2122/97
gcucggcgucgccgcca

SEQ ID NO: 1148329 - RNA, 15 nt, Mycobacterium bovis subsp bovis AF2122/97
gcucggcggucggga

SEQ ID NO: 1148330 - RNA, 13 nt, Mycobacterium bovis subsp bovis AF2122/97
gcucggcggugcc

SEQ ID NO: 1148331 - RNA, 15 nt, Mycobacterium bovis subsp bovis AF2122/97
gcucggcgugucggg

SEQ ID NO: 1148332 - RNA, 18 nt, Mycobacterium bovis subsp bovis AF2122/97
gcucggcggugccgcggc

SEQ ID NO: 1148333 - RNA, 19 nt, Mycobacterium bovis subsp bovis AF2122/97
gcucggcggugccgcggcu

SEQ ID NO: 1148334 - RNA, 17 nt, Mycobacterium bovis subsp bovis AF2122/97
gcucggcgugcucggcc

SEQ ID NO: 1148335 - RNA, 16 nt, Mycobacterium bovis subsp bovis AF2122/97
gcucguggucgacgug

SEQ ID NO: 1148336 - RNA, 15 nt, Mycobacterium bovis subsp bovis AF2122/97
gcucggcugcucgac

SEQ ID NO: 1148337 - RNA, 14 nt, Mycobacterium bovis subsp bovis AF2122/97
gcucgggcaaccgg

SEQ ID NO: 1148338 - RNA, 19 nt, Mycobacterium bovis subsp bovis AF2122/97
gcucgggcaaggccaccgg

SEQ ID NO: 1148339 - RNA, 19 nt, Mycobacterium bovis subsp bovis AF2122/97
gcucggcuauggguucgcg

SEQ ID NO: 1148340 - RNA, 17 nt, Mycobacterium bovis subsp bovis AF2122/97
gcucggcugcucgacgg

SEQ ID NO: 1148341 - RNA, 16 nt, Mycobacterium bovis subsp bovis AF2122/97
gcucucauagcgacgg

SEQ ID NO: 1148342 - RNA, 23 nt, Mycobacterium bovis subsp bovis AF2122/97
gcucucauagcgacggcgcucgg

SEQ ID NO: 1148343 - RNA, 14 nt, Mycobacterium bovis subsp bovis AF2122/97
gcucuccggugauc

SEQ ID NO: 1148344 - RNA, 19 nt, Mycobacterium bovis subsp bovis AF2122/97
gcucuccggugaucaccga

SEQ ID NO: 1148345 - RNA, 20 nt, Mycobacterium bovis subsp bovis AF2122/97
gcucuccauggccgauuccg

SEQ ID NO: 1148346 - RNA, 15 nt, Mycobacterium bovis subsp bovis AF2122/97
gcucuacucgcggcc

SEQ ID NO: 1148347 - RNA, 22 nt, Mycobacterium bovis subsp bovis AF2122/97
gcucuacucgcggccggcgucg

SEQ ID NO: 1148348 - RNA, 20 nt, Mycobacterium bovis subsp bovis AF2122/97
gcucuaucgggaagccgccg

SEQ ID NO: 1148349 - RNA, 16 nt, Mycobacterium bovis subsp bovis AF2122/97
gcucguuugcgagcag

SEQ ID NO: 1148350 - RNA, 20 nt, Mycobacterium bovis subsp bovis AF2122/97
gcucguugcuggcggccagc

SEQ ID NO: 1148351 - RNA, 18 nt, Mycobacterium bovis subsp bovis AF2122/97
gcucguugguucagcucg

SEQ ID NO: 1148352 - RNA, 13 nt, Mycobacterium bovis subsp bovis AF2122/97
gcugcgcggugcc

SEQ ID NO: 1148353 - RNA, 17 nt, Mycobacterium bovis subsp bovis AF2122/97
gcugcgggucucgccga

SEQ ID NO: 1148354 - RNA, 24 nt, Mycobacterium bovis subsp bovis AF2122/97
gcugcgggucgcguuucgcagccg

SEQ ID NO: 1148355 - RNA, 13 nt, Mycobacterium bovis subsp bovis AF2122/97
gcugcgggucucg

SEQ ID NO: 1148356 - RNA, 14 nt, Mycobacterium bovis subsp bovis AF2122/97
gcugcggguagccg

SEQ ID NO: 1148357 - RNA, 23 nt, Mycobacterium bovis subsp bovis AF2122/97
gcugcggguagccgucgaucccg

SEQ ID NO: 1148358 - RNA, 22 nt, Mycobacterium bovis subsp bovis AF2122/97
gcugcggggcgauccccagcac

SEQ ID NO: 1148359 - RNA, 23 nt, Mycobacterium bovis subsp bovis AF2122/97
gcugcggggcgauccccagcacc

SEQ ID NO: 1148360 - RNA, 16 nt, Mycobacterium bovis subsp bovis AF2122/97
gcugcgggguaaggcu

SEQ ID NO: 1148361 - RNA, 15 nt, Mycobacterium bovis subsp bovis AF2122/97
gcugcgcgcccaccg

SEQ ID NO: 1148362 - RNA, 20 nt, Mycobacterium bovis subsp bovis AF2122/97
gcugcgcgcccaccgggcgg

SEQ ID NO: 1148363 - RNA, 13 nt, Mycobacterium bovis subsp bovis AF2122/97
gcugcgcgcggcg

SEQ ID NO: 1148364 - RNA, 14 nt, Mycobacterium bovis subsp bovis AF2122/97
gcugcgcgcucggc

SEQ ID NO: 1148365 - RNA, 17 nt, Mycobacterium bovis subsp bovis AF2122/97
gcugcgcgaagccacca

SEQ ID NO: 1148366 - RNA, 14 nt, Mycobacterium bovis subsp bovis AF2122/97
gcugcgcgauggcc

SEQ ID NO: 1148367 - RNA, 23 nt, Mycobacterium bovis subsp bovis AF2122/97
gcugcgcgacugauccucgauga

SEQ ID NO: 1148368 - RNA, 20 nt, Mycobacterium bovis subsp bovis AF2122/97
gcugcgcgaugucguucgcg

SEQ ID NO: 1148369 - RNA, 23 nt, Mycobacterium bovis subsp bovis AF2122/97
gcugcggguucacuuccgggcag

SEQ ID NO: 1148370 - RNA, 12 nt, Mycobacterium bovis subsp bovis AF2122/97
gcugcggugccg

SEQ ID NO: 1148371 - RNA, 19 nt, Mycobacterium bovis subsp bovis AF2122/97
gcugcgguaaucgccaccg

SEQ ID NO: 1148372 - RNA, 19 nt, Mycobacterium bovis subsp bovis AF2122/97
gcugcgggugauugagcuc

SEQ ID NO: 1148373 - RNA, 19 nt, Mycobacterium bovis subsp bovis AF2122/97
gcugcguggcgaaccaggg

SEQ ID NO: 1148374 - RNA, 22 nt, Mycobacterium bovis subsp bovis AF2122/97
gcugcguggcgggcugcagccg

SEQ ID NO: 1148375 - RNA, 20 nt, Mycobacterium bovis subsp bovis AF2122/97
gcugcgucgucugcagaccu

SEQ ID NO: 1148376 - RNA, 14 nt, Mycobacterium bovis subsp bovis AF2122/97
gcugccgccgccgc

SEQ ID NO: 1148377 - RNA, 16 nt, Mycobacterium bovis subsp bovis AF2122/97
gcugccgccgccgccg

SEQ ID NO: 1148378 - RNA, 16 nt, Mycobacterium bovis subsp bovis AF2122/97
gcugccgcccaugccg

SEQ ID NO: 1148379 - RNA, 16 nt, Mycobacterium bovis subsp bovis AF2122/97
gcugccgcccuugccg

SEQ ID NO: 1148380 - RNA, 20 nt, Mycobacterium bovis subsp bovis AF2122/97
gcugccgccgagcuggcgcg

SEQ ID NO: 1148381 - RNA, 19 nt, Mycobacterium bovis subsp bovis AF2122/97
gcugccgccgaucgacacc

SEQ ID NO: 1148382 - RNA, 21 nt, Mycobacterium bovis subsp bovis AF2122/97
gcugccgccgaucgacacccg

SEQ ID NO: 1148383 - RNA, 12 nt, Mycobacterium bovis subsp bovis AF2122/97
gcugccgccggu

SEQ ID NO: 1148384 - RNA, 11 nt, Mycobacterium bovis subsp bovis AF2122/97
gcugccgccgu

SEQ ID NO: 1148385 - RNA, 16 nt, Mycobacterium bovis subsp bovis AF2122/97
gcugccgccgucgccg

SEQ ID NO: 1148386 - RNA, 17 nt, Mycobacterium bovis subsp bovis AF2122/97
gcugccgccgucgccgc

SEQ ID NO: 1148387 - RNA, 19 nt, Mycobacterium bovis subsp bovis AF2122/97
gcugccgccgucgccgccg

SEQ ID NO: 1148388 - RNA, 22 nt, Mycobacterium bovis subsp bovis AF2122/97
gcugccgcaaacgcggcgucga

SEQ ID NO: 1148389 - RNA, 14 nt, Mycobacterium bovis subsp bovis AF2122/97
gcugccgcacacgc

SEQ ID NO: 1148390 - RNA, 21 nt, Mycobacterium bovis subsp bovis AF2122/97
gcugccgcacacgcgugcacc

SEQ ID NO: 1148391 - RNA, 16 nt, Mycobacterium bovis subsp bovis AF2122/97
gcugccgcagcucagc

SEQ ID NO: 1148392 - RNA, 19 nt, Mycobacterium bovis subsp bovis AF2122/97
gcugccgcaugcgcuccgg

SEQ ID NO: 1148393 - RNA, 21 nt, Mycobacterium bovis subsp bovis AF2122/97
gcugccgcaugcgcuccggcg

SEQ ID NO: 1148394 - RNA, 22 nt, Mycobacterium bovis subsp bovis AF2122/97
gcugccgcaugcgcuccggcgc

SEQ ID NO: 1148395 - RNA, 18 nt, Mycobacterium bovis subsp bovis AF2122/97
gcugccgcaucggcaagg

SEQ ID NO: 1148396 - RNA, 14 nt, Mycobacterium bovis subsp bovis AF2122/97
gcugccgccaggcu

SEQ ID NO: 1148397 - RNA, 15 nt, Mycobacterium bovis subsp bovis AF2122/97
gcugccgccaggcuc

SEQ ID NO: 1148398 - RNA, 19 nt, Mycobacterium bovis subsp bovis AF2122/97
gcugccgccaggcucgagg

SEQ ID NO: 1148399 - RNA, 21 nt, Mycobacterium bovis subsp bovis AF2122/97
gcugccgccgccggcggucgc

SEQ ID NO: 1148400 - RNA, 19 nt, Mycobacterium bovis subsp bovis AF2122/97
gcugccgcggccggcgugc

SEQ ID NO: 1148401 - RNA, 17 nt, Mycobacterium bovis subsp bovis AF2122/97
gcugccgcgcgcugccg

SEQ ID NO: 1148402 - RNA, 17 nt, Mycobacterium bovis subsp bovis AF2122/97
gcugccgcgcggcgaga

SEQ ID NO: 1148403 - RNA, 18 nt, Mycobacterium bovis subsp bovis AF2122/97
gcugccgcugcgcguacu

SEQ ID NO: 1148404 - RNA, 22 nt, Mycobacterium bovis subsp bovis AF2122/97
gcugccgcucgaccccgcgcug

SEQ ID NO: 1148405 - RNA, 21 nt, Mycobacterium bovis subsp bovis AF2122/97
gcugccgccuuggucgcgucg

SEQ ID NO: 1148406 - RNA, 17 nt, Mycobacterium bovis subsp bovis AF2122/97
gcugccggagacacccg

SEQ ID NO: 1148407 - RNA, 21 nt, Mycobacterium bovis subsp bovis AF2122/97
gcugccggcaacagcucgccu

SEQ ID NO: 1148408 - RNA, 13 nt, Mycobacterium bovis subsp bovis AF2122/97
gcugccggccaga

SEQ ID NO: 1148409 - RNA, 18 nt, Mycobacterium bovis subsp bovis AF2122/97
gcugccggccagacggug

SEQ ID NO: 1148410 - RNA, 16 nt, Mycobacterium bovis subsp bovis AF2122/97
gcugccggcaccaacc

SEQ ID NO: 1148411 - RNA, 14 nt, Mycobacterium bovis subsp bovis AF2122/97
gcugcgccagguca

SEQ ID NO: 1148412 - RNA, 15 nt, Mycobacterium bovis subsp bovis AF2122/97
gcugccggcugacga

SEQ ID NO: 1148413 - RNA, 20 nt, Mycobacterium bovis subsp bovis AF2122/97
gcugccggcugacgaccaac

SEQ ID NO: 1148414 - RNA, 21 nt, Mycobacterium bovis subsp bovis AF2122/97
gcugcgccgauacccagcggg

SEQ ID NO: 1148415 - RNA, 14 nt, Mycobacterium bovis subsp bovis AF2122/97
gcugcgccgauacg

SEQ ID NO: 1148416 - RNA, 20 nt, Mycobacterium bovis subsp bovis AF2122/97
gcugcgccgucgcagccagc

SEQ ID NO: 1148417 - RNA, 12 nt, Mycobacterium bovis subsp bovis AF2122/97
gcugcgccgagg

SEQ ID NO: 1148418 - RNA, 14 nt, Mycobacterium bovis subsp bovis AF2122/97
gcugcgccgaggca

SEQ ID NO: 1148419 - RNA, 16 nt, Mycobacterium bovis subsp bovis AF2122/97
gcugcccaucccggcc

SEQ ID NO: 1148420 - RNA, 21 nt, Mycobacterium bovis subsp bovis AF2122/97
gcugcccaugcggcaggugcc

SEQ ID NO: 1148421 - RNA, 17 nt, Mycobacterium bovis subsp bovis AF2122/97
gcugcccaugguggcga

SEQ ID NO: 1148422 - RNA, 18 nt, Mycobacterium bovis subsp bovis AF2122/97
gcugcccaucggugaucg

SEQ ID NO: 1148423 - RNA, 17 nt, Mycobacterium bovis subsp bovis AF2122/97
gcugcccaucacacccg

SEQ ID NO: 1148424 - RNA, 12 nt, Mycobacterium bovis subsp bovis AF2122/97
gcugccgaccuu

SEQ ID NO: 1148425 - RNA, 23 nt, Mycobacterium bovis subsp bovis AF2122/97
gcugccgaacagcgaaccgccgg

SEQ ID NO: 1148426 - RNA, 13 nt, Mycobacterium bovis subsp bovis AF2122/97
gcugccgcaccgg

SEQ ID NO: 1148427 - RNA, 15 nt, Mycobacterium bovis subsp bovis AF2122/97
gcugccgcaccggug

SEQ ID NO: 1148428 - RNA, 16 nt, Mycobacterium bovis subsp bovis AF2122/97
gcugccgcaccggugc

SEQ ID NO: 1148429 - RNA, 20 nt, Mycobacterium bovis subsp bovis AF2122/97
gcugccgauagcgcggcacc

SEQ ID NO: 1148430 - RNA, 20 nt, Mycobacterium bovis subsp bovis AF2122/97
gcugccgaucaauggcaacg

SEQ ID NO: 1148431 - RNA, 22 nt, Mycobacterium bovis subsp bovis AF2122/97
gcugccgaagcggccaccgccg

SEQ ID NO: 1148432 - RNA, 17 nt, Mycobacterium bovis subsp bovis AF2122/97
gcugcccaaccggucaa

SEQ ID NO: 1148433 - RNA, 15 nt, Mycobacterium bovis subsp bovis AF2122/97
gcugcccaacggaag

SEQ ID NO: 1148434 - RNA, 21 nt, Mycobacterium bovis subsp bovis AF2122/97
gcugcccaacggaagaccgcg

SEQ ID NO: 1148435 - RNA, 12 nt, Mycobacterium bovis subsp bovis AF2122/97
gcugcccaaaag

SEQ ID NO: 1148436 - RNA, 19 nt, Mycobacterium bovis subsp bovis AF2122/97
gcugcccaaaagcgcggca

SEQ ID NO: 1148437 - RNA, 17 nt, Mycobacterium bovis subsp bovis AF2122/97
gcugccacaggugaccu

SEQ ID NO: 1148438 - RNA, 20 nt, Mycobacterium bovis subsp bovis AF2122/97
gcugccaccagggccgcagu

SEQ ID NO: 1148439 - RNA, 16 nt, Mycobacterium bovis subsp bovis AF2122/97
gcugccaccgcggugg

SEQ ID NO: 1148440 - RNA, 18 nt, Mycobacterium bovis subsp bovis AF2122/97
gcugcagcgagaccucuc

SEQ ID NO: 1148441 - RNA, 14 nt, Mycobacterium bovis subsp bovis AF2122/97
gcugcagcauggcu

SEQ ID NO: 1148442 - RNA, 14 nt, Mycobacterium bovis subsp bovis AF2122/97
gcugcagcaccgca

SEQ ID NO: 1148443 - RNA, 19 nt, Mycobacterium bovis subsp bovis AF2122/97
gcugcagcaccgcagcgac

SEQ ID NO: 1148444 - RNA, 14 nt, Mycobacterium bovis subsp bovis AF2122/97
gcugcagcagggcu

SEQ ID NO: 1148445 - RNA, 14 nt, Mycobacterium bovis subsp bovis AF2122/97
gcugcagcacggcu

SEQ ID NO: 1148446 - RNA, 12 nt, Mycobacterium bovis subsp bovis AF2122/97
gcugcagaggcg

SEQ ID NO: 1148447 - RNA, 18 nt, Mycobacterium bovis subsp bovis AF2122/97
gcugcagacccguucgcc

SEQ ID NO: 1148448 - RNA, 17 nt, Mycobacterium bovis subsp bovis AF2122/97
gcugcaacggagcgagc

SEQ ID NO: 1148449 - RNA, 19 nt, Mycobacterium bovis subsp bovis AF2122/97
gcugaugaaacgccgucgc

SEQ ID NO: 1148450 - RNA, 18 nt, Mycobacterium bovis subsp bovis AF2122/97
gcugcaaccagcggcaca

SEQ ID NO: 1148451 - RNA, 18 nt, Mycobacterium bovis subsp bovis AF2122/97
gcugcucggucaggcggc

SEQ ID NO: 1148452 - RNA, 18 nt, Mycobacterium bovis subsp bovis AF2122/97
gcugcucgucggcgccgg

SEQ ID NO: 1148453 - RNA, 19 nt, Mycobacterium bovis subsp bovis AF2122/97
gcugcucgucgugagacug

SEQ ID NO: 1148454 - RNA, 20 nt, Mycobacterium bovis subsp bovis AF2122/97
gcugcucgucuuggcggcgg

SEQ ID NO: 1148455 - RNA, 22 nt, Mycobacterium bovis subsp bovis AF2122/97
gcugcucugagcuuggucgccg

SEQ ID NO: 1148456 - RNA, 21 nt, Mycobacterium bovis subsp bovis AF2122/97
gcugcucuccgucgcgcacgg

SEQ ID NO: 1148457 - RNA, 16 nt, Mycobacterium bovis subsp bovis AF2122/97
gcugcuccgucgccga

SEQ ID NO: 1148458 - RNA, 23 nt, Mycobacterium bovis subsp bovis AF2122/97
gcugcucccgaaaagcgccucgg

SEQ ID NO: 1148459 - RNA, 13 nt, Mycobacterium bovis subsp bovis AF2122/97
gcugcuccucgcg

SEQ ID NO: 1148460 - RNA, 16 nt, Mycobacterium bovis subsp bovis AF2122/97
gcugcuccucgcggua

SEQ ID NO: 1148461 - RNA, 22 nt, Mycobacterium bovis subsp bovis AF2122/97
gcugcuccuggaaguacacggc

SEQ ID NO: 1148462 - RNA, 16 nt, Mycobacterium bovis subsp bovis AF2122/97
gcugcucagcaacggc

SEQ ID NO: 1148463 - RNA, 17 nt, Mycobacterium bovis subsp bovis AF2122/97
gcugcucaucgcgcccg

SEQ ID NO: 1148464 - RNA, 18 nt, Mycobacterium bovis subsp bovis AF2122/97
gcugcucaucgcgcccgc

SEQ ID NO: 1148465 - RNA, 16 nt, Mycobacterium bovis subsp bovis AF2122/97
gcuggcgugcagcagg

SEQ ID NO: 1148466 - RNA, 23 nt, Mycobacterium bovis subsp bovis AF2122/97
gcuggcguugcugaugucgccgg

SEQ ID NO: 1148467 - RNA, 19 nt, Mycobacterium bovis subsp bovis AF2122/97
gcuggcguucccgcucggc

SEQ ID NO: 1148468 - RNA, 15 nt, Mycobacterium bovis subsp bovis AF2122/97
gcuggcgucaccgcg

SEQ ID NO: 1148469 - RNA, 17 nt, Mycobacterium bovis subsp bovis AF2122/97
gcugcucugcgaccucg

SEQ ID NO: 1148470 - RNA, 14 nt, Mycobacterium bovis subsp bovis AF2122/97
gcugcugaacaccg

SEQ ID NO: 1148471 - RNA, 14 nt, Mycobacterium bovis subsp bovis AF2122/97
gcuggcggccucgc

SEQ ID NO: 1148472 - RNA, 22 nt, Mycobacterium bovis subsp bovis AF2122/97
gcuggcggccucgccggcgcgc

SEQ ID NO: 1148473 - RNA, 13 nt, Mycobacterium bovis subsp bovis AF2122/97
gcuggcggcgugc

SEQ ID NO: 1148474 - RNA, 16 nt, Mycobacterium bovis subsp bovis AF2122/97
gcuggcgggcggcgug

SEQ ID NO: 1148475 - RNA, 21 nt, Mycobacterium bovis subsp bovis AF2122/97
gcugggauguucgaucagcga

SEQ ID NO: 1148476 - RNA, 13 nt, Mycobacterium bovis subsp bovis AF2122/97
gcugggcaccccg

SEQ ID NO: 1148477 - RNA, 19 nt, Mycobacterium bovis subsp bovis AF2122/97
gcugggcagaccgaucggc

SEQ ID NO: 1148478 - RNA, 20 nt, Mycobacterium bovis subsp bovis AF2122/97
gcugggcagaccgaucggca

SEQ ID NO: 1148479 - RNA, 15 nt, Mycobacterium bovis subsp bovis AF2122/97
gcugggcaucaccga

SEQ ID NO: 1148480 - RNA, 18 nt, Mycobacterium bovis subsp bovis AF2122/97
gcugggcaucaccgacgc

SEQ ID NO: 1148481 - RNA, 13 nt, Mycobacterium bovis subsp bovis AF2122/97
gcugggaggcgcg

SEQ ID NO: 1148482 - RNA, 19 nt, Mycobacterium bovis subsp bovis AF2122/97
gcugggacggucgcucggc

SEQ ID NO: 1148483 - RNA, 18 nt, Mycobacterium bovis subsp bovis AF2122/97
gcuggcuugggccagcgc

SEQ ID NO: 1148484 - RNA, 11 nt, Mycobacterium bovis subsp bovis AF2122/97
gcuggcugcgg

SEQ ID NO: 1148485 - RNA, 14 nt, Mycobacterium bovis subsp bovis AF2122/97
gcuggcugacaccg

SEQ ID NO: 1148486 - RNA, 21 nt, Mycobacterium bovis subsp bovis AF2122/97
gcuggcucaccgacaugacgc

SEQ ID NO: 1148487 - RNA, 22 nt, Mycobacterium bovis subsp bovis AF2122/97
gcuggcucaucgaagcuucggc

SEQ ID NO: 1148488 - RNA, 20 nt, Mycobacterium bovis subsp bovis AF2122/97
gcugggcgccaugcgccaac

SEQ ID NO: 1148489 - RNA, 17 nt, Mycobacterium bovis subsp bovis AF2122/97
gcugggcgccgcgcucg

SEQ ID NO: 1148490 - RNA, 12 nt, Mycobacterium bovis subsp bovis AF2122/97
gcugggcgcgcu

SEQ ID NO: 1148491 - RNA, 14 nt, Mycobacterium bovis subsp bovis AF2122/97
gcugggcgcgcuca

SEQ ID NO: 1148492 - RNA, 17 nt, Mycobacterium bovis subsp bovis AF2122/97
gcugggcgcgcucaucg

SEQ ID NO: 1148493 - RNA, 15 nt, Mycobacterium bovis subsp bovis AF2122/97
gcugggccgaccgcc

SEQ ID NO: 1148494 - RNA, 21 nt, Mycobacterium bovis subsp bovis AF2122/97
gcugggccgacgggacaaccc

SEQ ID NO: 1148495 - RNA, 21 nt, Mycobacterium bovis subsp bovis AF2122/97
gcugggccgcaucggauggcc

SEQ ID NO: 1148496 - RNA, 20 nt, Mycobacterium bovis subsp bovis AF2122/97
gcugggcccgccagcccagc

SEQ ID NO: 1148497 - RNA, 17 nt, Mycobacterium bovis subsp bovis AF2122/97
gcugggcaucaccgccg

SEQ ID NO: 1148498 - RNA, 20 nt, Mycobacterium bovis subsp bovis AF2122/97
gcugggcaucaccgccgcgg

SEQ ID NO: 1148499 - RNA, 21 nt, Mycobacterium bovis subsp bovis AF2122/97
gcugggcaucaccgccgcggc

SEQ ID NO: 1148500 - RNA, 22 nt, Mycobacterium bovis subsp bovis AF2122/97
gcugggauguucgaucagcgac

SEQ ID NO: 1148501 - RNA, 15 nt, Mycobacterium bovis subsp bovis AF2122/97
gcugguggcggcgac

SEQ ID NO: 1148502 - RNA, 20 nt, Mycobacterium bovis subsp bovis AF2122/97
gcugguggcggcgacacgcc

SEQ ID NO: 1148503 - RNA, 12 nt, Mycobacterium bovis subsp bovis AF2122/97
gcugguggcggu

SEQ ID NO: 1148504 - RNA, 16 nt, Mycobacterium bovis subsp bovis AF2122/97
gcugguggcggucacc

SEQ ID NO: 1148505 - RNA, 17 nt, Mycobacterium bovis subsp bovis AF2122/97
gcuggugggacgcggcc

SEQ ID NO: 1148506 - RNA, 19 nt, Mycobacterium bovis subsp bovis AF2122/97
gcuggugggacgcggccga

SEQ ID NO: 1148507 - RNA, 22 nt, Mycobacterium bovis subsp bovis AF2122/97
gcuggugggaucgcagcgccau

SEQ ID NO: 1148508 - RNA, 16 nt, Mycobacterium bovis subsp bovis AF2122/97
gcugguggugcgugga

SEQ ID NO: 1148509 - RNA, 23 nt, Mycobacterium bovis subsp bovis AF2122/97
gcuggugggggagcggccgccgc

SEQ ID NO: 1148510 - RNA, 13 nt, Mycobacterium bovis subsp bovis AF2122/97
gcuggugguaucg

SEQ ID NO: 1148511 - RNA, 14 nt, Mycobacterium bovis subsp bovis AF2122/97
gcugguguccagcc

SEQ ID NO: 1148512 - RNA, 15 nt, Mycobacterium bovis subsp bovis AF2122/97
gcugguguccagcca

SEQ ID NO: 1148513 - RNA, 16 nt, Mycobacterium bovis subsp bovis AF2122/97
gcuggugucggcucga

SEQ ID NO: 1148514 - RNA, 14 nt, Mycobacterium bovis subsp bovis AF2122/97
gcugguugaccgag

SEQ ID NO: 1148515 - RNA, 21 nt, Mycobacterium bovis subsp bovis AF2122/97
gcugguugaacauguccagug

SEQ ID NO: 1148516 - RNA, 23 nt, Mycobacterium bovis subsp bovis AF2122/97
gcugguugccuuugcggcgggca

SEQ ID NO: 1148517 - RNA, 15 nt, Mycobacterium bovis subsp bovis AF2122/97
gcugguuggcacgca

SEQ ID NO: 1148518 - RNA, 16 nt, Mycobacterium bovis subsp bovis AF2122/97
gcugguuucggccgca

SEQ ID NO: 1148519 - RNA, 16 nt, Mycobacterium bovis subsp bovis AF2122/97
gcugguuucggggacc

SEQ ID NO: 1148520 - RNA, 18 nt, Mycobacterium bovis subsp bovis AF2122/97
gcuggugcgggacgccga

SEQ ID NO: 1148521 - RNA, 22 nt, Mycobacterium bovis subsp bovis AF2122/97
gcuggugcguagcccacccggg

SEQ ID NO: 1148522 - RNA, 20 nt, Mycobacterium bovis subsp bovis AF2122/97
gcuggugcgccacgccaccg

SEQ ID NO: 1148523 - RNA, 21 nt, Mycobacterium bovis subsp bovis AF2122/97
gcuggugcagaauucggcgcg

SEQ ID NO: 1148524 - RNA, 17 nt, Mycobacterium bovis subsp bovis AF2122/97
gcuggugccaacugcgc

SEQ ID NO: 1148525 - RNA, 18 nt, Mycobacterium bovis subsp bovis AF2122/97
gcuggugaucugcugggc

SEQ ID NO: 1148526 - RNA, 19 nt, Mycobacterium bovis subsp bovis AF2122/97
gcuggugauucgcagccga

SEQ ID NO: 1148527 - RNA, 14 nt, Mycobacterium bovis subsp bovis AF2122/97
gcuggucgccgcgg

SEQ ID NO: 1148528 - RNA, 15 nt, Mycobacterium bovis subsp bovis AF2122/97
gcuggucgccgcggc

SEQ ID NO: 1148529 - RNA, 18 nt, Mycobacterium bovis subsp bovis AF2122/97
gcuggucgccgcggcagc

SEQ ID NO: 1148530 - RNA, 13 nt, Mycobacterium bovis subsp bovis AF2122/97
gcuggucgccguc

SEQ ID NO: 1148531 - RNA, 16 nt, Mycobacterium bovis subsp bovis AF2122/97
gcuggucgcgguggcg

SEQ ID NO: 1148532 - RNA, 19 nt, Mycobacterium bovis subsp bovis AF2122/97
gcuggucgcgguggcggcg

SEQ ID NO: 1148533 - RNA, 18 nt, Mycobacterium bovis subsp bovis AF2122/97
gcuggucgcugcugcgau

SEQ ID NO: 1148534 - RNA, 20 nt, Mycobacterium bovis subsp bovis AF2122/97
gcuggucggcuaccgccgac

SEQ ID NO: 1148535 - RNA, 13 nt, Mycobacterium bovis subsp bovis AF2122/97
gcuggucgagcag

SEQ ID NO: 1148536 - RNA, 17 nt, Mycobacterium bovis subsp bovis AF2122/97
gcuggucuacccgcggc

SEQ ID NO: 1148537 - RNA, 18 nt, Mycobacterium bovis subsp bovis AF2122/97
gcuggucugcaggcggcc

SEQ ID NO: 1148538 - RNA, 14 nt, Mycobacterium bovis subsp bovis AF2122/97
gcuggucgugggcc

SEQ ID NO: 1148539 - RNA, 19 nt, Mycobacterium bovis subsp bovis AF2122/97
gcugggcggucggaaugcc

SEQ ID NO: 1148540 - RNA, 21 nt, Mycobacterium bovis subsp bovis AF2122/97
gcugggcugauggacggugcg

SEQ ID NO: 1148541 - RNA, 17 nt, Mycobacterium bovis subsp bovis AF2122/97
gcugggcuucgagugcg

SEQ ID NO: 1148542 - RNA, 13 nt, Mycobacterium bovis subsp bovis AF2122/97
gcuggggcuguag

SEQ ID NO: 1148543 - RNA, 21 nt, Mycobacterium bovis subsp bovis AF2122/97
gcugggggauaccgcuggguc

SEQ ID NO: 1148544 - RNA, 15 nt, Mycobacterium bovis subsp bovis AF2122/97
gcugggggucaaucg

SEQ ID NO: 1148545 - RNA, 21 nt, Mycobacterium bovis subsp bovis AF2122/97
gcuggggccccgcgccggccg

SEQ ID NO: 1148546 - RNA, 22 nt, Mycobacterium bovis subsp bovis AF2122/97
gcuggggucaaagcacucguag

SEQ ID NO: 1148547 - RNA, 18 nt, Mycobacterium bovis subsp bovis AF2122/97
gcugggguccgcgucggc

SEQ ID NO: 1148548 - RNA, 14 nt, Mycobacterium bovis subsp bovis AF2122/97
gcugggugcgcgaa

SEQ ID NO: 1148549 - RNA, 20 nt, Mycobacterium bovis subsp bovis AF2122/97
gcugggucagguugucggcg

SEQ ID NO: 1148550 - RNA, 22 nt, Mycobacterium bovis subsp bovis AF2122/97
gcuggguccccucccaccagcg

SEQ ID NO: 1148551 - RNA, 17 nt, Mycobacterium bovis subsp bovis AF2122/97
gcugggucccgcuggca

SEQ ID NO: 1148552 - RNA, 15 nt, Mycobacterium bovis subsp bovis AF2122/97
gcugggucgccguuu

SEQ ID NO: 1148553 - RNA, 15 nt, Mycobacterium bovis subsp bovis AF2122/97
gcuggucagguaucg

SEQ ID NO: 1148554 - RNA, 19 nt, Mycobacterium bovis subsp bovis AF2122/97
gcugguccuccuucggugg

SEQ ID NO: 1148555 - RNA, 18 nt, Mycobacterium bovis subsp bovis AF2122/97
gcuggggaugcgauggcc

SEQ ID NO: 1148556 - RNA, 13 nt, Mycobacterium bovis subsp bovis AF2122/97
gcugucccagccc

SEQ ID NO: 1148557 - RNA, 20 nt, Mycobacterium bovis subsp bovis AF2122/97
gcugucgauuucgccgucgc

SEQ ID NO: 1148558 - RNA, 17 nt, Mycobacterium bovis subsp bovis AF2122/97
gcugucgcaacgcaucg

SEQ ID NO: 1148559 - RNA, 23 nt, Mycobacterium bovis subsp bovis AF2122/97
gcugucgcaacgcaucgaugcgu

SEQ ID NO: 1148560 - RNA, 14 nt, Mycobacterium bovis subsp bovis AF2122/97
gcugucgaucagcg

SEQ ID NO: 1148561 - RNA, 16 nt, Mycobacterium bovis subsp bovis AF2122/97
gcugucgaucagcgac

SEQ ID NO: 1148562 - RNA, 17 nt, Mycobacterium bovis subsp bovis AF2122/97
gcugucggcaugccggu

SEQ ID NO: 1148563 - RNA, 15 nt, Mycobacterium bovis subsp bovis AF2122/97
gcugucguaccgcgg

SEQ ID NO: 1148564 - RNA, 17 nt, Mycobacterium bovis subsp bovis AF2122/97
gcugucguaccgcucgg

SEQ ID NO: 1148565 - RNA, 18 nt, Mycobacterium bovis subsp bovis AF2122/97
gcugucguaccgcucggc

SEQ ID NO: 1148566 - RNA, 14 nt, Mycobacterium bovis subsp bovis AF2122/97
gcugucggugccgu

SEQ ID NO: 1148567 - RNA, 16 nt, Mycobacterium bovis subsp bovis AF2122/97
gcugucgggcagcugg

SEQ ID NO: 1148568 - RNA, 13 nt, Mycobacterium bovis subsp bovis AF2122/97
gcugucgcgggcc

SEQ ID NO: 1148569 - RNA, 14 nt, Mycobacterium bovis subsp bovis AF2122/97
gcugugcgguaucg

SEQ ID NO: 1148570 - RNA, 20 nt, Mycobacterium bovis subsp bovis AF2122/97
gcugugcuucguugucggcg

SEQ ID NO: 1148571 - RNA, 14 nt, Mycobacterium bovis subsp bovis AF2122/97
gcugugcgcugguc

SEQ ID NO: 1148572 - RNA, 18 nt, Mycobacterium bovis subsp bovis AF2122/97
gcuguggaucgacaccga

SEQ ID NO: 1148573 - RNA, 21 nt, Mycobacterium bovis subsp bovis AF2122/97
gcuguggaucgacaccgacgc

SEQ ID NO: 1148574 - RNA, 23 nt, Mycobacterium bovis subsp bovis AF2122/97
gcuguggaucgacaccgacgcgg

SEQ ID NO: 1148575 - RNA, 15 nt, Mycobacterium bovis subsp bovis AF2122/97
gcuguggaugccgac

SEQ ID NO: 1148576 - RNA, 17 nt, Mycobacterium bovis subsp bovis AF2122/97
gcuguggaugccgacgg

SEQ ID NO: 1148577 - RNA, 18 nt, Mycobacterium bovis subsp bovis AF2122/97
gcuguggcccgcggugac

SEQ ID NO: 1148578 - RNA, 19 nt, Mycobacterium bovis subsp bovis AF2122/97
gcugugccgagaugccggc

SEQ ID NO: 1148579 - RNA, 18 nt, Mycobacterium bovis subsp bovis AF2122/97
gcugugcgcagacaucgg

SEQ ID NO: 1148580 - RNA, 18 nt, Mycobacterium bovis subsp bovis AF2122/97
gcugugaucgagucgcga

SEQ ID NO: 1148581 - RNA, 13 nt, Mycobacterium bovis subsp bovis AF2122/97
gcugugcaggcgg

SEQ ID NO: 1148582 - RNA, 18 nt, Mycobacterium bovis subsp bovis AF2122/97
gcugugaacagcgcgucg

SEQ ID NO: 1148583 - RNA, 19 nt, Mycobacterium bovis subsp bovis AF2122/97
gcugucgucuuggcgaucg

SEQ ID NO: 1148584 - RNA, 19 nt, Mycobacterium bovis subsp bovis AF2122/97
gcuguccgaccucgccgcg

SEQ ID NO: 1148585 - RNA, 14 nt, Mycobacterium bovis subsp bovis AF2122/97
gcuguccgacuugu

SEQ ID NO: 1148586 - RNA, 16 nt, Mycobacterium bovis subsp bovis AF2122/97
gcuguccccgccgagg

SEQ ID NO: 1148587 - RNA, 23 nt, Mycobacterium bovis subsp bovis AF2122/97
gcugucgaaauaaaccgcgaucg

SEQ ID NO: 1148588 - RNA, 15 nt, Mycobacterium bovis subsp bovis AF2122/97
gcugucgaaguggua

SEQ ID NO: 1148589 - RNA, 19 nt, Mycobacterium bovis subsp bovis AF2122/97
gcuguccacugccaccgcg

SEQ ID NO: 1148590 - RNA, 21 nt, Mycobacterium bovis subsp bovis AF2122/97
gcuguccacugccaccgcgag

SEQ ID NO: 1148591 - RNA, 11 nt, Mycobacterium bovis subsp bovis AF2122/97
gcuguccaccg

SEQ ID NO: 1148592 - RNA, 18 nt, Mycobacterium bovis subsp bovis AF2122/97
gcugucauccccggccag

SEQ ID NO: 1148593 - RNA, 19 nt, Mycobacterium bovis subsp bovis AF2122/97
gcugucaguucccgcuuga

SEQ ID NO: 1148594 - RNA, 19 nt, Mycobacterium bovis subsp bovis AF2122/97
gcuguaggucagcgcgucg

SEQ ID NO: 1148595 - RNA, 19 nt, Mycobacterium bovis subsp bovis AF2122/97
gcuguacucgcggcgcggc

SEQ ID NO: 1148596 - RNA, 20 nt, Mycobacterium bovis subsp bovis AF2122/97
gcuguacucgcggcgcggcc

SEQ ID NO: 1148597 - RNA, 22 nt, Mycobacterium bovis subsp bovis AF2122/97
gcuguacauacucugcgacacc

SEQ ID NO: 1148598 - RNA, 19 nt, Mycobacterium bovis subsp bovis AF2122/97
gcuguaacacccggccgcc

SEQ ID NO: 1148599 - RNA, 21 nt, Mycobacterium bovis subsp bovis AF2122/97
gcuguaacacccggccgccga

SEQ ID NO: 1148600 - RNA, 22 nt, Mycobacterium bovis subsp bovis AF2122/97
gcuguaagcaugccguugcgau

SEQ ID NO: 1148601 - RNA, 20 nt, Mycobacterium bovis subsp bovis AF2122/97
gcuguugaagccgcccgagu

SEQ ID NO: 1148602 - RNA, 21 nt, Mycobacterium bovis subsp bovis AF2122/97
gcuguucggccauggcggcgc

SEQ ID NO: 1148603 - RNA, 19 nt, Mycobacterium bovis subsp bovis AF2122/97
gcuguucgagccgcguucg

SEQ ID NO: 1148604 - RNA, 18 nt, Mycobacterium bovis subsp bovis AF2122/97
gcugugguaggccggugc

SEQ ID NO: 1148605 - RNA, 13 nt, Mycobacterium bovis subsp bovis AF2122/97
gcugugucguacc

SEQ ID NO: 1148606 - RNA, 16 nt, Mycobacterium bovis subsp bovis AF2122/97
gcuguguugcacccga

SEQ ID NO: 1148607 - RNA, 18 nt, Mycobacterium bovis subsp bovis AF2122/97
gcuguugcaucgccgcga

SEQ ID NO: 1148608 - RNA, 15 nt, Mycobacterium bovis subsp bovis AF2122/97
gcuguugcgcggucg

SEQ ID NO: 1148609 - RNA, 20 nt, Mycobacterium bovis subsp bovis AF2122/97
gcuguugcggggugcucagc

SEQ ID NO: 1148610 - RNA, 23 nt, Mycobacterium bovis subsp bovis AF2122/97
gcuguuguacggcccaaacggcg

SEQ ID NO: 1148611 - RNA, 15 nt, Mycobacterium bovis subsp bovis AF2122/97
gcuguuggccagccg

SEQ ID NO: 1148612 - RNA, 14 nt, Mycobacterium bovis subsp bovis AF2122/97
gcuuacuugaucuc

SEQ ID NO: 1148613 - RNA, 19 nt, Mycobacterium bovis subsp bovis AF2122/97
gcuuacuugaucucggcga

SEQ ID NO: 1148614 - RNA, 20 nt, Mycobacterium bovis subsp bovis AF2122/97
gcuuacuugaucucggcgag

SEQ ID NO: 1148615 - RNA, 22 nt, Mycobacterium bovis subsp bovis AF2122/97
gcuuacuuaaccaggcgagccg

SEQ ID NO: 1148616 - RNA, 22 nt, Mycobacterium bovis subsp bovis AF2122/97
gcuuacgggugucgggcgcgcu

SEQ ID NO: 1148617 - RNA, 16 nt, Mycobacterium bovis subsp bovis AF2122/97
gcuuagcggcuuggcc

SEQ ID NO: 1148618 - RNA, 19 nt, Mycobacterium bovis subsp bovis AF2122/97
gcuuagggcgcccgccccg

SEQ ID NO: 1148619 - RNA, 21 nt, Mycobacterium bovis subsp bovis AF2122/97
gcuucacgggccguccaggac

SEQ ID NO: 1148620 - RNA, 19 nt, Mycobacterium bovis subsp bovis AF2122/97
gcuucacagccaccagccg

SEQ ID NO: 1148621 - RNA, 20 nt, Mycobacterium bovis subsp bovis AF2122/97
gcuuaugcgucugcucgccc

SEQ ID NO: 1148622 - RNA, 17 nt, Mycobacterium bovis subsp bovis AF2122/97
gcuuauguguccgcucg

SEQ ID NO: 1148623 - RNA, 13 nt, Mycobacterium bovis subsp bovis AF2122/97
gcuucaacaccgg

SEQ ID NO: 1148624 - RNA, 19 nt, Mycobacterium bovis subsp bovis AF2122/97
gcuuggugaaccgcgcggc

SEQ ID NO: 1148625 - RNA, 17 nt, Mycobacterium bovis subsp bovis AF2122/97
gcuuggucgccgggcag

SEQ ID NO: 1148626 - RNA, 18 nt, Mycobacterium bovis subsp bovis AF2122/97
gcuuguagcgcaucgcca

SEQ ID NO: 1148627 - RNA, 15 nt, Mycobacterium bovis subsp bovis AF2122/97
gcuugucgaccacga

SEQ ID NO: 1148628 - RNA, 21 nt, Mycobacterium bovis subsp bovis AF2122/97
gcuuguccggugguggcgacc

SEQ ID NO: 1148629 - RNA, 16 nt, Mycobacterium bovis subsp bovis AF2122/97
gcuuguccaccgugcg

SEQ ID NO: 1148630 - RNA, 17 nt, Mycobacterium bovis subsp bovis AF2122/97
gcuuguccaccgugcgg

SEQ ID NO: 1148631 - RNA, 13 nt, Mycobacterium bovis subsp bovis AF2122/97
gcuugucgcggug

SEQ ID NO: 1148632 - RNA, 17 nt, Mycobacterium bovis subsp bovis AF2122/97
gcuugguguggcccaac

SEQ ID NO: 1148633 - RNA, 13 nt, Mycobacterium bovis subsp bovis AF2122/97
gcuugucgccgcg

SEQ ID NO: 1148634 - RNA, 14 nt, Mycobacterium bovis subsp bovis AF2122/97
gcuugucgccggca

SEQ ID NO: 1148635 - RNA, 17 nt, Mycobacterium bovis subsp bovis AF2122/97
gcuuguuuuccaccagc

SEQ ID NO: 1148636 - RNA, 17 nt, Mycobacterium bovis subsp bovis AF2122/97
gcuugugggccggugug

SEQ ID NO: 1148637 - RNA, 14 nt, Mycobacterium bovis subsp bovis AF2122/97
gcuuguugcagcgg

SEQ ID NO: 1148638 - RNA, 20 nt, Mycobacterium bovis subsp bovis AF2122/97
gcuuguugcgcgacgccgcg

SEQ ID NO: 1148639 - RNA, 15 nt, Mycobacterium bovis subsp bovis AF2122/97
gcuuuccggcggugg

SEQ ID NO: 1148640 - RNA, 16 nt, Mycobacterium bovis subsp bovis AF2122/97
gcuuuccggcgguggu

SEQ ID NO: 1148641 - RNA, 14 nt, Mycobacterium bovis subsp bovis AF2122/97
gcuuucagcaccgg

SEQ ID NO: 1148642 - RNA, 22 nt, Mycobacterium bovis subsp bovis AF2122/97
gcuuuaaccgcgucaucaccgg

SEQ ID NO: 1148643 - RNA, 18 nt, Mycobacterium bovis subsp bovis AF2122/97
gcuuuagugucugcucgc

SEQ ID NO: 1148644 - RNA, 23 nt, Mycobacterium bovis subsp bovis AF2122/97
gcuuggccacuugcucggugagc

SEQ ID NO: 1148645 - RNA, 17 nt, Mycobacterium bovis subsp bovis AF2122/97
gcuuggcauugaccacc

SEQ ID NO: 1148646 - RNA, 18 nt, Mycobacterium bovis subsp bovis AF2122/97
gcuuggcauugaccaccg

SEQ ID NO: 1148647 - RNA, 21 nt, Mycobacterium bovis subsp bovis AF2122/97
gcuuggcaaucaucucccgac

SEQ ID NO: 1148648 - RNA, 20 nt, Mycobacterium bovis subsp bovis AF2122/97
gcuuggacccugcgccgcca

SEQ ID NO: 1148649 - RNA, 15 nt, Mycobacterium bovis subsp bovis AF2122/97
gcuuggagaucgccg

SEQ ID NO: 1148650 - RNA, 16 nt, Mycobacterium bovis subsp bovis AF2122/97
gcuuggagaucgccgc

SEQ ID NO: 1148651 - RNA, 19 nt, Mycobacterium bovis subsp bovis AF2122/97
gcuuggagaucgccgccgg

SEQ ID NO: 1148652 - RNA, 21 nt, Mycobacterium bovis subsp bovis AF2122/97
gcuuggagaucgccgccggcg

SEQ ID NO: 1148653 - RNA, 21 nt, Mycobacterium bovis subsp bovis AF2122/97
gcuugcggcacccagucggcg

SEQ ID NO: 1148654 - RNA, 22 nt, Mycobacterium bovis subsp bovis AF2122/97
gcuugcggggccgggcgaucgc

SEQ ID NO: 1148655 - RNA, 19 nt, Mycobacterium bovis subsp bovis AF2122/97
gcuuggccguaggcggcga

SEQ ID NO: 1148656 - RNA, 21 nt, Mycobacterium bovis subsp bovis AF2122/97
gcuuggccguaggcggcgacc

SEQ ID NO: 1148657 - RNA, 18 nt, Mycobacterium bovis subsp bovis AF2122/97
gcuuggccucagccaccg

SEQ ID NO: 1148658 - RNA, 22 nt, Mycobacterium bovis subsp bovis AF2122/97
gcuuggccucagccaccgggcg

SEQ ID NO: 1148659 - RNA, 14 nt, Mycobacterium bovis subsp bovis AF2122/97
gcuuggccgggagu

SEQ ID NO: 1148660 - RNA, 16 nt, Mycobacterium bovis subsp bovis AF2122/97
gcuuggccgcgcaggc

SEQ ID NO: 1148661 - RNA, 17 nt, Mycobacterium bovis subsp bovis AF2122/97
gcuuggccgcgcaggcu

SEQ ID NO: 1148662 - RNA, 16 nt, Mycobacterium bovis subsp bovis AF2122/97
gcuuggcgagccacgg

SEQ ID NO: 1148663 - RNA, 16 nt, Mycobacterium bovis subsp bovis AF2122/97
gcuuggcgucgacguc

SEQ ID NO: 1148664 - RNA, 19 nt, Mycobacterium bovis subsp bovis AF2122/97
gcuuggcgccgaugccggc

SEQ ID NO: 1148665 - RNA, 16 nt, Mycobacterium bovis subsp bovis AF2122/97
gcuuggcagcggugua

SEQ ID NO: 1148666 - RNA, 14 nt, Mycobacterium bovis subsp bovis AF2122/97
gcuuggcgggaccg

SEQ ID NO: 1148667 - RNA, 11 nt, Mycobacterium bovis subsp bovis AF2122/97
gcuuggcgccg

SEQ ID NO: 1148668 - RNA, 13 nt, Mycobacterium bovis subsp bovis AF2122/97
gcuuggcgccgau

SEQ ID NO: 1148669 - RNA, 14 nt, Mycobacterium bovis subsp bovis AF2122/97
gcuuggcgccgaug

SEQ ID NO: 1148670 - RNA, 22 nt, Mycobacterium bovis subsp bovis AF2122/97
gcuuggggccggaugucgacga

SEQ ID NO: 1148671 - RNA, 15 nt, Mycobacterium bovis subsp bovis AF2122/97
gcuuggcuuggccgu

SEQ ID NO: 1148672 - RNA, 13 nt, Mycobacterium bovis subsp bovis AF2122/97
gcuugggccaggc

SEQ ID NO: 1148673 - RNA, 18 nt, Mycobacterium bovis subsp bovis AF2122/97
gcuugggccaggcccagc

SEQ ID NO: 1148674 - RNA, 14 nt, Mycobacterium bovis subsp bovis AF2122/97
gcuuggggucaccc

SEQ ID NO: 1148675 - RNA, 15 nt, Mycobacterium bovis subsp bovis AF2122/97
gcuugggguugggcg

SEQ ID NO: 1148676 - RNA, 21 nt, Mycobacterium bovis subsp bovis AF2122/97
gcuuggucaaaaagcucggcc

SEQ ID NO: 1148677 - RNA, 15 nt, Mycobacterium bovis subsp bovis AF2122/97
ggaaagccgcagccg

SEQ ID NO: 1148678 - RNA, 15 nt, Mycobacterium bovis subsp bovis AF2122/97
ggaaagggccgccgc

SEQ ID NO: 1148679 - RNA, 18 nt, Mycobacterium bovis subsp bovis AF2122/97
ggaaaggucggccugcga

SEQ ID NO: 1148680 - RNA, 18 nt, Mycobacterium bovis subsp bovis AF2122/97
ggaaaccggccagccgac

SEQ ID NO: 1148681 - RNA, 23 nt, Mycobacterium bovis subsp bovis AF2122/97
ggaaaccucuucgggugcagcca

SEQ ID NO: 1148682 - RNA, 16 nt, Mycobacterium bovis subsp bovis AF2122/97
ggaaacuccgcggcgc

SEQ ID NO: 1148683 - RNA, 18 nt, Mycobacterium bovis subsp bovis AF2122/97
ggaaacaaccccgcgguu

SEQ ID NO: 1148684 - RNA, 14 nt, Mycobacterium bovis subsp bovis AF2122/97
ggaaacccgccgaa

SEQ ID NO: 1148685 - RNA, 16 nt, Mycobacterium bovis subsp bovis AF2122/97
ggaaacccggccgccg

SEQ ID NO: 1148686 - RNA, 21 nt, Mycobacterium bovis subsp bovis AF2122/97
ggaaaccaucgccagccggcg

SEQ ID NO: 1148687 - RNA, 22 nt, Mycobacterium bovis subsp bovis AF2122/97
ggaaacaucguucugacggcuu

SEQ ID NO: 1148688 - RNA, 16 nt, Mycobacterium bovis subsp bovis AF2122/97
ggaaaccacagcgcca

SEQ ID NO: 1148689 - RNA, 17 nt, Mycobacterium bovis subsp bovis AF2122/97
ggaaaccacagcgccau

SEQ ID NO: 1148690 - RNA, 21 nt, Mycobacterium bovis subsp bovis AF2122/97
gcuuuuccggcauugccgccg

SEQ ID NO: 1148691 - RNA, 19 nt, Mycobacterium bovis subsp bovis AF2122/97
gcuuuugcgucugcucgcg

SEQ ID NO: 1148692 - RNA, 15 nt, Mycobacterium bovis subsp bovis AF2122/97
gcuuuugcaccggac

SEQ ID NO: 1148693 - RNA, 17 nt, Mycobacterium bovis subsp bovis AF2122/97
gcuuuugcgucugcucg

SEQ ID NO: 1148694 - RNA, 20 nt, Mycobacterium bovis subsp bovis AF2122/97
gcuuuugcgucugcucgcgc

SEQ ID NO: 1148695 - RNA, 22 nt, Mycobacterium bovis subsp bovis AF2122/97
gcuuuugcgucugcucgcgccg

SEQ ID NO: 1148696 - RNA, 16 nt, Mycobacterium bovis subsp bovis AF2122/97
gcuuuggguccgggcg

SEQ ID NO: 1148697 - RNA, 16 nt, Mycobacterium bovis subsp bovis AF2122/97
gcuuugcgcggucagc

SEQ ID NO: 1148698 - RNA, 13 nt, Mycobacterium bovis subsp bovis AF2122/97
gcuuugcuugccg

SEQ ID NO: 1148699 - RNA, 17 nt, Mycobacterium bovis subsp bovis AF2122/97
gcuuuggcccgcgagcg

SEQ ID NO: 1148700 - RNA, 14 nt, Mycobacterium bovis subsp bovis AF2122/97
gcuuuggccgccgu

SEQ ID NO: 1148701 - RNA, 17 nt, Mycobacterium bovis subsp bovis AF2122/97
gcuuuggccgccguggc

SEQ ID NO: 1148702 - RNA, 24 nt, Mycobacterium bovis subsp bovis AF2122/97
gcuuuggccgccguggcgucggcg

SEQ ID NO: 1148703 - RNA, 19 nt, Mycobacterium bovis subsp bovis AF2122/97
gcuuuuacgucugcucgcg

SEQ ID NO: 1148704 - RNA, 20 nt, Mycobacterium bovis subsp bovis AF2122/97
gcuuucgagugcagcggcgc

SEQ ID NO: 1148705 - RNA, 20 nt, Mycobacterium bovis subsp bovis AF2122/97
gcuuucgauauagccgccgg

SEQ ID NO: 1148706 - RNA, 15 nt, Mycobacterium bovis subsp bovis AF2122/97
gcuuugacgcccggc

SEQ ID NO: 1148707 - RNA, 15 nt, Mycobacterium bovis subsp bovis AF2122/97
gcuuugacgcccucg

SEQ ID NO: 1148708 - RNA, 18 nt, Mycobacterium bovis subsp bovis AF2122/97
gcuuugacgcccucggcg

SEQ ID NO: 1148709 - RNA, 21 nt, Mycobacterium bovis subsp bovis AF2122/97
gcuuugacgcccucggcgacc

SEQ ID NO: 1148710 - RNA, 20 nt, Mycobacterium bovis subsp bovis AF2122/97
gcuuugagucccgguagacc

SEQ ID NO: 1148711 - RNA, 21 nt, Mycobacterium bovis subsp bovis AF2122/97
gcuuugagucccgguagacca

SEQ ID NO: 1148712 - RNA, 18 nt, Mycobacterium bovis subsp bovis AF2122/97
gcuugcaggcgaucuggc

SEQ ID NO: 1148713 - RNA, 18 nt, Mycobacterium bovis subsp bovis AF2122/97
gcuugcccgacggcgucu

SEQ ID NO: 1148714 - RNA, 13 nt, Mycobacterium bovis subsp bovis AF2122/97
gcuugaucgccga

SEQ ID NO: 1148715 - RNA, 15 nt, Mycobacterium bovis subsp bovis AF2122/97
gcuugaucgccgagg

SEQ ID NO: 1148716 - RNA, 14 nt, Mycobacterium bovis subsp bovis AF2122/97
gcuugaugccggcc

SEQ ID NO: 1148717 - RNA, 21 nt, Mycobacterium bovis subsp bovis AF2122/97
gcuugaugucuuuggcguacu

SEQ ID NO: 1148718 - RNA, 17 nt, Mycobacterium bovis subsp bovis AF2122/97
gcuugcaauugcgcggc

SEQ ID NO: 1148719 - RNA, 14 nt, Mycobacterium bovis subsp bovis AF2122/97
gcuugccgaccugc

SEQ ID NO: 1148720 - RNA, 15 nt, Mycobacterium bovis subsp bovis AF2122/97
gcuugccgucgcuga

SEQ ID NO: 1148721 - RNA, 14 nt, Mycobacterium bovis subsp bovis AF2122/97
gcuugcgcagcagc

SEQ ID NO: 1148722 - RNA, 14 nt, Mycobacterium bovis subsp bovis AF2122/97
gcuugcgcagccgc

SEQ ID NO: 1148723 - RNA, 15 nt, Mycobacterium bovis subsp bovis AF2122/97
gcuugcgcagccgca

SEQ ID NO: 1148724 - RNA, 16 nt, Mycobacterium bovis subsp bovis AF2122/97
gcuugcgcagccgcag

SEQ ID NO: 1148725 - RNA, 17 nt, Mycobacterium bovis subsp bovis AF2122/97
gcuugcgcccggccugc

SEQ ID NO: 1148726 - RNA, 17 nt, Mycobacterium bovis subsp bovis AF2122/97
gcuugagccgcagcacc

SEQ ID NO: 1148727 - RNA, 22 nt, Mycobacterium bovis subsp bovis AF2122/97
gcuugagcacacguccggcgau

SEQ ID NO: 1148728 - RNA, 14 nt, Mycobacterium bovis subsp bovis AF2122/97
gcuugagcgccgau

SEQ ID NO: 1148729 - RNA, 15 nt, Mycobacterium bovis subsp bovis AF2122/97
gcuugagcgccgaug

SEQ ID NO: 1148730 - RNA, 18 nt, Mycobacterium bovis subsp bovis AF2122/97
gcuugacugcacaccacc

SEQ ID NO: 1148731 - RNA, 20 nt, Mycobacterium bovis subsp bovis AF2122/97
gcuugaacgcauacagcgcc

SEQ ID NO: 1148732 - RNA, 21 nt, Mycobacterium bovis subsp bovis AF2122/97
gcuugaccccuggccgccggc

SEQ ID NO: 1148733 - RNA, 19 nt, Mycobacterium bovis subsp bovis AF2122/97
gcuucuucuucuugaccgc

SEQ ID NO: 1148734 - RNA, 20 nt, Mycobacterium bovis subsp bovis AF2122/97
gcuucugcgucagccgacaa

SEQ ID NO: 1148735 - RNA, 19 nt, Mycobacterium bovis subsp bovis AF2122/97
gcuucugcgucugcucgcg

SEQ ID NO: 1148736 - RNA, 18 nt, Mycobacterium bovis subsp bovis AF2122/97
gcuucugggguuggcucg

SEQ ID NO: 1148737 - RNA, 21 nt, Mycobacterium bovis subsp bovis AF2122/97
gcuucugggguuggcucggcg

SEQ ID NO: 1148738 - RNA, 22 nt, Mycobacterium bovis subsp bovis AF2122/97
gcuucugggguuggcucggcgc

SEQ ID NO: 1148739 - RNA, 20 nt, Mycobacterium bovis subsp bovis AF2122/97
gcuucuucggacagcagccg

SEQ ID NO: 1148740 - RNA, 23 nt, Mycobacterium bovis subsp bovis AF2122/97
gcuucuucggacagcagccggcg

SEQ ID NO: 1148741 - RNA, 20 nt, Mycobacterium bovis subsp bovis AF2122/97
gcuucuuccgcgcgccggcg

SEQ ID NO: 1148742 - RNA, 22 nt, Mycobacterium bovis subsp bovis AF2122/97
gcuucucagcaccaugcucgga

SEQ ID NO: 1148743 - RNA, 21 nt, Mycobacterium bovis subsp bovis AF2122/97
gcuucucgucggugcgcgcgg

SEQ ID NO: 1148744 - RNA, 23 nt, Mycobacterium bovis subsp bovis AF2122/97
gcuucucgucggugcgcgcggcg

SEQ ID NO: 1148745 - RNA, 18 nt, Mycobacterium bovis subsp bovis AF2122/97
gcuucgucggccggcacc

SEQ ID NO: 1148746 - RNA, 19 nt, Mycobacterium bovis subsp bovis AF2122/97
gcuucgucggccggcaccc

SEQ ID NO: 1148747 - RNA, 21 nt, Mycobacterium bovis subsp bovis AF2122/97
gcuucgucggccggcacccca

SEQ ID NO: 1148748 - RNA, 18 nt, Mycobacterium bovis subsp bovis AF2122/97
gcuuccaaacccgguguu

SEQ ID NO: 1148749 - RNA, 20 nt, Mycobacterium bovis subsp bovis AF2122/97
gcuuccaacucggcggccag

SEQ ID NO: 1148750 - RNA, 16 nt, Mycobacterium bovis subsp bovis AF2122/97
gcuucaucuggcgccg

SEQ ID NO: 1148751 - RNA, 18 nt, Mycobacterium bovis subsp bovis AF2122/97
gcuucaucccggagccgc

SEQ ID NO: 1148752 - RNA, 14 nt, Mycobacterium bovis subsp bovis AF2122/97
gcuucagcacggug

SEQ ID NO: 1148753 - RNA, 17 nt, Mycobacterium bovis subsp bovis AF2122/97
gcuuccgcugaacaccg

SEQ ID NO: 1148754 - RNA, 20 nt, Mycobacterium bovis subsp bovis AF2122/97
gcuuccgcugaacaccgugg

SEQ ID NO: 1148755 - RNA, 20 nt, Mycobacterium bovis subsp bovis AF2122/97
gcuuccgcuggguggccgcu

SEQ ID NO: 1148756 - RNA, 18 nt, Mycobacterium bovis subsp bovis AF2122/97
gcuuccggaacaaaggcu

SEQ ID NO: 1148757 - RNA, 15 nt, Mycobacterium bovis subsp bovis AF2122/97
gcuuccgguccagcg

SEQ ID NO: 1148758 - RNA, 18 nt, Mycobacterium bovis subsp bovis AF2122/97
gcuuccgguccagcggcc

SEQ ID NO: 1148759 - RNA, 22 nt, Mycobacterium bovis subsp bovis AF2122/97
gcuuccgguccagcggccgccg

SEQ ID NO: 1148760 - RNA, 23 nt, Mycobacterium bovis subsp bovis AF2122/97
gcuuccgguccagcggccgccgc

SEQ ID NO: 1148761 - RNA, 16 nt, Mycobacterium bovis subsp bovis AF2122/97
gcuuccggugccggga

SEQ ID NO: 1148762 - RNA, 15 nt, Mycobacterium bovis subsp bovis AF2122/97
gcuuccagcaucagu

SEQ ID NO: 1148763 - RNA, 19 nt, Mycobacterium bovis subsp bovis AF2122/97
gcuucgaagcgaucgccgg

SEQ ID NO: 1148764 - RNA, 23 nt, Mycobacterium bovis subsp bovis AF2122/97
gcuuccucgagcgaaccgaagcc

SEQ ID NO: 1148765 - RNA, 18 nt, Mycobacterium bovis subsp bovis AF2122/97
gcuuccgggacuaccacc

SEQ ID NO: 1148766 - RNA, 20 nt, Mycobacterium bovis subsp bovis AF2122/97
gcuuccgggacuaccacccg

SEQ ID NO: 1148767 - RNA, 18 nt, Mycobacterium bovis subsp bovis AF2122/97
gcuucgagguggcugcgc

SEQ ID NO: 1148768 - RNA, 18 nt, Mycobacterium bovis subsp bovis AF2122/97
gcuucgaccaucaccacg

SEQ ID NO: 1148769 - RNA, 18 nt, Mycobacterium bovis subsp bovis AF2122/97
gcuucgacgucggcgacc

SEQ ID NO: 1148770 - RNA, 16 nt, Mycobacterium bovis subsp bovis AF2122/97
gcuucgccacaccaug

SEQ ID NO: 1148771 - RNA, 19 nt, Mycobacterium bovis subsp bovis AF2122/97
gcuucgagcaccgacaccg

SEQ ID NO: 1148772 - RNA, 18 nt, Mycobacterium bovis subsp bovis AF2122/97
gcuucgagugcgacggcg

SEQ ID NO: 1148773 - RNA, 18 nt, Mycobacterium bovis subsp bovis AF2122/97
gcuucgaguuuggcgacg

SEQ ID NO: 1148774 - RNA, 13 nt, Mycobacterium bovis subsp bovis AF2122/97
gcuucgaugggca

SEQ ID NO: 1148775 - RNA, 21 nt, Mycobacterium bovis subsp bovis AF2122/97
gcuucgauugcgcugcaccgg

SEQ ID NO: 1148776 - RNA, 12 nt, Mycobacterium bovis subsp bovis AF2122/97
gcuucgccgagu

SEQ ID NO: 1148777 - RNA, 16 nt, Mycobacterium bovis subsp bovis AF2122/97
gcuucgccgcgcagcc

SEQ ID NO: 1148778 - RNA, 19 nt, Mycobacterium bovis subsp bovis AF2122/97
gcuucggugacccgggcgg

SEQ ID NO: 1148779 - RNA, 18 nt, Mycobacterium bovis subsp bovis AF2122/97
gcuucgucgacaucgcca

SEQ ID NO: 1148780 - RNA, 15 nt, Mycobacterium bovis subsp bovis AF2122/97
gcuucguccaccgcg

SEQ ID NO: 1148781 - RNA, 18 nt, Mycobacterium bovis subsp bovis AF2122/97
gcuucgucggccagcagc

SEQ ID NO: 1148782 - RNA, 16 nt, Mycobacterium bovis subsp bovis AF2122/97
gcuucgucggccggca

SEQ ID NO: 1148783 - RNA, 13 nt, Mycobacterium bovis subsp bovis AF2122/97
gcuucggugaccc

SEQ ID NO: 1148784 - RNA, 19 nt, Mycobacterium bovis subsp bovis AF2122/97
gcuucgggguaaccggcgg

SEQ ID NO: 1148785 - RNA, 22 nt, Mycobacterium bovis subsp bovis AF2122/97
gcuucgggguaaccggcggauu

SEQ ID NO: 1148786 - RNA, 13 nt, Mycobacterium bovis subsp bovis AF2122/97
gcuucggcuggcg

SEQ ID NO: 1148787 - RNA, 14 nt, Mycobacterium bovis subsp bovis AF2122/97
gcuucggcuggcgu

SEQ ID NO: 1148788 - RNA, 17 nt, Mycobacterium bovis subsp bovis AF2122/97
gcuucggcggucgccgc

SEQ ID NO: 1148789 - RNA, 19 nt, Mycobacterium bovis subsp bovis AF2122/97
gcuucggcggucgccgcgc

SEQ ID NO: 1148790 - RNA, 14 nt, Mycobacterium bovis subsp bovis AF2122/97
gcuucggcgugcgu

SEQ ID NO: 1148791 - RNA, 17 nt, Mycobacterium bovis subsp bovis AF2122/97
gcuucggcggccgagcg

SEQ ID NO: 1148792 - RNA, 20 nt, Mycobacterium bovis subsp bovis AF2122/97
gcuucgcgguuggcggcgau

SEQ ID NO: 1148793 - RNA, 13 nt, Mycobacterium bovis subsp bovis AF2122/97
gcuucggcgagcg

SEQ ID NO: 1148794 - RNA, 21 nt, Mycobacterium bovis subsp bovis AF2122/97
gcuucggcgagcgcaucggcc

SEQ ID NO: 1148795 - RNA, 21 nt, Mycobacterium bovis subsp bovis AF2122/97
gcuucggcagcucccgccacg

SEQ ID NO: 1148796 - RNA, 14 nt, Mycobacterium bovis subsp bovis AF2122/97
gccaggggacccgg

SEQ ID NO: 1148797 - RNA, 23 nt, Mycobacterium bovis subsp bovis AF2122/97
gccaggggacccggggccguugg

SEQ ID NO: 1148798 - RNA, 14 nt, Mycobacterium bovis subsp bovis AF2122/97
gccaggggcgcagc

SEQ ID NO: 1148799 - RNA, 18 nt, Mycobacterium bovis subsp bovis AF2122/97
gccaggggcgcagcgcgg

SEQ ID NO: 1148800 - RNA, 20 nt, Mycobacterium bovis subsp bovis AF2122/97
gccaggggcgcagcgcggca

SEQ ID NO: 1148801 - RNA, 15 nt, Mycobacterium bovis subsp bovis AF2122/97
gccagggcgguggcc

SEQ ID NO: 1148802 - RNA, 22 nt, Mycobacterium bovis subsp bovis AF2122/97
gccagggcgguggccacccggc

SEQ ID NO: 1148803 - RNA, 24 nt, Mycobacterium bovis subsp bovis AF2122/97
gccagggaucagccgugcgggccg

SEQ ID NO: 1148804 - RNA, 13 nt, Mycobacterium bovis subsp bovis AF2122/97
gccagggcgccga

SEQ ID NO: 1148805 - RNA, 14 nt, Mycobacterium bovis subsp bovis AF2122/97
gccagggcggcauc

SEQ ID NO: 1148806 - RNA, 19 nt, Mycobacterium bovis subsp bovis AF2122/97
gccagggcccuagccggcg

SEQ ID NO: 1148807 - RNA, 12 nt, Mycobacterium bovis subsp bovis AF2122/97
gccaggccggcg

SEQ ID NO: 1148808 - RNA, 16 nt, Mycobacterium bovis subsp bovis AF2122/97
gccaggccgaugccga

SEQ ID NO: 1148809 - RNA, 20 nt, Mycobacterium bovis subsp bovis AF2122/97
gccaggaugccugccacccg

SEQ ID NO: 1148810 - RNA, 12 nt, Mycobacterium bovis subsp bovis AF2122/97
gccaggccgaug

SEQ ID NO: 1148811 - RNA, 15 nt, Mycobacterium bovis subsp bovis AF2122/97
gccaggccgcacagc

SEQ ID NO: 1148812 - RNA, 18 nt, Mycobacterium bovis subsp bovis AF2122/97
gccaggccgcacagcacc

SEQ ID NO: 1148813 - RNA, 13 nt, Mycobacterium bovis subsp bovis AF2122/97
gccaggccggcgg

SEQ ID NO: 1148814 - RNA, 14 nt, Mycobacterium bovis subsp bovis AF2122/97
gccaggccggcggc

SEQ ID NO: 1148815 - RNA, 15 nt, Mycobacterium bovis subsp bovis AF2122/97
gccaggccgucggcg

SEQ ID NO: 1148816 - RNA, 16 nt, Mycobacterium bovis subsp bovis AF2122/97
gccaggcuugcggcac

SEQ ID NO: 1148817 - RNA, 18 nt, Mycobacterium bovis subsp bovis AF2122/97
gccagggaggggccguca

SEQ ID NO: 1148818 - RNA, 13 nt, Mycobacterium bovis subsp bovis AF2122/97
gccagggaucagc

SEQ ID NO: 1148819 - RNA, 21 nt, Mycobacterium bovis subsp bovis AF2122/97
gccagguuguagacggcaccc

SEQ ID NO: 1148820 - RNA, 19 nt, Mycobacterium bovis subsp bovis AF2122/97
gccagucgcaggaucggcg

SEQ ID NO: 1148821 - RNA, 16 nt, Mycobacterium bovis subsp bovis AF2122/97
gccagucgcaggaucg

SEQ ID NO: 1148822 - RNA, 14 nt, Mycobacterium bovis subsp bovis AF2122/97
gccagucgagcacc

SEQ ID NO: 1148823 - RNA, 15 nt, Mycobacterium bovis subsp bovis AF2122/97
gccagucgaucgcgg

SEQ ID NO: 1148824 - RNA, 23 nt, Mycobacterium bovis subsp bovis AF2122/97
gccagucgaucgcggcccgcagc

SEQ ID NO: 1148825 - RNA, 15 nt, Mycobacterium bovis subsp bovis AF2122/97
gccaguccggggaac

SEQ ID NO: 1148826 - RNA, 22 nt, Mycobacterium bovis subsp bovis AF2122/97
gccagucgaaucgucaucccga

SEQ ID NO: 1148827 - RNA, 17 nt, Mycobacterium bovis subsp bovis AF2122/97
gccaggucggccaccgu

SEQ ID NO: 1148828 - RNA, 18 nt, Mycobacterium bovis subsp bovis AF2122/97
gccaggucggcgaugaug

SEQ ID NO: 1148829 - RNA, 18 nt, Mycobacterium bovis subsp bovis AF2122/97
gccagguugaucguggcg

SEQ ID NO: 1148830 - RNA, 16 nt, Mycobacterium bovis subsp bovis AF2122/97
gccagguugccgucgg

SEQ ID NO: 1148831 - RNA, 22 nt, Mycobacterium bovis subsp bovis AF2122/97
gccaggucgcgauagccgccgc

SEQ ID NO: 1148832 - RNA, 16 nt, Mycobacterium bovis subsp bovis AF2122/97
gccaggucggcguuga

SEQ ID NO: 1148833 - RNA, 16 nt, Mycobacterium bovis subsp bovis AF2122/97
gccaggucgacaccgc

SEQ ID NO: 1148834 - RNA, 17 nt, Mycobacterium bovis subsp bovis AF2122/97
gccaggucgacaccgcg

SEQ ID NO: 1148835 - RNA, 23 nt, Mycobacterium bovis subsp bovis AF2122/97
gccagggucacaaacccagcauc

SEQ ID NO: 1148836 - RNA, 16 nt, Mycobacterium bovis subsp bovis AF2122/97
gccaggucagccgcgc

SEQ ID NO: 1148837 - RNA, 18 nt, Mycobacterium bovis subsp bovis AF2122/97
gccaggucagccgcgcgg

SEQ ID NO: 1148838 - RNA, 15 nt, Mycobacterium bovis subsp bovis AF2122/97
gccaggucgagcacc

SEQ ID NO: 1148839 - RNA, 17 nt, Mycobacterium bovis subsp bovis AF2122/97
gccaggucgaggcaggc

SEQ ID NO: 1148840 - RNA, 16 nt, Mycobacterium bovis subsp bovis AF2122/97
gccaggucgauaccgg

SEQ ID NO: 1148841 - RNA, 21 nt, Mycobacterium bovis subsp bovis AF2122/97
gccaggucgauaccggcgugc

SEQ ID NO: 1148842 - RNA, 19 nt, Mycobacterium bovis subsp bovis AF2122/97
gccagguccccgacaacgg

SEQ ID NO: 1148843 - RNA, 18 nt, Mycobacterium bovis subsp bovis AF2122/97
gccagguccgccggugcc

SEQ ID NO: 1148844 - RNA, 18 nt, Mycobacterium bovis subsp bovis AF2122/97
gccaggucgacgggcacg

SEQ ID NO: 1148845 - RNA, 16 nt, Mycobacterium bovis subsp bovis AF2122/97
gccaggauaaguccgg

SEQ ID NO: 1148846 - RNA, 17 nt, Mycobacterium bovis subsp bovis AF2122/97
gccaggauccgaccccg

SEQ ID NO: 1148847 - RNA, 17 nt, Mycobacterium bovis subsp bovis AF2122/97
gccagcguugugcgucc

SEQ ID NO: 1148848 - RNA, 15 nt, Mycobacterium bovis subsp bovis AF2122/97
gccaggaguggccac

SEQ ID NO: 1148849 - RNA, 23 nt, Mycobacterium bovis subsp bovis AF2122/97
gccaggaguuugaccaccugguu

SEQ ID NO: 1148850 - RNA, 18 nt, Mycobacterium bovis subsp bovis AF2122/97
gccaggaucgcggcgccg

SEQ ID NO: 1148851 - RNA, 20 nt, Mycobacterium bovis subsp bovis AF2122/97
gccaggaucgcggcgccguc

SEQ ID NO: 1148852 - RNA, 21 nt, Mycobacterium bovis subsp bovis AF2122/97
gccaggcacguccgaucggcg

SEQ ID NO: 1148853 - RNA, 15 nt, Mycobacterium bovis subsp bovis AF2122/97
gccaggcaccacgac

SEQ ID NO: 1148854 - RNA, 20 nt, Mycobacterium bovis subsp bovis AF2122/97
gccaggccgacaaugucggc

SEQ ID NO: 1148855 - RNA, 22 nt, Mycobacterium bovis subsp bovis AF2122/97
gccaggccgacaaugucggcga

SEQ ID NO: 1148856 - RNA, 20 nt, Mycobacterium bovis subsp bovis AF2122/97
gccaggccgaccgcgcacau

SEQ ID NO: 1148857 - RNA, 20 nt, Mycobacterium bovis subsp bovis AF2122/97
gccagcugcagcagacccgg

SEQ ID NO: 1148858 - RNA, 17 nt, Mycobacterium bovis subsp bovis AF2122/97
gccagcugacacccgca

SEQ ID NO: 1148859 - RNA, 19 nt, Mycobacterium bovis subsp bovis AF2122/97
gccagcugacacccgcagc

SEQ ID NO: 1148860 - RNA, 22 nt, Mycobacterium bovis subsp bovis AF2122/97
gccagcugcgcagcgcaacauc

SEQ ID NO: 1148861 - RNA, 15 nt, Mycobacterium bovis subsp bovis AF2122/97
gccagcugcguggcg

SEQ ID NO: 1148862 - RNA, 22 nt, Mycobacterium bovis subsp bovis AF2122/97
gccagcugcguggcgaaccagg

SEQ ID NO: 1148863 - RNA, 19 nt, Mycobacterium bovis subsp bovis AF2122/97
gccagcugcggcuccggcg

SEQ ID NO: 1148864 - RNA, 21 nt, Mycobacterium bovis subsp bovis AF2122/97
gccagcugcggcuccggcggc

SEQ ID NO: 1148865 - RNA, 23 nt, Mycobacterium bovis subsp bovis AF2122/97
gccagcuucccgguagcggcggc

SEQ ID NO: 1148866 - RNA, 19 nt, Mycobacterium bovis subsp bovis AF2122/97
gccagcuugcggagccgcc

SEQ ID NO: 1148867 - RNA, 20 nt, Mycobacterium bovis subsp bovis AF2122/97
gccagcuugcggagccgccg

SEQ ID NO: 1148868 - RNA, 21 nt, Mycobacterium bovis subsp bovis AF2122/97
gccagcuugcggagccgccgc

SEQ ID NO: 1148869 - RNA, 18 nt, Mycobacterium bovis subsp bovis AF2122/97
gccagcuccgccugccgc

SEQ ID NO: 1148870 - RNA, 18 nt, Mycobacterium bovis subsp bovis AF2122/97
gccagcucccgggcggcg

SEQ ID NO: 1148871 - RNA, 21 nt, Mycobacterium bovis subsp bovis AF2122/97
gccagcuccgccugccgcugg

SEQ ID NO: 1148872 - RNA, 14 nt, Mycobacterium bovis subsp bovis AF2122/97
gccagcuccggcgc

SEQ ID NO: 1148873 - RNA, 15 nt, Mycobacterium bovis subsp bovis AF2122/97
gccagcuccggcgcu

SEQ ID NO: 1148874 - RNA, 21 nt, Mycobacterium bovis subsp bovis AF2122/97
gccagcuccggcgcuccacug

SEQ ID NO: 1148875 - RNA, 20 nt, Mycobacterium bovis subsp bovis AF2122/97
gccagcuccgugacaccggg

SEQ ID NO: 1148876 - RNA, 20 nt, Mycobacterium bovis subsp bovis AF2122/97
gccagcuccucagccaccgc

SEQ ID NO: 1148877 - RNA, 21 nt, Mycobacterium bovis subsp bovis AF2122/97
gccagcuccucagccaccgcg

SEQ ID NO: 1148878 - RNA, 17 nt, Mycobacterium bovis subsp bovis AF2122/97
gccagcucgccggccgg

SEQ ID NO: 1148879 - RNA, 17 nt, Mycobacterium bovis subsp bovis AF2122/97
gccagcucggcggcagc

SEQ ID NO: 1148880 - RNA, 19 nt, Mycobacterium bovis subsp bovis AF2122/97
gccagcucggcggcagcgg

SEQ ID NO: 1148881 - RNA, 20 nt, Mycobacterium bovis subsp bovis AF2122/97
gccagcucggcggcagcggc

SEQ ID NO: 1148882 - RNA, 14 nt, Mycobacterium bovis subsp bovis AF2122/97
gccagcucggcacc

SEQ ID NO: 1148883 - RNA, 20 nt, Mycobacterium bovis subsp bovis AF2122/97
gccagcucggcacccgccgg

SEQ ID NO: 1148884 - RNA, 19 nt, Mycobacterium bovis subsp bovis AF2122/97
gccagcguuaggucgccgg

SEQ ID NO: 1148885 - RNA, 15 nt, Mycobacterium bovis subsp bovis AF2122/97
gccagcguguccgcc

SEQ ID NO: 1148886 - RNA, 14 nt, Mycobacterium bovis subsp bovis AF2122/97
gccagcguguccgc

SEQ ID NO: 1148887 - RNA, 13 nt, Mycobacterium bovis subsp bovis AF2122/97
gccagcguuggcg

SEQ ID NO: 1148888 - RNA, 15 nt, Mycobacterium bovis subsp bovis AF2122/97
gccagcguuggcggc

SEQ ID NO: 1148889 - RNA, 19 nt, Mycobacterium bovis subsp bovis AF2122/97
gccagcggcugcccaucgg

SEQ ID NO: 1148890 - RNA, 18 nt, Mycobacterium bovis subsp bovis AF2122/97
gccagcgggugaggucau

SEQ ID NO: 1148891 - RNA, 19 nt, Mycobacterium bovis subsp bovis AF2122/97
gccagcgguaaugccagcg

SEQ ID NO: 1148892 - RNA, 17 nt, Mycobacterium bovis subsp bovis AF2122/97
gccagcgggcgaugagc

SEQ ID NO: 1148893 - RNA, 12 nt, Mycobacterium bovis subsp bovis AF2122/97
gccagcguggug

SEQ ID NO: 1148894 - RNA, 15 nt, Mycobacterium bovis subsp bovis AF2122/97
gccagcguggugauc

SEQ ID NO: 1148895 - RNA, 15 nt, Mycobacterium bovis subsp bovis AF2122/97
gccagcggcgcgacc

SEQ ID NO: 1148896 - RNA, 18 nt, Mycobacterium bovis subsp bovis AF2122/97
gccagcgcggcgcgcggg

SEQ ID NO: 1148897 - RNA, 12 nt, Mycobacterium bovis subsp bovis AF2122/97
gccagcgcggcg

SEQ ID NO: 1148898 - RNA, 13 nt, Mycobacterium bovis subsp bovis AF2122/97
gccagcgcggcga

SEQ ID NO: 1148899 - RNA, 15 nt, Mycobacterium bovis subsp bovis AF2122/97
gccagcgcgcgcggg

SEQ ID NO: 1148900 - RNA, 18 nt, Mycobacterium bovis subsp bovis AF2122/97
gccagcgcgcgcgggugc

SEQ ID NO: 1148901 - RNA, 14 nt, Mycobacterium bovis subsp bovis AF2122/97
gccagcgccgccgg

SEQ ID NO: 1148902 - RNA, 16 nt, Mycobacterium bovis subsp bovis AF2122/97
gccagcgccgccggag

SEQ ID NO: 1148903 - RNA, 17 nt, Mycobacterium bovis subsp bovis AF2122/97
gccagcgccgccggagc

SEQ ID NO: 1148904 - RNA, 15 nt, Mycobacterium bovis subsp bovis AF2122/97
gccagcgccgccggc

SEQ ID NO: 1148905 - RNA, 17 nt, Mycobacterium bovis subsp bovis AF2122/97
gccagcgccgccggcgc

SEQ ID NO: 1148906 - RNA, 17 nt, Mycobacterium bovis subsp bovis AF2122/97
gccagcgccgcggcuac

SEQ ID NO: 1148907 - RNA, 14 nt, Mycobacterium bovis subsp bovis AF2122/97
gccagcgccgcggc

SEQ ID NO: 1148908 - RNA, 12 nt, Mycobacterium bovis subsp bovis AF2122/97
gccagcgcgacc

SEQ ID NO: 1148909 - RNA, 16 nt, Mycobacterium bovis subsp bovis AF2122/97
gccagcgcgcccgcgg

SEQ ID NO: 1148910 - RNA, 17 nt, Mycobacterium bovis subsp bovis AF2122/97
gccagcgcgcccgcggc

SEQ ID NO: 1148911 - RNA, 24 nt, Mycobacterium bovis subsp bovis AF2122/97
gccagcgcgcccgcggccgccagc

SEQ ID NO: 1148912 - RNA, 13 nt, Mycobacterium bovis subsp bovis AF2122/97
gccagcgcgccac

SEQ ID NO: 1148913 - RNA, 10 nt, Mycobacterium bovis subsp bovis AF2122/97
gccagcgcgc

SEQ ID NO: 1148914 - RNA, 13 nt, Mycobacterium bovis subsp bovis AF2122/97
gccagccuccacc

SEQ ID NO: 1148915 - RNA, 15 nt, Mycobacterium bovis subsp bovis AF2122/97
gccagccuccaccag

SEQ ID NO: 1148916 - RNA, 16 nt, Mycobacterium bovis subsp bovis AF2122/97
gccagccugcuggccg

SEQ ID NO: 1148917 - RNA, 20 nt, Mycobacterium bovis subsp bovis AF2122/97
gccagccugcuggccgcggc

SEQ ID NO: 1148918 - RNA, 18 nt, Mycobacterium bovis subsp bovis AF2122/97
gccagcgaaucgcuggug

SEQ ID NO: 1148919 - RNA, 13 nt, Mycobacterium bovis subsp bovis AF2122/97
gccagcgccgcca

SEQ ID NO: 1148920 - RNA, 14 nt, Mycobacterium bovis subsp bovis AF2122/97
gccagcgccgccga

SEQ ID NO: 1148921 - RNA, 17 nt, Mycobacterium bovis subsp bovis AF2122/97
gccagcgccgccgccga

SEQ ID NO: 1148922 - RNA, 18 nt, Mycobacterium bovis subsp bovis AF2122/97
gccagcgccgccgccgac

SEQ ID NO: 1148923 - RNA, 15 nt, Mycobacterium bovis subsp bovis AF2122/97
gccagcgccgccgcg

SEQ ID NO: 1148924 - RNA, 20 nt, Mycobacterium bovis subsp bovis AF2122/97
gccagccguucucgcccacc

SEQ ID NO: 1148925 - RNA, 14 nt, Mycobacterium bovis subsp bovis AF2122/97
gccagccgugcagg

SEQ ID NO: 1148926 - RNA, 15 nt, Mycobacterium bovis subsp bovis AF2122/97
gccagccgcgagccg

SEQ ID NO: 1148927 - RNA, 13 nt, Mycobacterium bovis subsp bovis AF2122/97
gccagccgaccga

SEQ ID NO: 1148928 - RNA, 16 nt, Mycobacterium bovis subsp bovis AF2122/97
gccagccgacgcggcg

SEQ ID NO: 1148929 - RNA, 17 nt, Mycobacterium bovis subsp bovis AF2122/97
gccagccgacgcggcgg

SEQ ID NO: 1148930 - RNA, 15 nt, Mycobacterium bovis subsp bovis AF2122/97
gccagccgcacgguu

SEQ ID NO: 1148931 - RNA, 16 nt, Mycobacterium bovis subsp bovis AF2122/97
gccagcacuccgcggg

SEQ ID NO: 1148932 - RNA, 19 nt, Mycobacterium bovis subsp bovis AF2122/97
gccagcacugccaucgcgg

SEQ ID NO: 1148933 - RNA, 15 nt, Mycobacterium bovis subsp bovis AF2122/97
gccagcagagcggca

SEQ ID NO: 1148934 - RNA, 16 nt, Mycobacterium bovis subsp bovis AF2122/97
gccagcagagcggcac

SEQ ID NO: 1148935 - RNA, 22 nt, Mycobacterium bovis subsp bovis AF2122/97
gccagcagcaaacaucgcaggc

SEQ ID NO: 1148936 - RNA, 15 nt, Mycobacterium bovis subsp bovis AF2122/97
gccagcagcaaccgc

SEQ ID NO: 1148937 - RNA, 19 nt, Mycobacterium bovis subsp bovis AF2122/97
gccagcagcaacgacccga

SEQ ID NO: 1148938 - RNA, 16 nt, Mycobacterium bovis subsp bovis AF2122/97
gccagcagcaaucagc

SEQ ID NO: 1148939 - RNA, 20 nt, Mycobacterium bovis subsp bovis AF2122/97
gccagcagcaaucagccgcc

SEQ ID NO: 1148940 - RNA, 20 nt, Mycobacterium bovis subsp bovis AF2122/97
gccagcagcaaugcgguacc

SEQ ID NO: 1148941 - RNA, 20 nt, Mycobacterium bovis subsp bovis AF2122/97
gccagcaggaugaugaccgc

SEQ ID NO: 1148942 - RNA, 22 nt, Mycobacterium bovis subsp bovis AF2122/97
gccagcaggaacgccgugccgu

SEQ ID NO: 1148943 - RNA, 21 nt, Mycobacterium bovis subsp bovis AF2122/97
gccagcagcuucucguucguc

SEQ ID NO: 1148944 - RNA, 12 nt, Mycobacterium bovis subsp bovis AF2122/97
gccagcaucagc

SEQ ID NO: 1148945 - RNA, 20 nt, Mycobacterium bovis subsp bovis AF2122/97
gccagcaucggcagcagcgc

SEQ ID NO: 1148946 - RNA, 15 nt, Mycobacterium bovis subsp bovis AF2122/97
gccagcaugacaccg

SEQ ID NO: 1148947 - RNA, 17 nt, Mycobacterium bovis subsp bovis AF2122/97
gccagcagaaacaucga

SEQ ID NO: 1148948 - RNA, 18 nt, Mycobacterium bovis subsp bovis AF2122/97
gccagcaucagcccggcg

SEQ ID NO: 1148949 - RNA, 19 nt, Mycobacterium bovis subsp bovis AF2122/97
gccagcaucagcccggcgc

SEQ ID NO: 1148950 - RNA, 16 nt, Mycobacterium bovis subsp bovis AF2122/97
gccagcaucagcgcca

SEQ ID NO: 1148951 - RNA, 20 nt, Mycobacterium bovis subsp bovis AF2122/97
gccagcaucagcgccagcga

SEQ ID NO: 1148952 - RNA, 15 nt, Mycobacterium bovis subsp bovis AF2122/97
gccagcagggccacc

SEQ ID NO: 1148953 - RNA, 19 nt, Mycobacterium bovis subsp bovis AF2122/97
gccagcagggccaccacca

SEQ ID NO: 1148954 - RNA, 22 nt, Mycobacterium bovis subsp bovis AF2122/97
gccagcaggcggcugaacggca

SEQ ID NO: 1148955 - RNA, 13 nt, Mycobacterium bovis subsp bovis AF2122/97
gccagcaggcggc

SEQ ID NO: 1148956 - RNA, 18 nt, Mycobacterium bovis subsp bovis AF2122/97
gccagcaggcggcugaac

SEQ ID NO: 1148957 - RNA, 18 nt, Mycobacterium bovis subsp bovis AF2122/97
gccagcaaguacgcgucg

SEQ ID NO: 1148958 - RNA, 17 nt, Mycobacterium bovis subsp bovis AF2122/97
gccagcacccugaugug

SEQ ID NO: 1148959 - RNA, 12 nt, Mycobacterium bovis subsp bovis AF2122/97
gccagcaccggg

SEQ ID NO: 1148960 - RNA, 20 nt, Mycobacterium bovis subsp bovis AF2122/97
gccagcaccuagucgcggcc

SEQ ID NO: 1148961 - RNA, 17 nt, Mycobacterium bovis subsp bovis AF2122/97
gccagcacccgcagccg

SEQ ID NO: 1148962 - RNA, 20 nt, Mycobacterium bovis subsp bovis AF2122/97
gccagcacccgcagccgcga

SEQ ID NO: 1148963 - RNA, 17 nt, Mycobacterium bovis subsp bovis AF2122/97
gccagcaaugcccgcac

SEQ ID NO: 1148964 - RNA, 21 nt, Mycobacterium bovis subsp bovis AF2122/97
gccagcaacgguuggucgaac

SEQ ID NO: 1148965 - RNA, 17 nt, Mycobacterium bovis subsp bovis AF2122/97
gccagcaacugccgcac

SEQ ID NO: 1148966 - RNA, 23 nt, Mycobacterium bovis subsp bovis AF2122/97
gccacuucccccggguccgccgu

SEQ ID NO: 1148967 - RNA, 23 nt, Mycobacterium bovis subsp bovis AF2122/97
gccacuguugaagaagcccgaag

SEQ ID NO: 1148968 - RNA, 18 nt, Mycobacterium bovis subsp bovis AF2122/97
gccacuuggacgaacaca

SEQ ID NO: 1148969 - RNA, 22 nt, Mycobacterium bovis subsp bovis AF2122/97
gccacuuggacgaacacaccgg

SEQ ID NO: 1148970 - RNA, 17 nt, Mycobacterium bovis subsp bovis AF2122/97
gccacuugaugccgcac

SEQ ID NO: 1148971 - RNA, 19 nt, Mycobacterium bovis subsp bovis AF2122/97
gccacuugaugcucgaugc

SEQ ID NO: 1148972 - RNA, 15 nt, Mycobacterium bovis subsp bovis AF2122/97
gccaccccgcgcgcc

SEQ ID NO: 1148973 - RNA, 21 nt, Mycobacterium bovis subsp bovis AF2122/97
gccaccccgcgcgccagcucg

SEQ ID NO: 1148974 - RNA, 18 nt, Mycobacterium bovis subsp bovis AF2122/97
gccaccccugcgguccgc

SEQ ID NO: 1148975 - RNA, 21 nt, Mycobacterium bovis subsp bovis AF2122/97
gccaccccugcgguccgcugc

SEQ ID NO: 1148976 - RNA, 22 nt, Mycobacterium bovis subsp bovis AF2122/97
gccaccccugcgguccgcugcc

SEQ ID NO: 1148977 - RNA, 22 nt, Mycobacterium bovis subsp bovis AF2122/97
gccacccgaaugccuucgauga

SEQ ID NO: 1148978 - RNA, 13 nt, Mycobacterium bovis subsp bovis AF2122/97
gccacccgcaacu

SEQ ID NO: 1148979 - RNA, 18 nt, Mycobacterium bovis subsp bovis AF2122/97
gccaccccggguacgccg

SEQ ID NO: 1148980 - RNA, 13 nt, Mycobacterium bovis subsp bovis AF2122/97
gccacccgcgccg

SEQ ID NO: 1148981 - RNA, 13 nt, Mycobacterium bovis subsp bovis AF2122/97
gccacccgcgacg

SEQ ID NO: 1148982 - RNA, 14 nt, Mycobacterium bovis subsp bovis AF2122/97
gccacccggccagg

SEQ ID NO: 1148983 - RNA, 13 nt, Mycobacterium bovis subsp bovis AF2122/97
gccacccggccgc

SEQ ID NO: 1148984 - RNA, 14 nt, Mycobacterium bovis subsp bovis AF2122/97
gccacccggccgcg

SEQ ID NO: 1148985 - RNA, 15 nt, Mycobacterium bovis subsp bovis AF2122/97
gccacccggccgcgc

SEQ ID NO: 1148986 - RNA, 16 nt, Mycobacterium bovis subsp bovis AF2122/97
gccacccggccgcgcg

SEQ ID NO: 1148987 - RNA, 23 nt, Mycobacterium bovis subsp bovis AF2122/97
gccacccucgguguccucgaccg

SEQ ID NO: 1148988 - RNA, 17 nt, Mycobacterium bovis subsp bovis AF2122/97
gccacccuugccgccgg

SEQ ID NO: 1148989 - RNA, 14 nt, Mycobacterium bovis subsp bovis AF2122/97
gccaccgaccccgg

SEQ ID NO: 1148990 - RNA, 20 nt, Mycobacterium bovis subsp bovis AF2122/97
gccaccgaacgcggccaccg

SEQ ID NO: 1148991 - RNA, 17 nt, Mycobacterium bovis subsp bovis AF2122/97
gccaccgaagccgccgg

SEQ ID NO: 1148992 - RNA, 16 nt, Mycobacterium bovis subsp bovis AF2122/97
gccaccgaacgcggcc

SEQ ID NO: 1148993 - RNA, 18 nt, Mycobacterium bovis subsp bovis AF2122/97
gccaccgagucgaucacg

SEQ ID NO: 1148994 - RNA, 16 nt, Mycobacterium bovis subsp bovis AF2122/97
gccaccgcaucgccga

SEQ ID NO: 1148995 - RNA, 17 nt, Mycobacterium bovis subsp bovis AF2122/97
gccaccgcagacgccgu

SEQ ID NO: 1148996 - RNA, 13 nt, Mycobacterium bovis subsp bovis AF2122/97
gccaccgcaagaa

SEQ ID NO: 1148997 - RNA, 17 nt, Mycobacterium bovis subsp bovis AF2122/97
gccaccgcacguucggc

SEQ ID NO: 1148998 - RNA, 17 nt, Mycobacterium bovis subsp bovis AF2122/97
gccaccgcaucgccgaa

SEQ ID NO: 1148999 - RNA, 13 nt, Mycobacterium bovis subsp bovis AF2122/97
gccaccgccacca

SEQ ID NO: 1149000 - RNA, 17 nt, Mycobacterium bovis subsp bovis AF2122/97
gccaccgccagcgucga

SEQ ID NO: 1149001 - RNA, 18 nt, Mycobacterium bovis subsp bovis AF2122/97
gccaccgccagcgucgac

SEQ ID NO: 1149002 - RNA, 20 nt, Mycobacterium bovis subsp bovis AF2122/97
gccaccgccagcgucgacac

SEQ ID NO: 1149003 - RNA, 22 nt, Mycobacterium bovis subsp bovis AF2122/97
gccaccgagaucaugccggcga

SEQ ID NO: 1149004 - RNA, 13 nt, Mycobacterium bovis subsp bovis AF2122/97
gccaccgcacgca

SEQ ID NO: 1149005 - RNA, 14 nt, Mycobacterium bovis subsp bovis AF2122/97
gccaccgcacgcug

SEQ ID NO: 1149006 - RNA, 13 nt, Mycobacterium bovis subsp bovis AF2122/97
gccaccgcacguu

SEQ ID NO: 1149007 - RNA, 15 nt, Mycobacterium bovis subsp bovis AF2122/97
gccaccgcacguucg

SEQ ID NO: 1149008 - RNA, 21 nt, Mycobacterium bovis subsp bovis AF2122/97
gccaccgauaccgucagcgcc

SEQ ID NO: 1149009 - RNA, 14 nt, Mycobacterium bovis subsp bovis AF2122/97
gccaccgccgccgc

SEQ ID NO: 1149010 - RNA, 15 nt, Mycobacterium bovis subsp bovis AF2122/97
gccaccgccgccgcc

SEQ ID NO: 1149011 - RNA, 19 nt, Mycobacterium bovis subsp bovis AF2122/97
gccaccgccgccgccaccg

SEQ ID NO: 1149012 - RNA, 16 nt, Mycobacterium bovis subsp bovis AF2122/97
gccaccgccgccgccg

SEQ ID NO: 1149013 - RNA, 17 nt, Mycobacterium bovis subsp bovis AF2122/97
gccaccgccgccgccga

SEQ ID NO: 1149014 - RNA, 18 nt, Mycobacterium bovis subsp bovis AF2122/97
gccaccgccgccgccgac

SEQ ID NO: 1149015 - RNA, 17 nt, Mycobacterium bovis subsp bovis AF2122/97
gccaccgccgccggugu

SEQ ID NO: 1149016 - RNA, 14 nt, Mycobacterium bovis subsp bovis AF2122/97
gccaccgccgcugc

SEQ ID NO: 1149017 - RNA, 15 nt, Mycobacterium bovis subsp bovis AF2122/97
gccaccgccgcugcc

SEQ ID NO: 1149018 - RNA, 20 nt, Mycobacterium bovis subsp bovis AF2122/97
gccaccgccgcugccggugu

SEQ ID NO: 1149019 - RNA, 17 nt, Mycobacterium bovis subsp bovis AF2122/97
gccaccgccgaaaaccu

SEQ ID NO: 1149020 - RNA, 14 nt, Mycobacterium bovis subsp bovis AF2122/97
gccaccgccggcag

SEQ ID NO: 1149021 - RNA, 16 nt, Mycobacterium bovis subsp bovis AF2122/97
gccaccgccggcagca

SEQ ID NO: 1149022 - RNA, 19 nt, Mycobacterium bovis subsp bovis AF2122/97
gccaccgccggcagcaucg

SEQ ID NO: 1149023 - RNA, 21 nt, Mycobacterium bovis subsp bovis AF2122/97
gccaccgccggcagcaucggc

SEQ ID NO: 1149024 - RNA, 19 nt, Mycobacterium bovis subsp bovis AF2122/97
gccaccgggcgugcggcgg

SEQ ID NO: 1149025 - RNA, 20 nt, Mycobacterium bovis subsp bovis AF2122/97
gccaccgggcgugcggcggc

SEQ ID NO: 1149026 - RNA, 21 nt, Mycobacterium bovis subsp bovis AF2122/97
gccaccgggcgugcggcggcc

SEQ ID NO: 1149027 - RNA, 17 nt, Mycobacterium bovis subsp bovis AF2122/97
gccaccggguucaccga

SEQ ID NO: 1149028 - RNA, 15 nt, Mycobacterium bovis subsp bovis AF2122/97
gccaccgguaccgcc

SEQ ID NO: 1149029 - RNA, 17 nt, Mycobacterium bovis subsp bovis AF2122/97
gccaccgguaccgccgg

SEQ ID NO: 1149030 - RNA, 17 nt, Mycobacterium bovis subsp bovis AF2122/97
gccaccgguaccggcga

SEQ ID NO: 1149031 - RNA, 19 nt, Mycobacterium bovis subsp bovis AF2122/97
gccaccgguaccggcgacg

SEQ ID NO: 1149032 - RNA, 21 nt, Mycobacterium bovis subsp bovis AF2122/97
gccaccggcguuguugaccag

SEQ ID NO: 1149033 - RNA, 21 nt, Mycobacterium bovis subsp bovis AF2122/97
gccaccggcgucgacgucggc

SEQ ID NO: 1149034 - RNA, 14 nt, Mycobacterium bovis subsp bovis AF2122/97
gccaccggcggugc

SEQ ID NO: 1149035 - RNA, 13 nt, Mycobacterium bovis subsp bovis AF2122/97
gccaccggcgucg

SEQ ID NO: 1149036 - RNA, 15 nt, Mycobacterium bovis subsp bovis AF2122/97
gccaccggcgucgac

SEQ ID NO: 1149037 - RNA, 16 nt, Mycobacterium bovis subsp bovis AF2122/97
gccaccggcgucgacg

SEQ ID NO: 1149038 - RNA, 17 nt, Mycobacterium bovis subsp bovis AF2122/97
gccaccucggugcggaa

SEQ ID NO: 1149039 - RNA, 19 nt, Mycobacterium bovis subsp bovis AF2122/97
gccaccgucaugccgacga

SEQ ID NO: 1149040 - RNA, 17 nt, Mycobacterium bovis subsp bovis AF2122/97
gccaccgucaugccgac

SEQ ID NO: 1149041 - RNA, 14 nt, Mycobacterium bovis subsp bovis AF2122/97
gccaccgucaccgc

SEQ ID NO: 1149042 - RNA, 22 nt, Mycobacterium bovis subsp bovis AF2122/97
gccaccgucaccgccguugccg

SEQ ID NO: 1149043 - RNA, 13 nt, Mycobacterium bovis subsp bovis AF2122/97
gccaccgucagcg

SEQ ID NO: 1149044 - RNA, 19 nt, Mycobacterium bovis subsp bovis AF2122/97
gccaccgguuuggagcuca

SEQ ID NO: 1149045 - RNA, 22 nt, Mycobacterium bovis subsp bovis AF2122/97
gccaccgguuuggagcucaucg

SEQ ID NO: 1149046 - RNA, 23 nt, Mycobacterium bovis subsp bovis AF2122/97
gccaccgguuuggagcucaucga

SEQ ID NO: 1149047 - RNA, 14 nt, Mycobacterium bovis subsp bovis AF2122/97
gccaccggugccgg

SEQ ID NO: 1149048 - RNA, 16 nt, Mycobacterium bovis subsp bovis AF2122/97
gccaccggugccggcg

SEQ ID NO: 1149049 - RNA, 17 nt, Mycobacterium bovis subsp bovis AF2122/97
gccaccggugccggcga

SEQ ID NO: 1149050 - RNA, 19 nt, Mycobacterium bovis subsp bovis AF2122/97
gccaccggugccggcgacg

SEQ ID NO: 1149051 - RNA, 21 nt, Mycobacterium bovis subsp bovis AF2122/97
gccaccguaaacagcgcgccg

SEQ ID NO: 1149052 - RNA, 22 nt, Mycobacterium bovis subsp bovis AF2122/97
gccaccguaaacagcgcgccgg

SEQ ID NO: 1149053 - RNA, 17 nt, Mycobacterium bovis subsp bovis AF2122/97
gccaccguagccgaggg

SEQ ID NO: 1149054 - RNA, 18 nt, Mycobacterium bovis subsp bovis AF2122/97
gccaccgucacccaucga

SEQ ID NO: 1149055 - RNA, 13 nt, Mycobacterium bovis subsp bovis AF2122/97
gccaccgcggccg

SEQ ID NO: 1149056 - RNA, 15 nt, Mycobacterium bovis subsp bovis AF2122/97
gccaccgcggccgcg

SEQ ID NO: 1149057 - RNA, 19 nt, Mycobacterium bovis subsp bovis AF2122/97
gccaccgcggccgcggucg

SEQ ID NO: 1149058 - RNA, 14 nt, Mycobacterium bovis subsp bovis AF2122/97
gccaccgcggccug

SEQ ID NO: 1149059 - RNA, 12 nt, Mycobacterium bovis subsp bovis AF2122/97
gccaccgcggcc

SEQ ID NO: 1149060 - RNA, 12 nt, Mycobacterium bovis subsp bovis AF2122/97
gccaccgcgacg

SEQ ID NO: 1149061 - RNA, 16 nt, Mycobacterium bovis subsp bovis AF2122/97
gccaccgcgacgagcg

SEQ ID NO: 1149062 - RNA, 20 nt, Mycobacterium bovis subsp bovis AF2122/97
gccaccgcgggcggcaucgc

SEQ ID NO: 1149063 - RNA, 13 nt, Mycobacterium bovis subsp bovis AF2122/97
gccaccgcggcgu

SEQ ID NO: 1149064 - RNA, 15 nt, Mycobacterium bovis subsp bovis AF2122/97
gccaccgcaucgccg

SEQ ID NO: 1149065 - RNA, 15 nt, Mycobacterium bovis subsp bovis AF2122/97
gccaccgcgacggca

SEQ ID NO: 1149066 - RNA, 20 nt, Mycobacterium bovis subsp bovis AF2122/97
gccaccgcgguggcggcgag

SEQ ID NO: 1149067 - RNA, 16 nt, Mycobacterium bovis subsp bovis AF2122/97
gccaccgcugccggca

SEQ ID NO: 1149068 - RNA, 22 nt, Mycobacterium bovis subsp bovis AF2122/97
gccaccggaggugcgccgcggg

SEQ ID NO: 1149069 - RNA, 23 nt, Mycobacterium bovis subsp bovis AF2122/97
gccaccggaggugcgccgcgggc

SEQ ID NO: 1149070 - RNA, 15 nt, Mycobacterium bovis subsp bovis AF2122/97
gccaccggccgcggc

SEQ ID NO: 1149071 - RNA, 13 nt, Mycobacterium bovis subsp bovis AF2122/97
gccaccggcaccg

SEQ ID NO: 1149072 - RNA, 18 nt, Mycobacterium bovis subsp bovis AF2122/97
gccaccgcugccggcacg

SEQ ID NO: 1149073 - RNA, 20 nt, Mycobacterium bovis subsp bovis AF2122/97
gccaccggcgcgaccgcggc

SEQ ID NO: 1149074 - RNA, 16 nt, Mycobacterium bovis subsp bovis AF2122/97
gccaccggcgccaccg

SEQ ID NO: 1149075 - RNA, 18 nt, Mycobacterium bovis subsp bovis AF2122/97
gccaccggcgccaccggc

SEQ ID NO: 1149076 - RNA, 20 nt, Mycobacterium bovis subsp bovis AF2122/97
gccaccggcgccaccggcgc

SEQ ID NO: 1149077 - RNA, 21 nt, Mycobacterium bovis subsp bovis AF2122/97
gccaccggcgccaccggcgcc

SEQ ID NO: 1149078 - RNA, 21 nt, Mycobacterium bovis subsp bovis AF2122/97
gccaccggcgccgcccgcgcc

SEQ ID NO: 1149079 - RNA, 18 nt, Mycobacterium bovis subsp bovis AF2122/97
gccaccggcgcgaccgcg

SEQ ID NO: 1149080 - RNA, 13 nt, Mycobacterium bovis subsp bovis AF2122/97
gccaccggcgacc

SEQ ID NO: 1149081 - RNA, 16 nt, Mycobacterium bovis subsp bovis AF2122/97
gccaccggcgacgccg

SEQ ID NO: 1149082 - RNA, 19 nt, Mycobacterium bovis subsp bovis AF2122/97
gccaccggcgacgccggcc

SEQ ID NO: 1149083 - RNA, 20 nt, Mycobacterium bovis subsp bovis AF2122/97
gccaccggaauccuggccgc

SEQ ID NO: 1149084 - RNA, 15 nt, Mycobacterium bovis subsp bovis AF2122/97
gccaccggccggcgc

SEQ ID NO: 1149085 - RNA, 16 nt, Mycobacterium bovis subsp bovis AF2122/97
gccaccggccggcgca

SEQ ID NO: 1149086 - RNA, 21 nt, Mycobacterium bovis subsp bovis AF2122/97
gccacgcgucuucggucgcgg

SEQ ID NO: 1149087 - RNA, 21 nt, Mycobacterium bovis subsp bovis AF2122/97
gccacgcguuccuccagcagc

SEQ ID NO: 1149088 - RNA, 18 nt, Mycobacterium bovis subsp bovis AF2122/97
gccacgcugucccgcggg

SEQ ID NO: 1149089 - RNA, 22 nt, Mycobacterium bovis subsp bovis AF2122/97
gccacgcucggugcugcgccga

SEQ ID NO: 1149090 - RNA, 19 nt, Mycobacterium bovis subsp bovis AF2122/97
gccaccuuggacaccacga

SEQ ID NO: 1149091 - RNA, 12 nt, Mycobacterium bovis subsp bovis AF2122/97
gccacgccgccg

SEQ ID NO: 1149092 - RNA, 16 nt, Mycobacterium bovis subsp bovis AF2122/97
gccacgccgccgguga

SEQ ID NO: 1149093 - RNA, 19 nt, Mycobacterium bovis subsp bovis AF2122/97
gccacgccggucgcgguca

SEQ ID NO: 1149094 - RNA, 18 nt, Mycobacterium bovis subsp bovis AF2122/97
gccacgccugagccacca

SEQ ID NO: 1149095 - RNA, 15 nt, Mycobacterium bovis subsp bovis AF2122/97
gccaccugcuggccg

SEQ ID NO: 1149096 - RNA, 14 nt, Mycobacterium bovis subsp bovis AF2122/97
gccaccugugcgaa

SEQ ID NO: 1149097 - RNA, 19 nt, Mycobacterium bovis subsp bovis AF2122/97
gccaccugugcgaacagcg

SEQ ID NO: 1149098 - RNA, 16 nt, Mycobacterium bovis subsp bovis AF2122/97
gccaccuggucggcau

SEQ ID NO: 1149099 - RNA, 17 nt, Mycobacterium bovis subsp bovis AF2122/97
gccaccucuaccggugg

SEQ ID NO: 1149100 - RNA, 17 nt, Mycobacterium bovis subsp bovis AF2122/97
gccaccgucagcgcgac

SEQ ID NO: 1149101 - RNA, 13 nt, Mycobacterium bovis subsp bovis AF2122/97
gccaccucuucga

SEQ ID NO: 1149102 - RNA, 20 nt, Mycobacterium bovis subsp bovis AF2122/97
gccaccugacgugcggcgcg

SEQ ID NO: 1149103 - RNA, 16 nt, Mycobacterium bovis subsp bovis AF2122/97
gccacgucgaugugcg

SEQ ID NO: 1149104 - RNA, 13 nt, Mycobacterium bovis subsp bovis AF2122/97
gccacgucgacgg

SEQ ID NO: 1149105 - RNA, 16 nt, Mycobacterium bovis subsp bovis AF2122/97
gccacgucgacggucu

SEQ ID NO: 1149106 - RNA, 20 nt, Mycobacterium bovis subsp bovis AF2122/97
gccacguccaucaccggcgg

SEQ ID NO: 1149107 - RNA, 22 nt, Mycobacterium bovis subsp bovis AF2122/97
gccacguccaucaccggcggcc

SEQ ID NO: 1149108 - RNA, 20 nt, Mycobacterium bovis subsp bovis AF2122/97
gccacgucccaggacuccgg

SEQ ID NO: 1149109 - RNA, 18 nt, Mycobacterium bovis subsp bovis AF2122/97
gccacguccaucaccggc

SEQ ID NO: 1149110 - RNA, 19 nt, Mycobacterium bovis subsp bovis AF2122/97
gccacguccaucaccggcg

SEQ ID NO: 1149111 - RNA, 21 nt, Mycobacterium bovis subsp bovis AF2122/97
gccacguccugcccgucgucg

SEQ ID NO: 1149112 - RNA, 22 nt, Mycobacterium bovis subsp bovis AF2122/97
gccacguccugcccgucgucgg

SEQ ID NO: 1149113 - RNA, 14 nt, Mycobacterium bovis subsp bovis AF2122/97
gccacgucgccggc

SEQ ID NO: 1149114 - RNA, 15 nt, Mycobacterium bovis subsp bovis AF2122/97
gccacgucggcgaac

SEQ ID NO: 1149115 - RNA, 20 nt, Mycobacterium bovis subsp bovis AF2122/97
gccacgucgccggcuaccgc

SEQ ID NO: 1149116 - RNA, 14 nt, Mycobacterium bovis subsp bovis AF2122/97
gccacgucggcgaa

SEQ ID NO: 1149117 - RNA, 19 nt, Mycobacterium bovis subsp bovis AF2122/97
gccacguacuccaccgcgc

SEQ ID NO: 1149118 - RNA, 20 nt, Mycobacterium bovis subsp bovis AF2122/97
gccacguacuccaccgcgcc

SEQ ID NO: 1149119 - RNA, 16 nt, Mycobacterium bovis subsp bovis AF2122/97
gccacguacuuggacg

SEQ ID NO: 1149120 - RNA, 14 nt, Mycobacterium bovis subsp bovis AF2122/97
gccacguagcagcg

SEQ ID NO: 1149121 - RNA, 20 nt, Mycobacterium bovis subsp bovis AF2122/97
gccacguccaacucggcccg

SEQ ID NO: 1149122 - RNA, 16 nt, Mycobacterium bovis subsp bovis AF2122/97
gccacgguucgggcag

SEQ ID NO: 1149123 - RNA, 17 nt, Mycobacterium bovis subsp bovis AF2122/97
gccacgguucgggcagc

SEQ ID NO: 1149124 - RNA, 21 nt, Mycobacterium bovis subsp bovis AF2122/97
gccacgcuucuuccgcgcgcc

SEQ ID NO: 1149125 - RNA, 19 nt, Mycobacterium bovis subsp bovis AF2122/97
gccacggaaguaucgccgg

SEQ ID NO: 1149126 - RNA, 23 nt, Mycobacterium bovis subsp bovis AF2122/97
gccacggaaguaucgccggccgc

SEQ ID NO: 1149127 - RNA, 20 nt, Mycobacterium bovis subsp bovis AF2122/97
gccacuagcauugucgccgg

SEQ ID NO: 1149128 - RNA, 20 nt, Mycobacterium bovis subsp bovis AF2122/97
gccacguggucgagcaggcg

SEQ ID NO: 1149129 - RNA, 17 nt, Mycobacterium bovis subsp bovis AF2122/97
gccacguuguccgcgac

SEQ ID NO: 1149130 - RNA, 17 nt, Mycobacterium bovis subsp bovis AF2122/97
gccacguugaucccgaa

SEQ ID NO: 1149131 - RNA, 19 nt, Mycobacterium bovis subsp bovis AF2122/97
gccacguuacgcucgcggg

SEQ ID NO: 1149132 - RNA, 15 nt, Mycobacterium bovis subsp bovis AF2122/97
gccacguucgcggcc

SEQ ID NO: 1149133 - RNA, 20 nt, Mycobacterium bovis subsp bovis AF2122/97
gccacucccagccaacccgu

SEQ ID NO: 1149134 - RNA, 15 nt, Mycobacterium bovis subsp bovis AF2122/97
gccacucagcccgac

SEQ ID NO: 1149135 - RNA, 20 nt, Mycobacterium bovis subsp bovis AF2122/97
gccacuccaggagccgagga

SEQ ID NO: 1149136 - RNA, 23 nt, Mycobacterium bovis subsp bovis AF2122/97
gccacuccgguggccaacaccgc

SEQ ID NO: 1149137 - RNA, 19 nt, Mycobacterium bovis subsp bovis AF2122/97
gccacuccucggugugcuc

SEQ ID NO: 1149138 - RNA, 24 nt, Mycobacterium bovis subsp bovis AF2122/97
gccacuccucggugugcucgccga

SEQ ID NO: 1149139 - RNA, 16 nt, Mycobacterium bovis subsp bovis AF2122/97
gccacucgaucaccgg

SEQ ID NO: 1149140 - RNA, 22 nt, Mycobacterium bovis subsp bovis AF2122/97
gccaccacccaggccauaccgc

SEQ ID NO: 1149141 - RNA, 23 nt, Mycobacterium bovis subsp bovis AF2122/97
gccaccacggucaagccggcgcc

SEQ ID NO: 1149142 - RNA, 16 nt, Mycobacterium bovis subsp bovis AF2122/97
gccaccacgccgucga

SEQ ID NO: 1149143 - RNA, 15 nt, Mycobacterium bovis subsp bovis AF2122/97
gccaccacgcgccgc

SEQ ID NO: 1149144 - RNA, 17 nt, Mycobacterium bovis subsp bovis AF2122/97
gccaccacgcgccgcac

SEQ ID NO: 1149145 - RNA, 18 nt, Mycobacterium bovis subsp bovis AF2122/97
gccaccagacaacgccgu

SEQ ID NO: 1149146 - RNA, 21 nt, Mycobacterium bovis subsp bovis AF2122/97
gccaccagacaacgccgucga

SEQ ID NO: 1149147 - RNA, 13 nt, Mycobacterium bovis subsp bovis AF2122/97
gccaccagaaucc

SEQ ID NO: 1149148 - RNA, 20 nt, Mycobacterium bovis subsp bovis AF2122/97
gccaccagaaacaccgacga

SEQ ID NO: 1149149 - RNA, 17 nt, Mycobacterium bovis subsp bovis AF2122/97
gccaccaccgcugccgg

SEQ ID NO: 1149150 - RNA, 22 nt, Mycobacterium bovis subsp bovis AF2122/97
gccaccaccgcugccggcgccg

SEQ ID NO: 1149151 - RNA, 17 nt, Mycobacterium bovis subsp bovis AF2122/97
gccaccaccgcgccguc

SEQ ID NO: 1149152 - RNA, 14 nt, Mycobacterium bovis subsp bovis AF2122/97
gccaccaccgcgcc

SEQ ID NO: 1149153 - RNA, 22 nt, Mycobacterium bovis subsp bovis AF2122/97
gccaccaccgugaagcccuggc

SEQ ID NO: 1149154 - RNA, 19 nt, Mycobacterium bovis subsp bovis AF2122/97
gccaccaccuccgcgucgg

SEQ ID NO: 1149155 - RNA, 20 nt, Mycobacterium bovis subsp bovis AF2122/97
gccaccaccuccgcgucgga

SEQ ID NO: 1149156 - RNA, 14 nt, Mycobacterium bovis subsp bovis AF2122/97
gccaccaccggcgc

SEQ ID NO: 1149157 - RNA, 20 nt, Mycobacterium bovis subsp bovis AF2122/97
gccaccaccggcgccuccgg

SEQ ID NO: 1149158 - RNA, 13 nt, Mycobacterium bovis subsp bovis AF2122/97
gccaccaccucgg

SEQ ID NO: 1149159 - RNA, 20 nt, Mycobacterium bovis subsp bovis AF2122/97
gccaccacgcaugcgcgcgc

SEQ ID NO: 1149160 - RNA, 15 nt, Mycobacterium bovis subsp bovis AF2122/97
gccaccaccacggcc

SEQ ID NO: 1149161 - RNA, 14 nt, Mycobacterium bovis subsp bovis AF2122/97
gccaccaccgccga

SEQ ID NO: 1149162 - RNA, 22 nt, Mycobacterium bovis subsp bovis AF2122/97
gccaccaccgccgccggcaccg

SEQ ID NO: 1149163 - RNA, 17 nt, Mycobacterium bovis subsp bovis AF2122/97
gccaccacccggcgcag

SEQ ID NO: 1149164 - RNA, 23 nt, Mycobacterium bovis subsp bovis AF2122/97
gccaccacccaacagcccaccgg

SEQ ID NO: 1149165 - RNA, 17 nt, Mycobacterium bovis subsp bovis AF2122/97
gccaccacccaggccau

SEQ ID NO: 1149166 - RNA, 20 nt, Mycobacterium bovis subsp bovis AF2122/97
gccaccaccagggcaacggc

SEQ ID NO: 1149167 - RNA, 22 nt, Mycobacterium bovis subsp bovis AF2122/97
gccacagcucgccgugaccagg

SEQ ID NO: 1149168 - RNA, 18 nt, Mycobacterium bovis subsp bovis AF2122/97
gccaccaacucggcgacc

SEQ ID NO: 1149169 - RNA, 23 nt, Mycobacterium bovis subsp bovis AF2122/97
gccaccaaccucaucgcggucgc

SEQ ID NO: 1149170 - RNA, 18 nt, Mycobacterium bovis subsp bovis AF2122/97
gccaccagggccaccgcg

SEQ ID NO: 1149171 - RNA, 21 nt, Mycobacterium bovis subsp bovis AF2122/97
gccaccagggccaccgcgccg

SEQ ID NO: 1149172 - RNA, 16 nt, Mycobacterium bovis subsp bovis AF2122/97
gccaccagcugcgcga

SEQ ID NO: 1149173 - RNA, 16 nt, Mycobacterium bovis subsp bovis AF2122/97
gccaccagcuggcgau

SEQ ID NO: 1149174 - RNA, 16 nt, Mycobacterium bovis subsp bovis AF2122/97
gccaccagcgcccggc

SEQ ID NO: 1149175 - RNA, 17 nt, Mycobacterium bovis subsp bovis AF2122/97
gccaccagcgcccggcc

SEQ ID NO: 1149176 - RNA, 17 nt, Mycobacterium bovis subsp bovis AF2122/97
gccaccagcaccgccgc

SEQ ID NO: 1149177 - RNA, 22 nt, Mycobacterium bovis subsp bovis AF2122/97
gccaccagaucgcacaccaaca

SEQ ID NO: 1149178 - RNA, 22 nt, Mycobacterium bovis subsp bovis AF2122/97
gccaccagcgcacgcucggcac

SEQ ID NO: 1149179 - RNA, 16 nt, Mycobacterium bovis subsp bovis AF2122/97
gccaccagcccgauga

SEQ ID NO: 1149180 - RNA, 15 nt, Mycobacterium bovis subsp bovis AF2122/97
gccaccagcgacgac

SEQ ID NO: 1149181 - RNA, 19 nt, Mycobacterium bovis subsp bovis AF2122/97
gccacccccaaccgccggc

SEQ ID NO: 1149182 - RNA, 22 nt, Mycobacterium bovis subsp bovis AF2122/97
gccaccccgagcucaccaaggu

SEQ ID NO: 1149183 - RNA, 16 nt, Mycobacterium bovis subsp bovis AF2122/97
gccacccagcacgcgc

SEQ ID NO: 1149184 - RNA, 20 nt, Mycobacterium bovis subsp bovis AF2122/97
gccacccacauggcggcccg

SEQ ID NO: 1149185 - RNA, 13 nt, Mycobacterium bovis subsp bovis AF2122/97
gccacccaccgac

SEQ ID NO: 1149186 - RNA, 18 nt, Mycobacterium bovis subsp bovis AF2122/97
gccacccagaaugacauc

SEQ ID NO: 1149187 - RNA, 17 nt, Mycobacterium bovis subsp bovis AF2122/97
gccaccaggggaccgcg

SEQ ID NO: 1149188 - RNA, 20 nt, Mycobacterium bovis subsp bovis AF2122/97
gccaccaggggaccgcggcg

SEQ ID NO: 1149189 - RNA, 22 nt, Mycobacterium bovis subsp bovis AF2122/97
gccaccaggggaccgcggcgcg

SEQ ID NO: 1149190 - RNA, 16 nt, Mycobacterium bovis subsp bovis AF2122/97
gccaccaucgccgccg

SEQ ID NO: 1149191 - RNA, 19 nt, Mycobacterium bovis subsp bovis AF2122/97
gccaccaucgccgccguug

SEQ ID NO: 1149192 - RNA, 19 nt, Mycobacterium bovis subsp bovis AF2122/97
gccaccaucuggauggcgc

SEQ ID NO: 1149193 - RNA, 17 nt, Mycobacterium bovis subsp bovis AF2122/97
gccaccaucguugccgg

SEQ ID NO: 1149194 - RNA, 16 nt, Mycobacterium bovis subsp bovis AF2122/97
gcagucgcacggugcc

SEQ ID NO: 1149195 - RNA, 21 nt, Mycobacterium bovis subsp bovis AF2122/97
gcagucgcacggugccgccgu

SEQ ID NO: 1149196 - RNA, 22 nt, Mycobacterium bovis subsp bovis AF2122/97
gcagucgcacggugccgccguc

SEQ ID NO: 1149197 - RNA, 20 nt, Mycobacterium bovis subsp bovis AF2122/97
gcagucgauuucggcggcga

SEQ ID NO: 1149198 - RNA, 15 nt, Mycobacterium bovis subsp bovis AF2122/97
gcagucgggcagcgc

SEQ ID NO: 1149199 - RNA, 15 nt, Mycobacterium bovis subsp bovis AF2122/97
gcagucgcgagguga

SEQ ID NO: 1149200 - RNA, 21 nt, Mycobacterium bovis subsp bovis AF2122/97
gcagucgcgguaccaucaccg

SEQ ID NO: 1149201 - RNA, 17 nt, Mycobacterium bovis subsp bovis AF2122/97
gcaguccaccgcgcggc

SEQ ID NO: 1149202 - RNA, 19 nt, Mycobacterium bovis subsp bovis AF2122/97
gcaguccaccgcgcggcgc

SEQ ID NO: 1149203 - RNA, 12 nt, Mycobacterium bovis subsp bovis AF2122/97
gcaguccacgag

SEQ ID NO: 1149204 - RNA, 15 nt, Mycobacterium bovis subsp bovis AF2122/97
gcagucaggccuagc

SEQ ID NO: 1149205 - RNA, 14 nt, Mycobacterium bovis subsp bovis AF2122/97
gcaguccgggugua

SEQ ID NO: 1149206 - RNA, 20 nt, Mycobacterium bovis subsp bovis AF2122/97
gcaguccgguuacgcucgcg

SEQ ID NO: 1149207 - RNA, 16 nt, Mycobacterium bovis subsp bovis AF2122/97
gccaacuggucgccaa

SEQ ID NO: 1149208 - RNA, 18 nt, Mycobacterium bovis subsp bovis AF2122/97
gccaacuugacccgggga

SEQ ID NO: 1149209 - RNA, 23 nt, Mycobacterium bovis subsp bovis AF2122/97
gccaacuuggcggccagccgcuc

SEQ ID NO: 1149210 - RNA, 14 nt, Mycobacterium bovis subsp bovis AF2122/97
gccaagacgucggc

SEQ ID NO: 1149211 - RNA, 15 nt, Mycobacterium bovis subsp bovis AF2122/97
gccaagaucgggugg

SEQ ID NO: 1149212 - RNA, 19 nt, Mycobacterium bovis subsp bovis AF2122/97
gccaagauggcgcgcuggg

SEQ ID NO: 1149213 - RNA, 13 nt, Mycobacterium bovis subsp bovis AF2122/97
gcagugaccucgu

SEQ ID NO: 1149214 - RNA, 15 nt, Mycobacterium bovis subsp bovis AF2122/97
gccaacucgaccgac

SEQ ID NO: 1149215 - RNA, 14 nt, Mycobacterium bovis subsp bovis AF2122/97
gcagugacgccucg

SEQ ID NO: 1149216 - RNA, 17 nt, Mycobacterium bovis subsp bovis AF2122/97
gcagugacgccucgaca

SEQ ID NO: 1149217 - RNA, 15 nt, Mycobacterium bovis subsp bovis AF2122/97
gcagugacguuccgc

SEQ ID NO: 1149218 - RNA, 16 nt, Mycobacterium bovis subsp bovis AF2122/97
gccaacucaggccggu

SEQ ID NO: 1149219 - RNA, 18 nt, Mycobacterium bovis subsp bovis AF2122/97
gccaacucaggccgguac

SEQ ID NO: 1149220 - RNA, 15 nt, Mycobacterium bovis subsp bovis AF2122/97
gccaacuccagcacc

SEQ ID NO: 1149221 - RNA, 18 nt, Mycobacterium bovis subsp bovis AF2122/97
gccaacuccagcacccgc

SEQ ID NO: 1149222 - RNA, 19 nt, Mycobacterium bovis subsp bovis AF2122/97
gcagugaaauugccgccgc

SEQ ID NO: 1149223 - RNA, 14 nt, Mycobacterium bovis subsp bovis AF2122/97
gcagugaccgcugg

SEQ ID NO: 1149224 - RNA, 19 nt, Mycobacterium bovis subsp bovis AF2122/97
gccacaaaggcgccggguc

SEQ ID NO: 1149225 - RNA, 14 nt, Mycobacterium bovis subsp bovis AF2122/97
gccaauugcgccgc

SEQ ID NO: 1149226 - RNA, 16 nt, Mycobacterium bovis subsp bovis AF2122/97
gccaauugcgccgcca

SEQ ID NO: 1149227 - RNA, 18 nt, Mycobacterium bovis subsp bovis AF2122/97
gccaauggugggcgagcu

SEQ ID NO: 1149228 - RNA, 16 nt, Mycobacterium bovis subsp bovis AF2122/97
gccaauggccgcggca

SEQ ID NO: 1149229 - RNA, 13 nt, Mycobacterium bovis subsp bovis AF2122/97
gccacagccguau

SEQ ID NO: 1149230 - RNA, 15 nt, Mycobacterium bovis subsp bovis AF2122/97
gccacagcgacagcg

SEQ ID NO: 1149231 - RNA, 15 nt, Mycobacterium bovis subsp bovis AF2122/97
gccacagcccggcgg

SEQ ID NO: 1149232 - RNA, 22 nt, Mycobacterium bovis subsp bovis AF2122/97
gccacagcccggcggcggucug

SEQ ID NO: 1149233 - RNA, 17 nt, Mycobacterium bovis subsp bovis AF2122/97
gccacagccgaccucga

SEQ ID NO: 1149234 - RNA, 21 nt, Mycobacterium bovis subsp bovis AF2122/97
gccacagcagcguugacggcu

SEQ ID NO: 1149235 - RNA, 16 nt, Mycobacterium bovis subsp bovis AF2122/97
gccacaaccucgucgu

SEQ ID NO: 1149236 - RNA, 21 nt, Mycobacterium bovis subsp bovis AF2122/97
gccacaacgccucgauggcgg

SEQ ID NO: 1149237 - RNA, 15 nt, Mycobacterium bovis subsp bovis AF2122/97
gccacaacggcggcg

SEQ ID NO: 1149238 - RNA, 16 nt, Mycobacterium bovis subsp bovis AF2122/97
gccacaacggcggcgc

SEQ ID NO: 1149239 - RNA, 17 nt, Mycobacterium bovis subsp bovis AF2122/97
gccacaacggcggcgca

SEQ ID NO: 1149240 - RNA, 18 nt, Mycobacterium bovis subsp bovis AF2122/97
gccacaacggcggcgcag

SEQ ID NO: 1149241 - RNA, 19 nt, Mycobacterium bovis subsp bovis AF2122/97
gccacaacggcggcgcagu

SEQ ID NO: 1149242 - RNA, 21 nt, Mycobacterium bovis subsp bovis AF2122/97
gccaagggugcuugucgccgc

SEQ ID NO: 1149243 - RNA, 14 nt, Mycobacterium bovis subsp bovis AF2122/97
gccaagggccggau

SEQ ID NO: 1149244 - RNA, 22 nt, Mycobacterium bovis subsp bovis AF2122/97
gccaaggcuuccuccgacgcga

SEQ ID NO: 1149245 - RNA, 14 nt, Mycobacterium bovis subsp bovis AF2122/97
gccaagguggccac

SEQ ID NO: 1149246 - RNA, 17 nt, Mycobacterium bovis subsp bovis AF2122/97
gccaagguggccaccaa

SEQ ID NO: 1149247 - RNA, 17 nt, Mycobacterium bovis subsp bovis AF2122/97
gccaagacgucggcgug

SEQ ID NO: 1149248 - RNA, 15 nt, Mycobacterium bovis subsp bovis AF2122/97
gccaaguacgcgacc

SEQ ID NO: 1149249 - RNA, 19 nt, Mycobacterium bovis subsp bovis AF2122/97
gccaaguacgcgaccgcga

SEQ ID NO: 1149250 - RNA, 20 nt, Mycobacterium bovis subsp bovis AF2122/97
gccaaguacgcgaccgcgau

SEQ ID NO: 1149251 - RNA, 15 nt, Mycobacterium bovis subsp bovis AF2122/97
gccaaugcugcaggu

SEQ ID NO: 1149252 - RNA, 15 nt, Mycobacterium bovis subsp bovis AF2122/97
gccaaguugcagcgg

SEQ ID NO: 1149253 - RNA, 16 nt, Mycobacterium bovis subsp bovis AF2122/97
gccaaguacugggcca

SEQ ID NO: 1149254 - RNA, 16 nt, Mycobacterium bovis subsp bovis AF2122/97
gcccgaucaccaucca

SEQ ID NO: 1149255 - RNA, 19 nt, Mycobacterium bovis subsp bovis AF2122/97
gcccgaucaccauccagcc

SEQ ID NO: 1149256 - RNA, 22 nt, Mycobacterium bovis subsp bovis AF2122/97
gcccgaucaccauccagcccau

SEQ ID NO: 1149257 - RNA, 20 nt, Mycobacterium bovis subsp bovis AF2122/97
gcccgaguuaaacgcagcgg

SEQ ID NO: 1149258 - RNA, 23 nt, Mycobacterium bovis subsp bovis AF2122/97
gcccgaguugaaggugccggcgu

SEQ ID NO: 1149259 - RNA, 19 nt, Mycobacterium bovis subsp bovis AF2122/97
gcccgaguuguggacgccc

SEQ ID NO: 1149260 - RNA, 20 nt, Mycobacterium bovis subsp bovis AF2122/97
gcccgaguuguggacgcccg

SEQ ID NO: 1149261 - RNA, 23 nt, Mycobacterium bovis subsp bovis AF2122/97
gcccgaguuguucgugccggcgu

SEQ ID NO: 1149262 - RNA, 16 nt, Mycobacterium bovis subsp bovis AF2122/97
gcccgaguuugaccag

SEQ ID NO: 1149263 - RNA, 22 nt, Mycobacterium bovis subsp bovis AF2122/97
gcccgaguuugcgauacccacc

SEQ ID NO: 1149264 - RNA, 19 nt, Mycobacterium bovis subsp bovis AF2122/97
gcccgagucucgucgggua

SEQ ID NO: 1149265 - RNA, 22 nt, Mycobacterium bovis subsp bovis AF2122/97
gcccgauaaaugccgcgugggc

SEQ ID NO: 1149266 - RNA, 23 nt, Mycobacterium bovis subsp bovis AF2122/97
gcccgauaaaugccgcgugggca

SEQ ID NO: 1149267 - RNA, 23 nt, Mycobacterium bovis subsp bovis AF2122/97
gcccgauccggaucccaccaccg

SEQ ID NO: 1149268 - RNA, 22 nt, Mycobacterium bovis subsp bovis AF2122/97
gcccgagugugaaucgcacgac

SEQ ID NO: 1149269 - RNA, 21 nt, Mycobacterium bovis subsp bovis AF2122/97
gcccgaucggcaacccgcacc

SEQ ID NO: 1149270 - RNA, 16 nt, Mycobacterium bovis subsp bovis AF2122/97
gcccgaucgcggcccg

SEQ ID NO: 1149271 - RNA, 21 nt, Mycobacterium bovis subsp bovis AF2122/97
gcccgaucgauaucggcaauc

SEQ ID NO: 1149272 - RNA, 21 nt, Mycobacterium bovis subsp bovis AF2122/97
gcccgaucgaccgcuggaucg

SEQ ID NO: 1149273 - RNA, 12 nt, Mycobacterium bovis subsp bovis AF2122/97
gcccgaucccga

SEQ ID NO: 1149274 - RNA, 13 nt, Mycobacterium bovis subsp bovis AF2122/97
gcccgaucccgau

SEQ ID NO: 1149275 - RNA, 22 nt, Mycobacterium bovis subsp bovis AF2122/97
gcccgaucgaagaaacggcguc

SEQ ID NO: 1149276 - RNA, 13 nt, Mycobacterium bovis subsp bovis AF2122/97
gccccuccgcgcc

SEQ ID NO: 1149277 - RNA, 12 nt, Mycobacterium bovis subsp bovis AF2122/97
gccccucgucgu

SEQ ID NO: 1149278 - RNA, 17 nt, Mycobacterium bovis subsp bovis AF2122/97
gcccgaggugccggggc

SEQ ID NO: 1149279 - RNA, 18 nt, Mycobacterium bovis subsp bovis AF2122/97
gcccgaggugccggggcc

SEQ ID NO: 1149280 - RNA, 19 nt, Mycobacterium bovis subsp bovis AF2122/97
gccccuucaaagcggccuc

SEQ ID NO: 1149281 - RNA, 21 nt, Mycobacterium bovis subsp bovis AF2122/97
gcccgaggcggguacaccacg

SEQ ID NO: 1149282 - RNA, 14 nt, Mycobacterium bovis subsp bovis AF2122/97
gccccugcgcggcc

SEQ ID NO: 1149283 - RNA, 16 nt, Mycobacterium bovis subsp bovis AF2122/97
gccccugcgcggccac

SEQ ID NO: 1149284 - RNA, 19 nt, Mycobacterium bovis subsp bovis AF2122/97
gccccugucaacgccgcgg

SEQ ID NO: 1149285 - RNA, 21 nt, Mycobacterium bovis subsp bovis AF2122/97
gccccugucaacgccgcgguc

SEQ ID NO: 1149286 - RNA, 15 nt, Mycobacterium bovis subsp bovis AF2122/97
gccccuggccgccgc

SEQ ID NO: 1149287 - RNA, 16 nt, Mycobacterium bovis subsp bovis AF2122/97
gccccuggccgccgca

SEQ ID NO: 1149288 - RNA, 16 nt, Mycobacterium bovis subsp bovis AF2122/97
gcccgcaucgccucga

SEQ ID NO: 1149289 - RNA, 15 nt, Mycobacterium bovis subsp bovis AF2122/97
gcccgcauccgcacc

SEQ ID NO: 1149290 - RNA, 18 nt, Mycobacterium bovis subsp bovis AF2122/97
gcccgcauccgcaccgaa

SEQ ID NO: 1149291 - RNA, 22 nt, Mycobacterium bovis subsp bovis AF2122/97
gcccgcauccgcaccgaaacca

SEQ ID NO: 1149292 - RNA, 22 nt, Mycobacterium bovis subsp bovis AF2122/97
gcccgcaucgcggcaucgacgc

SEQ ID NO: 1149293 - RNA, 13 nt, Mycobacterium bovis subsp bovis AF2122/97
gcccgcaggacgc

SEQ ID NO: 1149294 - RNA, 16 nt, Mycobacterium bovis subsp bovis AF2122/97
gcccgcaggacgcugc

SEQ ID NO: 1149295 - RNA, 19 nt, Mycobacterium bovis subsp bovis AF2122/97
gcccgcaggacgcugccgg

SEQ ID NO: 1149296 - RNA, 16 nt, Mycobacterium bovis subsp bovis AF2122/97
gcccgcagggccgccg

SEQ ID NO: 1149297 - RNA, 15 nt, Mycobacterium bovis subsp bovis AF2122/97
gcccgcauugaucuc

SEQ ID NO: 1149298 - RNA, 20 nt, Mycobacterium bovis subsp bovis AF2122/97
gcccgccacaacggcggcgc

SEQ ID NO: 1149299 - RNA, 15 nt, Mycobacterium bovis subsp bovis AF2122/97
gcccgccagcgaucc

SEQ ID NO: 1149300 - RNA, 16 nt, Mycobacterium bovis subsp bovis AF2122/97
gcccgccagcgccgcc

SEQ ID NO: 1149301 - RNA, 21 nt, Mycobacterium bovis subsp bovis AF2122/97
gcccgcccaccucgaucgcgc

SEQ ID NO: 1149302 - RNA, 22 nt, Mycobacterium bovis subsp bovis AF2122/97
gcccgcccaccucgaucgcgcc

SEQ ID NO: 1149303 - RNA, 17 nt, Mycobacterium bovis subsp bovis AF2122/97
gcccgccaucagcccgg

SEQ ID NO: 1149304 - RNA, 21 nt, Mycobacterium bovis subsp bovis AF2122/97
gcccgccaucauggcggcccg

SEQ ID NO: 1149305 - RNA, 13 nt, Mycobacterium bovis subsp bovis AF2122/97
gcccgaucguagg

SEQ ID NO: 1149306 - RNA, 23 nt, Mycobacterium bovis subsp bovis AF2122/97
gcccgaugaggacauccggcgcc

SEQ ID NO: 1149307 - RNA, 14 nt, Mycobacterium bovis subsp bovis AF2122/97
gcccgaugaucccg

SEQ ID NO: 1149308 - RNA, 20 nt, Mycobacterium bovis subsp bovis AF2122/97
gcccgaugaucccgccaccg

SEQ ID NO: 1149309 - RNA, 20 nt, Mycobacterium bovis subsp bovis AF2122/97
gcccgaugcccucgauggcc

SEQ ID NO: 1149310 - RNA, 19 nt, Mycobacterium bovis subsp bovis AF2122/97
gcccgcaaacagucggaga

SEQ ID NO: 1149311 - RNA, 15 nt, Mycobacterium bovis subsp bovis AF2122/97
gcccgauucagcgcc

SEQ ID NO: 1149312 - RNA, 17 nt, Mycobacterium bovis subsp bovis AF2122/97
gcccgauucagcgcccc

SEQ ID NO: 1149313 - RNA, 15 nt, Mycobacterium bovis subsp bovis AF2122/97
gcccgaugcgccacc

SEQ ID NO: 1149314 - RNA, 19 nt, Mycobacterium bovis subsp bovis AF2122/97
gcccgaugguacccgcgcc

SEQ ID NO: 1149315 - RNA, 16 nt, Mycobacterium bovis subsp bovis AF2122/97
gcccgauggugccgac

SEQ ID NO: 1149316 - RNA, 17 nt, Mycobacterium bovis subsp bovis AF2122/97
gcccgaugguggugccg

SEQ ID NO: 1149317 - RNA, 20 nt, Mycobacterium bovis subsp bovis AF2122/97
gcccgaugucgucgacgagg

SEQ ID NO: 1149318 - RNA, 20 nt, Mycobacterium bovis subsp bovis AF2122/97
gcccgcaccacaccgugggc

SEQ ID NO: 1149319 - RNA, 21 nt, Mycobacterium bovis subsp bovis AF2122/97
gcccgcaccacaccgugggcg

SEQ ID NO: 1149320 - RNA, 17 nt, Mycobacterium bovis subsp bovis AF2122/97
gcccgcccagcccggcg

SEQ ID NO: 1149321 - RNA, 14 nt, Mycobacterium bovis subsp bovis AF2122/97
gcccgccccgcgcc

SEQ ID NO: 1149322 - RNA, 14 nt, Mycobacterium bovis subsp bovis AF2122/97
gcccgccggccccg

SEQ ID NO: 1149323 - RNA, 15 nt, Mycobacterium bovis subsp bovis AF2122/97
gcccgccggccccgc

SEQ ID NO: 1149324 - RNA, 18 nt, Mycobacterium bovis subsp bovis AF2122/97
gcccgccggccccgccgg

SEQ ID NO: 1149325 - RNA, 19 nt, Mycobacterium bovis subsp bovis AF2122/97
gcccgccggccccgccggc

SEQ ID NO: 1149326 - RNA, 20 nt, Mycobacterium bovis subsp bovis AF2122/97
gcccgccggccccgccggcc

SEQ ID NO: 1149327 - RNA, 12 nt, Mycobacterium bovis subsp bovis AF2122/97
gcccgcgaucgg

SEQ ID NO: 1149328 - RNA, 14 nt, Mycobacterium bovis subsp bovis AF2122/97
gcccgcgcggcgca

SEQ ID NO: 1149329 - RNA, 22 nt, Mycobacterium bovis subsp bovis AF2122/97
gcccgcgaauacgaggacgacg

SEQ ID NO: 1149330 - RNA, 15 nt, Mycobacterium bovis subsp bovis AF2122/97
gcccgccggcaaccg

SEQ ID NO: 1149331 - RNA, 19 nt, Mycobacterium bovis subsp bovis AF2122/97
gcccgccggugaucggcgg

SEQ ID NO: 1149332 - RNA, 21 nt, Mycobacterium bovis subsp bovis AF2122/97
gcccgccggugaucggcggca

SEQ ID NO: 1149333 - RNA, 23 nt, Mycobacterium bovis subsp bovis AF2122/97
gcccgccggugaucggcggcaac

SEQ ID NO: 1149334 - RNA, 17 nt, Mycobacterium bovis subsp bovis AF2122/97
gcccgcgaacgaucccg

SEQ ID NO: 1149335 - RNA, 15 nt, Mycobacterium bovis subsp bovis AF2122/97
gcccgcggccgccag

SEQ ID NO: 1149336 - RNA, 15 nt, Mycobacterium bovis subsp bovis AF2122/97
gcccgcgguccggcg

SEQ ID NO: 1149337 - RNA, 18 nt, Mycobacterium bovis subsp bovis AF2122/97
gcccgcgguccggcgaaa

SEQ ID NO: 1149338 - RNA, 22 nt, Mycobacterium bovis subsp bovis AF2122/97
gcccgcgguuugcacgucacgc

SEQ ID NO: 1149339 - RNA, 22 nt, Mycobacterium bovis subsp bovis AF2122/97
gcccgcgggcaguggcagcccg

SEQ ID NO: 1149340 - RNA, 13 nt, Mycobacterium bovis subsp bovis AF2122/97
gcccgcggucgcg

SEQ ID NO: 1149341 - RNA, 17 nt, Mycobacterium bovis subsp bovis AF2122/97
gcccgcggugaccaccc

SEQ ID NO: 1149342 - RNA, 23 nt, Mycobacterium bovis subsp bovis AF2122/97
gcccgcgucuacgucguccagca

SEQ ID NO: 1149343 - RNA, 19 nt, Mycobacterium bovis subsp bovis AF2122/97
gcccgcguucucggcaccc

SEQ ID NO: 1149344 - RNA, 15 nt, Mycobacterium bovis subsp bovis AF2122/97
gcccgcgcugccgac

SEQ ID NO: 1149345 - RNA, 12 nt, Mycobacterium bovis subsp bovis AF2122/97
gcccgcggcgga

SEQ ID NO: 1149346 - RNA, 13 nt, Mycobacterium bovis subsp bovis AF2122/97
gcccgcgcggcgg

SEQ ID NO: 1149347 - RNA, 12 nt, Mycobacterium bovis subsp bovis AF2122/97
gcccgcgcggug

SEQ ID NO: 1149348 - RNA, 22 nt, Mycobacterium bovis subsp bovis AF2122/97
gcccgcgcgguggcggucgcca

SEQ ID NO: 1149349 - RNA, 21 nt, Mycobacterium bovis subsp bovis AF2122/97
gcccgcgcguacccgaucagc

SEQ ID NO: 1149350 - RNA, 17 nt, Mycobacterium bovis subsp bovis AF2122/97
gcccgcgcuagcgguug

SEQ ID NO: 1149351 - RNA, 12 nt, Mycobacterium bovis subsp bovis AF2122/97
gcccgcgcucgc

SEQ ID NO: 1149352 - RNA, 13 nt, Mycobacterium bovis subsp bovis AF2122/97
gcccgcgcucgca

SEQ ID NO: 1149353 - RNA, 15 nt, Mycobacterium bovis subsp bovis AF2122/97
gcccgcgcucgcacc

SEQ ID NO: 1149354 - RNA, 14 nt, Mycobacterium bovis subsp bovis AF2122/97
gcccgcgacaucgg

SEQ ID NO: 1149355 - RNA, 21 nt, Mycobacterium bovis subsp bovis AF2122/97
gccccggccuuuacccgggcg

SEQ ID NO: 1149356 - RNA, 15 nt, Mycobacterium bovis subsp bovis AF2122/97
gccccggcgcggcca

SEQ ID NO: 1149357 - RNA, 17 nt, Mycobacterium bovis subsp bovis AF2122/97
gccccggcgcggccagc

SEQ ID NO: 1149358 - RNA, 14 nt, Mycobacterium bovis subsp bovis AF2122/97
gccccggcggcggc

SEQ ID NO: 1149359 - RNA, 18 nt, Mycobacterium bovis subsp bovis AF2122/97
gccccggcggcggcggcc

SEQ ID NO: 1149360 - RNA, 20 nt, Mycobacterium bovis subsp bovis AF2122/97
gccccggcggcggcggcccg

SEQ ID NO: 1149361 - RNA, 17 nt, Mycobacterium bovis subsp bovis AF2122/97
gccccgggggaagcgcc

SEQ ID NO: 1149362 - RNA, 18 nt, Mycobacterium bovis subsp bovis AF2122/97
gccccggggugcccccgg

SEQ ID NO: 1149363 - RNA, 14 nt, Mycobacterium bovis subsp bovis AF2122/97
gccccggucggcga

SEQ ID NO: 1149364 - RNA, 15 nt, Mycobacterium bovis subsp bovis AF2122/97
gccccggugccgacc

SEQ ID NO: 1149365 - RNA, 19 nt, Mycobacterium bovis subsp bovis AF2122/97
gccccuccaggggcuggug

SEQ ID NO: 1149366 - RNA, 18 nt, Mycobacterium bovis subsp bovis AF2122/97
gccccguucacgcucgua

SEQ ID NO: 1149367 - RNA, 16 nt, Mycobacterium bovis subsp bovis AF2122/97
gccccguugagcagca

SEQ ID NO: 1149368 - RNA, 17 nt, Mycobacterium bovis subsp bovis AF2122/97
gccccggugccgaccgg

SEQ ID NO: 1149369 - RNA, 18 nt, Mycobacterium bovis subsp bovis AF2122/97
gccccggugccgaccggu

SEQ ID NO: 1149370 - RNA, 16 nt, Mycobacterium bovis subsp bovis AF2122/97
gccccgucgaccucca

SEQ ID NO: 1149371 - RNA, 22 nt, Mycobacterium bovis subsp bovis AF2122/97
gccccgugggccucgaucagcg

SEQ ID NO: 1149372 - RNA, 20 nt, Mycobacterium bovis subsp bovis AF2122/97
gcccccauuucggcacgaaa

SEQ ID NO: 1149373 - RNA, 13 nt, Mycobacterium bovis subsp bovis AF2122/97
gccccccacggcc

SEQ ID NO: 1149374 - RNA, 12 nt, Mycobacterium bovis subsp bovis AF2122/97
gccccccgcgcc

SEQ ID NO: 1149375 - RNA, 23 nt, Mycobacterium bovis subsp bovis AF2122/97
gccccccagugcagacaggcggc

SEQ ID NO: 1149376 - RNA, 23 nt, Mycobacterium bovis subsp bovis AF2122/97
aagacgccgauccgguggcuggc

SEQ ID NO: 1149377 - RNA, 12 nt, Mycobacterium bovis subsp bovis AF2122/97
gccccccggcga

SEQ ID NO: 1149378 - RNA, 20 nt, Mycobacterium bovis subsp bovis AF2122/97
gccccccggcgacggcguag

SEQ ID NO: 1149379 - RNA, 21 nt, Mycobacterium bovis subsp bovis AF2122/97
gcccccggugccgcccgcgcc

SEQ ID NO: 1149380 - RNA, 14 nt, Mycobacterium bovis subsp bovis AF2122/97
gcccccggugccgu

SEQ ID NO: 1149381 - RNA, 22 nt, Mycobacterium bovis subsp bovis AF2122/97
gcccccguucuggaaccccgag

SEQ ID NO: 1149382 - RNA, 21 nt, Mycobacterium bovis subsp bovis AF2122/97
gcccccguuuacggcccggca

SEQ ID NO: 1149383 - RNA, 16 nt, Mycobacterium bovis subsp bovis AF2122/97
gcccccggcgcggcgg

SEQ ID NO: 1149384 - RNA, 20 nt, Mycobacterium bovis subsp bovis AF2122/97
gcccccggcgcggcggaccg

SEQ ID NO: 1149385 - RNA, 16 nt, Mycobacterium bovis subsp bovis AF2122/97
gcccccggcagcaucg

SEQ ID NO: 1149386 - RNA, 15 nt, Mycobacterium bovis subsp bovis AF2122/97
gcccccgccggccgc

SEQ ID NO: 1149387 - RNA, 18 nt, Mycobacterium bovis subsp bovis AF2122/97
gcccccgccggccgcgcc

SEQ ID NO: 1149388 - RNA, 20 nt, Mycobacterium bovis subsp bovis AF2122/97
gcccccgccggccgcgccgg

SEQ ID NO: 1149389 - RNA, 13 nt, Mycobacterium bovis subsp bovis AF2122/97
gccccgaccagca

SEQ ID NO: 1149390 - RNA, 16 nt, Mycobacterium bovis subsp bovis AF2122/97
gccccgaagccggugc

SEQ ID NO: 1149391 - RNA, 21 nt, Mycobacterium bovis subsp bovis AF2122/97
gccccgaauguugcgaucugc

SEQ ID NO: 1149392 - RNA, 17 nt, Mycobacterium bovis subsp bovis AF2122/97
gccccgacauacgucgg

SEQ ID NO: 1149393 - RNA, 15 nt, Mycobacterium bovis subsp bovis AF2122/97
gccccgaaacgaugg

SEQ ID NO: 1149394 - RNA, 17 nt, Mycobacterium bovis subsp bovis AF2122/97
aagacgccgucggcgcc

SEQ ID NO: 1149395 - RNA, 16 nt, Mycobacterium bovis subsp bovis AF2122/97
gcccccucggcgugau

SEQ ID NO: 1149396 - RNA, 16 nt, Mycobacterium bovis subsp bovis AF2122/97
gccccgccguaccgaa

SEQ ID NO: 1149397 - RNA, 14 nt, Mycobacterium bovis subsp bovis AF2122/97
gccccgccgucacc

SEQ ID NO: 1149398 - RNA, 15 nt, Mycobacterium bovis subsp bovis AF2122/97
gccccgccgucgccg

SEQ ID NO: 1149399 - RNA, 19 nt, Mycobacterium bovis subsp bovis AF2122/97
gccccgccgucgccgccgg

SEQ ID NO: 1149400 - RNA, 23 nt, Mycobacterium bovis subsp bovis AF2122/97
gccccgccguuaccgccguugcc

SEQ ID NO: 1149401 - RNA, 15 nt, Mycobacterium bovis subsp bovis AF2122/97
gccccgccguugaac

SEQ ID NO: 1149402 - RNA, 21 nt, Mycobacterium bovis subsp bovis AF2122/97
gccccgccguugaacggcacc

SEQ ID NO: 1149403 - RNA, 22 nt, Mycobacterium bovis subsp bovis AF2122/97
gccccgccguuuccgccgccgc

SEQ ID NO: 1149404 - RNA, 15 nt, Mycobacterium bovis subsp bovis AF2122/97
gccccgccuuggcca

SEQ ID NO: 1149405 - RNA, 17 nt, Mycobacterium bovis subsp bovis AF2122/97
gccccgccuuggccacc

SEQ ID NO: 1149406 - RNA, 18 nt, Mycobacterium bovis subsp bovis AF2122/97
gccccgccuuggccacca

SEQ ID NO: 1149407 - RNA, 14 nt, Mycobacterium bovis subsp bovis AF2122/97
gccccgcgcccacc

SEQ ID NO: 1149408 - RNA, 15 nt, Mycobacterium bovis subsp bovis AF2122/97
gccccgcgcccaccc

SEQ ID NO: 1149409 - RNA, 13 nt, Mycobacterium bovis subsp bovis AF2122/97
gccccgcgccggc

SEQ ID NO: 1149410 - RNA, 23 nt, Mycobacterium bovis subsp bovis AF2122/97
gccccgcgccggccgcacgccgg

SEQ ID NO: 1149411 - RNA, 21 nt, Mycobacterium bovis subsp bovis AF2122/97
gccccgcgcguucggcgagca

SEQ ID NO: 1149412 - RNA, 16 nt, Mycobacterium bovis subsp bovis AF2122/97
gccccgcggcagacau

SEQ ID NO: 1149413 - RNA, 15 nt, Mycobacterium bovis subsp bovis AF2122/97
gccccgcggccagca

SEQ ID NO: 1149414 - RNA, 16 nt, Mycobacterium bovis subsp bovis AF2122/97
gccccgcggccagcag

SEQ ID NO: 1149415 - RNA, 17 nt, Mycobacterium bovis subsp bovis AF2122/97
gccccgcggccagcagc

SEQ ID NO: 1149416 - RNA, 13 nt, Mycobacterium bovis subsp bovis AF2122/97
gccccgcggcgcc

SEQ ID NO: 1149417 - RNA, 22 nt, Mycobacterium bovis subsp bovis AF2122/97
gccccaggugguucaaccggac

SEQ ID NO: 1149418 - RNA, 24 nt, Mycobacterium bovis subsp bovis AF2122/97
gccccaggugguucaaccggacga

SEQ ID NO: 1149419 - RNA, 16 nt, Mycobacterium bovis subsp bovis AF2122/97
gccccagguagucgac

SEQ ID NO: 1149420 - RNA, 15 nt, Mycobacterium bovis subsp bovis AF2122/97
gccccagguuccgcu

SEQ ID NO: 1149421 - RNA, 12 nt, Mycobacterium bovis subsp bovis AF2122/97
gcccccagggcc

SEQ ID NO: 1149422 - RNA, 19 nt, Mycobacterium bovis subsp bovis AF2122/97
gcccccagguaaccccgca

SEQ ID NO: 1149423 - RNA, 20 nt, Mycobacterium bovis subsp bovis AF2122/97
gcccccagugcacgcucggc

SEQ ID NO: 1149424 - RNA, 15 nt, Mycobacterium bovis subsp bovis AF2122/97
gcccccaguucggcg

SEQ ID NO: 1149425 - RNA, 18 nt, Mycobacterium bovis subsp bovis AF2122/97
gcccccauaacugcggcc

SEQ ID NO: 1149426 - RNA, 16 nt, Mycobacterium bovis subsp bovis AF2122/97
gcccccauccggucga

SEQ ID NO: 1149427 - RNA, 19 nt, Mycobacterium bovis subsp bovis AF2122/97
gccccagcguucccgccgg

SEQ ID NO: 1149428 - RNA, 22 nt, Mycobacterium bovis subsp bovis AF2122/97
gccccagauauugaaccgggcc

SEQ ID NO: 1149429 - RNA, 19 nt, Mycobacterium bovis subsp bovis AF2122/97
gccccaccggcccgggaaa

SEQ ID NO: 1149430 - RNA, 17 nt, Mycobacterium bovis subsp bovis AF2122/97
gccccaccggugccgcc

SEQ ID NO: 1149431 - RNA, 19 nt, Mycobacterium bovis subsp bovis AF2122/97
gccccaccggugccgccgu

SEQ ID NO: 1149432 - RNA, 16 nt, Mycobacterium bovis subsp bovis AF2122/97
gccccaccgcgccgag

SEQ ID NO: 1149433 - RNA, 15 nt, Mycobacterium bovis subsp bovis AF2122/97
gccccaccggcaccc

SEQ ID NO: 1149434 - RNA, 22 nt, Mycobacterium bovis subsp bovis AF2122/97
gccccacaccuuggcggucggc

SEQ ID NO: 1149435 - RNA, 15 nt, Mycobacterium bovis subsp bovis AF2122/97
gcccaucacacccgg

SEQ ID NO: 1149436 - RNA, 13 nt, Mycobacterium bovis subsp bovis AF2122/97
gcccaucccggcc

SEQ ID NO: 1149437 - RNA, 16 nt, Mycobacterium bovis subsp bovis AF2122/97
gcccaucccggccgag

SEQ ID NO: 1149438 - RNA, 14 nt, Mycobacterium bovis subsp bovis AF2122/97
gcccaggccaccgg

SEQ ID NO: 1149439 - RNA, 18 nt, Mycobacterium bovis subsp bovis AF2122/97
gcccaggccaccggcugc

SEQ ID NO: 1149440 - RNA, 19 nt, Mycobacterium bovis subsp bovis AF2122/97
gcccaggccaccggcugca

SEQ ID NO: 1149441 - RNA, 20 nt, Mycobacterium bovis subsp bovis AF2122/97
gcccauaacagcuggcggca

SEQ ID NO: 1149442 - RNA, 22 nt, Mycobacterium bovis subsp bovis AF2122/97
gcccauaacagcuggcggcagc

SEQ ID NO: 1149443 - RNA, 19 nt, Mycobacterium bovis subsp bovis AF2122/97
gcccauacgugccgccgau

SEQ ID NO: 1149444 - RNA, 12 nt, Mycobacterium bovis subsp bovis AF2122/97
gcccaucccgau

SEQ ID NO: 1149445 - RNA, 17 nt, Mycobacterium bovis subsp bovis AF2122/97
gcccauccggccgucgg

SEQ ID NO: 1149446 - RNA, 21 nt, Mycobacterium bovis subsp bovis AF2122/97
gcccauccggccgucgggcag

SEQ ID NO: 1149447 - RNA, 15 nt, Mycobacterium bovis subsp bovis AF2122/97
gcccaucgcgacggc

SEQ ID NO: 1149448 - RNA, 17 nt, Mycobacterium bovis subsp bovis AF2122/97
gcccaucgcgacggccc

SEQ ID NO: 1149449 - RNA, 23 nt, Mycobacterium bovis subsp bovis AF2122/97
gcccaucucgggcaggccgucga

SEQ ID NO: 1149450 - RNA, 17 nt, Mycobacterium bovis subsp bovis AF2122/97
gcccaucucaugcaucu

SEQ ID NO: 1149451 - RNA, 14 nt, Mycobacterium bovis subsp bovis AF2122/97
gccccacccgccgc

SEQ ID NO: 1149452 - RNA, 15 nt, Mycobacterium bovis subsp bovis AF2122/97
gccccacccgccgcc

SEQ ID NO: 1149453 - RNA, 14 nt, Mycobacterium bovis subsp bovis AF2122/97
gccccacccgcggc

SEQ ID NO: 1149454 - RNA, 15 nt, Mycobacterium bovis subsp bovis AF2122/97
gccccacccgcggcg

SEQ ID NO: 1149455 - RNA, 18 nt, Mycobacterium bovis subsp bovis AF2122/97
gccccacccgcggcgccg

SEQ ID NO: 1149456 - RNA, 15 nt, Mycobacterium bovis subsp bovis AF2122/97
gccccaccgacagcc

SEQ ID NO: 1149457 - RNA, 14 nt, Mycobacterium bovis subsp bovis AF2122/97
gcccagcccggcgu

SEQ ID NO: 1149458 - RNA, 22 nt, Mycobacterium bovis subsp bovis AF2122/97
gcccagccgagcggcggcacug

SEQ ID NO: 1149459 - RNA, 14 nt, Mycobacterium bovis subsp bovis AF2122/97
gcccagccgcagca

SEQ ID NO: 1149460 - RNA, 13 nt, Mycobacterium bovis subsp bovis AF2122/97
gcccagccgccag

SEQ ID NO: 1149461 - RNA, 16 nt, Mycobacterium bovis subsp bovis AF2122/97
gcccagccggaccgcg

SEQ ID NO: 1149462 - RNA, 12 nt, Mycobacterium bovis subsp bovis AF2122/97
gcccagccgcgg

SEQ ID NO: 1149463 - RNA, 14 nt, Mycobacterium bovis subsp bovis AF2122/97
gcccagccgcgggc

SEQ ID NO: 1149464 - RNA, 22 nt, Mycobacterium bovis subsp bovis AF2122/97
gcccagccgggagucgucggca

SEQ ID NO: 1149465 - RNA, 14 nt, Mycobacterium bovis subsp bovis AF2122/97
gcccagccgggcac

SEQ ID NO: 1149466 - RNA, 19 nt, Mycobacterium bovis subsp bovis AF2122/97
gcccagccggguggacacc

SEQ ID NO: 1149467 - RNA, 24 nt, Mycobacterium bovis subsp bovis AF2122/97
gcccagccggaccgcgacggcgcc

SEQ ID NO: 1149468 - RNA, 22 nt, Mycobacterium bovis subsp bovis AF2122/97
gcccagccguucgucgcgggug

SEQ ID NO: 1149469 - RNA, 17 nt, Mycobacterium bovis subsp bovis AF2122/97
gcccagcgacaacacca

SEQ ID NO: 1149470 - RNA, 15 nt, Mycobacterium bovis subsp bovis AF2122/97
gcccagcgacccggc

SEQ ID NO: 1149471 - RNA, 21 nt, Mycobacterium bovis subsp bovis AF2122/97
gcccagcgaugcgcucacugc

SEQ ID NO: 1149472 - RNA, 16 nt, Mycobacterium bovis subsp bovis AF2122/97
gcccagcgcacggacc

SEQ ID NO: 1149473 - RNA, 18 nt, Mycobacterium bovis subsp bovis AF2122/97
gcccagcgccuccagcac

SEQ ID NO: 1149474 - RNA, 18 nt, Mycobacterium bovis subsp bovis AF2122/97
gcccagcgcccgcgcggc

SEQ ID NO: 1149475 - RNA, 14 nt, Mycobacterium bovis subsp bovis AF2122/97
gcccagcggaauca

SEQ ID NO: 1149476 - RNA, 18 nt, Mycobacterium bovis subsp bovis AF2122/97
gcccagcgucaucccgau

SEQ ID NO: 1149477 - RNA, 14 nt, Mycobacterium bovis subsp bovis AF2122/97
gcccagcggccgcg

SEQ ID NO: 1149478 - RNA, 19 nt, Mycobacterium bovis subsp bovis AF2122/97
gcccagcggaaucaccgaa

SEQ ID NO: 1149479 - RNA, 14 nt, Mycobacterium bovis subsp bovis AF2122/97
gcccagcguggcug

SEQ ID NO: 1149480 - RNA, 23 nt, Mycobacterium bovis subsp bovis AF2122/97
gcccagcguggcuggcaccuccc

SEQ ID NO: 1149481 - RNA, 21 nt, Mycobacterium bovis subsp bovis AF2122/97
gcccagcgugauuucaacguc

SEQ ID NO: 1149482 - RNA, 17 nt, Mycobacterium bovis subsp bovis AF2122/97
gcccagcugcgccgaac

SEQ ID NO: 1149483 - RNA, 22 nt, Mycobacterium bovis subsp bovis AF2122/97
gcccagcugucauccccggcca

SEQ ID NO: 1149484 - RNA, 15 nt, Mycobacterium bovis subsp bovis AF2122/97
gcccaggacagcagc

SEQ ID NO: 1149485 - RNA, 21 nt, Mycobacterium bovis subsp bovis AF2122/97
gcccaggacggcuaccaccgc

SEQ ID NO: 1149486 - RNA, 18 nt, Mycobacterium bovis subsp bovis AF2122/97
gcccaggcaaaccgauca

SEQ ID NO: 1149487 - RNA, 17 nt, Mycobacterium bovis subsp bovis AF2122/97
gcccaggaucacgggug

SEQ ID NO: 1149488 - RNA, 17 nt, Mycobacterium bovis subsp bovis AF2122/97
gcccagagugaauccgg

SEQ ID NO: 1149489 - RNA, 16 nt, Mycobacterium bovis subsp bovis AF2122/97
gcccagauccagcaac

SEQ ID NO: 1149490 - RNA, 22 nt, Mycobacterium bovis subsp bovis AF2122/97
gcccagauccagcaacgcggug

SEQ ID NO: 1149491 - RNA, 18 nt, Mycobacterium bovis subsp bovis AF2122/97
gcccagauagagcuggug

SEQ ID NO: 1149492 - RNA, 16 nt, Mycobacterium bovis subsp bovis AF2122/97
gcccagaccgacccgc

SEQ ID NO: 1149493 - RNA, 15 nt, Mycobacterium bovis subsp bovis AF2122/97
gcccagaccgccgac

SEQ ID NO: 1149494 - RNA, 20 nt, Mycobacterium bovis subsp bovis AF2122/97
gcccagcaaccgcucggcga

SEQ ID NO: 1149495 - RNA, 15 nt, Mycobacterium bovis subsp bovis AF2122/97
gcccagcaccaccgc

SEQ ID NO: 1149496 - RNA, 18 nt, Mycobacterium bovis subsp bovis AF2122/97
gcccagauugcccaacac

SEQ ID NO: 1149497 - RNA, 12 nt, Mycobacterium bovis subsp bovis AF2122/97
gcccagcacccc

SEQ ID NO: 1149498 - RNA, 15 nt, Mycobacterium bovis subsp bovis AF2122/97
gcccagcacggucaa

SEQ ID NO: 1149499 - RNA, 20 nt, Mycobacterium bovis subsp bovis AF2122/97
gcccagcaggcccuuggcga

SEQ ID NO: 1149500 - RNA, 15 nt, Mycobacterium bovis subsp bovis AF2122/97
gcccagcagcgcgac

SEQ ID NO: 1149501 - RNA, 20 nt, Mycobacterium bovis subsp bovis AF2122/97
gcccagcaggucgucggcgu

SEQ ID NO: 1149502 - RNA, 17 nt, Mycobacterium bovis subsp bovis AF2122/97
gcccagcauggcggaac

SEQ ID NO: 1149503 - RNA, 19 nt, Mycobacterium bovis subsp bovis AF2122/97
gcccagcaucucggcggcc

SEQ ID NO: 1149504 - RNA, 17 nt, Mycobacterium bovis subsp bovis AF2122/97
gcccagccacugacggc

SEQ ID NO: 1149505 - RNA, 23 nt, Mycobacterium bovis subsp bovis AF2122/97
gcccaccucgaucgcgccgucgg

SEQ ID NO: 1149506 - RNA, 17 nt, Mycobacterium bovis subsp bovis AF2122/97
gcccacgaaugcaagac

SEQ ID NO: 1149507 - RNA, 20 nt, Mycobacterium bovis subsp bovis AF2122/97
gcccaccgucugcuggccgg

SEQ ID NO: 1149508 - RNA, 14 nt, Mycobacterium bovis subsp bovis AF2122/97
gcccacgccgcauc

SEQ ID NO: 1149509 - RNA, 17 nt, Mycobacterium bovis subsp bovis AF2122/97
gcccacgccggggcaac

SEQ ID NO: 1149510 - RNA, 17 nt, Mycobacterium bovis subsp bovis AF2122/97
gcccacguuggccccgc

SEQ ID NO: 1149511 - RNA, 18 nt, Mycobacterium bovis subsp bovis AF2122/97
gcccacguuuagggugcc

SEQ ID NO: 1149512 - RNA, 17 nt, Mycobacterium bovis subsp bovis AF2122/97
gcccacguugacggcga

SEQ ID NO: 1149513 - RNA, 19 nt, Mycobacterium bovis subsp bovis AF2122/97
gcccacguugacggcgaac

SEQ ID NO: 1149514 - RNA, 19 nt, Mycobacterium bovis subsp bovis AF2122/97
gcccacggugucccgcgag

SEQ ID NO: 1149515 - RNA, 18 nt, Mycobacterium bovis subsp bovis AF2122/97
gcccacgggccggccgag

SEQ ID NO: 1149516 - RNA, 19 nt, Mycobacterium bovis subsp bovis AF2122/97
gcccacgggccggccgagc

SEQ ID NO: 1149517 - RNA, 21 nt, Mycobacterium bovis subsp bovis AF2122/97
gcccacgggccggccgagcgc

SEQ ID NO: 1149518 - RNA, 13 nt, Mycobacterium bovis subsp bovis AF2122/97
gcccacggcgacc

SEQ ID NO: 1149519 - RNA, 17 nt, Mycobacterium bovis subsp bovis AF2122/97
gcccacggcagcgccgg

SEQ ID NO: 1149520 - RNA, 16 nt, Mycobacterium bovis subsp bovis AF2122/97
gcccacggcgaccagg

SEQ ID NO: 1149521 - RNA, 20 nt, Mycobacterium bovis subsp bovis AF2122/97
gcccacggcgaccaggagcc

SEQ ID NO: 1149522 - RNA, 18 nt, Mycobacterium bovis subsp bovis AF2122/97
gcccagaaaaccgccgca

SEQ ID NO: 1149523 - RNA, 20 nt, Mycobacterium bovis subsp bovis AF2122/97
gcccagaaaaccgccgcaac

SEQ ID NO: 1149524 - RNA, 20 nt, Mycobacterium bovis subsp bovis AF2122/97
gcccacucucgccacgccgu

SEQ ID NO: 1149525 - RNA, 22 nt, Mycobacterium bovis subsp bovis AF2122/97
gcccacucucgccacgccgugg

SEQ ID NO: 1149526 - RNA, 19 nt, Mycobacterium bovis subsp bovis AF2122/97
gcccacuagcagggggacc

SEQ ID NO: 1149527 - RNA, 17 nt, Mycobacterium bovis subsp bovis AF2122/97
gccauggcccgugcggu

SEQ ID NO: 1149528 - RNA, 15 nt, Mycobacterium bovis subsp bovis AF2122/97
gccaugcugcccuug

SEQ ID NO: 1149529 - RNA, 13 nt, Mycobacterium bovis subsp bovis AF2122/97
gccaugcugcucg

SEQ ID NO: 1149530 - RNA, 18 nt, Mycobacterium bovis subsp bovis AF2122/97
gccaugcgccaacccggc

SEQ ID NO: 1149531 - RNA, 13 nt, Mycobacterium bovis subsp bovis AF2122/97
gccaugcgcacca

SEQ ID NO: 1149532 - RNA, 21 nt, Mycobacterium bovis subsp bovis AF2122/97
gccaugcuaggaccaccagcg

SEQ ID NO: 1149533 - RNA, 14 nt, Mycobacterium bovis subsp bovis AF2122/97
gccaugcggcgcgu

SEQ ID NO: 1149534 - RNA, 21 nt, Mycobacterium bovis subsp bovis AF2122/97
gccagucgugcuugcccgguu

SEQ ID NO: 1149535 - RNA, 16 nt, Mycobacterium bovis subsp bovis AF2122/97
aagacaccggcgucga

SEQ ID NO: 1149536 - RNA, 13 nt, Mycobacterium bovis subsp bovis AF2122/97
aagacaguggcgc

SEQ ID NO: 1149537 - RNA, 21 nt, Mycobacterium bovis subsp bovis AF2122/97
gccagugaaaccaccggccgu

SEQ ID NO: 1149538 - RNA, 23 nt, Mycobacterium bovis subsp bovis AF2122/97
gccagugaaaccaccggccgucc

SEQ ID NO: 1149539 - RNA, 14 nt, Mycobacterium bovis subsp bovis AF2122/97
aagaccaccgccca

SEQ ID NO: 1149540 - RNA, 22 nt, Mycobacterium bovis subsp bovis AF2122/97
aagaccagcggcggcggcggca

SEQ ID NO: 1149541 - RNA, 15 nt, Mycobacterium bovis subsp bovis AF2122/97
aagacccggcaccca

SEQ ID NO: 1149542 - RNA, 16 nt, Mycobacterium bovis subsp bovis AF2122/97
aagaccgacagcggca

SEQ ID NO: 1149543 - RNA, 14 nt, Mycobacterium bovis subsp bovis AF2122/97
aagaccgcgccaac

SEQ ID NO: 1149544 - RNA, 17 nt, Mycobacterium bovis subsp bovis AF2122/97
gccauucaucggcaucg

SEQ ID NO: 1149545 - RNA, 18 nt, Mycobacterium bovis subsp bovis AF2122/97
gccauuagcagcacccgg

SEQ ID NO: 1149546 - RNA, 16 nt, Mycobacterium bovis subsp bovis AF2122/97
gccauuccagccggug

SEQ ID NO: 1149547 - RNA, 20 nt, Mycobacterium bovis subsp bovis AF2122/97
gccauuccagccggugccgc

SEQ ID NO: 1149548 - RNA, 20 nt, Mycobacterium bovis subsp bovis AF2122/97
gccauuccagaucaacgcgu

SEQ ID NO: 1149549 - RNA, 22 nt, Mycobacterium bovis subsp bovis AF2122/97
gccauuccagaucaacgcgucg

SEQ ID NO: 1149550 - RNA, 14 nt, Mycobacterium bovis subsp bovis AF2122/97
gccauguggcgucg

SEQ ID NO: 1149551 - RNA, 18 nt, Mycobacterium bovis subsp bovis AF2122/97
gccauuaaaaagcccagc

SEQ ID NO: 1149552 - RNA, 20 nt, Mycobacterium bovis subsp bovis AF2122/97
gccauguggcgucgcucguc

SEQ ID NO: 1149553 - RNA, 21 nt, Mycobacterium bovis subsp bovis AF2122/97
gccauguggcgucgcucgucg

SEQ ID NO: 1149554 - RNA, 17 nt, Mycobacterium bovis subsp bovis AF2122/97
gccauguguauucgauc

SEQ ID NO: 1149555 - RNA, 22 nt, Mycobacterium bovis subsp bovis AF2122/97
gccaugugugcaaaggcgccgu

SEQ ID NO: 1149556 - RNA, 21 nt, Mycobacterium bovis subsp bovis AF2122/97
gccauuguugggccgccagcg

SEQ ID NO: 1149557 - RNA, 17 nt, Mycobacterium bovis subsp bovis AF2122/97
gccauuuccuuggcgcu

SEQ ID NO: 1149558 - RNA, 14 nt, Mycobacterium bovis subsp bovis AF2122/97
gccauuucgucguc

SEQ ID NO: 1149559 - RNA, 15 nt, Mycobacterium bovis subsp bovis AF2122/97
gccauuucgucgucg

SEQ ID NO: 1149560 - RNA, 23 nt, Mycobacterium bovis subsp bovis AF2122/97
gccauuggccugucaggcggcgg

SEQ ID NO: 1149561 - RNA, 17 nt, Mycobacterium bovis subsp bovis AF2122/97
gccauuggcgccgccga

SEQ ID NO: 1149562 - RNA, 20 nt, Mycobacterium bovis subsp bovis AF2122/97
gccauugccucccgcgccgg

SEQ ID NO: 1149563 - RNA, 15 nt, Mycobacterium bovis subsp bovis AF2122/97
gccauugccugggcg

SEQ ID NO: 1149564 - RNA, 14 nt, Mycobacterium bovis subsp bovis AF2122/97
gccauuggacagcg

SEQ ID NO: 1149565 - RNA, 19 nt, Mycobacterium bovis subsp bovis AF2122/97
gccauucuucgaucagcgg

SEQ ID NO: 1149566 - RNA, 14 nt, Mycobacterium bovis subsp bovis AF2122/97
gccauugacgccgu

SEQ ID NO: 1149567 - RNA, 16 nt, Mycobacterium bovis subsp bovis AF2122/97
gccauucccgguggcu

SEQ ID NO: 1149568 - RNA, 15 nt, Mycobacterium bovis subsp bovis AF2122/97
gccauugccgccggc

SEQ ID NO: 1149569 - RNA, 19 nt, Mycobacterium bovis subsp bovis AF2122/97
gccauugccgccggcgccg

SEQ ID NO: 1149570 - RNA, 20 nt, Mycobacterium bovis subsp bovis AF2122/97
gccauugccgccggcgccgc

SEQ ID NO: 1149571 - RNA, 22 nt, Mycobacterium bovis subsp bovis AF2122/97
gccauugaggaagccguuggcg

SEQ ID NO: 1149572 - RNA, 23 nt, Mycobacterium bovis subsp bovis AF2122/97
gccauugaggaagccguuggcga

SEQ ID NO: 1149573 - RNA, 23 nt, Mycobacterium bovis subsp bovis AF2122/97
gcccaacccauaucgauaaccgc

SEQ ID NO: 1149574 - RNA, 14 nt, Mycobacterium bovis subsp bovis AF2122/97
gcccaagccgccgg

SEQ ID NO: 1149575 - RNA, 18 nt, Mycobacterium bovis subsp bovis AF2122/97
gcccaagguggcggccag

SEQ ID NO: 1149576 - RNA, 16 nt, Mycobacterium bovis subsp bovis AF2122/97
gcccaagccguggccg

SEQ ID NO: 1149577 - RNA, 20 nt, Mycobacterium bovis subsp bovis AF2122/97
gcccaagcucagggugggcg

SEQ ID NO: 1149578 - RNA, 22 nt, Mycobacterium bovis subsp bovis AF2122/97
gcccaagcaguccacgagcacg

SEQ ID NO: 1149579 - RNA, 18 nt, Mycobacterium bovis subsp bovis AF2122/97
gcccaagaucucgcgggc

SEQ ID NO: 1149580 - RNA, 23 nt, Mycobacterium bovis subsp bovis AF2122/97
gcccaacgcgauguccagguggc

SEQ ID NO: 1149581 - RNA, 15 nt, Mycobacterium bovis subsp bovis AF2122/97
gcccaacucggccag

SEQ ID NO: 1149582 - RNA, 15 nt, Mycobacterium bovis subsp bovis AF2122/97
gcccacacgcucacg

SEQ ID NO: 1149583 - RNA, 15 nt, Mycobacterium bovis subsp bovis AF2122/97
gcccacaccagcgca

SEQ ID NO: 1149584 - RNA, 12 nt, Mycobacterium bovis subsp bovis AF2122/97
gcccaauucgac

SEQ ID NO: 1149585 - RNA, 15 nt, Mycobacterium bovis subsp bovis AF2122/97
gcccaauucgacugc

SEQ ID NO: 1149586 - RNA, 22 nt, Mycobacterium bovis subsp bovis AF2122/97
gcccacaaugacucggccgcac

SEQ ID NO: 1149587 - RNA, 18 nt, Mycobacterium bovis subsp bovis AF2122/97
gcccaauuucgugccgaa

SEQ ID NO: 1149588 - RNA, 22 nt, Mycobacterium bovis subsp bovis AF2122/97
gcccaauccgcaacagcucggc

SEQ ID NO: 1149589 - RNA, 22 nt, Mycobacterium bovis subsp bovis AF2122/97
gcccaauccaccgauucggcga

SEQ ID NO: 1149590 - RNA, 19 nt, Mycobacterium bovis subsp bovis AF2122/97
gcccaacccacucgcagca

SEQ ID NO: 1149591 - RNA, 21 nt, Mycobacterium bovis subsp bovis AF2122/97
gcccaacccacucgcagcagc

SEQ ID NO: 1149592 - RNA, 18 nt, Mycobacterium bovis subsp bovis AF2122/97
gcccaacaacgcuucggc

SEQ ID NO: 1149593 - RNA, 17 nt, Mycobacterium bovis subsp bovis AF2122/97
gcccaacaggcgggaca

SEQ ID NO: 1149594 - RNA, 15 nt, Mycobacterium bovis subsp bovis AF2122/97
gcccaacgucgccag

SEQ ID NO: 1149595 - RNA, 16 nt, Mycobacterium bovis subsp bovis AF2122/97
gcccaacgcgagcuug

SEQ ID NO: 1149596 - RNA, 20 nt, Mycobacterium bovis subsp bovis AF2122/97
gcccaacgcgagcuugauuc

SEQ ID NO: 1149597 - RNA, 17 nt, Mycobacterium bovis subsp bovis AF2122/97
gcccaacggaagaccgc

SEQ ID NO: 1149598 - RNA, 24 nt, Mycobacterium bovis subsp bovis AF2122/97
gcccaaaaagaccgccgcuggguc

SEQ ID NO: 1149599 - RNA, 14 nt, Mycobacterium bovis subsp bovis AF2122/97
gcccaaaaccgcga

SEQ ID NO: 1149600 - RNA, 20 nt, Mycobacterium bovis subsp bovis AF2122/97
gcccaaaaccgcgaacccga

SEQ ID NO: 1149601 - RNA, 16 nt, Mycobacterium bovis subsp bovis AF2122/97
gcccaaaagcgcggca

SEQ ID NO: 1149602 - RNA, 17 nt, Mycobacterium bovis subsp bovis AF2122/97
gcccaaaagcgcggcaa

SEQ ID NO: 1149603 - RNA, 21 nt, Mycobacterium bovis subsp bovis AF2122/97
gcccaacaacgcuucggcgug

SEQ ID NO: 1149604 - RNA, 22 nt, Mycobacterium bovis subsp bovis AF2122/97
gcccaacacccacugcacggag

SEQ ID NO: 1149605 - RNA, 13 nt, Mycobacterium bovis subsp bovis AF2122/97
gcccaacaccgcg

SEQ ID NO: 1149606 - RNA, 15 nt, Mycobacterium bovis subsp bovis AF2122/97
gcccaacaccgcgcc

SEQ ID NO: 1149607 - RNA, 13 nt, Mycobacterium bovis subsp bovis AF2122/97
gcccaacagacau

SEQ ID NO: 1149608 - RNA, 19 nt, Mycobacterium bovis subsp bovis AF2122/97
gcccaacagcaacccgccg

SEQ ID NO: 1149609 - RNA, 13 nt, Mycobacterium bovis subsp bovis AF2122/97
gcccaccccggcc

SEQ ID NO: 1149610 - RNA, 15 nt, Mycobacterium bovis subsp bovis AF2122/97
gcccaccgaaaccgg

SEQ ID NO: 1149611 - RNA, 20 nt, Mycobacterium bovis subsp bovis AF2122/97
gcccaccgcaacgcuucggc

SEQ ID NO: 1149612 - RNA, 22 nt, Mycobacterium bovis subsp bovis AF2122/97
gcccaccgccguugggccgcgc

SEQ ID NO: 1149613 - RNA, 20 nt, Mycobacterium bovis subsp bovis AF2122/97
gcccaccgccugggcggcca

SEQ ID NO: 1149614 - RNA, 21 nt, Mycobacterium bovis subsp bovis AF2122/97
gcccaccgccugggcggccag

SEQ ID NO: 1149615 - RNA, 18 nt, Mycobacterium bovis subsp bovis AF2122/97
gcccaccgcugcggcacc

SEQ ID NO: 1149616 - RNA, 12 nt, Mycobacterium bovis subsp bovis AF2122/97
gcccaccggcgc

SEQ ID NO: 1149617 - RNA, 18 nt, Mycobacterium bovis subsp bovis AF2122/97
gcccaccggcgccgccgg

SEQ ID NO: 1149618 - RNA, 23 nt, Mycobacterium bovis subsp bovis AF2122/97
gcccaccggcgccgccggcaccc

SEQ ID NO: 1149619 - RNA, 13 nt, Mycobacterium bovis subsp bovis AF2122/97
gcccaccggucgc

SEQ ID NO: 1149620 - RNA, 15 nt, Mycobacterium bovis subsp bovis AF2122/97
gcccaccggucgccg

SEQ ID NO: 1149621 - RNA, 11 nt, Mycobacterium bovis subsp bovis AF2122/97
gcccaccggug

SEQ ID NO: 1149622 - RNA, 12 nt, Mycobacterium bovis subsp bovis AF2122/97
gcccaccggugc

SEQ ID NO: 1149623 - RNA, 16 nt, Mycobacterium bovis subsp bovis AF2122/97
gcccaccggugccgcc

SEQ ID NO: 1149624 - RNA, 20 nt, Mycobacterium bovis subsp bovis AF2122/97
gcccaccggugccgcccgcg

SEQ ID NO: 1149625 - RNA, 21 nt, Mycobacterium bovis subsp bovis AF2122/97
gcccaccggugccgcccgcgc

SEQ ID NO: 1149626 - RNA, 22 nt, Mycobacterium bovis subsp bovis AF2122/97
gcccaccggugccgcccgcgcc

SEQ ID NO: 1149627 - RNA, 15 nt, Mycobacterium bovis subsp bovis AF2122/97
gcccaccacgcgacg

SEQ ID NO: 1149628 - RNA, 20 nt, Mycobacterium bovis subsp bovis AF2122/97
gcccaccacugugacacccg

SEQ ID NO: 1149629 - RNA, 16 nt, Mycobacterium bovis subsp bovis AF2122/97
gcccaccaucccgcuc

SEQ ID NO: 1149630 - RNA, 17 nt, Mycobacterium bovis subsp bovis AF2122/97
gcccacaugcucagggc

SEQ ID NO: 1149631 - RNA, 19 nt, Mycobacterium bovis subsp bovis AF2122/97
gcccaccaguuccggggug

SEQ ID NO: 1149632 - RNA, 23 nt, Mycobacterium bovis subsp bovis AF2122/97
gcccaccaugaucacaccgagcg

SEQ ID NO: 1149633 - RNA, 15 nt, Mycobacterium bovis subsp bovis AF2122/97
gcccacaggcggcgc

SEQ ID NO: 1149634 - RNA, 19 nt, Mycobacterium bovis subsp bovis AF2122/97
gcccacaggggcagcgcgg

SEQ ID NO: 1149635 - RNA, 18 nt, Mycobacterium bovis subsp bovis AF2122/97
gcccacagcugacgagcc

SEQ ID NO: 1149636 - RNA, 17 nt, Mycobacterium bovis subsp bovis AF2122/97
gcccacaucgucggcgg

SEQ ID NO: 1149637 - RNA, 17 nt, Mycobacterium bovis subsp bovis AF2122/97
gcccacagcaacgacau

SEQ ID NO: 1149638 - RNA, 19 nt, Mycobacterium bovis subsp bovis AF2122/97
gcccaccacacagccgcgc

SEQ ID NO: 1149639 - RNA, 22 nt, Mycobacterium bovis subsp bovis AF2122/97
gcccacauguccagcguccugg

SEQ ID NO: 1149640 - RNA, 20 nt, Mycobacterium bovis subsp bovis AF2122/97
gccgcgcccggcgcaagcgc

SEQ ID NO: 1149641 - RNA, 17 nt, Mycobacterium bovis subsp bovis AF2122/97
gccgcgcccggcgcuag

SEQ ID NO: 1149642 - RNA, 14 nt, Mycobacterium bovis subsp bovis AF2122/97
gccgcgccgaaucg

SEQ ID NO: 1149643 - RNA, 21 nt, Mycobacterium bovis subsp bovis AF2122/97
gccgcgccgaccucaucggca

SEQ ID NO: 1149644 - RNA, 20 nt, Mycobacterium bovis subsp bovis AF2122/97
gccgcgccgauuccaccgcc

SEQ ID NO: 1149645 - RNA, 13 nt, Mycobacterium bovis subsp bovis AF2122/97
gccgcgccgcaga

SEQ ID NO: 1149646 - RNA, 13 nt, Mycobacterium bovis subsp bovis AF2122/97
gccgcgccgcggc

SEQ ID NO: 1149647 - RNA, 12 nt, Mycobacterium bovis subsp bovis AF2122/97
gccgcgccgccu

SEQ ID NO: 1149648 - RNA, 13 nt, Mycobacterium bovis subsp bovis AF2122/97
gccgcgccggcac

SEQ ID NO: 1149649 - RNA, 12 nt, Mycobacterium bovis subsp bovis AF2122/97
gccgcgccggca

SEQ ID NO: 1149650 - RNA, 12 nt, Mycobacterium bovis subsp bovis AF2122/97
gccgcgccggcc

SEQ ID NO: 1149651 - RNA, 15 nt, Mycobacterium bovis subsp bovis AF2122/97
gccgcgccggcgggc

SEQ ID NO: 1149652 - RNA, 15 nt, Mycobacterium bovis subsp bovis AF2122/97
gccgcgccgucccga

SEQ ID NO: 1149653 - RNA, 18 nt, Mycobacterium bovis subsp bovis AF2122/97
gccgcgcgacaacccggc

SEQ ID NO: 1149654 - RNA, 22 nt, Mycobacterium bovis subsp bovis AF2122/97
gccgcgcgcauuuuucgccagc

SEQ ID NO: 1149655 - RNA, 21 nt, Mycobacterium bovis subsp bovis AF2122/97
gccgcgcgcagggcgucggcg

SEQ ID NO: 1149656 - RNA, 21 nt, Mycobacterium bovis subsp bovis AF2122/97
gccgcgcgcacuugcguggcg

SEQ ID NO: 1149657 - RNA, 15 nt, Mycobacterium bovis subsp bovis AF2122/97
gccgcgcgcagagcg

SEQ ID NO: 1149658 - RNA, 13 nt, Mycobacterium bovis subsp bovis AF2122/97
gccgcgcgccggc

SEQ ID NO: 1149659 - RNA, 15 nt, Mycobacterium bovis subsp bovis AF2122/97
gccgcgcgcggcgua

SEQ ID NO: 1149660 - RNA, 16 nt, Mycobacterium bovis subsp bovis AF2122/97
gccgcgcgcggcguag

SEQ ID NO: 1149661 - RNA, 13 nt, Mycobacterium bovis subsp bovis AF2122/97
gccgcgcgcggcg

SEQ ID NO: 1149662 - RNA, 22 nt, Mycobacterium bovis subsp bovis AF2122/97
gccgcgcgcugccgcugcgcgu

SEQ ID NO: 1149663 - RNA, 15 nt, Mycobacterium bovis subsp bovis AF2122/97
gccgcgcggauacgc

SEQ ID NO: 1149664 - RNA, 12 nt, Mycobacterium bovis subsp bovis AF2122/97
gccgcgcggaac

SEQ ID NO: 1149665 - RNA, 21 nt, Mycobacterium bovis subsp bovis AF2122/97
gccgcgcggaacaccgaggcg

SEQ ID NO: 1149666 - RNA, 12 nt, Mycobacterium bovis subsp bovis AF2122/97
gccgcgcggcga

SEQ ID NO: 1149667 - RNA, 13 nt, Mycobacterium bovis subsp bovis AF2122/97
gccgcgcggcgac

SEQ ID NO: 1149668 - RNA, 12 nt, Mycobacterium bovis subsp bovis AF2122/97
gccgcgcggguc

SEQ ID NO: 1149669 - RNA, 13 nt, Mycobacterium bovis subsp bovis AF2122/97
gccgcgcggguca

SEQ ID NO: 1149670 - RNA, 13 nt, Mycobacterium bovis subsp bovis AF2122/97
gccgcgcgguacu

SEQ ID NO: 1149671 - RNA, 19 nt, Mycobacterium bovis subsp bovis AF2122/97
gccgcgcgguacugcgcag

SEQ ID NO: 1149672 - RNA, 18 nt, Mycobacterium bovis subsp bovis AF2122/97
gccgcgcgggccgccgca

SEQ ID NO: 1149673 - RNA, 13 nt, Mycobacterium bovis subsp bovis AF2122/97
gccgcgcggggug

SEQ ID NO: 1149674 - RNA, 16 nt, Mycobacterium bovis subsp bovis AF2122/97
gccgcgcggugauggu

SEQ ID NO: 1149675 - RNA, 17 nt, Mycobacterium bovis subsp bovis AF2122/97
gccgcgcguccgggcag

SEQ ID NO: 1149676 - RNA, 21 nt, Mycobacterium bovis subsp bovis AF2122/97
gccgcgcguuccagcacaccc

SEQ ID NO: 1149677 - RNA, 15 nt, Mycobacterium bovis subsp bovis AF2122/97
gccgcgcguucggcg

SEQ ID NO: 1149678 - RNA, 18 nt, Mycobacterium bovis subsp bovis AF2122/97
gccgcgcguucggcgcug

SEQ ID NO: 1149679 - RNA, 19 nt, Mycobacterium bovis subsp bovis AF2122/97
gccgcgcucaucgcggcga

SEQ ID NO: 1149680 - RNA, 14 nt, Mycobacterium bovis subsp bovis AF2122/97
gccgcggccaccgc

SEQ ID NO: 1149681 - RNA, 19 nt, Mycobacterium bovis subsp bovis AF2122/97
gccgcggccaccgccgccg

SEQ ID NO: 1149682 - RNA, 20 nt, Mycobacterium bovis subsp bovis AF2122/97
gccgcggccaccgccgccgc

SEQ ID NO: 1149683 - RNA, 23 nt, Mycobacterium bovis subsp bovis AF2122/97
gccgcggccaccgccgccgccga

SEQ ID NO: 1149684 - RNA, 20 nt, Mycobacterium bovis subsp bovis AF2122/97
gccgcggccacaucgccagc

SEQ ID NO: 1149685 - RNA, 17 nt, Mycobacterium bovis subsp bovis AF2122/97
gccgcggcagggcggug

SEQ ID NO: 1149686 - RNA, 12 nt, Mycobacterium bovis subsp bovis AF2122/97
gccgcggcaccu

SEQ ID NO: 1149687 - RNA, 21 nt, Mycobacterium bovis subsp bovis AF2122/97
gccgcggccacaucgccagca

SEQ ID NO: 1149688 - RNA, 22 nt, Mycobacterium bovis subsp bovis AF2122/97
gccgcggcccacucucgccacg

SEQ ID NO: 1149689 - RNA, 21 nt, Mycobacterium bovis subsp bovis AF2122/97
gccgcggcccgcucgaucggc

SEQ ID NO: 1149690 - RNA, 14 nt, Mycobacterium bovis subsp bovis AF2122/97
gccgcggcccucga

SEQ ID NO: 1149691 - RNA, 22 nt, Mycobacterium bovis subsp bovis AF2122/97
gccgcggccggcgugccagcac

SEQ ID NO: 1149692 - RNA, 16 nt, Mycobacterium bovis subsp bovis AF2122/97
gccgcggcgacgguga

SEQ ID NO: 1149693 - RNA, 13 nt, Mycobacterium bovis subsp bovis AF2122/97
gccgcggccgaaa

SEQ ID NO: 1149694 - RNA, 15 nt, Mycobacterium bovis subsp bovis AF2122/97
gccgcggcgcccggc

SEQ ID NO: 1149695 - RNA, 14 nt, Mycobacterium bovis subsp bovis AF2122/97
gccgcggcgcccgg

SEQ ID NO: 1149696 - RNA, 19 nt, Mycobacterium bovis subsp bovis AF2122/97
gccgcggcgccggugggcg

SEQ ID NO: 1149697 - RNA, 22 nt, Mycobacterium bovis subsp bovis AF2122/97
gccgcggcggauggcgucgacc

SEQ ID NO: 1149698 - RNA, 11 nt, Mycobacterium bovis subsp bovis AF2122/97
gccgcggcggc

SEQ ID NO: 1149699 - RNA, 18 nt, Mycobacterium bovis subsp bovis AF2122/97
gccgcggcggaauucggg

SEQ ID NO: 1149700 - RNA, 13 nt, Mycobacterium bovis subsp bovis AF2122/97
gccgcggcggccc

SEQ ID NO: 1149701 - RNA, 13 nt, Mycobacterium bovis subsp bovis AF2122/97
gccgcggcggcca

SEQ ID NO: 1149702 - RNA, 14 nt, Mycobacterium bovis subsp bovis AF2122/97
gccgcggcggccag

SEQ ID NO: 1149703 - RNA, 12 nt, Mycobacterium bovis subsp bovis AF2122/97
gccgcggcggca

SEQ ID NO: 1149704 - RNA, 14 nt, Mycobacterium bovis subsp bovis AF2122/97
gccgcggcggcagc

SEQ ID NO: 1149705 - RNA, 14 nt, Mycobacterium bovis subsp bovis AF2122/97
gccgcggcggucug

SEQ ID NO: 1149706 - RNA, 13 nt, Mycobacterium bovis subsp bovis AF2122/97
gccgcgcucgccg

SEQ ID NO: 1149707 - RNA, 16 nt, Mycobacterium bovis subsp bovis AF2122/97
gccgcgcucgccgaua

SEQ ID NO: 1149708 - RNA, 13 nt, Mycobacterium bovis subsp bovis AF2122/97
gccgcgcucgaac

SEQ ID NO: 1149709 - RNA, 14 nt, Mycobacterium bovis subsp bovis AF2122/97
gccgcgcucgucga

SEQ ID NO: 1149710 - RNA, 20 nt, Mycobacterium bovis subsp bovis AF2122/97
gccgcgcucgucgaaguagc

SEQ ID NO: 1149711 - RNA, 23 nt, Mycobacterium bovis subsp bovis AF2122/97
gccgcgcuggugauucgcagccg

SEQ ID NO: 1149712 - RNA, 12 nt, Mycobacterium bovis subsp bovis AF2122/97
gccgcgcugguc

SEQ ID NO: 1149713 - RNA, 14 nt, Mycobacterium bovis subsp bovis AF2122/97
gccgcgcuugcgau

SEQ ID NO: 1149714 - RNA, 14 nt, Mycobacterium bovis subsp bovis AF2122/97
gccgcggaccgcga

SEQ ID NO: 1149715 - RNA, 17 nt, Mycobacterium bovis subsp bovis AF2122/97
gccgcgcugcagcacgg

SEQ ID NO: 1149716 - RNA, 17 nt, Mycobacterium bovis subsp bovis AF2122/97
gccgcgcuacgucaagc

SEQ ID NO: 1149717 - RNA, 21 nt, Mycobacterium bovis subsp bovis AF2122/97
gccgcggccacaaccucgucg

SEQ ID NO: 1149718 - RNA, 16 nt, Mycobacterium bovis subsp bovis AF2122/97
gccgcggcacccaggu

SEQ ID NO: 1149719 - RNA, 21 nt, Mycobacterium bovis subsp bovis AF2122/97
gccgcggcacccaggugucgc

SEQ ID NO: 1149720 - RNA, 19 nt, Mycobacterium bovis subsp bovis AF2122/97
gccgcggaugcucagguca

SEQ ID NO: 1149721 - RNA, 19 nt, Mycobacterium bovis subsp bovis AF2122/97
gccgcggacuugcgagccg

SEQ ID NO: 1149722 - RNA, 21 nt, Mycobacterium bovis subsp bovis AF2122/97
gccgcggagaaggcgcgggcg

SEQ ID NO: 1149723 - RNA, 16 nt, Mycobacterium bovis subsp bovis AF2122/97
gccgcggcugccaucc

SEQ ID NO: 1149724 - RNA, 19 nt, Mycobacterium bovis subsp bovis AF2122/97
gccgcggcugccaucccga

SEQ ID NO: 1149725 - RNA, 14 nt, Mycobacterium bovis subsp bovis AF2122/97
gccgcggcuaggcc

SEQ ID NO: 1149726 - RNA, 18 nt, Mycobacterium bovis subsp bovis AF2122/97
gccgcggcuaggccagca

SEQ ID NO: 1149727 - RNA, 20 nt, Mycobacterium bovis subsp bovis AF2122/97
gccgcggcuaggccagcacg

SEQ ID NO: 1149728 - RNA, 22 nt, Mycobacterium bovis subsp bovis AF2122/97
gccgcggcuggugucgggcguc

SEQ ID NO: 1149729 - RNA, 23 nt, Mycobacterium bovis subsp bovis AF2122/97
gccgcggcuggugucgggcguca

SEQ ID NO: 1149730 - RNA, 17 nt, Mycobacterium bovis subsp bovis AF2122/97
gccgcgggacaccaccg

SEQ ID NO: 1149731 - RNA, 15 nt, Mycobacterium bovis subsp bovis AF2122/97
gccgcgggcgcggcc

SEQ ID NO: 1149732 - RNA, 17 nt, Mycobacterium bovis subsp bovis AF2122/97
gccgcgggcgcggccca

SEQ ID NO: 1149733 - RNA, 14 nt, Mycobacterium bovis subsp bovis AF2122/97
gccgcgggcgccgg

SEQ ID NO: 1149734 - RNA, 18 nt, Mycobacterium bovis subsp bovis AF2122/97
gccgcgggcugaccaacc

SEQ ID NO: 1149735 - RNA, 15 nt, Mycobacterium bovis subsp bovis AF2122/97
gccgcggggaucagc

SEQ ID NO: 1149736 - RNA, 13 nt, Mycobacterium bovis subsp bovis AF2122/97
gccgcggggcauc

SEQ ID NO: 1149737 - RNA, 16 nt, Mycobacterium bovis subsp bovis AF2122/97
gccgcggggcaucggu

SEQ ID NO: 1149738 - RNA, 20 nt, Mycobacterium bovis subsp bovis AF2122/97
gccgcgggugaucugggcgg

SEQ ID NO: 1149739 - RNA, 16 nt, Mycobacterium bovis subsp bovis AF2122/97
gccgcgggucgcugcg

SEQ ID NO: 1149740 - RNA, 19 nt, Mycobacterium bovis subsp bovis AF2122/97
gccgcgguagacgccgccg

SEQ ID NO: 1149741 - RNA, 20 nt, Mycobacterium bovis subsp bovis AF2122/97
gccgcgguagacgccgccgu

SEQ ID NO: 1149742 - RNA, 14 nt, Mycobacterium bovis subsp bovis AF2122/97
gccgcggguugggu

SEQ ID NO: 1149743 - RNA, 17 nt, Mycobacterium bovis subsp bovis AF2122/97
gccgcggucggaccacc

SEQ ID NO: 1149744 - RNA, 22 nt, Mycobacterium bovis subsp bovis AF2122/97
gccgcggucaccccggcucggc

SEQ ID NO: 1149745 - RNA, 20 nt, Mycobacterium bovis subsp bovis AF2122/97
gccgcggucagauccagaga

SEQ ID NO: 1149746 - RNA, 18 nt, Mycobacterium bovis subsp bovis AF2122/97
gccgcggucggccaccaa

SEQ ID NO: 1149747 - RNA, 13 nt, Mycobacterium bovis subsp bovis AF2122/97
gccgcggucggcg

SEQ ID NO: 1149748 - RNA, 15 nt, Mycobacterium bovis subsp bovis AF2122/97
gccgcggucggcgac

SEQ ID NO: 1149749 - RNA, 14 nt, Mycobacterium bovis subsp bovis AF2122/97
gccgcggucggcca

SEQ ID NO: 1149750 - RNA, 17 nt, Mycobacterium bovis subsp bovis AF2122/97
gccgcggucggcgugca

SEQ ID NO: 1149751 - RNA, 18 nt, Mycobacterium bovis subsp bovis AF2122/97
gccgcggucgugaucagc

SEQ ID NO: 1149752 - RNA, 24 nt, Mycobacterium bovis subsp bovis AF2122/97
gccgcggucgugaucagcaggacg

SEQ ID NO: 1149753 - RNA, 15 nt, Mycobacterium bovis subsp bovis AF2122/97
gccgcggucguuggc

SEQ ID NO: 1149754 - RNA, 16 nt, Mycobacterium bovis subsp bovis AF2122/97
gccgcggucguuggcg

SEQ ID NO: 1149755 - RNA, 21 nt, Mycobacterium bovis subsp bovis AF2122/97
gccgcgguggaugcgaugcgc

SEQ ID NO: 1149756 - RNA, 14 nt, Mycobacterium bovis subsp bovis AF2122/97
gccgcgguuuggcg

SEQ ID NO: 1149757 - RNA, 21 nt, Mycobacterium bovis subsp bovis AF2122/97
gccgcgguuuggcgacgucga

SEQ ID NO: 1149758 - RNA, 22 nt, Mycobacterium bovis subsp bovis AF2122/97
gccgcgguuuggcgacgucgac

SEQ ID NO: 1149759 - RNA, 18 nt, Mycobacterium bovis subsp bovis AF2122/97
gccgcgguuuucgccgga

SEQ ID NO: 1149760 - RNA, 21 nt, Mycobacterium bovis subsp bovis AF2122/97
gccgcgguguagaagcgggcg

SEQ ID NO: 1149761 - RNA, 17 nt, Mycobacterium bovis subsp bovis AF2122/97
gccgcgguuaucgccga

SEQ ID NO: 1149762 - RNA, 20 nt, Mycobacterium bovis subsp bovis AF2122/97
gccgcguagguggccagcgc

SEQ ID NO: 1149763 - RNA, 22 nt, Mycobacterium bovis subsp bovis AF2122/97
gccgcguaggccuugcucagcc

SEQ ID NO: 1149764 - RNA, 13 nt, Mycobacterium bovis subsp bovis AF2122/97
gccgcguccagac

SEQ ID NO: 1149765 - RNA, 14 nt, Mycobacterium bovis subsp bovis AF2122/97
gccgcguccagacc

SEQ ID NO: 1149766 - RNA, 16 nt, Mycobacterium bovis subsp bovis AF2122/97
gccgcguccagaccgu

SEQ ID NO: 1149767 - RNA, 15 nt, Mycobacterium bovis subsp bovis AF2122/97
gccgcgucgagcacc

SEQ ID NO: 1149768 - RNA, 17 nt, Mycobacterium bovis subsp bovis AF2122/97
gccgcgucgaacugggc

SEQ ID NO: 1149769 - RNA, 12 nt, Mycobacterium bovis subsp bovis AF2122/97
gccgcgucgcga

SEQ ID NO: 1149770 - RNA, 15 nt, Mycobacterium bovis subsp bovis AF2122/97
gccgcgucgucgaga

SEQ ID NO: 1149771 - RNA, 21 nt, Mycobacterium bovis subsp bovis AF2122/97
gccgcgugacguaccacggcg

SEQ ID NO: 1149772 - RNA, 13 nt, Mycobacterium bovis subsp bovis AF2122/97
gccgcgugcagcc

SEQ ID NO: 1149773 - RNA, 20 nt, Mycobacterium bovis subsp bovis AF2122/97
gccgcucgccgguaggcggc

SEQ ID NO: 1149774 - RNA, 20 nt, Mycobacterium bovis subsp bovis AF2122/97
gccgcucgaccccgcgcugg

SEQ ID NO: 1149775 - RNA, 14 nt, Mycobacterium bovis subsp bovis AF2122/97
gccgcucgacggcc

SEQ ID NO: 1149776 - RNA, 21 nt, Mycobacterium bovis subsp bovis AF2122/97
gccgcugaacucaacgggacc

SEQ ID NO: 1149777 - RNA, 22 nt, Mycobacterium bovis subsp bovis AF2122/97
gccgcucuagcgucgugugggu

SEQ ID NO: 1149778 - RNA, 19 nt, Mycobacterium bovis subsp bovis AF2122/97
gccgcucguuacgccgagc

SEQ ID NO: 1149779 - RNA, 14 nt, Mycobacterium bovis subsp bovis AF2122/97
gccgcucauccagc

SEQ ID NO: 1149780 - RNA, 13 nt, Mycobacterium bovis subsp bovis AF2122/97
gccgcucaccccg

SEQ ID NO: 1149781 - RNA, 16 nt, Mycobacterium bovis subsp bovis AF2122/97
gccgcuccacguacgc

SEQ ID NO: 1149782 - RNA, 18 nt, Mycobacterium bovis subsp bovis AF2122/97
gccgcucauuagcccccg

SEQ ID NO: 1149783 - RNA, 21 nt, Mycobacterium bovis subsp bovis AF2122/97
gccgcuccaaaagccucagcc

SEQ ID NO: 1149784 - RNA, 21 nt, Mycobacterium bovis subsp bovis AF2122/97
gccgcuccaccacgaccgcga

SEQ ID NO: 1149785 - RNA, 16 nt, Mycobacterium bovis subsp bovis AF2122/97
gccgcucauccagcgc

SEQ ID NO: 1149786 - RNA, 19 nt, Mycobacterium bovis subsp bovis AF2122/97
gccgcucauccagcgcgug

SEQ ID NO: 1149787 - RNA, 20 nt, Mycobacterium bovis subsp bovis AF2122/97
gccgcuccacguacgcggcu

SEQ ID NO: 1149788 - RNA, 14 nt, Mycobacterium bovis subsp bovis AF2122/97
gccgcucccgcaca

SEQ ID NO: 1149789 - RNA, 16 nt, Mycobacterium bovis subsp bovis AF2122/97
gccgcgugggcaugcg

SEQ ID NO: 1149790 - RNA, 19 nt, Mycobacterium bovis subsp bovis AF2122/97
gccgcgugcugcggcuggu

SEQ ID NO: 1149791 - RNA, 16 nt, Mycobacterium bovis subsp bovis AF2122/97
gccgcguggcuggcgg

SEQ ID NO: 1149792 - RNA, 20 nt, Mycobacterium bovis subsp bovis AF2122/97
gccgcguggcuggcggcgac

SEQ ID NO: 1149793 - RNA, 18 nt, Mycobacterium bovis subsp bovis AF2122/97
gccgcguuucccggaaua

SEQ ID NO: 1149794 - RNA, 22 nt, Mycobacterium bovis subsp bovis AF2122/97
gccgcguuugggguuguuggcg

SEQ ID NO: 1149795 - RNA, 13 nt, Mycobacterium bovis subsp bovis AF2122/97
gccgcguugccgg

SEQ ID NO: 1149796 - RNA, 20 nt, Mycobacterium bovis subsp bovis AF2122/97
gccgcguugccgggguuggu

SEQ ID NO: 1149797 - RNA, 17 nt, Mycobacterium bovis subsp bovis AF2122/97
gccgcguugccggucgc

SEQ ID NO: 1149798 - RNA, 23 nt, Mycobacterium bovis subsp bovis AF2122/97
gccgcucacauacagcaggccgc

SEQ ID NO: 1149799 - RNA, 23 nt, Mycobacterium bovis subsp bovis AF2122/97
gccgcuauggcccgggccgaagc

SEQ ID NO: 1149800 - RNA, 23 nt, Mycobacterium bovis subsp bovis AF2122/97
gccgcuaucgaggaggcggucga

SEQ ID NO: 1149801 - RNA, 15 nt, Mycobacterium bovis subsp bovis AF2122/97
gccgcuaggacggcg

SEQ ID NO: 1149802 - RNA, 16 nt, Mycobacterium bovis subsp bovis AF2122/97
gccgcuaggacggcgc

SEQ ID NO: 1149803 - RNA, 17 nt, Mycobacterium bovis subsp bovis AF2122/97
gccgcuaggacggcgcg

SEQ ID NO: 1149804 - RNA, 18 nt, Mycobacterium bovis subsp bovis AF2122/97
gccgcuaggacggcgcga

SEQ ID NO: 1149805 - RNA, 21 nt, Mycobacterium bovis subsp bovis AF2122/97
gccgcuaggacggcgcgagcc

SEQ ID NO: 1149806 - RNA, 14 nt, Mycobacterium bovis subsp bovis AF2122/97
gccgcuacgccggc

SEQ ID NO: 1149807 - RNA, 19 nt, Mycobacterium bovis subsp bovis AF2122/97
gccgcuacccccgauggcg

SEQ ID NO: 1149808 - RNA, 23 nt, Mycobacterium bovis subsp bovis AF2122/97
gccgcuacccggacagggcggcg

SEQ ID NO: 1149809 - RNA, 14 nt, Mycobacterium bovis subsp bovis AF2122/97
gccgcuaccgccgg

SEQ ID NO: 1149810 - RNA, 13 nt, Mycobacterium bovis subsp bovis AF2122/97
gccgcuaccguca

SEQ ID NO: 1149811 - RNA, 15 nt, Mycobacterium bovis subsp bovis AF2122/97
gccgccggcgccgaa

SEQ ID NO: 1149812 - RNA, 14 nt, Mycobacterium bovis subsp bovis AF2122/97
gccgccggcgccgc

SEQ ID NO: 1149813 - RNA, 21 nt, Mycobacterium bovis subsp bovis AF2122/97
gccgccggcgcccaggccgau

SEQ ID NO: 1149814 - RNA, 12 nt, Mycobacterium bovis subsp bovis AF2122/97
gccgccggcgcg

SEQ ID NO: 1149815 - RNA, 15 nt, Mycobacterium bovis subsp bovis AF2122/97
gccgccggcgccgcc

SEQ ID NO: 1149816 - RNA, 17 nt, Mycobacterium bovis subsp bovis AF2122/97
gccgccggcgccgccga

SEQ ID NO: 1149817 - RNA, 18 nt, Mycobacterium bovis subsp bovis AF2122/97
gccgccggcgccgccgau

SEQ ID NO: 1149818 - RNA, 12 nt, Mycobacterium bovis subsp bovis AF2122/97
gccgccggcggc

SEQ ID NO: 1149819 - RNA, 13 nt, Mycobacterium bovis subsp bovis AF2122/97
gccgccggcgcgu

SEQ ID NO: 1149820 - RNA, 19 nt, Mycobacterium bovis subsp bovis AF2122/97
gccgccggcggcgguaccg

SEQ ID NO: 1149821 - RNA, 13 nt, Mycobacterium bovis subsp bovis AF2122/97
gccgccggcucgc

SEQ ID NO: 1149822 - RNA, 14 nt, Mycobacterium bovis subsp bovis AF2122/97
gccgccgggcaucg

SEQ ID NO: 1149823 - RNA, 15 nt, Mycobacterium bovis subsp bovis AF2122/97
gccgccgggcaguuc

SEQ ID NO: 1149824 - RNA, 20 nt, Mycobacterium bovis subsp bovis AF2122/97
gccgccgggauaacccagca

SEQ ID NO: 1149825 - RNA, 22 nt, Mycobacterium bovis subsp bovis AF2122/97
gccgccgggauaacccagcacc

SEQ ID NO: 1149826 - RNA, 14 nt, Mycobacterium bovis subsp bovis AF2122/97
gccgccggcuccac

SEQ ID NO: 1149827 - RNA, 16 nt, Mycobacterium bovis subsp bovis AF2122/97
gccgccggcggucgcg

SEQ ID NO: 1149828 - RNA, 17 nt, Mycobacterium bovis subsp bovis AF2122/97
gccgccggcggucgcgu

SEQ ID NO: 1149829 - RNA, 16 nt, Mycobacterium bovis subsp bovis AF2122/97
gccgccgggugcgccg

SEQ ID NO: 1149830 - RNA, 14 nt, Mycobacterium bovis subsp bovis AF2122/97
gccgccggucaucc

SEQ ID NO: 1149831 - RNA, 11 nt, Mycobacterium bovis subsp bovis AF2122/97
gccgccggugc

SEQ ID NO: 1149832 - RNA, 15 nt, Mycobacterium bovis subsp bovis AF2122/97
gccgccggugccgau

SEQ ID NO: 1149833 - RNA, 20 nt, Mycobacterium bovis subsp bovis AF2122/97
gccgccggugccacccuugc

SEQ ID NO: 1149834 - RNA, 16 nt, Mycobacterium bovis subsp bovis AF2122/97
gccgccggugccaccg

SEQ ID NO: 1149835 - RNA, 15 nt, Mycobacterium bovis subsp bovis AF2122/97
gccgccggugccacc

SEQ ID NO: 1149836 - RNA, 14 nt, Mycobacterium bovis subsp bovis AF2122/97
gccgccggugccgc

SEQ ID NO: 1149837 - RNA, 18 nt, Mycobacterium bovis subsp bovis AF2122/97
gccgccggugccgcccga

SEQ ID NO: 1149838 - RNA, 17 nt, Mycobacterium bovis subsp bovis AF2122/97
gccgccggugccgccga

SEQ ID NO: 1149839 - RNA, 12 nt, Mycobacterium bovis subsp bovis AF2122/97
gccgccgguguc

SEQ ID NO: 1149840 - RNA, 20 nt, Mycobacterium bovis subsp bovis AF2122/97
gccgccgguguuagccccga

SEQ ID NO: 1149841 - RNA, 14 nt, Mycobacterium bovis subsp bovis AF2122/97
gccgccgguuccgc

SEQ ID NO: 1149842 - RNA, 18 nt, Mycobacterium bovis subsp bovis AF2122/97
gccgccgguuccgccggc

SEQ ID NO: 1149843 - RNA, 20 nt, Mycobacterium bovis subsp bovis AF2122/97
gccgccgguggugccggcgc

SEQ ID NO: 1149844 - RNA, 19 nt, Mycobacterium bovis subsp bovis AF2122/97
gccgccgguguaacccucg

SEQ ID NO: 1149845 - RNA, 17 nt, Mycobacterium bovis subsp bovis AF2122/97
gccgccguaacggucgc

SEQ ID NO: 1149846 - RNA, 12 nt, Mycobacterium bovis subsp bovis AF2122/97
gccgccgucacc

SEQ ID NO: 1149847 - RNA, 23 nt, Mycobacterium bovis subsp bovis AF2122/97
gccgccgucaccgccguugccga

SEQ ID NO: 1149848 - RNA, 12 nt, Mycobacterium bovis subsp bovis AF2122/97
gccgccgucgac

SEQ ID NO: 1149849 - RNA, 17 nt, Mycobacterium bovis subsp bovis AF2122/97
gccgccguccccgccga

SEQ ID NO: 1149850 - RNA, 20 nt, Mycobacterium bovis subsp bovis AF2122/97
gccgccguccccgccgacgc

SEQ ID NO: 1149851 - RNA, 22 nt, Mycobacterium bovis subsp bovis AF2122/97
gccgccguccccgccgacgccg

SEQ ID NO: 1149852 - RNA, 23 nt, Mycobacterium bovis subsp bovis AF2122/97
gccgccguccccgccgacgccga

SEQ ID NO: 1149853 - RNA, 22 nt, Mycobacterium bovis subsp bovis AF2122/97
gccgccguccccgccgucgcca

SEQ ID NO: 1149854 - RNA, 13 nt, Mycobacterium bovis subsp bovis AF2122/97
gccgccgucggcg

SEQ ID NO: 1149855 - RNA, 14 nt, Mycobacterium bovis subsp bovis AF2122/97
gccgccgucggcga

SEQ ID NO: 1149856 - RNA, 18 nt, Mycobacterium bovis subsp bovis AF2122/97
gccgccgucggcgagcag

SEQ ID NO: 1149857 - RNA, 14 nt, Mycobacterium bovis subsp bovis AF2122/97
gccgccgucgauga

SEQ ID NO: 1149858 - RNA, 15 nt, Mycobacterium bovis subsp bovis AF2122/97
gccgccgucgccgau

SEQ ID NO: 1149859 - RNA, 20 nt, Mycobacterium bovis subsp bovis AF2122/97
gccgccguuggcucgagccg

SEQ ID NO: 1149860 - RNA, 17 nt, Mycobacterium bovis subsp bovis AF2122/97
gccgccguucccgccgg

SEQ ID NO: 1149861 - RNA, 18 nt, Mycobacterium bovis subsp bovis AF2122/97
gccgccguucccgccggc

SEQ ID NO: 1149862 - RNA, 21 nt, Mycobacterium bovis subsp bovis AF2122/97
gccgccguucccgccggcgcc

SEQ ID NO: 1149863 - RNA, 17 nt, Mycobacterium bovis subsp bovis AF2122/97
gccgccguugccgucgu

SEQ ID NO: 1149864 - RNA, 17 nt, Mycobacterium bovis subsp bovis AF2122/97
gccgccguugccgccgg

SEQ ID NO: 1149865 - RNA, 20 nt, Mycobacterium bovis subsp bovis AF2122/97
gccgccguugccgccggcgc

SEQ ID NO: 1149866 - RNA, 21 nt, Mycobacterium bovis subsp bovis AF2122/97
gccgccguugccgccggcgcc

SEQ ID NO: 1149867 - RNA, 20 nt, Mycobacterium bovis subsp bovis AF2122/97
gccgccguugccgccgucgu

SEQ ID NO: 1149868 - RNA, 23 nt, Mycobacterium bovis subsp bovis AF2122/97
gccgccguugccgccguugccga

SEQ ID NO: 1149869 - RNA, 14 nt, Mycobacterium bovis subsp bovis AF2122/97
gccgccguugccgg

SEQ ID NO: 1149870 - RNA, 21 nt, Mycobacterium bovis subsp bovis AF2122/97
gccgccguugccggcuuggcc

SEQ ID NO: 1149871 - RNA, 18 nt, Mycobacterium bovis subsp bovis AF2122/97
gccgccguucgggaugca

SEQ ID NO: 1149872 - RNA, 23 nt, Mycobacterium bovis subsp bovis AF2122/97
gccgccguucgggaugcaaggaa

SEQ ID NO: 1149873 - RNA, 11 nt, Mycobacterium bovis subsp bovis AF2122/97
gccgccguugc

SEQ ID NO: 1149874 - RNA, 19 nt, Mycobacterium bovis subsp bovis AF2122/97
gccgccguugccgaucacc

SEQ ID NO: 1149875 - RNA, 20 nt, Mycobacterium bovis subsp bovis AF2122/97
gccgccgucguacaccucga

SEQ ID NO: 1149876 - RNA, 16 nt, Mycobacterium bovis subsp bovis AF2122/97
gccgccgucgccgcca

SEQ ID NO: 1149877 - RNA, 16 nt, Mycobacterium bovis subsp bovis AF2122/97
gccgccgucgccgccg

SEQ ID NO: 1149878 - RNA, 19 nt, Mycobacterium bovis subsp bovis AF2122/97
gccgccguuaccgagcccg

SEQ ID NO: 1149879 - RNA, 22 nt, Mycobacterium bovis subsp bovis AF2122/97
gccgccguucccaccaccaccg

SEQ ID NO: 1149880 - RNA, 14 nt, Mycobacterium bovis subsp bovis AF2122/97
gccgccguuaccgc

SEQ ID NO: 1149881 - RNA, 20 nt, Mycobacterium bovis subsp bovis AF2122/97
gccgccguuaccgccgcugc

SEQ ID NO: 1149882 - RNA, 22 nt, Mycobacterium bovis subsp bovis AF2122/97
gccgccguuaccgccgcugccg

SEQ ID NO: 1149883 - RNA, 17 nt, Mycobacterium bovis subsp bovis AF2122/97
gccgccguuaccgccgg

SEQ ID NO: 1149884 - RNA, 21 nt, Mycobacterium bovis subsp bovis AF2122/97
gccgccguggcgucggcguca

SEQ ID NO: 1149885 - RNA, 18 nt, Mycobacterium bovis subsp bovis AF2122/97
gccgccgaucgacacccg

SEQ ID NO: 1149886 - RNA, 17 nt, Mycobacterium bovis subsp bovis AF2122/97
gccgccgaugucgacga

SEQ ID NO: 1149887 - RNA, 16 nt, Mycobacterium bovis subsp bovis AF2122/97
gccgccgccgccaucg

SEQ ID NO: 1149888 - RNA, 13 nt, Mycobacterium bovis subsp bovis AF2122/97
gccgccgccccgg

SEQ ID NO: 1149889 - RNA, 13 nt, Mycobacterium bovis subsp bovis AF2122/97
gccgccgccggcg

SEQ ID NO: 1149890 - RNA, 14 nt, Mycobacterium bovis subsp bovis AF2122/97
gccgccgccggcgc

SEQ ID NO: 1149891 - RNA, 16 nt, Mycobacterium bovis subsp bovis AF2122/97
gccgccgccggcgccg

SEQ ID NO: 1149892 - RNA, 12 nt, Mycobacterium bovis subsp bovis AF2122/97
gccgccgccggc

SEQ ID NO: 1149893 - RNA, 14 nt, Mycobacterium bovis subsp bovis AF2122/97
gccgccgccgccgg

SEQ ID NO: 1149894 - RNA, 15 nt, Mycobacterium bovis subsp bovis AF2122/97
gccgccgccgccggc

SEQ ID NO: 1149895 - RNA, 22 nt, Mycobacterium bovis subsp bovis AF2122/97
gccgccgccugcuccucggcca

SEQ ID NO: 1149896 - RNA, 21 nt, Mycobacterium bovis subsp bovis AF2122/97
gccgccgccugugcgcgguga

SEQ ID NO: 1149897 - RNA, 13 nt, Mycobacterium bovis subsp bovis AF2122/97
gccgccgcgacca

SEQ ID NO: 1149898 - RNA, 15 nt, Mycobacterium bovis subsp bovis AF2122/97
gccgccgccggcggu

SEQ ID NO: 1149899 - RNA, 15 nt, Mycobacterium bovis subsp bovis AF2122/97
gccgccgccgucggc

SEQ ID NO: 1149900 - RNA, 18 nt, Mycobacterium bovis subsp bovis AF2122/97
gccgccgagggcgccggg

SEQ ID NO: 1149901 - RNA, 19 nt, Mycobacterium bovis subsp bovis AF2122/97
gccgccgagggcgccgggg

SEQ ID NO: 1149902 - RNA, 21 nt, Mycobacterium bovis subsp bovis AF2122/97
gccgccgaggucgguucggcc

SEQ ID NO: 1149903 - RNA, 14 nt, Mycobacterium bovis subsp bovis AF2122/97
gccgccgagcuggc

SEQ ID NO: 1149904 - RNA, 21 nt, Mycobacterium bovis subsp bovis AF2122/97
gccgccgagcuggcgcgcggg

SEQ ID NO: 1149905 - RNA, 13 nt, Mycobacterium bovis subsp bovis AF2122/97
gccgccgaucacc

SEQ ID NO: 1149906 - RNA, 14 nt, Mycobacterium bovis subsp bovis AF2122/97
gccgccgaucacca

SEQ ID NO: 1149907 - RNA, 15 nt, Mycobacterium bovis subsp bovis AF2122/97
gccgccgaucaccag

SEQ ID NO: 1149908 - RNA, 19 nt, Mycobacterium bovis subsp bovis AF2122/97
gccgccaccuuggcugggc

SEQ ID NO: 1149909 - RNA, 23 nt, Mycobacterium bovis subsp bovis AF2122/97
gccgccacgguacauccagagac

SEQ ID NO: 1149910 - RNA, 15 nt, Mycobacterium bovis subsp bovis AF2122/97
gccgccacgggcggc

SEQ ID NO: 1149911 - RNA, 17 nt, Mycobacterium bovis subsp bovis AF2122/97
gccgccacgggcggcca

SEQ ID NO: 1149912 - RNA, 19 nt, Mycobacterium bovis subsp bovis AF2122/97
gccgccacggaucgcggcg

SEQ ID NO: 1149913 - RNA, 17 nt, Mycobacterium bovis subsp bovis AF2122/97
gccgccggaggugacaa

SEQ ID NO: 1149914 - RNA, 14 nt, Mycobacterium bovis subsp bovis AF2122/97
gccgccggaguugg

SEQ ID NO: 1149915 - RNA, 20 nt, Mycobacterium bovis subsp bovis AF2122/97
gccgccggaucgccacggug

SEQ ID NO: 1149916 - RNA, 18 nt, Mycobacterium bovis subsp bovis AF2122/97
gccgccggaucgccggug

SEQ ID NO: 1149917 - RNA, 19 nt, Mycobacterium bovis subsp bovis AF2122/97
gccgccggcacccgccgug

SEQ ID NO: 1149918 - RNA, 13 nt, Mycobacterium bovis subsp bovis AF2122/97
gccgccggcaccg

SEQ ID NO: 1149919 - RNA, 22 nt, Mycobacterium bovis subsp bovis AF2122/97
gccgccggcaccgccggcgcca

SEQ ID NO: 1149920 - RNA, 15 nt, Mycobacterium bovis subsp bovis AF2122/97
gccgccggcaccgua

SEQ ID NO: 1149921 - RNA, 12 nt, Mycobacterium bovis subsp bovis AF2122/97
gccgccggccag

SEQ ID NO: 1149922 - RNA, 23 nt, Mycobacterium bovis subsp bovis AF2122/97
gccgccggccaguccgcgcgcaa

SEQ ID NO: 1149923 - RNA, 14 nt, Mycobacterium bovis subsp bovis AF2122/97
gccgccggccggca

SEQ ID NO: 1149924 - RNA, 24 nt, Mycobacterium bovis subsp bovis AF2122/97
gccgccggccggcauccgguucgc

SEQ ID NO: 1149925 - RNA, 16 nt, Mycobacterium bovis subsp bovis AF2122/97
gccgccggccccgcca

SEQ ID NO: 1149926 - RNA, 18 nt, Mycobacterium bovis subsp bovis AF2122/97
gccgccggccccgccagc

SEQ ID NO: 1149927 - RNA, 20 nt, Mycobacterium bovis subsp bovis AF2122/97
gccgccggccccgccagcgc

SEQ ID NO: 1149928 - RNA, 21 nt, Mycobacterium bovis subsp bovis AF2122/97
gccgccggccccgccagcgcc

SEQ ID NO: 1149929 - RNA, 23 nt, Mycobacterium bovis subsp bovis AF2122/97
gccgccggccccgccgucgccgc

SEQ ID NO: 1149930 - RNA, 12 nt, Mycobacterium bovis subsp bovis AF2122/97
gccgccggcgaa

SEQ ID NO: 1149931 - RNA, 11 nt, Mycobacterium bovis subsp bovis AF2122/97
gccgccggcgc

SEQ ID NO: 1149932 - RNA, 18 nt, Mycobacterium bovis subsp bovis AF2122/97
gccgccggcgccagcgcc

SEQ ID NO: 1149933 - RNA, 15 nt, Mycobacterium bovis subsp bovis AF2122/97
gccgccggcgccauc

SEQ ID NO: 1149934 - RNA, 14 nt, Mycobacterium bovis subsp bovis AF2122/97
gccgccggcgccag

SEQ ID NO: 1149935 - RNA, 14 nt, Mycobacterium bovis subsp bovis AF2122/97
gccgccgcggcagg

SEQ ID NO: 1149936 - RNA, 12 nt, Mycobacterium bovis subsp bovis AF2122/97
gccgccgcggcc

SEQ ID NO: 1149937 - RNA, 14 nt, Mycobacterium bovis subsp bovis AF2122/97
gccgccgcggccac

SEQ ID NO: 1149938 - RNA, 19 nt, Mycobacterium bovis subsp bovis AF2122/97
gccgccgcggccaccaccg

SEQ ID NO: 1149939 - RNA, 13 nt, Mycobacterium bovis subsp bovis AF2122/97
gccgccgcggcga

SEQ ID NO: 1149940 - RNA, 15 nt, Mycobacterium bovis subsp bovis AF2122/97
gccgccgcggcgaag

SEQ ID NO: 1149941 - RNA, 15 nt, Mycobacterium bovis subsp bovis AF2122/97
gccgccgcggcuugu

SEQ ID NO: 1149942 - RNA, 19 nt, Mycobacterium bovis subsp bovis AF2122/97
gccgccgcgggacaccacc

SEQ ID NO: 1149943 - RNA, 22 nt, Mycobacterium bovis subsp bovis AF2122/97
gccgccgcgggacaccaccgcc

SEQ ID NO: 1149944 - RNA, 17 nt, Mycobacterium bovis subsp bovis AF2122/97
gccgccgcggccggcgc

SEQ ID NO: 1149945 - RNA, 13 nt, Mycobacterium bovis subsp bovis AF2122/97
gccgccgcgggcg

SEQ ID NO: 1149946 - RNA, 14 nt, Mycobacterium bovis subsp bovis AF2122/97
gccgccgcgucgac

SEQ ID NO: 1149947 - RNA, 17 nt, Mycobacterium bovis subsp bovis AF2122/97
gccgccgcgggcgccgg

SEQ ID NO: 1149948 - RNA, 15 nt, Mycobacterium bovis subsp bovis AF2122/97
gccgccgcugccgcc

SEQ ID NO: 1149949 - RNA, 17 nt, Mycobacterium bovis subsp bovis AF2122/97
gccgccgcuacccccga

SEQ ID NO: 1149950 - RNA, 22 nt, Mycobacterium bovis subsp bovis AF2122/97
gccgccgcuacccccgauggcg

SEQ ID NO: 1149951 - RNA, 14 nt, Mycobacterium bovis subsp bovis AF2122/97
gccgccgcuaccgc

SEQ ID NO: 1149952 - RNA, 17 nt, Mycobacterium bovis subsp bovis AF2122/97
gccgccgcuaccgccgg

SEQ ID NO: 1149953 - RNA, 14 nt, Mycobacterium bovis subsp bovis AF2122/97
gccgccgcuucacc

SEQ ID NO: 1149954 - RNA, 17 nt, Mycobacterium bovis subsp bovis AF2122/97
gccgccggaagcgccgg

SEQ ID NO: 1149955 - RNA, 23 nt, Mycobacterium bovis subsp bovis AF2122/97
gccgccggaagcgccggccgauc

SEQ ID NO: 1149956 - RNA, 13 nt, Mycobacterium bovis subsp bovis AF2122/97
gccgccgcugguc

SEQ ID NO: 1149957 - RNA, 12 nt, Mycobacterium bovis subsp bovis AF2122/97
gccgccggaccc

SEQ ID NO: 1149958 - RNA, 18 nt, Mycobacterium bovis subsp bovis AF2122/97
gccgccggacccaccguc

SEQ ID NO: 1149959 - RNA, 19 nt, Mycobacterium bovis subsp bovis AF2122/97
gccgccggacccaccguca

SEQ ID NO: 1149960 - RNA, 21 nt, Mycobacterium bovis subsp bovis AF2122/97
gccgccggacccaccgucacc

SEQ ID NO: 1149961 - RNA, 17 nt, Mycobacterium bovis subsp bovis AF2122/97
gccgccggacccgucga

SEQ ID NO: 1149962 - RNA, 15 nt, Mycobacterium bovis subsp bovis AF2122/97
gccgccugcgccgcc

SEQ ID NO: 1149963 - RNA, 16 nt, Mycobacterium bovis subsp bovis AF2122/97
gccgccugcgccgcca

SEQ ID NO: 1149964 - RNA, 20 nt, Mycobacterium bovis subsp bovis AF2122/97
gccgccugcuccucggccag

SEQ ID NO: 1149965 - RNA, 18 nt, Mycobacterium bovis subsp bovis AF2122/97
gccgccuggguugaccgc

SEQ ID NO: 1149966 - RNA, 20 nt, Mycobacterium bovis subsp bovis AF2122/97
gccgccuggguugaccgcca

SEQ ID NO: 1149967 - RNA, 22 nt, Mycobacterium bovis subsp bovis AF2122/97
gccgccuuccuggcgggcgccu

SEQ ID NO: 1149968 - RNA, 14 nt, Mycobacterium bovis subsp bovis AF2122/97
gccgccugucccgc

SEQ ID NO: 1149969 - RNA, 16 nt, Mycobacterium bovis subsp bovis AF2122/97
gccgccugucccgccg

SEQ ID NO: 1149970 - RNA, 18 nt, Mycobacterium bovis subsp bovis AF2122/97
gccgccugucccgccggc

SEQ ID NO: 1149971 - RNA, 18 nt, Mycobacterium bovis subsp bovis AF2122/97
gccgccucaaugaccacc

SEQ ID NO: 1149972 - RNA, 22 nt, Mycobacterium bovis subsp bovis AF2122/97
gccgccuacccguucuucgcga

SEQ ID NO: 1149973 - RNA, 14 nt, Mycobacterium bovis subsp bovis AF2122/97
gccgccuccgccga

SEQ ID NO: 1149974 - RNA, 21 nt, Mycobacterium bovis subsp bovis AF2122/97
gccgccuccgccugccccacc

SEQ ID NO: 1149975 - RNA, 16 nt, Mycobacterium bovis subsp bovis AF2122/97
gccgccuccgcggcau

SEQ ID NO: 1149976 - RNA, 18 nt, Mycobacterium bovis subsp bovis AF2122/97
gccgccucgucgucggac

SEQ ID NO: 1149977 - RNA, 14 nt, Mycobacterium bovis subsp bovis AF2122/97
gccgccucgggcac

SEQ ID NO: 1149978 - RNA, 13 nt, Mycobacterium bovis subsp bovis AF2122/97
gccgccugcccgg

SEQ ID NO: 1149979 - RNA, 22 nt, Mycobacterium bovis subsp bovis AF2122/97
gccgccucgcggaugagcucgg

SEQ ID NO: 1149980 - RNA, 19 nt, Mycobacterium bovis subsp bovis AF2122/97
gccgccucgaucgacucga

SEQ ID NO: 1149981 - RNA, 13 nt, Mycobacterium bovis subsp bovis AF2122/97
gccgcgaccgcga

SEQ ID NO: 1149982 - RNA, 14 nt, Mycobacterium bovis subsp bovis AF2122/97
gccgcgaccagcgc

SEQ ID NO: 1149983 - RNA, 16 nt, Mycobacterium bovis subsp bovis AF2122/97
gccgcgaccagcgccg

SEQ ID NO: 1149984 - RNA, 16 nt, Mycobacterium bovis subsp bovis AF2122/97
gccgcgaccgcgagca

SEQ ID NO: 1149985 - RNA, 13 nt, Mycobacterium bovis subsp bovis AF2122/97
gccgcgaccggcg

SEQ ID NO: 1149986 - RNA, 17 nt, Mycobacterium bovis subsp bovis AF2122/97
gccgcgaccggcguaac

SEQ ID NO: 1149987 - RNA, 14 nt, Mycobacterium bovis subsp bovis AF2122/97
gccgcgacccgcgc

SEQ ID NO: 1149988 - RNA, 16 nt, Mycobacterium bovis subsp bovis AF2122/97
gccgcgacauccgcgg

SEQ ID NO: 1149989 - RNA, 21 nt, Mycobacterium bovis subsp bovis AF2122/97
gccgcgacauccgcggcaugc

SEQ ID NO: 1149990 - RNA, 17 nt, Mycobacterium bovis subsp bovis AF2122/97
gccgcgacacgugcauc

SEQ ID NO: 1149991 - RNA, 22 nt, Mycobacterium bovis subsp bovis AF2122/97
gccgcgacaauggugcccagga

SEQ ID NO: 1149992 - RNA, 22 nt, Mycobacterium bovis subsp bovis AF2122/97
gccgcgaccgccucgccguaga

SEQ ID NO: 1149993 - RNA, 14 nt, Mycobacterium bovis subsp bovis AF2122/97
gccgcgacgacacg

SEQ ID NO: 1149994 - RNA, 15 nt, Mycobacterium bovis subsp bovis AF2122/97
gccgcgacgacacgc

SEQ ID NO: 1149995 - RNA, 18 nt, Mycobacterium bovis subsp bovis AF2122/97
gccgcgacgacacgccug

SEQ ID NO: 1149996 - RNA, 19 nt, Mycobacterium bovis subsp bovis AF2122/97
gccgcgacgaugccucggc

SEQ ID NO: 1149997 - RNA, 23 nt, Mycobacterium bovis subsp bovis AF2122/97
gccgcgacgaugccucggcggcc

SEQ ID NO: 1149998 - RNA, 14 nt, Mycobacterium bovis subsp bovis AF2122/97
gccgcgacgcggcg

SEQ ID NO: 1149999 - RNA, 13 nt, Mycobacterium bovis subsp bovis AF2122/97
gccgcgacugcac

SEQ ID NO: 1150000 - RNA, 14 nt, Mycobacterium bovis subsp bovis AF2122/97
gccgcgacggcacg

SEQ ID NO: 1150001 - RNA, 15 nt, Mycobacterium bovis subsp bovis AF2122/97
gccgcgacguugaac

SEQ ID NO: 1150002 - RNA, 22 nt, Mycobacterium bovis subsp bovis AF2122/97
gccgcgacaaaucggucgacga

SEQ ID NO: 1150003 - RNA, 22 nt, Mycobacterium bovis subsp bovis AF2122/97
gccgcgaaugaagcccucgucg

SEQ ID NO: 1150004 - RNA, 17 nt, Mycobacterium bovis subsp bovis AF2122/97
gccgcgaaugcugugcc

SEQ ID NO: 1150005 - RNA, 17 nt, Mycobacterium bovis subsp bovis AF2122/97
gccgcgaaugucgccgc

SEQ ID NO: 1150006 - RNA, 18 nt, Mycobacterium bovis subsp bovis AF2122/97
gccgcgaaggggugcccg

SEQ ID NO: 1150007 - RNA, 21 nt, Mycobacterium bovis subsp bovis AF2122/97
gccgcgaaggggugcccggcg

SEQ ID NO: 1150008 - RNA, 17 nt, Mycobacterium bovis subsp bovis AF2122/97
gccgcgaagcgcucggc

SEQ ID NO: 1150009 - RNA, 22 nt, Mycobacterium bovis subsp bovis AF2122/97
gccgcgaagcgcucggcagccg

SEQ ID NO: 1150010 - RNA, 21 nt, Mycobacterium bovis subsp bovis AF2122/97
gccgcgaacuccagcagcccg

SEQ ID NO: 1150011 - RNA, 15 nt, Mycobacterium bovis subsp bovis AF2122/97
gccgcgaacgggucg

SEQ ID NO: 1150012 - RNA, 17 nt, Mycobacterium bovis subsp bovis AF2122/97
gccgccuuggcccccgg

SEQ ID NO: 1150013 - RNA, 20 nt, Mycobacterium bovis subsp bovis AF2122/97
gccgccuuggucgcgucggc

SEQ ID NO: 1150014 - RNA, 18 nt, Mycobacterium bovis subsp bovis AF2122/97
gccgccuucuccggcguc

SEQ ID NO: 1150015 - RNA, 15 nt, Mycobacterium bovis subsp bovis AF2122/97
gccgccuucuucucg

SEQ ID NO: 1150016 - RNA, 20 nt, Mycobacterium bovis subsp bovis AF2122/97
gccgccuucuucucggcgag

SEQ ID NO: 1150017 - RNA, 21 nt, Mycobacterium bovis subsp bovis AF2122/97
gccgccuuugcccccgguguc

SEQ ID NO: 1150018 - RNA, 19 nt, Mycobacterium bovis subsp bovis AF2122/97
gccgcgcaccaacaccagc

SEQ ID NO: 1150019 - RNA, 21 nt, Mycobacterium bovis subsp bovis AF2122/97
gccgcgcaccaacaccagcgc

SEQ ID NO: 1150020 - RNA, 23 nt, Mycobacterium bovis subsp bovis AF2122/97
gccgcgcacccguccgccgcaga

SEQ ID NO: 1150021 - RNA, 12 nt, Mycobacterium bovis subsp bovis AF2122/97
gccgcgcaccga

SEQ ID NO: 1150022 - RNA, 20 nt, Mycobacterium bovis subsp bovis AF2122/97
gccgcgaugcgccuugacga

SEQ ID NO: 1150023 - RNA, 12 nt, Mycobacterium bovis subsp bovis AF2122/97
gccgcgauggcc

SEQ ID NO: 1150024 - RNA, 15 nt, Mycobacterium bovis subsp bovis AF2122/97
gccgcgauggccccu

SEQ ID NO: 1150025 - RNA, 23 nt, Mycobacterium bovis subsp bovis AF2122/97
gccgcgaugccacccaacagcgc

SEQ ID NO: 1150026 - RNA, 17 nt, Mycobacterium bovis subsp bovis AF2122/97
gccgcgaugacggugcc

SEQ ID NO: 1150027 - RNA, 23 nt, Mycobacterium bovis subsp bovis AF2122/97
gccgcgaugugguggacgccaug

SEQ ID NO: 1150028 - RNA, 20 nt, Mycobacterium bovis subsp bovis AF2122/97
gccgcgagagccggcggcga

SEQ ID NO: 1150029 - RNA, 23 nt, Mycobacterium bovis subsp bovis AF2122/97
gccgcgagagccggcggcgacca

SEQ ID NO: 1150030 - RNA, 17 nt, Mycobacterium bovis subsp bovis AF2122/97
gccgcgaggcaccgaca

SEQ ID NO: 1150031 - RNA, 21 nt, Mycobacterium bovis subsp bovis AF2122/97
gccgcgaggaugcugagcgcc

SEQ ID NO: 1150032 - RNA, 22 nt, Mycobacterium bovis subsp bovis AF2122/97
gccgcgaggaugcugagcgcca

SEQ ID NO: 1150033 - RNA, 14 nt, Mycobacterium bovis subsp bovis AF2122/97
gccgcgagcgccgg

SEQ ID NO: 1150034 - RNA, 15 nt, Mycobacterium bovis subsp bovis AF2122/97
gccgcgagcgccggc

SEQ ID NO: 1150035 - RNA, 22 nt, Mycobacterium bovis subsp bovis AF2122/97
gccgcgaggugaaucgcgucga

SEQ ID NO: 1150036 - RNA, 17 nt, Mycobacterium bovis subsp bovis AF2122/97
gccgcgaucccggccgu

SEQ ID NO: 1150037 - RNA, 17 nt, Mycobacterium bovis subsp bovis AF2122/97
gccgcgaucgcggcauc

SEQ ID NO: 1150038 - RNA, 19 nt, Mycobacterium bovis subsp bovis AF2122/97
gccgcgaucgggcccagca

SEQ ID NO: 1150039 - RNA, 21 nt, Mycobacterium bovis subsp bovis AF2122/97
gccgcgaucgggcccagcagc

SEQ ID NO: 1150040 - RNA, 22 nt, Mycobacterium bovis subsp bovis AF2122/97
gccgcgaucgggcccagcagcg

SEQ ID NO: 1150041 - RNA, 14 nt, Mycobacterium bovis subsp bovis AF2122/97
gccgcgaucgacgg

SEQ ID NO: 1150042 - RNA, 17 nt, Mycobacterium bovis subsp bovis AF2122/97
gccgcgaucgacggugu

SEQ ID NO: 1150043 - RNA, 22 nt, Mycobacterium bovis subsp bovis AF2122/97
gccgcgacgacacgccugggcg

SEQ ID NO: 1150044 - RNA, 23 nt, Mycobacterium bovis subsp bovis AF2122/97
gccgcgaucggugcgggcgccgc

SEQ ID NO: 1150045 - RNA, 14 nt, Mycobacterium bovis subsp bovis AF2122/97
gccgcgaucgugca

SEQ ID NO: 1150046 - RNA, 21 nt, Mycobacterium bovis subsp bovis AF2122/97
gccgcgaucuccuuggccguu

SEQ ID NO: 1150047 - RNA, 14 nt, Mycobacterium bovis subsp bovis AF2122/97
gccgcgcagcgugc

SEQ ID NO: 1150048 - RNA, 20 nt, Mycobacterium bovis subsp bovis AF2122/97
gccgcgcagccgcucgacgg

SEQ ID NO: 1150049 - RNA, 18 nt, Mycobacterium bovis subsp bovis AF2122/97
gccgcgcagccggcccgu

SEQ ID NO: 1150050 - RNA, 20 nt, Mycobacterium bovis subsp bovis AF2122/97
gccgcgcaggggcggcguga

SEQ ID NO: 1150051 - RNA, 13 nt, Mycobacterium bovis subsp bovis AF2122/97
gccgcgcagcugc

SEQ ID NO: 1150052 - RNA, 13 nt, Mycobacterium bovis subsp bovis AF2122/97
gccgcgcaucgcg

SEQ ID NO: 1150053 - RNA, 18 nt, Mycobacterium bovis subsp bovis AF2122/97
gccgcgcaucgcggccga

SEQ ID NO: 1150054 - RNA, 13 nt, Mycobacterium bovis subsp bovis AF2122/97
gccgcgcccacca

SEQ ID NO: 1150055 - RNA, 16 nt, Mycobacterium bovis subsp bovis AF2122/97
gccgcgcccaccauga

SEQ ID NO: 1150056 - RNA, 15 nt, Mycobacterium bovis subsp bovis AF2122/97
gccgcgccccgcggc

SEQ ID NO: 1150057 - RNA, 18 nt, Mycobacterium bovis subsp bovis AF2122/97
gccgcgccccgcggcaga

SEQ ID NO: 1150058 - RNA, 19 nt, Mycobacterium bovis subsp bovis AF2122/97
gccgcgcccgccucgaccg

SEQ ID NO: 1150059 - RNA, 21 nt, Mycobacterium bovis subsp bovis AF2122/97
gccgcgcccgccucgaccgcc

SEQ ID NO: 1150060 - RNA, 13 nt, Mycobacterium bovis subsp bovis AF2122/97
gccgcgcccggcg

SEQ ID NO: 1150061 - RNA, 18 nt, Mycobacterium bovis subsp bovis AF2122/97
gcccgcuacggcagcccg

SEQ ID NO: 1150062 - RNA, 16 nt, Mycobacterium bovis subsp bovis AF2122/97
gcccgcuacggcagcc

SEQ ID NO: 1150063 - RNA, 12 nt, Mycobacterium bovis subsp bovis AF2122/97
gcccgcuaccaa

SEQ ID NO: 1150064 - RNA, 22 nt, Mycobacterium bovis subsp bovis AF2122/97
gcccgcuccaacacccgccggu

SEQ ID NO: 1150065 - RNA, 13 nt, Mycobacterium bovis subsp bovis AF2122/97
gcccgcuccgccg

SEQ ID NO: 1150066 - RNA, 14 nt, Mycobacterium bovis subsp bovis AF2122/97
gcccgcuccgcggc

SEQ ID NO: 1150067 - RNA, 15 nt, Mycobacterium bovis subsp bovis AF2122/97
gcccgcucggagauc

SEQ ID NO: 1150068 - RNA, 21 nt, Mycobacterium bovis subsp bovis AF2122/97
gcccgcucgaaagcgucgauc

SEQ ID NO: 1150069 - RNA, 22 nt, Mycobacterium bovis subsp bovis AF2122/97
gcccgcucgaucggcagccagg

SEQ ID NO: 1150070 - RNA, 18 nt, Mycobacterium bovis subsp bovis AF2122/97
gcccgcucgaucggcagc

SEQ ID NO: 1150071 - RNA, 19 nt, Mycobacterium bovis subsp bovis AF2122/97
gcccgcucgaucggcagcc

SEQ ID NO: 1150072 - RNA, 16 nt, Mycobacterium bovis subsp bovis AF2122/97
gcccgcuccugcucgu

SEQ ID NO: 1150073 - RNA, 17 nt, Mycobacterium bovis subsp bovis AF2122/97
gcccgcucguaggaccu

SEQ ID NO: 1150074 - RNA, 13 nt, Mycobacterium bovis subsp bovis AF2122/97
gcccgcugaccau

SEQ ID NO: 1150075 - RNA, 15 nt, Mycobacterium bovis subsp bovis AF2122/97
gcccgcugaccauca

SEQ ID NO: 1150076 - RNA, 16 nt, Mycobacterium bovis subsp bovis AF2122/97
gcccgcugaccaucac

SEQ ID NO: 1150077 - RNA, 15 nt, Mycobacterium bovis subsp bovis AF2122/97
gcccgcucggccgca

SEQ ID NO: 1150078 - RNA, 17 nt, Mycobacterium bovis subsp bovis AF2122/97
gcccgcucggagaucgc

SEQ ID NO: 1150079 - RNA, 14 nt, Mycobacterium bovis subsp bovis AF2122/97
gcccucgaugccgc

SEQ ID NO: 1150080 - RNA, 14 nt, Mycobacterium bovis subsp bovis AF2122/97
gcccuccucgauga

SEQ ID NO: 1150081 - RNA, 18 nt, Mycobacterium bovis subsp bovis AF2122/97
gcccucgagcagugccgu

SEQ ID NO: 1150082 - RNA, 21 nt, Mycobacterium bovis subsp bovis AF2122/97
gcccucgacguccaucccggc

SEQ ID NO: 1150083 - RNA, 20 nt, Mycobacterium bovis subsp bovis AF2122/97
gcccucgacgccgcgcagcc

SEQ ID NO: 1150084 - RNA, 23 nt, Mycobacterium bovis subsp bovis AF2122/97
gcccucgacgccgcgcagccggc

SEQ ID NO: 1150085 - RNA, 13 nt, Mycobacterium bovis subsp bovis AF2122/97
gcccucgacgcgc

SEQ ID NO: 1150086 - RNA, 18 nt, Mycobacterium bovis subsp bovis AF2122/97
gcccucgacgcgcucggg

SEQ ID NO: 1150087 - RNA, 16 nt, Mycobacterium bovis subsp bovis AF2122/97
gcccucgacggcgucg

SEQ ID NO: 1150088 - RNA, 17 nt, Mycobacterium bovis subsp bovis AF2122/97
gcccgcugcagacgccc

SEQ ID NO: 1150089 - RNA, 12 nt, Mycobacterium bovis subsp bovis AF2122/97
gcccgcugauca

SEQ ID NO: 1150090 - RNA, 20 nt, Mycobacterium bovis subsp bovis AF2122/97
gcccgcugaucagauccucg

SEQ ID NO: 1150091 - RNA, 19 nt, Mycobacterium bovis subsp bovis AF2122/97
gcccgcugagcacucauga

SEQ ID NO: 1150092 - RNA, 20 nt, Mycobacterium bovis subsp bovis AF2122/97
gcccgcugagcacucaugau

SEQ ID NO: 1150093 - RNA, 20 nt, Mycobacterium bovis subsp bovis AF2122/97
gcccuccuggcggguggcga

SEQ ID NO: 1150094 - RNA, 14 nt, Mycobacterium bovis subsp bovis AF2122/97
gcccuccucgguga

SEQ ID NO: 1150095 - RNA, 16 nt, Mycobacterium bovis subsp bovis AF2122/97
gcccuccucgaccgcg

SEQ ID NO: 1150096 - RNA, 13 nt, Mycobacterium bovis subsp bovis AF2122/97
gcccuccggcgca

SEQ ID NO: 1150097 - RNA, 14 nt, Mycobacterium bovis subsp bovis AF2122/97
gcccuccggcgcag

SEQ ID NO: 1150098 - RNA, 21 nt, Mycobacterium bovis subsp bovis AF2122/97
gcccuccggcgcagcgaccgg

SEQ ID NO: 1150099 - RNA, 19 nt, Mycobacterium bovis subsp bovis AF2122/97
gcccuccgggcccaucgcc

SEQ ID NO: 1150100 - RNA, 21 nt, Mycobacterium bovis subsp bovis AF2122/97
gcccuccgugggcagcgcgcc

SEQ ID NO: 1150101 - RNA, 13 nt, Mycobacterium bovis subsp bovis AF2122/97
gcccucgcuguug

SEQ ID NO: 1150102 - RNA, 12 nt, Mycobacterium bovis subsp bovis AF2122/97
gcccucggccgc

SEQ ID NO: 1150103 - RNA, 21 nt, Mycobacterium bovis subsp bovis AF2122/97
gcccucgggacugcgcggcuu

SEQ ID NO: 1150104 - RNA, 14 nt, Mycobacterium bovis subsp bovis AF2122/97
gcccucggcgccga

SEQ ID NO: 1150105 - RNA, 14 nt, Mycobacterium bovis subsp bovis AF2122/97
gcccucgaucgcca

SEQ ID NO: 1150106 - RNA, 21 nt, Mycobacterium bovis subsp bovis AF2122/97
gcccucgccauggcguucugc

SEQ ID NO: 1150107 - RNA, 21 nt, Mycobacterium bovis subsp bovis AF2122/97
gcccugacacccaucgaccgc

SEQ ID NO: 1150108 - RNA, 23 nt, Mycobacterium bovis subsp bovis AF2122/97
gcccugagaacacguucggcguc

SEQ ID NO: 1150109 - RNA, 20 nt, Mycobacterium bovis subsp bovis AF2122/97
gcccugacccggagccgcca

SEQ ID NO: 1150110 - RNA, 22 nt, Mycobacterium bovis subsp bovis AF2122/97
gcccugacacccaucgaccgcc

SEQ ID NO: 1150111 - RNA, 21 nt, Mycobacterium bovis subsp bovis AF2122/97
gcccugagcgaagugucgcug

SEQ ID NO: 1150112 - RNA, 20 nt, Mycobacterium bovis subsp bovis AF2122/97
gcccugagcugccgagcggu

SEQ ID NO: 1150113 - RNA, 24 nt, Mycobacterium bovis subsp bovis AF2122/97
gcccugagcugccgagcggucaac

SEQ ID NO: 1150114 - RNA, 18 nt, Mycobacterium bovis subsp bovis AF2122/97
gcccugauugaagccccc

SEQ ID NO: 1150115 - RNA, 21 nt, Mycobacterium bovis subsp bovis AF2122/97
gcccucguuaucgaccgccgc

SEQ ID NO: 1150116 - RNA, 19 nt, Mycobacterium bovis subsp bovis AF2122/97
gcccucguuaucgaccgcc

SEQ ID NO: 1150117 - RNA, 20 nt, Mycobacterium bovis subsp bovis AF2122/97
gcccucgucgggaucggcgu

SEQ ID NO: 1150118 - RNA, 16 nt, Mycobacterium bovis subsp bovis AF2122/97
gcccugaacgguucgg

SEQ ID NO: 1150119 - RNA, 17 nt, Mycobacterium bovis subsp bovis AF2122/97
gcccugaacgguucggc

SEQ ID NO: 1150120 - RNA, 15 nt, Mycobacterium bovis subsp bovis AF2122/97
gcccuggacgucggc

SEQ ID NO: 1150121 - RNA, 13 nt, Mycobacterium bovis subsp bovis AF2122/97
gcccugcucgccg

SEQ ID NO: 1150122 - RNA, 16 nt, Mycobacterium bovis subsp bovis AF2122/97
gcccuggacgucggcg

SEQ ID NO: 1150123 - RNA, 17 nt, Mycobacterium bovis subsp bovis AF2122/97
gcccuggacgucggcga

SEQ ID NO: 1150124 - RNA, 16 nt, Mycobacterium bovis subsp bovis AF2122/97
gcccuggcaacgacac

SEQ ID NO: 1150125 - RNA, 17 nt, Mycobacterium bovis subsp bovis AF2122/97
gcccuggcaacgacacg

SEQ ID NO: 1150126 - RNA, 18 nt, Mycobacterium bovis subsp bovis AF2122/97
gcccuggcaacgacacgc

SEQ ID NO: 1150127 - RNA, 19 nt, Mycobacterium bovis subsp bovis AF2122/97
gcccuggccagcccgagcu

SEQ ID NO: 1150128 - RNA, 14 nt, Mycobacterium bovis subsp bovis AF2122/97
gcccugcgcucggg

SEQ ID NO: 1150129 - RNA, 15 nt, Mycobacterium bovis subsp bovis AF2122/97
gcccugcuccucgcg

SEQ ID NO: 1150130 - RNA, 19 nt, Mycobacterium bovis subsp bovis AF2122/97
gcccugcuccucgcgggcg

SEQ ID NO: 1150131 - RNA, 22 nt, Mycobacterium bovis subsp bovis AF2122/97
gcccugcuccucgcgggcggcg

SEQ ID NO: 1150132 - RNA, 13 nt, Mycobacterium bovis subsp bovis AF2122/97
gcccugccgccgg

SEQ ID NO: 1150133 - RNA, 17 nt, Mycobacterium bovis subsp bovis AF2122/97
gcccugccggcagcggc

SEQ ID NO: 1150134 - RNA, 16 nt, Mycobacterium bovis subsp bovis AF2122/97
gcccugccgacgcucc

SEQ ID NO: 1150135 - RNA, 15 nt, Mycobacterium bovis subsp bovis AF2122/97
gcccugcgauaccac

SEQ ID NO: 1150136 - RNA, 15 nt, Mycobacterium bovis subsp bovis AF2122/97
gcccugcgcagccgc

SEQ ID NO: 1150137 - RNA, 16 nt, Mycobacterium bovis subsp bovis AF2122/97
gcccugcccgaaggug

SEQ ID NO: 1150138 - RNA, 18 nt, Mycobacterium bovis subsp bovis AF2122/97
gcccugcgccacacccgg

SEQ ID NO: 1150139 - RNA, 13 nt, Mycobacterium bovis subsp bovis AF2122/97
gcccugcgccucg

SEQ ID NO: 1150140 - RNA, 13 nt, Mycobacterium bovis subsp bovis AF2122/97
gcccugcagacgg

SEQ ID NO: 1150141 - RNA, 14 nt, Mycobacterium bovis subsp bovis AF2122/97
gcccuggccgcgcc

SEQ ID NO: 1150142 - RNA, 15 nt, Mycobacterium bovis subsp bovis AF2122/97
gcccuggccgccggc

SEQ ID NO: 1150143 - RNA, 16 nt, Mycobacterium bovis subsp bovis AF2122/97
gcccuggccgccggcc

SEQ ID NO: 1150144 - RNA, 20 nt, Mycobacterium bovis subsp bovis AF2122/97
gcccuggccgcccuggccgc

SEQ ID NO: 1150145 - RNA, 14 nt, Mycobacterium bovis subsp bovis AF2122/97
gcccuggcggcccg

SEQ ID NO: 1150146 - RNA, 23 nt, Mycobacterium bovis subsp bovis AF2122/97
gcccugggugguuccgcgcggca

SEQ ID NO: 1150147 - RNA, 23 nt, Mycobacterium bovis subsp bovis AF2122/97
gcccuggggguggcagcgcggcc

SEQ ID NO: 1150148 - RNA, 14 nt, Mycobacterium bovis subsp bovis AF2122/97
gcccugggcgccgg

SEQ ID NO: 1150149 - RNA, 17 nt, Mycobacterium bovis subsp bovis AF2122/97
gcccuucgacgaggacg

SEQ ID NO: 1150150 - RNA, 16 nt, Mycobacterium bovis subsp bovis AF2122/97
gcccuuccuggccgaa

SEQ ID NO: 1150151 - RNA, 19 nt, Mycobacterium bovis subsp bovis AF2122/97
gcccuucagcacggugauc

SEQ ID NO: 1150152 - RNA, 21 nt, Mycobacterium bovis subsp bovis AF2122/97
gcccuucaguucgacggugcc

SEQ ID NO: 1150153 - RNA, 21 nt, Mycobacterium bovis subsp bovis AF2122/97
gcccuuaagccggcgcggcgg

SEQ ID NO: 1150154 - RNA, 14 nt, Mycobacterium bovis subsp bovis AF2122/97
gcccuucaccagcc

SEQ ID NO: 1150155 - RNA, 15 nt, Mycobacterium bovis subsp bovis AF2122/97
gcccuguucggcccg

SEQ ID NO: 1150156 - RNA, 22 nt, Mycobacterium bovis subsp bovis AF2122/97
gcccuguuugacugcgaccggu

SEQ ID NO: 1150157 - RNA, 19 nt, Mycobacterium bovis subsp bovis AF2122/97
gcccugggugauggccgcg

SEQ ID NO: 1150158 - RNA, 19 nt, Mycobacterium bovis subsp bovis AF2122/97
gccgaacuccgcggaaccc

SEQ ID NO: 1150159 - RNA, 20 nt, Mycobacterium bovis subsp bovis AF2122/97
gccgaacagcugcccgccag

SEQ ID NO: 1150160 - RNA, 22 nt, Mycobacterium bovis subsp bovis AF2122/97
gccgaacagcugcccgccagcg

SEQ ID NO: 1150161 - RNA, 19 nt, Mycobacterium bovis subsp bovis AF2122/97
gccgaacagcgaaccgccg

SEQ ID NO: 1150162 - RNA, 20 nt, Mycobacterium bovis subsp bovis AF2122/97
gccgaacagcgaaccgccgg

SEQ ID NO: 1150163 - RNA, 21 nt, Mycobacterium bovis subsp bovis AF2122/97
gccgaacagcgaaccgccggc

SEQ ID NO: 1150164 - RNA, 13 nt, Mycobacterium bovis subsp bovis AF2122/97
gccgaacagcgac

SEQ ID NO: 1150165 - RNA, 16 nt, Mycobacterium bovis subsp bovis AF2122/97
gccgaacagcaggccu

SEQ ID NO: 1150166 - RNA, 19 nt, Mycobacterium bovis subsp bovis AF2122/97
gccgaagcucaucgccgcu

SEQ ID NO: 1150167 - RNA, 15 nt, Mycobacterium bovis subsp bovis AF2122/97
gccgaagcugcccaa

SEQ ID NO: 1150168 - RNA, 15 nt, Mycobacterium bovis subsp bovis AF2122/97
gccgaagaugaccgc

SEQ ID NO: 1150169 - RNA, 16 nt, Mycobacterium bovis subsp bovis AF2122/97
gccgaagaugaccgcu

SEQ ID NO: 1150170 - RNA, 19 nt, Mycobacterium bovis subsp bovis AF2122/97
gccgaagaugaccgcucgu

SEQ ID NO: 1150171 - RNA, 21 nt, Mycobacterium bovis subsp bovis AF2122/97
gccgaagacgugccggcucag

SEQ ID NO: 1150172 - RNA, 22 nt, Mycobacterium bovis subsp bovis AF2122/97
gccgaaguuuuggaagcccgaa

SEQ ID NO: 1150173 - RNA, 17 nt, Mycobacterium bovis subsp bovis AF2122/97
gccgaaguggucuccgg

SEQ ID NO: 1150174 - RNA, 21 nt, Mycobacterium bovis subsp bovis AF2122/97
gccgaaguggucuccggcacc

SEQ ID NO: 1150175 - RNA, 20 nt, Mycobacterium bovis subsp bovis AF2122/97
gccgaaguuccagccgacgg

SEQ ID NO: 1150176 - RNA, 18 nt, Mycobacterium bovis subsp bovis AF2122/97
gccgaaguagacgguggu

SEQ ID NO: 1150177 - RNA, 18 nt, Mycobacterium bovis subsp bovis AF2122/97
gccgaaggggaacgcgcc

SEQ ID NO: 1150178 - RNA, 15 nt, Mycobacterium bovis subsp bovis AF2122/97
gccgacaccaccggc

SEQ ID NO: 1150179 - RNA, 17 nt, Mycobacterium bovis subsp bovis AF2122/97
gccgacaccaccggcgc

SEQ ID NO: 1150180 - RNA, 19 nt, Mycobacterium bovis subsp bovis AF2122/97
gccgacaccaccggcgccg

SEQ ID NO: 1150181 - RNA, 20 nt, Mycobacterium bovis subsp bovis AF2122/97
gccgacaccaccggcgccgc

SEQ ID NO: 1150182 - RNA, 21 nt, Mycobacterium bovis subsp bovis AF2122/97
gccgacaccaccggcgccgcc

SEQ ID NO: 1150183 - RNA, 16 nt, Mycobacterium bovis subsp bovis AF2122/97
gccgacaagucaagau

SEQ ID NO: 1150184 - RNA, 18 nt, Mycobacterium bovis subsp bovis AF2122/97
gccgaaguugaugucgcg

SEQ ID NO: 1150185 - RNA, 23 nt, Mycobacterium bovis subsp bovis AF2122/97
gccgaaguuuuggaagcccgaau

SEQ ID NO: 1150186 - RNA, 18 nt, Mycobacterium bovis subsp bovis AF2122/97
gccgaauaacagcaggca

SEQ ID NO: 1150187 - RNA, 18 nt, Mycobacterium bovis subsp bovis AF2122/97
gccgaauaccacaccgug

SEQ ID NO: 1150188 - RNA, 16 nt, Mycobacterium bovis subsp bovis AF2122/97
gccgaauaccgguggc

SEQ ID NO: 1150189 - RNA, 21 nt, Mycobacterium bovis subsp bovis AF2122/97
gcccuugauguccgcgacggc

SEQ ID NO: 1150190 - RNA, 22 nt, Mycobacterium bovis subsp bovis AF2122/97
gcccuugccuuguuccagcgca

SEQ ID NO: 1150191 - RNA, 16 nt, Mycobacterium bovis subsp bovis AF2122/97
gcccuugccggcgaga

SEQ ID NO: 1150192 - RNA, 14 nt, Mycobacterium bovis subsp bovis AF2122/97
gcccuugccgcaga

SEQ ID NO: 1150193 - RNA, 14 nt, Mycobacterium bovis subsp bovis AF2122/97
gcccuugccgccga

SEQ ID NO: 1150194 - RNA, 14 nt, Mycobacterium bovis subsp bovis AF2122/97
gcccuugccgccgg

SEQ ID NO: 1150195 - RNA, 16 nt, Mycobacterium bovis subsp bovis AF2122/97
gcccuugccgccggcc

SEQ ID NO: 1150196 - RNA, 21 nt, Mycobacterium bovis subsp bovis AF2122/97
gcccuucuucgaccgcgaacu

SEQ ID NO: 1150197 - RNA, 16 nt, Mycobacterium bovis subsp bovis AF2122/97
gcccuugagccgccgu

SEQ ID NO: 1150198 - RNA, 14 nt, Mycobacterium bovis subsp bovis AF2122/97
gcccuucgucggca

SEQ ID NO: 1150199 - RNA, 15 nt, Mycobacterium bovis subsp bovis AF2122/97
gcccuugcggcguga

SEQ ID NO: 1150200 - RNA, 15 nt, Mycobacterium bovis subsp bovis AF2122/97
gcccuugcggaagaa

SEQ ID NO: 1150201 - RNA, 17 nt, Mycobacterium bovis subsp bovis AF2122/97
gcccuuguagcacaccg

SEQ ID NO: 1150202 - RNA, 14 nt, Mycobacterium bovis subsp bovis AF2122/97
gccgaacaccguca

SEQ ID NO: 1150203 - RNA, 13 nt, Mycobacterium bovis subsp bovis AF2122/97
gccgaacaccgag

SEQ ID NO: 1150204 - RNA, 12 nt, Mycobacterium bovis subsp bovis AF2122/97
gccgaacaccgc

SEQ ID NO: 1150205 - RNA, 22 nt, Mycobacterium bovis subsp bovis AF2122/97
gccgaacaccgccgcgucgagc

SEQ ID NO: 1150206 - RNA, 22 nt, Mycobacterium bovis subsp bovis AF2122/97
gccgaacaccgucagcgucuga

SEQ ID NO: 1150207 - RNA, 17 nt, Mycobacterium bovis subsp bovis AF2122/97
gccgaacaccucggcac

SEQ ID NO: 1150208 - RNA, 23 nt, Mycobacterium bovis subsp bovis AF2122/97
gcccuuugcuguccccgccgagg

SEQ ID NO: 1150209 - RNA, 17 nt, Mycobacterium bovis subsp bovis AF2122/97
gccgaaaaagaccgaca

SEQ ID NO: 1150210 - RNA, 14 nt, Mycobacterium bovis subsp bovis AF2122/97
gccgaaaaugccgc

SEQ ID NO: 1150211 - RNA, 19 nt, Mycobacterium bovis subsp bovis AF2122/97
gccgaaaaugccgcccagc

SEQ ID NO: 1150212 - RNA, 15 nt, Mycobacterium bovis subsp bovis AF2122/97
gccgaaaaucgcagc

SEQ ID NO: 1150213 - RNA, 16 nt, Mycobacterium bovis subsp bovis AF2122/97
gccgaaaaucgcagcc

SEQ ID NO: 1150214 - RNA, 16 nt, Mycobacterium bovis subsp bovis AF2122/97
gccgaccaggaccacc

SEQ ID NO: 1150215 - RNA, 16 nt, Mycobacterium bovis subsp bovis AF2122/97
gccgaccagucgacgu

SEQ ID NO: 1150216 - RNA, 21 nt, Mycobacterium bovis subsp bovis AF2122/97
gccgaccgcgacccggcccag

SEQ ID NO: 1150217 - RNA, 22 nt, Mycobacterium bovis subsp bovis AF2122/97
gccgaccgcgacccggcccagc

SEQ ID NO: 1150218 - RNA, 22 nt, Mycobacterium bovis subsp bovis AF2122/97
gccgacccgacgcuggucggcg

SEQ ID NO: 1150219 - RNA, 15 nt, Mycobacterium bovis subsp bovis AF2122/97
gccgaccaucucacc

SEQ ID NO: 1150220 - RNA, 22 nt, Mycobacterium bovis subsp bovis AF2122/97
gccgacccgccacaucguggcg

SEQ ID NO: 1150221 - RNA, 15 nt, Mycobacterium bovis subsp bovis AF2122/97
gccgacccgccgcgc

SEQ ID NO: 1150222 - RNA, 16 nt, Mycobacterium bovis subsp bovis AF2122/97
gccgacccgccgcgcc

SEQ ID NO: 1150223 - RNA, 19 nt, Mycobacterium bovis subsp bovis AF2122/97
gccgacccgccgcgcccgg

SEQ ID NO: 1150224 - RNA, 23 nt, Mycobacterium bovis subsp bovis AF2122/97
gccgaccgauggcucaccagcuc

SEQ ID NO: 1150225 - RNA, 15 nt, Mycobacterium bovis subsp bovis AF2122/97
gccgacagcucaucg

SEQ ID NO: 1150226 - RNA, 16 nt, Mycobacterium bovis subsp bovis AF2122/97
gccgacagcucaucga

SEQ ID NO: 1150227 - RNA, 14 nt, Mycobacterium bovis subsp bovis AF2122/97
gccgacaucggcgg

SEQ ID NO: 1150228 - RNA, 18 nt, Mycobacterium bovis subsp bovis AF2122/97
gccgacaucggcggcccu

SEQ ID NO: 1150229 - RNA, 15 nt, Mycobacterium bovis subsp bovis AF2122/97
gccgacaggccggcc

SEQ ID NO: 1150230 - RNA, 18 nt, Mycobacterium bovis subsp bovis AF2122/97
gccgacaggccggccacc

SEQ ID NO: 1150231 - RNA, 15 nt, Mycobacterium bovis subsp bovis AF2122/97
gccgacagccaccgc

SEQ ID NO: 1150232 - RNA, 15 nt, Mycobacterium bovis subsp bovis AF2122/97
gccgacagauggucg

SEQ ID NO: 1150233 - RNA, 18 nt, Mycobacterium bovis subsp bovis AF2122/97
gccgacaaucaccaacgc

SEQ ID NO: 1150234 - RNA, 15 nt, Mycobacterium bovis subsp bovis AF2122/97
gccgacaccgccacc

SEQ ID NO: 1150235 - RNA, 20 nt, Mycobacterium bovis subsp bovis AF2122/97
gccgacaccgccaccacgcc

SEQ ID NO: 1150236 - RNA, 14 nt, Mycobacterium bovis subsp bovis AF2122/97
gccgacacgccgau

SEQ ID NO: 1150237 - RNA, 12 nt, Mycobacterium bovis subsp bovis AF2122/97
gccgaccgcgcc

SEQ ID NO: 1150238 - RNA, 16 nt, Mycobacterium bovis subsp bovis AF2122/97
gccgaccgggcucugg

SEQ ID NO: 1150239 - RNA, 12 nt, Mycobacterium bovis subsp bovis AF2122/97
gccgaccgggua

SEQ ID NO: 1150240 - RNA, 14 nt, Mycobacterium bovis subsp bovis AF2122/97
gccgaccggcaccc

SEQ ID NO: 1150241 - RNA, 15 nt, Mycobacterium bovis subsp bovis AF2122/97
gccgaccggcacccg

SEQ ID NO: 1150242 - RNA, 19 nt, Mycobacterium bovis subsp bovis AF2122/97
gccgaccggcacccgcggc

SEQ ID NO: 1150243 - RNA, 20 nt, Mycobacterium bovis subsp bovis AF2122/97
gccgaccggcacccgcggcg

SEQ ID NO: 1150244 - RNA, 21 nt, Mycobacterium bovis subsp bovis AF2122/97
gccgaccggcacccgcggcga

SEQ ID NO: 1150245 - RNA, 13 nt, Mycobacterium bovis subsp bovis AF2122/97
gccgaccggcagc

SEQ ID NO: 1150246 - RNA, 22 nt, Mycobacterium bovis subsp bovis AF2122/97
gccgacgagaucguccaugggc

SEQ ID NO: 1150247 - RNA, 19 nt, Mycobacterium bovis subsp bovis AF2122/97
gccgaccuucucggcguac

SEQ ID NO: 1150248 - RNA, 22 nt, Mycobacterium bovis subsp bovis AF2122/97
gccgacgaaggauugcggaaac

SEQ ID NO: 1150249 - RNA, 14 nt, Mycobacterium bovis subsp bovis AF2122/97
gccgaccgcggguc

SEQ ID NO: 1150250 - RNA, 19 nt, Mycobacterium bovis subsp bovis AF2122/97
gccgacgaaagguugccga

SEQ ID NO: 1150251 - RNA, 18 nt, Mycobacterium bovis subsp bovis AF2122/97
gccgacgaaaucgucggg

SEQ ID NO: 1150252 - RNA, 16 nt, Mycobacterium bovis subsp bovis AF2122/97
gccgacgaacagcggu

SEQ ID NO: 1150253 - RNA, 17 nt, Mycobacterium bovis subsp bovis AF2122/97
gccgacgaacugcagcc

SEQ ID NO: 1150254 - RNA, 13 nt, Mycobacterium bovis subsp bovis AF2122/97
gccgacgccguug

SEQ ID NO: 1150255 - RNA, 14 nt, Mycobacterium bovis subsp bovis AF2122/97
gccgacgccggugc

SEQ ID NO: 1150256 - RNA, 15 nt, Mycobacterium bovis subsp bovis AF2122/97
gccgacgccggugcc

SEQ ID NO: 1150257 - RNA, 17 nt, Mycobacterium bovis subsp bovis AF2122/97
gccgacgauccacggcg

SEQ ID NO: 1150258 - RNA, 13 nt, Mycobacterium bovis subsp bovis AF2122/97
gccgacgccgaua

SEQ ID NO: 1150259 - RNA, 18 nt, Mycobacterium bovis subsp bovis AF2122/97
gccgacgaggggcgcggg

SEQ ID NO: 1150260 - RNA, 21 nt, Mycobacterium bovis subsp bovis AF2122/97
gccgacgaggggcgcgggugg

SEQ ID NO: 1150261 - RNA, 13 nt, Mycobacterium bovis subsp bovis AF2122/97
gccgacgccgccg

SEQ ID NO: 1150262 - RNA, 14 nt, Mycobacterium bovis subsp bovis AF2122/97
gccgacgccgccgg

SEQ ID NO: 1150263 - RNA, 15 nt, Mycobacterium bovis subsp bovis AF2122/97
gccgacgccgccggc

SEQ ID NO: 1150264 - RNA, 19 nt, Mycobacterium bovis subsp bovis AF2122/97
gccgacgccgccggcaccg

SEQ ID NO: 1150265 - RNA, 16 nt, Mycobacterium bovis subsp bovis AF2122/97
gccgacgccgccggcc

SEQ ID NO: 1150266 - RNA, 22 nt, Mycobacterium bovis subsp bovis AF2122/97
gccgacgccgccggcgccaccg

SEQ ID NO: 1150267 - RNA, 18 nt, Mycobacterium bovis subsp bovis AF2122/97
gccgacgccguugcccac

SEQ ID NO: 1150268 - RNA, 19 nt, Mycobacterium bovis subsp bovis AF2122/97
gccgacgcuaaguccccgc

SEQ ID NO: 1150269 - RNA, 22 nt, Mycobacterium bovis subsp bovis AF2122/97
gccgacgcuccaggguccggac

SEQ ID NO: 1150270 - RNA, 18 nt, Mycobacterium bovis subsp bovis AF2122/97
gccgacgcuggcggugua

SEQ ID NO: 1150271 - RNA, 15 nt, Mycobacterium bovis subsp bovis AF2122/97
gccgcaucggcgaac

SEQ ID NO: 1150272 - RNA, 16 nt, Mycobacterium bovis subsp bovis AF2122/97
gccgcaucgcccaaca

SEQ ID NO: 1150273 - RNA, 19 nt, Mycobacterium bovis subsp bovis AF2122/97
gccgcaucgccucaccacg

SEQ ID NO: 1150274 - RNA, 22 nt, Mycobacterium bovis subsp bovis AF2122/97
gccgcaucgggcguacauucgg

SEQ ID NO: 1150275 - RNA, 14 nt, Mycobacterium bovis subsp bovis AF2122/97
gccgcaucgucgcc

SEQ ID NO: 1150276 - RNA, 17 nt, Mycobacterium bovis subsp bovis AF2122/97
gccgcaucgucgccgcg

SEQ ID NO: 1150277 - RNA, 20 nt, Mycobacterium bovis subsp bovis AF2122/97
gccgcaucgucgccgcgcag

SEQ ID NO: 1150278 - RNA, 14 nt, Mycobacterium bovis subsp bovis AF2122/97
gccgcagcugagcc

SEQ ID NO: 1150279 - RNA, 17 nt, Mycobacterium bovis subsp bovis AF2122/97
gccgcaggcgaacacca

SEQ ID NO: 1150280 - RNA, 20 nt, Mycobacterium bovis subsp bovis AF2122/97
gccgcagggccgcgcgcacu

SEQ ID NO: 1150281 - RNA, 23 nt, Mycobacterium bovis subsp bovis AF2122/97
gccgcauccagccgugcggcggc

SEQ ID NO: 1150282 - RNA, 12 nt, Mycobacterium bovis subsp bovis AF2122/97
gccgccaccgca

SEQ ID NO: 1150283 - RNA, 11 nt, Mycobacterium bovis subsp bovis AF2122/97
gccgccaccgu

SEQ ID NO: 1150284 - RNA, 22 nt, Mycobacterium bovis subsp bovis AF2122/97
gccgccaccgucaccgccguca

SEQ ID NO: 1150285 - RNA, 19 nt, Mycobacterium bovis subsp bovis AF2122/97
gccgccaccggcgacgccg

SEQ ID NO: 1150286 - RNA, 15 nt, Mycobacterium bovis subsp bovis AF2122/97
gccgccaccggcgcc

SEQ ID NO: 1150287 - RNA, 16 nt, Mycobacterium bovis subsp bovis AF2122/97
gccgccaccggcgccg

SEQ ID NO: 1150288 - RNA, 18 nt, Mycobacterium bovis subsp bovis AF2122/97
gccgccaccggcgccgcc

SEQ ID NO: 1150289 - RNA, 15 nt, Mycobacterium bovis subsp bovis AF2122/97
gccgccaccggcguc

SEQ ID NO: 1150290 - RNA, 14 nt, Mycobacterium bovis subsp bovis AF2122/97
gccgccaccggcga

SEQ ID NO: 1150291 - RNA, 16 nt, Mycobacterium bovis subsp bovis AF2122/97
gccgccaccgcugucg

SEQ ID NO: 1150292 - RNA, 23 nt, Mycobacterium bovis subsp bovis AF2122/97
gccgccaccucccagggcucggc

SEQ ID NO: 1150293 - RNA, 24 nt, Mycobacterium bovis subsp bovis AF2122/97
gccgccaccucccagggcucggcg

SEQ ID NO: 1150294 - RNA, 16 nt, Mycobacterium bovis subsp bovis AF2122/97
gccgccaccccgcgcg

SEQ ID NO: 1150295 - RNA, 14 nt, Mycobacterium bovis subsp bovis AF2122/97
gccgccacccgcaa

SEQ ID NO: 1150296 - RNA, 21 nt, Mycobacterium bovis subsp bovis AF2122/97
gccgccaccagcgcgagcccg

SEQ ID NO: 1150297 - RNA, 13 nt, Mycobacterium bovis subsp bovis AF2122/97
gccgccacccggc

SEQ ID NO: 1150298 - RNA, 18 nt, Mycobacterium bovis subsp bovis AF2122/97
gccgccacccggcgggcg

SEQ ID NO: 1150299 - RNA, 16 nt, Mycobacterium bovis subsp bovis AF2122/97
gccgccaccgaagccg

SEQ ID NO: 1150300 - RNA, 18 nt, Mycobacterium bovis subsp bovis AF2122/97
gccgccaccgaagccgcc

SEQ ID NO: 1150301 - RNA, 13 nt, Mycobacterium bovis subsp bovis AF2122/97
gccgccaccagcg

SEQ ID NO: 1150302 - RNA, 17 nt, Mycobacterium bovis subsp bovis AF2122/97
gccgcaucuggccggcg

SEQ ID NO: 1150303 - RNA, 18 nt, Mycobacterium bovis subsp bovis AF2122/97
gccgcaucuggccggcgg

SEQ ID NO: 1150304 - RNA, 19 nt, Mycobacterium bovis subsp bovis AF2122/97
gccgcaucuggccggcggu

SEQ ID NO: 1150305 - RNA, 20 nt, Mycobacterium bovis subsp bovis AF2122/97
gccgcaucuggccggcggug

SEQ ID NO: 1150306 - RNA, 19 nt, Mycobacterium bovis subsp bovis AF2122/97
gccgccaccagcugcgcga

SEQ ID NO: 1150307 - RNA, 14 nt, Mycobacterium bovis subsp bovis AF2122/97
gccgccaccagggc

SEQ ID NO: 1150308 - RNA, 23 nt, Mycobacterium bovis subsp bovis AF2122/97
gccgccaccagggcacguucggc

SEQ ID NO: 1150309 - RNA, 13 nt, Mycobacterium bovis subsp bovis AF2122/97
gccgcagcggcca

SEQ ID NO: 1150310 - RNA, 12 nt, Mycobacterium bovis subsp bovis AF2122/97
gccgcagcggcc

SEQ ID NO: 1150311 - RNA, 17 nt, Mycobacterium bovis subsp bovis AF2122/97
gccgcagcggccagccc

SEQ ID NO: 1150312 - RNA, 17 nt, Mycobacterium bovis subsp bovis AF2122/97
gccgcagcucgccgagu

SEQ ID NO: 1150313 - RNA, 17 nt, Mycobacterium bovis subsp bovis AF2122/97
gccgcagcuccccgacc

SEQ ID NO: 1150314 - RNA, 16 nt, Mycobacterium bovis subsp bovis AF2122/97
gccgcagcguccgcgg

SEQ ID NO: 1150315 - RNA, 16 nt, Mycobacterium bovis subsp bovis AF2122/97
gccgcagcgucguaac

SEQ ID NO: 1150316 - RNA, 17 nt, Mycobacterium bovis subsp bovis AF2122/97
gccgcaggaagucgagc

SEQ ID NO: 1150317 - RNA, 20 nt, Mycobacterium bovis subsp bovis AF2122/97
gccgcaggaagucgagcaga

SEQ ID NO: 1150318 - RNA, 17 nt, Mycobacterium bovis subsp bovis AF2122/97
gccgcacgccgaccagc

SEQ ID NO: 1150319 - RNA, 19 nt, Mycobacterium bovis subsp bovis AF2122/97
gccgcacgccgaccagcac

SEQ ID NO: 1150320 - RNA, 14 nt, Mycobacterium bovis subsp bovis AF2122/97
gccgcacgccggca

SEQ ID NO: 1150321 - RNA, 20 nt, Mycobacterium bovis subsp bovis AF2122/97
gccgcacgccggccagcgaa

SEQ ID NO: 1150322 - RNA, 13 nt, Mycobacterium bovis subsp bovis AF2122/97
gccgcacggcgac

SEQ ID NO: 1150323 - RNA, 18 nt, Mycobacterium bovis subsp bovis AF2122/97
gccgcacgcuagccgaca

SEQ ID NO: 1150324 - RNA, 12 nt, Mycobacterium bovis subsp bovis AF2122/97
gccgcacgucga

SEQ ID NO: 1150325 - RNA, 12 nt, Mycobacterium bovis subsp bovis AF2122/97
gccgcacgggcc

SEQ ID NO: 1150326 - RNA, 13 nt, Mycobacterium bovis subsp bovis AF2122/97
gccgcacugggcg

SEQ ID NO: 1150327 - RNA, 22 nt, Mycobacterium bovis subsp bovis AF2122/97
gccgcacucgguuugacgagac

SEQ ID NO: 1150328 - RNA, 20 nt, Mycobacterium bovis subsp bovis AF2122/97
gccgcacuguugcguagcgc

SEQ ID NO: 1150329 - RNA, 19 nt, Mycobacterium bovis subsp bovis AF2122/97
gccgcacugggugcgucga

SEQ ID NO: 1150330 - RNA, 20 nt, Mycobacterium bovis subsp bovis AF2122/97
gccgcacugggugcgucgac

SEQ ID NO: 1150331 - RNA, 15 nt, Mycobacterium bovis subsp bovis AF2122/97
gccgcacguucggcg

SEQ ID NO: 1150332 - RNA, 17 nt, Mycobacterium bovis subsp bovis AF2122/97
gccgcacguucggcgau

SEQ ID NO: 1150333 - RNA, 18 nt, Mycobacterium bovis subsp bovis AF2122/97
gccgcacgguugccguca

SEQ ID NO: 1150334 - RNA, 13 nt, Mycobacterium bovis subsp bovis AF2122/97
gccgcacgucgac

SEQ ID NO: 1150335 - RNA, 23 nt, Mycobacterium bovis subsp bovis AF2122/97
gccgauggugaugggggagccgg

SEQ ID NO: 1150336 - RNA, 22 nt, Mycobacterium bovis subsp bovis AF2122/97
gccgauguacugugccgccccc

SEQ ID NO: 1150337 - RNA, 22 nt, Mycobacterium bovis subsp bovis AF2122/97
gccgaugucgucuuuggucagc

SEQ ID NO: 1150338 - RNA, 22 nt, Mycobacterium bovis subsp bovis AF2122/97
gccgaugucgaugccgcgcagc

SEQ ID NO: 1150339 - RNA, 18 nt, Mycobacterium bovis subsp bovis AF2122/97
gccgaugucgcgcgcuag

SEQ ID NO: 1150340 - RNA, 15 nt, Mycobacterium bovis subsp bovis AF2122/97
gccgaugucgacgac

SEQ ID NO: 1150341 - RNA, 17 nt, Mycobacterium bovis subsp bovis AF2122/97
gccgaugugggcggagc

SEQ ID NO: 1150342 - RNA, 17 nt, Mycobacterium bovis subsp bovis AF2122/97
gccgauguggccggcga

SEQ ID NO: 1150343 - RNA, 16 nt, Mycobacterium bovis subsp bovis AF2122/97
gccgauguggccggcg

SEQ ID NO: 1150344 - RNA, 14 nt, Mycobacterium bovis subsp bovis AF2122/97
gccgauguggccgg

SEQ ID NO: 1150345 - RNA, 17 nt, Mycobacterium bovis subsp bovis AF2122/97
gccgauuccaccgccga

SEQ ID NO: 1150346 - RNA, 22 nt, Mycobacterium bovis subsp bovis AF2122/97
gccgauuacggugaucgccggc

SEQ ID NO: 1150347 - RNA, 11 nt, Mycobacterium bovis subsp bovis AF2122/97
gccgcaaccau

SEQ ID NO: 1150348 - RNA, 16 nt, Mycobacterium bovis subsp bovis AF2122/97
gccgauuccgcgcguc

SEQ ID NO: 1150349 - RNA, 16 nt, Mycobacterium bovis subsp bovis AF2122/97
gccgaugcugccgccg

SEQ ID NO: 1150350 - RNA, 17 nt, Mycobacterium bovis subsp bovis AF2122/97
gccgaugcugccgccgc

SEQ ID NO: 1150351 - RNA, 13 nt, Mycobacterium bovis subsp bovis AF2122/97
gccgaugcggguc

SEQ ID NO: 1150352 - RNA, 16 nt, Mycobacterium bovis subsp bovis AF2122/97
gccgaugcgcagugca

SEQ ID NO: 1150353 - RNA, 20 nt, Mycobacterium bovis subsp bovis AF2122/97
gccgaugcgggucucgaccu

SEQ ID NO: 1150354 - RNA, 20 nt, Mycobacterium bovis subsp bovis AF2122/97
gccgauggucaaugcgcugg

SEQ ID NO: 1150355 - RNA, 21 nt, Mycobacterium bovis subsp bovis AF2122/97
gccgauggucaaugcgcuggc

SEQ ID NO: 1150356 - RNA, 22 nt, Mycobacterium bovis subsp bovis AF2122/97
gccgauggucaaugcgcuggcg

SEQ ID NO: 1150357 - RNA, 19 nt, Mycobacterium bovis subsp bovis AF2122/97
gccgauggcuuggugccca

SEQ ID NO: 1150358 - RNA, 19 nt, Mycobacterium bovis subsp bovis AF2122/97
gccgcaaguucacccauca

SEQ ID NO: 1150359 - RNA, 22 nt, Mycobacterium bovis subsp bovis AF2122/97
gccgcaccgccugcucggcgac

SEQ ID NO: 1150360 - RNA, 18 nt, Mycobacterium bovis subsp bovis AF2122/97
gccgcacgauagccgaaa

SEQ ID NO: 1150361 - RNA, 19 nt, Mycobacterium bovis subsp bovis AF2122/97
gccgcacgaugccgggaac

SEQ ID NO: 1150362 - RNA, 20 nt, Mycobacterium bovis subsp bovis AF2122/97
gccgcacgaugccgggaacg

SEQ ID NO: 1150363 - RNA, 14 nt, Mycobacterium bovis subsp bovis AF2122/97
gccgcacgccgacc

SEQ ID NO: 1150364 - RNA, 13 nt, Mycobacterium bovis subsp bovis AF2122/97
gccgcacgauggc

SEQ ID NO: 1150365 - RNA, 21 nt, Mycobacterium bovis subsp bovis AF2122/97
gccgcacgauggccgucgauc

SEQ ID NO: 1150366 - RNA, 17 nt, Mycobacterium bovis subsp bovis AF2122/97
gccgcaaggcgccgaua

SEQ ID NO: 1150367 - RNA, 21 nt, Mycobacterium bovis subsp bovis AF2122/97
aagcagaacaguaucgccgga

SEQ ID NO: 1150368 - RNA, 16 nt, Mycobacterium bovis subsp bovis AF2122/97
aagcacagcccggcua

SEQ ID NO: 1150369 - RNA, 14 nt, Mycobacterium bovis subsp bovis AF2122/97
gccgcaaccgcgaa

SEQ ID NO: 1150370 - RNA, 16 nt, Mycobacterium bovis subsp bovis AF2122/97
gccgcaaccggcgauc

SEQ ID NO: 1150371 - RNA, 19 nt, Mycobacterium bovis subsp bovis AF2122/97
gccgcaacgacuuucaucg

SEQ ID NO: 1150372 - RNA, 22 nt, Mycobacterium bovis subsp bovis AF2122/97
gccgaucgaugccacgucccag

SEQ ID NO: 1150373 - RNA, 14 nt, Mycobacterium bovis subsp bovis AF2122/97
gccgaucggccaac

SEQ ID NO: 1150374 - RNA, 17 nt, Mycobacterium bovis subsp bovis AF2122/97
gccgaucggccugcagc

SEQ ID NO: 1150375 - RNA, 22 nt, Mycobacterium bovis subsp bovis AF2122/97
gccgaucggccugcagcgauga

SEQ ID NO: 1150376 - RNA, 12 nt, Mycobacterium bovis subsp bovis AF2122/97
gccgaucggcac

SEQ ID NO: 1150377 - RNA, 12 nt, Mycobacterium bovis subsp bovis AF2122/97
gccgaugaccga

SEQ ID NO: 1150378 - RNA, 13 nt, Mycobacterium bovis subsp bovis AF2122/97
gccgaugaccgaa

SEQ ID NO: 1150379 - RNA, 22 nt, Mycobacterium bovis subsp bovis AF2122/97
gccgaugaccgaagagcgcgcg

SEQ ID NO: 1150380 - RNA, 18 nt, Mycobacterium bovis subsp bovis AF2122/97
gccgaugaccgcaaccgg

SEQ ID NO: 1150381 - RNA, 23 nt, Mycobacterium bovis subsp bovis AF2122/97
gccgaugaccgccugcuggccgc

SEQ ID NO: 1150382 - RNA, 13 nt, Mycobacterium bovis subsp bovis AF2122/97
gccgaugacgaug

SEQ ID NO: 1150383 - RNA, 22 nt, Mycobacterium bovis subsp bovis AF2122/97
gccgaugaccugcccgucccgc

SEQ ID NO: 1150384 - RNA, 15 nt, Mycobacterium bovis subsp bovis AF2122/97
gccgauccgaucgca

SEQ ID NO: 1150385 - RNA, 16 nt, Mycobacterium bovis subsp bovis AF2122/97
gccgaugaacguggcg

SEQ ID NO: 1150386 - RNA, 16 nt, Mycobacterium bovis subsp bovis AF2122/97
gccgaugcccaucacg

SEQ ID NO: 1150387 - RNA, 13 nt, Mycobacterium bovis subsp bovis AF2122/97
gccgaugccggcc

SEQ ID NO: 1150388 - RNA, 14 nt, Mycobacterium bovis subsp bovis AF2122/97
gccgaugccggcca

SEQ ID NO: 1150389 - RNA, 14 nt, Mycobacterium bovis subsp bovis AF2122/97
gccgaugccggcga

SEQ ID NO: 1150390 - RNA, 14 nt, Mycobacterium bovis subsp bovis AF2122/97
gccgaugccgccgg

SEQ ID NO: 1150391 - RNA, 16 nt, Mycobacterium bovis subsp bovis AF2122/97
gccgaugcgacgcaga

SEQ ID NO: 1150392 - RNA, 17 nt, Mycobacterium bovis subsp bovis AF2122/97
gccgaugcgacgcagac

SEQ ID NO: 1150393 - RNA, 13 nt, Mycobacterium bovis subsp bovis AF2122/97
gccgaugagccca

SEQ ID NO: 1150394 - RNA, 15 nt, Mycobacterium bovis subsp bovis AF2122/97
gccgaugagcccagc

SEQ ID NO: 1150395 - RNA, 14 nt, Mycobacterium bovis subsp bovis AF2122/97
gccgaugacggugu

SEQ ID NO: 1150396 - RNA, 18 nt, Mycobacterium bovis subsp bovis AF2122/97
gccgaugacgauggccgc

SEQ ID NO: 1150397 - RNA, 19 nt, Mycobacterium bovis subsp bovis AF2122/97
gccgaugacgaugccgccg

SEQ ID NO: 1150398 - RNA, 20 nt, Mycobacterium bovis subsp bovis AF2122/97
gccgaugacgaugccgccga

SEQ ID NO: 1150399 - RNA, 14 nt, Mycobacterium bovis subsp bovis AF2122/97
gccgaugacgaugg

SEQ ID NO: 1150400 - RNA, 15 nt, Mycobacterium bovis subsp bovis AF2122/97
gccgaugacgauggc

SEQ ID NO: 1150401 - RNA, 20 nt, Mycobacterium bovis subsp bovis AF2122/97
gccgaugaugcggcgcagcg

SEQ ID NO: 1150402 - RNA, 20 nt, Mycobacterium bovis subsp bovis AF2122/97
gccgaugauggacaccagcc

SEQ ID NO: 1150403 - RNA, 19 nt, Mycobacterium bovis subsp bovis AF2122/97
gccgaucaccaccggcaga

SEQ ID NO: 1150404 - RNA, 21 nt, Mycobacterium bovis subsp bovis AF2122/97
gccgaucaccaccggcagaug

SEQ ID NO: 1150405 - RNA, 22 nt, Mycobacterium bovis subsp bovis AF2122/97
gccgaucaccaccggcagauga

SEQ ID NO: 1150406 - RNA, 15 nt, Mycobacterium bovis subsp bovis AF2122/97
gccgaucaccgccgg

SEQ ID NO: 1150407 - RNA, 23 nt, Mycobacterium bovis subsp bovis AF2122/97
gccgaucaccgcuguguucagcg

SEQ ID NO: 1150408 - RNA, 16 nt, Mycobacterium bovis subsp bovis AF2122/97
gccgaucaccgcaucg

SEQ ID NO: 1150409 - RNA, 14 nt, Mycobacterium bovis subsp bovis AF2122/97
gccgauccgguggc

SEQ ID NO: 1150410 - RNA, 16 nt, Mycobacterium bovis subsp bovis AF2122/97
gccgaucgacacccgc

SEQ ID NO: 1150411 - RNA, 19 nt, Mycobacterium bovis subsp bovis AF2122/97
gccgaucgacacccgcucg

SEQ ID NO: 1150412 - RNA, 21 nt, Mycobacterium bovis subsp bovis AF2122/97
gccgagggauugccgugcucg

SEQ ID NO: 1150413 - RNA, 20 nt, Mycobacterium bovis subsp bovis AF2122/97
gccgagguguuuccggugug

SEQ ID NO: 1150414 - RNA, 15 nt, Mycobacterium bovis subsp bovis AF2122/97
gccgaguccggcaag

SEQ ID NO: 1150415 - RNA, 16 nt, Mycobacterium bovis subsp bovis AF2122/97
gccgaguaccggccag

SEQ ID NO: 1150416 - RNA, 17 nt, Mycobacterium bovis subsp bovis AF2122/97
gccgaguaccggccagc

SEQ ID NO: 1150417 - RNA, 18 nt, Mycobacterium bovis subsp bovis AF2122/97
gccgaguagauggucgac

SEQ ID NO: 1150418 - RNA, 20 nt, Mycobacterium bovis subsp bovis AF2122/97
gccgaguagauggucgacgg

SEQ ID NO: 1150419 - RNA, 16 nt, Mycobacterium bovis subsp bovis AF2122/97
gccgagguugcggacg

SEQ ID NO: 1150420 - RNA, 22 nt, Mycobacterium bovis subsp bovis AF2122/97
gccgagguuguuggagaugucg

SEQ ID NO: 1150421 - RNA, 13 nt, Mycobacterium bovis subsp bovis AF2122/97
gccgagcggugcc

SEQ ID NO: 1150422 - RNA, 13 nt, Mycobacterium bovis subsp bovis AF2122/97
gccgagcggguug

SEQ ID NO: 1150423 - RNA, 20 nt, Mycobacterium bovis subsp bovis AF2122/97
gccgagcggugccggcguag

SEQ ID NO: 1150424 - RNA, 17 nt, Mycobacterium bovis subsp bovis AF2122/97
gccgaggaaaccaccag

SEQ ID NO: 1150425 - RNA, 19 nt, Mycobacterium bovis subsp bovis AF2122/97
gccgaggaaaucgcccucg

SEQ ID NO: 1150426 - RNA, 21 nt, Mycobacterium bovis subsp bovis AF2122/97
gccgaggaauacucucgcgac

SEQ ID NO: 1150427 - RNA, 13 nt, Mycobacterium bovis subsp bovis AF2122/97
gccgagcgcgccg

SEQ ID NO: 1150428 - RNA, 13 nt, Mycobacterium bovis subsp bovis AF2122/97
gccgagcggcggc

SEQ ID NO: 1150429 - RNA, 15 nt, Mycobacterium bovis subsp bovis AF2122/97
gccgagcgcgccgaa

SEQ ID NO: 1150430 - RNA, 14 nt, Mycobacterium bovis subsp bovis AF2122/97
gccgagcggaccac

SEQ ID NO: 1150431 - RNA, 16 nt, Mycobacterium bovis subsp bovis AF2122/97
gccgagcggaccaccg

SEQ ID NO: 1150432 - RNA, 23 nt, Mycobacterium bovis subsp bovis AF2122/97
gccgaggccuaccaggcgcggcc

SEQ ID NO: 1150433 - RNA, 14 nt, Mycobacterium bovis subsp bovis AF2122/97
gccgaggccucggc

SEQ ID NO: 1150434 - RNA, 18 nt, Mycobacterium bovis subsp bovis AF2122/97
gccgaggccuaccaggcg

SEQ ID NO: 1150435 - RNA, 14 nt, Mycobacterium bovis subsp bovis AF2122/97
gccgaggccgccgu

SEQ ID NO: 1150436 - RNA, 16 nt, Mycobacterium bovis subsp bovis AF2122/97
gccgaggccgucgcga

SEQ ID NO: 1150437 - RNA, 17 nt, Mycobacterium bovis subsp bovis AF2122/97
gccgaggccuaccaggc

SEQ ID NO: 1150438 - RNA, 15 nt, Mycobacterium bovis subsp bovis AF2122/97
gccgaggacgccggc

SEQ ID NO: 1150439 - RNA, 17 nt, Mycobacterium bovis subsp bovis AF2122/97
gccgaggacgccggcgc

SEQ ID NO: 1150440 - RNA, 19 nt, Mycobacterium bovis subsp bovis AF2122/97
gccgaggacgccggcgccg

SEQ ID NO: 1150441 - RNA, 14 nt, Mycobacterium bovis subsp bovis AF2122/97
gccgacgggacaac

SEQ ID NO: 1150442 - RNA, 17 nt, Mycobacterium bovis subsp bovis AF2122/97
gccgacgggaaccucga

SEQ ID NO: 1150443 - RNA, 21 nt, Mycobacterium bovis subsp bovis AF2122/97
gccgagcacgggcagauacgc

SEQ ID NO: 1150444 - RNA, 13 nt, Mycobacterium bovis subsp bovis AF2122/97
gccgacggcgccg

SEQ ID NO: 1150445 - RNA, 17 nt, Mycobacterium bovis subsp bovis AF2122/97
gccgacggcgccgaacc

SEQ ID NO: 1150446 - RNA, 17 nt, Mycobacterium bovis subsp bovis AF2122/97
gccgacggcgggcgauc

SEQ ID NO: 1150447 - RNA, 14 nt, Mycobacterium bovis subsp bovis AF2122/97
gccgacggccagca

SEQ ID NO: 1150448 - RNA, 16 nt, Mycobacterium bovis subsp bovis AF2122/97
gccgacggcgaccacc

SEQ ID NO: 1150449 - RNA, 16 nt, Mycobacterium bovis subsp bovis AF2122/97
gccgacggcgcccgcc

SEQ ID NO: 1150450 - RNA, 13 nt, Mycobacterium bovis subsp bovis AF2122/97
gccgacggcaagg

SEQ ID NO: 1150451 - RNA, 18 nt, Mycobacterium bovis subsp bovis AF2122/97
gccgagcgcccgcuaggc

SEQ ID NO: 1150452 - RNA, 16 nt, Mycobacterium bovis subsp bovis AF2122/97
aagaugucgucaccgu

SEQ ID NO: 1150453 - RNA, 18 nt, Mycobacterium bovis subsp bovis AF2122/97
gcaccagcacggcaacca

SEQ ID NO: 1150454 - RNA, 13 nt, Mycobacterium bovis subsp bovis AF2122/97
gcaccagcaccug

SEQ ID NO: 1150455 - RNA, 15 nt, Mycobacterium bovis subsp bovis AF2122/97
gcaccagcagcacca

SEQ ID NO: 1150456 - RNA, 16 nt, Mycobacterium bovis subsp bovis AF2122/97
gcaccagcagcaccaa

SEQ ID NO: 1150457 - RNA, 13 nt, Mycobacterium bovis subsp bovis AF2122/97
gcaccagcgacca

SEQ ID NO: 1150458 - RNA, 14 nt, Mycobacterium bovis subsp bovis AF2122/97
gcaccagcgaccag

SEQ ID NO: 1150459 - RNA, 19 nt, Mycobacterium bovis subsp bovis AF2122/97
gcaccagcgaccaggucgc

SEQ ID NO: 1150460 - RNA, 14 nt, Mycobacterium bovis subsp bovis AF2122/97
gcaccagccgguga

SEQ ID NO: 1150461 - RNA, 20 nt, Mycobacterium bovis subsp bovis AF2122/97
gcaccagcauucucgccgac

SEQ ID NO: 1150462 - RNA, 23 nt, Mycobacterium bovis subsp bovis AF2122/97
gcaccagccggugagcgagcgcg

SEQ ID NO: 1150463 - RNA, 14 nt, Mycobacterium bovis subsp bovis AF2122/97
gcaccagcgaaucc

SEQ ID NO: 1150464 - RNA, 14 nt, Mycobacterium bovis subsp bovis AF2122/97
gcaccagcgcgcgc

SEQ ID NO: 1150465 - RNA, 14 nt, Mycobacterium bovis subsp bovis AF2122/97
gcaccagcggcacc

SEQ ID NO: 1150466 - RNA, 19 nt, Mycobacterium bovis subsp bovis AF2122/97
gcaccagcggcaccgcggc

SEQ ID NO: 1150467 - RNA, 22 nt, Mycobacterium bovis subsp bovis AF2122/97
gcaccagcggcaccgcggccag

SEQ ID NO: 1150468 - RNA, 18 nt, Mycobacterium bovis subsp bovis AF2122/97
gcaccagcggcugaccgg

SEQ ID NO: 1150469 - RNA, 22 nt, Mycobacterium bovis subsp bovis AF2122/97
gcaccagcggcugaccgggcag

SEQ ID NO: 1150470 - RNA, 13 nt, Mycobacterium bovis subsp bovis AF2122/97
gcaccagcucggu

SEQ ID NO: 1150471 - RNA, 14 nt, Mycobacterium bovis subsp bovis AF2122/97
gcaccagcgucgcg

SEQ ID NO: 1150472 - RNA, 19 nt, Mycobacterium bovis subsp bovis AF2122/97
gcaccagcugucgggcagc

SEQ ID NO: 1150473 - RNA, 19 nt, Mycobacterium bovis subsp bovis AF2122/97
gcaccagcugcucgucguc

SEQ ID NO: 1150474 - RNA, 21 nt, Mycobacterium bovis subsp bovis AF2122/97
gcaccagggcgcaacggauca

SEQ ID NO: 1150475 - RNA, 12 nt, Mycobacterium bovis subsp bovis AF2122/97
gcaccaggcggc

SEQ ID NO: 1150476 - RNA, 17 nt, Mycobacterium bovis subsp bovis AF2122/97
gcaccaggcggccguaa

SEQ ID NO: 1150477 - RNA, 15 nt, Mycobacterium bovis subsp bovis AF2122/97
gcaccagggccucga

SEQ ID NO: 1150478 - RNA, 18 nt, Mycobacterium bovis subsp bovis AF2122/97
gcaccagggccucgaccg

SEQ ID NO: 1150479 - RNA, 20 nt, Mycobacterium bovis subsp bovis AF2122/97
gcaccaucgcggccgcuggg

SEQ ID NO: 1150480 - RNA, 18 nt, Mycobacterium bovis subsp bovis AF2122/97
gcaccauucgcaccggcc

SEQ ID NO: 1150481 - RNA, 18 nt, Mycobacterium bovis subsp bovis AF2122/97
gcaccauuguuccguccc

SEQ ID NO: 1150482 - RNA, 20 nt, Mycobacterium bovis subsp bovis AF2122/97
gcaccauuguuccguccccg

SEQ ID NO: 1150483 - RNA, 13 nt, Mycobacterium bovis subsp bovis AF2122/97
gcacccaacccgg

SEQ ID NO: 1150484 - RNA, 16 nt, Mycobacterium bovis subsp bovis AF2122/97
gcacccaacccggcgg

SEQ ID NO: 1150485 - RNA, 12 nt, Mycobacterium bovis subsp bovis AF2122/97
gcacccaacucc

SEQ ID NO: 1150486 - RNA, 18 nt, Mycobacterium bovis subsp bovis AF2122/97
gcacccaacuccaucagc

SEQ ID NO: 1150487 - RNA, 15 nt, Mycobacterium bovis subsp bovis AF2122/97
gcacccacgccggug

SEQ ID NO: 1150488 - RNA, 18 nt, Mycobacterium bovis subsp bovis AF2122/97
gcacccaccagugcaucg

SEQ ID NO: 1150489 - RNA, 21 nt, Mycobacterium bovis subsp bovis AF2122/97
gcacccaacuccaucagcgcg

SEQ ID NO: 1150490 - RNA, 13 nt, Mycobacterium bovis subsp bovis AF2122/97
gcaccagcgaguu

SEQ ID NO: 1150491 - RNA, 20 nt, Mycobacterium bovis subsp bovis AF2122/97
gcaccccguuccacgaucac

SEQ ID NO: 1150492 - RNA, 14 nt, Mycobacterium bovis subsp bovis AF2122/97
gcacccagaccgcc

SEQ ID NO: 1150493 - RNA, 19 nt, Mycobacterium bovis subsp bovis AF2122/97
gcacccgaauuugucggcg

SEQ ID NO: 1150494 - RNA, 14 nt, Mycobacterium bovis subsp bovis AF2122/97
gcaccccgcuugcg

SEQ ID NO: 1150495 - RNA, 15 nt, Mycobacterium bovis subsp bovis AF2122/97
gcaccccgcgguagc

SEQ ID NO: 1150496 - RNA, 18 nt, Mycobacterium bovis subsp bovis AF2122/97
gcacccgacucgucggcc

SEQ ID NO: 1150497 - RNA, 17 nt, Mycobacterium bovis subsp bovis AF2122/97
gcacccgacccgaugcg

SEQ ID NO: 1150498 - RNA, 20 nt, Mycobacterium bovis subsp bovis AF2122/97
gcacccgaauuugucggcga

SEQ ID NO: 1150499 - RNA, 15 nt, Mycobacterium bovis subsp bovis AF2122/97
gcacccgagccgcac

SEQ ID NO: 1150500 - RNA, 14 nt, Mycobacterium bovis subsp bovis AF2122/97
gcacccgggccugg

SEQ ID NO: 1150501 - RNA, 17 nt, Mycobacterium bovis subsp bovis AF2122/97
gcacccgggccugggac

SEQ ID NO: 1150502 - RNA, 19 nt, Mycobacterium bovis subsp bovis AF2122/97
gcacccggcuucgccgcgc

SEQ ID NO: 1150503 - RNA, 12 nt, Mycobacterium bovis subsp bovis AF2122/97
gcacccgggacg

SEQ ID NO: 1150504 - RNA, 18 nt, Mycobacterium bovis subsp bovis AF2122/97
gcacccgggccacgucga

SEQ ID NO: 1150505 - RNA, 15 nt, Mycobacterium bovis subsp bovis AF2122/97
gcacccggccgcgca

SEQ ID NO: 1150506 - RNA, 14 nt, Mycobacterium bovis subsp bovis AF2122/97
gcacccggccaccg

SEQ ID NO: 1150507 - RNA, 17 nt, Mycobacterium bovis subsp bovis AF2122/97
gcacccggccaccggac

SEQ ID NO: 1150508 - RNA, 15 nt, Mycobacterium bovis subsp bovis AF2122/97
gcaccccggccgcgc

SEQ ID NO: 1150509 - RNA, 18 nt, Mycobacterium bovis subsp bovis AF2122/97
gcacccggccaccggacg

SEQ ID NO: 1150510 - RNA, 23 nt, Mycobacterium bovis subsp bovis AF2122/97
gcacccggccaccggacgaaacg

SEQ ID NO: 1150511 - RNA, 22 nt, Mycobacterium bovis subsp bovis AF2122/97
gcacccggcgauuggaccgcca

SEQ ID NO: 1150512 - RNA, 15 nt, Mycobacterium bovis subsp bovis AF2122/97
gcacccggggugccc

SEQ ID NO: 1150513 - RNA, 11 nt, Mycobacterium bovis subsp bovis AF2122/97
gcaccgagcga

SEQ ID NO: 1150514 - RNA, 20 nt, Mycobacterium bovis subsp bovis AF2122/97
gcaccgagcugagcggccag

SEQ ID NO: 1150515 - RNA, 20 nt, Mycobacterium bovis subsp bovis AF2122/97
gcaccgaggccaaguugcag

SEQ ID NO: 1150516 - RNA, 14 nt, Mycobacterium bovis subsp bovis AF2122/97
gcaccgaggccgcc

SEQ ID NO: 1150517 - RNA, 19 nt, Mycobacterium bovis subsp bovis AF2122/97
gcaccgaggccgccgagau

SEQ ID NO: 1150518 - RNA, 15 nt, Mycobacterium bovis subsp bovis AF2122/97
gcaccgcccgccgaa

SEQ ID NO: 1150519 - RNA, 20 nt, Mycobacterium bovis subsp bovis AF2122/97
gcaccgauuccagcggaagc

SEQ ID NO: 1150520 - RNA, 21 nt, Mycobacterium bovis subsp bovis AF2122/97
gcaccgauggcgcaccggcgu

SEQ ID NO: 1150521 - RNA, 22 nt, Mycobacterium bovis subsp bovis AF2122/97
gcaccgauggcgcaccggcguc

SEQ ID NO: 1150522 - RNA, 23 nt, Mycobacterium bovis subsp bovis AF2122/97
gcaccgauggcgcaccggcgucg

SEQ ID NO: 1150523 - RNA, 12 nt, Mycobacterium bovis subsp bovis AF2122/97
gcaccgaugccu

SEQ ID NO: 1150524 - RNA, 14 nt, Mycobacterium bovis subsp bovis AF2122/97
gcaccgaucaacgg

SEQ ID NO: 1150525 - RNA, 20 nt, Mycobacterium bovis subsp bovis AF2122/97
gcaccgaugcugacgaugcg

SEQ ID NO: 1150526 - RNA, 18 nt, Mycobacterium bovis subsp bovis AF2122/97
gcaccgauggcgcaccgg

SEQ ID NO: 1150527 - RNA, 20 nt, Mycobacterium bovis subsp bovis AF2122/97
gcaccgauggcgcaccggcg

SEQ ID NO: 1150528 - RNA, 14 nt, Mycobacterium bovis subsp bovis AF2122/97
gcaccgccggcgcc

SEQ ID NO: 1150529 - RNA, 17 nt, Mycobacterium bovis subsp bovis AF2122/97
gcaccgccggcgcccag

SEQ ID NO: 1150530 - RNA, 23 nt, Mycobacterium bovis subsp bovis AF2122/97
gcaccgccggcgcccaggccgau

SEQ ID NO: 1150531 - RNA, 11 nt, Mycobacterium bovis subsp bovis AF2122/97
gcaccgccggc

SEQ ID NO: 1150532 - RNA, 15 nt, Mycobacterium bovis subsp bovis AF2122/97
gcaccgccggcaccg

SEQ ID NO: 1150533 - RNA, 13 nt, Mycobacterium bovis subsp bovis AF2122/97
gcaccgccgcgcc

SEQ ID NO: 1150534 - RNA, 14 nt, Mycobacterium bovis subsp bovis AF2122/97
gcaccgccgcgccg

SEQ ID NO: 1150535 - RNA, 18 nt, Mycobacterium bovis subsp bovis AF2122/97
gcaccgccgcgccggcgg

SEQ ID NO: 1150536 - RNA, 21 nt, Mycobacterium bovis subsp bovis AF2122/97
gcaccgccgcgccggcggcca

SEQ ID NO: 1150537 - RNA, 15 nt, Mycobacterium bovis subsp bovis AF2122/97
gcaccgcgacgacga

SEQ ID NO: 1150538 - RNA, 18 nt, Mycobacterium bovis subsp bovis AF2122/97
gcaccgcgacgacgaggu

SEQ ID NO: 1150539 - RNA, 15 nt, Mycobacterium bovis subsp bovis AF2122/97
gcaccgcgaccgcgc

SEQ ID NO: 1150540 - RNA, 16 nt, Mycobacterium bovis subsp bovis AF2122/97
gcaccgcgaccgcgca

SEQ ID NO: 1150541 - RNA, 19 nt, Mycobacterium bovis subsp bovis AF2122/97
gcaccgcgaccgcgcacgg

SEQ ID NO: 1150542 - RNA, 16 nt, Mycobacterium bovis subsp bovis AF2122/97
gcaccgcgguacgccg

SEQ ID NO: 1150543 - RNA, 18 nt, Mycobacterium bovis subsp bovis AF2122/97
gcaccgcgguacgccggu

SEQ ID NO: 1150544 - RNA, 12 nt, Mycobacterium bovis subsp bovis AF2122/97
gcaccgccggug

SEQ ID NO: 1150545 - RNA, 12 nt, Mycobacterium bovis subsp bovis AF2122/97
gcaccgcgccgg

SEQ ID NO: 1150546 - RNA, 23 nt, Mycobacterium bovis subsp bovis AF2122/97
gcaccgcgcccaccagcggcggc

SEQ ID NO: 1150547 - RNA, 13 nt, Mycobacterium bovis subsp bovis AF2122/97
gcaccgcgaccau

SEQ ID NO: 1150548 - RNA, 17 nt, Mycobacterium bovis subsp bovis AF2122/97
gcaccgcgaccaucgcg

SEQ ID NO: 1150549 - RNA, 18 nt, Mycobacterium bovis subsp bovis AF2122/97
gcaccgcgaccaucgcga

SEQ ID NO: 1150550 - RNA, 20 nt, Mycobacterium bovis subsp bovis AF2122/97
gcaccgcgaccaucgcgacg

SEQ ID NO: 1150551 - RNA, 15 nt, Mycobacterium bovis subsp bovis AF2122/97
gcaccgccugcgccg

SEQ ID NO: 1150552 - RNA, 17 nt, Mycobacterium bovis subsp bovis AF2122/97
gcaccgccugcucggcg

SEQ ID NO: 1150553 - RNA, 18 nt, Mycobacterium bovis subsp bovis AF2122/97
gcaccgccugcucggcga

SEQ ID NO: 1150554 - RNA, 17 nt, Mycobacterium bovis subsp bovis AF2122/97
gcaccgccggcuccgcc

SEQ ID NO: 1150555 - RNA, 16 nt, Mycobacterium bovis subsp bovis AF2122/97
gcaccgccgcccccgc

SEQ ID NO: 1150556 - RNA, 14 nt, Mycobacterium bovis subsp bovis AF2122/97
gcaccgccgccgcc

SEQ ID NO: 1150557 - RNA, 20 nt, Mycobacterium bovis subsp bovis AF2122/97
gcaccgcgucguagccacgc

SEQ ID NO: 1150558 - RNA, 16 nt, Mycobacterium bovis subsp bovis AF2122/97
gcaccgcuggcagcga

SEQ ID NO: 1150559 - RNA, 20 nt, Mycobacterium bovis subsp bovis AF2122/97
gcaccgcuguugcaucgccg

SEQ ID NO: 1150560 - RNA, 23 nt, Mycobacterium bovis subsp bovis AF2122/97
gcaccgcguugaugaccgccgcc

SEQ ID NO: 1150561 - RNA, 19 nt, Mycobacterium bovis subsp bovis AF2122/97
gcaccgcgguggggucgac

SEQ ID NO: 1150562 - RNA, 17 nt, Mycobacterium bovis subsp bovis AF2122/97
gcaccgcuacgaccaau

SEQ ID NO: 1150563 - RNA, 21 nt, Mycobacterium bovis subsp bovis AF2122/97
gcaccgcugaccccggcagcg

SEQ ID NO: 1150564 - RNA, 22 nt, Mycobacterium bovis subsp bovis AF2122/97
gcaccgcugaccccggcagcgc

SEQ ID NO: 1150565 - RNA, 19 nt, Mycobacterium bovis subsp bovis AF2122/97
gcaccggaucggcuaccua

SEQ ID NO: 1150566 - RNA, 12 nt, Mycobacterium bovis subsp bovis AF2122/97
gcaccggcaccc

SEQ ID NO: 1150567 - RNA, 22 nt, Mycobacterium bovis subsp bovis AF2122/97
gcaccggaucgaccaauucgac

SEQ ID NO: 1150568 - RNA, 14 nt, Mycobacterium bovis subsp bovis AF2122/97
gcaccggaucggcu

SEQ ID NO: 1150569 - RNA, 17 nt, Mycobacterium bovis subsp bovis AF2122/97
gcaccggagucgcccgg

SEQ ID NO: 1150570 - RNA, 19 nt, Mycobacterium bovis subsp bovis AF2122/97
gcaccggagucggcgucga

SEQ ID NO: 1150571 - RNA, 16 nt, Mycobacterium bovis subsp bovis AF2122/97
gcaccggauacagcca

SEQ ID NO: 1150572 - RNA, 20 nt, Mycobacterium bovis subsp bovis AF2122/97
gcaccggauacagccacgca

SEQ ID NO: 1150573 - RNA, 18 nt, Mycobacterium bovis subsp bovis AF2122/97
gcaccggaucaccgcgcc

SEQ ID NO: 1150574 - RNA, 15 nt, Mycobacterium bovis subsp bovis AF2122/97
gcaccggaucgccgu

SEQ ID NO: 1150575 - RNA, 19 nt, Mycobacterium bovis subsp bovis AF2122/97
gcaccggaucgccgucgcg

SEQ ID NO: 1150576 - RNA, 22 nt, Mycobacterium bovis subsp bovis AF2122/97
gcacaccgucgcgcucgcacca

SEQ ID NO: 1150577 - RNA, 14 nt, Mycobacterium bovis subsp bovis AF2122/97
gcacaccgucgcac

SEQ ID NO: 1150578 - RNA, 17 nt, Mycobacterium bovis subsp bovis AF2122/97
gcacacagguccugcgc

SEQ ID NO: 1150579 - RNA, 17 nt, Mycobacterium bovis subsp bovis AF2122/97
gcacaccgucgcaccca

SEQ ID NO: 1150580 - RNA, 14 nt, Mycobacterium bovis subsp bovis AF2122/97
gcacaccgucgucg

SEQ ID NO: 1150581 - RNA, 17 nt, Mycobacterium bovis subsp bovis AF2122/97
gcacaccuccucgaccg

SEQ ID NO: 1150582 - RNA, 17 nt, Mycobacterium bovis subsp bovis AF2122/97
gcacaccugcgcggcgu

SEQ ID NO: 1150583 - RNA, 15 nt, Mycobacterium bovis subsp bovis AF2122/97
gcacacgccuaccgc

SEQ ID NO: 1150584 - RNA, 20 nt, Mycobacterium bovis subsp bovis AF2122/97
gcacacgccuaccgcgacga

SEQ ID NO: 1150585 - RNA, 21 nt, Mycobacterium bovis subsp bovis AF2122/97
gcacacgccuaccgcgacgau

SEQ ID NO: 1150586 - RNA, 13 nt, Mycobacterium bovis subsp bovis AF2122/97
gcacacgaucgcg

SEQ ID NO: 1150587 - RNA, 13 nt, Mycobacterium bovis subsp bovis AF2122/97
gcacagcgcagcc

SEQ ID NO: 1150588 - RNA, 15 nt, Mycobacterium bovis subsp bovis AF2122/97
gcacagcccggcgac

SEQ ID NO: 1150589 - RNA, 16 nt, Mycobacterium bovis subsp bovis AF2122/97
gcacagcccggcgacg

SEQ ID NO: 1150590 - RNA, 21 nt, Mycobacterium bovis subsp bovis AF2122/97
gcacagcccggcgacgacccg

SEQ ID NO: 1150591 - RNA, 13 nt, Mycobacterium bovis subsp bovis AF2122/97
gcacacggccuug

SEQ ID NO: 1150592 - RNA, 18 nt, Mycobacterium bovis subsp bovis AF2122/97
gcacacggcuaccccgca

SEQ ID NO: 1150593 - RNA, 20 nt, Mycobacterium bovis subsp bovis AF2122/97
gcacacguccggcgaugacc

SEQ ID NO: 1150594 - RNA, 20 nt, Mycobacterium bovis subsp bovis AF2122/97
gcacaggugccaaacgccgc

SEQ ID NO: 1150595 - RNA, 21 nt, Mycobacterium bovis subsp bovis AF2122/97
gcacaggugccaaacgccgcc

SEQ ID NO: 1150596 - RNA, 23 nt, Mycobacterium bovis subsp bovis AF2122/97
gcacaggugccaaacgccgcccg

SEQ ID NO: 1150597 - RNA, 15 nt, Mycobacterium bovis subsp bovis AF2122/97
gcacaggcggccagc

SEQ ID NO: 1150598 - RNA, 18 nt, Mycobacterium bovis subsp bovis AF2122/97
gcacaggcggccagcauc

SEQ ID NO: 1150599 - RNA, 19 nt, Mycobacterium bovis subsp bovis AF2122/97
gcacaggucagcgcugcca

SEQ ID NO: 1150600 - RNA, 14 nt, Mycobacterium bovis subsp bovis AF2122/97
gcacagccauggug

SEQ ID NO: 1150601 - RNA, 14 nt, Mycobacterium bovis subsp bovis AF2122/97
gcacagcccggcua

SEQ ID NO: 1150602 - RNA, 15 nt, Mycobacterium bovis subsp bovis AF2122/97
gcacagcgcagccug

SEQ ID NO: 1150603 - RNA, 17 nt, Mycobacterium bovis subsp bovis AF2122/97
gcacaggaucacccacu

SEQ ID NO: 1150604 - RNA, 14 nt, Mycobacterium bovis subsp bovis AF2122/97
gcaacaggaggucg

SEQ ID NO: 1150605 - RNA, 19 nt, Mycobacterium bovis subsp bovis AF2122/97
gcaacaggcccacggcgac

SEQ ID NO: 1150606 - RNA, 23 nt, Mycobacterium bovis subsp bovis AF2122/97
gcaacagcggggugugcgguugc

SEQ ID NO: 1150607 - RNA, 12 nt, Mycobacterium bovis subsp bovis AF2122/97
gcaacagcucgg

SEQ ID NO: 1150608 - RNA, 22 nt, Mycobacterium bovis subsp bovis AF2122/97
gcaauucgggcauggucgccgg

SEQ ID NO: 1150609 - RNA, 20 nt, Mycobacterium bovis subsp bovis AF2122/97
gcacaaucgguugcacccgc

SEQ ID NO: 1150610 - RNA, 16 nt, Mycobacterium bovis subsp bovis AF2122/97
gcacacagaccgugac

SEQ ID NO: 1150611 - RNA, 17 nt, Mycobacterium bovis subsp bovis AF2122/97
gcacacagaccgugacg

SEQ ID NO: 1150612 - RNA, 17 nt, Mycobacterium bovis subsp bovis AF2122/97
gcacaccguccgucggc

SEQ ID NO: 1150613 - RNA, 19 nt, Mycobacterium bovis subsp bovis AF2122/97
gcacaccguccgucggcgc

SEQ ID NO: 1150614 - RNA, 15 nt, Mycobacterium bovis subsp bovis AF2122/97
gcacaccgucgacga

SEQ ID NO: 1150615 - RNA, 16 nt, Mycobacterium bovis subsp bovis AF2122/97
gcacaccaacaccgcg

SEQ ID NO: 1150616 - RNA, 18 nt, Mycobacterium bovis subsp bovis AF2122/97
gcacaccaacaccgcggc

SEQ ID NO: 1150617 - RNA, 15 nt, Mycobacterium bovis subsp bovis AF2122/97
gcacaaacgggcgug

SEQ ID NO: 1150618 - RNA, 14 nt, Mycobacterium bovis subsp bovis AF2122/97
gcacaauggcggcg

SEQ ID NO: 1150619 - RNA, 15 nt, Mycobacterium bovis subsp bovis AF2122/97
gcacaauggcggcgc

SEQ ID NO: 1150620 - RNA, 19 nt, Mycobacterium bovis subsp bovis AF2122/97
gcacaauggcggcgccguc

SEQ ID NO: 1150621 - RNA, 19 nt, Mycobacterium bovis subsp bovis AF2122/97
gcacaaaauacuccgcgag

SEQ ID NO: 1150622 - RNA, 19 nt, Mycobacterium bovis subsp bovis AF2122/97
gcacaaucaccgccgcgac

SEQ ID NO: 1150623 - RNA, 18 nt, Mycobacterium bovis subsp bovis AF2122/97
gcaccaccgucucgccgc

SEQ ID NO: 1150624 - RNA, 19 nt, Mycobacterium bovis subsp bovis AF2122/97
gcaccaccgucucgccgcg

SEQ ID NO: 1150625 - RNA, 20 nt, Mycobacterium bovis subsp bovis AF2122/97
gcaccaccgucucgccgcgc

SEQ ID NO: 1150626 - RNA, 17 nt, Mycobacterium bovis subsp bovis AF2122/97
gcaccaccggcucccgg

SEQ ID NO: 1150627 - RNA, 21 nt, Mycobacterium bovis subsp bovis AF2122/97
gcaccaccggcucccgggggc

SEQ ID NO: 1150628 - RNA, 12 nt, Mycobacterium bovis subsp bovis AF2122/97
gcaccaccggcc

SEQ ID NO: 1150629 - RNA, 17 nt, Mycobacterium bovis subsp bovis AF2122/97
gcaccaccggccccacc

SEQ ID NO: 1150630 - RNA, 13 nt, Mycobacterium bovis subsp bovis AF2122/97
gcaccaccggcuc

SEQ ID NO: 1150631 - RNA, 12 nt, Mycobacterium bovis subsp bovis AF2122/97
gcaccaccggaa

SEQ ID NO: 1150632 - RNA, 15 nt, Mycobacterium bovis subsp bovis AF2122/97
gcaccaccgcggcgg

SEQ ID NO: 1150633 - RNA, 16 nt, Mycobacterium bovis subsp bovis AF2122/97
gcaccaccgagccgau

SEQ ID NO: 1150634 - RNA, 18 nt, Mycobacterium bovis subsp bovis AF2122/97
gcaccaccgccccgcgcc

SEQ ID NO: 1150635 - RNA, 17 nt, Mycobacterium bovis subsp bovis AF2122/97
gcaccaccgcgaccucg

SEQ ID NO: 1150636 - RNA, 14 nt, Mycobacterium bovis subsp bovis AF2122/97
gcaccacccggcga

SEQ ID NO: 1150637 - RNA, 17 nt, Mycobacterium bovis subsp bovis AF2122/97
gcaccaccccagcggcc

SEQ ID NO: 1150638 - RNA, 21 nt, Mycobacterium bovis subsp bovis AF2122/97
gcaccaccccagcggccaccg

SEQ ID NO: 1150639 - RNA, 23 nt, Mycobacterium bovis subsp bovis AF2122/97
gcaccaccccgaggccgaccucg

SEQ ID NO: 1150640 - RNA, 13 nt, Mycobacterium bovis subsp bovis AF2122/97
gcaccacggcgcg

SEQ ID NO: 1150641 - RNA, 21 nt, Mycobacterium bovis subsp bovis AF2122/97
gcaccacgccagcccguccgg

SEQ ID NO: 1150642 - RNA, 19 nt, Mycobacterium bovis subsp bovis AF2122/97
gcaccacgcugugcucgac

SEQ ID NO: 1150643 - RNA, 14 nt, Mycobacterium bovis subsp bovis AF2122/97
gcaccacgcccgac

SEQ ID NO: 1150644 - RNA, 17 nt, Mycobacterium bovis subsp bovis AF2122/97
gcaccacggcgcgcgcg

SEQ ID NO: 1150645 - RNA, 21 nt, Mycobacterium bovis subsp bovis AF2122/97
gcaccacggcgcgcgcgccgg

SEQ ID NO: 1150646 - RNA, 22 nt, Mycobacterium bovis subsp bovis AF2122/97
gcaccacggcgcgcgcgccggc

SEQ ID NO: 1150647 - RNA, 23 nt, Mycobacterium bovis subsp bovis AF2122/97
gcaccacggcggucaacggucuc

SEQ ID NO: 1150648 - RNA, 16 nt, Mycobacterium bovis subsp bovis AF2122/97
gcaccacgucgaccaa

SEQ ID NO: 1150649 - RNA, 15 nt, Mycobacterium bovis subsp bovis AF2122/97
gcaccagaucgucgg

SEQ ID NO: 1150650 - RNA, 19 nt, Mycobacterium bovis subsp bovis AF2122/97
gcaccagaucgucgggcac

SEQ ID NO: 1150651 - RNA, 14 nt, Mycobacterium bovis subsp bovis AF2122/97
gcaccagcacaccc

SEQ ID NO: 1150652 - RNA, 16 nt, Mycobacterium bovis subsp bovis AF2122/97
gcaccagcacacccgu

SEQ ID NO: 1150653 - RNA, 17 nt, Mycobacterium bovis subsp bovis AF2122/97
gcaccagcacacccguc

SEQ ID NO: 1150654 - RNA, 16 nt, Mycobacterium bovis subsp bovis AF2122/97
gcaccaccacgccgac

SEQ ID NO: 1150655 - RNA, 15 nt, Mycobacterium bovis subsp bovis AF2122/97
gcaccaccacccgau

SEQ ID NO: 1150656 - RNA, 20 nt, Mycobacterium bovis subsp bovis AF2122/97
gcaccacaccgugggcgacg

SEQ ID NO: 1150657 - RNA, 16 nt, Mycobacterium bovis subsp bovis AF2122/97
gcaccaaccugagcau

SEQ ID NO: 1150658 - RNA, 15 nt, Mycobacterium bovis subsp bovis AF2122/97
gcaccaacgccaccg

SEQ ID NO: 1150659 - RNA, 22 nt, Mycobacterium bovis subsp bovis AF2122/97
gcacauugguguccaccaccgg

SEQ ID NO: 1150660 - RNA, 21 nt, Mycobacterium bovis subsp bovis AF2122/97
gcaccaacgccaccgucgcug

SEQ ID NO: 1150661 - RNA, 20 nt, Mycobacterium bovis subsp bovis AF2122/97
gcaccaacugaauggcaccg

SEQ ID NO: 1150662 - RNA, 14 nt, Mycobacterium bovis subsp bovis AF2122/97
gcaccaaggccgcc

SEQ ID NO: 1150663 - RNA, 17 nt, Mycobacterium bovis subsp bovis AF2122/97
gcaccaaggucuucagg

SEQ ID NO: 1150664 - RNA, 20 nt, Mycobacterium bovis subsp bovis AF2122/97
gcacaugcucgacgcccgcc

SEQ ID NO: 1150665 - RNA, 18 nt, Mycobacterium bovis subsp bovis AF2122/97
gcacaugcugccgcugcg

SEQ ID NO: 1150666 - RNA, 20 nt, Mycobacterium bovis subsp bovis AF2122/97
gcacaugcugccgcugcgaa

SEQ ID NO: 1150667 - RNA, 17 nt, Mycobacterium bovis subsp bovis AF2122/97
gcacaucgccggagucg

SEQ ID NO: 1150668 - RNA, 19 nt, Mycobacterium bovis subsp bovis AF2122/97
gcacaucgccggagucgac

SEQ ID NO: 1150669 - RNA, 18 nt, Mycobacterium bovis subsp bovis AF2122/97
gcacauccugcagcucgg

SEQ ID NO: 1150670 - RNA, 17 nt, Mycobacterium bovis subsp bovis AF2122/97
gcacauaggcgaucgca

SEQ ID NO: 1150671 - RNA, 19 nt, Mycobacterium bovis subsp bovis AF2122/97
gcacauaugugcccggcgc

SEQ ID NO: 1150672 - RNA, 20 nt, Mycobacterium bovis subsp bovis AF2122/97
gcacauaugugcccggcgcg

SEQ ID NO: 1150673 - RNA, 13 nt, Mycobacterium bovis subsp bovis AF2122/97
gcacaguccgcga

SEQ ID NO: 1150674 - RNA, 14 nt, Mycobacterium bovis subsp bovis AF2122/97
gcacaguccgcgaa

SEQ ID NO: 1150675 - RNA, 22 nt, Mycobacterium bovis subsp bovis AF2122/97
gcacagguccggguuggccacc

SEQ ID NO: 1150676 - RNA, 11 nt, Mycobacterium bovis subsp bovis AF2122/97
gcacgcccgca

SEQ ID NO: 1150677 - RNA, 17 nt, Mycobacterium bovis subsp bovis AF2122/97
gcacgccauaccggcug

SEQ ID NO: 1150678 - RNA, 14 nt, Mycobacterium bovis subsp bovis AF2122/97
gcacgcaugccggu

SEQ ID NO: 1150679 - RNA, 21 nt, Mycobacterium bovis subsp bovis AF2122/97
gcacgccaacguugcgccagc

SEQ ID NO: 1150680 - RNA, 16 nt, Mycobacterium bovis subsp bovis AF2122/97
gcacgauccgcacccg

SEQ ID NO: 1150681 - RNA, 17 nt, Mycobacterium bovis subsp bovis AF2122/97
gcacgauccgcacccgg

SEQ ID NO: 1150682 - RNA, 14 nt, Mycobacterium bovis subsp bovis AF2122/97
gcacgagugcggcg

SEQ ID NO: 1150683 - RNA, 17 nt, Mycobacterium bovis subsp bovis AF2122/97
gcacgagugcggcgacc

SEQ ID NO: 1150684 - RNA, 13 nt, Mycobacterium bovis subsp bovis AF2122/97
gcacgauagccga

SEQ ID NO: 1150685 - RNA, 22 nt, Mycobacterium bovis subsp bovis AF2122/97
gcacgaucgcggugaccucgug

SEQ ID NO: 1150686 - RNA, 17 nt, Mycobacterium bovis subsp bovis AF2122/97
gcacgaucgccaacgac

SEQ ID NO: 1150687 - RNA, 17 nt, Mycobacterium bovis subsp bovis AF2122/97
gcacgacaccucgaagg

SEQ ID NO: 1150688 - RNA, 21 nt, Mycobacterium bovis subsp bovis AF2122/97
gcacgcgaaaugccugcgcga

SEQ ID NO: 1150689 - RNA, 13 nt, Mycobacterium bovis subsp bovis AF2122/97
gcacgcgauggcc

SEQ ID NO: 1150690 - RNA, 12 nt, Mycobacterium bovis subsp bovis AF2122/97
gcacgccgggca

SEQ ID NO: 1150691 - RNA, 17 nt, Mycobacterium bovis subsp bovis AF2122/97
gcacgccuacgaugacg

SEQ ID NO: 1150692 - RNA, 16 nt, Mycobacterium bovis subsp bovis AF2122/97
gcacgcccucgucgau

SEQ ID NO: 1150693 - RNA, 19 nt, Mycobacterium bovis subsp bovis AF2122/97
gcacgcccucgucgaucgc

SEQ ID NO: 1150694 - RNA, 16 nt, Mycobacterium bovis subsp bovis AF2122/97
gcacgcccucgacgcg

SEQ ID NO: 1150695 - RNA, 20 nt, Mycobacterium bovis subsp bovis AF2122/97
gcacgcccucgacgcgcucg

SEQ ID NO: 1150696 - RNA, 14 nt, Mycobacterium bovis subsp bovis AF2122/97
gcacgacaccucga

SEQ ID NO: 1150697 - RNA, 13 nt, Mycobacterium bovis subsp bovis AF2122/97
gcacgaauccccc

SEQ ID NO: 1150698 - RNA, 17 nt, Mycobacterium bovis subsp bovis AF2122/97
gcacgacaucgucgcga

SEQ ID NO: 1150699 - RNA, 18 nt, Mycobacterium bovis subsp bovis AF2122/97
gcacgacaucgucgcgac

SEQ ID NO: 1150700 - RNA, 19 nt, Mycobacterium bovis subsp bovis AF2122/97
gcacgacaucgucgcgacg

SEQ ID NO: 1150701 - RNA, 20 nt, Mycobacterium bovis subsp bovis AF2122/97
gcacgacaucgucgcgacga

SEQ ID NO: 1150702 - RNA, 18 nt, Mycobacterium bovis subsp bovis AF2122/97
gcacgagugcggcgacca

SEQ ID NO: 1150703 - RNA, 18 nt, Mycobacterium bovis subsp bovis AF2122/97
gcacgaguuaccgguggu

SEQ ID NO: 1150704 - RNA, 20 nt, Mycobacterium bovis subsp bovis AF2122/97
gcacgaagcuggcgugcagc

SEQ ID NO: 1150705 - RNA, 19 nt, Mycobacterium bovis subsp bovis AF2122/97
gcacgaaguccuggcagac

SEQ ID NO: 1150706 - RNA, 18 nt, Mycobacterium bovis subsp bovis AF2122/97
gcacgaacgccugcucgu

SEQ ID NO: 1150707 - RNA, 20 nt, Mycobacterium bovis subsp bovis AF2122/97
gcaccuggcgcagcaacucg

SEQ ID NO: 1150708 - RNA, 14 nt, Mycobacterium bovis subsp bovis AF2122/97
gcaccuggcgcagc

SEQ ID NO: 1150709 - RNA, 14 nt, Mycobacterium bovis subsp bovis AF2122/97
gcaccuggcuugag

SEQ ID NO: 1150710 - RNA, 13 nt, Mycobacterium bovis subsp bovis AF2122/97
gcaccggccgcua

SEQ ID NO: 1150711 - RNA, 20 nt, Mycobacterium bovis subsp bovis AF2122/97
gcaccugcgcgcggccgcgc

SEQ ID NO: 1150712 - RNA, 23 nt, Mycobacterium bovis subsp bovis AF2122/97
gcacggucugggucuuggauccg

SEQ ID NO: 1150713 - RNA, 21 nt, Mycobacterium bovis subsp bovis AF2122/97
gcacggucacacgccagccgg

SEQ ID NO: 1150714 - RNA, 22 nt, Mycobacterium bovis subsp bovis AF2122/97
gcacgguccacgguggcgccga

SEQ ID NO: 1150715 - RNA, 23 nt, Mycobacterium bovis subsp bovis AF2122/97
gcacggugaacaaaugccggugc

SEQ ID NO: 1150716 - RNA, 15 nt, Mycobacterium bovis subsp bovis AF2122/97
gcacggucgcccgau

SEQ ID NO: 1150717 - RNA, 19 nt, Mycobacterium bovis subsp bovis AF2122/97
gcacggucgcccgaucggc

SEQ ID NO: 1150718 - RNA, 18 nt, Mycobacterium bovis subsp bovis AF2122/97
gcacgguccacgguggcg

SEQ ID NO: 1150719 - RNA, 17 nt, Mycobacterium bovis subsp bovis AF2122/97
gcacggucaacgauccc

SEQ ID NO: 1150720 - RNA, 18 nt, Mycobacterium bovis subsp bovis AF2122/97
gcacggucaacgaucccg

SEQ ID NO: 1150721 - RNA, 17 nt, Mycobacterium bovis subsp bovis AF2122/97
gcacggguaaucaccga

SEQ ID NO: 1150722 - RNA, 16 nt, Mycobacterium bovis subsp bovis AF2122/97
gcacggguagcgucca

SEQ ID NO: 1150723 - RNA, 18 nt, Mycobacterium bovis subsp bovis AF2122/97
gcacggcgcuaccagcca

SEQ ID NO: 1150724 - RNA, 14 nt, Mycobacterium bovis subsp bovis AF2122/97
gcacggcgcggcgg

SEQ ID NO: 1150725 - RNA, 18 nt, Mycobacterium bovis subsp bovis AF2122/97
gcacggcgcggcggagug

SEQ ID NO: 1150726 - RNA, 19 nt, Mycobacterium bovis subsp bovis AF2122/97
gcacgucggcugccgcaaa

SEQ ID NO: 1150727 - RNA, 16 nt, Mycobacterium bovis subsp bovis AF2122/97
gcacgucggcugccgc

SEQ ID NO: 1150728 - RNA, 19 nt, Mycobacterium bovis subsp bovis AF2122/97
gcacguauccacggucgac

SEQ ID NO: 1150729 - RNA, 17 nt, Mycobacterium bovis subsp bovis AF2122/97
gcacgucacgcaaccgg

SEQ ID NO: 1150730 - RNA, 21 nt, Mycobacterium bovis subsp bovis AF2122/97
gcacgucaucggcuggccgcg

SEQ ID NO: 1150731 - RNA, 23 nt, Mycobacterium bovis subsp bovis AF2122/97
gcacgucaucggcuggccgcgcc

SEQ ID NO: 1150732 - RNA, 13 nt, Mycobacterium bovis subsp bovis AF2122/97
gcacguacgggca

SEQ ID NO: 1150733 - RNA, 21 nt, Mycobacterium bovis subsp bovis AF2122/97
gcacguagaaguaggcggcga

SEQ ID NO: 1150734 - RNA, 23 nt, Mycobacterium bovis subsp bovis AF2122/97
gcacguagaaguaggcggcgacg

SEQ ID NO: 1150735 - RNA, 19 nt, Mycobacterium bovis subsp bovis AF2122/97
gcacggccccugccacgac

SEQ ID NO: 1150736 - RNA, 15 nt, Mycobacterium bovis subsp bovis AF2122/97
gcacggcccgagccg

SEQ ID NO: 1150737 - RNA, 16 nt, Mycobacterium bovis subsp bovis AF2122/97
gcacggcccgagccgc

SEQ ID NO: 1150738 - RNA, 16 nt, Mycobacterium bovis subsp bovis AF2122/97
gcacggccccugccac

SEQ ID NO: 1150739 - RNA, 17 nt, Mycobacterium bovis subsp bovis AF2122/97
gcacggccuccggaccg

SEQ ID NO: 1150740 - RNA, 18 nt, Mycobacterium bovis subsp bovis AF2122/97
gcacggccgggucgaaca

SEQ ID NO: 1150741 - RNA, 14 nt, Mycobacterium bovis subsp bovis AF2122/97
gcacggccgggacg

SEQ ID NO: 1150742 - RNA, 17 nt, Mycobacterium bovis subsp bovis AF2122/97
gcacggccgggacggcg

SEQ ID NO: 1150743 - RNA, 15 nt, Mycobacterium bovis subsp bovis AF2122/97
gcacggcgaggugcu

SEQ ID NO: 1150744 - RNA, 14 nt, Mycobacterium bovis subsp bovis AF2122/97
gcacggcgccgacc

SEQ ID NO: 1150745 - RNA, 20 nt, Mycobacterium bovis subsp bovis AF2122/97
gcacgcucaugaccgcucgg

SEQ ID NO: 1150746 - RNA, 15 nt, Mycobacterium bovis subsp bovis AF2122/97
gcacgcuccagcucg

SEQ ID NO: 1150747 - RNA, 16 nt, Mycobacterium bovis subsp bovis AF2122/97
gcacgcuccagcucgg

SEQ ID NO: 1150748 - RNA, 13 nt, Mycobacterium bovis subsp bovis AF2122/97
gcacgcucgcccu

SEQ ID NO: 1150749 - RNA, 19 nt, Mycobacterium bovis subsp bovis AF2122/97
gcacgcucggcggggaccg

SEQ ID NO: 1150750 - RNA, 21 nt, Mycobacterium bovis subsp bovis AF2122/97
gcacgcucgugacgaucagcg

SEQ ID NO: 1150751 - RNA, 11 nt, Mycobacterium bovis subsp bovis AF2122/97
gcacgcucggc

SEQ ID NO: 1150752 - RNA, 22 nt, Mycobacterium bovis subsp bovis AF2122/97
gcacgcugaccggaucugacgg

SEQ ID NO: 1150753 - RNA, 16 nt, Mycobacterium bovis subsp bovis AF2122/97
gcacggcaaccagcga

SEQ ID NO: 1150754 - RNA, 22 nt, Mycobacterium bovis subsp bovis AF2122/97
gcacggcaaccagcgagcccag

SEQ ID NO: 1150755 - RNA, 15 nt, Mycobacterium bovis subsp bovis AF2122/97
gcacgcugcucgacg

SEQ ID NO: 1150756 - RNA, 22 nt, Mycobacterium bovis subsp bovis AF2122/97
gcacgcuggaacuuggcgucga

SEQ ID NO: 1150757 - RNA, 16 nt, Mycobacterium bovis subsp bovis AF2122/97
gcacgcugagucccca

SEQ ID NO: 1150758 - RNA, 21 nt, Mycobacterium bovis subsp bovis AF2122/97
gcacggaugucgcccaaccga

SEQ ID NO: 1150759 - RNA, 21 nt, Mycobacterium bovis subsp bovis AF2122/97
gcacggauucaucacgggacg

SEQ ID NO: 1150760 - RNA, 14 nt, Mycobacterium bovis subsp bovis AF2122/97
gcacggauuuucgc

SEQ ID NO: 1150761 - RNA, 22 nt, Mycobacterium bovis subsp bovis AF2122/97
gcacucgggauucggcagcggc

SEQ ID NO: 1150762 - RNA, 13 nt, Mycobacterium bovis subsp bovis AF2122/97
gcacucggccacg

SEQ ID NO: 1150763 - RNA, 12 nt, Mycobacterium bovis subsp bovis AF2122/97
gcacucggcccg

SEQ ID NO: 1150764 - RNA, 15 nt, Mycobacterium bovis subsp bovis AF2122/97
gcacucggcccggcc

SEQ ID NO: 1150765 - RNA, 20 nt, Mycobacterium bovis subsp bovis AF2122/97
gcacucggucgggggugcuc

SEQ ID NO: 1150766 - RNA, 13 nt, Mycobacterium bovis subsp bovis AF2122/97
gcacugaacgucg

SEQ ID NO: 1150767 - RNA, 22 nt, Mycobacterium bovis subsp bovis AF2122/97
gcacugaucugcguugcggcaa

SEQ ID NO: 1150768 - RNA, 13 nt, Mycobacterium bovis subsp bovis AF2122/97
gcacugaugucac

SEQ ID NO: 1150769 - RNA, 21 nt, Mycobacterium bovis subsp bovis AF2122/97
gcacugaugucacccgcccga

SEQ ID NO: 1150770 - RNA, 15 nt, Mycobacterium bovis subsp bovis AF2122/97
gcacugccgagcacg

SEQ ID NO: 1150771 - RNA, 16 nt, Mycobacterium bovis subsp bovis AF2122/97
gcacugcgccggccgg

SEQ ID NO: 1150772 - RNA, 20 nt, Mycobacterium bovis subsp bovis AF2122/97
gcacugcgccggccggcgca

SEQ ID NO: 1150773 - RNA, 14 nt, Mycobacterium bovis subsp bovis AF2122/97
gcacugccgccggu

SEQ ID NO: 1150774 - RNA, 24 nt, Mycobacterium bovis subsp bovis AF2122/97
gcacugccgccgguuccgccggcc

SEQ ID NO: 1150775 - RNA, 12 nt, Mycobacterium bovis subsp bovis AF2122/97
gcacugccggca

SEQ ID NO: 1150776 - RNA, 14 nt, Mycobacterium bovis subsp bovis AF2122/97
gcacugccgggugg

SEQ ID NO: 1150777 - RNA, 16 nt, Mycobacterium bovis subsp bovis AF2122/97
gcacugcgaacccugc

SEQ ID NO: 1150778 - RNA, 20 nt, Mycobacterium bovis subsp bovis AF2122/97
gcacugcgaacccugcgcac

SEQ ID NO: 1150779 - RNA, 13 nt, Mycobacterium bovis subsp bovis AF2122/97
gcacugcgaucgc

SEQ ID NO: 1150780 - RNA, 14 nt, Mycobacterium bovis subsp bovis AF2122/97
gcacugcgaucgcg

SEQ ID NO: 1150781 - RNA, 16 nt, Mycobacterium bovis subsp bovis AF2122/97
gcacugcgaucgcgac

SEQ ID NO: 1150782 - RNA, 18 nt, Mycobacterium bovis subsp bovis AF2122/97
gcacugcgaucgcgaccc

SEQ ID NO: 1150783 - RNA, 22 nt, Mycobacterium bovis subsp bovis AF2122/97
gcacgugccccaugcgcagguu

SEQ ID NO: 1150784 - RNA, 15 nt, Mycobacterium bovis subsp bovis AF2122/97
gcacgugcacggcga

SEQ ID NO: 1150785 - RNA, 17 nt, Mycobacterium bovis subsp bovis AF2122/97
gcacgugcacggcgagg

SEQ ID NO: 1150786 - RNA, 14 nt, Mycobacterium bovis subsp bovis AF2122/97
gcacgucgggcccg

SEQ ID NO: 1150787 - RNA, 18 nt, Mycobacterium bovis subsp bovis AF2122/97
gcacgucggggugccggc

SEQ ID NO: 1150788 - RNA, 20 nt, Mycobacterium bovis subsp bovis AF2122/97
gcacgucggggugccggcug

SEQ ID NO: 1150789 - RNA, 21 nt, Mycobacterium bovis subsp bovis AF2122/97
gcacucgaagaugucgucacc

SEQ ID NO: 1150790 - RNA, 15 nt, Mycobacterium bovis subsp bovis AF2122/97
gcacucgacgccaau

SEQ ID NO: 1150791 - RNA, 15 nt, Mycobacterium bovis subsp bovis AF2122/97
gcacucccgagccac

SEQ ID NO: 1150792 - RNA, 16 nt, Mycobacterium bovis subsp bovis AF2122/97
gcacucccggcucggc

SEQ ID NO: 1150793 - RNA, 19 nt, Mycobacterium bovis subsp bovis AF2122/97
gcacucccggcucggccag

SEQ ID NO: 1150794 - RNA, 13 nt, Mycobacterium bovis subsp bovis AF2122/97
gcacuccggcgac

SEQ ID NO: 1150795 - RNA, 20 nt, Mycobacterium bovis subsp bovis AF2122/97
gcacuccggcgacgaucucg

SEQ ID NO: 1150796 - RNA, 21 nt, Mycobacterium bovis subsp bovis AF2122/97
gcacuccggcgacgaucucgc

SEQ ID NO: 1150797 - RNA, 13 nt, Mycobacterium bovis subsp bovis AF2122/97
gcacuccaccgcu

SEQ ID NO: 1150798 - RNA, 14 nt, Mycobacterium bovis subsp bovis AF2122/97
gcacuccagcggcg

SEQ ID NO: 1150799 - RNA, 18 nt, Mycobacterium bovis subsp bovis AF2122/97
gcacuagcgagccggcgc

SEQ ID NO: 1150800 - RNA, 21 nt, Mycobacterium bovis subsp bovis AF2122/97
gcacugcgcgugcucgacgcg

SEQ ID NO: 1150801 - RNA, 15 nt, Mycobacterium bovis subsp bovis AF2122/97
gcacugcggcagcga

SEQ ID NO: 1150802 - RNA, 15 nt, Mycobacterium bovis subsp bovis AF2122/97
gcacugggaugaguu

SEQ ID NO: 1150803 - RNA, 19 nt, Mycobacterium bovis subsp bovis AF2122/97
gcacuggcccccacaccac

SEQ ID NO: 1150804 - RNA, 22 nt, Mycobacterium bovis subsp bovis AF2122/97
gcacugggaugaguucgucgug

SEQ ID NO: 1150805 - RNA, 23 nt, Mycobacterium bovis subsp bovis AF2122/97
gcacugggaugaguucgucgugg

SEQ ID NO: 1150806 - RNA, 16 nt, Mycobacterium bovis subsp bovis AF2122/97
gcacugggcgaugacg

SEQ ID NO: 1150807 - RNA, 23 nt, Mycobacterium bovis subsp bovis AF2122/97
gcacugggcgaugacgccaucga

SEQ ID NO: 1150808 - RNA, 21 nt, Mycobacterium bovis subsp bovis AF2122/97
gcacuggguccacgcgcucgg

SEQ ID NO: 1150809 - RNA, 20 nt, Mycobacterium bovis subsp bovis AF2122/97
gcacugguugggcgagaccg

SEQ ID NO: 1150810 - RNA, 22 nt, Mycobacterium bovis subsp bovis AF2122/97
gcacugggugcgucgacccagc

SEQ ID NO: 1150811 - RNA, 18 nt, Mycobacterium bovis subsp bovis AF2122/97
gcacuuagcccgauggug

SEQ ID NO: 1150812 - RNA, 20 nt, Mycobacterium bovis subsp bovis AF2122/97
gcacugugaggucauuggcg

SEQ ID NO: 1150813 - RNA, 14 nt, Mycobacterium bovis subsp bovis AF2122/97
gcacugugcccuca

SEQ ID NO: 1150814 - RNA, 15 nt, Mycobacterium bovis subsp bovis AF2122/97
gcacugugcguccgc

SEQ ID NO: 1150815 - RNA, 19 nt, Mycobacterium bovis subsp bovis AF2122/97
gcacuguugcccaauucga

SEQ ID NO: 1150816 - RNA, 20 nt, Mycobacterium bovis subsp bovis AF2122/97
gcacuguugcccaauucgac

SEQ ID NO: 1150817 - RNA, 23 nt, Mycobacterium bovis subsp bovis AF2122/97
gcacuucggcgaaguugcgcgac

SEQ ID NO: 1150818 - RNA, 16 nt, Mycobacterium bovis subsp bovis AF2122/97
gcagaacaccaccgcc

SEQ ID NO: 1150819 - RNA, 17 nt, Mycobacterium bovis subsp bovis AF2122/97
gcagaaacagccgcagc

SEQ ID NO: 1150820 - RNA, 19 nt, Mycobacterium bovis subsp bovis AF2122/97
gcagaaaccauucggcgag

SEQ ID NO: 1150821 - RNA, 19 nt, Mycobacterium bovis subsp bovis AF2122/97
gcagaaacgccgagcgcca

SEQ ID NO: 1150822 - RNA, 19 nt, Mycobacterium bovis subsp bovis AF2122/97
gcagaaagucgcgcgcgaa

SEQ ID NO: 1150823 - RNA, 19 nt, Mycobacterium bovis subsp bovis AF2122/97
gcacuugaaauugagccgg

SEQ ID NO: 1150824 - RNA, 22 nt, Mycobacterium bovis subsp bovis AF2122/97
gcacuugggaaggauggucgaa

SEQ ID NO: 1150825 - RNA, 18 nt, Mycobacterium bovis subsp bovis AF2122/97
gcagcacccgggccuggg

SEQ ID NO: 1150826 - RNA, 13 nt, Mycobacterium bovis subsp bovis AF2122/97
gcagcaccgacgu

SEQ ID NO: 1150827 - RNA, 17 nt, Mycobacterium bovis subsp bovis AF2122/97
gcagcaaucagccgccu

SEQ ID NO: 1150828 - RNA, 14 nt, Mycobacterium bovis subsp bovis AF2122/97
gcagcaagccgccg

SEQ ID NO: 1150829 - RNA, 16 nt, Mycobacterium bovis subsp bovis AF2122/97
gcagcaagccgccggu

SEQ ID NO: 1150830 - RNA, 15 nt, Mycobacterium bovis subsp bovis AF2122/97
gcagcaagaccgcgc

SEQ ID NO: 1150831 - RNA, 18 nt, Mycobacterium bovis subsp bovis AF2122/97
gcagcaacugggcggccu

SEQ ID NO: 1150832 - RNA, 14 nt, Mycobacterium bovis subsp bovis AF2122/97
gcagcaacggcggc

SEQ ID NO: 1150833 - RNA, 22 nt, Mycobacterium bovis subsp bovis AF2122/97
gcagcaacgcggugccgggauc

SEQ ID NO: 1150834 - RNA, 22 nt, Mycobacterium bovis subsp bovis AF2122/97
gcagcaacgacccgaagccgac

SEQ ID NO: 1150835 - RNA, 18 nt, Mycobacterium bovis subsp bovis AF2122/97
gcagcaacgacgucgucg

SEQ ID NO: 1150836 - RNA, 21 nt, Mycobacterium bovis subsp bovis AF2122/97
gcagcaacgcggugccgggau

SEQ ID NO: 1150837 - RNA, 23 nt, Mycobacterium bovis subsp bovis AF2122/97
gcagcaacaucuugccgucggcc

SEQ ID NO: 1150838 - RNA, 14 nt, Mycobacterium bovis subsp bovis AF2122/97
gcagauacucggcg

SEQ ID NO: 1150839 - RNA, 16 nt, Mycobacterium bovis subsp bovis AF2122/97
gcagauacucggcgac

SEQ ID NO: 1150840 - RNA, 19 nt, Mycobacterium bovis subsp bovis AF2122/97
gcagauaugacggcagacc

SEQ ID NO: 1150841 - RNA, 21 nt, Mycobacterium bovis subsp bovis AF2122/97
gcagauugucgacggucaccg

SEQ ID NO: 1150842 - RNA, 22 nt, Mycobacterium bovis subsp bovis AF2122/97
gcagauugucgacggucaccgg

SEQ ID NO: 1150843 - RNA, 23 nt, Mycobacterium bovis subsp bovis AF2122/97
gcagauuccucuucaggcccucg

SEQ ID NO: 1150844 - RNA, 15 nt, Mycobacterium bovis subsp bovis AF2122/97
gcagauguguccggc

SEQ ID NO: 1150845 - RNA, 22 nt, Mycobacterium bovis subsp bovis AF2122/97
gcagauuugcuccagcgacgaa

SEQ ID NO: 1150846 - RNA, 18 nt, Mycobacterium bovis subsp bovis AF2122/97
gcagauucuucacccaac

SEQ ID NO: 1150847 - RNA, 22 nt, Mycobacterium bovis subsp bovis AF2122/97
gcagcaacaccucgucacccgg

SEQ ID NO: 1150848 - RNA, 17 nt, Mycobacterium bovis subsp bovis AF2122/97
gcagauuggcggcuucg

SEQ ID NO: 1150849 - RNA, 18 nt, Mycobacterium bovis subsp bovis AF2122/97
gcagcaaaaaccagcguc

SEQ ID NO: 1150850 - RNA, 20 nt, Mycobacterium bovis subsp bovis AF2122/97
gcagacguaaaagcccccgc

SEQ ID NO: 1150851 - RNA, 15 nt, Mycobacterium bovis subsp bovis AF2122/97
gcagacccaguccgg

SEQ ID NO: 1150852 - RNA, 20 nt, Mycobacterium bovis subsp bovis AF2122/97
gcagaccaagcccgucgucg

SEQ ID NO: 1150853 - RNA, 20 nt, Mycobacterium bovis subsp bovis AF2122/97
gcagacacgcugcaggcggc

SEQ ID NO: 1150854 - RNA, 18 nt, Mycobacterium bovis subsp bovis AF2122/97
gcagacacgagucgccag

SEQ ID NO: 1150855 - RNA, 19 nt, Mycobacterium bovis subsp bovis AF2122/97
gcagacacgaccccgucga

SEQ ID NO: 1150856 - RNA, 21 nt, Mycobacterium bovis subsp bovis AF2122/97
gcagacaucggagaucauggc

SEQ ID NO: 1150857 - RNA, 14 nt, Mycobacterium bovis subsp bovis AF2122/97
gcagacaggcggcg

SEQ ID NO: 1150858 - RNA, 18 nt, Mycobacterium bovis subsp bovis AF2122/97
gcagacaggcggcggccu

SEQ ID NO: 1150859 - RNA, 19 nt, Mycobacterium bovis subsp bovis AF2122/97
gcagacaggcggcggccug

SEQ ID NO: 1150860 - RNA, 20 nt, Mycobacterium bovis subsp bovis AF2122/97
gcagaacgaucgcgcuggcg

SEQ ID NO: 1150861 - RNA, 16 nt, Mycobacterium bovis subsp bovis AF2122/97
gcagaggcggcuggcg

SEQ ID NO: 1150862 - RNA, 14 nt, Mycobacterium bovis subsp bovis AF2122/97
gcagagcggcacgc

SEQ ID NO: 1150863 - RNA, 22 nt, Mycobacterium bovis subsp bovis AF2122/97
gcagaguucccugaugggcgaa

SEQ ID NO: 1150864 - RNA, 20 nt, Mycobacterium bovis subsp bovis AF2122/97
gcagaccaaguccggucgcg

SEQ ID NO: 1150865 - RNA, 18 nt, Mycobacterium bovis subsp bovis AF2122/97
gcagcugacgucaccacg

SEQ ID NO: 1150866 - RNA, 18 nt, Mycobacterium bovis subsp bovis AF2122/97
gcagcucgugaccgccgu

SEQ ID NO: 1150867 - RNA, 19 nt, Mycobacterium bovis subsp bovis AF2122/97
gcagcugggcaucaccgcc

SEQ ID NO: 1150868 - RNA, 17 nt, Mycobacterium bovis subsp bovis AF2122/97
gcagcugguaggucacc

SEQ ID NO: 1150869 - RNA, 20 nt, Mycobacterium bovis subsp bovis AF2122/97
gcagcuggucgugggccacc

SEQ ID NO: 1150870 - RNA, 21 nt, Mycobacterium bovis subsp bovis AF2122/97
gcagcugggugcgccauugcg

SEQ ID NO: 1150871 - RNA, 15 nt, Mycobacterium bovis subsp bovis AF2122/97
gcagcugguagguca

SEQ ID NO: 1150872 - RNA, 14 nt, Mycobacterium bovis subsp bovis AF2122/97
gcagcuugacaucg

SEQ ID NO: 1150873 - RNA, 21 nt, Mycobacterium bovis subsp bovis AF2122/97
gcagcuuguuuuccaccagcg

SEQ ID NO: 1150874 - RNA, 17 nt, Mycobacterium bovis subsp bovis AF2122/97
gcagcuuggacucaucg

SEQ ID NO: 1150875 - RNA, 14 nt, Mycobacterium bovis subsp bovis AF2122/97
gcagcuuggccagc

SEQ ID NO: 1150876 - RNA, 17 nt, Mycobacterium bovis subsp bovis AF2122/97
gcagcuuggccucagcc

SEQ ID NO: 1150877 - RNA, 15 nt, Mycobacterium bovis subsp bovis AF2122/97
gcagcuucucggcga

SEQ ID NO: 1150878 - RNA, 16 nt, Mycobacterium bovis subsp bovis AF2122/97
gcagcuucucgccgac

SEQ ID NO: 1150879 - RNA, 18 nt, Mycobacterium bovis subsp bovis AF2122/97
gcagcuucucgccgacga

SEQ ID NO: 1150880 - RNA, 19 nt, Mycobacterium bovis subsp bovis AF2122/97
gcagcuuagucagggccga

SEQ ID NO: 1150881 - RNA, 15 nt, Mycobacterium bovis subsp bovis AF2122/97
gcagcuucaacaccg

SEQ ID NO: 1150882 - RNA, 17 nt, Mycobacterium bovis subsp bovis AF2122/97
gcagcuucaacaccggc

SEQ ID NO: 1150883 - RNA, 20 nt, Mycobacterium bovis subsp bovis AF2122/97
gcagcuucaacaccggcauc

SEQ ID NO: 1150884 - RNA, 20 nt, Mycobacterium bovis subsp bovis AF2122/97
gcaggaucgaggcgucggca

SEQ ID NO: 1150885 - RNA, 23 nt, Mycobacterium bovis subsp bovis AF2122/97
gcaggaucgccugagcgccgcgg

SEQ ID NO: 1150886 - RNA, 20 nt, Mycobacterium bovis subsp bovis AF2122/97
gcaggagcgcgaugaccucg

SEQ ID NO: 1150887 - RNA, 22 nt, Mycobacterium bovis subsp bovis AF2122/97
gcaggagcgcgaugaccucggc

SEQ ID NO: 1150888 - RNA, 17 nt, Mycobacterium bovis subsp bovis AF2122/97
gcaggaucacgccgccg

SEQ ID NO: 1150889 - RNA, 22 nt, Mycobacterium bovis subsp bovis AF2122/97
gcaggaucacgccgccggcgaa

SEQ ID NO: 1150890 - RNA, 22 nt, Mycobacterium bovis subsp bovis AF2122/97
gcaggaucaaaaccucgugcgc

SEQ ID NO: 1150891 - RNA, 15 nt, Mycobacterium bovis subsp bovis AF2122/97
gcaggaccugcguca

SEQ ID NO: 1150892 - RNA, 12 nt, Mycobacterium bovis subsp bovis AF2122/97
gcaggacgcugc

SEQ ID NO: 1150893 - RNA, 15 nt, Mycobacterium bovis subsp bovis AF2122/97
gcaggacgcugccgg

SEQ ID NO: 1150894 - RNA, 17 nt, Mycobacterium bovis subsp bovis AF2122/97
gcaggagccggcaaccg

SEQ ID NO: 1150895 - RNA, 21 nt, Mycobacterium bovis subsp bovis AF2122/97
gcaggacguuugagaccccaa

SEQ ID NO: 1150896 - RNA, 12 nt, Mycobacterium bovis subsp bovis AF2122/97
gcaggacucgcg

SEQ ID NO: 1150897 - RNA, 13 nt, Mycobacterium bovis subsp bovis AF2122/97
gcaggaccagcac

SEQ ID NO: 1150898 - RNA, 15 nt, Mycobacterium bovis subsp bovis AF2122/97
gcaggaccagcaccg

SEQ ID NO: 1150899 - RNA, 18 nt, Mycobacterium bovis subsp bovis AF2122/97
gcaggaccagcaccgccg

SEQ ID NO: 1150900 - RNA, 21 nt, Mycobacterium bovis subsp bovis AF2122/97
gcaggaccagcaccgccgcgc

SEQ ID NO: 1150901 - RNA, 22 nt, Mycobacterium bovis subsp bovis AF2122/97
gcaggaauucgccauagcgggc

SEQ ID NO: 1150902 - RNA, 23 nt, Mycobacterium bovis subsp bovis AF2122/97
gcaggaauucgccauagcgggcg

SEQ ID NO: 1150903 - RNA, 15 nt, Mycobacterium bovis subsp bovis AF2122/97
gcaggaauucgccau

SEQ ID NO: 1150904 - RNA, 23 nt, Mycobacterium bovis subsp bovis AF2122/97
gcaggaaucgggucagcaccacc

SEQ ID NO: 1150905 - RNA, 20 nt, Mycobacterium bovis subsp bovis AF2122/97
gcaggaaggcuucggugacc

SEQ ID NO: 1150906 - RNA, 22 nt, Mycobacterium bovis subsp bovis AF2122/97
gcaggaaaaccccggccaccag

SEQ ID NO: 1150907 - RNA, 23 nt, Mycobacterium bovis subsp bovis AF2122/97
gcagcuuugacgcccucggcgac

SEQ ID NO: 1150908 - RNA, 23 nt, Mycobacterium bovis subsp bovis AF2122/97
gcagcuuugagucccgguagacc

SEQ ID NO: 1150909 - RNA, 14 nt, Mycobacterium bovis subsp bovis AF2122/97
gcagcgggcggugu

SEQ ID NO: 1150910 - RNA, 15 nt, Mycobacterium bovis subsp bovis AF2122/97
gcagcgggcgguguc

SEQ ID NO: 1150911 - RNA, 14 nt, Mycobacterium bovis subsp bovis AF2122/97
gcagcggcggcaac

SEQ ID NO: 1150912 - RNA, 20 nt, Mycobacterium bovis subsp bovis AF2122/97
gcagcgggccgaagccccga

SEQ ID NO: 1150913 - RNA, 23 nt, Mycobacterium bovis subsp bovis AF2122/97
gcagcgggccgcccuucaucuug

SEQ ID NO: 1150914 - RNA, 14 nt, Mycobacterium bovis subsp bovis AF2122/97
gcagcgggcgcgcu

SEQ ID NO: 1150915 - RNA, 15 nt, Mycobacterium bovis subsp bovis AF2122/97
gcagcgggcgcgcua

SEQ ID NO: 1150916 - RNA, 20 nt, Mycobacterium bovis subsp bovis AF2122/97
gcagcgguuuuaggcagccc

SEQ ID NO: 1150917 - RNA, 13 nt, Mycobacterium bovis subsp bovis AF2122/97
gcagcgguccgcc

SEQ ID NO: 1150918 - RNA, 17 nt, Mycobacterium bovis subsp bovis AF2122/97
gcagcgguguagccggc

SEQ ID NO: 1150919 - RNA, 21 nt, Mycobacterium bovis subsp bovis AF2122/97
gcagcgguguagccggcgccg

SEQ ID NO: 1150920 - RNA, 23 nt, Mycobacterium bovis subsp bovis AF2122/97
gcagcgguguagccggcgccgcc

SEQ ID NO: 1150921 - RNA, 21 nt, Mycobacterium bovis subsp bovis AF2122/97
gcagcgguugaugcggccgcg

SEQ ID NO: 1150922 - RNA, 23 nt, Mycobacterium bovis subsp bovis AF2122/97
gcagcgguugaugcggccgcggc

SEQ ID NO: 1150923 - RNA, 19 nt, Mycobacterium bovis subsp bovis AF2122/97
gcagcggugcgcgguugug

SEQ ID NO: 1150924 - RNA, 15 nt, Mycobacterium bovis subsp bovis AF2122/97
gcagcgguggucggc

SEQ ID NO: 1150925 - RNA, 23 nt, Mycobacterium bovis subsp bovis AF2122/97
gcagcgggcuccccggauuccuc

SEQ ID NO: 1150926 - RNA, 15 nt, Mycobacterium bovis subsp bovis AF2122/97
gcagcggguugcggu

SEQ ID NO: 1150927 - RNA, 20 nt, Mycobacterium bovis subsp bovis AF2122/97
gcagcggguugcggucaccg

SEQ ID NO: 1150928 - RNA, 14 nt, Mycobacterium bovis subsp bovis AF2122/97
gcagcgugagugca

SEQ ID NO: 1150929 - RNA, 20 nt, Mycobacterium bovis subsp bovis AF2122/97
gcagcgugaucuggccacgg

SEQ ID NO: 1150930 - RNA, 23 nt, Mycobacterium bovis subsp bovis AF2122/97
gcagcgugaaaugcacgaucgcc

SEQ ID NO: 1150931 - RNA, 19 nt, Mycobacterium bovis subsp bovis AF2122/97
gcagcgugaccaccgccga

SEQ ID NO: 1150932 - RNA, 21 nt, Mycobacterium bovis subsp bovis AF2122/97
gcagcgugaccaccgccgaca

SEQ ID NO: 1150933 - RNA, 18 nt, Mycobacterium bovis subsp bovis AF2122/97
gcagcgugcgaugcagcg

SEQ ID NO: 1150934 - RNA, 21 nt, Mycobacterium bovis subsp bovis AF2122/97
gcagcgugcgaugcagcgcgc

SEQ ID NO: 1150935 - RNA, 17 nt, Mycobacterium bovis subsp bovis AF2122/97
gcagcgugcagcggcgg

SEQ ID NO: 1150936 - RNA, 15 nt, Mycobacterium bovis subsp bovis AF2122/97
gcagcgugcccagua

SEQ ID NO: 1150937 - RNA, 20 nt, Mycobacterium bovis subsp bovis AF2122/97
gcagcgucacccugucgcgc

SEQ ID NO: 1150938 - RNA, 13 nt, Mycobacterium bovis subsp bovis AF2122/97
gcagcguccgcgg

SEQ ID NO: 1150939 - RNA, 18 nt, Mycobacterium bovis subsp bovis AF2122/97
gcagcguccgcggaugca

SEQ ID NO: 1150940 - RNA, 20 nt, Mycobacterium bovis subsp bovis AF2122/97
gcagcguccgaaccaccugu

SEQ ID NO: 1150941 - RNA, 16 nt, Mycobacterium bovis subsp bovis AF2122/97
gcagcgucgucgacga

SEQ ID NO: 1150942 - RNA, 17 nt, Mycobacterium bovis subsp bovis AF2122/97
gcagcgucgucgacgac

SEQ ID NO: 1150943 - RNA, 15 nt, Mycobacterium bovis subsp bovis AF2122/97
gcagcguccagcgcc

SEQ ID NO: 1150944 - RNA, 22 nt, Mycobacterium bovis subsp bovis AF2122/97
gcagcgucguaaccgucgccug

SEQ ID NO: 1150945 - RNA, 16 nt, Mycobacterium bovis subsp bovis AF2122/97
gcagcucgccggcacg

SEQ ID NO: 1150946 - RNA, 21 nt, Mycobacterium bovis subsp bovis AF2122/97
gcagcucgcacucguugccga

SEQ ID NO: 1150947 - RNA, 16 nt, Mycobacterium bovis subsp bovis AF2122/97
gcagcuccucgcccag

SEQ ID NO: 1150948 - RNA, 15 nt, Mycobacterium bovis subsp bovis AF2122/97
gcagcuccucgcgcu

SEQ ID NO: 1150949 - RNA, 14 nt, Mycobacterium bovis subsp bovis AF2122/97
gcagcucgaccagg

SEQ ID NO: 1150950 - RNA, 14 nt, Mycobacterium bovis subsp bovis AF2122/97
gcagcucgauaccc

SEQ ID NO: 1150951 - RNA, 21 nt, Mycobacterium bovis subsp bovis AF2122/97
gcagcucgccggcacgcagcc

SEQ ID NO: 1150952 - RNA, 12 nt, Mycobacterium bovis subsp bovis AF2122/97
gcagcucgguca

SEQ ID NO: 1150953 - RNA, 14 nt, Mycobacterium bovis subsp bovis AF2122/97
gcagcucggccgag

SEQ ID NO: 1150954 - RNA, 16 nt, Mycobacterium bovis subsp bovis AF2122/97
gcagcucggccgaggc

SEQ ID NO: 1150955 - RNA, 22 nt, Mycobacterium bovis subsp bovis AF2122/97
gcagcucggggcgaugagccug

SEQ ID NO: 1150956 - RNA, 20 nt, Mycobacterium bovis subsp bovis AF2122/97
gcagcucggucagcgucagg

SEQ ID NO: 1150957 - RNA, 18 nt, Mycobacterium bovis subsp bovis AF2122/97
gcagcuccccgaccgaac

SEQ ID NO: 1150958 - RNA, 20 nt, Mycobacterium bovis subsp bovis AF2122/97
gcagcuccccgaccgaaccg

SEQ ID NO: 1150959 - RNA, 15 nt, Mycobacterium bovis subsp bovis AF2122/97
gcagcuccgggugca

SEQ ID NO: 1150960 - RNA, 17 nt, Mycobacterium bovis subsp bovis AF2122/97
gcagcuccaccgugacg

SEQ ID NO: 1150961 - RNA, 21 nt, Mycobacterium bovis subsp bovis AF2122/97
gcagcguguugcguucgguga

SEQ ID NO: 1150962 - RNA, 16 nt, Mycobacterium bovis subsp bovis AF2122/97
gcagcucaccucauga

SEQ ID NO: 1150963 - RNA, 18 nt, Mycobacterium bovis subsp bovis AF2122/97
gcagcucaucgcgcacgc

SEQ ID NO: 1150964 - RNA, 19 nt, Mycobacterium bovis subsp bovis AF2122/97
gcagcuacggggcggucga

SEQ ID NO: 1150965 - RNA, 15 nt, Mycobacterium bovis subsp bovis AF2122/97
gcagcuaguggccga

SEQ ID NO: 1150966 - RNA, 21 nt, Mycobacterium bovis subsp bovis AF2122/97
gcagcuauuucgcgacgcgcg

SEQ ID NO: 1150967 - RNA, 23 nt, Mycobacterium bovis subsp bovis AF2122/97
gcagcuauuucgcgacgcgcgag

SEQ ID NO: 1150968 - RNA, 24 nt, Mycobacterium bovis subsp bovis AF2122/97
gcagcuauuucgcgacgcgcgaga

SEQ ID NO: 1150969 - RNA, 15 nt, Mycobacterium bovis subsp bovis AF2122/97
gcagcguugacggcg

SEQ ID NO: 1150970 - RNA, 16 nt, Mycobacterium bovis subsp bovis AF2122/97
gcagcguugacggcgg

SEQ ID NO: 1150971 - RNA, 17 nt, Mycobacterium bovis subsp bovis AF2122/97
gcagcguugacggcggg

SEQ ID NO: 1150972 - RNA, 18 nt, Mycobacterium bovis subsp bovis AF2122/97
gcagcguugacggcuucg

SEQ ID NO: 1150973 - RNA, 23 nt, Mycobacterium bovis subsp bovis AF2122/97
gcagcguugacggcuucggcagc

SEQ ID NO: 1150974 - RNA, 15 nt, Mycobacterium bovis subsp bovis AF2122/97
gcagcguugacgguc

SEQ ID NO: 1150975 - RNA, 19 nt, Mycobacterium bovis subsp bovis AF2122/97
gcagcgugugcucgugggc

SEQ ID NO: 1150976 - RNA, 20 nt, Mycobacterium bovis subsp bovis AF2122/97
gcagcgugugcucgugggcg

SEQ ID NO: 1150977 - RNA, 15 nt, Mycobacterium bovis subsp bovis AF2122/97
gcagcguguaaccga

SEQ ID NO: 1150978 - RNA, 16 nt, Mycobacterium bovis subsp bovis AF2122/97
gcagcguuggccgcug

SEQ ID NO: 1150979 - RNA, 20 nt, Mycobacterium bovis subsp bovis AF2122/97
gcagcguuggccgcugucgu

SEQ ID NO: 1150980 - RNA, 23 nt, Mycobacterium bovis subsp bovis AF2122/97
gcagcguuggccgcugucguacc

SEQ ID NO: 1150981 - RNA, 14 nt, Mycobacterium bovis subsp bovis AF2122/97
gcagcgcuggcuac

SEQ ID NO: 1150982 - RNA, 18 nt, Mycobacterium bovis subsp bovis AF2122/97
gcagcgcuucggcggucg

SEQ ID NO: 1150983 - RNA, 19 nt, Mycobacterium bovis subsp bovis AF2122/97
gcagcgcucguuccggcgg

SEQ ID NO: 1150984 - RNA, 18 nt, Mycobacterium bovis subsp bovis AF2122/97
gcagcgcguucggcaccu

SEQ ID NO: 1150985 - RNA, 15 nt, Mycobacterium bovis subsp bovis AF2122/97
gcagcggcgcucggc

SEQ ID NO: 1150986 - RNA, 13 nt, Mycobacterium bovis subsp bovis AF2122/97
gcagcggcgagcc

SEQ ID NO: 1150987 - RNA, 13 nt, Mycobacterium bovis subsp bovis AF2122/97
gcagcggcgcggu

SEQ ID NO: 1150988 - RNA, 13 nt, Mycobacterium bovis subsp bovis AF2122/97
gcagcggcgguau

SEQ ID NO: 1150989 - RNA, 15 nt, Mycobacterium bovis subsp bovis AF2122/97
gcagcggcggcgacg

SEQ ID NO: 1150990 - RNA, 23 nt, Mycobacterium bovis subsp bovis AF2122/97
gcagcggcuugcccaggcgcaac

SEQ ID NO: 1150991 - RNA, 15 nt, Mycobacterium bovis subsp bovis AF2122/97
gcagcggcucggcgg

SEQ ID NO: 1150992 - RNA, 16 nt, Mycobacterium bovis subsp bovis AF2122/97
gcagcggcucggcggc

SEQ ID NO: 1150993 - RNA, 17 nt, Mycobacterium bovis subsp bovis AF2122/97
gcagcggcucggcggcg

SEQ ID NO: 1150994 - RNA, 19 nt, Mycobacterium bovis subsp bovis AF2122/97
gcagcggcgucgucgucga

SEQ ID NO: 1150995 - RNA, 20 nt, Mycobacterium bovis subsp bovis AF2122/97
gcagcggccagggcacccau

SEQ ID NO: 1150996 - RNA, 16 nt, Mycobacterium bovis subsp bovis AF2122/97
gcagcggccagcccag

SEQ ID NO: 1150997 - RNA, 18 nt, Mycobacterium bovis subsp bovis AF2122/97
gcagcggcaucggccagc

SEQ ID NO: 1150998 - RNA, 18 nt, Mycobacterium bovis subsp bovis AF2122/97
gcagcggccugaccggcu

SEQ ID NO: 1150999 - RNA, 14 nt, Mycobacterium bovis subsp bovis AF2122/97
gcagcggcgcgcug

SEQ ID NO: 1151000 - RNA, 22 nt, Mycobacterium bovis subsp bovis AF2122/97
gcagcggcgaccgcggucgcca

SEQ ID NO: 1151001 - RNA, 14 nt, Mycobacterium bovis subsp bovis AF2122/97
gcagcgcgaucugc

SEQ ID NO: 1151002 - RNA, 13 nt, Mycobacterium bovis subsp bovis AF2122/97
gcagcgcgcccug

SEQ ID NO: 1151003 - RNA, 13 nt, Mycobacterium bovis subsp bovis AF2122/97
gcagcgcggcaaa

SEQ ID NO: 1151004 - RNA, 21 nt, Mycobacterium bovis subsp bovis AF2122/97
gcagcgcggccagagccgcgc

SEQ ID NO: 1151005 - RNA, 13 nt, Mycobacterium bovis subsp bovis AF2122/97
gcagcgcggccgg

SEQ ID NO: 1151006 - RNA, 14 nt, Mycobacterium bovis subsp bovis AF2122/97
gcagcgcggccggg

SEQ ID NO: 1151007 - RNA, 14 nt, Mycobacterium bovis subsp bovis AF2122/97
gcagcgcgggaucu

SEQ ID NO: 1151008 - RNA, 23 nt, Mycobacterium bovis subsp bovis AF2122/97
gcagcgcgguggucagcaccggc

SEQ ID NO: 1151009 - RNA, 15 nt, Mycobacterium bovis subsp bovis AF2122/97
gcagcgcgucgccga

SEQ ID NO: 1151010 - RNA, 14 nt, Mycobacterium bovis subsp bovis AF2122/97
gcagcgccgcgugg

SEQ ID NO: 1151011 - RNA, 12 nt, Mycobacterium bovis subsp bovis AF2122/97
gcagcgccgaca

SEQ ID NO: 1151012 - RNA, 14 nt, Mycobacterium bovis subsp bovis AF2122/97
gcagcgccgccacc

SEQ ID NO: 1151013 - RNA, 13 nt, Mycobacterium bovis subsp bovis AF2122/97
gcagcgcgauggc

SEQ ID NO: 1151014 - RNA, 19 nt, Mycobacterium bovis subsp bovis AF2122/97
gcagcgcgaugucgccggc

SEQ ID NO: 1151015 - RNA, 21 nt, Mycobacterium bovis subsp bovis AF2122/97
gcagcgcgaugucgccggcga

SEQ ID NO: 1151016 - RNA, 17 nt, Mycobacterium bovis subsp bovis AF2122/97
gcagcgcgacccguagc

SEQ ID NO: 1151017 - RNA, 16 nt, Mycobacterium bovis subsp bovis AF2122/97
gcagcgcgaucaccga

SEQ ID NO: 1151018 - RNA, 14 nt, Mycobacterium bovis subsp bovis AF2122/97
gcagcgcgacgguu

SEQ ID NO: 1151019 - RNA, 13 nt, Mycobacterium bovis subsp bovis AF2122/97
gcagcgcgaggcu

SEQ ID NO: 1151020 - RNA, 15 nt, Mycobacterium bovis subsp bovis AF2122/97
gcagcgcgaucaccg

SEQ ID NO: 1151021 - RNA, 13 nt, Mycobacterium bovis subsp bovis AF2122/97
gcagcgcgacccg

SEQ ID NO: 1151022 - RNA, 14 nt, Mycobacterium bovis subsp bovis AF2122/97
gcagcgccggcacc

SEQ ID NO: 1151023 - RNA, 15 nt, Mycobacterium bovis subsp bovis AF2122/97
gcagcgccggcaccg

SEQ ID NO: 1151024 - RNA, 17 nt, Mycobacterium bovis subsp bovis AF2122/97
gcagcgccgcguucagg

SEQ ID NO: 1151025 - RNA, 20 nt, Mycobacterium bovis subsp bovis AF2122/97
gcagcaccgacgugauggug

SEQ ID NO: 1151026 - RNA, 18 nt, Mycobacterium bovis subsp bovis AF2122/97
gcagcaccgcagcgacca

SEQ ID NO: 1151027 - RNA, 15 nt, Mycobacterium bovis subsp bovis AF2122/97
gcagcaccgcgacca

SEQ ID NO: 1151028 - RNA, 18 nt, Mycobacterium bovis subsp bovis AF2122/97
gcagcaccgcgaccaucg

SEQ ID NO: 1151029 - RNA, 17 nt, Mycobacterium bovis subsp bovis AF2122/97
gcagccccuccgcgccg

SEQ ID NO: 1151030 - RNA, 18 nt, Mycobacterium bovis subsp bovis AF2122/97
gcagccccuccgcgccga

SEQ ID NO: 1151031 - RNA, 15 nt, Mycobacterium bovis subsp bovis AF2122/97
gcagcccccggaucc

SEQ ID NO: 1151032 - RNA, 14 nt, Mycobacterium bovis subsp bovis AF2122/97
gcagccccucgucg

SEQ ID NO: 1151033 - RNA, 16 nt, Mycobacterium bovis subsp bovis AF2122/97
gcagcccgcggaucac

SEQ ID NO: 1151034 - RNA, 15 nt, Mycobacterium bovis subsp bovis AF2122/97
gcagcccggcggccg

SEQ ID NO: 1151035 - RNA, 15 nt, Mycobacterium bovis subsp bovis AF2122/97
gcagccgcgccgcgg

SEQ ID NO: 1151036 - RNA, 20 nt, Mycobacterium bovis subsp bovis AF2122/97
gcagccgcgccgcggcccgc

SEQ ID NO: 1151037 - RNA, 22 nt, Mycobacterium bovis subsp bovis AF2122/97
gcagccgcgcggugauggucac

SEQ ID NO: 1151038 - RNA, 15 nt, Mycobacterium bovis subsp bovis AF2122/97
gcagccgcggucguu

SEQ ID NO: 1151039 - RNA, 22 nt, Mycobacterium bovis subsp bovis AF2122/97
gcagccgcugaucugccgccgc

SEQ ID NO: 1151040 - RNA, 15 nt, Mycobacterium bovis subsp bovis AF2122/97
gcagccgcucgacgg

SEQ ID NO: 1151041 - RNA, 19 nt, Mycobacterium bovis subsp bovis AF2122/97
gcagccgcucgacggcccg

SEQ ID NO: 1151042 - RNA, 22 nt, Mycobacterium bovis subsp bovis AF2122/97
gcagccggcauagcggcccauc

SEQ ID NO: 1151043 - RNA, 15 nt, Mycobacterium bovis subsp bovis AF2122/97
gcagcgcaacaucga

SEQ ID NO: 1151044 - RNA, 14 nt, Mycobacterium bovis subsp bovis AF2122/97
gcagcgcaacggcc

SEQ ID NO: 1151045 - RNA, 17 nt, Mycobacterium bovis subsp bovis AF2122/97
gcagcgcaaugcaucgc

SEQ ID NO: 1151046 - RNA, 15 nt, Mycobacterium bovis subsp bovis AF2122/97
gcagcgccacccgau

SEQ ID NO: 1151047 - RNA, 16 nt, Mycobacterium bovis subsp bovis AF2122/97
gcagcgacgcugccgc

SEQ ID NO: 1151048 - RNA, 17 nt, Mycobacterium bovis subsp bovis AF2122/97
gcagcgacgccggcccg

SEQ ID NO: 1151049 - RNA, 13 nt, Mycobacterium bovis subsp bovis AF2122/97
gcagcgacgcgau

SEQ ID NO: 1151050 - RNA, 19 nt, Mycobacterium bovis subsp bovis AF2122/97
gcagcgaccaccgucacga

SEQ ID NO: 1151051 - RNA, 19 nt, Mycobacterium bovis subsp bovis AF2122/97
gcagcgagucgacgucgau

SEQ ID NO: 1151052 - RNA, 16 nt, Mycobacterium bovis subsp bovis AF2122/97
gcagcgaugacgacca

SEQ ID NO: 1151053 - RNA, 17 nt, Mycobacterium bovis subsp bovis AF2122/97
gcagcgcaaacaucuug

SEQ ID NO: 1151054 - RNA, 19 nt, Mycobacterium bovis subsp bovis AF2122/97
gcagcgcaaacaucuuguc

SEQ ID NO: 1151055 - RNA, 13 nt, Mycobacterium bovis subsp bovis AF2122/97
gcagccgggcguc

SEQ ID NO: 1151056 - RNA, 18 nt, Mycobacterium bovis subsp bovis AF2122/97
gcagccgggcgucgcugg

SEQ ID NO: 1151057 - RNA, 17 nt, Mycobacterium bovis subsp bovis AF2122/97
gcagccgggcaccaccc

SEQ ID NO: 1151058 - RNA, 15 nt, Mycobacterium bovis subsp bovis AF2122/97
gcagccgggcaccga

SEQ ID NO: 1151059 - RNA, 17 nt, Mycobacterium bovis subsp bovis AF2122/97
gcagccgggccaaccgg

SEQ ID NO: 1151060 - RNA, 17 nt, Mycobacterium bovis subsp bovis AF2122/97
gcagccggcccgucgcg

SEQ ID NO: 1151061 - RNA, 22 nt, Mycobacterium bovis subsp bovis AF2122/97
gcagcgaaaacccggucggcga

SEQ ID NO: 1151062 - RNA, 23 nt, Mycobacterium bovis subsp bovis AF2122/97
gcagcgaaacaccggccagcggc

SEQ ID NO: 1151063 - RNA, 14 nt, Mycobacterium bovis subsp bovis AF2122/97
gcagcgaaacaccg

SEQ ID NO: 1151064 - RNA, 20 nt, Mycobacterium bovis subsp bovis AF2122/97
gcagcgaaacaccggccagc

SEQ ID NO: 1151065 - RNA, 17 nt, Mycobacterium bovis subsp bovis AF2122/97
gcaggaucuccgggucg

SEQ ID NO: 1151066 - RNA, 20 nt, Mycobacterium bovis subsp bovis AF2122/97
gcaggaucuccgggucgaug

SEQ ID NO: 1151067 - RNA, 17 nt, Mycobacterium bovis subsp bovis AF2122/97
gcaggaugaugaccgcc

SEQ ID NO: 1151068 - RNA, 19 nt, Mycobacterium bovis subsp bovis AF2122/97
gcaggaugcgaucgucacg

SEQ ID NO: 1151069 - RNA, 14 nt, Mycobacterium bovis subsp bovis AF2122/97
gcaggcacaucgcg

SEQ ID NO: 1151070 - RNA, 21 nt, Mycobacterium bovis subsp bovis AF2122/97
gcaggauucccagucgcggcg

SEQ ID NO: 1151071 - RNA, 24 nt, Mycobacterium bovis subsp bovis AF2122/97
gcaggauucccagucgcggcgcga

SEQ ID NO: 1151072 - RNA, 21 nt, Mycobacterium bovis subsp bovis AF2122/97
gcaggauucccucgacagugc

SEQ ID NO: 1151073 - RNA, 15 nt, Mycobacterium bovis subsp bovis AF2122/97
gcaggauucggcggu

SEQ ID NO: 1151074 - RNA, 23 nt, Mycobacterium bovis subsp bovis AF2122/97
gcaggcagguuggccaccgccca

SEQ ID NO: 1151075 - RNA, 18 nt, Mycobacterium bovis subsp bovis AF2122/97
gcaggcauggcgccguug

SEQ ID NO: 1151076 - RNA, 18 nt, Mycobacterium bovis subsp bovis AF2122/97
gcaggccgaagacgugcc

SEQ ID NO: 1151077 - RNA, 18 nt, Mycobacterium bovis subsp bovis AF2122/97
gcaggcccuucaguucga

SEQ ID NO: 1151078 - RNA, 22 nt, Mycobacterium bovis subsp bovis AF2122/97
gcaggccccacuggugcagcgc

SEQ ID NO: 1151079 - RNA, 20 nt, Mycobacterium bovis subsp bovis AF2122/97
gcaggcccgacggcgcccag

SEQ ID NO: 1151080 - RNA, 21 nt, Mycobacterium bovis subsp bovis AF2122/97
gcaggcccgacggcgcccagc

SEQ ID NO: 1151081 - RNA, 14 nt, Mycobacterium bovis subsp bovis AF2122/97
gcaggcccagcgga

SEQ ID NO: 1151082 - RNA, 16 nt, Mycobacterium bovis subsp bovis AF2122/97
gcaggcccacccgggc

SEQ ID NO: 1151083 - RNA, 14 nt, Mycobacterium bovis subsp bovis AF2122/97
gcaggccgcccagc

SEQ ID NO: 1151084 - RNA, 14 nt, Mycobacterium bovis subsp bovis AF2122/97
gcaggccgcugggc

SEQ ID NO: 1151085 - RNA, 24 nt, Mycobacterium bovis subsp bovis AF2122/97
gcaggccgggcgcaagcagcccgg

SEQ ID NO: 1151086 - RNA, 12 nt, Mycobacterium bovis subsp bovis AF2122/97
gcaggccggcgg

SEQ ID NO: 1151087 - RNA, 23 nt, Mycobacterium bovis subsp bovis AF2122/97
gcaggccgucgaguuccggccgg

SEQ ID NO: 1151088 - RNA, 19 nt, Mycobacterium bovis subsp bovis AF2122/97
gcaggccuccaagcccgcc

SEQ ID NO: 1151089 - RNA, 14 nt, Mycobacterium bovis subsp bovis AF2122/97
gcaggccucggcgc

SEQ ID NO: 1151090 - RNA, 18 nt, Mycobacterium bovis subsp bovis AF2122/97
gcaggccucggcgccgcc

SEQ ID NO: 1151091 - RNA, 20 nt, Mycobacterium bovis subsp bovis AF2122/97
gcaggccucggcgccgccca

SEQ ID NO: 1151092 - RNA, 15 nt, Mycobacterium bovis subsp bovis AF2122/97
gcaggcgacggcucu

SEQ ID NO: 1151093 - RNA, 22 nt, Mycobacterium bovis subsp bovis AF2122/97
gcaggccuccaagcccgccgga

SEQ ID NO: 1151094 - RNA, 19 nt, Mycobacterium bovis subsp bovis AF2122/97
gcaggcgaguuaggccgcc

SEQ ID NO: 1151095 - RNA, 15 nt, Mycobacterium bovis subsp bovis AF2122/97
gcaggcgaacaccag

SEQ ID NO: 1151096 - RNA, 16 nt, Mycobacterium bovis subsp bovis AF2122/97
gcaggcgaacaccaga

SEQ ID NO: 1151097 - RNA, 14 nt, Mycobacterium bovis subsp bovis AF2122/97
gcaggcgaacacca

SEQ ID NO: 1151098 - RNA, 13 nt, Mycobacterium bovis subsp bovis AF2122/97
gcaggcggccagc

SEQ ID NO: 1151099 - RNA, 18 nt, Mycobacterium bovis subsp bovis AF2122/97
gcaggcuaaucagccagg

SEQ ID NO: 1151100 - RNA, 18 nt, Mycobacterium bovis subsp bovis AF2122/97
gcaggcucaccgagccga

SEQ ID NO: 1151101 - RNA, 14 nt, Mycobacterium bovis subsp bovis AF2122/97
gcaggcggccgccg

SEQ ID NO: 1151102 - RNA, 15 nt, Mycobacterium bovis subsp bovis AF2122/97
gcaggcggccgccgg

SEQ ID NO: 1151103 - RNA, 15 nt, Mycobacterium bovis subsp bovis AF2122/97
gcaggcggcucaacc

SEQ ID NO: 1151104 - RNA, 11 nt, Mycobacterium bovis subsp bovis AF2122/97
gcaggcggccu

SEQ ID NO: 1151105 - RNA, 14 nt, Mycobacterium bovis subsp bovis AF2122/97
gcaggcgucccagc

SEQ ID NO: 1151106 - RNA, 20 nt, Mycobacterium bovis subsp bovis AF2122/97
gcaggcgucccagccgauca

SEQ ID NO: 1151107 - RNA, 22 nt, Mycobacterium bovis subsp bovis AF2122/97
gcaggcugguuucggccgcauc

SEQ ID NO: 1151108 - RNA, 14 nt, Mycobacterium bovis subsp bovis AF2122/97
gcagggcagcccgg

SEQ ID NO: 1151109 - RNA, 16 nt, Mycobacterium bovis subsp bovis AF2122/97
gcagggcagcccggcg

SEQ ID NO: 1151110 - RNA, 21 nt, Mycobacterium bovis subsp bovis AF2122/97
gcagggacccggcgccgucga

SEQ ID NO: 1151111 - RNA, 19 nt, Mycobacterium bovis subsp bovis AF2122/97
gcagggacugugggggcgc

SEQ ID NO: 1151112 - RNA, 14 nt, Mycobacterium bovis subsp bovis AF2122/97
gcagggaucacccc

SEQ ID NO: 1151113 - RNA, 19 nt, Mycobacterium bovis subsp bovis AF2122/97
gcaggcuuccagccacagc

SEQ ID NO: 1151114 - RNA, 22 nt, Mycobacterium bovis subsp bovis AF2122/97
gcagggaauagcggcgcccgcc

SEQ ID NO: 1151115 - RNA, 12 nt, Mycobacterium bovis subsp bovis AF2122/97
gcaggucgcacc

SEQ ID NO: 1151116 - RNA, 12 nt, Mycobacterium bovis subsp bovis AF2122/97
gcaggucgaugc

SEQ ID NO: 1151117 - RNA, 13 nt, Mycobacterium bovis subsp bovis AF2122/97
gcaggucgccugc

SEQ ID NO: 1151118 - RNA, 13 nt, Mycobacterium bovis subsp bovis AF2122/97
gcaggucgcuggc

SEQ ID NO: 1151119 - RNA, 12 nt, Mycobacterium bovis subsp bovis AF2122/97
gcagguccgcgg

SEQ ID NO: 1151120 - RNA, 21 nt, Mycobacterium bovis subsp bovis AF2122/97
gcagguccaggguggucgucg

SEQ ID NO: 1151121 - RNA, 20 nt, Mycobacterium bovis subsp bovis AF2122/97
gcagguaccaccgcggugug

SEQ ID NO: 1151122 - RNA, 15 nt, Mycobacterium bovis subsp bovis AF2122/97
gcagguaggcgcgau

SEQ ID NO: 1151123 - RNA, 23 nt, Mycobacterium bovis subsp bovis AF2122/97
gcagguagguauagccgguuguc

SEQ ID NO: 1151124 - RNA, 15 nt, Mycobacterium bovis subsp bovis AF2122/97
gcagguagucgacga

SEQ ID NO: 1151125 - RNA, 12 nt, Mycobacterium bovis subsp bovis AF2122/97
gcagggugugcg

SEQ ID NO: 1151126 - RNA, 14 nt, Mycobacterium bovis subsp bovis AF2122/97
gcaggguuccccau

SEQ ID NO: 1151127 - RNA, 20 nt, Mycobacterium bovis subsp bovis AF2122/97
gcagguacgccucgacagcg

SEQ ID NO: 1151128 - RNA, 14 nt, Mycobacterium bovis subsp bovis AF2122/97
gcaggguggccagc

SEQ ID NO: 1151129 - RNA, 11 nt, Mycobacterium bovis subsp bovis AF2122/97
gcagggugacc

SEQ ID NO: 1151130 - RNA, 20 nt, Mycobacterium bovis subsp bovis AF2122/97
gcagggcauugcggcccgcg

SEQ ID NO: 1151131 - RNA, 19 nt, Mycobacterium bovis subsp bovis AF2122/97
gcagggccacuggccgguu

SEQ ID NO: 1151132 - RNA, 14 nt, Mycobacterium bovis subsp bovis AF2122/97
gcagggccagcggc

SEQ ID NO: 1151133 - RNA, 18 nt, Mycobacterium bovis subsp bovis AF2122/97
gcagggccagcggcagcc

SEQ ID NO: 1151134 - RNA, 13 nt, Mycobacterium bovis subsp bovis AF2122/97
gcagggccgccgc

SEQ ID NO: 1151135 - RNA, 18 nt, Mycobacterium bovis subsp bovis AF2122/97
gcagggccucggucgcca

SEQ ID NO: 1151136 - RNA, 15 nt, Mycobacterium bovis subsp bovis AF2122/97
gcagggccagaccga

SEQ ID NO: 1151137 - RNA, 15 nt, Mycobacterium bovis subsp bovis AF2122/97
gcagggccuggccac

SEQ ID NO: 1151138 - RNA, 13 nt, Mycobacterium bovis subsp bovis AF2122/97
gcagggcggcgaa

SEQ ID NO: 1151139 - RNA, 22 nt, Mycobacterium bovis subsp bovis AF2122/97
gcagggcgucggcgaauuccuc

SEQ ID NO: 1151140 - RNA, 21 nt, Mycobacterium bovis subsp bovis AF2122/97
gcagggcgcgcaucugcucgg

SEQ ID NO: 1151141 - RNA, 22 nt, Mycobacterium bovis subsp bovis AF2122/97
gcagggcgcgcaucugcucggc

SEQ ID NO: 1151142 - RNA, 17 nt, Mycobacterium bovis subsp bovis AF2122/97
gcagggcgucggcgaau

SEQ ID NO: 1151143 - RNA, 15 nt, Mycobacterium bovis subsp bovis AF2122/97
gcagggugccggcgc

SEQ ID NO: 1151144 - RNA, 19 nt, Mycobacterium bovis subsp bovis AF2122/97
gcagggugccggcgccgcc

SEQ ID NO: 1151145 - RNA, 20 nt, Mycobacterium bovis subsp bovis AF2122/97
gcagggugccggcgccgccc

SEQ ID NO: 1151146 - RNA, 13 nt, Mycobacterium bovis subsp bovis AF2122/97
gcaggggacgacc

SEQ ID NO: 1151147 - RNA, 14 nt, Mycobacterium bovis subsp bovis AF2122/97
gcaggggcggcgug

SEQ ID NO: 1151148 - RNA, 15 nt, Mycobacterium bovis subsp bovis AF2122/97
gcaggggacgaccau

SEQ ID NO: 1151149 - RNA, 18 nt, Mycobacterium bovis subsp bovis AF2122/97
gcagggggacccggaccu

SEQ ID NO: 1151150 - RNA, 15 nt, Mycobacterium bovis subsp bovis AF2122/97
gcagguuccacggcc

SEQ ID NO: 1151151 - RNA, 23 nt, Mycobacterium bovis subsp bovis AF2122/97
gcagguuccacggccaggucgac

SEQ ID NO: 1151152 - RNA, 20 nt, Mycobacterium bovis subsp bovis AF2122/97
gcagguucuugaccagcagc

SEQ ID NO: 1151153 - RNA, 14 nt, Mycobacterium bovis subsp bovis AF2122/97
gcagguuggcaagc

SEQ ID NO: 1151154 - RNA, 18 nt, Mycobacterium bovis subsp bovis AF2122/97
gcagguuggcaagcacgg

SEQ ID NO: 1151155 - RNA, 18 nt, Mycobacterium bovis subsp bovis AF2122/97
gcagguuggccaccgccc

SEQ ID NO: 1151156 - RNA, 18 nt, Mycobacterium bovis subsp bovis AF2122/97
gcaguaacuucaccggcu

SEQ ID NO: 1151157 - RNA, 20 nt, Mycobacterium bovis subsp bovis AF2122/97
gcaguaacuucaccggcucg

SEQ ID NO: 1151158 - RNA, 21 nt, Mycobacterium bovis subsp bovis AF2122/97
gcaguaacuucaccggcucgu

SEQ ID NO: 1151159 - RNA, 21 nt, Mycobacterium bovis subsp bovis AF2122/97
gcaguacuaacaacaccacca

SEQ ID NO: 1151160 - RNA, 16 nt, Mycobacterium bovis subsp bovis AF2122/97
gcaguacuagcagcgg

SEQ ID NO: 1151161 - RNA, 16 nt, Mycobacterium bovis subsp bovis AF2122/97
gcaguacaccgcccgg

SEQ ID NO: 1151162 - RNA, 18 nt, Mycobacterium bovis subsp bovis AF2122/97
gcaguacaccgcccggcc

SEQ ID NO: 1151163 - RNA, 21 nt, Mycobacterium bovis subsp bovis AF2122/97
gcaguauucacagucgcucgc

SEQ ID NO: 1151164 - RNA, 20 nt, Mycobacterium bovis subsp bovis AF2122/97
gcaguaguagcgcaaccgcg

SEQ ID NO: 1151165 - RNA, 19 nt, Mycobacterium bovis subsp bovis AF2122/97
gcaguagugaucgaucgcg

SEQ ID NO: 1151166 - RNA, 20 nt, Mycobacterium bovis subsp bovis AF2122/97
gcaguaucaucggcgcuggc

SEQ ID NO: 1151167 - RNA, 19 nt, Mycobacterium bovis subsp bovis AF2122/97
gcaggugagccaguuggcc

SEQ ID NO: 1151168 - RNA, 21 nt, Mycobacterium bovis subsp bovis AF2122/97
gcaggugacgaucaggucgcc

SEQ ID NO: 1151169 - RNA, 23 nt, Mycobacterium bovis subsp bovis AF2122/97
gcaggugacgaucaggucgccga

SEQ ID NO: 1151170 - RNA, 22 nt, Mycobacterium bovis subsp bovis AF2122/97
gcaggugacauguugccgcuga

SEQ ID NO: 1151171 - RNA, 18 nt, Mycobacterium bovis subsp bovis AF2122/97
gcaggugaugagugcgga

SEQ ID NO: 1151172 - RNA, 14 nt, Mycobacterium bovis subsp bovis AF2122/97
gcaggugagugcgg

SEQ ID NO: 1151173 - RNA, 17 nt, Mycobacterium bovis subsp bovis AF2122/97
gcaggugauguucagcg

SEQ ID NO: 1151174 - RNA, 16 nt, Mycobacterium bovis subsp bovis AF2122/97
gcaggugccaaccgcg

SEQ ID NO: 1151175 - RNA, 15 nt, Mycobacterium bovis subsp bovis AF2122/97
gcaggugcccaucgg

SEQ ID NO: 1151176 - RNA, 21 nt, Mycobacterium bovis subsp bovis AF2122/97
gcaggugcccgaggugcuugg

SEQ ID NO: 1151177 - RNA, 16 nt, Mycobacterium bovis subsp bovis AF2122/97
gcaggugccuuucggc

SEQ ID NO: 1151178 - RNA, 17 nt, Mycobacterium bovis subsp bovis AF2122/97
gcaggugggcguuggcg

SEQ ID NO: 1151179 - RNA, 16 nt, Mycobacterium bovis subsp bovis AF2122/97
gcagguggccgucgcc

SEQ ID NO: 1151180 - RNA, 18 nt, Mycobacterium bovis subsp bovis AF2122/97
gcaggugggcguuggcga

SEQ ID NO: 1151181 - RNA, 19 nt, Mycobacterium bovis subsp bovis AF2122/97
gcaggugauguucagcgcc

SEQ ID NO: 1151182 - RNA, 13 nt, Mycobacterium bovis subsp bovis AF2122/97
gcagguggucgau

SEQ ID NO: 1151183 - RNA, 15 nt, Mycobacterium bovis subsp bovis AF2122/97
gcaggucgucguacc

SEQ ID NO: 1151184 - RNA, 16 nt, Mycobacterium bovis subsp bovis AF2122/97
gcaggucuucgcuguc

SEQ ID NO: 1151185 - RNA, 17 nt, Mycobacterium bovis subsp bovis AF2122/97
aagaaguggucggcccg

SEQ ID NO: 1151186 - RNA, 18 nt, Mycobacterium bovis subsp bovis AF2122/97
aagaagaacucggcgucg

SEQ ID NO: 1151187 - RNA, 22 nt, Mycobacterium bovis subsp bovis AF2122/97
aagaacucggcgucgugguggc

SEQ ID NO: 1151188 - RNA, 22 nt, Mycobacterium bovis subsp bovis AF2122/97
aagaagcccgacuggucacugc

SEQ ID NO: 1151189 - RNA, 12 nt, Mycobacterium bovis subsp bovis AF2122/97
aagaacucggcg

SEQ ID NO: 1151190 - RNA, 20 nt, Mycobacterium bovis subsp bovis AF2122/97
aagaacucaaagacccgacg

SEQ ID NO: 1151191 - RNA, 22 nt, Mycobacterium bovis subsp bovis AF2122/97
gaggucgguguuuggccgccga

SEQ ID NO: 1151192 - RNA, 24 nt, Mycobacterium bovis subsp bovis AF2122/97
gaggucguaguucuucucucgggc

SEQ ID NO: 1151193 - RNA, 13 nt, Mycobacterium bovis subsp bovis AF2122/97
gaggucggcggcg

SEQ ID NO: 1151194 - RNA, 16 nt, Mycobacterium bovis subsp bovis AF2122/97
gaggucggccagcagc

SEQ ID NO: 1151195 - RNA, 13 nt, Mycobacterium bovis subsp bovis AF2122/97
gagguuggcggcc

SEQ ID NO: 1151196 - RNA, 16 nt, Mycobacterium bovis subsp bovis AF2122/97
gagguuggagcgccag

SEQ ID NO: 1151197 - RNA, 23 nt, Mycobacterium bovis subsp bovis AF2122/97
gaguaaacaaacccaacaccagc

SEQ ID NO: 1151198 - RNA, 23 nt, Mycobacterium bovis subsp bovis AF2122/97
gaggucguuucccuggccgccgc

SEQ ID NO: 1151199 - RNA, 15 nt, Mycobacterium bovis subsp bovis AF2122/97
gaggucggucagcca

SEQ ID NO: 1151200 - RNA, 14 nt, Mycobacterium bovis subsp bovis AF2122/97
gaggugaagccgag

SEQ ID NO: 1151201 - RNA, 15 nt, Mycobacterium bovis subsp bovis AF2122/97
gagguugccgcacca

SEQ ID NO: 1151202 - RNA, 22 nt, Mycobacterium bovis subsp bovis AF2122/97
gagguagaccugguugaccucg

SEQ ID NO: 1151203 - RNA, 19 nt, Mycobacterium bovis subsp bovis AF2122/97
gagguaggucgccgccgcc

SEQ ID NO: 1151204 - RNA, 21 nt, Mycobacterium bovis subsp bovis AF2122/97
gaggguucgccgaagccggac

SEQ ID NO: 1151205 - RNA, 22 nt, Mycobacterium bovis subsp bovis AF2122/97
gaggucacccaucaacgccggc

SEQ ID NO: 1151206 - RNA, 19 nt, Mycobacterium bovis subsp bovis AF2122/97
gaggucaacgccacgccga

SEQ ID NO: 1151207 - RNA, 18 nt, Mycobacterium bovis subsp bovis AF2122/97
gagguauaaacgcggcgc

SEQ ID NO: 1151208 - RNA, 19 nt, Mycobacterium bovis subsp bovis AF2122/97
gagguccucgucggcgucg

SEQ ID NO: 1151209 - RNA, 20 nt, Mycobacterium bovis subsp bovis AF2122/97
gagguccuugaggauccgca

SEQ ID NO: 1151210 - RNA, 13 nt, Mycobacterium bovis subsp bovis AF2122/97
gagguccggugga

SEQ ID NO: 1151211 - RNA, 16 nt, Mycobacterium bovis subsp bovis AF2122/97
gaggucccggcuggga

SEQ ID NO: 1151212 - RNA, 19 nt, Mycobacterium bovis subsp bovis AF2122/97
gagggcuaccggcgccgcg

SEQ ID NO: 1151213 - RNA, 20 nt, Mycobacterium bovis subsp bovis AF2122/97
gagggcuaccggcgccgcgc

SEQ ID NO: 1151214 - RNA, 20 nt, Mycobacterium bovis subsp bovis AF2122/97
gagggcuuguggugagcgga

SEQ ID NO: 1151215 - RNA, 22 nt, Mycobacterium bovis subsp bovis AF2122/97
gaggcuuacaugcccugcgcuc

SEQ ID NO: 1151216 - RNA, 14 nt, Mycobacterium bovis subsp bovis AF2122/97
gagggaaucuccgg

SEQ ID NO: 1151217 - RNA, 12 nt, Mycobacterium bovis subsp bovis AF2122/97
gagggcucggug

SEQ ID NO: 1151218 - RNA, 13 nt, Mycobacterium bovis subsp bovis AF2122/97
gagggugcccgag

SEQ ID NO: 1151219 - RNA, 22 nt, Mycobacterium bovis subsp bovis AF2122/97
gagggugaagacaccggcgucg

SEQ ID NO: 1151220 - RNA, 17 nt, Mycobacterium bovis subsp bovis AF2122/97
gagggugaccaacgucg

SEQ ID NO: 1151221 - RNA, 21 nt, Mycobacterium bovis subsp bovis AF2122/97
gagggggguguugaggccggu

SEQ ID NO: 1151222 - RNA, 12 nt, Mycobacterium bovis subsp bovis AF2122/97
gaggggacccag

SEQ ID NO: 1151223 - RNA, 16 nt, Mycobacterium bovis subsp bovis AF2122/97
gaggccaugcucgcca

SEQ ID NO: 1151224 - RNA, 23 nt, Mycobacterium bovis subsp bovis AF2122/97
gaggcccgucacaaugcccaggc

SEQ ID NO: 1151225 - RNA, 20 nt, Mycobacterium bovis subsp bovis AF2122/97
gaggccacgccagcucgccg

SEQ ID NO: 1151226 - RNA, 13 nt, Mycobacterium bovis subsp bovis AF2122/97
gaggccaccgcga

SEQ ID NO: 1151227 - RNA, 20 nt, Mycobacterium bovis subsp bovis AF2122/97
gaggccaaguugcagcgggc

SEQ ID NO: 1151228 - RNA, 21 nt, Mycobacterium bovis subsp bovis AF2122/97
gaggcuccuggucgccguggg

SEQ ID NO: 1151229 - RNA, 22 nt, Mycobacterium bovis subsp bovis AF2122/97
gaggcuagcagagacaugccgg

SEQ ID NO: 1151230 - RNA, 15 nt, Mycobacterium bovis subsp bovis AF2122/97
gaggcucguggcgac

SEQ ID NO: 1151231 - RNA, 15 nt, Mycobacterium bovis subsp bovis AF2122/97
gaggcugaccguggc

SEQ ID NO: 1151232 - RNA, 16 nt, Mycobacterium bovis subsp bovis AF2122/97
gaggcuggcaucccgg

SEQ ID NO: 1151233 - RNA, 14 nt, Mycobacterium bovis subsp bovis AF2122/97
gaggccgaccagca

SEQ ID NO: 1151234 - RNA, 16 nt, Mycobacterium bovis subsp bovis AF2122/97
gaggcuggucugcagg

SEQ ID NO: 1151235 - RNA, 14 nt, Mycobacterium bovis subsp bovis AF2122/97
gagcucaucgacga

SEQ ID NO: 1151236 - RNA, 15 nt, Mycobacterium bovis subsp bovis AF2122/97
gagcucaccgucgag

SEQ ID NO: 1151237 - RNA, 17 nt, Mycobacterium bovis subsp bovis AF2122/97
gagcucaccugcgggug

SEQ ID NO: 1151238 - RNA, 13 nt, Mycobacterium bovis subsp bovis AF2122/97
gagcucacgccgg

SEQ ID NO: 1151239 - RNA, 16 nt, Mycobacterium bovis subsp bovis AF2122/97
gagcuacucacgguga

SEQ ID NO: 1151240 - RNA, 17 nt, Mycobacterium bovis subsp bovis AF2122/97
gagcucaucuucgguca

SEQ ID NO: 1151241 - RNA, 18 nt, Mycobacterium bovis subsp bovis AF2122/97
gagcucgaugucagcggc

SEQ ID NO: 1151242 - RNA, 16 nt, Mycobacterium bovis subsp bovis AF2122/97
gagcucgaaguuggcu

SEQ ID NO: 1151243 - RNA, 17 nt, Mycobacterium bovis subsp bovis AF2122/97
gagcgugagccaugccg

SEQ ID NO: 1151244 - RNA, 16 nt, Mycobacterium bovis subsp bovis AF2122/97
gagcgugccgcagcgg

SEQ ID NO: 1151245 - RNA, 19 nt, Mycobacterium bovis subsp bovis AF2122/97
gagcgugccgcagcggcgg

SEQ ID NO: 1151246 - RNA, 21 nt, Mycobacterium bovis subsp bovis AF2122/97
gagcgugccgcagcggcggca

SEQ ID NO: 1151247 - RNA, 18 nt, Mycobacterium bovis subsp bovis AF2122/97
gagcgugucuggcgaaca

SEQ ID NO: 1151248 - RNA, 13 nt, Mycobacterium bovis subsp bovis AF2122/97
gagcuacgacgag

SEQ ID NO: 1151249 - RNA, 14 nt, Mycobacterium bovis subsp bovis AF2122/97
gagcuacgacgagu

SEQ ID NO: 1151250 - RNA, 13 nt, Mycobacterium bovis subsp bovis AF2122/97
gagcgugcgguga

SEQ ID NO: 1151251 - RNA, 16 nt, Mycobacterium bovis subsp bovis AF2122/97
gagcugccgucgcugc

SEQ ID NO: 1151252 - RNA, 24 nt, Mycobacterium bovis subsp bovis AF2122/97
gagcugcgacgaugccgccuggug

SEQ ID NO: 1151253 - RNA, 22 nt, Mycobacterium bovis subsp bovis AF2122/97
gagcugccaacgcccguguuga

SEQ ID NO: 1151254 - RNA, 16 nt, Mycobacterium bovis subsp bovis AF2122/97
gagcugccaacgcccg

SEQ ID NO: 1151255 - RNA, 16 nt, Mycobacterium bovis subsp bovis AF2122/97
gagcugagcggccagc

SEQ ID NO: 1151256 - RNA, 16 nt, Mycobacterium bovis subsp bovis AF2122/97
gagcucguugaccagg

SEQ ID NO: 1151257 - RNA, 18 nt, Mycobacterium bovis subsp bovis AF2122/97
gagcucggucaccacggc

SEQ ID NO: 1151258 - RNA, 20 nt, Mycobacterium bovis subsp bovis AF2122/97
gagcucggucaccacggcgg

SEQ ID NO: 1151259 - RNA, 17 nt, Mycobacterium bovis subsp bovis AF2122/97
gagcucggccccgccgc

SEQ ID NO: 1151260 - RNA, 16 nt, Mycobacterium bovis subsp bovis AF2122/97
gagcucggcgcccagc

SEQ ID NO: 1151261 - RNA, 13 nt, Mycobacterium bovis subsp bovis AF2122/97
gagcugaucacgc

SEQ ID NO: 1151262 - RNA, 17 nt, Mycobacterium bovis subsp bovis AF2122/97
gagcucggucaccacgg

SEQ ID NO: 1151263 - RNA, 15 nt, Mycobacterium bovis subsp bovis AF2122/97
gagcucgaggcccgg

SEQ ID NO: 1151264 - RNA, 21 nt, Mycobacterium bovis subsp bovis AF2122/97
gagcucguugcuggcggccag

SEQ ID NO: 1151265 - RNA, 21 nt, Mycobacterium bovis subsp bovis AF2122/97
gagcuuggucgccaugucggc

SEQ ID NO: 1151266 - RNA, 16 nt, Mycobacterium bovis subsp bovis AF2122/97
gagcuuggccagcagc

SEQ ID NO: 1151267 - RNA, 20 nt, Mycobacterium bovis subsp bovis AF2122/97
gagcuuggccagcagcagcg

SEQ ID NO: 1151268 - RNA, 23 nt, Mycobacterium bovis subsp bovis AF2122/97
gagcuugagcgugagcgccgcgg

SEQ ID NO: 1151269 - RNA, 23 nt, Mycobacterium bovis subsp bovis AF2122/97
gagcugucgcaacgcaucgaugc

SEQ ID NO: 1151270 - RNA, 13 nt, Mycobacterium bovis subsp bovis AF2122/97
gagcuggccguca

SEQ ID NO: 1151271 - RNA, 14 nt, Mycobacterium bovis subsp bovis AF2122/97
gagcugcuggcgcg

SEQ ID NO: 1151272 - RNA, 19 nt, Mycobacterium bovis subsp bovis AF2122/97
gagcuguggucacccgugu

SEQ ID NO: 1151273 - RNA, 17 nt, Mycobacterium bovis subsp bovis AF2122/97
gagcugguugacggcga

SEQ ID NO: 1151274 - RNA, 20 nt, Mycobacterium bovis subsp bovis AF2122/97
gagcugucgcaacgcaucga

SEQ ID NO: 1151275 - RNA, 15 nt, Mycobacterium bovis subsp bovis AF2122/97
gagcugggcugaugg

SEQ ID NO: 1151276 - RNA, 23 nt, Mycobacterium bovis subsp bovis AF2122/97
gagcuggugcagaauucggcgcg

SEQ ID NO: 1151277 - RNA, 20 nt, Mycobacterium bovis subsp bovis AF2122/97
gaggagggccgcgaucgacg

SEQ ID NO: 1151278 - RNA, 17 nt, Mycobacterium bovis subsp bovis AF2122/97
gaggcaggccucggcgc

SEQ ID NO: 1151279 - RNA, 23 nt, Mycobacterium bovis subsp bovis AF2122/97
gaggcaggccucggcgccgccca

SEQ ID NO: 1151280 - RNA, 20 nt, Mycobacterium bovis subsp bovis AF2122/97
gaggacgcugauccacgaua

SEQ ID NO: 1151281 - RNA, 16 nt, Mycobacterium bovis subsp bovis AF2122/97
gaggacgccggcgccg

SEQ ID NO: 1151282 - RNA, 15 nt, Mycobacterium bovis subsp bovis AF2122/97
gaggagggccgcgau

SEQ ID NO: 1151283 - RNA, 16 nt, Mycobacterium bovis subsp bovis AF2122/97
gaggagggccgcgauc

SEQ ID NO: 1151284 - RNA, 13 nt, Mycobacterium bovis subsp bovis AF2122/97
gaggacgacgauc

SEQ ID NO: 1151285 - RNA, 22 nt, Mycobacterium bovis subsp bovis AF2122/97
gagcuucucgucggugcgcgcg

SEQ ID NO: 1151286 - RNA, 22 nt, Mycobacterium bovis subsp bovis AF2122/97
gaggacccgugcacgaucgcgg

SEQ ID NO: 1151287 - RNA, 23 nt, Mycobacterium bovis subsp bovis AF2122/97
gagccgcuuucccggcuggggcc

SEQ ID NO: 1151288 - RNA, 15 nt, Mycobacterium bovis subsp bovis AF2122/97
gagccggaccggcuu

SEQ ID NO: 1151289 - RNA, 22 nt, Mycobacterium bovis subsp bovis AF2122/97
gagccggauucggcugccaccg

SEQ ID NO: 1151290 - RNA, 23 nt, Mycobacterium bovis subsp bovis AF2122/97
gagccggauucggcugccaccgc

SEQ ID NO: 1151291 - RNA, 11 nt, Mycobacterium bovis subsp bovis AF2122/97
gagccggcggc

SEQ ID NO: 1151292 - RNA, 20 nt, Mycobacterium bovis subsp bovis AF2122/97
gagccggcucagacgacgau

SEQ ID NO: 1151293 - RNA, 14 nt, Mycobacterium bovis subsp bovis AF2122/97
gagccggccaccuc

SEQ ID NO: 1151294 - RNA, 19 nt, Mycobacterium bovis subsp bovis AF2122/97
gagccgggcaaccagcagc

SEQ ID NO: 1151295 - RNA, 17 nt, Mycobacterium bovis subsp bovis AF2122/97
gagccggcuguuaggcg

SEQ ID NO: 1151296 - RNA, 16 nt, Mycobacterium bovis subsp bovis AF2122/97
gagccgggccguccgg

SEQ ID NO: 1151297 - RNA, 18 nt, Mycobacterium bovis subsp bovis AF2122/97
gagccgugccucgaggac

SEQ ID NO: 1151298 - RNA, 22 nt, Mycobacterium bovis subsp bovis AF2122/97
gagccgugccucgaggacggcg

SEQ ID NO: 1151299 - RNA, 19 nt, Mycobacterium bovis subsp bovis AF2122/97
gagccgugcggucgcgccc

SEQ ID NO: 1151300 - RNA, 17 nt, Mycobacterium bovis subsp bovis AF2122/97
gagccucggcgagccgu

SEQ ID NO: 1151301 - RNA, 14 nt, Mycobacterium bovis subsp bovis AF2122/97
gagccucuugguca

SEQ ID NO: 1151302 - RNA, 23 nt, Mycobacterium bovis subsp bovis AF2122/97
gagccugauaaagcccggcggca

SEQ ID NO: 1151303 - RNA, 19 nt, Mycobacterium bovis subsp bovis AF2122/97
gagccugcaggccgccggc

SEQ ID NO: 1151304 - RNA, 20 nt, Mycobacterium bovis subsp bovis AF2122/97
gagccugcaggccgccggcc

SEQ ID NO: 1151305 - RNA, 19 nt, Mycobacterium bovis subsp bovis AF2122/97
gagccugcucgcagcgggc

SEQ ID NO: 1151306 - RNA, 21 nt, Mycobacterium bovis subsp bovis AF2122/97
gagccugcucgcagcgggcga

SEQ ID NO: 1151307 - RNA, 16 nt, Mycobacterium bovis subsp bovis AF2122/97
gagccgcucuagcguc

SEQ ID NO: 1151308 - RNA, 20 nt, Mycobacterium bovis subsp bovis AF2122/97
gagccgccguugccgccggc

SEQ ID NO: 1151309 - RNA, 14 nt, Mycobacterium bovis subsp bovis AF2122/97
gagccgcugcgaca

SEQ ID NO: 1151310 - RNA, 17 nt, Mycobacterium bovis subsp bovis AF2122/97
gagccgcugcggcaccg

SEQ ID NO: 1151311 - RNA, 20 nt, Mycobacterium bovis subsp bovis AF2122/97
gagccgcugcggcaccgagc

SEQ ID NO: 1151312 - RNA, 18 nt, Mycobacterium bovis subsp bovis AF2122/97
gagccgcggucaccccgg

SEQ ID NO: 1151313 - RNA, 19 nt, Mycobacterium bovis subsp bovis AF2122/97
gagccgcggucaccccggc

SEQ ID NO: 1151314 - RNA, 22 nt, Mycobacterium bovis subsp bovis AF2122/97
gagccgcguucgcgcaaaugcc

SEQ ID NO: 1151315 - RNA, 22 nt, Mycobacterium bovis subsp bovis AF2122/97
gagccgcuacguuacgccgaga

SEQ ID NO: 1151316 - RNA, 14 nt, Mycobacterium bovis subsp bovis AF2122/97
gagccgcgcccaau

SEQ ID NO: 1151317 - RNA, 19 nt, Mycobacterium bovis subsp bovis AF2122/97
gagccgcgcgccgguuggc

SEQ ID NO: 1151318 - RNA, 11 nt, Mycobacterium bovis subsp bovis AF2122/97
gagccgccggc

SEQ ID NO: 1151319 - RNA, 15 nt, Mycobacterium bovis subsp bovis AF2122/97
gagccgccggccccg

SEQ ID NO: 1151320 - RNA, 17 nt, Mycobacterium bovis subsp bovis AF2122/97
gacguaaugcgcugccg

SEQ ID NO: 1151321 - RNA, 18 nt, Mycobacterium bovis subsp bovis AF2122/97
gagccgcgagcacgucgg

SEQ ID NO: 1151322 - RNA, 12 nt, Mycobacterium bovis subsp bovis AF2122/97
gagccgccguug

SEQ ID NO: 1151323 - RNA, 13 nt, Mycobacterium bovis subsp bovis AF2122/97
gagccgccggauc

SEQ ID NO: 1151324 - RNA, 15 nt, Mycobacterium bovis subsp bovis AF2122/97
gagccgccggaucgc

SEQ ID NO: 1151325 - RNA, 20 nt, Mycobacterium bovis subsp bovis AF2122/97
gacgguuugcagcgggauca

SEQ ID NO: 1151326 - RNA, 16 nt, Mycobacterium bovis subsp bovis AF2122/97
gacguaaccgcuggcc

SEQ ID NO: 1151327 - RNA, 17 nt, Mycobacterium bovis subsp bovis AF2122/97
gagcgccgagcucggcg

SEQ ID NO: 1151328 - RNA, 18 nt, Mycobacterium bovis subsp bovis AF2122/97
gagcgccgagcucggcgc

SEQ ID NO: 1151329 - RNA, 20 nt, Mycobacterium bovis subsp bovis AF2122/97
gagcgccaggccgcacagca

SEQ ID NO: 1151330 - RNA, 16 nt, Mycobacterium bovis subsp bovis AF2122/97
gagcgcaucggccaac

SEQ ID NO: 1151331 - RNA, 21 nt, Mycobacterium bovis subsp bovis AF2122/97
gagcgcaccugaaggcggcga

SEQ ID NO: 1151332 - RNA, 16 nt, Mycobacterium bovis subsp bovis AF2122/97
gagcgcaccacggcgg

SEQ ID NO: 1151333 - RNA, 13 nt, Mycobacterium bovis subsp bovis AF2122/97
gagcgcaccgcga

SEQ ID NO: 1151334 - RNA, 13 nt, Mycobacterium bovis subsp bovis AF2122/97
gagcgaacccgcg

SEQ ID NO: 1151335 - RNA, 11 nt, Mycobacterium bovis subsp bovis AF2122/97
gagcgcggcca

SEQ ID NO: 1151336 - RNA, 16 nt, Mycobacterium bovis subsp bovis AF2122/97
gagcgcggccaccaga

SEQ ID NO: 1151337 - RNA, 23 nt, Mycobacterium bovis subsp bovis AF2122/97
gagcgcggccaccagaucgcaca

SEQ ID NO: 1151338 - RNA, 13 nt, Mycobacterium bovis subsp bovis AF2122/97
gagcgcggcgaca

SEQ ID NO: 1151339 - RNA, 21 nt, Mycobacterium bovis subsp bovis AF2122/97
gagcgcgucgcgggauugcgc

SEQ ID NO: 1151340 - RNA, 14 nt, Mycobacterium bovis subsp bovis AF2122/97
gagcgcgucgguca

SEQ ID NO: 1151341 - RNA, 15 nt, Mycobacterium bovis subsp bovis AF2122/97
gagcgcggcccgccu

SEQ ID NO: 1151342 - RNA, 22 nt, Mycobacterium bovis subsp bovis AF2122/97
gagcgcgggauguaccccggcc

SEQ ID NO: 1151343 - RNA, 13 nt, Mycobacterium bovis subsp bovis AF2122/97
gagcgcggcggcg

SEQ ID NO: 1151344 - RNA, 17 nt, Mycobacterium bovis subsp bovis AF2122/97
gagcgcggcggcggagg

SEQ ID NO: 1151345 - RNA, 20 nt, Mycobacterium bovis subsp bovis AF2122/97
gagcgcucgaucacggcggg

SEQ ID NO: 1151346 - RNA, 14 nt, Mycobacterium bovis subsp bovis AF2122/97
gagcgcuaucaccg

SEQ ID NO: 1151347 - RNA, 14 nt, Mycobacterium bovis subsp bovis AF2122/97
gagcgcucgggcaa

SEQ ID NO: 1151348 - RNA, 20 nt, Mycobacterium bovis subsp bovis AF2122/97
gagcggaauggaggccgccg

SEQ ID NO: 1151349 - RNA, 21 nt, Mycobacterium bovis subsp bovis AF2122/97
gagcggaauggaggccgccga

SEQ ID NO: 1151350 - RNA, 22 nt, Mycobacterium bovis subsp bovis AF2122/97
gagcggaauggaggccgccgag

SEQ ID NO: 1151351 - RNA, 14 nt, Mycobacterium bovis subsp bovis AF2122/97
gagcggaauggcgc

SEQ ID NO: 1151352 - RNA, 18 nt, Mycobacterium bovis subsp bovis AF2122/97
gagcggaauggcgccggc

SEQ ID NO: 1151353 - RNA, 18 nt, Mycobacterium bovis subsp bovis AF2122/97
gagcggaccaccgcucgc

SEQ ID NO: 1151354 - RNA, 19 nt, Mycobacterium bovis subsp bovis AF2122/97
gagcgcuucgucgccgaac

SEQ ID NO: 1151355 - RNA, 18 nt, Mycobacterium bovis subsp bovis AF2122/97
gagcgcuucugcgucagc

SEQ ID NO: 1151356 - RNA, 13 nt, Mycobacterium bovis subsp bovis AF2122/97
gagcgcuugguca

SEQ ID NO: 1151357 - RNA, 16 nt, Mycobacterium bovis subsp bovis AF2122/97
gagcggagccgccgac

SEQ ID NO: 1151358 - RNA, 19 nt, Mycobacterium bovis subsp bovis AF2122/97
gagcggagccgccgacucg

SEQ ID NO: 1151359 - RNA, 21 nt, Mycobacterium bovis subsp bovis AF2122/97
gagcggagccgccgacucggc

SEQ ID NO: 1151360 - RNA, 14 nt, Mycobacterium bovis subsp bovis AF2122/97
gagcggagccggcg

SEQ ID NO: 1151361 - RNA, 15 nt, Mycobacterium bovis subsp bovis AF2122/97
gagcggccaggucgg

SEQ ID NO: 1151362 - RNA, 22 nt, Mycobacterium bovis subsp bovis AF2122/97
gagcggccaggucggucauccg

SEQ ID NO: 1151363 - RNA, 15 nt, Mycobacterium bovis subsp bovis AF2122/97
gagcggcaucgguca

SEQ ID NO: 1151364 - RNA, 10 nt, Mycobacterium bovis subsp bovis AF2122/97
gagcggcaug

SEQ ID NO: 1151365 - RNA, 13 nt, Mycobacterium bovis subsp bovis AF2122/97
gagcggccaccgu

SEQ ID NO: 1151366 - RNA, 22 nt, Mycobacterium bovis subsp bovis AF2122/97
gagcggauccgugucgcagauc

SEQ ID NO: 1151367 - RNA, 17 nt, Mycobacterium bovis subsp bovis AF2122/97
gagcggcacgcacgcgg

SEQ ID NO: 1151368 - RNA, 16 nt, Mycobacterium bovis subsp bovis AF2122/97
gagcggcgugucguug

SEQ ID NO: 1151369 - RNA, 12 nt, Mycobacterium bovis subsp bovis AF2122/97
gagcggcugcgg

SEQ ID NO: 1151370 - RNA, 15 nt, Mycobacterium bovis subsp bovis AF2122/97
gagcggcugcggcaa

SEQ ID NO: 1151371 - RNA, 20 nt, Mycobacterium bovis subsp bovis AF2122/97
gagcggccuccagcacccgg

SEQ ID NO: 1151372 - RNA, 15 nt, Mycobacterium bovis subsp bovis AF2122/97
aacucgcgcgucguc

SEQ ID NO: 1151373 - RNA, 20 nt, Mycobacterium bovis subsp bovis AF2122/97
aacucgcgcgucgucgcgcu

SEQ ID NO: 1151374 - RNA, 18 nt, Mycobacterium bovis subsp bovis AF2122/97
aacucggcauucaccgcg

SEQ ID NO: 1151375 - RNA, 21 nt, Mycobacterium bovis subsp bovis AF2122/97
gagcggcuugggauuugggcg

SEQ ID NO: 1151376 - RNA, 17 nt, Mycobacterium bovis subsp bovis AF2122/97
aacucgcgaagcaucgc

SEQ ID NO: 1151377 - RNA, 16 nt, Mycobacterium bovis subsp bovis AF2122/97
aacucggcgucguggu

SEQ ID NO: 1151378 - RNA, 12 nt, Mycobacterium bovis subsp bovis AF2122/97
aacucgggcagc

SEQ ID NO: 1151379 - RNA, 15 nt, Mycobacterium bovis subsp bovis AF2122/97
aacucguccagcagu

SEQ ID NO: 1151380 - RNA, 18 nt, Mycobacterium bovis subsp bovis AF2122/97
aacucggccacggcgucg

SEQ ID NO: 1151381 - RNA, 19 nt, Mycobacterium bovis subsp bovis AF2122/97
aacucuacgguggugcggu

SEQ ID NO: 1151382 - RNA, 13 nt, Mycobacterium bovis subsp bovis AF2122/97
gagcgggugcauu

SEQ ID NO: 1151383 - RNA, 15 nt, Mycobacterium bovis subsp bovis AF2122/97
gagcguaggccagcg

SEQ ID NO: 1151384 - RNA, 23 nt, Mycobacterium bovis subsp bovis AF2122/97
gagcgguaaaucgcgaagcggac

SEQ ID NO: 1151385 - RNA, 24 nt, Mycobacterium bovis subsp bovis AF2122/97
gagcggugauugcaagcgggcacc

SEQ ID NO: 1151386 - RNA, 14 nt, Mycobacterium bovis subsp bovis AF2122/97
gagcggugccggcg

SEQ ID NO: 1151387 - RNA, 15 nt, Mycobacterium bovis subsp bovis AF2122/97
gagcggugccggcgu

SEQ ID NO: 1151388 - RNA, 23 nt, Mycobacterium bovis subsp bovis AF2122/97
gagcggucagcgucgaucgugcg

SEQ ID NO: 1151389 - RNA, 22 nt, Mycobacterium bovis subsp bovis AF2122/97
aacugacccccugacggcaucu

SEQ ID NO: 1151390 - RNA, 17 nt, Mycobacterium bovis subsp bovis AF2122/97
aacugacccgcauaccg

SEQ ID NO: 1151391 - RNA, 15 nt, Mycobacterium bovis subsp bovis AF2122/97
gagcgggccaacucg

SEQ ID NO: 1151392 - RNA, 13 nt, Mycobacterium bovis subsp bovis AF2122/97
gagcgggaucggg

SEQ ID NO: 1151393 - RNA, 13 nt, Mycobacterium bovis subsp bovis AF2122/97
aacugccgcggca

SEQ ID NO: 1151394 - RNA, 14 nt, Mycobacterium bovis subsp bovis AF2122/97
aacugcccgcggcg

SEQ ID NO: 1151395 - RNA, 15 nt, Mycobacterium bovis subsp bovis AF2122/97
aacugcccgcggcgg

SEQ ID NO: 1151396 - RNA, 16 nt, Mycobacterium bovis subsp bovis AF2122/97
aacugcccgcggcgga

SEQ ID NO: 1151397 - RNA, 13 nt, Mycobacterium bovis subsp bovis AF2122/97
gaucaccgcugug

SEQ ID NO: 1151398 - RNA, 23 nt, Mycobacterium bovis subsp bovis AF2122/97
gaucaccaugaucagcgccgugg

SEQ ID NO: 1151399 - RNA, 20 nt, Mycobacterium bovis subsp bovis AF2122/97
gaucaccggaguucucgcug

SEQ ID NO: 1151400 - RNA, 18 nt, Mycobacterium bovis subsp bovis AF2122/97
gaucaccaggguuggcac

SEQ ID NO: 1151401 - RNA, 20 nt, Mycobacterium bovis subsp bovis AF2122/97
gaucaccaggguuggcaccg

SEQ ID NO: 1151402 - RNA, 23 nt, Mycobacterium bovis subsp bovis AF2122/97
gaucaccacggcguugccgccgg

SEQ ID NO: 1151403 - RNA, 22 nt, Mycobacterium bovis subsp bovis AF2122/97
gaucaccgugguggcguaucgg

SEQ ID NO: 1151404 - RNA, 12 nt, Mycobacterium bovis subsp bovis AF2122/97
gaucaccgucga

SEQ ID NO: 1151405 - RNA, 16 nt, Mycobacterium bovis subsp bovis AF2122/97
gaucaccucggcgacg

SEQ ID NO: 1151406 - RNA, 20 nt, Mycobacterium bovis subsp bovis AF2122/97
gaucagcaccgugacagcgg

SEQ ID NO: 1151407 - RNA, 21 nt, Mycobacterium bovis subsp bovis AF2122/97
gaucagcaccgugacagcggc

SEQ ID NO: 1151408 - RNA, 23 nt, Mycobacterium bovis subsp bovis AF2122/97
gaucaccgucguacucggcggcc

SEQ ID NO: 1151409 - RNA, 22 nt, Mycobacterium bovis subsp bovis AF2122/97
gaucaccucggugccggccgca

SEQ ID NO: 1151410 - RNA, 22 nt, Mycobacterium bovis subsp bovis AF2122/97
gaucaccuucggccgaccgggc

SEQ ID NO: 1151411 - RNA, 19 nt, Mycobacterium bovis subsp bovis AF2122/97
gaucaccuucgucgcggcc

SEQ ID NO: 1151412 - RNA, 21 nt, Mycobacterium bovis subsp bovis AF2122/97
gaucaccuugccuagccgcag

SEQ ID NO: 1151413 - RNA, 17 nt, Mycobacterium bovis subsp bovis AF2122/97
gaucacacccacgucga

SEQ ID NO: 1151414 - RNA, 20 nt, Mycobacterium bovis subsp bovis AF2122/97
gaucacacccacgucgagca

SEQ ID NO: 1151415 - RNA, 20 nt, Mycobacterium bovis subsp bovis AF2122/97
gaucacacgguccgccacgg

SEQ ID NO: 1151416 - RNA, 22 nt, Mycobacterium bovis subsp bovis AF2122/97
gaucacacguccgcgcaccgca

SEQ ID NO: 1151417 - RNA, 23 nt, Mycobacterium bovis subsp bovis AF2122/97
gaucacauucagcacgucuugcu

SEQ ID NO: 1151418 - RNA, 14 nt, Mycobacterium bovis subsp bovis AF2122/97
gaucaccaacccgu

SEQ ID NO: 1151419 - RNA, 15 nt, Mycobacterium bovis subsp bovis AF2122/97
gaucacaccgagcgc

SEQ ID NO: 1151420 - RNA, 15 nt, Mycobacterium bovis subsp bovis AF2122/97
gauauuugucggcgc

SEQ ID NO: 1151421 - RNA, 22 nt, Mycobacterium bovis subsp bovis AF2122/97
gauauugggauacucgucgucg

SEQ ID NO: 1151422 - RNA, 16 nt, Mycobacterium bovis subsp bovis AF2122/97
gaucaaaccggcggcg

SEQ ID NO: 1151423 - RNA, 19 nt, Mycobacterium bovis subsp bovis AF2122/97
gaucaaaccggcggcgacg

SEQ ID NO: 1151424 - RNA, 16 nt, Mycobacterium bovis subsp bovis AF2122/97
gaucaaacuaccgaac

SEQ ID NO: 1151425 - RNA, 21 nt, Mycobacterium bovis subsp bovis AF2122/97
gauauggguugccagcgacgc

SEQ ID NO: 1151426 - RNA, 19 nt, Mycobacterium bovis subsp bovis AF2122/97
gauaucagagggccgcggu

SEQ ID NO: 1151427 - RNA, 23 nt, Mycobacterium bovis subsp bovis AF2122/97
gauaucagcacguaacgccgcuc

SEQ ID NO: 1151428 - RNA, 18 nt, Mycobacterium bovis subsp bovis AF2122/97
gauagcggucggucacca

SEQ ID NO: 1151429 - RNA, 15 nt, Mycobacterium bovis subsp bovis AF2122/97
gauagcgcggcacca

SEQ ID NO: 1151430 - RNA, 22 nt, Mycobacterium bovis subsp bovis AF2122/97
gauagcgucgucccagcgcggu

SEQ ID NO: 1151431 - RNA, 19 nt, Mycobacterium bovis subsp bovis AF2122/97
gauaguucuggcccgcagc

SEQ ID NO: 1151432 - RNA, 18 nt, Mycobacterium bovis subsp bovis AF2122/97
gauagcggcgcagcguga

SEQ ID NO: 1151433 - RNA, 16 nt, Mycobacterium bovis subsp bovis AF2122/97
gauagccugcggcggc

SEQ ID NO: 1151434 - RNA, 13 nt, Mycobacterium bovis subsp bovis AF2122/97
gauagccugcggc

SEQ ID NO: 1151435 - RNA, 14 nt, Mycobacterium bovis subsp bovis AF2122/97
gagucgcacugcgc

SEQ ID NO: 1151436 - RNA, 22 nt, Mycobacterium bovis subsp bovis AF2122/97
gagucgaacccgcgagcaucga

SEQ ID NO: 1151437 - RNA, 15 nt, Mycobacterium bovis subsp bovis AF2122/97
gagucgcacgugggc

SEQ ID NO: 1151438 - RNA, 16 nt, Mycobacterium bovis subsp bovis AF2122/97
gagucgcacugcgccg

SEQ ID NO: 1151439 - RNA, 18 nt, Mycobacterium bovis subsp bovis AF2122/97
gagucgcagcacggguga

SEQ ID NO: 1151440 - RNA, 14 nt, Mycobacterium bovis subsp bovis AF2122/97
gagucgccagaccg

SEQ ID NO: 1151441 - RNA, 21 nt, Mycobacterium bovis subsp bovis AF2122/97
gagucgccgaggacgccggcg

SEQ ID NO: 1151442 - RNA, 12 nt, Mycobacterium bovis subsp bovis AF2122/97
gagucgaucagc

SEQ ID NO: 1151443 - RNA, 16 nt, Mycobacterium bovis subsp bovis AF2122/97
gagucgaaugucccgg

SEQ ID NO: 1151444 - RNA, 16 nt, Mycobacterium bovis subsp bovis AF2122/97
gagucgacccugccca

SEQ ID NO: 1151445 - RNA, 19 nt, Mycobacterium bovis subsp bovis AF2122/97
gagucgacccugcccagca

SEQ ID NO: 1151446 - RNA, 20 nt, Mycobacterium bovis subsp bovis AF2122/97
gagucgacccugcccagcac

SEQ ID NO: 1151447 - RNA, 21 nt, Mycobacterium bovis subsp bovis AF2122/97
gagucgacccugcccagcacc

SEQ ID NO: 1151448 - RNA, 16 nt, Mycobacterium bovis subsp bovis AF2122/97
gaguccgucgacaccg

SEQ ID NO: 1151449 - RNA, 19 nt, Mycobacterium bovis subsp bovis AF2122/97
gaguccgucgacaccgcgg

SEQ ID NO: 1151450 - RNA, 23 nt, Mycobacterium bovis subsp bovis AF2122/97
gaguccgucggggacauccgcuu

SEQ ID NO: 1151451 - RNA, 18 nt, Mycobacterium bovis subsp bovis AF2122/97
gaguccgacaguccgcgc

SEQ ID NO: 1151452 - RNA, 20 nt, Mycobacterium bovis subsp bovis AF2122/97
gaguccgacaguccgcgccg

SEQ ID NO: 1151453 - RNA, 18 nt, Mycobacterium bovis subsp bovis AF2122/97
gaguacggcgaugcgguc

SEQ ID NO: 1151454 - RNA, 18 nt, Mycobacterium bovis subsp bovis AF2122/97
gaguacaacagcgucugg

SEQ ID NO: 1151455 - RNA, 17 nt, Mycobacterium bovis subsp bovis AF2122/97
gaguacggccugccgcu

SEQ ID NO: 1151456 - RNA, 16 nt, Mycobacterium bovis subsp bovis AF2122/97
gaguacaggcgcagcg

SEQ ID NO: 1151457 - RNA, 18 nt, Mycobacterium bovis subsp bovis AF2122/97
gaguaccaauccaggcca

SEQ ID NO: 1151458 - RNA, 22 nt, Mycobacterium bovis subsp bovis AF2122/97
gaguaccagcccaccggcgccg

SEQ ID NO: 1151459 - RNA, 20 nt, Mycobacterium bovis subsp bovis AF2122/97
gaguaccggccagccgcggc

SEQ ID NO: 1151460 - RNA, 20 nt, Mycobacterium bovis subsp bovis AF2122/97
gauaaccuggcggucccgca

SEQ ID NO: 1151461 - RNA, 23 nt, Mycobacterium bovis subsp bovis AF2122/97
gauaacgacgucggcgcguccgc

SEQ ID NO: 1151462 - RNA, 17 nt, Mycobacterium bovis subsp bovis AF2122/97
gauaaccucagcgcggu

SEQ ID NO: 1151463 - RNA, 14 nt, Mycobacterium bovis subsp bovis AF2122/97
gauaaccgcgacca

SEQ ID NO: 1151464 - RNA, 16 nt, Mycobacterium bovis subsp bovis AF2122/97
gauaacccaaccgcgc

SEQ ID NO: 1151465 - RNA, 16 nt, Mycobacterium bovis subsp bovis AF2122/97
gauaacccagcaccac

SEQ ID NO: 1151466 - RNA, 15 nt, Mycobacterium bovis subsp bovis AF2122/97
gauaacccagcggcg

SEQ ID NO: 1151467 - RNA, 23 nt, Mycobacterium bovis subsp bovis AF2122/97
gauaacaaggccgccgccgucgg

SEQ ID NO: 1151468 - RNA, 17 nt, Mycobacterium bovis subsp bovis AF2122/97
gauaacggcgaccgcca

SEQ ID NO: 1151469 - RNA, 13 nt, Mycobacterium bovis subsp bovis AF2122/97
gauaccaccgccg

SEQ ID NO: 1151470 - RNA, 22 nt, Mycobacterium bovis subsp bovis AF2122/97
gauaccaccgccgcugccggua

SEQ ID NO: 1151471 - RNA, 12 nt, Mycobacterium bovis subsp bovis AF2122/97
gauacagcucgg

SEQ ID NO: 1151472 - RNA, 19 nt, Mycobacterium bovis subsp bovis AF2122/97
gauacccagcgggucgcgg

SEQ ID NO: 1151473 - RNA, 20 nt, Mycobacterium bovis subsp bovis AF2122/97
gauacccagcgggucgcggg

SEQ ID NO: 1151474 - RNA, 13 nt, Mycobacterium bovis subsp bovis AF2122/97
gauacccagcgcc

SEQ ID NO: 1151475 - RNA, 15 nt, Mycobacterium bovis subsp bovis AF2122/97
gauacccagcgcccg

SEQ ID NO: 1151476 - RNA, 21 nt, Mycobacterium bovis subsp bovis AF2122/97
gauacccagcgcccggccacu

SEQ ID NO: 1151477 - RNA, 19 nt, Mycobacterium bovis subsp bovis AF2122/97
gauacaugguccggccgcg

SEQ ID NO: 1151478 - RNA, 24 nt, Mycobacterium bovis subsp bovis AF2122/97
gauacaugguccggccgcggaccg

SEQ ID NO: 1151479 - RNA, 15 nt, Mycobacterium bovis subsp bovis AF2122/97
gauacagccgccgcc

SEQ ID NO: 1151480 - RNA, 19 nt, Mycobacterium bovis subsp bovis AF2122/97
gauacagcacauccagccc

SEQ ID NO: 1151481 - RNA, 14 nt, Mycobacterium bovis subsp bovis AF2122/97
gauaaggaccgcgc

SEQ ID NO: 1151482 - RNA, 14 nt, Mycobacterium bovis subsp bovis AF2122/97
gauaccgaccaucg

SEQ ID NO: 1151483 - RNA, 15 nt, Mycobacterium bovis subsp bovis AF2122/97
gauaccgaccaucgg

SEQ ID NO: 1151484 - RNA, 13 nt, Mycobacterium bovis subsp bovis AF2122/97
gauacggccacca

SEQ ID NO: 1151485 - RNA, 18 nt, Mycobacterium bovis subsp bovis AF2122/97
gauaccccuccgaucacg

SEQ ID NO: 1151486 - RNA, 17 nt, Mycobacterium bovis subsp bovis AF2122/97
gauacggugcgacgauc

SEQ ID NO: 1151487 - RNA, 12 nt, Mycobacterium bovis subsp bovis AF2122/97
gauacucgucgu

SEQ ID NO: 1151488 - RNA, 14 nt, Mycobacterium bovis subsp bovis AF2122/97
gauacucggcgacu

SEQ ID NO: 1151489 - RNA, 19 nt, Mycobacterium bovis subsp bovis AF2122/97
gauacuaaacaggccgcca

SEQ ID NO: 1151490 - RNA, 20 nt, Mycobacterium bovis subsp bovis AF2122/97
gauacgugaggucccggcug

SEQ ID NO: 1151491 - RNA, 14 nt, Mycobacterium bovis subsp bovis AF2122/97
gaucaggacgcgau

SEQ ID NO: 1151492 - RNA, 21 nt, Mycobacterium bovis subsp bovis AF2122/97
gaucagcuugggcagcagcgc

SEQ ID NO: 1151493 - RNA, 23 nt, Mycobacterium bovis subsp bovis AF2122/97
gaucagcuugggcagcagcgcgc

SEQ ID NO: 1151494 - RNA, 19 nt, Mycobacterium bovis subsp bovis AF2122/97
gaucagcuugugggcgacg

SEQ ID NO: 1151495 - RNA, 23 nt, Mycobacterium bovis subsp bovis AF2122/97
gaucagcuugugggcgacggcga

SEQ ID NO: 1151496 - RNA, 22 nt, Mycobacterium bovis subsp bovis AF2122/97
gaucaggccguguacgugcucg

SEQ ID NO: 1151497 - RNA, 24 nt, Mycobacterium bovis subsp bovis AF2122/97
gaucaggcgcucgaaggccgcacu

SEQ ID NO: 1151498 - RNA, 14 nt, Mycobacterium bovis subsp bovis AF2122/97
gaucaggcugggca

SEQ ID NO: 1151499 - RNA, 23 nt, Mycobacterium bovis subsp bovis AF2122/97
gaucaucgggguggccaccagcg

SEQ ID NO: 1151500 - RNA, 16 nt, Mycobacterium bovis subsp bovis AF2122/97
gaucaucaugucggcg

SEQ ID NO: 1151501 - RNA, 19 nt, Mycobacterium bovis subsp bovis AF2122/97
gaucaucgccgcggccagg

SEQ ID NO: 1151502 - RNA, 19 nt, Mycobacterium bovis subsp bovis AF2122/97
gaucaugaacgcaagcagc

SEQ ID NO: 1151503 - RNA, 17 nt, Mycobacterium bovis subsp bovis AF2122/97
gaucaugaccaucugcu

SEQ ID NO: 1151504 - RNA, 21 nt, Mycobacterium bovis subsp bovis AF2122/97
gaucaugaccaucugcugugg

SEQ ID NO: 1151505 - RNA, 12 nt, Mycobacterium bovis subsp bovis AF2122/97
gauccagcaggc

SEQ ID NO: 1151506 - RNA, 18 nt, Mycobacterium bovis subsp bovis AF2122/97
gauccagcccaugcgcca

SEQ ID NO: 1151507 - RNA, 20 nt, Mycobacterium bovis subsp bovis AF2122/97
gauccagccaugcgguuugc

SEQ ID NO: 1151508 - RNA, 21 nt, Mycobacterium bovis subsp bovis AF2122/97
gauccagcccaacucggccag

SEQ ID NO: 1151509 - RNA, 22 nt, Mycobacterium bovis subsp bovis AF2122/97
gauccagcccaacucggccagc

SEQ ID NO: 1151510 - RNA, 17 nt, Mycobacterium bovis subsp bovis AF2122/97
gauccagaacaacggcg

SEQ ID NO: 1151511 - RNA, 18 nt, Mycobacterium bovis subsp bovis AF2122/97
gauccagaacaacggcgc

SEQ ID NO: 1151512 - RNA, 20 nt, Mycobacterium bovis subsp bovis AF2122/97
gauccagaacaacggcgcgg

SEQ ID NO: 1151513 - RNA, 17 nt, Mycobacterium bovis subsp bovis AF2122/97
gauccagaacgcaucgg

SEQ ID NO: 1151514 - RNA, 13 nt, Mycobacterium bovis subsp bovis AF2122/97
gauccagcaacgc

SEQ ID NO: 1151515 - RNA, 23 nt, Mycobacterium bovis subsp bovis AF2122/97
gaucagcgaggaauuccgcuacc

SEQ ID NO: 1151516 - RNA, 23 nt, Mycobacterium bovis subsp bovis AF2122/97
gaucagccgccaaccgcaggccg

SEQ ID NO: 1151517 - RNA, 22 nt, Mycobacterium bovis subsp bovis AF2122/97
gaucagcgccguggcgcggucg

SEQ ID NO: 1151518 - RNA, 18 nt, Mycobacterium bovis subsp bovis AF2122/97
gaucagcggcagcaccgc

SEQ ID NO: 1151519 - RNA, 11 nt, Mycobacterium bovis subsp bovis AF2122/97
gaucagcggca

SEQ ID NO: 1151520 - RNA, 11 nt, Mycobacterium bovis subsp bovis AF2122/97
gaucagcgccg

SEQ ID NO: 1151521 - RNA, 19 nt, Mycobacterium bovis subsp bovis AF2122/97
gaucagcguggcgcccgug

SEQ ID NO: 1151522 - RNA, 15 nt, Mycobacterium bovis subsp bovis AF2122/97
gaucagccgugcggg

SEQ ID NO: 1151523 - RNA, 18 nt, Mycobacterium bovis subsp bovis AF2122/97
gaucagccgugcgggccg

SEQ ID NO: 1151524 - RNA, 21 nt, Mycobacterium bovis subsp bovis AF2122/97
gaucagccguggcagucgcac

SEQ ID NO: 1151525 - RNA, 21 nt, Mycobacterium bovis subsp bovis AF2122/97
gaucagccgccgccugugcgc

SEQ ID NO: 1151526 - RNA, 22 nt, Mycobacterium bovis subsp bovis AF2122/97
gaucagcgacuugcuggcguag

SEQ ID NO: 1151527 - RNA, 22 nt, Mycobacterium bovis subsp bovis AF2122/97
gaucagccguggcagucgcacg

SEQ ID NO: 1151528 - RNA, 19 nt, Mycobacterium bovis subsp bovis AF2122/97
gaucagcgaaccaccggcg

SEQ ID NO: 1151529 - RNA, 22 nt, Mycobacterium bovis subsp bovis AF2122/97
gaucagcgaaccaccggcgccg

SEQ ID NO: 1151530 - RNA, 23 nt, Mycobacterium bovis subsp bovis AF2122/97
gaucagcccggccuugccgccgg

SEQ ID NO: 1151531 - RNA, 23 nt, Mycobacterium bovis subsp bovis AF2122/97
gaucagccagaccaacaugaacg

SEQ ID NO: 1151532 - RNA, 14 nt, Mycobacterium bovis subsp bovis AF2122/97
gaucagccggcagc

SEQ ID NO: 1151533 - RNA, 16 nt, Mycobacterium bovis subsp bovis AF2122/97
gaucagcagcuguugg

SEQ ID NO: 1151534 - RNA, 15 nt, Mycobacterium bovis subsp bovis AF2122/97
gaucagcaggaucgg

SEQ ID NO: 1151535 - RNA, 14 nt, Mycobacterium bovis subsp bovis AF2122/97
gaucagcaugcccu

SEQ ID NO: 1151536 - RNA, 22 nt, Mycobacterium bovis subsp bovis AF2122/97
gaucagcaugccuucggccaac

SEQ ID NO: 1151537 - RNA, 18 nt, Mycobacterium bovis subsp bovis AF2122/97
gaucagcaugcggccaug

SEQ ID NO: 1151538 - RNA, 13 nt, Mycobacterium bovis subsp bovis AF2122/97
gaucagcaugguc

SEQ ID NO: 1151539 - RNA, 19 nt, Mycobacterium bovis subsp bovis AF2122/97
gaucagcaugguccacagc

SEQ ID NO: 1151540 - RNA, 21 nt, Mycobacterium bovis subsp bovis AF2122/97
gaucagcacgucgcggccgug

SEQ ID NO: 1151541 - RNA, 13 nt, Mycobacterium bovis subsp bovis AF2122/97
gaucagccagacc

SEQ ID NO: 1151542 - RNA, 13 nt, Mycobacterium bovis subsp bovis AF2122/97
gaucgacagcggg

SEQ ID NO: 1151543 - RNA, 19 nt, Mycobacterium bovis subsp bovis AF2122/97
gaucgacagccccgcggcc

SEQ ID NO: 1151544 - RNA, 21 nt, Mycobacterium bovis subsp bovis AF2122/97
gaucgacagccccgcggccag

SEQ ID NO: 1151545 - RNA, 23 nt, Mycobacterium bovis subsp bovis AF2122/97
gaucgacagccccgcggccagca

SEQ ID NO: 1151546 - RNA, 19 nt, Mycobacterium bovis subsp bovis AF2122/97
gaucgaauugcguucgccg

SEQ ID NO: 1151547 - RNA, 22 nt, Mycobacterium bovis subsp bovis AF2122/97
gaucgaauugcguucgccgccc

SEQ ID NO: 1151548 - RNA, 21 nt, Mycobacterium bovis subsp bovis AF2122/97
gaucgacauaguuggcgcccg

SEQ ID NO: 1151549 - RNA, 22 nt, Mycobacterium bovis subsp bovis AF2122/97
gaucgacauaguuggcgcccga

SEQ ID NO: 1151550 - RNA, 15 nt, Mycobacterium bovis subsp bovis AF2122/97
gaucgacaucguugg

SEQ ID NO: 1151551 - RNA, 20 nt, Mycobacterium bovis subsp bovis AF2122/97
gaucgaauacccgcggggaa

SEQ ID NO: 1151552 - RNA, 15 nt, Mycobacterium bovis subsp bovis AF2122/97
gaucgaacugggggc

SEQ ID NO: 1151553 - RNA, 23 nt, Mycobacterium bovis subsp bovis AF2122/97
gaucgacaccgacgcggucggcg

SEQ ID NO: 1151554 - RNA, 15 nt, Mycobacterium bovis subsp bovis AF2122/97
gaucgacaccgagcc

SEQ ID NO: 1151555 - RNA, 16 nt, Mycobacterium bovis subsp bovis AF2122/97
gaucgacaccgagcca

SEQ ID NO: 1151556 - RNA, 16 nt, Mycobacterium bovis subsp bovis AF2122/97
gaucgacaccgugacc

SEQ ID NO: 1151557 - RNA, 17 nt, Mycobacterium bovis subsp bovis AF2122/97
gaucgaagaccagcaac

SEQ ID NO: 1151558 - RNA, 15 nt, Mycobacterium bovis subsp bovis AF2122/97
gaucgaaccgcugcu

SEQ ID NO: 1151559 - RNA, 17 nt, Mycobacterium bovis subsp bovis AF2122/97
gaucgaacgcagccagc

SEQ ID NO: 1151560 - RNA, 17 nt, Mycobacterium bovis subsp bovis AF2122/97
gaucgaguuccgcaucg

SEQ ID NO: 1151561 - RNA, 15 nt, Mycobacterium bovis subsp bovis AF2122/97
gaucgaucguagcuc

SEQ ID NO: 1151562 - RNA, 17 nt, Mycobacterium bovis subsp bovis AF2122/97
gaucgcccgguucagcg

SEQ ID NO: 1151563 - RNA, 21 nt, Mycobacterium bovis subsp bovis AF2122/97
gaucgcccgguucagcgcugg

SEQ ID NO: 1151564 - RNA, 16 nt, Mycobacterium bovis subsp bovis AF2122/97
gaucgcccgcugagca

SEQ ID NO: 1151565 - RNA, 16 nt, Mycobacterium bovis subsp bovis AF2122/97
gaucgaucugcgggcg

SEQ ID NO: 1151566 - RNA, 22 nt, Mycobacterium bovis subsp bovis AF2122/97
gaucgacgacuuggauggccga

SEQ ID NO: 1151567 - RNA, 16 nt, Mycobacterium bovis subsp bovis AF2122/97
gaucgaccgcuggauc

SEQ ID NO: 1151568 - RNA, 15 nt, Mycobacterium bovis subsp bovis AF2122/97
gaucgagcggguguc

SEQ ID NO: 1151569 - RNA, 13 nt, Mycobacterium bovis subsp bovis AF2122/97
gaucgaggcggcg

SEQ ID NO: 1151570 - RNA, 17 nt, Mycobacterium bovis subsp bovis AF2122/97
gaucgaggcggcggucg

SEQ ID NO: 1151571 - RNA, 17 nt, Mycobacterium bovis subsp bovis AF2122/97
gaucgaggggacgggua

SEQ ID NO: 1151572 - RNA, 13 nt, Mycobacterium bovis subsp bovis AF2122/97
gauccgcccgccu

SEQ ID NO: 1151573 - RNA, 23 nt, Mycobacterium bovis subsp bovis AF2122/97
gauccgcacccggccgcgcaccc

SEQ ID NO: 1151574 - RNA, 15 nt, Mycobacterium bovis subsp bovis AF2122/97
gauccgccgacagcc

SEQ ID NO: 1151575 - RNA, 17 nt, Mycobacterium bovis subsp bovis AF2122/97
gauccgccacgaaucgc

SEQ ID NO: 1151576 - RNA, 17 nt, Mycobacterium bovis subsp bovis AF2122/97
gauccgccagaccgcgg

SEQ ID NO: 1151577 - RNA, 14 nt, Mycobacterium bovis subsp bovis AF2122/97
gauccagccgucgg

SEQ ID NO: 1151578 - RNA, 23 nt, Mycobacterium bovis subsp bovis AF2122/97
gauccaggcccagccgagcggcg

SEQ ID NO: 1151579 - RNA, 14 nt, Mycobacterium bovis subsp bovis AF2122/97
gauccaggccucgc

SEQ ID NO: 1151580 - RNA, 19 nt, Mycobacterium bovis subsp bovis AF2122/97
gauccagggagcggcugca

SEQ ID NO: 1151581 - RNA, 16 nt, Mycobacterium bovis subsp bovis AF2122/97
gaucccugugccagca

SEQ ID NO: 1151582 - RNA, 23 nt, Mycobacterium bovis subsp bovis AF2122/97
gauccgcaccccauacucggcgg

SEQ ID NO: 1151583 - RNA, 20 nt, Mycobacterium bovis subsp bovis AF2122/97
gauccgcaacaacgccgcga

SEQ ID NO: 1151584 - RNA, 22 nt, Mycobacterium bovis subsp bovis AF2122/97
gauccgcaacaacgccgcgacg

SEQ ID NO: 1151585 - RNA, 21 nt, Mycobacterium bovis subsp bovis AF2122/97
gauccgcaccacgcccgacga

SEQ ID NO: 1151586 - RNA, 20 nt, Mycobacterium bovis subsp bovis AF2122/97
gauccgacaguggcucaccc

SEQ ID NO: 1151587 - RNA, 16 nt, Mycobacterium bovis subsp bovis AF2122/97
gauccgaccccgcgcc

SEQ ID NO: 1151588 - RNA, 15 nt, Mycobacterium bovis subsp bovis AF2122/97
gauccgacgaccgca

SEQ ID NO: 1151589 - RNA, 22 nt, Mycobacterium bovis subsp bovis AF2122/97
gauccgauacagugcgcggauc

SEQ ID NO: 1151590 - RNA, 14 nt, Mycobacterium bovis subsp bovis AF2122/97
gauccgggcgccga

SEQ ID NO: 1151591 - RNA, 13 nt, Mycobacterium bovis subsp bovis AF2122/97
gauccggcugcgg

SEQ ID NO: 1151592 - RNA, 19 nt, Mycobacterium bovis subsp bovis AF2122/97
gauccggguggcgucaccg

SEQ ID NO: 1151593 - RNA, 23 nt, Mycobacterium bovis subsp bovis AF2122/97
gauccggguggcgucaccgccgg

SEQ ID NO: 1151594 - RNA, 17 nt, Mycobacterium bovis subsp bovis AF2122/97
gauccggcggcagguag

SEQ ID NO: 1151595 - RNA, 16 nt, Mycobacterium bovis subsp bovis AF2122/97
gauccggucggccagg

SEQ ID NO: 1151596 - RNA, 17 nt, Mycobacterium bovis subsp bovis AF2122/97
gauccgugucgcagauc

SEQ ID NO: 1151597 - RNA, 17 nt, Mycobacterium bovis subsp bovis AF2122/97
gauccucgcccgcacca

SEQ ID NO: 1151598 - RNA, 20 nt, Mycobacterium bovis subsp bovis AF2122/97
gauccucgacuucggcggga

SEQ ID NO: 1151599 - RNA, 22 nt, Mycobacterium bovis subsp bovis AF2122/97
gauccucgucgagguccucguc

SEQ ID NO: 1151600 - RNA, 17 nt, Mycobacterium bovis subsp bovis AF2122/97
gauccuuaucgcucucg

SEQ ID NO: 1151601 - RNA, 14 nt, Mycobacterium bovis subsp bovis AF2122/97
gauccuucgcguug

SEQ ID NO: 1151602 - RNA, 19 nt, Mycobacterium bovis subsp bovis AF2122/97
gauccugcccaccaucccg

SEQ ID NO: 1151603 - RNA, 14 nt, Mycobacterium bovis subsp bovis AF2122/97
gaugucacccgccc

SEQ ID NO: 1151604 - RNA, 20 nt, Mycobacterium bovis subsp bovis AF2122/97
gaugucagugaucaccaacc

SEQ ID NO: 1151605 - RNA, 12 nt, Mycobacterium bovis subsp bovis AF2122/97
gaugucgccgau

SEQ ID NO: 1151606 - RNA, 18 nt, Mycobacterium bovis subsp bovis AF2122/97
gaugucgagcguggcgac

SEQ ID NO: 1151607 - RNA, 12 nt, Mycobacterium bovis subsp bovis AF2122/97
gaugucgaggua

SEQ ID NO: 1151608 - RNA, 18 nt, Mycobacterium bovis subsp bovis AF2122/97
gaugucgaucagccgcau

SEQ ID NO: 1151609 - RNA, 13 nt, Mycobacterium bovis subsp bovis AF2122/97
gauguaguuggcg

SEQ ID NO: 1151610 - RNA, 21 nt, Mycobacterium bovis subsp bovis AF2122/97
gauguaguuggcgaccugcgc

SEQ ID NO: 1151611 - RNA, 13 nt, Mycobacterium bovis subsp bovis AF2122/97
gaugucggccagg

SEQ ID NO: 1151612 - RNA, 18 nt, Mycobacterium bovis subsp bovis AF2122/97
gaugucggggccgucguc

SEQ ID NO: 1151613 - RNA, 22 nt, Mycobacterium bovis subsp bovis AF2122/97
gaugucggcgaaccacggcagc

SEQ ID NO: 1151614 - RNA, 15 nt, Mycobacterium bovis subsp bovis AF2122/97
gaugucgccgguguc

SEQ ID NO: 1151615 - RNA, 21 nt, Mycobacterium bovis subsp bovis AF2122/97
gaugucgcgcauugccgacgc

SEQ ID NO: 1151616 - RNA, 15 nt, Mycobacterium bovis subsp bovis AF2122/97
gauguagcggcguuc

SEQ ID NO: 1151617 - RNA, 21 nt, Mycobacterium bovis subsp bovis AF2122/97
gauguagcggcguuccgggcc

SEQ ID NO: 1151618 - RNA, 21 nt, Mycobacterium bovis subsp bovis AF2122/97
gauggugacuucgguggcggg

SEQ ID NO: 1151619 - RNA, 14 nt, Mycobacterium bovis subsp bovis AF2122/97
gauguacccggcga

SEQ ID NO: 1151620 - RNA, 20 nt, Mycobacterium bovis subsp bovis AF2122/97
gauggucccgagggcggcag

SEQ ID NO: 1151621 - RNA, 16 nt, Mycobacterium bovis subsp bovis AF2122/97
gaugguccgccagauc

SEQ ID NO: 1151622 - RNA, 16 nt, Mycobacterium bovis subsp bovis AF2122/97
gauggucccgcucugg

SEQ ID NO: 1151623 - RNA, 15 nt, Mycobacterium bovis subsp bovis AF2122/97
gauggucggccacgc

SEQ ID NO: 1151624 - RNA, 14 nt, Mycobacterium bovis subsp bovis AF2122/97
gauggucgggcggc

SEQ ID NO: 1151625 - RNA, 17 nt, Mycobacterium bovis subsp bovis AF2122/97
gauggucuccucgguca

SEQ ID NO: 1151626 - RNA, 22 nt, Mycobacterium bovis subsp bovis AF2122/97
gauggucuccggacgcacgauc

SEQ ID NO: 1151627 - RNA, 19 nt, Mycobacterium bovis subsp bovis AF2122/97
gauggccgggucgaugcgc

SEQ ID NO: 1151628 - RNA, 15 nt, Mycobacterium bovis subsp bovis AF2122/97
gauggccgucagcca

SEQ ID NO: 1151629 - RNA, 14 nt, Mycobacterium bovis subsp bovis AF2122/97
gauggccgucgauc

SEQ ID NO: 1151630 - RNA, 19 nt, Mycobacterium bovis subsp bovis AF2122/97
gauggccucgaacgccgcc

SEQ ID NO: 1151631 - RNA, 16 nt, Mycobacterium bovis subsp bovis AF2122/97
gauggcaucucgauac

SEQ ID NO: 1151632 - RNA, 14 nt, Mycobacterium bovis subsp bovis AF2122/97
gauggcgcugcacc

SEQ ID NO: 1151633 - RNA, 15 nt, Mycobacterium bovis subsp bovis AF2122/97
gauggcgcgcugggc

SEQ ID NO: 1151634 - RNA, 12 nt, Mycobacterium bovis subsp bovis AF2122/97
gauggcggccac

SEQ ID NO: 1151635 - RNA, 18 nt, Mycobacterium bovis subsp bovis AF2122/97
gauggcggccaccagcgc

SEQ ID NO: 1151636 - RNA, 14 nt, Mycobacterium bovis subsp bovis AF2122/97
gauggcggcgcacc

SEQ ID NO: 1151637 - RNA, 12 nt, Mycobacterium bovis subsp bovis AF2122/97
gauggcggcgcg

SEQ ID NO: 1151638 - RNA, 18 nt, Mycobacterium bovis subsp bovis AF2122/97
gauggcguuugccggccg

SEQ ID NO: 1151639 - RNA, 22 nt, Mycobacterium bovis subsp bovis AF2122/97
gauggcucacaugcccgcaccg

SEQ ID NO: 1151640 - RNA, 18 nt, Mycobacterium bovis subsp bovis AF2122/97
gauggcucacccaggcgc

SEQ ID NO: 1151641 - RNA, 23 nt, Mycobacterium bovis subsp bovis AF2122/97
gauggcucacccaggcgccgaug

SEQ ID NO: 1151642 - RNA, 13 nt, Mycobacterium bovis subsp bovis AF2122/97
gauggcucgccga

SEQ ID NO: 1151643 - RNA, 14 nt, Mycobacterium bovis subsp bovis AF2122/97
gauggcuggccagc

SEQ ID NO: 1151644 - RNA, 20 nt, Mycobacterium bovis subsp bovis AF2122/97
gaugggauaccccuccgauc

SEQ ID NO: 1151645 - RNA, 15 nt, Mycobacterium bovis subsp bovis AF2122/97
gaugggcaugguggu

SEQ ID NO: 1151646 - RNA, 16 nt, Mycobacterium bovis subsp bovis AF2122/97
gaugggcccagcggcc

SEQ ID NO: 1151647 - RNA, 18 nt, Mycobacterium bovis subsp bovis AF2122/97
gaugggcccagcggccgc

SEQ ID NO: 1151648 - RNA, 13 nt, Mycobacterium bovis subsp bovis AF2122/97
gaugggcagccgc

SEQ ID NO: 1151649 - RNA, 15 nt, Mycobacterium bovis subsp bovis AF2122/97
gaugggcagccgccc

SEQ ID NO: 1151650 - RNA, 19 nt, Mycobacterium bovis subsp bovis AF2122/97
gaugggcagccgcccgccc

SEQ ID NO: 1151651 - RNA, 13 nt, Mycobacterium bovis subsp bovis AF2122/97
gaugggaaccgaa

SEQ ID NO: 1151652 - RNA, 22 nt, Mycobacterium bovis subsp bovis AF2122/97
gaugggaaccgaaucggcaccg

SEQ ID NO: 1151653 - RNA, 17 nt, Mycobacterium bovis subsp bovis AF2122/97
gauggcuuggaccagcg

SEQ ID NO: 1151654 - RNA, 18 nt, Mycobacterium bovis subsp bovis AF2122/97
gauggcuuggaccagcgu

SEQ ID NO: 1151655 - RNA, 16 nt, Mycobacterium bovis subsp bovis AF2122/97
gauggcauugcgccca

SEQ ID NO: 1151656 - RNA, 13 nt, Mycobacterium bovis subsp bovis AF2122/97
gauggcagcgccg

SEQ ID NO: 1151657 - RNA, 16 nt, Mycobacterium bovis subsp bovis AF2122/97
gauggcaccaccccga

SEQ ID NO: 1151658 - RNA, 13 nt, Mycobacterium bovis subsp bovis AF2122/97
gauggcaccgugg

SEQ ID NO: 1151659 - RNA, 18 nt, Mycobacterium bovis subsp bovis AF2122/97
gauggcauugcgcccacc

SEQ ID NO: 1151660 - RNA, 19 nt, Mycobacterium bovis subsp bovis AF2122/97
gauggcauugcgcccaccg

SEQ ID NO: 1151661 - RNA, 15 nt, Mycobacterium bovis subsp bovis AF2122/97
gaugcugccgccgcc

SEQ ID NO: 1151662 - RNA, 16 nt, Mycobacterium bovis subsp bovis AF2122/97
gaugcugccgccgccg

SEQ ID NO: 1151663 - RNA, 21 nt, Mycobacterium bovis subsp bovis AF2122/97
gaugcugccgccgccgccggc

SEQ ID NO: 1151664 - RNA, 16 nt, Mycobacterium bovis subsp bovis AF2122/97
gaugcugccggcacca

SEQ ID NO: 1151665 - RNA, 18 nt, Mycobacterium bovis subsp bovis AF2122/97
gauggacggugcgcaggg

SEQ ID NO: 1151666 - RNA, 15 nt, Mycobacterium bovis subsp bovis AF2122/97
gauggacggcagcca

SEQ ID NO: 1151667 - RNA, 14 nt, Mycobacterium bovis subsp bovis AF2122/97
gauggacugaucgc

SEQ ID NO: 1151668 - RNA, 14 nt, Mycobacterium bovis subsp bovis AF2122/97
gauggcaaacgcac

SEQ ID NO: 1151669 - RNA, 21 nt, Mycobacterium bovis subsp bovis AF2122/97
gauggauuggcgucagcagca

SEQ ID NO: 1151670 - RNA, 13 nt, Mycobacterium bovis subsp bovis AF2122/97
aacuugccggugc

SEQ ID NO: 1151671 - RNA, 14 nt, Mycobacterium bovis subsp bovis AF2122/97
gaugcucaccggga

SEQ ID NO: 1151672 - RNA, 23 nt, Mycobacterium bovis subsp bovis AF2122/97
gaugcucaggucaccggccgccg

SEQ ID NO: 1151673 - RNA, 23 nt, Mycobacterium bovis subsp bovis AF2122/97
gaugcugccagaucggucggcca

SEQ ID NO: 1151674 - RNA, 23 nt, Mycobacterium bovis subsp bovis AF2122/97
gaugcucgucccagaaccggcuc

SEQ ID NO: 1151675 - RNA, 14 nt, Mycobacterium bovis subsp bovis AF2122/97
gaugcugcccgagu

SEQ ID NO: 1151676 - RNA, 14 nt, Mycobacterium bovis subsp bovis AF2122/97
gaugcugaccuuca

SEQ ID NO: 1151677 - RNA, 14 nt, Mycobacterium bovis subsp bovis AF2122/97
gaugcugacggugg

SEQ ID NO: 1151678 - RNA, 20 nt, Mycobacterium bovis subsp bovis AF2122/97
gaugcucccuauugcugcgg

SEQ ID NO: 1151679 - RNA, 14 nt, Mycobacterium bovis subsp bovis AF2122/97
gaugcgggcgacga

SEQ ID NO: 1151680 - RNA, 13 nt, Mycobacterium bovis subsp bovis AF2122/97
gaugcguucggcc

SEQ ID NO: 1151681 - RNA, 19 nt, Mycobacterium bovis subsp bovis AF2122/97
aacuucuucagcagcggcg

SEQ ID NO: 1151682 - RNA, 14 nt, Mycobacterium bovis subsp bovis AF2122/97
aacuugaucaccgc

SEQ ID NO: 1151683 - RNA, 21 nt, Mycobacterium bovis subsp bovis AF2122/97
aacuugcggaccuggcggcgg

SEQ ID NO: 1151684 - RNA, 18 nt, Mycobacterium bovis subsp bovis AF2122/97
aacuugccgcauaucacc

SEQ ID NO: 1151685 - RNA, 16 nt, Mycobacterium bovis subsp bovis AF2122/97
gaugcgccaccggcgc

SEQ ID NO: 1151686 - RNA, 13 nt, Mycobacterium bovis subsp bovis AF2122/97
gaugcgcccggcg

SEQ ID NO: 1151687 - RNA, 15 nt, Mycobacterium bovis subsp bovis AF2122/97
gaugcgcccggcgug

SEQ ID NO: 1151688 - RNA, 16 nt, Mycobacterium bovis subsp bovis AF2122/97
gaugcgccggaccagc

SEQ ID NO: 1151689 - RNA, 13 nt, Mycobacterium bovis subsp bovis AF2122/97
gaugcgcgccggc

SEQ ID NO: 1151690 - RNA, 17 nt, Mycobacterium bovis subsp bovis AF2122/97
gaugcgcgcggcgcgau

SEQ ID NO: 1151691 - RNA, 21 nt, Mycobacterium bovis subsp bovis AF2122/97
gaugcgcgcggcgcgaucguc

SEQ ID NO: 1151692 - RNA, 21 nt, Mycobacterium bovis subsp bovis AF2122/97
gaugcggaaaucggacgacuc

SEQ ID NO: 1151693 - RNA, 18 nt, Mycobacterium bovis subsp bovis AF2122/97
gaugcggaugucgucgac

SEQ ID NO: 1151694 - RNA, 17 nt, Mycobacterium bovis subsp bovis AF2122/97
gaugcggccgcggcagc

SEQ ID NO: 1151695 - RNA, 14 nt, Mycobacterium bovis subsp bovis AF2122/97
gaugcggccggcgc

SEQ ID NO: 1151696 - RNA, 20 nt, Mycobacterium bovis subsp bovis AF2122/97
gaugcggcccgggcucggcg

SEQ ID NO: 1151697 - RNA, 12 nt, Mycobacterium bovis subsp bovis AF2122/97
gcaacagcacca

SEQ ID NO: 1151698 - RNA, 20 nt, Mycobacterium bovis subsp bovis AF2122/97
gcaacaccggugucggccag

SEQ ID NO: 1151699 - RNA, 15 nt, Mycobacterium bovis subsp bovis AF2122/97
gcaacaccgucggca

SEQ ID NO: 1151700 - RNA, 21 nt, Mycobacterium bovis subsp bovis AF2122/97
gcaacaccgucggcagcagcg

SEQ ID NO: 1151701 - RNA, 19 nt, Mycobacterium bovis subsp bovis AF2122/97
gcaacaccucaccgcggau

SEQ ID NO: 1151702 - RNA, 19 nt, Mycobacterium bovis subsp bovis AF2122/97
gcaacacgccggcccggug

SEQ ID NO: 1151703 - RNA, 17 nt, Mycobacterium bovis subsp bovis AF2122/97
gcaaacuucgcgcacgc

SEQ ID NO: 1151704 - RNA, 15 nt, Mycobacterium bovis subsp bovis AF2122/97
gcaaagaacagccgg

SEQ ID NO: 1151705 - RNA, 12 nt, Mycobacterium bovis subsp bovis AF2122/97
gcaaaucaagca

SEQ ID NO: 1151706 - RNA, 20 nt, Mycobacterium bovis subsp bovis AF2122/97
gauuuccaucgcgaccucgg

SEQ ID NO: 1151707 - RNA, 20 nt, Mycobacterium bovis subsp bovis AF2122/97
gauuucgagcgcugcucccg

SEQ ID NO: 1151708 - RNA, 17 nt, Mycobacterium bovis subsp bovis AF2122/97
gauuucgaugacgaaca

SEQ ID NO: 1151709 - RNA, 20 nt, Mycobacterium bovis subsp bovis AF2122/97
gauuuugcgucugcucgcca

SEQ ID NO: 1151710 - RNA, 17 nt, Mycobacterium bovis subsp bovis AF2122/97
gcaaacgcacccaucgu

SEQ ID NO: 1151711 - RNA, 15 nt, Mycobacterium bovis subsp bovis AF2122/97
gcaaacgcggcgucg

SEQ ID NO: 1151712 - RNA, 18 nt, Mycobacterium bovis subsp bovis AF2122/97
gcaaacguaccgucaugg

SEQ ID NO: 1151713 - RNA, 20 nt, Mycobacterium bovis subsp bovis AF2122/97
gauuuugggaucgugccggc

SEQ ID NO: 1151714 - RNA, 20 nt, Mycobacterium bovis subsp bovis AF2122/97
gauuuugugucugcucgccg

SEQ ID NO: 1151715 - RNA, 13 nt, Mycobacterium bovis subsp bovis AF2122/97
gauucauggcggc

SEQ ID NO: 1151716 - RNA, 13 nt, Mycobacterium bovis subsp bovis AF2122/97
gauucgaucaggc

SEQ ID NO: 1151717 - RNA, 18 nt, Mycobacterium bovis subsp bovis AF2122/97
gauucgaucaggccuugg

SEQ ID NO: 1151718 - RNA, 19 nt, Mycobacterium bovis subsp bovis AF2122/97
gauuccaccgccgacgccc

SEQ ID NO: 1151719 - RNA, 20 nt, Mycobacterium bovis subsp bovis AF2122/97
gauuccaauugggcgaugcg

SEQ ID NO: 1151720 - RNA, 14 nt, Mycobacterium bovis subsp bovis AF2122/97
gauuccaccgccga

SEQ ID NO: 1151721 - RNA, 14 nt, Mycobacterium bovis subsp bovis AF2122/97
gauucggccgccga

SEQ ID NO: 1151722 - RNA, 18 nt, Mycobacterium bovis subsp bovis AF2122/97
gauucggccugagcggcc

SEQ ID NO: 1151723 - RNA, 19 nt, Mycobacterium bovis subsp bovis AF2122/97
gauucggccugagcggcca

SEQ ID NO: 1151724 - RNA, 18 nt, Mycobacterium bovis subsp bovis AF2122/97
gauucggagucaccagca

SEQ ID NO: 1151725 - RNA, 12 nt, Mycobacterium bovis subsp bovis AF2122/97
gauucggccagc

SEQ ID NO: 1151726 - RNA, 16 nt, Mycobacterium bovis subsp bovis AF2122/97
gauucggcugccaccg

SEQ ID NO: 1151727 - RNA, 18 nt, Mycobacterium bovis subsp bovis AF2122/97
gauucggcgauggucccg

SEQ ID NO: 1151728 - RNA, 13 nt, Mycobacterium bovis subsp bovis AF2122/97
gauucggcgacga

SEQ ID NO: 1151729 - RNA, 18 nt, Mycobacterium bovis subsp bovis AF2122/97
gauucgcggcagccggcg

SEQ ID NO: 1151730 - RNA, 19 nt, Mycobacterium bovis subsp bovis AF2122/97
gauucgcggcagccggcgg

SEQ ID NO: 1151731 - RNA, 17 nt, Mycobacterium bovis subsp bovis AF2122/97
gauucggcacgccgggc

SEQ ID NO: 1151732 - RNA, 16 nt, Mycobacterium bovis subsp bovis AF2122/97
gauucggcagcggcgc

SEQ ID NO: 1151733 - RNA, 18 nt, Mycobacterium bovis subsp bovis AF2122/97
gauucggcagcggcgcgg

SEQ ID NO: 1151734 - RNA, 16 nt, Mycobacterium bovis subsp bovis AF2122/97
gauucgcgcagcgcga

SEQ ID NO: 1151735 - RNA, 15 nt, Mycobacterium bovis subsp bovis AF2122/97
gauucgcccgggcgu

SEQ ID NO: 1151736 - RNA, 17 nt, Mycobacterium bovis subsp bovis AF2122/97
gauucgcccgggcguug

SEQ ID NO: 1151737 - RNA, 12 nt, Mycobacterium bovis subsp bovis AF2122/97
gauucgccgccc

SEQ ID NO: 1151738 - RNA, 16 nt, Mycobacterium bovis subsp bovis AF2122/97
gauugcagcuucggcc

SEQ ID NO: 1151739 - RNA, 15 nt, Mycobacterium bovis subsp bovis AF2122/97
gauugccaccgagau

SEQ ID NO: 1151740 - RNA, 22 nt, Mycobacterium bovis subsp bovis AF2122/97
gauugccaccgagaucaugccg

SEQ ID NO: 1151741 - RNA, 17 nt, Mycobacterium bovis subsp bovis AF2122/97
gauugccgagaacaccg

SEQ ID NO: 1151742 - RNA, 23 nt, Mycobacterium bovis subsp bovis AF2122/97
gauugccgagaacaccggccaac

SEQ ID NO: 1151743 - RNA, 22 nt, Mycobacterium bovis subsp bovis AF2122/97
gauugcccgugcgaugcacaac

SEQ ID NO: 1151744 - RNA, 24 nt, Mycobacterium bovis subsp bovis AF2122/97
gauugcccgugcgaugcacaaccg

SEQ ID NO: 1151745 - RNA, 20 nt, Mycobacterium bovis subsp bovis AF2122/97
gauugccgcgguugugcugg

SEQ ID NO: 1151746 - RNA, 13 nt, Mycobacterium bovis subsp bovis AF2122/97
gauugcggccgcc

SEQ ID NO: 1151747 - RNA, 22 nt, Mycobacterium bovis subsp bovis AF2122/97
gauuguguuccaccagcgcccg

SEQ ID NO: 1151748 - RNA, 17 nt, Mycobacterium bovis subsp bovis AF2122/97
gauugccgugcucgucg

SEQ ID NO: 1151749 - RNA, 15 nt, Mycobacterium bovis subsp bovis AF2122/97
gauugcgcgggcauc

SEQ ID NO: 1151750 - RNA, 22 nt, Mycobacterium bovis subsp bovis AF2122/97
gauugcggaaacccggccgccg

SEQ ID NO: 1151751 - RNA, 20 nt, Mycobacterium bovis subsp bovis AF2122/97
gauugccuccggguacggcg

SEQ ID NO: 1151752 - RNA, 19 nt, Mycobacterium bovis subsp bovis AF2122/97
gauucacacucgggcggcu

SEQ ID NO: 1151753 - RNA, 17 nt, Mycobacterium bovis subsp bovis AF2122/97
gauucacgcaccggcgc

SEQ ID NO: 1151754 - RNA, 23 nt, Mycobacterium bovis subsp bovis AF2122/97
gauucagccgguggucugcgcgg

SEQ ID NO: 1151755 - RNA, 19 nt, Mycobacterium bovis subsp bovis AF2122/97
gauuaccagcggcaccgcg

SEQ ID NO: 1151756 - RNA, 19 nt, Mycobacterium bovis subsp bovis AF2122/97
gauuaccggcacgccggcg

SEQ ID NO: 1151757 - RNA, 19 nt, Mycobacterium bovis subsp bovis AF2122/97
gaugugguccaucgcgcug

SEQ ID NO: 1151758 - RNA, 22 nt, Mycobacterium bovis subsp bovis AF2122/97
gaugugguccaucgcgcugcgg

SEQ ID NO: 1151759 - RNA, 16 nt, Mycobacterium bovis subsp bovis AF2122/97
gauguggucggacagc

SEQ ID NO: 1151760 - RNA, 17 nt, Mycobacterium bovis subsp bovis AF2122/97
gaugugguccaucgcgc

SEQ ID NO: 1151761 - RNA, 21 nt, Mycobacterium bovis subsp bovis AF2122/97
gaugugucggcgagggcgcgc

SEQ ID NO: 1151762 - RNA, 20 nt, Mycobacterium bovis subsp bovis AF2122/97
gauguguccggcaucgguga

SEQ ID NO: 1151763 - RNA, 18 nt, Mycobacterium bovis subsp bovis AF2122/97
gauguggugugccugcgu

SEQ ID NO: 1151764 - RNA, 22 nt, Mycobacterium bovis subsp bovis AF2122/97
gaugucggugaucacggucggc

SEQ ID NO: 1151765 - RNA, 17 nt, Mycobacterium bovis subsp bovis AF2122/97
gauguggcgcuccggcg

SEQ ID NO: 1151766 - RNA, 22 nt, Mycobacterium bovis subsp bovis AF2122/97
gauguggcgcuguuguugucgg

SEQ ID NO: 1151767 - RNA, 14 nt, Mycobacterium bovis subsp bovis AF2122/97
gauguucacgccgc

SEQ ID NO: 1151768 - RNA, 16 nt, Mycobacterium bovis subsp bovis AF2122/97
gauguucacgccgccg

SEQ ID NO: 1151769 - RNA, 20 nt, Mycobacterium bovis subsp bovis AF2122/97
gauguucauccgcaguccgg

SEQ ID NO: 1151770 - RNA, 13 nt, Mycobacterium bovis subsp bovis AF2122/97
gauguugccgccg

SEQ ID NO: 1151771 - RNA, 22 nt, Mycobacterium bovis subsp bovis AF2122/97
gauguuuuccgguccggcgucg

SEQ ID NO: 1151772 - RNA, 22 nt, Mycobacterium bovis subsp bovis AF2122/97
gaucgccgcgaagcgcucggca

SEQ ID NO: 1151773 - RNA, 13 nt, Mycobacterium bovis subsp bovis AF2122/97
gaucgccggccgc

SEQ ID NO: 1151774 - RNA, 14 nt, Mycobacterium bovis subsp bovis AF2122/97
gaucgccggccgcg

SEQ ID NO: 1151775 - RNA, 16 nt, Mycobacterium bovis subsp bovis AF2122/97
gaucgccggccgcgug

SEQ ID NO: 1151776 - RNA, 20 nt, Mycobacterium bovis subsp bovis AF2122/97
gaucgccggccugcucggcg

SEQ ID NO: 1151777 - RNA, 16 nt, Mycobacterium bovis subsp bovis AF2122/97
gaucgccgcgauggcg

SEQ ID NO: 1151778 - RNA, 13 nt, Mycobacterium bovis subsp bovis AF2122/97
gaucgccgcgcug

SEQ ID NO: 1151779 - RNA, 15 nt, Mycobacterium bovis subsp bovis AF2122/97
gaucgccggcuucgc

SEQ ID NO: 1151780 - RNA, 19 nt, Mycobacterium bovis subsp bovis AF2122/97
gaucgccgcuaacgcaccu

SEQ ID NO: 1151781 - RNA, 21 nt, Mycobacterium bovis subsp bovis AF2122/97
gaucgccggccugcucggcga

SEQ ID NO: 1151782 - RNA, 23 nt, Mycobacterium bovis subsp bovis AF2122/97
gaucgccggcuucgcccagagcc

SEQ ID NO: 1151783 - RNA, 11 nt, Mycobacterium bovis subsp bovis AF2122/97
gaucgccgggg

SEQ ID NO: 1151784 - RNA, 23 nt, Mycobacterium bovis subsp bovis AF2122/97
gaucgccggggacgccgcggcgc

SEQ ID NO: 1151785 - RNA, 14 nt, Mycobacterium bovis subsp bovis AF2122/97
gaucgccgccggcg

SEQ ID NO: 1151786 - RNA, 15 nt, Mycobacterium bovis subsp bovis AF2122/97
gaucgccgccggcgc

SEQ ID NO: 1151787 - RNA, 16 nt, Mycobacterium bovis subsp bovis AF2122/97
gaucgccgccggcgcc

SEQ ID NO: 1151788 - RNA, 21 nt, Mycobacterium bovis subsp bovis AF2122/97
gaucgccgagcaggucggcaa

SEQ ID NO: 1151789 - RNA, 22 nt, Mycobacterium bovis subsp bovis AF2122/97
gaucgccgagcgugaaccuggc

SEQ ID NO: 1151790 - RNA, 16 nt, Mycobacterium bovis subsp bovis AF2122/97
gaucgccgaaucggca

SEQ ID NO: 1151791 - RNA, 12 nt, Mycobacterium bovis subsp bovis AF2122/97
gaucgcccggcc

SEQ ID NO: 1151792 - RNA, 20 nt, Mycobacterium bovis subsp bovis AF2122/97
gaucgccgaaucggcaguug

SEQ ID NO: 1151793 - RNA, 19 nt, Mycobacterium bovis subsp bovis AF2122/97
gaucucuaccagccgcccc

SEQ ID NO: 1151794 - RNA, 17 nt, Mycobacterium bovis subsp bovis AF2122/97
gaucucgacggccucgu

SEQ ID NO: 1151795 - RNA, 23 nt, Mycobacterium bovis subsp bovis AF2122/97
gaucucgaccguauugaccagcg

SEQ ID NO: 1151796 - RNA, 22 nt, Mycobacterium bovis subsp bovis AF2122/97
gaucuccucgaguugcgcggca

SEQ ID NO: 1151797 - RNA, 16 nt, Mycobacterium bovis subsp bovis AF2122/97
gaucucgaaggccgcc

SEQ ID NO: 1151798 - RNA, 21 nt, Mycobacterium bovis subsp bovis AF2122/97
gaucucgaccagcgccgauac

SEQ ID NO: 1151799 - RNA, 15 nt, Mycobacterium bovis subsp bovis AF2122/97
gaucuccgugagccg

SEQ ID NO: 1151800 - RNA, 16 nt, Mycobacterium bovis subsp bovis AF2122/97
gaucuccccgaccgcg

SEQ ID NO: 1151801 - RNA, 16 nt, Mycobacterium bovis subsp bovis AF2122/97
gaucuccacggcggug

SEQ ID NO: 1151802 - RNA, 14 nt, Mycobacterium bovis subsp bovis AF2122/97
gaucgccucgacgc

SEQ ID NO: 1151803 - RNA, 14 nt, Mycobacterium bovis subsp bovis AF2122/97
gaucgccguugccg

SEQ ID NO: 1151804 - RNA, 19 nt, Mycobacterium bovis subsp bovis AF2122/97
gaucgccguugccggcgac

SEQ ID NO: 1151805 - RNA, 14 nt, Mycobacterium bovis subsp bovis AF2122/97
gaucgccguccagc

SEQ ID NO: 1151806 - RNA, 14 nt, Mycobacterium bovis subsp bovis AF2122/97
gaucgccucggaca

SEQ ID NO: 1151807 - RNA, 22 nt, Mycobacterium bovis subsp bovis AF2122/97
gaucucacgugcccgcgcggcg

SEQ ID NO: 1151808 - RNA, 13 nt, Mycobacterium bovis subsp bovis AF2122/97
gaucuuggccagc

SEQ ID NO: 1151809 - RNA, 20 nt, Mycobacterium bovis subsp bovis AF2122/97
gaucuuggccagcagcgcgg

SEQ ID NO: 1151810 - RNA, 17 nt, Mycobacterium bovis subsp bovis AF2122/97
gaucuuggcgcccgccg

SEQ ID NO: 1151811 - RNA, 16 nt, Mycobacterium bovis subsp bovis AF2122/97
gaucuugccgcggcgc

SEQ ID NO: 1151812 - RNA, 14 nt, Mycobacterium bovis subsp bovis AF2122/97
gaucuugccgcugg

SEQ ID NO: 1151813 - RNA, 15 nt, Mycobacterium bovis subsp bovis AF2122/97
gaucuugcgacgccc

SEQ ID NO: 1151814 - RNA, 20 nt, Mycobacterium bovis subsp bovis AF2122/97
gaucuugccacuccaggagc

SEQ ID NO: 1151815 - RNA, 12 nt, Mycobacterium bovis subsp bovis AF2122/97
gaucuugccgcc

SEQ ID NO: 1151816 - RNA, 13 nt, Mycobacterium bovis subsp bovis AF2122/97
gaucuugccgccc

SEQ ID NO: 1151817 - RNA, 17 nt, Mycobacterium bovis subsp bovis AF2122/97
gaucugucgcgccggug

SEQ ID NO: 1151818 - RNA, 13 nt, Mycobacterium bovis subsp bovis AF2122/97
gaucuucggccgc

SEQ ID NO: 1151819 - RNA, 23 nt, Mycobacterium bovis subsp bovis AF2122/97
gaucuguggaagcccgucgcggc

SEQ ID NO: 1151820 - RNA, 14 nt, Mycobacterium bovis subsp bovis AF2122/97
gaucugggcgguga

SEQ ID NO: 1151821 - RNA, 17 nt, Mycobacterium bovis subsp bovis AF2122/97
gaucuggggcaccacgc

SEQ ID NO: 1151822 - RNA, 14 nt, Mycobacterium bovis subsp bovis AF2122/97
gaucugcccccgcc

SEQ ID NO: 1151823 - RNA, 16 nt, Mycobacterium bovis subsp bovis AF2122/97
gaucugcccggugauc

SEQ ID NO: 1151824 - RNA, 13 nt, Mycobacterium bovis subsp bovis AF2122/97
gaucugccucucg

SEQ ID NO: 1151825 - RNA, 14 nt, Mycobacterium bovis subsp bovis AF2122/97
gaucuggucggcgg

SEQ ID NO: 1151826 - RNA, 18 nt, Mycobacterium bovis subsp bovis AF2122/97
gaucuccgggucgauguc

SEQ ID NO: 1151827 - RNA, 19 nt, Mycobacterium bovis subsp bovis AF2122/97
gaucugggcugcggccgcg

SEQ ID NO: 1151828 - RNA, 14 nt, Mycobacterium bovis subsp bovis AF2122/97
gaucuggugcgcgg

SEQ ID NO: 1151829 - RNA, 17 nt, Mycobacterium bovis subsp bovis AF2122/97
gaucugucagcgcggcg

SEQ ID NO: 1151830 - RNA, 21 nt, Mycobacterium bovis subsp bovis AF2122/97
gaucugucagcgcggcgcgca

SEQ ID NO: 1151831 - RNA, 21 nt, Mycobacterium bovis subsp bovis AF2122/97
gaucugaaacagucgaccgag

SEQ ID NO: 1151832 - RNA, 23 nt, Mycobacterium bovis subsp bovis AF2122/97
gaucugaaacagucgaccgaggc

SEQ ID NO: 1151833 - RNA, 21 nt, Mycobacterium bovis subsp bovis AF2122/97
gaucugagcgcggguggcagc

SEQ ID NO: 1151834 - RNA, 21 nt, Mycobacterium bovis subsp bovis AF2122/97
gaucugagcuagccguucggc

SEQ ID NO: 1151835 - RNA, 22 nt, Mycobacterium bovis subsp bovis AF2122/97
gaucugagcuagccguucggcu

SEQ ID NO: 1151836 - RNA, 19 nt, Mycobacterium bovis subsp bovis AF2122/97
gaucugagggcucgguggc

SEQ ID NO: 1151837 - RNA, 15 nt, Mycobacterium bovis subsp bovis AF2122/97
gaucugacggcgccg

SEQ ID NO: 1151838 - RNA, 17 nt, Mycobacterium bovis subsp bovis AF2122/97
gaucugacggcgccguc

SEQ ID NO: 1151839 - RNA, 16 nt, Mycobacterium bovis subsp bovis AF2122/97
gaucugaucggcgcgg

SEQ ID NO: 1151840 - RNA, 18 nt, Mycobacterium bovis subsp bovis AF2122/97
gaugacguugcagccggc

SEQ ID NO: 1151841 - RNA, 19 nt, Mycobacterium bovis subsp bovis AF2122/97
gaugacguugcagccggca

SEQ ID NO: 1151842 - RNA, 23 nt, Mycobacterium bovis subsp bovis AF2122/97
gaugacgcccagggcgucggcga

SEQ ID NO: 1151843 - RNA, 15 nt, Mycobacterium bovis subsp bovis AF2122/97
gaugacggcggcccg

SEQ ID NO: 1151844 - RNA, 17 nt, Mycobacterium bovis subsp bovis AF2122/97
gaugacgccgucggcgc

SEQ ID NO: 1151845 - RNA, 22 nt, Mycobacterium bovis subsp bovis AF2122/97
gaugacgcguucaacaccgccg

SEQ ID NO: 1151846 - RNA, 13 nt, Mycobacterium bovis subsp bovis AF2122/97
gaugagcucggcc

SEQ ID NO: 1151847 - RNA, 16 nt, Mycobacterium bovis subsp bovis AF2122/97
gaugagcucggccauc

SEQ ID NO: 1151848 - RNA, 16 nt, Mycobacterium bovis subsp bovis AF2122/97
gaugagcggcgcggca

SEQ ID NO: 1151849 - RNA, 13 nt, Mycobacterium bovis subsp bovis AF2122/97
gaugagcgguacc

SEQ ID NO: 1151850 - RNA, 18 nt, Mycobacterium bovis subsp bovis AF2122/97
gaugagcgguacccccca

SEQ ID NO: 1151851 - RNA, 15 nt, Mycobacterium bovis subsp bovis AF2122/97
gaugaggaucaucga

SEQ ID NO: 1151852 - RNA, 23 nt, Mycobacterium bovis subsp bovis AF2122/97
gaugagccugcaggccgccggcc

SEQ ID NO: 1151853 - RNA, 17 nt, Mycobacterium bovis subsp bovis AF2122/97
gaugagcccagccgcgg

SEQ ID NO: 1151854 - RNA, 23 nt, Mycobacterium bovis subsp bovis AF2122/97
gaugagccgcagaugcaccugcg

SEQ ID NO: 1151855 - RNA, 18 nt, Mycobacterium bovis subsp bovis AF2122/97
gaugagcaacgccacgcc

SEQ ID NO: 1151856 - RNA, 16 nt, Mycobacterium bovis subsp bovis AF2122/97
gaugaccgcucgugca

SEQ ID NO: 1151857 - RNA, 13 nt, Mycobacterium bovis subsp bovis AF2122/97
gaugaccggacgc

SEQ ID NO: 1151858 - RNA, 13 nt, Mycobacterium bovis subsp bovis AF2122/97
gaugaccgccgcc

SEQ ID NO: 1151859 - RNA, 14 nt, Mycobacterium bovis subsp bovis AF2122/97
gaugaccgccgccg

SEQ ID NO: 1151860 - RNA, 15 nt, Mycobacterium bovis subsp bovis AF2122/97
gaugacccggaaucc

SEQ ID NO: 1151861 - RNA, 24 nt, Mycobacterium bovis subsp bovis AF2122/97
gaugacccggaaucccgagucugc

SEQ ID NO: 1151862 - RNA, 19 nt, Mycobacterium bovis subsp bovis AF2122/97
gaugaccgaaccuggucuu

SEQ ID NO: 1151863 - RNA, 14 nt, Mycobacterium bovis subsp bovis AF2122/97
gaugaccgcaaccg

SEQ ID NO: 1151864 - RNA, 13 nt, Mycobacterium bovis subsp bovis AF2122/97
gaugaccgccauc

SEQ ID NO: 1151865 - RNA, 17 nt, Mycobacterium bovis subsp bovis AF2122/97
gaugaccaggucgguca

SEQ ID NO: 1151866 - RNA, 19 nt, Mycobacterium bovis subsp bovis AF2122/97
gaugaccaggucggucagg

SEQ ID NO: 1151867 - RNA, 16 nt, Mycobacterium bovis subsp bovis AF2122/97
gaugaccagugaucag

SEQ ID NO: 1151868 - RNA, 18 nt, Mycobacterium bovis subsp bovis AF2122/97
gaugaccaugaugaccgg

SEQ ID NO: 1151869 - RNA, 20 nt, Mycobacterium bovis subsp bovis AF2122/97
gaugaccaugaugaccggca

SEQ ID NO: 1151870 - RNA, 15 nt, Mycobacterium bovis subsp bovis AF2122/97
gaugaccccgguggu

SEQ ID NO: 1151871 - RNA, 16 nt, Mycobacterium bovis subsp bovis AF2122/97
gaugacgaucugguca

SEQ ID NO: 1151872 - RNA, 18 nt, Mycobacterium bovis subsp bovis AF2122/97
gaugacgaucgcguccgc

SEQ ID NO: 1151873 - RNA, 16 nt, Mycobacterium bovis subsp bovis AF2122/97
gaugacgaccgaucgg

SEQ ID NO: 1151874 - RNA, 17 nt, Mycobacterium bovis subsp bovis AF2122/97
gaugacgacgccgucgg

SEQ ID NO: 1151875 - RNA, 17 nt, Mycobacterium bovis subsp bovis AF2122/97
gaugaccuugcccacca

SEQ ID NO: 1151876 - RNA, 22 nt, Mycobacterium bovis subsp bovis AF2122/97
gaugaccucggcgaugucgcgc

SEQ ID NO: 1151877 - RNA, 18 nt, Mycobacterium bovis subsp bovis AF2122/97
gaugaccuguagaucagc

SEQ ID NO: 1151878 - RNA, 13 nt, Mycobacterium bovis subsp bovis AF2122/97
gaugaccuucccg

SEQ ID NO: 1151879 - RNA, 20 nt, Mycobacterium bovis subsp bovis AF2122/97
gaugaccguauagccgacgc

SEQ ID NO: 1151880 - RNA, 14 nt, Mycobacterium bovis subsp bovis AF2122/97
gaugaccucggcga

SEQ ID NO: 1151881 - RNA, 16 nt, Mycobacterium bovis subsp bovis AF2122/97
gaugaccucggcgacg

SEQ ID NO: 1151882 - RNA, 18 nt, Mycobacterium bovis subsp bovis AF2122/97
aacugcucgauccgcaac

SEQ ID NO: 1151883 - RNA, 23 nt, Mycobacterium bovis subsp bovis AF2122/97
aacugcugaugaaacgccgucgc

SEQ ID NO: 1151884 - RNA, 14 nt, Mycobacterium bovis subsp bovis AF2122/97
aacugcuggccgau

SEQ ID NO: 1151885 - RNA, 18 nt, Mycobacterium bovis subsp bovis AF2122/97
aacugcuugcgcaucgcc

SEQ ID NO: 1151886 - RNA, 22 nt, Mycobacterium bovis subsp bovis AF2122/97
gaugaauuucauaaaccgcaca

SEQ ID NO: 1151887 - RNA, 19 nt, Mycobacterium bovis subsp bovis AF2122/97
gaugaccagggucugcuca

SEQ ID NO: 1151888 - RNA, 20 nt, Mycobacterium bovis subsp bovis AF2122/97
gaugacacgucuaucggcga

SEQ ID NO: 1151889 - RNA, 19 nt, Mycobacterium bovis subsp bovis AF2122/97
gaugacagacaucgcgacg

SEQ ID NO: 1151890 - RNA, 16 nt, Mycobacterium bovis subsp bovis AF2122/97
gaugacaucaccgacc

SEQ ID NO: 1151891 - RNA, 21 nt, Mycobacterium bovis subsp bovis AF2122/97
gaugacauccuugacgcggcc

SEQ ID NO: 1151892 - RNA, 14 nt, Mycobacterium bovis subsp bovis AF2122/97
gaugaagcgcgguu

SEQ ID NO: 1151893 - RNA, 14 nt, Mycobacterium bovis subsp bovis AF2122/97
aacugcgccggugc

SEQ ID NO: 1151894 - RNA, 20 nt, Mycobacterium bovis subsp bovis AF2122/97
aacugcgccggugccggcca

SEQ ID NO: 1151895 - RNA, 19 nt, Mycobacterium bovis subsp bovis AF2122/97
aacugcgaucggccgccga

SEQ ID NO: 1151896 - RNA, 16 nt, Mycobacterium bovis subsp bovis AF2122/97
gaugaacaccggcgcc

SEQ ID NO: 1151897 - RNA, 13 nt, Mycobacterium bovis subsp bovis AF2122/97
gaugaaccaggcg

SEQ ID NO: 1151898 - RNA, 15 nt, Mycobacterium bovis subsp bovis AF2122/97
gaugaacaccggcgc

SEQ ID NO: 1151899 - RNA, 21 nt, Mycobacterium bovis subsp bovis AF2122/97
gaugccgccggugccgccgcc

SEQ ID NO: 1151900 - RNA, 11 nt, Mycobacterium bovis subsp bovis AF2122/97
gaugccgccgg

SEQ ID NO: 1151901 - RNA, 20 nt, Mycobacterium bovis subsp bovis AF2122/97
gaugccggacgccaugcccg

SEQ ID NO: 1151902 - RNA, 12 nt, Mycobacterium bovis subsp bovis AF2122/97
gaugccggacgc

SEQ ID NO: 1151903 - RNA, 15 nt, Mycobacterium bovis subsp bovis AF2122/97
gaugccggacgccau

SEQ ID NO: 1151904 - RNA, 17 nt, Mycobacterium bovis subsp bovis AF2122/97
gaugccggcgagcaggc

SEQ ID NO: 1151905 - RNA, 12 nt, Mycobacterium bovis subsp bovis AF2122/97
gaugccgcggcu

SEQ ID NO: 1151906 - RNA, 15 nt, Mycobacterium bovis subsp bovis AF2122/97
gaugccgcgcagcgc

SEQ ID NO: 1151907 - RNA, 16 nt, Mycobacterium bovis subsp bovis AF2122/97
gaugccgcgcagcgcg

SEQ ID NO: 1151908 - RNA, 19 nt, Mycobacterium bovis subsp bovis AF2122/97
gaugccggacagcucgcgc

SEQ ID NO: 1151909 - RNA, 17 nt, Mycobacterium bovis subsp bovis AF2122/97
gaugcccugccccggac

SEQ ID NO: 1151910 - RNA, 15 nt, Mycobacterium bovis subsp bovis AF2122/97
gaugccgaagccccc

SEQ ID NO: 1151911 - RNA, 17 nt, Mycobacterium bovis subsp bovis AF2122/97
gaugccgaaccgcugcg

SEQ ID NO: 1151912 - RNA, 18 nt, Mycobacterium bovis subsp bovis AF2122/97
gaugccgaaccgcugcgg

SEQ ID NO: 1151913 - RNA, 19 nt, Mycobacterium bovis subsp bovis AF2122/97
gaugccgacggcgggcgau

SEQ ID NO: 1151914 - RNA, 19 nt, Mycobacterium bovis subsp bovis AF2122/97
gaugccgaccuagcucgcg

SEQ ID NO: 1151915 - RNA, 23 nt, Mycobacterium bovis subsp bovis AF2122/97
gaugccgaccuuuugcggcaagc

SEQ ID NO: 1151916 - RNA, 15 nt, Mycobacterium bovis subsp bovis AF2122/97
gaugccgacggcggg

SEQ ID NO: 1151917 - RNA, 17 nt, Mycobacterium bovis subsp bovis AF2122/97
gaugcccguagacgccg

SEQ ID NO: 1151918 - RNA, 17 nt, Mycobacterium bovis subsp bovis AF2122/97
gaugcccucgauggcca

SEQ ID NO: 1151919 - RNA, 13 nt, Mycobacterium bovis subsp bovis AF2122/97
gaugccgggucgc

SEQ ID NO: 1151920 - RNA, 15 nt, Mycobacterium bovis subsp bovis AF2122/97
gaugccgggucgcgg

SEQ ID NO: 1151921 - RNA, 13 nt, Mycobacterium bovis subsp bovis AF2122/97
gaugccggcguug

SEQ ID NO: 1151922 - RNA, 15 nt, Mycobacterium bovis subsp bovis AF2122/97
gaugccggucggcgu

SEQ ID NO: 1151923 - RNA, 17 nt, Mycobacterium bovis subsp bovis AF2122/97
gaugccggucggcgucg

SEQ ID NO: 1151924 - RNA, 22 nt, Mycobacterium bovis subsp bovis AF2122/97
gaugccguaggcggccaguugc

SEQ ID NO: 1151925 - RNA, 20 nt, Mycobacterium bovis subsp bovis AF2122/97
gaugccgugcugggccgacg

SEQ ID NO: 1151926 - RNA, 18 nt, Mycobacterium bovis subsp bovis AF2122/97
gaugccggucggcgucga

SEQ ID NO: 1151927 - RNA, 13 nt, Mycobacterium bovis subsp bovis AF2122/97
gaugccgugcccg

SEQ ID NO: 1151928 - RNA, 17 nt, Mycobacterium bovis subsp bovis AF2122/97
gaugccgugccgggcca

SEQ ID NO: 1151929 - RNA, 18 nt, Mycobacterium bovis subsp bovis AF2122/97
gaugccguguucagcacc

SEQ ID NO: 1151930 - RNA, 22 nt, Mycobacterium bovis subsp bovis AF2122/97
gaugccguguucgauagcggcg

SEQ ID NO: 1151931 - RNA, 22 nt, Mycobacterium bovis subsp bovis AF2122/97
gaugccugcuagcagcagcccg

SEQ ID NO: 1151932 - RNA, 18 nt, Mycobacterium bovis subsp bovis AF2122/97
gaugccuucguagcggcc

SEQ ID NO: 1151933 - RNA, 17 nt, Mycobacterium bovis subsp bovis AF2122/97
gaugcgacgaaccucgg

SEQ ID NO: 1151934 - RNA, 14 nt, Mycobacterium bovis subsp bovis AF2122/97
gaugcgaucgacga

SEQ ID NO: 1151935 - RNA, 13 nt, Mycobacterium bovis subsp bovis AF2122/97
gaugcgaccgccg

SEQ ID NO: 1151936 - RNA, 16 nt, Mycobacterium bovis subsp bovis AF2122/97
gaugcgaucgucacgc

SEQ ID NO: 1151937 - RNA, 13 nt, Mycobacterium bovis subsp bovis AF2122/97
gaugcgacgaacc

SEQ ID NO: 1151938 - RNA, 15 nt, Mycobacterium bovis subsp bovis AF2122/97
gaugccuggucgcgg

SEQ ID NO: 1151939 - RNA, 16 nt, Mycobacterium bovis subsp bovis AF2122/97
gaugcgaaaguggugg

SEQ ID NO: 1151940 - RNA, 14 nt, Mycobacterium bovis subsp bovis AF2122/97
gaugcgcagcccgu

SEQ ID NO: 1151941 - RNA, 20 nt, Mycobacterium bovis subsp bovis AF2122/97
gaugcgcagugcaccgcguc

SEQ ID NO: 1151942 - RNA, 14 nt, Mycobacterium bovis subsp bovis AF2122/97
gaugcgcaccagca

SEQ ID NO: 1151943 - RNA, 16 nt, Mycobacterium bovis subsp bovis AF2122/97
gaugcgcaccagcggc

SEQ ID NO: 1151944 - RNA, 22 nt, Mycobacterium bovis subsp bovis AF2122/97
gaugcgauggccgacgcugcug

SEQ ID NO: 1151945 - RNA, 22 nt, Mycobacterium bovis subsp bovis AF2122/97
gaugcgcaacuucuucagcagc

SEQ ID NO: 1151946 - RNA, 15 nt, Mycobacterium bovis subsp bovis AF2122/97
gaugcgcaacaccuc

SEQ ID NO: 1151947 - RNA, 14 nt, Mycobacterium bovis subsp bovis AF2122/97
gaugaucagcgagg

SEQ ID NO: 1151948 - RNA, 23 nt, Mycobacterium bovis subsp bovis AF2122/97
gaugaucaugaacgcaagcagcg

SEQ ID NO: 1151949 - RNA, 17 nt, Mycobacterium bovis subsp bovis AF2122/97
gaugagguucaucgccg

SEQ ID NO: 1151950 - RNA, 21 nt, Mycobacterium bovis subsp bovis AF2122/97
gaugaguagcagacgcagcca

SEQ ID NO: 1151951 - RNA, 22 nt, Mycobacterium bovis subsp bovis AF2122/97
gaugaguuccuugaugcggccg

SEQ ID NO: 1151952 - RNA, 19 nt, Mycobacterium bovis subsp bovis AF2122/97
gaugauacccaacgacaug

SEQ ID NO: 1151953 - RNA, 17 nt, Mycobacterium bovis subsp bovis AF2122/97
gaugagucaggcgccgc

SEQ ID NO: 1151954 - RNA, 22 nt, Mycobacterium bovis subsp bovis AF2122/97
gaugagugacgguccguucgau

SEQ ID NO: 1151955 - RNA, 21 nt, Mycobacterium bovis subsp bovis AF2122/97
gaugaucugcuugccaccgcc

SEQ ID NO: 1151956 - RNA, 16 nt, Mycobacterium bovis subsp bovis AF2122/97
gaugaugaacagacgc

SEQ ID NO: 1151957 - RNA, 14 nt, Mycobacterium bovis subsp bovis AF2122/97
gaugaugaccgcca

SEQ ID NO: 1151958 - RNA, 17 nt, Mycobacterium bovis subsp bovis AF2122/97
gaugaucccgccaccga

SEQ ID NO: 1151959 - RNA, 23 nt, Mycobacterium bovis subsp bovis AF2122/97
gaugaucccgccaccgaacaguc

SEQ ID NO: 1151960 - RNA, 14 nt, Mycobacterium bovis subsp bovis AF2122/97
aacuggucgacgcc

SEQ ID NO: 1151961 - RNA, 19 nt, Mycobacterium bovis subsp bovis AF2122/97
aacugguuggugacguaga

SEQ ID NO: 1151962 - RNA, 15 nt, Mycobacterium bovis subsp bovis AF2122/97
gaugauuucgccgag

SEQ ID NO: 1151963 - RNA, 20 nt, Mycobacterium bovis subsp bovis AF2122/97
aacugggccgagcgcgccgu

SEQ ID NO: 1151964 - RNA, 21 nt, Mycobacterium bovis subsp bovis AF2122/97
aacugggcaccggcggucugc

SEQ ID NO: 1151965 - RNA, 17 nt, Mycobacterium bovis subsp bovis AF2122/97
gaugcaagcgggcauga

SEQ ID NO: 1151966 - RNA, 16 nt, Mycobacterium bovis subsp bovis AF2122/97
gaugcaauagcugcgc

SEQ ID NO: 1151967 - RNA, 13 nt, Mycobacterium bovis subsp bovis AF2122/97
gaugaugccggcg

SEQ ID NO: 1151968 - RNA, 16 nt, Mycobacterium bovis subsp bovis AF2122/97
gaugaugacggcggcc

SEQ ID NO: 1151969 - RNA, 20 nt, Mycobacterium bovis subsp bovis AF2122/97
gaugccaucggugaugaguc

SEQ ID NO: 1151970 - RNA, 17 nt, Mycobacterium bovis subsp bovis AF2122/97
gaugccauuucgucguc

SEQ ID NO: 1151971 - RNA, 18 nt, Mycobacterium bovis subsp bovis AF2122/97
gaugccacaucccacggu

SEQ ID NO: 1151972 - RNA, 13 nt, Mycobacterium bovis subsp bovis AF2122/97
gaugccacaucgu

SEQ ID NO: 1151973 - RNA, 19 nt, Mycobacterium bovis subsp bovis AF2122/97
gaugccagugcaucgguca

SEQ ID NO: 1151974 - RNA, 21 nt, Mycobacterium bovis subsp bovis AF2122/97
gaugccagugcaucggucagc

SEQ ID NO: 1151975 - RNA, 21 nt, Mycobacterium bovis subsp bovis AF2122/97
gaugcagggcccgcaacaucg

SEQ ID NO: 1151976 - RNA, 22 nt, Mycobacterium bovis subsp bovis AF2122/97
gaugcauggcuugcucugcgca

SEQ ID NO: 1151977 - RNA, 22 nt, Mycobacterium bovis subsp bovis AF2122/97
gaugcaugucuugugguggaaa

SEQ ID NO: 1151978 - RNA, 18 nt, Mycobacterium bovis subsp bovis AF2122/97
gaugcacgucgagcaggc

SEQ ID NO: 1151979 - RNA, 14 nt, Mycobacterium bovis subsp bovis AF2122/97
gaugcagccacaua

SEQ ID NO: 1151980 - RNA, 21 nt, Mycobacterium bovis subsp bovis AF2122/97
gaugcaccucgcccugcagac

SEQ ID NO: 1151981 - RNA, 12 nt, Mycobacterium bovis subsp bovis AF2122/97
gaugcacgucga

SEQ ID NO: 1151982 - RNA, 13 nt, Mycobacterium bovis subsp bovis AF2122/97
gaugcagugcgac

SEQ ID NO: 1151983 - RNA, 17 nt, Mycobacterium bovis subsp bovis AF2122/97
cuggcgccggugccgcc

SEQ ID NO: 1151984 - RNA, 18 nt, Mycobacterium bovis subsp bovis AF2122/97
cuggcgccggugccgccg

SEQ ID NO: 1151985 - RNA, 19 nt, Mycobacterium bovis subsp bovis AF2122/97
cuggcgccggugccgccgg

SEQ ID NO: 1151986 - RNA, 21 nt, Mycobacterium bovis subsp bovis AF2122/97
cuggcgcccuugccggcgaga

SEQ ID NO: 1151987 - RNA, 12 nt, Mycobacterium bovis subsp bovis AF2122/97
cuggcgccgaag

SEQ ID NO: 1151988 - RNA, 23 nt, Mycobacterium bovis subsp bovis AF2122/97
cuggcgccgaaguagccgaccgg

SEQ ID NO: 1151989 - RNA, 14 nt, Mycobacterium bovis subsp bovis AF2122/97
cuggcgccgccggu

SEQ ID NO: 1151990 - RNA, 15 nt, Mycobacterium bovis subsp bovis AF2122/97
cuggcgccggccagc

SEQ ID NO: 1151991 - RNA, 16 nt, Mycobacterium bovis subsp bovis AF2122/97
cuggcgccggccagcc

SEQ ID NO: 1151992 - RNA, 17 nt, Mycobacterium bovis subsp bovis AF2122/97
cuggcgccggccagcca

SEQ ID NO: 1151993 - RNA, 21 nt, Mycobacterium bovis subsp bovis AF2122/97
cuggcgcgccugugccaccgc

SEQ ID NO: 1151994 - RNA, 19 nt, Mycobacterium bovis subsp bovis AF2122/97
cuggcgcagcucaccgacg

SEQ ID NO: 1151995 - RNA, 18 nt, Mycobacterium bovis subsp bovis AF2122/97
cuggcgcagcaacucgac

SEQ ID NO: 1151996 - RNA, 14 nt, Mycobacterium bovis subsp bovis AF2122/97
cuggcgcccccgac

SEQ ID NO: 1151997 - RNA, 17 nt, Mycobacterium bovis subsp bovis AF2122/97
cuggcgcccccgacgac

SEQ ID NO: 1151998 - RNA, 23 nt, Mycobacterium bovis subsp bovis AF2122/97
cuggcgcccccgccauugccgcc

SEQ ID NO: 1151999 - RNA, 12 nt, Mycobacterium bovis subsp bovis AF2122/97
cuggcgcagcgc

SEQ ID NO: 1152000 - RNA, 20 nt, Mycobacterium bovis subsp bovis AF2122/97
cuggcgauaaccgacgauca

SEQ ID NO: 1152001 - RNA, 15 nt, Mycobacterium bovis subsp bovis AF2122/97
cuggcgaucgcgacg

SEQ ID NO: 1152002 - RNA, 19 nt, Mycobacterium bovis subsp bovis AF2122/97
cuggcgaucucuaccagcc

SEQ ID NO: 1152003 - RNA, 20 nt, Mycobacterium bovis subsp bovis AF2122/97
cuggcgauuucgaucacauc

SEQ ID NO: 1152004 - RNA, 18 nt, Mycobacterium bovis subsp bovis AF2122/97
cuggcgauggccguccga

SEQ ID NO: 1152005 - RNA, 13 nt, Mycobacterium bovis subsp bovis AF2122/97
cuggccgcgccgg

SEQ ID NO: 1152006 - RNA, 15 nt, Mycobacterium bovis subsp bovis AF2122/97
cuggccgcgccgggg

SEQ ID NO: 1152007 - RNA, 16 nt, Mycobacterium bovis subsp bovis AF2122/97
cuggccgcgccgggga

SEQ ID NO: 1152008 - RNA, 23 nt, Mycobacterium bovis subsp bovis AF2122/97
cuggccgcuauccaggccgucag

SEQ ID NO: 1152009 - RNA, 14 nt, Mycobacterium bovis subsp bovis AF2122/97
cuggccggcaccgu

SEQ ID NO: 1152010 - RNA, 16 nt, Mycobacterium bovis subsp bovis AF2122/97
cuggccgggaccgccc

SEQ ID NO: 1152011 - RNA, 14 nt, Mycobacterium bovis subsp bovis AF2122/97
cuggccggcggugu

SEQ ID NO: 1152012 - RNA, 18 nt, Mycobacterium bovis subsp bovis AF2122/97
cuggccggcgguguugcc

SEQ ID NO: 1152013 - RNA, 21 nt, Mycobacterium bovis subsp bovis AF2122/97
cuggccugcccagcaccaccg

SEQ ID NO: 1152014 - RNA, 15 nt, Mycobacterium bovis subsp bovis AF2122/97
cuggccugccccaga

SEQ ID NO: 1152015 - RNA, 16 nt, Mycobacterium bovis subsp bovis AF2122/97
cuggccuuggcagucc

SEQ ID NO: 1152016 - RNA, 21 nt, Mycobacterium bovis subsp bovis AF2122/97
cuggcgaacagugacgccacg

SEQ ID NO: 1152017 - RNA, 15 nt, Mycobacterium bovis subsp bovis AF2122/97
cuggcgaaccagagu

SEQ ID NO: 1152018 - RNA, 14 nt, Mycobacterium bovis subsp bovis AF2122/97
cuggcgacgcgaca

SEQ ID NO: 1152019 - RNA, 15 nt, Mycobacterium bovis subsp bovis AF2122/97
cuggcgacgcgacac

SEQ ID NO: 1152020 - RNA, 18 nt, Mycobacterium bovis subsp bovis AF2122/97
cuggcgacgcgacacacg

SEQ ID NO: 1152021 - RNA, 22 nt, Mycobacterium bovis subsp bovis AF2122/97
cuggcgacgcgacacacgccgc

SEQ ID NO: 1152022 - RNA, 13 nt, Mycobacterium bovis subsp bovis AF2122/97
cuggccagcacgc

SEQ ID NO: 1152023 - RNA, 18 nt, Mycobacterium bovis subsp bovis AF2122/97
cuggccagcacgcccgcg

SEQ ID NO: 1152024 - RNA, 21 nt, Mycobacterium bovis subsp bovis AF2122/97
cuggccagcacaccgucgacg

SEQ ID NO: 1152025 - RNA, 14 nt, Mycobacterium bovis subsp bovis AF2122/97
cuggccagcacacc

SEQ ID NO: 1152026 - RNA, 19 nt, Mycobacterium bovis subsp bovis AF2122/97
cuggccacggggcugccgg

SEQ ID NO: 1152027 - RNA, 17 nt, Mycobacterium bovis subsp bovis AF2122/97
cuggccccgccagcggc

SEQ ID NO: 1152028 - RNA, 18 nt, Mycobacterium bovis subsp bovis AF2122/97
cuggccccgccagcggca

SEQ ID NO: 1152029 - RNA, 17 nt, Mycobacterium bovis subsp bovis AF2122/97
cuggccccgguggugcu

SEQ ID NO: 1152030 - RNA, 11 nt, Mycobacterium bovis subsp bovis AF2122/97
cuggcccgcca

SEQ ID NO: 1152031 - RNA, 13 nt, Mycobacterium bovis subsp bovis AF2122/97
cuggcccgccacg

SEQ ID NO: 1152032 - RNA, 23 nt, Mycobacterium bovis subsp bovis AF2122/97
cuggcccgccacgaugucgucga

SEQ ID NO: 1152033 - RNA, 13 nt, Mycobacterium bovis subsp bovis AF2122/97
cuggcccggcgcu

SEQ ID NO: 1152034 - RNA, 19 nt, Mycobacterium bovis subsp bovis AF2122/97
cuggcccggcgcuccaacg

SEQ ID NO: 1152035 - RNA, 23 nt, Mycobacterium bovis subsp bovis AF2122/97
cuggccgaacgacggguccgggc

SEQ ID NO: 1152036 - RNA, 20 nt, Mycobacterium bovis subsp bovis AF2122/97
cuggccgaauaacagcaggc

SEQ ID NO: 1152037 - RNA, 21 nt, Mycobacterium bovis subsp bovis AF2122/97
cuggcccugcuccucgcgggc

SEQ ID NO: 1152038 - RNA, 15 nt, Mycobacterium bovis subsp bovis AF2122/97
cuggccaccgcaucg

SEQ ID NO: 1152039 - RNA, 21 nt, Mycobacterium bovis subsp bovis AF2122/97
cuggccacggcuuugcggcgc

SEQ ID NO: 1152040 - RNA, 15 nt, Mycobacterium bovis subsp bovis AF2122/97
cuggccaacgccggg

SEQ ID NO: 1152041 - RNA, 14 nt, Mycobacterium bovis subsp bovis AF2122/97
cuggcaccucccgg

SEQ ID NO: 1152042 - RNA, 16 nt, Mycobacterium bovis subsp bovis AF2122/97
cugccgaagcggccac

SEQ ID NO: 1152043 - RNA, 20 nt, Mycobacterium bovis subsp bovis AF2122/97
cugccgaaguugaagaagcc

SEQ ID NO: 1152044 - RNA, 19 nt, Mycobacterium bovis subsp bovis AF2122/97
cugccgacgaggggcgcgg

SEQ ID NO: 1152045 - RNA, 14 nt, Mycobacterium bovis subsp bovis AF2122/97
cugccgacgcucca

SEQ ID NO: 1152046 - RNA, 18 nt, Mycobacterium bovis subsp bovis AF2122/97
cugcccgggcugccgccc

SEQ ID NO: 1152047 - RNA, 19 nt, Mycobacterium bovis subsp bovis AF2122/97
cugcccgggcugccgccca

SEQ ID NO: 1152048 - RNA, 16 nt, Mycobacterium bovis subsp bovis AF2122/97
cugcccgucccgcucg

SEQ ID NO: 1152049 - RNA, 12 nt, Mycobacterium bovis subsp bovis AF2122/97
cugcccggcgcc

SEQ ID NO: 1152050 - RNA, 13 nt, Mycobacterium bovis subsp bovis AF2122/97
cuggaggccacca

SEQ ID NO: 1152051 - RNA, 18 nt, Mycobacterium bovis subsp bovis AF2122/97
cuggaguucgucaccguu

SEQ ID NO: 1152052 - RNA, 21 nt, Mycobacterium bovis subsp bovis AF2122/97
cuggaguucgucaccguuggc

SEQ ID NO: 1152053 - RNA, 16 nt, Mycobacterium bovis subsp bovis AF2122/97
cuggaucaacccggcc

SEQ ID NO: 1152054 - RNA, 17 nt, Mycobacterium bovis subsp bovis AF2122/97
cuggaucaacccggccu

SEQ ID NO: 1152055 - RNA, 16 nt, Mycobacterium bovis subsp bovis AF2122/97
cuggcaacgacacgcc

SEQ ID NO: 1152056 - RNA, 16 nt, Mycobacterium bovis subsp bovis AF2122/97
cuggcaacgccgcgcc

SEQ ID NO: 1152057 - RNA, 19 nt, Mycobacterium bovis subsp bovis AF2122/97
cugggacaguucgcgccgu

SEQ ID NO: 1152058 - RNA, 20 nt, Mycobacterium bovis subsp bovis AF2122/97
cugggaccccgcugcgacgu

SEQ ID NO: 1152059 - RNA, 22 nt, Mycobacterium bovis subsp bovis AF2122/97
cugggaccccgcugcgacguua

SEQ ID NO: 1152060 - RNA, 17 nt, Mycobacterium bovis subsp bovis AF2122/97
cuggcuugucauccccg

SEQ ID NO: 1152061 - RNA, 21 nt, Mycobacterium bovis subsp bovis AF2122/97
cuggcuggaccacucgccggc

SEQ ID NO: 1152062 - RNA, 18 nt, Mycobacterium bovis subsp bovis AF2122/97
cuggcugccacgaacgcu

SEQ ID NO: 1152063 - RNA, 14 nt, Mycobacterium bovis subsp bovis AF2122/97
cuggcuggccagcu

SEQ ID NO: 1152064 - RNA, 16 nt, Mycobacterium bovis subsp bovis AF2122/97
cugggcgaucgacacc

SEQ ID NO: 1152065 - RNA, 17 nt, Mycobacterium bovis subsp bovis AF2122/97
cugggcgaucgacaccg

SEQ ID NO: 1152066 - RNA, 19 nt, Mycobacterium bovis subsp bovis AF2122/97
cugggcgaugacgccaucg

SEQ ID NO: 1152067 - RNA, 21 nt, Mycobacterium bovis subsp bovis AF2122/97
cugggcgaugacgccaucgau

SEQ ID NO: 1152068 - RNA, 23 nt, Mycobacterium bovis subsp bovis AF2122/97
cugggcgcccgcgguccggcgaa

SEQ ID NO: 1152069 - RNA, 16 nt, Mycobacterium bovis subsp bovis AF2122/97
cugggcgucgaccacg

SEQ ID NO: 1152070 - RNA, 23 nt, Mycobacterium bovis subsp bovis AF2122/97
cugggcgaaagugauccagucga

SEQ ID NO: 1152071 - RNA, 14 nt, Mycobacterium bovis subsp bovis AF2122/97
cugggccugcggca

SEQ ID NO: 1152072 - RNA, 22 nt, Mycobacterium bovis subsp bovis AF2122/97
cugggccgcuccaccacgaccg

SEQ ID NO: 1152073 - RNA, 23 nt, Mycobacterium bovis subsp bovis AF2122/97
cugggccgcuccaccacgaccgc

SEQ ID NO: 1152074 - RNA, 23 nt, Mycobacterium bovis subsp bovis AF2122/97
cuggguggguuuacgcugccgca

SEQ ID NO: 1152075 - RNA, 14 nt, Mycobacterium bovis subsp bovis AF2122/97
cuggguggcgucgc

SEQ ID NO: 1152076 - RNA, 18 nt, Mycobacterium bovis subsp bovis AF2122/97
cuggguugaccgccaccc

SEQ ID NO: 1152077 - RNA, 23 nt, Mycobacterium bovis subsp bovis AF2122/97
cuggguugaggaucccggccggg

SEQ ID NO: 1152078 - RNA, 17 nt, Mycobacterium bovis subsp bovis AF2122/97
cugguauucaugcccgu

SEQ ID NO: 1152079 - RNA, 21 nt, Mycobacterium bovis subsp bovis AF2122/97
cugguauucaugcccguccug

SEQ ID NO: 1152080 - RNA, 16 nt, Mycobacterium bovis subsp bovis AF2122/97
cuggucagcggcgcga

SEQ ID NO: 1152081 - RNA, 21 nt, Mycobacterium bovis subsp bovis AF2122/97
cugguauagcucacgguggcc

SEQ ID NO: 1152082 - RNA, 18 nt, Mycobacterium bovis subsp bovis AF2122/97
cuggucacccguaucggg

SEQ ID NO: 1152083 - RNA, 21 nt, Mycobacterium bovis subsp bovis AF2122/97
cuggucaacuccacgcggacc

SEQ ID NO: 1152084 - RNA, 16 nt, Mycobacterium bovis subsp bovis AF2122/97
cuggucaacacgacug

SEQ ID NO: 1152085 - RNA, 15 nt, Mycobacterium bovis subsp bovis AF2122/97
cuggucaacagcggc

SEQ ID NO: 1152086 - RNA, 18 nt, Mycobacterium bovis subsp bovis AF2122/97
cugguaucgagcaccccg

SEQ ID NO: 1152087 - RNA, 19 nt, Mycobacterium bovis subsp bovis AF2122/97
cugggugaccucgucgacc

SEQ ID NO: 1152088 - RNA, 14 nt, Mycobacterium bovis subsp bovis AF2122/97
cugggugaccagga

SEQ ID NO: 1152089 - RNA, 18 nt, Mycobacterium bovis subsp bovis AF2122/97
cugggugccggcagcggc

SEQ ID NO: 1152090 - RNA, 18 nt, Mycobacterium bovis subsp bovis AF2122/97
cugggugauggccgcgcc

SEQ ID NO: 1152091 - RNA, 19 nt, Mycobacterium bovis subsp bovis AF2122/97
cugggugauggccgcgccc

SEQ ID NO: 1152092 - RNA, 19 nt, Mycobacterium bovis subsp bovis AF2122/97
cuggggauaaacugccgcg

SEQ ID NO: 1152093 - RNA, 16 nt, Mycobacterium bovis subsp bovis AF2122/97
cugggcuuggcgacga

SEQ ID NO: 1152094 - RNA, 18 nt, Mycobacterium bovis subsp bovis AF2122/97
cugggcuugugggccggu

SEQ ID NO: 1152095 - RNA, 18 nt, Mycobacterium bovis subsp bovis AF2122/97
cugggcuuucugcacccg

SEQ ID NO: 1152096 - RNA, 16 nt, Mycobacterium bovis subsp bovis AF2122/97
cugggcugcggccgcg

SEQ ID NO: 1152097 - RNA, 15 nt, Mycobacterium bovis subsp bovis AF2122/97
cugggcuggccagca

SEQ ID NO: 1152098 - RNA, 15 nt, Mycobacterium bovis subsp bovis AF2122/97
cuggcggccucgccg

SEQ ID NO: 1152099 - RNA, 17 nt, Mycobacterium bovis subsp bovis AF2122/97
cuggcggccucgccggc

SEQ ID NO: 1152100 - RNA, 15 nt, Mycobacterium bovis subsp bovis AF2122/97
cuggcggcgcgacag

SEQ ID NO: 1152101 - RNA, 21 nt, Mycobacterium bovis subsp bovis AF2122/97
cuggcggguaagcgaccgacg

SEQ ID NO: 1152102 - RNA, 14 nt, Mycobacterium bovis subsp bovis AF2122/97
cuggcggugcagug

SEQ ID NO: 1152103 - RNA, 14 nt, Mycobacterium bovis subsp bovis AF2122/97
cuggcggucccgca

SEQ ID NO: 1152104 - RNA, 20 nt, Mycobacterium bovis subsp bovis AF2122/97
cuggcgggcgaucgcggcga

SEQ ID NO: 1152105 - RNA, 13 nt, Mycobacterium bovis subsp bovis AF2122/97
cuggcgggcgccu

SEQ ID NO: 1152106 - RNA, 15 nt, Mycobacterium bovis subsp bovis AF2122/97
cuggcgcugcuggca

SEQ ID NO: 1152107 - RNA, 20 nt, Mycobacterium bovis subsp bovis AF2122/97
cuggcggaccgguaggcacc

SEQ ID NO: 1152108 - RNA, 19 nt, Mycobacterium bovis subsp bovis AF2122/97
cuggcgcucauaggccggc

SEQ ID NO: 1152109 - RNA, 22 nt, Mycobacterium bovis subsp bovis AF2122/97
cuggcgcucauaggccggcggu

SEQ ID NO: 1152110 - RNA, 15 nt, Mycobacterium bovis subsp bovis AF2122/97
cuggcgccguuagcg

SEQ ID NO: 1152111 - RNA, 20 nt, Mycobacterium bovis subsp bovis AF2122/97
cuggcgcgcgggguggcggc

SEQ ID NO: 1152112 - RNA, 20 nt, Mycobacterium bovis subsp bovis AF2122/97
cuggcguagugcucgccggc

SEQ ID NO: 1152113 - RNA, 15 nt, Mycobacterium bovis subsp bovis AF2122/97
cuggcguagaucauc

SEQ ID NO: 1152114 - RNA, 20 nt, Mycobacterium bovis subsp bovis AF2122/97
cuggcggugccggcggcgca

SEQ ID NO: 1152115 - RNA, 15 nt, Mycobacterium bovis subsp bovis AF2122/97
cuggcgguugcccga

SEQ ID NO: 1152116 - RNA, 19 nt, Mycobacterium bovis subsp bovis AF2122/97
cuggcgguguaacccggaa

SEQ ID NO: 1152117 - RNA, 16 nt, Mycobacterium bovis subsp bovis AF2122/97
cuggcugaccgaaugg

SEQ ID NO: 1152118 - RNA, 21 nt, Mycobacterium bovis subsp bovis AF2122/97
cuggcugaccgaauggccgcc

SEQ ID NO: 1152119 - RNA, 22 nt, Mycobacterium bovis subsp bovis AF2122/97
cuggcugaccgaauggccgccg

SEQ ID NO: 1152120 - RNA, 15 nt, Mycobacterium bovis subsp bovis AF2122/97
cuggcguugccaccg

SEQ ID NO: 1152121 - RNA, 15 nt, Mycobacterium bovis subsp bovis AF2122/97
cuggcucaucgaagc

SEQ ID NO: 1152122 - RNA, 22 nt, Mycobacterium bovis subsp bovis AF2122/97
cuggcucaucgaagcuucggcc

SEQ ID NO: 1152123 - RNA, 16 nt, Mycobacterium bovis subsp bovis AF2122/97
cuggcgugucgccgcc

SEQ ID NO: 1152124 - RNA, 22 nt, Mycobacterium bovis subsp bovis AF2122/97
cuggcguuguugacgaucaccc

SEQ ID NO: 1152125 - RNA, 14 nt, Mycobacterium bovis subsp bovis AF2122/97
cuggcuacccaccg

SEQ ID NO: 1152126 - RNA, 16 nt, Mycobacterium bovis subsp bovis AF2122/97
cuggcuacccaccggc

SEQ ID NO: 1152127 - RNA, 19 nt, Mycobacterium bovis subsp bovis AF2122/97
cuggcuacgcgcgcccgau

SEQ ID NO: 1152128 - RNA, 15 nt, Mycobacterium bovis subsp bovis AF2122/97
cuggcuacgggccgc

SEQ ID NO: 1152129 - RNA, 20 nt, Mycobacterium bovis subsp bovis AF2122/97
cuggcuagcgccgaucuucg

SEQ ID NO: 1152130 - RNA, 12 nt, Mycobacterium bovis subsp bovis AF2122/97
cuucggcuggcg

SEQ ID NO: 1152131 - RNA, 17 nt, Mycobacterium bovis subsp bovis AF2122/97
cuucggcuggcgugcug

SEQ ID NO: 1152132 - RNA, 17 nt, Mycobacterium bovis subsp bovis AF2122/97
cuucgggaacgcucguc

SEQ ID NO: 1152133 - RNA, 18 nt, Mycobacterium bovis subsp bovis AF2122/97
cuucggcguccagggcgc

SEQ ID NO: 1152134 - RNA, 17 nt, Mycobacterium bovis subsp bovis AF2122/97
cuucggcggucagcggc

SEQ ID NO: 1152135 - RNA, 15 nt, Mycobacterium bovis subsp bovis AF2122/97
cuucggcggucgccg

SEQ ID NO: 1152136 - RNA, 18 nt, Mycobacterium bovis subsp bovis AF2122/97
cuucgggguaaccggcgg

SEQ ID NO: 1152137 - RNA, 16 nt, Mycobacterium bovis subsp bovis AF2122/97
cuucggggucaccggc

SEQ ID NO: 1152138 - RNA, 17 nt, Mycobacterium bovis subsp bovis AF2122/97
cuucgggcagcgcgugc

SEQ ID NO: 1152139 - RNA, 17 nt, Mycobacterium bovis subsp bovis AF2122/97
cuucgggugcagccaga

SEQ ID NO: 1152140 - RNA, 20 nt, Mycobacterium bovis subsp bovis AF2122/97
cuucggcagaccggcaucga

SEQ ID NO: 1152141 - RNA, 22 nt, Mycobacterium bovis subsp bovis AF2122/97
cuucggcagaccggcaucgauc

SEQ ID NO: 1152142 - RNA, 20 nt, Mycobacterium bovis subsp bovis AF2122/97
cuucggcggccgagcgcacc

SEQ ID NO: 1152143 - RNA, 14 nt, Mycobacterium bovis subsp bovis AF2122/97
cuucggcaccaccg

SEQ ID NO: 1152144 - RNA, 15 nt, Mycobacterium bovis subsp bovis AF2122/97
cuucggcaccaccgc

SEQ ID NO: 1152145 - RNA, 16 nt, Mycobacterium bovis subsp bovis AF2122/97
cuucggacgccagcuc

SEQ ID NO: 1152146 - RNA, 15 nt, Mycobacterium bovis subsp bovis AF2122/97
cuucggacagcagcc

SEQ ID NO: 1152147 - RNA, 19 nt, Mycobacterium bovis subsp bovis AF2122/97
cuucggacagcagccggcg

SEQ ID NO: 1152148 - RNA, 12 nt, Mycobacterium bovis subsp bovis AF2122/97
cuucggaccggc

SEQ ID NO: 1152149 - RNA, 19 nt, Mycobacterium bovis subsp bovis AF2122/97
cuucgcuauggcggcuucg

SEQ ID NO: 1152150 - RNA, 16 nt, Mycobacterium bovis subsp bovis AF2122/97
cuucgaugucgccgcu

SEQ ID NO: 1152151 - RNA, 23 nt, Mycobacterium bovis subsp bovis AF2122/97
cuucgcccagagccgcugcggca

SEQ ID NO: 1152152 - RNA, 13 nt, Mycobacterium bovis subsp bovis AF2122/97
cuucgccagcgcc

SEQ ID NO: 1152153 - RNA, 14 nt, Mycobacterium bovis subsp bovis AF2122/97
cuucgccacaccau

SEQ ID NO: 1152154 - RNA, 19 nt, Mycobacterium bovis subsp bovis AF2122/97
cuucgcguuggcccgccug

SEQ ID NO: 1152155 - RNA, 15 nt, Mycobacterium bovis subsp bovis AF2122/97
cuucgcggugugcgg

SEQ ID NO: 1152156 - RNA, 20 nt, Mycobacterium bovis subsp bovis AF2122/97
cuucgcggugugcggcagcc

SEQ ID NO: 1152157 - RNA, 23 nt, Mycobacterium bovis subsp bovis AF2122/97
cuucgcggugugcggcagcccgc

SEQ ID NO: 1152158 - RNA, 16 nt, Mycobacterium bovis subsp bovis AF2122/97
cuucgcccuugccgca

SEQ ID NO: 1152159 - RNA, 22 nt, Mycobacterium bovis subsp bovis AF2122/97
cuuccgcgcuucacagccacca

SEQ ID NO: 1152160 - RNA, 16 nt, Mycobacterium bovis subsp bovis AF2122/97
cuuccaggagcgccgu

SEQ ID NO: 1152161 - RNA, 15 nt, Mycobacterium bovis subsp bovis AF2122/97
cuuccagcucgucgu

SEQ ID NO: 1152162 - RNA, 17 nt, Mycobacterium bovis subsp bovis AF2122/97
cuuccaggagcgccguc

SEQ ID NO: 1152163 - RNA, 17 nt, Mycobacterium bovis subsp bovis AF2122/97
cuuccgguccagcggcc

SEQ ID NO: 1152164 - RNA, 16 nt, Mycobacterium bovis subsp bovis AF2122/97
cuuccggcguggcccc

SEQ ID NO: 1152165 - RNA, 17 nt, Mycobacterium bovis subsp bovis AF2122/97
cuuccggcguggcccca

SEQ ID NO: 1152166 - RNA, 22 nt, Mycobacterium bovis subsp bovis AF2122/97
cuuccggcguggccccaccgaa

SEQ ID NO: 1152167 - RNA, 21 nt, Mycobacterium bovis subsp bovis AF2122/97
cuucgauggguagcgagucga

SEQ ID NO: 1152168 - RNA, 16 nt, Mycobacterium bovis subsp bovis AF2122/97
cuucgacaggccaccg

SEQ ID NO: 1152169 - RNA, 17 nt, Mycobacterium bovis subsp bovis AF2122/97
cuucgacaggccaccgc

SEQ ID NO: 1152170 - RNA, 22 nt, Mycobacterium bovis subsp bovis AF2122/97
cuucgacaggccaccgcagacg

SEQ ID NO: 1152171 - RNA, 18 nt, Mycobacterium bovis subsp bovis AF2122/97
cuucgacaaguccgcgau

SEQ ID NO: 1152172 - RNA, 17 nt, Mycobacterium bovis subsp bovis AF2122/97
cuucgaaugccgugccg

SEQ ID NO: 1152173 - RNA, 13 nt, Mycobacterium bovis subsp bovis AF2122/97
cuucgacagcggc

SEQ ID NO: 1152174 - RNA, 21 nt, Mycobacterium bovis subsp bovis AF2122/97
cuucgaagcgaucgccggccg

SEQ ID NO: 1152175 - RNA, 19 nt, Mycobacterium bovis subsp bovis AF2122/97
cuucgaauagguguguggc

SEQ ID NO: 1152176 - RNA, 21 nt, Mycobacterium bovis subsp bovis AF2122/97
cuucgaaccguuucgccggcg

SEQ ID NO: 1152177 - RNA, 22 nt, Mycobacterium bovis subsp bovis AF2122/97
cuucagguccaccgcugccggc

SEQ ID NO: 1152178 - RNA, 15 nt, Mycobacterium bovis subsp bovis AF2122/97
cuucaguccggcccc

SEQ ID NO: 1152179 - RNA, 18 nt, Mycobacterium bovis subsp bovis AF2122/97
cuucaguccggcccccga

SEQ ID NO: 1152180 - RNA, 12 nt, Mycobacterium bovis subsp bovis AF2122/97
cuuccagcccgg

SEQ ID NO: 1152181 - RNA, 20 nt, Mycobacterium bovis subsp bovis AF2122/97
cuucaucuggcgccguuagc

SEQ ID NO: 1152182 - RNA, 16 nt, Mycobacterium bovis subsp bovis AF2122/97
cuucaucuugccgcga

SEQ ID NO: 1152183 - RNA, 19 nt, Mycobacterium bovis subsp bovis AF2122/97
cuucaugagccgcugcgcc

SEQ ID NO: 1152184 - RNA, 17 nt, Mycobacterium bovis subsp bovis AF2122/97
cuuccaacucggcggcc

SEQ ID NO: 1152185 - RNA, 18 nt, Mycobacterium bovis subsp bovis AF2122/97
cuucagccaguccagcgc

SEQ ID NO: 1152186 - RNA, 20 nt, Mycobacterium bovis subsp bovis AF2122/97
cuucagccaguccagcgcgc

SEQ ID NO: 1152187 - RNA, 14 nt, Mycobacterium bovis subsp bovis AF2122/97
cuucagcgcggcac

SEQ ID NO: 1152188 - RNA, 14 nt, Mycobacterium bovis subsp bovis AF2122/97
cuucaggccgcgca

SEQ ID NO: 1152189 - RNA, 19 nt, Mycobacterium bovis subsp bovis AF2122/97
cuucaaggaagccgcggcc

SEQ ID NO: 1152190 - RNA, 15 nt, Mycobacterium bovis subsp bovis AF2122/97
aaccggcccgcagca

SEQ ID NO: 1152191 - RNA, 18 nt, Mycobacterium bovis subsp bovis AF2122/97
cuuaugcgucugcucgcc

SEQ ID NO: 1152192 - RNA, 14 nt, Mycobacterium bovis subsp bovis AF2122/97
cuuaugcacgacgg

SEQ ID NO: 1152193 - RNA, 22 nt, Mycobacterium bovis subsp bovis AF2122/97
cuguagaucagcagcggcgacc

SEQ ID NO: 1152194 - RNA, 15 nt, Mycobacterium bovis subsp bovis AF2122/97
cuguagcgucgcacc

SEQ ID NO: 1152195 - RNA, 14 nt, Mycobacterium bovis subsp bovis AF2122/97
cuguagggcuucca

SEQ ID NO: 1152196 - RNA, 12 nt, Mycobacterium bovis subsp bovis AF2122/97
cuguaggcgaua

SEQ ID NO: 1152197 - RNA, 15 nt, Mycobacterium bovis subsp bovis AF2122/97
cugucaacgccgcgg

SEQ ID NO: 1152198 - RNA, 18 nt, Mycobacterium bovis subsp bovis AF2122/97
cugucaagcgggcuggcg

SEQ ID NO: 1152199 - RNA, 13 nt, Mycobacterium bovis subsp bovis AF2122/97
cuguagucgaugu

SEQ ID NO: 1152200 - RNA, 13 nt, Mycobacterium bovis subsp bovis AF2122/97
cuguacggcggcu

SEQ ID NO: 1152201 - RNA, 15 nt, Mycobacterium bovis subsp bovis AF2122/97
cuggucgaccggcgu

SEQ ID NO: 1152202 - RNA, 16 nt, Mycobacterium bovis subsp bovis AF2122/97
cuggucgaccggcguu

SEQ ID NO: 1152203 - RNA, 14 nt, Mycobacterium bovis subsp bovis AF2122/97
cugguccgcacggu

SEQ ID NO: 1152204 - RNA, 23 nt, Mycobacterium bovis subsp bovis AF2122/97
cuggucgaaacgguacgccgccg

SEQ ID NO: 1152205 - RNA, 14 nt, Mycobacterium bovis subsp bovis AF2122/97
cuggucccaccgca

SEQ ID NO: 1152206 - RNA, 22 nt, Mycobacterium bovis subsp bovis AF2122/97
cugguccaggcccuggccagcc

SEQ ID NO: 1152207 - RNA, 16 nt, Mycobacterium bovis subsp bovis AF2122/97
cugguccaacgaucag

SEQ ID NO: 1152208 - RNA, 23 nt, Mycobacterium bovis subsp bovis AF2122/97
cugugauagcgccguacagcggc

SEQ ID NO: 1152209 - RNA, 20 nt, Mycobacterium bovis subsp bovis AF2122/97
cugugccagcagcagcgccg

SEQ ID NO: 1152210 - RNA, 15 nt, Mycobacterium bovis subsp bovis AF2122/97
cugugccgagaugcc

SEQ ID NO: 1152211 - RNA, 18 nt, Mycobacterium bovis subsp bovis AF2122/97
cugugccgagaugccggc

SEQ ID NO: 1152212 - RNA, 12 nt, Mycobacterium bovis subsp bovis AF2122/97
cugugcgccgca

SEQ ID NO: 1152213 - RNA, 15 nt, Mycobacterium bovis subsp bovis AF2122/97
cugugcgcaaggccg

SEQ ID NO: 1152214 - RNA, 18 nt, Mycobacterium bovis subsp bovis AF2122/97
cugugccgugcgaucacc

SEQ ID NO: 1152215 - RNA, 15 nt, Mycobacterium bovis subsp bovis AF2122/97
cugugccgcccccgg

SEQ ID NO: 1152216 - RNA, 17 nt, Mycobacterium bovis subsp bovis AF2122/97
cugugccgcccccggca

SEQ ID NO: 1152217 - RNA, 16 nt, Mycobacterium bovis subsp bovis AF2122/97
cugugccgccggcgcc

SEQ ID NO: 1152218 - RNA, 21 nt, Mycobacterium bovis subsp bovis AF2122/97
cugucgcccucgaucgccacg

SEQ ID NO: 1152219 - RNA, 19 nt, Mycobacterium bovis subsp bovis AF2122/97
cugucggcuuccuccucgg

SEQ ID NO: 1152220 - RNA, 20 nt, Mycobacterium bovis subsp bovis AF2122/97
cugucggauagccucggcgg

SEQ ID NO: 1152221 - RNA, 17 nt, Mycobacterium bovis subsp bovis AF2122/97
cugucggcaugccgguc

SEQ ID NO: 1152222 - RNA, 22 nt, Mycobacterium bovis subsp bovis AF2122/97
cugucgccuuugagggcgacga

SEQ ID NO: 1152223 - RNA, 22 nt, Mycobacterium bovis subsp bovis AF2122/97
cugucagaaggaucagcgcacu

SEQ ID NO: 1152224 - RNA, 17 nt, Mycobacterium bovis subsp bovis AF2122/97
cugucagcgcggcgcgc

SEQ ID NO: 1152225 - RNA, 16 nt, Mycobacterium bovis subsp bovis AF2122/97
cugucacgccugccac

SEQ ID NO: 1152226 - RNA, 20 nt, Mycobacterium bovis subsp bovis AF2122/97
cugucacgccugccaccggc

SEQ ID NO: 1152227 - RNA, 15 nt, Mycobacterium bovis subsp bovis AF2122/97
cugugggggcgcacc

SEQ ID NO: 1152228 - RNA, 16 nt, Mycobacterium bovis subsp bovis AF2122/97
cugugggucgauccgg

SEQ ID NO: 1152229 - RNA, 14 nt, Mycobacterium bovis subsp bovis AF2122/97
cuguggccgcgucg

SEQ ID NO: 1152230 - RNA, 16 nt, Mycobacterium bovis subsp bovis AF2122/97
cuguggcgccgccggc

SEQ ID NO: 1152231 - RNA, 22 nt, Mycobacterium bovis subsp bovis AF2122/97
cuguggccccaagcgugcugcc

SEQ ID NO: 1152232 - RNA, 17 nt, Mycobacterium bovis subsp bovis AF2122/97
cuguggucgcugcugcc

SEQ ID NO: 1152233 - RNA, 19 nt, Mycobacterium bovis subsp bovis AF2122/97
cugugguaggccggugcgu

SEQ ID NO: 1152234 - RNA, 23 nt, Mycobacterium bovis subsp bovis AF2122/97
cugugcguccgcaacagguaggg

SEQ ID NO: 1152235 - RNA, 17 nt, Mycobacterium bovis subsp bovis AF2122/97
cugugcguuccugaucg

SEQ ID NO: 1152236 - RNA, 16 nt, Mycobacterium bovis subsp bovis AF2122/97
cugugcucacggcggc

SEQ ID NO: 1152237 - RNA, 18 nt, Mycobacterium bovis subsp bovis AF2122/97
cugugcucacggcggcga

SEQ ID NO: 1152238 - RNA, 19 nt, Mycobacterium bovis subsp bovis AF2122/97
cuguggaagcccgucgcgg

SEQ ID NO: 1152239 - RNA, 20 nt, Mycobacterium bovis subsp bovis AF2122/97
cuguuguggaacaccgcggc

SEQ ID NO: 1152240 - RNA, 14 nt, Mycobacterium bovis subsp bovis AF2122/97
cuguuguugccccg

SEQ ID NO: 1152241 - RNA, 14 nt, Mycobacterium bovis subsp bovis AF2122/97
cuguuacuccgacg

SEQ ID NO: 1152242 - RNA, 18 nt, Mycobacterium bovis subsp bovis AF2122/97
cugugucguacccggcaa

SEQ ID NO: 1152243 - RNA, 22 nt, Mycobacterium bovis subsp bovis AF2122/97
cuguguuugcggcuucggcaga

SEQ ID NO: 1152244 - RNA, 18 nt, Mycobacterium bovis subsp bovis AF2122/97
cugugucugcucgcgccg

SEQ ID NO: 1152245 - RNA, 19 nt, Mycobacterium bovis subsp bovis AF2122/97
cugugucugcucgcgccgc

SEQ ID NO: 1152246 - RNA, 19 nt, Mycobacterium bovis subsp bovis AF2122/97
cugugucugcucggcgagc

SEQ ID NO: 1152247 - RNA, 21 nt, Mycobacterium bovis subsp bovis AF2122/97
aaccgggccggcuagggcagc

SEQ ID NO: 1152248 - RNA, 19 nt, Mycobacterium bovis subsp bovis AF2122/97
aaccggcucaaggacgcac

SEQ ID NO: 1152249 - RNA, 21 nt, Mycobacterium bovis subsp bovis AF2122/97
aaccggcgggcacaccgcacc

SEQ ID NO: 1152250 - RNA, 13 nt, Mycobacterium bovis subsp bovis AF2122/97
aaccggccgacgc

SEQ ID NO: 1152251 - RNA, 14 nt, Mycobacterium bovis subsp bovis AF2122/97
aaccggccgcgacg

SEQ ID NO: 1152252 - RNA, 18 nt, Mycobacterium bovis subsp bovis AF2122/97
aaccggccgcgacgacac

SEQ ID NO: 1152253 - RNA, 17 nt, Mycobacterium bovis subsp bovis AF2122/97
aaccggccagccgacgc

SEQ ID NO: 1152254 - RNA, 22 nt, Mycobacterium bovis subsp bovis AF2122/97
aaccggccagccgacgcggcgg

SEQ ID NO: 1152255 - RNA, 18 nt, Mycobacterium bovis subsp bovis AF2122/97
cuuaaccgagccgaccgg

SEQ ID NO: 1152256 - RNA, 14 nt, Mycobacterium bovis subsp bovis AF2122/97
cuuggucgccggcg

SEQ ID NO: 1152257 - RNA, 22 nt, Mycobacterium bovis subsp bovis AF2122/97
cuuggucgccggcgucgagccg

SEQ ID NO: 1152258 - RNA, 15 nt, Mycobacterium bovis subsp bovis AF2122/97
cuugucgcggugcgg

SEQ ID NO: 1152259 - RNA, 14 nt, Mycobacterium bovis subsp bovis AF2122/97
cuugucagccgcga

SEQ ID NO: 1152260 - RNA, 19 nt, Mycobacterium bovis subsp bovis AF2122/97
cuugucggggugcacaccg

SEQ ID NO: 1152261 - RNA, 18 nt, Mycobacterium bovis subsp bovis AF2122/97
cuugucggcgugucgcgu

SEQ ID NO: 1152262 - RNA, 17 nt, Mycobacterium bovis subsp bovis AF2122/97
cuugucggccccggccg

SEQ ID NO: 1152263 - RNA, 19 nt, Mycobacterium bovis subsp bovis AF2122/97
cuugugcagaucagcgucc

SEQ ID NO: 1152264 - RNA, 19 nt, Mycobacterium bovis subsp bovis AF2122/97
cuugugccccgagcugccg

SEQ ID NO: 1152265 - RNA, 20 nt, Mycobacterium bovis subsp bovis AF2122/97
cuuuacguacagggugguga

SEQ ID NO: 1152266 - RNA, 18 nt, Mycobacterium bovis subsp bovis AF2122/97
cuuuagugucugcucgcg

SEQ ID NO: 1152267 - RNA, 21 nt, Mycobacterium bovis subsp bovis AF2122/97
aaccgguuggcgauccgcggc

SEQ ID NO: 1152268 - RNA, 23 nt, Mycobacterium bovis subsp bovis AF2122/97
aaccggugcgguuucaccgacga

SEQ ID NO: 1152269 - RNA, 22 nt, Mycobacterium bovis subsp bovis AF2122/97
aaccgguggaugaacaccucau

SEQ ID NO: 1152270 - RNA, 13 nt, Mycobacterium bovis subsp bovis AF2122/97
aaccgguggccgg

SEQ ID NO: 1152271 - RNA, 15 nt, Mycobacterium bovis subsp bovis AF2122/97
aaccguagcgcccac

SEQ ID NO: 1152272 - RNA, 14 nt, Mycobacterium bovis subsp bovis AF2122/97
aaccgucagcgcgc

SEQ ID NO: 1152273 - RNA, 19 nt, Mycobacterium bovis subsp bovis AF2122/97
aaccgucagcgcgccgucg

SEQ ID NO: 1152274 - RNA, 14 nt, Mycobacterium bovis subsp bovis AF2122/97
aaccgucagcggca

SEQ ID NO: 1152275 - RNA, 14 nt, Mycobacterium bovis subsp bovis AF2122/97
aaccguggccgcga

SEQ ID NO: 1152276 - RNA, 13 nt, Mycobacterium bovis subsp bovis AF2122/97
aaccguccgcgga

SEQ ID NO: 1152277 - RNA, 13 nt, Mycobacterium bovis subsp bovis AF2122/97
aaccggucgcagu

SEQ ID NO: 1152278 - RNA, 14 nt, Mycobacterium bovis subsp bovis AF2122/97
cuuggcgcccgccg

SEQ ID NO: 1152279 - RNA, 19 nt, Mycobacterium bovis subsp bovis AF2122/97
cuuggcgcccgccggcaac

SEQ ID NO: 1152280 - RNA, 18 nt, Mycobacterium bovis subsp bovis AF2122/97
cuuggcgccgaugccggc

SEQ ID NO: 1152281 - RNA, 16 nt, Mycobacterium bovis subsp bovis AF2122/97
cuuggcggucugcgcc

SEQ ID NO: 1152282 - RNA, 18 nt, Mycobacterium bovis subsp bovis AF2122/97
cuuggccagcagcagcgc

SEQ ID NO: 1152283 - RNA, 19 nt, Mycobacterium bovis subsp bovis AF2122/97
cuuggccaccaucgccgcc

SEQ ID NO: 1152284 - RNA, 20 nt, Mycobacterium bovis subsp bovis AF2122/97
cuuggccaccaucgccgccg

SEQ ID NO: 1152285 - RNA, 11 nt, Mycobacterium bovis subsp bovis AF2122/97
cuuggccagca

SEQ ID NO: 1152286 - RNA, 22 nt, Mycobacterium bovis subsp bovis AF2122/97
cuuggcagcgguguagccggcg

SEQ ID NO: 1152287 - RNA, 22 nt, Mycobacterium bovis subsp bovis AF2122/97
cuuggcaggugccuucuucgcu

SEQ ID NO: 1152288 - RNA, 20 nt, Mycobacterium bovis subsp bovis AF2122/97
cuuggcaguccagccgggug

SEQ ID NO: 1152289 - RNA, 14 nt, Mycobacterium bovis subsp bovis AF2122/97
cuuggcaucgcgag

SEQ ID NO: 1152290 - RNA, 13 nt, Mycobacterium bovis subsp bovis AF2122/97
cuugggcggcacu

SEQ ID NO: 1152291 - RNA, 18 nt, Mycobacterium bovis subsp bovis AF2122/97
cuugggcgguagccgacg

SEQ ID NO: 1152292 - RNA, 20 nt, Mycobacterium bovis subsp bovis AF2122/97
cuugggcgguagccgacgac

SEQ ID NO: 1152293 - RNA, 20 nt, Mycobacterium bovis subsp bovis AF2122/97
cuugggggucaggcguaucc

SEQ ID NO: 1152294 - RNA, 22 nt, Mycobacterium bovis subsp bovis AF2122/97
cuuggguaggcaauggcgugcg

SEQ ID NO: 1152295 - RNA, 16 nt, Mycobacterium bovis subsp bovis AF2122/97
cuuggucgaccgccga

SEQ ID NO: 1152296 - RNA, 18 nt, Mycobacterium bovis subsp bovis AF2122/97
cuuggucgaccgccgaga

SEQ ID NO: 1152297 - RNA, 13 nt, Mycobacterium bovis subsp bovis AF2122/97
cuugggcagcuug

SEQ ID NO: 1152298 - RNA, 17 nt, Mycobacterium bovis subsp bovis AF2122/97
cuugggccagcgcaucu

SEQ ID NO: 1152299 - RNA, 23 nt, Mycobacterium bovis subsp bovis AF2122/97
cuuggcguugaccagcacgacug

SEQ ID NO: 1152300 - RNA, 19 nt, Mycobacterium bovis subsp bovis AF2122/97
cuuggcguugaugucggcc

SEQ ID NO: 1152301 - RNA, 14 nt, Mycobacterium bovis subsp bovis AF2122/97
cuugggaccgcgcc

SEQ ID NO: 1152302 - RNA, 18 nt, Mycobacterium bovis subsp bovis AF2122/97
cuuggcugcgagagcacc

SEQ ID NO: 1152303 - RNA, 15 nt, Mycobacterium bovis subsp bovis AF2122/97
cuugggaccgcgcca

SEQ ID NO: 1152304 - RNA, 14 nt, Mycobacterium bovis subsp bovis AF2122/97
cuucgucggccggc

SEQ ID NO: 1152305 - RNA, 15 nt, Mycobacterium bovis subsp bovis AF2122/97
cuucgucaaccacca

SEQ ID NO: 1152306 - RNA, 14 nt, Mycobacterium bovis subsp bovis AF2122/97
cuucguccaccgcg

SEQ ID NO: 1152307 - RNA, 21 nt, Mycobacterium bovis subsp bovis AF2122/97
cuucggugccgugaucggcgc

SEQ ID NO: 1152308 - RNA, 14 nt, Mycobacterium bovis subsp bovis AF2122/97
cuucggugucgccg

SEQ ID NO: 1152309 - RNA, 15 nt, Mycobacterium bovis subsp bovis AF2122/97
cuucguugucggcgg

SEQ ID NO: 1152310 - RNA, 21 nt, Mycobacterium bovis subsp bovis AF2122/97
cuucguugucggcggggcgcc

SEQ ID NO: 1152311 - RNA, 15 nt, Mycobacterium bovis subsp bovis AF2122/97
cuucgucgcggccgc

SEQ ID NO: 1152312 - RNA, 15 nt, Mycobacterium bovis subsp bovis AF2122/97
cuucgugcaccacau

SEQ ID NO: 1152313 - RNA, 16 nt, Mycobacterium bovis subsp bovis AF2122/97
cuucgucgguguccuc

SEQ ID NO: 1152314 - RNA, 23 nt, Mycobacterium bovis subsp bovis AF2122/97
cuugcuagcgcuauaggccgcau

SEQ ID NO: 1152315 - RNA, 23 nt, Mycobacterium bovis subsp bovis AF2122/97
cuugcucagccggcccugcggcc

SEQ ID NO: 1152316 - RNA, 19 nt, Mycobacterium bovis subsp bovis AF2122/97
cuuggacgugcgcgccaag

SEQ ID NO: 1152317 - RNA, 18 nt, Mycobacterium bovis subsp bovis AF2122/97
cuuggacucaucggcgug

SEQ ID NO: 1152318 - RNA, 17 nt, Mycobacterium bovis subsp bovis AF2122/97
cuuggacugucccacca

SEQ ID NO: 1152319 - RNA, 15 nt, Mycobacterium bovis subsp bovis AF2122/97
cuuggacccugcgcc

SEQ ID NO: 1152320 - RNA, 17 nt, Mycobacterium bovis subsp bovis AF2122/97
cuuucccggcuggggcc

SEQ ID NO: 1152321 - RNA, 19 nt, Mycobacterium bovis subsp bovis AF2122/97
cuuucgaauccccgcggcg

SEQ ID NO: 1152322 - RNA, 14 nt, Mycobacterium bovis subsp bovis AF2122/97
cuuuccagaguucc

SEQ ID NO: 1152323 - RNA, 20 nt, Mycobacterium bovis subsp bovis AF2122/97
cuuucccgaugacgaagugc

SEQ ID NO: 1152324 - RNA, 18 nt, Mycobacterium bovis subsp bovis AF2122/97
cuuucggaaaaccgcacc

SEQ ID NO: 1152325 - RNA, 19 nt, Mycobacterium bovis subsp bovis AF2122/97
cuuucggaaaaccgcaccg

SEQ ID NO: 1152326 - RNA, 21 nt, Mycobacterium bovis subsp bovis AF2122/97
cuuucgauauagccgccggug

SEQ ID NO: 1152327 - RNA, 19 nt, Mycobacterium bovis subsp bovis AF2122/97
cuuucgcccagucgccgcg

SEQ ID NO: 1152328 - RNA, 18 nt, Mycobacterium bovis subsp bovis AF2122/97
cuuucguauucggccgcg

SEQ ID NO: 1152329 - RNA, 17 nt, Mycobacterium bovis subsp bovis AF2122/97
cuuugacgcccucggcg

SEQ ID NO: 1152330 - RNA, 15 nt, Mycobacterium bovis subsp bovis AF2122/97
cuuugcacagcggca

SEQ ID NO: 1152331 - RNA, 14 nt, Mycobacterium bovis subsp bovis AF2122/97
cuuugcccgccgcg

SEQ ID NO: 1152332 - RNA, 22 nt, Mycobacterium bovis subsp bovis AF2122/97
cuuugagucguuggacggcacc

SEQ ID NO: 1152333 - RNA, 16 nt, Mycobacterium bovis subsp bovis AF2122/97
cuuugacgccgagcac

SEQ ID NO: 1152334 - RNA, 14 nt, Mycobacterium bovis subsp bovis AF2122/97
cuuugcacagcggc

SEQ ID NO: 1152335 - RNA, 14 nt, Mycobacterium bovis subsp bovis AF2122/97
cuuugagcgcggcc

SEQ ID NO: 1152336 - RNA, 17 nt, Mycobacterium bovis subsp bovis AF2122/97
cuuuggccgcgaccggc

SEQ ID NO: 1152337 - RNA, 14 nt, Mycobacterium bovis subsp bovis AF2122/97
cuuuggcggccgca

SEQ ID NO: 1152338 - RNA, 17 nt, Mycobacterium bovis subsp bovis AF2122/97
cuuugucacgcaccgcg

SEQ ID NO: 1152339 - RNA, 19 nt, Mycobacterium bovis subsp bovis AF2122/97
cuuugucacgcaccgcggu

SEQ ID NO: 1152340 - RNA, 14 nt, Mycobacterium bovis subsp bovis AF2122/97
cuuuggcggugaug

SEQ ID NO: 1152341 - RNA, 13 nt, Mycobacterium bovis subsp bovis AF2122/97
cuuugggcggccc

SEQ ID NO: 1152342 - RNA, 22 nt, Mycobacterium bovis subsp bovis AF2122/97
cuuugggcggcccaccggccac

SEQ ID NO: 1152343 - RNA, 23 nt, Mycobacterium bovis subsp bovis AF2122/97
cuuuggucgccggaccagagcca

SEQ ID NO: 1152344 - RNA, 19 nt, Mycobacterium bovis subsp bovis AF2122/97
cuuuugcgucugcucgcca

SEQ ID NO: 1152345 - RNA, 21 nt, Mycobacterium bovis subsp bovis AF2122/97
cuuuugcgucugcucgcgcaa

SEQ ID NO: 1152346 - RNA, 19 nt, Mycobacterium bovis subsp bovis AF2122/97
cuuuugucacaggcgacac

SEQ ID NO: 1152347 - RNA, 20 nt, Mycobacterium bovis subsp bovis AF2122/97
gaaaacccagaucggcgacg

SEQ ID NO: 1152348 - RNA, 14 nt, Mycobacterium bovis subsp bovis AF2122/97
gaaaacauugcggc

SEQ ID NO: 1152349 - RNA, 19 nt, Mycobacterium bovis subsp bovis AF2122/97
gaaaaccucggacugcagc

SEQ ID NO: 1152350 - RNA, 21 nt, Mycobacterium bovis subsp bovis AF2122/97
gaaaaccgucgcagaaaccau

SEQ ID NO: 1152351 - RNA, 17 nt, Mycobacterium bovis subsp bovis AF2122/97
gaaaacccggucggcga

SEQ ID NO: 1152352 - RNA, 16 nt, Mycobacterium bovis subsp bovis AF2122/97
gaaaacggcggcgccg

SEQ ID NO: 1152353 - RNA, 14 nt, Mycobacterium bovis subsp bovis AF2122/97
gaaaaagcccgaca

SEQ ID NO: 1152354 - RNA, 21 nt, Mycobacterium bovis subsp bovis AF2122/97
gaaaaacgcccgcgcugccga

SEQ ID NO: 1152355 - RNA, 20 nt, Mycobacterium bovis subsp bovis AF2122/97
gaacgcugaggaagcggcgg

SEQ ID NO: 1152356 - RNA, 22 nt, Mycobacterium bovis subsp bovis AF2122/97
gaacgcgcgcagccgggcaccg

SEQ ID NO: 1152357 - RNA, 16 nt, Mycobacterium bovis subsp bovis AF2122/97
gaacgcgccggucagc

SEQ ID NO: 1152358 - RNA, 22 nt, Mycobacterium bovis subsp bovis AF2122/97
gaacgcuagcgccaaauccggc

SEQ ID NO: 1152359 - RNA, 19 nt, Mycobacterium bovis subsp bovis AF2122/97
gaacgggcuuccgacauga

SEQ ID NO: 1152360 - RNA, 16 nt, Mycobacterium bovis subsp bovis AF2122/97
gaacggauucccgccc

SEQ ID NO: 1152361 - RNA, 19 nt, Mycobacterium bovis subsp bovis AF2122/97
gaacggcaccgcgcccacc

SEQ ID NO: 1152362 - RNA, 16 nt, Mycobacterium bovis subsp bovis AF2122/97
gaacggaccucggcgg

SEQ ID NO: 1152363 - RNA, 17 nt, Mycobacterium bovis subsp bovis AF2122/97
gaacggaccucggcggu

SEQ ID NO: 1152364 - RNA, 15 nt, Mycobacterium bovis subsp bovis AF2122/97
gaacggauucccgcc

SEQ ID NO: 1152365 - RNA, 19 nt, Mycobacterium bovis subsp bovis AF2122/97
gaacggaauucagcgacgc

SEQ ID NO: 1152366 - RNA, 16 nt, Mycobacterium bovis subsp bovis AF2122/97
gaacgcuuuccggcgg

SEQ ID NO: 1152367 - RNA, 21 nt, Mycobacterium bovis subsp bovis AF2122/97
gaaccgggucacuccggcggc

SEQ ID NO: 1152368 - RNA, 15 nt, Mycobacterium bovis subsp bovis AF2122/97
gaacgaggcgcccag

SEQ ID NO: 1152369 - RNA, 17 nt, Mycobacterium bovis subsp bovis AF2122/97
gaacgaguacgggcagg

SEQ ID NO: 1152370 - RNA, 20 nt, Mycobacterium bovis subsp bovis AF2122/97
gaacgaguccaacucggcca

SEQ ID NO: 1152371 - RNA, 23 nt, Mycobacterium bovis subsp bovis AF2122/97
gaacgaucccgccgaucgaaccg

SEQ ID NO: 1152372 - RNA, 14 nt, Mycobacterium bovis subsp bovis AF2122/97
gaacgaucgaugac

SEQ ID NO: 1152373 - RNA, 16 nt, Mycobacterium bovis subsp bovis AF2122/97
gaacgccucgccggcc

SEQ ID NO: 1152374 - RNA, 18 nt, Mycobacterium bovis subsp bovis AF2122/97
gaacgccucgccggccac

SEQ ID NO: 1152375 - RNA, 19 nt, Mycobacterium bovis subsp bovis AF2122/97
gaacgccucgccggccacc

SEQ ID NO: 1152376 - RNA, 20 nt, Mycobacterium bovis subsp bovis AF2122/97
gaacgccucgccggccacca

SEQ ID NO: 1152377 - RNA, 21 nt, Mycobacterium bovis subsp bovis AF2122/97
gaacgcgaaugucgcgcuguu

SEQ ID NO: 1152378 - RNA, 17 nt, Mycobacterium bovis subsp bovis AF2122/97
gaacgcgagcaacacca

SEQ ID NO: 1152379 - RNA, 18 nt, Mycobacterium bovis subsp bovis AF2122/97
gaacgcgagcaacaccag

SEQ ID NO: 1152380 - RNA, 20 nt, Mycobacterium bovis subsp bovis AF2122/97
gaacgcgaauaccagaccgg

SEQ ID NO: 1152381 - RNA, 22 nt, Mycobacterium bovis subsp bovis AF2122/97
gaacgcgaauaccagaccggcc

SEQ ID NO: 1152382 - RNA, 23 nt, Mycobacterium bovis subsp bovis AF2122/97
gaacgccugcucgucggccaccg

SEQ ID NO: 1152383 - RNA, 19 nt, Mycobacterium bovis subsp bovis AF2122/97
gaacgugaacucacggcgg

SEQ ID NO: 1152384 - RNA, 20 nt, Mycobacterium bovis subsp bovis AF2122/97
gaacgugaacucacggcggu

SEQ ID NO: 1152385 - RNA, 18 nt, Mycobacterium bovis subsp bovis AF2122/97
gaacgucaaacccagcga

SEQ ID NO: 1152386 - RNA, 16 nt, Mycobacterium bovis subsp bovis AF2122/97
gaacguccgcgccgag

SEQ ID NO: 1152387 - RNA, 17 nt, Mycobacterium bovis subsp bovis AF2122/97
gaacguccagccguggc

SEQ ID NO: 1152388 - RNA, 12 nt, Mycobacterium bovis subsp bovis AF2122/97
gaacguccgcgc

SEQ ID NO: 1152389 - RNA, 13 nt, Mycobacterium bovis subsp bovis AF2122/97
gaacguccgcgcc

SEQ ID NO: 1152390 - RNA, 15 nt, Mycobacterium bovis subsp bovis AF2122/97
gaacguccgcgccga

SEQ ID NO: 1152391 - RNA, 20 nt, Mycobacterium bovis subsp bovis AF2122/97
gaacgucauacccagcucgu

SEQ ID NO: 1152392 - RNA, 18 nt, Mycobacterium bovis subsp bovis AF2122/97
gaacgucacguggucggc

SEQ ID NO: 1152393 - RNA, 21 nt, Mycobacterium bovis subsp bovis AF2122/97
gaacgucacguggucggccac

SEQ ID NO: 1152394 - RNA, 22 nt, Mycobacterium bovis subsp bovis AF2122/97
gaacgucacguggucggccacc

SEQ ID NO: 1152395 - RNA, 18 nt, Mycobacterium bovis subsp bovis AF2122/97
gaacgguucggccggggc

SEQ ID NO: 1152396 - RNA, 20 nt, Mycobacterium bovis subsp bovis AF2122/97
gaacgguucggccggggcga

SEQ ID NO: 1152397 - RNA, 13 nt, Mycobacterium bovis subsp bovis AF2122/97
gaacgguugcucg

SEQ ID NO: 1152398 - RNA, 12 nt, Mycobacterium bovis subsp bovis AF2122/97
gaacggugccga

SEQ ID NO: 1152399 - RNA, 23 nt, Mycobacterium bovis subsp bovis AF2122/97
gaacgguggcgcggugccggcgg

SEQ ID NO: 1152400 - RNA, 14 nt, Mycobacterium bovis subsp bovis AF2122/97
gaacggugccgauc

SEQ ID NO: 1152401 - RNA, 15 nt, Mycobacterium bovis subsp bovis AF2122/97
gaacgguagcacggu

SEQ ID NO: 1152402 - RNA, 19 nt, Mycobacterium bovis subsp bovis AF2122/97
gaacgguagcacugucgag

SEQ ID NO: 1152403 - RNA, 20 nt, Mycobacterium bovis subsp bovis AF2122/97
gaacucgaagaccucgucgc

SEQ ID NO: 1152404 - RNA, 21 nt, Mycobacterium bovis subsp bovis AF2122/97
gaacucgaagaccucgucgcg

SEQ ID NO: 1152405 - RNA, 19 nt, Mycobacterium bovis subsp bovis AF2122/97
gaacuccccggucgccgcg

SEQ ID NO: 1152406 - RNA, 23 nt, Mycobacterium bovis subsp bovis AF2122/97
gaacuccuuaucgucgacgccga

SEQ ID NO: 1152407 - RNA, 13 nt, Mycobacterium bovis subsp bovis AF2122/97
gaacuccagcagc

SEQ ID NO: 1152408 - RNA, 14 nt, Mycobacterium bovis subsp bovis AF2122/97
gaacuccagcagcc

SEQ ID NO: 1152409 - RNA, 14 nt, Mycobacterium bovis subsp bovis AF2122/97
gaacgugcgguggc

SEQ ID NO: 1152410 - RNA, 20 nt, Mycobacterium bovis subsp bovis AF2122/97
gaacgugaugcggucgcgga

SEQ ID NO: 1152411 - RNA, 16 nt, Mycobacterium bovis subsp bovis AF2122/97
gaacgugaccgacgcc

SEQ ID NO: 1152412 - RNA, 14 nt, Mycobacterium bovis subsp bovis AF2122/97
gaacgugacggucc

SEQ ID NO: 1152413 - RNA, 12 nt, Mycobacterium bovis subsp bovis AF2122/97
gaacgugaugug

SEQ ID NO: 1152414 - RNA, 17 nt, Mycobacterium bovis subsp bovis AF2122/97
gaacgugcaaccacggc

SEQ ID NO: 1152415 - RNA, 20 nt, Mycobacterium bovis subsp bovis AF2122/97
gaacgugccuuccucgccgg

SEQ ID NO: 1152416 - RNA, 22 nt, Mycobacterium bovis subsp bovis AF2122/97
gaacucaauaguguguuuggug

SEQ ID NO: 1152417 - RNA, 21 nt, Mycobacterium bovis subsp bovis AF2122/97
gaacuacugcgaucgcgagcg

SEQ ID NO: 1152418 - RNA, 16 nt, Mycobacterium bovis subsp bovis AF2122/97
gaacguucacgccagu

SEQ ID NO: 1152419 - RNA, 17 nt, Mycobacterium bovis subsp bovis AF2122/97
gaaccccgaccgcuggu

SEQ ID NO: 1152420 - RNA, 20 nt, Mycobacterium bovis subsp bovis AF2122/97
gaaccagaugggugacccgc

SEQ ID NO: 1152421 - RNA, 19 nt, Mycobacterium bovis subsp bovis AF2122/97
gaacccccccgugcggugu

SEQ ID NO: 1152422 - RNA, 23 nt, Mycobacterium bovis subsp bovis AF2122/97
gaaccccagcuuggcgucgaugc

SEQ ID NO: 1152423 - RNA, 18 nt, Mycobacterium bovis subsp bovis AF2122/97
gaacccccagcugcaggg

SEQ ID NO: 1152424 - RNA, 12 nt, Mycobacterium bovis subsp bovis AF2122/97
gaacccgccacc

SEQ ID NO: 1152425 - RNA, 17 nt, Mycobacterium bovis subsp bovis AF2122/97
gaaccccgcgcggugcc

SEQ ID NO: 1152426 - RNA, 21 nt, Mycobacterium bovis subsp bovis AF2122/97
gaacccgccgaugcugccgcc

SEQ ID NO: 1152427 - RNA, 12 nt, Mycobacterium bovis subsp bovis AF2122/97
gaacccgccggc

SEQ ID NO: 1152428 - RNA, 20 nt, Mycobacterium bovis subsp bovis AF2122/97
gaacccggacaggguggggg

SEQ ID NO: 1152429 - RNA, 15 nt, Mycobacterium bovis subsp bovis AF2122/97
gaacccuccgcagcu

SEQ ID NO: 1152430 - RNA, 17 nt, Mycobacterium bovis subsp bovis AF2122/97
gaaccgaaucggcaccg

SEQ ID NO: 1152431 - RNA, 19 nt, Mycobacterium bovis subsp bovis AF2122/97
gaaccgacgcguccggugc

SEQ ID NO: 1152432 - RNA, 17 nt, Mycobacterium bovis subsp bovis AF2122/97
gaaccgacccggccgcu

SEQ ID NO: 1152433 - RNA, 21 nt, Mycobacterium bovis subsp bovis AF2122/97
gaaccgaucaucauauccgcc

SEQ ID NO: 1152434 - RNA, 19 nt, Mycobacterium bovis subsp bovis AF2122/97
gaaccgauaccucgccauc

SEQ ID NO: 1152435 - RNA, 22 nt, Mycobacterium bovis subsp bovis AF2122/97
gaaccgcacccugacagcgagc

SEQ ID NO: 1152436 - RNA, 23 nt, Mycobacterium bovis subsp bovis AF2122/97
gaaccgcacccugacagcgagcg

SEQ ID NO: 1152437 - RNA, 20 nt, Mycobacterium bovis subsp bovis AF2122/97
gaaccggccaucgaccgucc

SEQ ID NO: 1152438 - RNA, 13 nt, Mycobacterium bovis subsp bovis AF2122/97
gaaccggccgacg

SEQ ID NO: 1152439 - RNA, 14 nt, Mycobacterium bovis subsp bovis AF2122/97
gaaccggccgacga

SEQ ID NO: 1152440 - RNA, 19 nt, Mycobacterium bovis subsp bovis AF2122/97
gaaccggccgacgaacagc

SEQ ID NO: 1152441 - RNA, 14 nt, Mycobacterium bovis subsp bovis AF2122/97
gaaccggcaccagc

SEQ ID NO: 1152442 - RNA, 15 nt, Mycobacterium bovis subsp bovis AF2122/97
gaaccggcaccagcg

SEQ ID NO: 1152443 - RNA, 21 nt, Mycobacterium bovis subsp bovis AF2122/97
gaaccggcaccagcggcaccg

SEQ ID NO: 1152444 - RNA, 16 nt, Mycobacterium bovis subsp bovis AF2122/97
gaaccgcagucaacgc

SEQ ID NO: 1152445 - RNA, 14 nt, Mycobacterium bovis subsp bovis AF2122/97
gaaccggccgucga

SEQ ID NO: 1152446 - RNA, 13 nt, Mycobacterium bovis subsp bovis AF2122/97
gaaccggccgcga

SEQ ID NO: 1152447 - RNA, 16 nt, Mycobacterium bovis subsp bovis AF2122/97
gaaccggccgcgacga

SEQ ID NO: 1152448 - RNA, 22 nt, Mycobacterium bovis subsp bovis AF2122/97
gaaccggcgcauucccuugucg

SEQ ID NO: 1152449 - RNA, 15 nt, Mycobacterium bovis subsp bovis AF2122/97
gaaccgggcaccacu

SEQ ID NO: 1152450 - RNA, 23 nt, Mycobacterium bovis subsp bovis AF2122/97
gaacgacgcuuucccgaugacga

SEQ ID NO: 1152451 - RNA, 14 nt, Mycobacterium bovis subsp bovis AF2122/97
gaacgacgccaccg

SEQ ID NO: 1152452 - RNA, 23 nt, Mycobacterium bovis subsp bovis AF2122/97
gaacgacagcagaaucucggguc

SEQ ID NO: 1152453 - RNA, 14 nt, Mycobacterium bovis subsp bovis AF2122/97
gaacgacauccggc

SEQ ID NO: 1152454 - RNA, 22 nt, Mycobacterium bovis subsp bovis AF2122/97
gaacacguugacucgucgcauc

SEQ ID NO: 1152455 - RNA, 21 nt, Mycobacterium bovis subsp bovis AF2122/97
gaacacguuauucaugcccau

SEQ ID NO: 1152456 - RNA, 16 nt, Mycobacterium bovis subsp bovis AF2122/97
gaacagcgacgccaug

SEQ ID NO: 1152457 - RNA, 20 nt, Mycobacterium bovis subsp bovis AF2122/97
gaacagcgaaccgccggcac

SEQ ID NO: 1152458 - RNA, 13 nt, Mycobacterium bovis subsp bovis AF2122/97
gaacagcgaaccg

SEQ ID NO: 1152459 - RNA, 17 nt, Mycobacterium bovis subsp bovis AF2122/97
gaacagcgaaccgccgg

SEQ ID NO: 1152460 - RNA, 24 nt, Mycobacterium bovis subsp bovis AF2122/97
gaacagcggaucccgccggugugc

SEQ ID NO: 1152461 - RNA, 12 nt, Mycobacterium bovis subsp bovis AF2122/97
gaacccacccau

SEQ ID NO: 1152462 - RNA, 23 nt, Mycobacterium bovis subsp bovis AF2122/97
gaaccaguucgugggucaacguc

SEQ ID NO: 1152463 - RNA, 17 nt, Mycobacterium bovis subsp bovis AF2122/97
gaaccauugcccgacga

SEQ ID NO: 1152464 - RNA, 13 nt, Mycobacterium bovis subsp bovis AF2122/97
gaaccagccgcgg

SEQ ID NO: 1152465 - RNA, 19 nt, Mycobacterium bovis subsp bovis AF2122/97
gaaccagcggucggcgacc

SEQ ID NO: 1152466 - RNA, 21 nt, Mycobacterium bovis subsp bovis AF2122/97
gaaccagcuugcgccgcagcg

SEQ ID NO: 1152467 - RNA, 12 nt, Mycobacterium bovis subsp bovis AF2122/97
gaaccaccagca

SEQ ID NO: 1152468 - RNA, 15 nt, Mycobacterium bovis subsp bovis AF2122/97
gaaccaccagcacgg

SEQ ID NO: 1152469 - RNA, 15 nt, Mycobacterium bovis subsp bovis AF2122/97
gaaccaccaccggca

SEQ ID NO: 1152470 - RNA, 17 nt, Mycobacterium bovis subsp bovis AF2122/97
gaaccaccacuucggcg

SEQ ID NO: 1152471 - RNA, 12 nt, Mycobacterium bovis subsp bovis AF2122/97
gaaccagcccgg

SEQ ID NO: 1152472 - RNA, 16 nt, Mycobacterium bovis subsp bovis AF2122/97
gaaccagaguucggcc

SEQ ID NO: 1152473 - RNA, 18 nt, Mycobacterium bovis subsp bovis AF2122/97
gaaaagcgccucgguggu

SEQ ID NO: 1152474 - RNA, 23 nt, Mycobacterium bovis subsp bovis AF2122/97
gaaaagccgugcaccagcgacca

SEQ ID NO: 1152475 - RNA, 22 nt, Mycobacterium bovis subsp bovis AF2122/97
gaaaagccguucgcgucgccga

SEQ ID NO: 1152476 - RNA, 18 nt, Mycobacterium bovis subsp bovis AF2122/97
gaaaagcccggaaucgcg

SEQ ID NO: 1152477 - RNA, 21 nt, Mycobacterium bovis subsp bovis AF2122/97
gaaaagccacggcugcccaug

SEQ ID NO: 1152478 - RNA, 23 nt, Mycobacterium bovis subsp bovis AF2122/97
aaccguuggagucaggcgggagc

SEQ ID NO: 1152479 - RNA, 17 nt, Mycobacterium bovis subsp bovis AF2122/97
aaccguuucgccggcgc

SEQ ID NO: 1152480 - RNA, 22 nt, Mycobacterium bovis subsp bovis AF2122/97
aaccucgguugguccucggcgg

SEQ ID NO: 1152481 - RNA, 22 nt, Mycobacterium bovis subsp bovis AF2122/97
aaccucaccugacacgcccgcg

SEQ ID NO: 1152482 - RNA, 14 nt, Mycobacterium bovis subsp bovis AF2122/97
aaccucagcgcggu

SEQ ID NO: 1152483 - RNA, 18 nt, Mycobacterium bovis subsp bovis AF2122/97
aaccucugcugagcugcu

SEQ ID NO: 1152484 - RNA, 14 nt, Mycobacterium bovis subsp bovis AF2122/97
aaccucuggcggcg

SEQ ID NO: 1152485 - RNA, 16 nt, Mycobacterium bovis subsp bovis AF2122/97
aaccucgacgcccgcc

SEQ ID NO: 1152486 - RNA, 17 nt, Mycobacterium bovis subsp bovis AF2122/97
aaccugaaccggccgcg

SEQ ID NO: 1152487 - RNA, 15 nt, Mycobacterium bovis subsp bovis AF2122/97
aaccugcucggccgu

SEQ ID NO: 1152488 - RNA, 19 nt, Mycobacterium bovis subsp bovis AF2122/97
aaccugcucggcgcgccgg

SEQ ID NO: 1152489 - RNA, 23 nt, Mycobacterium bovis subsp bovis AF2122/97
aaccugcucggcgcgccggucgc

SEQ ID NO: 1152490 - RNA, 20 nt, Mycobacterium bovis subsp bovis AF2122/97
aaccugccgggccacggcug

SEQ ID NO: 1152491 - RNA, 17 nt, Mycobacterium bovis subsp bovis AF2122/97
gaaaccacugcacccga

SEQ ID NO: 1152492 - RNA, 15 nt, Mycobacterium bovis subsp bovis AF2122/97
gaaaccauucggcga

SEQ ID NO: 1152493 - RNA, 21 nt, Mycobacterium bovis subsp bovis AF2122/97
gaaaccaucgccagccggcga

SEQ ID NO: 1152494 - RNA, 20 nt, Mycobacterium bovis subsp bovis AF2122/97
gaaacagugguuagucggcc

SEQ ID NO: 1152495 - RNA, 15 nt, Mycobacterium bovis subsp bovis AF2122/97
gaaacagccgcagcg

SEQ ID NO: 1152496 - RNA, 15 nt, Mycobacterium bovis subsp bovis AF2122/97
gaaacaccgacgacg

SEQ ID NO: 1152497 - RNA, 22 nt, Mycobacterium bovis subsp bovis AF2122/97
gaaaauucgucgcgucggaccg

SEQ ID NO: 1152498 - RNA, 22 nt, Mycobacterium bovis subsp bovis AF2122/97
aaccugcugcagaaaggccaac

SEQ ID NO: 1152499 - RNA, 12 nt, Mycobacterium bovis subsp bovis AF2122/97
aaccuucgaccu

SEQ ID NO: 1152500 - RNA, 20 nt, Mycobacterium bovis subsp bovis AF2122/97
gaaaaugacccacacaccga

SEQ ID NO: 1152501 - RNA, 18 nt, Mycobacterium bovis subsp bovis AF2122/97
aaccuuguucagcaacaa

SEQ ID NO: 1152502 - RNA, 20 nt, Mycobacterium bovis subsp bovis AF2122/97
aacgaaaauuugacgacggc

SEQ ID NO: 1152503 - RNA, 15 nt, Mycobacterium bovis subsp bovis AF2122/97
gaaaauaggccgggc

SEQ ID NO: 1152504 - RNA, 13 nt, Mycobacterium bovis subsp bovis AF2122/97
gaacacgucggcc

SEQ ID NO: 1152505 - RNA, 17 nt, Mycobacterium bovis subsp bovis AF2122/97
gaacacgaugcgcggug

SEQ ID NO: 1152506 - RNA, 21 nt, Mycobacterium bovis subsp bovis AF2122/97
gaacacgugauagcuugcguc

SEQ ID NO: 1152507 - RNA, 16 nt, Mycobacterium bovis subsp bovis AF2122/97
gaacacgucgacaccg

SEQ ID NO: 1152508 - RNA, 13 nt, Mycobacterium bovis subsp bovis AF2122/97
gaacacggcgucu

SEQ ID NO: 1152509 - RNA, 18 nt, Mycobacterium bovis subsp bovis AF2122/97
gaacacgcacacgaucgc

SEQ ID NO: 1152510 - RNA, 18 nt, Mycobacterium bovis subsp bovis AF2122/97
gaacacgaauccggccac

SEQ ID NO: 1152511 - RNA, 13 nt, Mycobacterium bovis subsp bovis AF2122/97
gaacaccucggca

SEQ ID NO: 1152512 - RNA, 20 nt, Mycobacterium bovis subsp bovis AF2122/97
gaacaccucggcacggaccg

SEQ ID NO: 1152513 - RNA, 15 nt, Mycobacterium bovis subsp bovis AF2122/97
gaacaauucacgcac

SEQ ID NO: 1152514 - RNA, 16 nt, Mycobacterium bovis subsp bovis AF2122/97
gaacaauuucugcagc

SEQ ID NO: 1152515 - RNA, 20 nt, Mycobacterium bovis subsp bovis AF2122/97
gaacaaccacgcacgguggc

SEQ ID NO: 1152516 - RNA, 16 nt, Mycobacterium bovis subsp bovis AF2122/97
gaaauugagccggccc

SEQ ID NO: 1152517 - RNA, 13 nt, Mycobacterium bovis subsp bovis AF2122/97
gaaauugagccgg

SEQ ID NO: 1152518 - RNA, 16 nt, Mycobacterium bovis subsp bovis AF2122/97
gaaaugguucgcacac

SEQ ID NO: 1152519 - RNA, 23 nt, Mycobacterium bovis subsp bovis AF2122/97
gaaauggcgucgccggcaccggc

SEQ ID NO: 1152520 - RNA, 18 nt, Mycobacterium bovis subsp bovis AF2122/97
gaaauggauugcggcacg

SEQ ID NO: 1152521 - RNA, 14 nt, Mycobacterium bovis subsp bovis AF2122/97
gaaauuccggcgcg

SEQ ID NO: 1152522 - RNA, 15 nt, Mycobacterium bovis subsp bovis AF2122/97
gaaacggagccgagc

SEQ ID NO: 1152523 - RNA, 17 nt, Mycobacterium bovis subsp bovis AF2122/97
gaaacggauuggucgac

SEQ ID NO: 1152524 - RNA, 21 nt, Mycobacterium bovis subsp bovis AF2122/97
gaaacguaugacgcccaccga

SEQ ID NO: 1152525 - RNA, 17 nt, Mycobacterium bovis subsp bovis AF2122/97
gaaacccaugaccuuca

SEQ ID NO: 1152526 - RNA, 21 nt, Mycobacterium bovis subsp bovis AF2122/97
gaaaccgcuagucgucggcgc

SEQ ID NO: 1152527 - RNA, 17 nt, Mycobacterium bovis subsp bovis AF2122/97
gaaaccgccgucccggc

SEQ ID NO: 1152528 - RNA, 15 nt, Mycobacterium bovis subsp bovis AF2122/97
gaaacccggcgacca

SEQ ID NO: 1152529 - RNA, 15 nt, Mycobacterium bovis subsp bovis AF2122/97
gaaacccgccgaacg

SEQ ID NO: 1152530 - RNA, 15 nt, Mycobacterium bovis subsp bovis AF2122/97
gaaacccgccgcgau

SEQ ID NO: 1152531 - RNA, 22 nt, Mycobacterium bovis subsp bovis AF2122/97
gaaacgucugccacgucggcga

SEQ ID NO: 1152532 - RNA, 17 nt, Mycobacterium bovis subsp bovis AF2122/97
gaaacuacucccccgcg

SEQ ID NO: 1152533 - RNA, 18 nt, Mycobacterium bovis subsp bovis AF2122/97
gaaacuacucccccgcga

SEQ ID NO: 1152534 - RNA, 19 nt, Mycobacterium bovis subsp bovis AF2122/97
gaaauagauucccggcucg

SEQ ID NO: 1152535 - RNA, 22 nt, Mycobacterium bovis subsp bovis AF2122/97
gaaaucaguucccgaaccccga

SEQ ID NO: 1152536 - RNA, 23 nt, Mycobacterium bovis subsp bovis AF2122/97
gacgccgcuggagaucacgccga

SEQ ID NO: 1152537 - RNA, 18 nt, Mycobacterium bovis subsp bovis AF2122/97
gacgccggccagcggcca

SEQ ID NO: 1152538 - RNA, 20 nt, Mycobacterium bovis subsp bovis AF2122/97
gacgccggccuggccgccag

SEQ ID NO: 1152539 - RNA, 14 nt, Mycobacterium bovis subsp bovis AF2122/97
gacgccggcgccgc

SEQ ID NO: 1152540 - RNA, 16 nt, Mycobacterium bovis subsp bovis AF2122/97
gacgccgcucccgcac

SEQ ID NO: 1152541 - RNA, 15 nt, Mycobacterium bovis subsp bovis AF2122/97
gacgccggcccgacg

SEQ ID NO: 1152542 - RNA, 23 nt, Mycobacterium bovis subsp bovis AF2122/97
gacgccggggaaccuugaccgac

SEQ ID NO: 1152543 - RNA, 15 nt, Mycobacterium bovis subsp bovis AF2122/97
gacgccgucagcggc

SEQ ID NO: 1152544 - RNA, 15 nt, Mycobacterium bovis subsp bovis AF2122/97
gacgccguccucgcu

SEQ ID NO: 1152545 - RNA, 12 nt, Mycobacterium bovis subsp bovis AF2122/97
gacgccgucgac

SEQ ID NO: 1152546 - RNA, 16 nt, Mycobacterium bovis subsp bovis AF2122/97
gacgccgucgacgucg

SEQ ID NO: 1152547 - RNA, 18 nt, Mycobacterium bovis subsp bovis AF2122/97
gacgccguagccggccgg

SEQ ID NO: 1152548 - RNA, 15 nt, Mycobacterium bovis subsp bovis AF2122/97
gacgccguaucggcg

SEQ ID NO: 1152549 - RNA, 16 nt, Mycobacterium bovis subsp bovis AF2122/97
gacgccguaucggcgu

SEQ ID NO: 1152550 - RNA, 14 nt, Mycobacterium bovis subsp bovis AF2122/97
gacgccggugccgg

SEQ ID NO: 1152551 - RNA, 21 nt, Mycobacterium bovis subsp bovis AF2122/97
gacgccgguggcagagccgcc

SEQ ID NO: 1152552 - RNA, 22 nt, Mycobacterium bovis subsp bovis AF2122/97
gacgccggugucggcuggucgc

SEQ ID NO: 1152553 - RNA, 16 nt, Mycobacterium bovis subsp bovis AF2122/97
gacgccuugaucggcg

SEQ ID NO: 1152554 - RNA, 17 nt, Mycobacterium bovis subsp bovis AF2122/97
gacgccuugaucggcga

SEQ ID NO: 1152555 - RNA, 16 nt, Mycobacterium bovis subsp bovis AF2122/97
gacgccuugcacaagc

SEQ ID NO: 1152556 - RNA, 19 nt, Mycobacterium bovis subsp bovis AF2122/97
gacgcgacacacgccgccg

SEQ ID NO: 1152557 - RNA, 20 nt, Mycobacterium bovis subsp bovis AF2122/97
gacgcgacacacgccgccgg

SEQ ID NO: 1152558 - RNA, 22 nt, Mycobacterium bovis subsp bovis AF2122/97
gacgcgacacacgccgccggug

SEQ ID NO: 1152559 - RNA, 17 nt, Mycobacterium bovis subsp bovis AF2122/97
gacgcgacacgccggcg

SEQ ID NO: 1152560 - RNA, 15 nt, Mycobacterium bovis subsp bovis AF2122/97
gacgcgaaauccccc

SEQ ID NO: 1152561 - RNA, 22 nt, Mycobacterium bovis subsp bovis AF2122/97
gacgcgaacccauacgccaagu

SEQ ID NO: 1152562 - RNA, 13 nt, Mycobacterium bovis subsp bovis AF2122/97
gacgccguccucg

SEQ ID NO: 1152563 - RNA, 23 nt, Mycobacterium bovis subsp bovis AF2122/97
gacgccgucgacgucgauggugc

SEQ ID NO: 1152564 - RNA, 13 nt, Mycobacterium bovis subsp bovis AF2122/97
gacgccgucggac

SEQ ID NO: 1152565 - RNA, 20 nt, Mycobacterium bovis subsp bovis AF2122/97
gacgccgucggcgccggcau

SEQ ID NO: 1152566 - RNA, 21 nt, Mycobacterium bovis subsp bovis AF2122/97
gacgccgucggcgccggcauc

SEQ ID NO: 1152567 - RNA, 23 nt, Mycobacterium bovis subsp bovis AF2122/97
gacgccgugcugggugacaccgg

SEQ ID NO: 1152568 - RNA, 15 nt, Mycobacterium bovis subsp bovis AF2122/97
gacgccguugccacc

SEQ ID NO: 1152569 - RNA, 16 nt, Mycobacterium bovis subsp bovis AF2122/97
gacgccguugccaccg

SEQ ID NO: 1152570 - RNA, 15 nt, Mycobacterium bovis subsp bovis AF2122/97
gacgccgugugcauc

SEQ ID NO: 1152571 - RNA, 12 nt, Mycobacterium bovis subsp bovis AF2122/97
gacgccucgaca

SEQ ID NO: 1152572 - RNA, 13 nt, Mycobacterium bovis subsp bovis AF2122/97
gacgccgccaccc

SEQ ID NO: 1152573 - RNA, 15 nt, Mycobacterium bovis subsp bovis AF2122/97
gacgccgccacccgg

SEQ ID NO: 1152574 - RNA, 20 nt, Mycobacterium bovis subsp bovis AF2122/97
gacgccgccacccggcgggc

SEQ ID NO: 1152575 - RNA, 17 nt, Mycobacterium bovis subsp bovis AF2122/97
gacgccgaugugcucgg

SEQ ID NO: 1152576 - RNA, 17 nt, Mycobacterium bovis subsp bovis AF2122/97
gacgccgauccgguggc

SEQ ID NO: 1152577 - RNA, 14 nt, Mycobacterium bovis subsp bovis AF2122/97
gacgccgccagcac

SEQ ID NO: 1152578 - RNA, 20 nt, Mycobacterium bovis subsp bovis AF2122/97
gacgccgccagguccgccgg

SEQ ID NO: 1152579 - RNA, 22 nt, Mycobacterium bovis subsp bovis AF2122/97
gacgccgauacuaaacaggccg

SEQ ID NO: 1152580 - RNA, 14 nt, Mycobacterium bovis subsp bovis AF2122/97
gacgccgcccccgu

SEQ ID NO: 1152581 - RNA, 23 nt, Mycobacterium bovis subsp bovis AF2122/97
gacgccgcgccgcagagcaccgc

SEQ ID NO: 1152582 - RNA, 21 nt, Mycobacterium bovis subsp bovis AF2122/97
gacgccgccgcugccgcccuu

SEQ ID NO: 1152583 - RNA, 11 nt, Mycobacterium bovis subsp bovis AF2122/97
gacgccgccgg

SEQ ID NO: 1152584 - RNA, 12 nt, Mycobacterium bovis subsp bovis AF2122/97
gacgccgccggc

SEQ ID NO: 1152585 - RNA, 13 nt, Mycobacterium bovis subsp bovis AF2122/97
gacgccgccggca

SEQ ID NO: 1152586 - RNA, 16 nt, Mycobacterium bovis subsp bovis AF2122/97
gacgccgccggcaccg

SEQ ID NO: 1152587 - RNA, 14 nt, Mycobacterium bovis subsp bovis AF2122/97
gacgccgccggcgc

SEQ ID NO: 1152588 - RNA, 20 nt, Mycobacterium bovis subsp bovis AF2122/97
gacgccgccggcgccaccgu

SEQ ID NO: 1152589 - RNA, 15 nt, Mycobacterium bovis subsp bovis AF2122/97
gacgccgcucccgca

SEQ ID NO: 1152590 - RNA, 15 nt, Mycobacterium bovis subsp bovis AF2122/97
gacgccgcggcgccg

SEQ ID NO: 1152591 - RNA, 16 nt, Mycobacterium bovis subsp bovis AF2122/97
gacgcccgugcggcuc

SEQ ID NO: 1152592 - RNA, 13 nt, Mycobacterium bovis subsp bovis AF2122/97
gacgcccgccacc

SEQ ID NO: 1152593 - RNA, 14 nt, Mycobacterium bovis subsp bovis AF2122/97
gacgcccgcccgca

SEQ ID NO: 1152594 - RNA, 14 nt, Mycobacterium bovis subsp bovis AF2122/97
gacgccccgaucgg

SEQ ID NO: 1152595 - RNA, 16 nt, Mycobacterium bovis subsp bovis AF2122/97
gacgccaugcccgcac

SEQ ID NO: 1152596 - RNA, 17 nt, Mycobacterium bovis subsp bovis AF2122/97
gacgcccggcgcaccau

SEQ ID NO: 1152597 - RNA, 17 nt, Mycobacterium bovis subsp bovis AF2122/97
gacgcccgcuccgcggc

SEQ ID NO: 1152598 - RNA, 14 nt, Mycobacterium bovis subsp bovis AF2122/97
gacgcccggcaccc

SEQ ID NO: 1152599 - RNA, 17 nt, Mycobacterium bovis subsp bovis AF2122/97
gacgccgacgaugacgc

SEQ ID NO: 1152600 - RNA, 22 nt, Mycobacterium bovis subsp bovis AF2122/97
gacgccgagaccgccgcugccg

SEQ ID NO: 1152601 - RNA, 17 nt, Mycobacterium bovis subsp bovis AF2122/97
gacgccgaacgcgaggu

SEQ ID NO: 1152602 - RNA, 20 nt, Mycobacterium bovis subsp bovis AF2122/97
gacgccgaaaaugccgccca

SEQ ID NO: 1152603 - RNA, 22 nt, Mycobacterium bovis subsp bovis AF2122/97
gacgccgaaaaugccgcccagc

SEQ ID NO: 1152604 - RNA, 23 nt, Mycobacterium bovis subsp bovis AF2122/97
gacgccgaaaaugccgcccagcg

SEQ ID NO: 1152605 - RNA, 18 nt, Mycobacterium bovis subsp bovis AF2122/97
gacgcacugccccgcauc

SEQ ID NO: 1152606 - RNA, 19 nt, Mycobacterium bovis subsp bovis AF2122/97
gacgcacugccccgcaucg

SEQ ID NO: 1152607 - RNA, 16 nt, Mycobacterium bovis subsp bovis AF2122/97
gacgcagaaucgccca

SEQ ID NO: 1152608 - RNA, 17 nt, Mycobacterium bovis subsp bovis AF2122/97
gacgcagaccguccagc

SEQ ID NO: 1152609 - RNA, 20 nt, Mycobacterium bovis subsp bovis AF2122/97
gacgcagccacgucucgcga

SEQ ID NO: 1152610 - RNA, 12 nt, Mycobacterium bovis subsp bovis AF2122/97
gacgcagcccgc

SEQ ID NO: 1152611 - RNA, 23 nt, Mycobacterium bovis subsp bovis AF2122/97
gacgcagagucgcacugcgccgg

SEQ ID NO: 1152612 - RNA, 24 nt, Mycobacterium bovis subsp bovis AF2122/97
gacgcagagucgcacugcgccggc

SEQ ID NO: 1152613 - RNA, 18 nt, Mycobacterium bovis subsp bovis AF2122/97
gacgcagcuugcccgacg

SEQ ID NO: 1152614 - RNA, 20 nt, Mycobacterium bovis subsp bovis AF2122/97
gacgcaggaucacacuggcc

SEQ ID NO: 1152615 - RNA, 19 nt, Mycobacterium bovis subsp bovis AF2122/97
gacgcaggugaacgccggu

SEQ ID NO: 1152616 - RNA, 16 nt, Mycobacterium bovis subsp bovis AF2122/97
gacgcauaaccggcgc

SEQ ID NO: 1152617 - RNA, 20 nt, Mycobacterium bovis subsp bovis AF2122/97
gacgcauaagcccccgcacg

SEQ ID NO: 1152618 - RNA, 19 nt, Mycobacterium bovis subsp bovis AF2122/97
gacgcaugcgugacccgac

SEQ ID NO: 1152619 - RNA, 21 nt, Mycobacterium bovis subsp bovis AF2122/97
gacgcaugucgggccaggcga

SEQ ID NO: 1152620 - RNA, 16 nt, Mycobacterium bovis subsp bovis AF2122/97
gacgccaaugccgcgg

SEQ ID NO: 1152621 - RNA, 16 nt, Mycobacterium bovis subsp bovis AF2122/97
gacgccaaaucggcca

SEQ ID NO: 1152622 - RNA, 19 nt, Mycobacterium bovis subsp bovis AF2122/97
gacgccaacgugacgccgg

SEQ ID NO: 1152623 - RNA, 21 nt, Mycobacterium bovis subsp bovis AF2122/97
gacgccaacgugacgccggcc

SEQ ID NO: 1152624 - RNA, 19 nt, Mycobacterium bovis subsp bovis AF2122/97
gacgcaugggucauggcgc

SEQ ID NO: 1152625 - RNA, 19 nt, Mycobacterium bovis subsp bovis AF2122/97
gacgccagcaaugcccgca

SEQ ID NO: 1152626 - RNA, 14 nt, Mycobacterium bovis subsp bovis AF2122/97
gacgccaugagcgc

SEQ ID NO: 1152627 - RNA, 21 nt, Mycobacterium bovis subsp bovis AF2122/97
gacgccaugcacguugccgaa

SEQ ID NO: 1152628 - RNA, 15 nt, Mycobacterium bovis subsp bovis AF2122/97
gacgccaugcccgca

SEQ ID NO: 1152629 - RNA, 20 nt, Mycobacterium bovis subsp bovis AF2122/97
gacgcccaguugccgguugc

SEQ ID NO: 1152630 - RNA, 13 nt, Mycobacterium bovis subsp bovis AF2122/97
gacgccaccgcca

SEQ ID NO: 1152631 - RNA, 17 nt, Mycobacterium bovis subsp bovis AF2122/97
gacgccaccgccaccac

SEQ ID NO: 1152632 - RNA, 17 nt, Mycobacterium bovis subsp bovis AF2122/97
gacgccacgaccgccga

SEQ ID NO: 1152633 - RNA, 19 nt, Mycobacterium bovis subsp bovis AF2122/97
gacgccagcugcccgacgu

SEQ ID NO: 1152634 - RNA, 20 nt, Mycobacterium bovis subsp bovis AF2122/97
gacgccagcugcccgacguu

SEQ ID NO: 1152635 - RNA, 15 nt, Mycobacterium bovis subsp bovis AF2122/97
gacgauggccgccgc

SEQ ID NO: 1152636 - RNA, 17 nt, Mycobacterium bovis subsp bovis AF2122/97
gacgauggcgucggcca

SEQ ID NO: 1152637 - RNA, 14 nt, Mycobacterium bovis subsp bovis AF2122/97
gacgauggccgccg

SEQ ID NO: 1152638 - RNA, 13 nt, Mycobacterium bovis subsp bovis AF2122/97
gacgauggccagg

SEQ ID NO: 1152639 - RNA, 21 nt, Mycobacterium bovis subsp bovis AF2122/97
gacgaugcgggcgaucucgau

SEQ ID NO: 1152640 - RNA, 21 nt, Mycobacterium bovis subsp bovis AF2122/97
gacgaugcggucgacgggcuc

SEQ ID NO: 1152641 - RNA, 14 nt, Mycobacterium bovis subsp bovis AF2122/97
gacgaugcuggcgg

SEQ ID NO: 1152642 - RNA, 17 nt, Mycobacterium bovis subsp bovis AF2122/97
gacgaugcuggcggccu

SEQ ID NO: 1152643 - RNA, 19 nt, Mycobacterium bovis subsp bovis AF2122/97
gacgaugcuggcggccucg

SEQ ID NO: 1152644 - RNA, 23 nt, Mycobacterium bovis subsp bovis AF2122/97
gacgaugcgcacucccggcucgg

SEQ ID NO: 1152645 - RNA, 18 nt, Mycobacterium bovis subsp bovis AF2122/97
gacgaugccucggcggcc

SEQ ID NO: 1152646 - RNA, 21 nt, Mycobacterium bovis subsp bovis AF2122/97
gacgaugccucggcggccucg

SEQ ID NO: 1152647 - RNA, 16 nt, Mycobacterium bovis subsp bovis AF2122/97
gacgaugccgccgaag

SEQ ID NO: 1152648 - RNA, 17 nt, Mycobacterium bovis subsp bovis AF2122/97
gacgaugccucggcggc

SEQ ID NO: 1152649 - RNA, 20 nt, Mycobacterium bovis subsp bovis AF2122/97
gacgaugcggucaacgcuga

SEQ ID NO: 1152650 - RNA, 13 nt, Mycobacterium bovis subsp bovis AF2122/97
gacgaugccccgg

SEQ ID NO: 1152651 - RNA, 22 nt, Mycobacterium bovis subsp bovis AF2122/97
gacgaugcccuccucgaccgcg

SEQ ID NO: 1152652 - RNA, 22 nt, Mycobacterium bovis subsp bovis AF2122/97
gacgcaccgccaguuccgguga

SEQ ID NO: 1152653 - RNA, 22 nt, Mycobacterium bovis subsp bovis AF2122/97
gacgcaccuauggucaaccgcg

SEQ ID NO: 1152654 - RNA, 23 nt, Mycobacterium bovis subsp bovis AF2122/97
gacgcaccuauggucaaccgcgc

SEQ ID NO: 1152655 - RNA, 13 nt, Mycobacterium bovis subsp bovis AF2122/97
gacgcacggccac

SEQ ID NO: 1152656 - RNA, 17 nt, Mycobacterium bovis subsp bovis AF2122/97
gacgcagaagcccccaa

SEQ ID NO: 1152657 - RNA, 21 nt, Mycobacterium bovis subsp bovis AF2122/97
gacgcagaaucgcacgcgaaa

SEQ ID NO: 1152658 - RNA, 20 nt, Mycobacterium bovis subsp bovis AF2122/97
gacgcaaaagccaccgcacg

SEQ ID NO: 1152659 - RNA, 23 nt, Mycobacterium bovis subsp bovis AF2122/97
gacgcaacaucggaugaccagug

SEQ ID NO: 1152660 - RNA, 15 nt, Mycobacterium bovis subsp bovis AF2122/97
gacgcacagcagcac

SEQ ID NO: 1152661 - RNA, 18 nt, Mycobacterium bovis subsp bovis AF2122/97
gacgcacagcagcaccgc

SEQ ID NO: 1152662 - RNA, 16 nt, Mycobacterium bovis subsp bovis AF2122/97
gacgcacaggcgacgg

SEQ ID NO: 1152663 - RNA, 23 nt, Mycobacterium bovis subsp bovis AF2122/97
gacgaugucggucggaucggcgc

SEQ ID NO: 1152664 - RNA, 17 nt, Mycobacterium bovis subsp bovis AF2122/97
gacgauuccgcccacau

SEQ ID NO: 1152665 - RNA, 14 nt, Mycobacterium bovis subsp bovis AF2122/97
gacgauucggcggc

SEQ ID NO: 1152666 - RNA, 21 nt, Mycobacterium bovis subsp bovis AF2122/97
gacgauucgagcaacugcucg

SEQ ID NO: 1152667 - RNA, 18 nt, Mycobacterium bovis subsp bovis AF2122/97
gacgauucggcggccgug

SEQ ID NO: 1152668 - RNA, 21 nt, Mycobacterium bovis subsp bovis AF2122/97
gacgcaaaauccccucgcaac

SEQ ID NO: 1152669 - RNA, 20 nt, Mycobacterium bovis subsp bovis AF2122/97
gacgcaaaaucgcccgaaaa

SEQ ID NO: 1152670 - RNA, 19 nt, Mycobacterium bovis subsp bovis AF2122/97
aacgguucggccggggcga

SEQ ID NO: 1152671 - RNA, 23 nt, Mycobacterium bovis subsp bovis AF2122/97
gacgaugacagacaucgcgacga

SEQ ID NO: 1152672 - RNA, 14 nt, Mycobacterium bovis subsp bovis AF2122/97
aacgguugcucguc

SEQ ID NO: 1152673 - RNA, 20 nt, Mycobacterium bovis subsp bovis AF2122/97
aacgguuucuuucggcagcg

SEQ ID NO: 1152674 - RNA, 21 nt, Mycobacterium bovis subsp bovis AF2122/97
aacgguuucuuucggcagcga

SEQ ID NO: 1152675 - RNA, 20 nt, Mycobacterium bovis subsp bovis AF2122/97
aacgucacgucgacggcggc

SEQ ID NO: 1152676 - RNA, 16 nt, Mycobacterium bovis subsp bovis AF2122/97
aacguaggguggccgg

SEQ ID NO: 1152677 - RNA, 13 nt, Mycobacterium bovis subsp bovis AF2122/97
aacgucaaccggg

SEQ ID NO: 1152678 - RNA, 16 nt, Mycobacterium bovis subsp bovis AF2122/97
gacgaugaugccgucg

SEQ ID NO: 1152679 - RNA, 21 nt, Mycobacterium bovis subsp bovis AF2122/97
gacgaugaugccgucgucguc

SEQ ID NO: 1152680 - RNA, 17 nt, Mycobacterium bovis subsp bovis AF2122/97
gacgaugacgcgcgaaa

SEQ ID NO: 1152681 - RNA, 12 nt, Mycobacterium bovis subsp bovis AF2122/97
gacgaucgccag

SEQ ID NO: 1152682 - RNA, 16 nt, Mycobacterium bovis subsp bovis AF2122/97
gacgaucucgccgcca

SEQ ID NO: 1152683 - RNA, 19 nt, Mycobacterium bovis subsp bovis AF2122/97
gacgaucucgccggcgaag

SEQ ID NO: 1152684 - RNA, 23 nt, Mycobacterium bovis subsp bovis AF2122/97
gacgaucuccacccgccggccgu

SEQ ID NO: 1152685 - RNA, 22 nt, Mycobacterium bovis subsp bovis AF2122/97
gacgaucgccaggccgagcccg

SEQ ID NO: 1152686 - RNA, 23 nt, Mycobacterium bovis subsp bovis AF2122/97
gacgaucugcagcacucgguguc

SEQ ID NO: 1152687 - RNA, 15 nt, Mycobacterium bovis subsp bovis AF2122/97
gacgaucucggcggc

SEQ ID NO: 1152688 - RNA, 16 nt, Mycobacterium bovis subsp bovis AF2122/97
gacgaucgacgccgcc

SEQ ID NO: 1152689 - RNA, 17 nt, Mycobacterium bovis subsp bovis AF2122/97
gacgauccacggcgaug

SEQ ID NO: 1152690 - RNA, 20 nt, Mycobacterium bovis subsp bovis AF2122/97
gacgaucaggccgucgccgg

SEQ ID NO: 1152691 - RNA, 24 nt, Mycobacterium bovis subsp bovis AF2122/97
gacgaucagcgugaucugcagggc

SEQ ID NO: 1152692 - RNA, 14 nt, Mycobacterium bovis subsp bovis AF2122/97
gacgaucagcacgu

SEQ ID NO: 1152693 - RNA, 15 nt, Mycobacterium bovis subsp bovis AF2122/97
gacgaggucagcggu

SEQ ID NO: 1152694 - RNA, 21 nt, Mycobacterium bovis subsp bovis AF2122/97
gacgauaucgggagcggcugc

SEQ ID NO: 1152695 - RNA, 16 nt, Mycobacterium bovis subsp bovis AF2122/97
gacgagccgagccucg

SEQ ID NO: 1152696 - RNA, 23 nt, Mycobacterium bovis subsp bovis AF2122/97
gacgagcagcuagcccggcagca

SEQ ID NO: 1152697 - RNA, 12 nt, Mycobacterium bovis subsp bovis AF2122/97
gacgagccacgg

SEQ ID NO: 1152698 - RNA, 20 nt, Mycobacterium bovis subsp bovis AF2122/97
gacgagccacggcuucgccg

SEQ ID NO: 1152699 - RNA, 17 nt, Mycobacterium bovis subsp bovis AF2122/97
gacgagcccaccgucgc

SEQ ID NO: 1152700 - RNA, 16 nt, Mycobacterium bovis subsp bovis AF2122/97
gacgagcacgccgacc

SEQ ID NO: 1152701 - RNA, 19 nt, Mycobacterium bovis subsp bovis AF2122/97
gacgagaucugcgaugggg

SEQ ID NO: 1152702 - RNA, 14 nt, Mycobacterium bovis subsp bovis AF2122/97
gacgagcaccgcgc

SEQ ID NO: 1152703 - RNA, 14 nt, Mycobacterium bovis subsp bovis AF2122/97
gacgagcacgccga

SEQ ID NO: 1152704 - RNA, 17 nt, Mycobacterium bovis subsp bovis AF2122/97
gacgagccgagccucgc

SEQ ID NO: 1152705 - RNA, 21 nt, Mycobacterium bovis subsp bovis AF2122/97
gacgagccgcggucggcgugc

SEQ ID NO: 1152706 - RNA, 22 nt, Mycobacterium bovis subsp bovis AF2122/97
gacgagccgcggucggcgugca

SEQ ID NO: 1152707 - RNA, 19 nt, Mycobacterium bovis subsp bovis AF2122/97
gacgagcgucagauccggc

SEQ ID NO: 1152708 - RNA, 20 nt, Mycobacterium bovis subsp bovis AF2122/97
gacgagcgucagauccggcc

SEQ ID NO: 1152709 - RNA, 13 nt, Mycobacterium bovis subsp bovis AF2122/97
gacgaggccacgg

SEQ ID NO: 1152710 - RNA, 15 nt, Mycobacterium bovis subsp bovis AF2122/97
gacgagggcgggacc

SEQ ID NO: 1152711 - RNA, 13 nt, Mycobacterium bovis subsp bovis AF2122/97
gacgaggcgagcg

SEQ ID NO: 1152712 - RNA, 18 nt, Mycobacterium bovis subsp bovis AF2122/97
gacgaggcgagcggccag

SEQ ID NO: 1152713 - RNA, 20 nt, Mycobacterium bovis subsp bovis AF2122/97
gacgagucgccgcgggcagc

SEQ ID NO: 1152714 - RNA, 16 nt, Mycobacterium bovis subsp bovis AF2122/97
gacgagguugccgcac

SEQ ID NO: 1152715 - RNA, 13 nt, Mycobacterium bovis subsp bovis AF2122/97
gacgagucggcgg

SEQ ID NO: 1152716 - RNA, 18 nt, Mycobacterium bovis subsp bovis AF2122/97
gacgagugguccggcggc

SEQ ID NO: 1152717 - RNA, 19 nt, Mycobacterium bovis subsp bovis AF2122/97
gacgacguccucgacgauc

SEQ ID NO: 1152718 - RNA, 13 nt, Mycobacterium bovis subsp bovis AF2122/97
gacgagaucagcc

SEQ ID NO: 1152719 - RNA, 20 nt, Mycobacterium bovis subsp bovis AF2122/97
gacgagauacggccaccagg

SEQ ID NO: 1152720 - RNA, 20 nt, Mycobacterium bovis subsp bovis AF2122/97
gacgagauagcauccgcccg

SEQ ID NO: 1152721 - RNA, 22 nt, Mycobacterium bovis subsp bovis AF2122/97
gacgagauagcauccgcccgag

SEQ ID NO: 1152722 - RNA, 22 nt, Mycobacterium bovis subsp bovis AF2122/97
gacgagauugccgggccgccga

SEQ ID NO: 1152723 - RNA, 20 nt, Mycobacterium bovis subsp bovis AF2122/97
gacgagcacaugcucgacgc

SEQ ID NO: 1152724 - RNA, 20 nt, Mycobacterium bovis subsp bovis AF2122/97
gacgacuggaaggcgggcag

SEQ ID NO: 1152725 - RNA, 15 nt, Mycobacterium bovis subsp bovis AF2122/97
gacgagacggcagga

SEQ ID NO: 1152726 - RNA, 16 nt, Mycobacterium bovis subsp bovis AF2122/97
gacgacgucgccgccg

SEQ ID NO: 1152727 - RNA, 19 nt, Mycobacterium bovis subsp bovis AF2122/97
gacgacgucgccgccgcgg

SEQ ID NO: 1152728 - RNA, 18 nt, Mycobacterium bovis subsp bovis AF2122/97
gacgacgucggccgcauc

SEQ ID NO: 1152729 - RNA, 14 nt, Mycobacterium bovis subsp bovis AF2122/97
gacgacgggcgcca

SEQ ID NO: 1152730 - RNA, 16 nt, Mycobacterium bovis subsp bovis AF2122/97
gacgacgagggccagc

SEQ ID NO: 1152731 - RNA, 12 nt, Mycobacterium bovis subsp bovis AF2122/97
gacgacgaucgc

SEQ ID NO: 1152732 - RNA, 22 nt, Mycobacterium bovis subsp bovis AF2122/97
gacgacgcgcgcgauggacaac

SEQ ID NO: 1152733 - RNA, 15 nt, Mycobacterium bovis subsp bovis AF2122/97
gacgacggcaccgau

SEQ ID NO: 1152734 - RNA, 13 nt, Mycobacterium bovis subsp bovis AF2122/97
gacgaaugcagca

SEQ ID NO: 1152735 - RNA, 16 nt, Mycobacterium bovis subsp bovis AF2122/97
gaccugcgcgagguug

SEQ ID NO: 1152736 - RNA, 13 nt, Mycobacterium bovis subsp bovis AF2122/97
gaccugcgggauc

SEQ ID NO: 1152737 - RNA, 16 nt, Mycobacterium bovis subsp bovis AF2122/97
gaccugcucgcuggug
